United States Patent 7,745,391 (HUMAN THROMBOSPONDIN POLYPEPTIDE) - sequence listing, part 57

SEQ ID NO: 180436 - DNA, 311 bp, Homo sapiens
gctccagcctgggcgacaagagtgaaactccatctcaaaaaacaacaaaaaaaatctaatttgggtttttgactcaaagtagaaaattgtaatagaagtttcaaagagacttgaatcagggtcttcatgctcacgtttaagagagggcacttggcacccgggtcctaagtggttcagactactttcatagctgaaggtgggcatccttgtcacaggaggggacagaatctataagcggtagctgataggtatataacttggtgccaattaattggataatgaggtcaacctaaattctagcttgtgtttac

SEQ ID NO: 180437 - DNA, 320 bp, Homo sapiens
gagagacctgtctctgaaggaggtaggtgcaaatatggagtaggacagtggttccttcaaaggagaagatcctgtatcatatcctgtatttccatcagatatttcattttcctgacttgggcaatgtgtaaagatatgacaacaagattgacaatttgggaaaacgtttaggaaagaataacagggacaggatgtgacttggaaagttcgttgcttagagtagcaaggtttgattctttttgatcaacaatatagacttttccatcctcttactgtgagaatttctactccatgctttgttacatgagaattctgagatt

SEQ ID NO: 180438 - DNA, 658 bp, Homo sapiens
tcagttttttatagtatttgaagctatattaaacaatttatatttatcatgtcttcctgatatattgactcatacatacatttttctctgtctctaatagtatttcttgaaacctattttatctgacattatagtgtcattcttttgagtaacatttaaatggtagatctttttctatcttacttgcaacccctatatttaaagtgtctttcatttatggttattagttgggttctgcctctttatacagtgattggagtgtcattagaccctttaaatttaatatatttttgacatggtatgccatgtcataccagattcaggtatgccacattgctatttttttatttgccctatctgtattttattctactttcctgcattttatattatttgaactttttttttttataatattgaatgctttacgaatttccgtgtcatccttgtgcaggggccatgctaatcttctctgtattgttccaattttgtctttttaggtacatccccttgaattttctgaatatgtgtgtttttctagggaatgtgttacgtacctttaccttatcaaaatctacttcaagttaatattgaaatttcaagtaaaatgtagcagccttataacagtataattccatttacattctctccgtccttt

SEQ ID NO: 180439 - DNA, 437 bp, Homo sapiens
aagagttgagtgaagctatgaaataaatgtggaagctacataggtgatttgcatggtagcattgtcttattctatgatgggacaacatgatggaaccaggtcttcataacacagttattaaaaatacatattttaccacatcttaggcttacagaattcaaattcacaacaaataacagaaatgttaagttgattttaattagttcttatcctttaaaaagaaaggatattgtctttttctaatgtagcttaacaatttttgttgcaggctttggtttggagatatttgatgcatacataatacatgaaaggtagtgttaaaagattgtatttcagaagtttgtgataaaattggttgttcagatttgcacattgtcccgtagaagtcattttaagtaaatccatgccagaacttctgaacaagtctgaggcaagtt

SEQ ID NO: 180440 - DNA, 212 bp, Homo sapiens
ctgttgagctgggatttagggccagagtttcctcattcctggtctaccgttagcttccctgcacctgacggttgtcctcttaagtacttctcccccattttcttaccggattccctctctccagtggtgtgttctccttctacagagggtatttcagatatttattcaatagttcagccattttacaaagttgaggagggagaatcgggtgg

SEQ ID NO: 180441 - DNA, 128 bp, Homo sapiens
gtggacttcctcccagggcaccagggagccactgcagagttgtgagcaagggacagacagaggtaggcttgtacttccaagagactcccccagctgccacatgcagggtgaatggaatgatgcacaga

SEQ ID NO: 180442 - DNA, 632 bp, Homo sapiens
gttcgtgtggctgttggcaggaggcctcagtttttcaccttctggacgcctgcacagggctgcttaagcagcctcacaacatggcagctgactctcgccatcgtgagtgattcaagagagagcaagatggaagccgcaatatctatgatgacctggtcacagtctgtcatttccacaactggtaacacaggttggccaagttcaagccccagttccgggatggagagctccatgccttggccctgccagtgggacttctgcatgtgctgggagagaagaaaggtttcctttgagccctgccaggatcttgttacagtctccacagagcaagacttcagggtcagggtgttgcattatgaagacaggagccgtggagcctccagcaggagacaatggcttccattgagataatatgacttaacgaggccacaagtccacagccaccactcaggaaacaataaccatttcaagagggcacaggaggtgttacagagaggcgtggtgacacaccccacccaccgtggcctcagagatggtgctaagggagaaagtttgctgggatttgtctgaaaaggtcagttattaaaaacagcttctggctgggcgcgctggctcacacctataatcctacc

SEQ ID NO: 180443 - DNA, 674 bp, Homo sapiens
cccatgctcccactgcaggtgcaggtgcaggtgcaggtgcaggtgcaggtgcaggtacaggtacaggtacaggtgcaggtgcaggtgcaggtgcagctgtggcagggcctcgcccctgcagcctgccacctggtggccttacccgccttgtctcagctgctggtaggctccggctccttgttttccagaacttcagtgcccattgaaccctaagttgctacacagctgcttgcagggtatccatccacatccagaaatactgttctgaccattcagtgctcatttaggcaccaggaggaagaatgtgttatagctgagaagtggacactctatatttgtaacaatggcttaacacaaaggcttgcagaatcaggcagagcaggatgtgcaacatgccaaaaacatggacaccgggaggcatggacattttgtggaagagaggcttgtgccagagtgtaatctggaagggaacctcttaagttatgtgaggagggggatctgcattttcctatggaggggttcgtagctctccccagaggggagaggcctatgactttcctaaggccaagaaccagtggcttaaagaatactcaggtttggctgggcacggtggctcacgcctgtaatcccagcactttgggaggccgaggtgggctgatcacttgaggtcagga

SEQ ID NO: 180444 - DNA, 451 bp, Homo sapiens
caattctgtcagtttgctcactctgtgcagatatatctcatcctctcaaccagaagtcaggtacagcgcagggaaaagcctgtatcttgttagaaggacttttttcctgtaggacatggtgatttacttggaaaacaagatggggaaggtagtttaagaagggcctaaaatgccaggaaggagagtttgtggagcctactggaggtacaacctgatgagaacttggcttactgaagatttatctggcagtgatgcagaagctaaactaaaacaggaagagatgagaagactttttttcagtctggtcaagaagtctgctccagtgtagtggcagggagcatggaaagagacccagtggaagaatctgttcaactccacaaatgattggctggctataaagttatacagcatgagccaccgtgcctggcccccagctagttttttcaaaaaa

SEQ ID NO: 180445 - DNA, 240 bp, Homo sapiens
tcactgtcttctcctccccacacacccatttttaaggtcctacaatggtgcaagcagaagaaacgctcccccatgagtaaatccactcacctggggactcttgtattcctcaacgggctctgaaagcttcctggtcaatctgaagttggaagactcactataatttatgaggaaagacttacctagtttgagtgagagatctgtctgtgggtaaatgaattgtcacaacttcttaactgg

SEQ ID NO: 180446 - DNA, 264 bp, Homo sapiens
aaaagtgctaccttaaaaacaactaaaattgtgatgtatttcttctcgtggtcctgtcaagtcacttgctttatatattttgaagctatattaacatacacattcatgatcataatcttttttttattacagtactagtatatgttggccaggcgcggtggctcacgcctgtaatcccagtactttgggaggccgaggtgggtggatcacgaagtcaggagatcgagaccatcctggctaacacggtgaagccccgtctctact

SEQ ID NO: 180447 - DNA, 203 bp, Homo sapiens
gatctgttgcttaaccattcccttctcagtgtcaaagggagcaagatacagtgaccctgataggaaaaatgaaaagccaacattcttctggtttgggcaaaaatcattccaagtggtcttatgattctcaagatagttggaaatgatctttcctccaccaaccagatactatatatcttttatggggatggtgatgactgagt

SEQ ID NO: 180448 - DNA, 495 bp, Homo sapiens
actgtagtttaaaaaaatgtataactataaatactagcaattatgcagaatttaggattcaacttgatattgatgtttaaatatttaaccttattaatttcaaaacactgatataaaaaaaccatcctctaaattcacaaatcaatttcagaagataaaaacacacaaattcaactttattcaaataagaagttaccctgtgccacttttccaattgttttgctacataacctctttcattcagataggaaaatccttttggaatggagagaaatctgcaaattaaaacaagcaatagtttaacattgagtctggcaaaaacgtatcttaagaagctaaaataactaaaatttaaaaaagtataaggagctaaaagactttaggaatagttcgttcctaaaactaaaaggtcaactataatttattataacttcaattacaaataaattttcacaatctttgcaacaacacgcgaacccaatcacaataaagaaa

SEQ ID NO: 180449 - DNA, 457 bp, Homo sapiens
ggaggcggaggttgcagtgagctgagaccgcactgaatacctcaatacctttcagatactttagatatttcaaattgccttgtatgattcactgaatttggttgggtctaatatgataattcaaagaccagagctgtttatctgtgaatggagagttttgcacatgaattgtgacaattcctggaataagatgtgtaataggagtgttcatatatcttcagccctttctatttaggaaacctagagttaggcttccacagtataagagggttccaaattattaatatcacaagatggacaaaaagagaagcccaggaaaaatagcttggagaagtgcaccctctccacacctcctcccaaagtataacaaaagtatttcattcgattaggaggaataggaataaaaaggacagatgcagtatatggcactggcttcaacagggaagagactcttcat

SEQ ID NO: 180450 - DNA, 591 bp, Homo sapiens
gtgtagaaagaagtagacatgggagacttttcattttgttctgtactaagaaaaattcttctgccttgggatcctgttgatctgtgaccttatccccaaccctgtgctctctgaaacatgtgctgtgtccactcagggttaaatggattaagggcagtgcaaggtgtgctttgttaaacagatgcttgaaggcagcatgctggttaagagtcatcaccactccctaatctcaagtacccacggacacaaacactgcggaaggccccagggtcctctgcctaggaaaaccagagacctttgttcacttatctgcaaaatgaaacactagaagcacagactagaaatgaatgaattgggggtgaggggcacccagcagtagaaatgacatgtctaaaaatacttttcatacttttttttttgagaccgagtttcgctcttgttgctcaggctggagtgcaatggcacaatcttggctcactgcaatctccgcctcccgggttcaagcaattctcctgcctcaggttcccaagtaaccgggattacaggtgtctgccacgacaaccggctaattttttgtattttaagtagaga

SEQ ID NO: 180451 - DNA, 534 bp, Homo sapiens
ggtgagtttaaggaatctgacctaaccctgatgaatcctccagaatctgtttcaatcctagagtgaaaacagagtactattctaaaatgccccagggttttgagattttcagtaaatctagttgttctgacttctacaccccttacgtgacaaaattctgctttctcctttgctttgtttttcttaacatccctcttctttcctatcttcctagttatgtctgccaaaagaatagacatcttagctgcctattcagaccatgtgtacaaaatgctacaaaagataatttgatctctaccatgttgggattgcatgaaactttccctaatggttacatttgcttctgtatgttttttaaaaaagcagccatgtttaatattgtgaaatatgatctgtctcctcttctgcccaccctctaaagcagtgataaatttcagagcatgctcagcagaattggattatattatgcacagtacacatgttcatcaccaaaactgtactgcctagaatgtatgcaagaagaatgaattgctg

SEQ ID NO: 180452 - DNA, 496 bp, Homo sapiens
atggcatataatgagttggttgtttcctagcaactaaagaagcagtttcactttagctgatcctgcaatagaaatgagacattttcccttgatagttgttattagtgatttccctgacaatggaatttcacttttgaataaggaatattctcagcttttggtttcctaaagaattttgattctgagttgcgctaagctctgcttaatcctgtataaaatgaaaaaaagaaattgagtcccctaagtacctctcatgggaagagccaaaggagtttgatacatagtttcttaaatggcaagtgattatacaagaagctgtaataggtgtattttctcagtgtttaacagaataattaatgaccacattcttttttttttccctgcttaatatttgcagcagtagaggtttcttaggtaatggccaatgtatgtcgaaataaatattgtaagtttttattacaagtgccattttgatataaagtcagtataaggaaaa

SEQ ID NO: 180453 - DNA, 386 bp, Homo sapiens
catgatggaaatcttgctaaaggcagaccagggtaataagatatcaggggtgggagatgagatatctaatcagatatccagaatgatcagataccaagggtaggggacttccactaaactgactcagcaggattcttgctaaaactgaactaagcaagccaagcttagttgagaagaaggctcacaaggacctgactcaaatttggtcaagcagagagtctttgtcaaaggcaaggtactattactggtttaggagtctagtacaaatattagacagtgctccagccccaaagagcttataatctaatgatgcaagaagacaagttaataaataatttacataaatgaaatcataaattgacagatgtattcgtggggtaggaggt

SEQ ID NO: 180454 - DNA, 243 bp, Homo sapiens
aactggaaaagaagggaggagagcgacgaaggcgttcatattgagccctgggtgggtataacagggtgagatgtgttgtatcgtcagcatgactgcaagcctggtgagcttgtgattctccaaggagacaaaatatccaaatgggaggttggtgcctgacttttgtctttttatcattttcatcatttgcctgggccccttgggggcattttccatgactgataaaatgctcctctgagttca

SEQ ID NO: 180455 - DNA, 163 bp, Homo sapiens
atttcccatttattagaaggcaggttagataactattggagcttaaattacttgaaatttatatttttatgacttaaacattaatagagcacattatatattctccaataaaccaaaatctatatacaaagactaaattgaaaatgtaatgagaagaaaactg

SEQ ID NO: 180456 - DNA, 179 bp, Homo sapiens
caccccctaagacagatggtcacattcttcttaggcaaacataaatcaatggtactcagccgaacattccacattttaagcaaaccttaaaaacaaaatctgcatagctggatggggagaagacagtccccagattctgatacatggagagagtgatgcttcctttcctttgctgaagc

SEQ ID NO: 180457 - DNA, 662 bp, Homo sapiens
atttactgaagttgaaccctctcatatgacctggcatttccactcctggatatgtactgaatagaaatgcaggcacacagacaccaggagacatctacataacagcttcattcataacttgataagggtggctaccagtagtagaatagataaataaattggggattactcataaagtagaatattatacagcaatgaaatgaatgaactgtagttctacacaagattttgactgtagttcctaagcaagattgagcaaaagaagccaggcaccaaagaacgcatttatagggctctttgctagcttgaaaaactagcaggacagggtagcatgcatgcgtaggtggtaaaactctaaacaaagtgtctgagtccatttgtgctgctgtaacaaaatacctgagactggataatttatatacaacagaaatttatttctcacagttacggaggctggaagtcgaagatcaaggcaccagcatttgctgtctggtgagggctgcatcctccaaaggagagaaatgctgagtccccacatggtggaaggtggaagagcaaaaagggacaaaccccctccatcaagcccttttatcaggatgctaatctcattcacaaggggagaagctctcatgacctaatcacttcttaaaggccccacctct

SEQ ID NO: 180458 - DNA, 335 bp, Homo sapiens
cctttctcttcttggcaaactatttgtgtcttggattgagtacatctcgtttcttaggttttttcctactatgtgacatttgtaaggttctttctttttctaatgtgggaaaaaaaataaccttaatttaggtcagtgttaaagatcaagatcttggttttagctagcatggtggttcacgcctgtaatcccacctcttcaggaggctgaggcaggaggatcccttgagaccaggagtttgagaccagcctgggtgactctgtctctaccaaaaagaaaaaaaagtagccagatgtgtggcgtacacctgtagtcccagctactcgagaagctct

SEQ ID NO: 180459 - DNA, 1158 bp, Homo sapiens
atggggtgcggcgccagcaggaaggtggtcccggggccaccagcgctggcttgggccaagcacgaaggtcaaaaccaagccggcgtcggaggcgcggggcctgggcccgaggcggcggcccaggcggcgcagaggatacaggtggctcgcttccgagccaagttcgacccccgggtccttgccaggtatgacatcaaagctcttattgggacaggcagtttcagcagggttgtcagggtagagcagaagaccaccaagaaaccttttgcaataaaagtgatggaaaccagagagagggaaggtagagaagcgtgcgtgtctgagctgagcgtcctgcggcgggttagccatcgttacattgtccagctcatggagatctttgagactgaggatcaagtttacatggtaatggagctggctaccggaggggagctctttgatcgactcattgctcagggatcctttacagagcgggatgccgtcaggatcctccagatggttgctgatgggattaggtatttgcatgcgctgcagataactcataggaatctaaagcctgaaaacctcttatactatcatccaggtgaagagtcgaaaattttaattacagattttggtttggcatactccgggaaaaaaagtggtgactggacaatgaagacactctgtgggaccccagagtacatagctcctgaggttttgctaaggaagccttataccagtgcagtggacatgtgggctcttggtgtgatcacatatgctttacttagcggattcctgccttttgatgatgaaagccagacaaggctttacaggaagattctgaaaggcaaatataattatacaggagagccttggccaagcatttcccacttggcgaaggactttatagacaaactactgattttggaggctggtcatcgcatgtcagctggccaggccctggaccatccctgggtgatcaccatggctgcagggtcttccatgaagaatctccagagggccatatcccgaaacctcatgcagagggcctctccccactctcagagtcctggatctgcacagtcttctaagtcacattattctcacaaatccaggcatatgtggagcaagagaaacttaaggatagtagaatcgccactgtctgcgcttttgtaa

SEQ ID NO: 180460 - DNA, 822 bp, Homo sapiens
aaggtaagtgttgactgtacaatcagtcctaaaatatagctatacagtaacattcatttttaatatggtgcttttaaggatttgatccattttctgtatttgaatgatataacctcagcactatttactttcacagaaatatgatcctcccaataagttgtgtatttcctgaaggtttttctgtgattacctgttatgtccttctctgcctggtgagcccttgtttttcttcttcagggtctaactcaatgacccctctttaatgaagccttccctggcccttcgctctgcccaactccagatttcaaccttcccacctgtgcttgtcatcactttgcacataactctgctttgaacacttgtcacattgtgaatagtttctgtgtctgtttcctggctatttgagctctcagcaggttagaactgtgtcatagccatcactgtaattctctcatgtagcagtattcctaacatatagtaagcaacgatgctttctttgagtgaatgaataattaaatactttgtttacaaccttagttatccccttctcttctaaccttcagtggctctccattgtttaccctgctggatcatattcacattccccagcgacctaccatataaggcccgttacagtcaaaccttaattactctccttcctgaaccctccacatcagcagagacctgggctccggcctggccctcaggcccgaggttttcctcaaccaacacagcagcatctcagcactggctcctttgctctccctgaattccttctcactcctggcttcccacccctttgtgggaaaatatcttctcaaa

SEQ ID NO: 180461 - DNA, 614 bp, Homo sapiens
tgcccaaaatgatgtttacatactatgttttttttgtttgtttgtttactttcaccataggccataaactagtcaagatcataagatgatcttaagaagattactcatttgattagtttaacaacaatatcatttggttctgttactctgttcttgatttactctcccaattaaagagcatttttattcagaggccacctaacaggttgcaaagaggttagttctcctgatagtcttttggaaaagacattctgctgctccatagagacaattagcagaagggctggaactgagtatttgataaaacactccaagttggaaacaatttcctcttgtgaaacttctgtttcattattgaaagtttataaaatgacaaatgggaaaaattgctttaatatgatgacttttgtaatcaattatttgacaaaataggtttttattttgaaaacaaccactataagattaccctgaactagtccttttcaatttttgaggttatttttgtatggaagaaatgaagcattatatttgtcgtctttctttccttctgtattttcatataagtgcaaattattttttttacagaaaatattgtagtaaccaaaatagaattg

SEQ ID NO: 180462 - DNA, 431 bp, Homo sapiens
gagaatcgtttgaaccttggaggtggaggctgcagtgagccaagattgtgccactgcactccagcctgggtgacagagtgtgactctgtctcaaataaataaatataaaaataaatttaaaaaaaatgagattttgggctgttttactgaattctgtcctaatagagggagaagcaactgtgactcctcctattttagatgagctgtcaaaagatgaaatgatggctccctgcatcagagtagtgggaggatgactggaaggttcctggcaatgttaacactttgtggaaaaggctgagctccaggaaaaggaaactgctgaatcaaagctgtaaactgaaggtcctcagagaaggcagtaattcactgcttcagctagcccatgccccacctccctggcaagttctaaaggagtctaagaattctcctcc

SEQ ID NO: 180463 - DNA, 427 bp, Homo sapiens
ttcagaggagaaaaagattagagagcagcaggtgtcaaaggaggtttcgaggaagaggtcatatgtgggttgggcattaaaggcagggcagaaggacaatgtagactgaggagagagcataacacaagccatagtgctgggaattacaaggtagaatcaggaaacgctgcatatgacctggagcctgggatactgagggttgaggctatccctgaggagatagaaaggagctggtgccaagcagagccttgaatgacaaaccaagtgcactgcactgtctagcaactggccaaatgtgattatttaaatttaaatttaatggaacaaaatgtaaaactcatagccacatgtggttagtggttaccatactggacggtgcagatgtagaacatttcatcactacagacatttctagtggacagcaatg

SEQ ID NO: 180464 - DNA, 188 bp, Homo sapiens
catgagccactgcgcccagccgatttatgcacatttacatattgttttttatattctataaaagaactttaaaggttttatgaataatcatttcgattttgttttttgttttgttttgttttgttttttgagattgagtctcactctatggcccaggatggagtgtggtgggcaccattgcactgggc

SEQ ID NO: 180465 - DNA, 573 bp, Homo sapiens
tgccaagtgaaaagaaattcaaagggaaacaccggtggaatatcacccttcacctttggccgtcatcatagacacatcttgttatttctagtgttggtgaaagtggagggaaagggtgtctgtatgatgtaatgggagtataaacagacaatttaggcaatttgacaacaaatatgtcctaacttaaaaatgcagacttgaccaagcaacttcacttctagaaatgaaacattaaaaaacaatcctgcaaatgtgtccactttgaggattggtgccacttccaagactgggttggccagaaccagaaaggagtctcccaaactcaagagagtagtggtgactctaataacagaaatgaaaacagcagacactggggagtagtcatgtaaatccacatggcaaagccaaggtgaactgcaccctgagaacacttcttccaacaaccactgtcacatcaacagatccgtgctctgtcttcatgtccctcttttctgtacgtctccctccttctactattgactttacatatctatctgaccctgtactgctccaagaggccctcctacattgagc

SEQ ID NO: 180466 - DNA, 712 bp, Homo sapiens
tctcaaaggcactggtctacaaaagacggagcctgggaatgaagtacaacacggatcctggagtgctgaagtctctagcagtggggctattccccccaggttacagactaacgagttgtttccctgccttcaatgtcctggataatgtgtgcttgcttactggggataaaaggcaggtctccaggagggtttctctttgcccaggtgaagcacgctttcttcctgcaggtaagcggtgagcaatcggaaaacatagcatctggaaacgggggcttttgtggctccacgacaagcctgggagggaggtttgtaaatatccgcagtgctgaagccaagctgatggattttgcttttttgaaaaaaaaaaaacccttacttggtacttcattttgattaggaacaacctttgcacaggttgtgcgtccacaggcttaagaaatctctactatttacttacctcattggtaaaaattaaaatggcctcaaaggtcacatgtatttcaaaaaaccatcaaggcaggctgctctacaatgaggttcccaaaaaacttatttcgaatagtttccttacttttaagcaacagctgaaactttctcgtgtgtattttatcatgccttagatgaaaaagctttgaagggccctaacccactctaggaggggacccatgataagcctggaggagatactctagacttccagtgtccccaggac

SEQ ID NO: 180467 - DNA, 232 bp, Homo sapiens
ggaatttaaaaaaatctacacgatacatattggatcatacaagcatgagagataaactgaagcagaaaggaagtatgaaaataaaaacaattggcaataaagcaatatgaatttcaagatgtaaattctcaggcaccgctatgctagaagacataaaacacgaatgctgtactcacatgtaaatttgctgtcaacgcagcagggacaaatgtcagcagcatcaggagcactg

SEQ ID NO: 180468 - DNA, 185 bp, Homo sapiens
cacagaacttgtacctaaacagaattatttgctgagacaaagaaaggcataggttacaaactggttaaaattaccaggaaaagtattttaaacagaggtaccgtaccgtttgttatgtaaactttaaaccaatgtcttccccatcctgaaattttctagtggtttaggtccaccgagggagatgc

SEQ ID NO: 180469 - DNA, 241 bp, Homo sapiens
ctgcccacgttgtcctctcgagtagctgggattacagatgtcaggcaccgcacccagctggatgcaaggttttatcaaatctttgtagaaactgtatttttgttcttcgggattgattattccaggataaccctaatcgttaatgacacttggatgtgattagactttaccaaattcatcaaaggctactgaataaaacagaaaactatcttgaacactggtgactgtgaactgtttttgg

SEQ ID NO: 180470 - DNA, 621 bp, Homo sapiens
gcatatgttcacacaaaaacttgcccacaaatgttcatagcagcatgattcccaatagccaagaagcagaaacaatccaaatgtcaatcaattaaaagaatgtggtctatccatgcaatcaaatattacttagcaagaaaaaggaatgaagtattgatacaagttacgacaggattgaaccttgaaaacgttatgccaagtgaaagaaaccaacacaaaaggccacatacatatgatttcattttcatgaaacatgtagaacaggcaaattcatagggacagaagcagattagtagttgtaaagcctagggttgggggaacagaaagtgactgctaaatgagtattgggtttcttttgggggtgatgaaaatgttctagagttagatagtggtgatggttgtacaacactgggaatgtactaagagccacttaattatacacgtaaattttatgttgcaagaattttacctcaacttttttttaaagacagctctatattatactgatatgggaggatctctaagatagttcctatttatttctgcattgttatttttagacagggtcttgccctgtacccaggctgcagtacgtgatgcaatgacagctcactgcagcct

SEQ ID NO: 180471 - DNA, 387 bp, Homo sapiens
ccacaacaaaatactagctaattgaatccaacagcatatcaaaaagataatacatcggctgggcacagtggctcacgcctataatcctggcactttgggaggcccaggcgggcagatcacgaggtcaggagattgagaccagcctggctaacacagtgaaaccccgtctctattacaaatacaaaaaaaaaaaaaaaatacacacacaaaaaaatttagctaggcgtggaggcatgcgcctgtaatcctagctactttggaggctgaggcaagagaatcgcttgaacccaggagccagaggttgcagtgagccaagatcgcactactgcactccagcctgggcgacagagtgagactcagtctcaaaaaaaaaaaaaaaaaaaaaaa

SEQ ID NO: 180472 - DNA, 588 bp, Homo sapiens
aatctgaattttctctctccatctccccactaaggtcaagatgatgttgcaatccatgtactgtttcacctgattttccttggcattacagaaataatttgtgaaaccactgagtaaaatagtagaagacaaggtaactgattatgaaaccagtaatggaaatcaaatctaaaatctcaacctttttagcatcagatgaacttgcctggaaatcaaactaagtctacaggaatttgccttggtgtcctaatgtactgcacacaaaagcgtagtggatctttcaatgtttgtttcccaacagcagtgtatgagagtctgatttttccacatcctagtgagcacgtactatttagctttttaattctagccatcctagtcagtgtgaagtggcatctcactgaagtttggatttgcattttcctaatggctaatgctgctgagcatctttttctgtgtttattggccatttgtgtatctcccttaaagaaatgtctattcagaccctttgctcatttcttaaattggattatttgcttttttattattgaattgtagagttctttccgacttcattttactatgtttctt

SEQ ID NO: 180473 - DNA, 701 bp, Homo sapiens
gtcttctctagtgaaaaatgctgtgggtttcttttttacctttaattttacttttcaagttaaaaaatagcttttaaggtcaaaattttcagagcaatttgtaagtatagatacagtttcatggtgacagtttcttatgttgaaaaggtgacacaaaacacattatcttttactttagattcaaggggtacatgtgcagatttgttacttgggtatattgcgtgatgctgaggtttggggtactgtcatccaggtactgagcataatacccaatagttagtttttcttttctttctatttttttttttttaatttttgagacagagtcttactctgttgcccgggctggagtgcagtggtgtgaacttggctcactgcaacctccacctcccaggtccaaacaattatcctgcctcagccttccaagtagctgggattacaggtgcccgccaccacacccagctatttttttcgtacttttgtaaagttggggttttgccatgttggccaggctagtctccaattcctgacctcaggtggtctgcctgccttggcctccccaaagtgctgggattacaggcacctgccactgcactccagcgtggatgaccaacacggtggtaacatagccaaggttacttttacttgggtaggatgactgcagaaggaatggctacacagagcttccagacctttccatg

SEQ ID NO: 180474 - DNA, 496 bp, Homo sapiens
caccatttctccccctaaccccccagctctgtgtcgtggaagttttacctggggtgttatgctctaggcaggtgtggtcaaaaagacaggggctctcctcccagctcctagtctggctcttcatttcgccctgggaggggaaggctgctggcctttctctacacagcaccccacccctccctgcccatccctgtgttgcagaatctctactgcaagcaggtacagcagagaggactttcccacaaggcccacctggagcgtggaagctcttctccaggtgtggcaggttgagaatgcttgggccctgccggcccaactccagctagctcataggatggaggctttttcacaccaggcggggcgagaccagctgagaataccagtggctgccaccccctggtacccacttatagagcagggtgtgacttaggaaaagtaggtccctcccccagtttgggtgccgtggcacgtgggtttttgctttggggaaagaggc

SEQ ID NO: 180475 - DNA, 302 bp, Homo sapiens
ctagcttcttcaggtagaattctagattacttatggtagatcttttgcttttctaaggcacaccatgaaagccttcaactttccacagagcaccactctagctggacatgctgatatgtttttattttcatgaccattcagtctgcagtatcatttttccttcttcagattggatggtttctgttgctctgtcttgtttgctgctgctttcttttgttatttccatccagtgaattttttatttcaaatttatgttagttatttatttatgttagtaattctaaaatgtttgtgtactttgt

SEQ ID NO: 180476 - DNA, 573 bp, Homo sapiens
cgttgacacttcagtagtatagcagtaaaatgcttataaacattaagatttataggaactgtaaataaattagcaactttaaaaaaattaggcaggaatattgcttgatcccaggagttcaaggctgtaggacactattgtacctgtgaatagcctctgcattccagcctgggcaacacagtgagacctcatctcctggaggaaaaaaaaacaaaacaaacaaacaaaaaaacctaacagaaaaacacacaactcacaaattgtgtggagtctactatgaaaaataggcaagttttacttgtagaacattactaaacttggttattttgatattctacccattcacatgaaccataagaaaaaatgtatttgttcttcatccttcactgaactttttaactttcaattttgaaatgacttcagactgagagttcctttacatccttcatccggtttccctaacagcaacatttcacataacatggcacatttatcaaaactgcaaaatgaacagtactacgacactgttaaccagagacttcattcatatttttccagctttgccacttatgt

SEQ ID NO: 180477 - DNA, 688 bp, Homo sapiens
agaaattctcagatcatttgaaacatctactataagttctcaaaataaatgagaaaatattactgtattatttaaacaaagtccatttctttgttataaaccactgactacaccccaggaatacttcaaggaagaaaggacacaagaagatttcgggcctttgccctcaaggttggagaaattaagatgtttttgattcaggtttcaacaaatcatcactcttctatgaatacgcaactaagaaacttcaacaaaaattatagtgaaaaataaacattggtgtcccaactaagaggagaatgctgggtgaggctcaaagagcttcaatgacttgcctcagaaatgacaggatggaccttgtgtaacccagtgatgtattcataatcgacagttgccaagttgatgctccattattaccttgagttttgatgatcctttgatatgccatgacccaacagagataaggtgtcctgggagtggagaaagggcagtttcatacatgttgtcagcatgtcacatgttttttcaatatttaaggaaggaatctggagaaacaggaatctggagttgaattcctctatggtcagatggtatcatgacctcatcattggcgtagtttcctctccaggaatggaacattgaagagaggaaagaatcatagactttgtttgtatcctgccaaccctca

SEQ ID NO: 180478 - DNA, 351 bp, Homo sapiens
ccttgctgactggttttcagtgtctgagctcttgtcttcctgaagttcgagtggcagcgcattagattcctggagcagtagttaagcttgagctaaacatcctaggcccaagttcagctccacctcgtacagtgacatgacattggcaaggtaattcatctttacttatctgcagaaaagggatgataaggctgggcacggtggctcatgcctgtaatcctagcactttgggaggccgaggcgggtggattgcctgagctcagaccagcctaggcaacacggtgaaaccccatctctactaaaatacaaaaaattatctgggcatggtggcgtgtgcctgcaatcccagct

SEQ ID NO: 180479 - DNA, 532 bp, Homo sapiens
actgggaaaaggacatcaagctggaaaactgaagaagtaccagacttaggctattagcaactccactgtgtcaggacttacttcttactagggtgtggattggggcacattttaatgcaaaacagccacagggtttatccaagaagtcattagaaaggaaatccagaaatacaaggcagaaaaatgactctccagggaagagctatgctctctctttcagccactatttcggacccctacttttaactcacttacttttaataataatagtaataataaatttaaaggtgattttgattctttaccacttttcctcaaaatcccaaatgcaattattggtaagatcgaatatttaaaagataaaacaattctagtccaacactctaatagacacaggaatcctcaccctaccaacctctgacaatatggtactcaccccatatgttttatgaccatggatagggacctcatgactctccaaggtaagggaggatataagcaaactgaaacaaaaaagggattctaacaaaag

SEQ ID NO: 180480 - DNA, 301 bp, Homo sapiens
ttgaactcctgggctcaagtgatcctcccacctcagactccctagtagctggggctacaggtgtgcaccaccacacccagctaatttttaaatttttgtagagatagggtctcacactatgttgcctagactggtctcgaagtcctggcctcaaatgatcctcccgcctcagcctacatgtgttctttcaaacccagagaaattcacaggaagagccaactcaatcacttgaaacaccaggtagaaataagaaaaagttatattgcagggatcccgcttggagatgttgggggcctaaggt

SEQ ID NO: 180481 - DNA, 403 bp, Homo sapiens
tgaaacgactaataaaatagacaaactgtcagctagcctaaggtaggaagaaaaaaacaaaaaagaaggaaagaaggggaaaggagggaaaaatattagtaatgagcaagtcgataaaaacacagcactttgggaggcctaggtggcgcggatcacgaggtcaggagtattgagcaccatctccgtggccaacatgtgggtgaaaccctgtgtcttctacttaaaaattacaaaaaattagcgtgggcattgggtggcccgagccttgttagctcccagctacctcaggaggctgagggaggagaattcaccttgaacccgggagacggaggtttgcagttgagctgagatttgagccactgtgcacttccagccgtgggcgacagagcaagacttcattctc

SEQ ID NO: 180482 - DNA, 169 bp, Homo sapiens
gattcgccactacaactcaacttcttcactgctttatactgcactggatactcagtaggcagcctaaattttgccacaagactacgtgagactatttaaagtagggaaagtttgtttcctaatcaagaagagctatgatctaagggaaattcaaagaataacctaaaag

SEQ ID NO: 180483 - DNA, 290 bp, Homo sapiens
ggaaaaaggaaagttttgtttgaaatggaaatttcttatctgaaaaaattacttttgaaattctgaattacgggttgttatgccttttatctaggaggaaagtggcctgtcttgtaggatttgtggatcttctgctctttattcatgtcatgacattctgatgtcaaaaatgggctggtagtaggcacctatattccaaggaagcaattctgatttctggtttctctctattttaacaattgatgcacttaacagggaaccgtatttatcttctcaaatttattttcacc

SEQ ID NO: 180484 - DNA, 448 bp, Homo sapiens
gggggagagaggagtgagaagcttttgtataatgagtacaaagatgaaaaaaatctggaaataaatacagatgcttctcaacttacaatagggttgcatcctgataaacccatagtaagtggaaaatatcatatgtcagaaatgcattcaacatgcctaacttaccaaacatcatagcttagtctagcctaccctaaatgtgcttagaacacttacattagcctacaattgggcaaaatcatctaatacaaagcatgttttataataaaattttgaacatctcatataatttattgaatactgaaagtgaaaaacaatggttgtatgggtactcgaagtatggtttctactgaatgcttactgcttttgtactgttgtaaagttaaaaaattgttaagttgaaccattgtaaattggggaccaactggtgatggttatacaacattga

SEQ ID NO: 180485 - DNA, 323 bp, Homo sapiens
tatgtttggaaatggtaaatgtcagggaaaaaaattaactatacataataatcttggaatggttcagggaaagttctcatgctgtgtggtaatttcttaatcaatgaacaaacgaaaagatacaagagaatccacgtagaaggcagcatcgagtgtttacatcatgcaagcaagacaacatttaccaagtctgaataaaaggagggaaataccttattttttaaaacaaatatgttatttctccaaaagcaaaatattgttgacagcatcccaatgagcatgaacaaactgaaagtgacccttaactacttccctccctcaaa

SEQ ID NO: 180486 - DNA, 365 bp, Homo sapiens
ttgtggaggaagtgacatggaaactgggacttacaggtagggagacactcatcaaaagaatagtagggtgcgcttcaacctgagagggcaacatatctataagtcaaaagataagaaactgtcttgtattttcaagaaaatgaaaggcattcctatagctagagtctacgatcaacatacgtcattggctataaactggtatgtttttctttgttataatgcttttacgtatttaaagtctacagttcatctggagactgaatatttttcaaagtaggattcttgcaactctcaaaagtttagaatacccttattttaccaaaatggacaagtttgtgttttctgctttagcacacataccctca

SEQ ID NO: 180487 - DNA, 548 bp, Homo sapiens
ttatcttgacttgtactttgcaggaaaaaagggaatccctggacaggaactcacttaacttattccttgtgtcctggaagctcactcagtggctcacacctgtcatcccagtgctttgggaggccaaggtgggagcctggcttgaggacaggagtttgagaccaccctgggcaacatagtgagactccgtcttgacaaaaaataaaataattagcctggaatggtggcgcatgccttagtctcagctacttgggaggctgaggcgggaggaatacttgagcccaggaatttcaggttacagagtgagctattatcaggccactgtacacctgagcaacagagtgagacttctgtctcttagaaaaacaaaaccaacgccacacaaccatctttctaatttgtgtccttcttcagtcattgcattcttttattaaaagcttctttaaaaacttttctgatctggtctgtactacatctgccactaagactcaacattgcagtctgatcttgttaatccactaacactgcccaggttgtcagtcacctct

SEQ ID NO: 180488 - DNA, 526 bp, Homo sapiens
tgtaaccacacttgatcatgaaagaccaagcagcctccgacatcagggtttacaaaaggaatcatacctttctagacctgaagtcacggggaattcctgattacaactggaagatcaacagttggctgggtaacacgttcatttatgtcataaattggcatcttagcctaagactttgtgtagggagagcaagggtgaagtgtatgaaaatatttgaagtaaatcactttacagcgttttaaaggcggaaagaagtaaaagcacgtgcctcccagccttgccaggatccaccttgggctgggtcctccaggtctcgatcagggccgacccattctgcatcctccgcctggacccctccaaggcttttgctgtaacttgcgctctcctgagctgcctcgcaagcagcaacgacctctccctggtctctcatcaaactcatcctcccagaaaccgggttcctgccctgtactgtgttcccatggcaacctgagcttactacccgctgctggcatcaccccctctccgc

SEQ ID NO: 180489 - DNA, 235 bp, Homo sapiens
tggagaaccaagaaaaagatttcctggaagcatagaaagagtgcgtttccggaagaaagattcatcaagaatttcaaacatcagggccaagtcaagcaggacaaggactaaaaggtgctccttaaatttgcctatgaagaggccactgctggggaggagtgtgtcaggcggcagtggagggaggacagcaagtgtaaaggagactctgcaacctccacctcccagcttcaagcac

SEQ ID NO: 180490 - DNA, 191 bp, Homo sapiens
gatactatgttgtgctgagacataagggtggaaatgatagacaagtgactctcttacagagacttctgtttggtctccaagtccagtgctctttccactgcacacatgcctccatcccaccaccttctcccgtgctgagcctttcccagccagacagtgttttgaggggcctttactacccctctccctgc

SEQ ID NO: 180491 - DNA, 132 bp, Homo sapiens
gaccacatcaccccactactgtggctcctctctcactcggagtccagctgggagctctgcccagaccccgggctctgtgccatctgtccctaccggtctctcggactccccctactgcccacgtacagccag

SEQ ID NO: 180492 - DNA, 116 bp, Homo sapiens
tcaagtattatttctcattttgagtaattttgttctcattttgttccagttctcactctcagaaaaagattactctttgtatattaatatttcttaatcatggttcttatttcaat

SEQ ID NO: 180493 - DNA, 390 bp, Homo sapiens
aattctaagtagaattctggagtcaaagtcatgcatctataagattttgatagatactgtaaaattctcctccagaaaggctctgccaatgtacatttccaccaacactgtaagaagtgcctgttttccatgcccttgcctacgatgggtacattttcctgttgctttttctgtaccacacataaactgcctcccttaagctgccttcttgtttttataatttgttcagtttcaccagcatgattacaactataaaaggaacaaaacaaaataatctacgtctaggaaacacaccaaaatgatggcagtgattggatttatgtgggcatgacataagtgatttttttttttttttgagatggagtttcgctcctgttgcccaggctggag

SEQ ID NO: 180494 - DNA, 183 bp, Homo sapiens
agcagcagcctggaactccgtgcaccatcgtccatgggcaccaagaggaggttagggttggaggtaatcacaggaagcctgtttgagtggaccagataggtgtggtactgagattgaaggtgaaacattaaaaacgtcaggccactggatacgcttggcaacttggaagtgtgcctttatctg

SEQ ID NO: 180495 - DNA, 368 bp, Homo sapiens
cattaatgtttactgcatagtcattaggcgccaggcactactccaaacatcgtatgtgtttatctcattttagagacaagggttactattatccgcattttataaatgagaaaactgaggctcaaagaggtcaaattccttgccaaggtcacacaactgtggaagtggcagagctgggatttgaacccaagtccctctgctctcaaaattctttttttttttcttttttttttttttggaaaaagagagttgtggctgtggttggccaagggtgtgggagggaggggggtgggtctccgcggccacagggcaacccttgggcccccggggttaaggggatccctcgggcctctatatgctcaggtact

SEQ ID NO: 180496 - DNA, 739 bp, Homo sapiens
gagaagagtgaaaaaagtaaagctaaagttccaagctgggttggtgaactaacagtagtaccatgaacagacacccacagtgaggcaaggaagatgagagaccttctggatgtaaacaaacacttgacaacaggtcagtataaatatgaaagttctgtagatagacacatgcagatctgacggctgttgagagccctggaggaagaacccagggagactagcctacatttgatacctaaacattctaatttccttcctgtgtattgtgtgcattattatccattatgtcagcaagtgcaccttcagaaaaatccccattaggtgcagagtcagttttggaaacggcttggatgaggcgtgtcgggattcacatctggggtctgtgccacccactggtcatgtggcttcaagttatttaacttcttagtttcctcatctttcagactttacacagcaccaccatcccttctcccaaataccctattatttcgttttcaatttctccctttctggggatatatttaatggatacatctatctgtgtttctcgtgacatccattattcggcatctggcatacctacatgctttctgtcctataatactactctatttcttacaacaatgtaagatgtaattgggaagaaagaattcttgattctttgagagtgagtctcctctgtcgcccaggctggagtgcagtggcacaatctcagctcattttgatctctgcctcctgg

SEQ ID NO: 180497 - DNA, 480 bp, Homo sapiens
ccacatagactctgattgttagacaaacacaagacaatcaagctgacaatgctactaattttagaggctaaagctactgggaactcagtgtacttactgaggaatcagatgtcagctcactatcaccacaaagcagatgtcctctggatcctttgaactaaagcttgggttcaacagtccccaatccttctcttgtaaagttcttcctattagttcttaaaggctccagaatatgactgctgctttatatttatctcccaaattaatccatgcagccccttaactgttttcttactcttcaccggatgttcttaaaagctctttgggtattatggtgcactgcatgctcacccggaacccagtctcatttactccctttttgtccattaacaatgagagaatggttagagcattttctcagctttttatgacctattctccatcagccaagattgtcttcagttttaccttctgcagttt

SEQ ID NO: 180498 - DNA, 390 bp, Homo sapiens
tttcacaggacttctttttggagggggattagaagtaaaatagctcagcagcacttcaaagtggggaagtaaagcctccacgtgcgctcgctgcaaagcagcagtcagagtgcctcgccaaggacacagcgtccacacaaaacgcctgtggttctcattgaaaaaggtcttggctttaaaatccacaccaaaagcatggctggaaatgtgtttttctgtccaaagaaaaaggttttatgacaagaactttattaaaataattagaagcgagtctccttgggatgatgtggacagttgaaagcagagggcggccccctcagtcctgcggcccccctcagtcctgtggccccctcagtcctgcttccccactcagtcctgctgcccccctca

SEQ ID NO: 180499 - DNA, 378 bp, Homo sapiens
actaagtttgcaccatctaagaagcaaaagacctaccatggagcaaataagattttacaggacatataaatgcagttcattaattaaataattctaaggagtttaccacatacggtatatacaaagattgatttagtatataattctaaaggaaagcagaaagatatggaagaaaaggaatagaatttggaagcacaaaacccggactcaagtattaagtgtactattgatagttttattttagttatactttggattttagtatatatttaatgtagctcacatttataaaaacctgtatataaaataattcaggcaaagaagtagccatgcaggaaatggaagaatgcccaataagccagaaaagagcaacatggg

SEQ ID NO: 180500 - DNA, 907 bp, Homo sapiens
actaagtttgcaccatctaagaagcaaaagacctaccatggagcaaataagattttacaggacatataaatgcagttcattaattaaataattctaaggagtttaccacatacggtatatacaaagattgatttagtatataattctaaaggaaagcagaaagatatggaagaaaaggaatagaatttggaagcacaaaacccggactcaagtattaagtgtactattgatagttttattttagttatactttggattttagtatatatttaatgtagctcacatttataaaaacctgtatataaaataattcaggcaaagaagtataaagaatagattaaaacaaaaacaaaatccaacatccctcccccatcgagcatcatgagtaaaactttaaaaatctgaatgacaatcacaagtatacccatcccagattgctttcctttttgcttctggcatcagaggtaaccagaatttggatttggtgttcgccagttgcaagtatggttttaaacattttccacatatgtatgcatccatcaattaaataattctaaatacttttatactttctacaaatggcttcctatgtattcttttgtaattttcctatttatttatttatttgacaggtctcactctgtcacccaggctggagtgcagtggtgcgatcctggctcttgacaatctcagcctcctaggctcaagtgatcctcccacctcagcctcccgagtagctggaaccacaggtgtgtgccaccatgccctgctaatttttgtattttttatagagatggggttttgtcatgttgaccaggctggtctggaactcctgggctcaagcaatccgcctgcctcagcctcccaaagtgctgggattacaggtgtgagccactgtgcccagcct

SEQ ID NO: 180501 - DNA, 494 bp, Homo sapiens
tcagaattaaaaaaaacagaaaactcttgaaaccagatgtgctcaaagcacttgccaccactcttattcccactctcttggccaatatcattaattgatcacattagtctttcccactggggccggattcaggcacagaatcttgctcaacgtacagtgttagctatcaactaccaattaacaattgagctaagttgtaactcagtatgaaaatctagttgtcattcttgacatagacgatccctgggtaagaactagagagagagaaaagctacacagtcatgaccttggaaatcctctctgtagattcaagtggtcctatctacaataaaagctgctatttacattcttgctgaggctatttccttctgatatgattttgccttgggaggctcgtgaagcttttctggcaagcattatctgtaatgaccatatgcagggtatacaaaataacagagaaaaaagtttaactttcattatacctagagtaccct

SEQ ID NO: 180502 - DNA, 141 bp, Homo sapiens
tacacatataatatgtgtgtgtatgtatgtgcgtatggtgttttgatgtaaaatttattattgtgggtcatggttaaaaaaaaagcttgagaatgaggagttagatcaagaaatagaaggaaagttgacataagaagttgt

SEQ ID NO: 180503 - DNA, 364 bp, Homo sapiens
ttggctggaacccaggaggcagaggttgcagtgaaccaaggtcaggccaccacactccagcctgggtgacagagcgagactgtctgaaaaaacaaaacaaaacaaaacaaagatgtgaaggggcatgagtaggggttgaccaaagagaggtggcagagccaagcttctaagcagaggagggacacaatcagttttggttggtcaaaaggtcacactgtctactgagtgggcgacaagcttgagacagagacctctaagcagcctggatttgagagaaagttgggagatggtataatcactccagtgtccacactccgggtagtccttccgccccagctgaacctgcagttcattggtccgtcca

SEQ ID NO: 180504 - DNA, 409 bp, Homo sapiens
cccagactgtcaagcccatcctttttggagcacagaacaaagccatgtttgcctaccaaacagaagaaggctctgtatgctaaggtaccttttctttttttaatttttgagacagggtcttactgttttgcccaggctggaatgcagtggcatgatcacggttcactgtagccttgatctcccaggctcaggcaatcctcccacctcagcctcccgagtagctgggaccacagatgcgcaccaacacaccagggtagtttttaacttttttttttttttttttttttttgagacaggatctcactatgctgcccaggctggagtgcagtggcgccatcccggctcaccgcaagctccgcctcccgggttcacgccattctcctgcctcaggttgggcacacattatgga

SEQ ID NO: 180505 - DNA, 434 bp, Homo sapiens
aaagacttctaccatgcagagggtgacctgacttcctgtattgcggttgtaacttaggggagggcctcaggttgtcagaggagacaggaaaagcaggagttgggttataagtgcaatcagatcagatggagaggtggcattaaagtgaatggattttcttttcctgtgtctgtgagtaggagaaatgttttagttatttgctgcatcatggatgtggtagccagggctgtttaattacctgagaagtggggctaattgtatcttgaacagtgagtcactttcctggcataattttctctgtgcccaatcattaccatataaaagttgtcagtgctggccctcaggagtgggatttgaagagggggagttaataggaagctggcaggagctggggctgagtgggagcagagctgatcatagggaggtggggataa

SEQ ID NO: 180506 - DNA, 541 bp, Homo sapiens
tatgaggttggaacggctgtagccatctccatctattgagggaacacgggtttgagaacacagtcaagtcaggacgagaacaagagacgctggatcttgaggacagtgcttgagccctcgaatcaatcaatgtctaaactaatggagggtcgatgaagacatttggccagaggaccctgaaacacctgaatcccacctttggctggctagccccatttctcagcagtgccttcacaggagcgggtaggaatatatccatagaacacatgcagatggataagccaggttctggtctccattccaggagaatgccatttggttgaattttggctacagtgtacggacataaagaatttgggtcattcttatacccaacagaccacatccaggaaatgtattcaagatgctttgatctcatctgaggggtggctaagtacaacccattcttaataaagctatttatagtgagaagcaatttgggtcaggcctgcctttccagtctgcctcattggcaaagtggtaggcccctgacttctgtctc

SEQ ID NO: 180507 - DNA, 428 bp, Homo sapiens
gaatagtagcatgaactgtacccgaacagactcaaataataggttagtatatacagtagagatggggtttcactgtgttggccaggatggtctcgatctcctgacctcatgatccgcccgcctcggcctcccaaagtgctgggattacaggcgtgagtcaccacgccgtgcccagataattcttatggcgtctcaatcagaggctccataaccgagtatgatcagagcaggttttctcccttctttagctttcatctctcttccgtggtcctacaacccagaggaagcagagagtgcagcagcagcaaaacaagttcggtaggtgatgcaagaactgccagaaccctttctccacatctttttgaggaagtgctggtcataatccatcttctgtgactgccttcaatctaggttcacctgcactgcac

SEQ ID NO: 180508 - DNA, 355 bp, Homo sapiens
aggctggtctcaaactcctggtctcaagcaatccacctgccttggcctcccaaagtgctgggattataggcgtgaaccaccacacctggcctccaagtggatcttgagaaataaaatagccaagttaagtagacagggatcaaagtatacttgtattacctctaaagctaggtcagaggacacagcttagttgagaactaaataagcctgtgcctgctacctgctaactgccacagtcaccctctagtccaaatcttggaacagcccctttgaagcaaagttctaacaaatacaaatatccagatggctgcttcccagtggaagagaagagctcactcccttgtccagcacattt

SEQ ID NO: 180509 - DNA, 338 bp, Homo sapiens
atctgaccagctttctgtactattttcatattctttattttatttatctctaatcattttcttccttctactagctttaggtttgtttctcttgtagttccttccctaagttgtaaagtttagttgttgaattgagattttttttttaaattcacatttacatttgtaaacataagttttcatgcataaataaaattttcctctgaacattgttctttctgcattctattttttgttgtattttatctgtaaatattttctaatttcccttgtgatttcatttttgatcctttgactgtttgaatgtgttaatttctacatatttgtgcgttgtccag

SEQ ID NO: 180510 - DNA, 534 bp, Homo sapiens
ggtgtgattatgtacacatacgtagatgtcgccggattcttgtttaagtactacaaaatttgttttcttattagcataacaaaacttttatcatagaatatatctcatcccatctccaaaacaaatatttaatgggaatcgggaagcttggaagaaagacccttagagatcatctgaccagttcctgatgtgacagatataggagggagaaccgagatacccaaagagagtagccaaattgggaccaaagctgatgttctgcttaaaaatacactgttgtctaggcgcgctgtctcatgcctgtaatcccagcactttgggaggctgaggcaggggatcgcttgaggccaggagttcaaaactgccctgggcaacatagcaagcacctgtctctaccaaataaaaattttaaaaattagcctagtgtagtggtgcacaagtgtagtcctagctactctggaggctgacatggaagaattgcttgagcccgggagttcaaaaccagcctgagcagcatagcaagacctcgtctct

SEQ ID NO: 180511 - DNA, 338 bp, Homo sapiens
gttcaatttctacacgtaaagagtgaaacctaggaaaagttacctactgttttacagaagaaataaagacctgcaaaagctgattttggttgtatatattttacacactgtgtggagttgcggcatctgctaattgaagttcaatttctacacactttaacacacaatgttagagagggatctagaaaccagtttaaaaagcacatagagaaagtcatgaagaaacaagtaagctcctattgacctaattattcagaatagggttaacactaaaggatttctctcttgctcaagtgccactgaacttccttgaccacttccttgcaggaaagctccca

SEQ ID NO: 180512 - DNA, 217 bp, Homo sapiens
agcctctaccatggctattagctttgtggggccaggaaggaaagaatttttgcaagatggttcaaccccagccacattctttggtgtccatgtgatctatggtgaactcacattggctcagcacaccaaatagtgggaatacacgtctcctcactgtcccttctcactgctttgtcatcttgctcctgccaatttctccacacccctgcagcactag

SEQ ID NO: 180513 - DNA, 150 bp, Homo sapiens
ggataagtgaccccaaaaaacttttaagaaccactaatctagcctatcaagaaacatcccattttccagaagaatacagctaagttggcttagttcatgcattcttacctcatattcatagagttcatagacgggatccttactacatga

SEQ ID NO: 180514 - DNA, 204 bp, Homo sapiens
cctcagcctccagagtagctaggactacaggtgtgcaccaccatacccagctaatttagaacttacggttttaaagccacaggctagatttcctacatggcctaaacatactccatgtggtactgtctgtctcctgctctttctctttagaaaatttaagattcttatggccgggagaggtggctcacgcctgtaatcccagca

SEQ ID NO: 180515 - DNA, 102 bp, Homo sapiens
ttctttttttttaggtaacatatattggacaagcagaattacagggcatgctaggacctcccaatagcactggacaaagaaaaaagagaggtagggcaaggt

SEQ ID NO: 180516 - DNA, 580 bp, Homo sapiens
ccagaaccctccgcgaacaccttcctcatcaagagaaaactactatgtgccatttggaaaggggccaggcctggcatctccatcttttcctcccagactgtattgcttagaacatttcttcccaagcccagtcactcatggccccctccttgcctctggccatgtctaaggacctttcctattgcagagaggagcttctgtgttgtgcttctgttaggagctctggctcggagctcagactgcataggtttctagcccaaatctactcctgagcccctgtgtgtttttgggcaagttgtttcacctctccaggcctcagtgtcactttccttatctacaaagcagggattggaatagtaccttccttagggggttgctaggaggactgagtgagtcaatacacgaaccgtgttgagagcagtgtgtgacacgtaataagcattcagcaagcattggctatcaaaattagtgattgttgacttagcattttctttaaaactagcccttaaaaatcaagatgagcttaatttagaaaggaaactagtggatagtaagagggaaaaaaagacaagtttaagag

SEQ ID NO: 180517 - DNA, 236 bp, Homo sapiens
gcaaatattacttactaatgaacattgtcataagattatgttccttttttattgtcactaaagttggtagttttttccaattgcagttattcttttcatacattttattggcctctcagcatcatttttcctaatattagggatttttagttacttttattacttagagaaatttttctttgaagtttcatttgagcttcccagataccttgagtttctccttttctttcatactt

SEQ ID NO: 180518 - DNA, 602 bp, Homo sapiens
aatctattgaaaattttactgacacatcatggcataaaattcactgccacattattgatctgctttaaaattcctgttctcctttgggcttttctgacaagcaatcaaattcataaagtaaattattgctaaatcagtctaaaatgtttattcaatatttgctatattcacagcagcaataattaggcaataacatgagatacaaatgagcagatactgttcctttcctcaagcttacagtttaattttgaagacagttacttatgtaaataactacaaagccaagaataaaggccacaagagtgatagcgaattgctctagtagcagtgggtattctagctgagaatatcagagactggcttcattgaaggagtattctgacctgggctgtaaatgacaagcttttaataggtagaagagacatgaaaggtcattcaagctggagggaatggagttaaagatacaagacacagatctgttaaaaaaaaaatgaatgaaatctttgagatcaagatgttttggtgtggttgaagtgtaagcttcatgctgcctggggtcttctaaggctaggtgctatggaaacttctaaaactagggggta

SEQ ID NO: 180519 - DNA, 403 bp, Homo sapiens
tacatattacccaacaacaatgtcaacaacaacaatatatagtagaacatacaccaagctctctgagtatcttcctgaaagctcccctcggctgatgcttccagtaccttctcttttcccctccaccgccattctctatctggctccaacccttcctgtttgctcctgggatggtttgtcacggcgtccagtcctctggctctggttctgtctagcaccaccgggagaagaaagtgtggaggaaataggagctgaggcactggtggttctgaccctgtccccgccaggctctgggttggcagtggcactgttcctgtctgaaagacccagctcctcctggaggcctgtcctcagctgtgtcgccacaggtctgggttccgaaacctccatttctgtttccctc

SEQ ID NO: 180520 - DNA, 253 bp, Homo sapiens
aaagctgatggtgagaatgataatgatggcaagaaatatagtaaagcctgccccacagtaacgagaatctggccaggtggtgattggcaatagactcctatcctctgctaaggccctgttctttcttcattaatcttgcaataacttgaccctgagttttaaagtaataaatattttggacttcacatattgtatgttagggttttatcatatatcaacaatgattatgatgacgtccccctttcctgagtat

SEQ ID NO: 180521 - DNA, 624 bp, Homo sapiens
aatgagtcaagatccaaagtttgaagaaaatgcttatttatttatttaatttgagctagagtctcactttgttgctcaggcgggagtgacggtcggcttcactgcagcctcaacctcccagggtcaatcaattctcctgcctcagccctctgagtagctgggactacaagtgtgcaacaccacgcccagctcattaaaaaaatttttttttgtttagataccaggtcttgttatattgttcaggctacttatttacccactcatttatttatttattattagtgggaataggttgtatggagccatttagtcttttttttttttttttttttgagaccaagtctcacttgcactccagcctgggcaacagagtgagattccgtctcaaacgcctccacaccaaaacaaaacaaaacaaaacaaaacaaacaaaaaaattgatttcctcacagttatggaggttagaagtccaagatcaaagtgtcagcaggtttgaattcttctgaagcccctctctttgttgtgcagatagtctccttttcactgtcattcctctctgtgcacacatcacatacctcgtgtctctttgtgtgaccaattttcctcttcttgtaaggataccag

SEQ ID NO: 180522 - DNA, 1019 bp, Homo sapiens
  misc_feature (3)..(4): n is a, c, g, or t
  misc_feature (792)..(792): n is a, c, g, or t
ggnncggagccccatagcctgcctgtctgcatggtccgcctagaggtttgagcagctgggcatggaagaagcgagccacacccccatcgcatgccctatgaacgggataagggaactttttcgcttcaccactatgcctgactaattttttaattaaaaaaaatttttttgtagaaacagagtttcaccatgttgcttaggctggtctcaaactcctggcctcaagtgatcctccctcctcggcctcccaaagtgctgggattacaggcaccgagaagagctcggaaaagagcagaaggcaccgccagctccaacgtcttctccatgtttgatcagtcccagatccaggagtttaaagagagtctggctctgtcgcccaggctggagcgcaatggcatgatctcggctcactgcaacctctgcctcacgggttcaagcaattctcctgcctcagcctcccaagctttcaccatcatggaccagaaccgtgatggcttcatcgacaaagaggacttgagggacacctttgccgcgctgggccgcatcaatgtcaagaacgaggaactggaggccatggtgaaggaggcccccggacccatcaacttcacggtgttcctgaccatgtttggggagaagctgaagggcacggacccagaggagaccattctccacgccttcaaagtgttcgacactgaagggaaaggtttcgtcaaggccgatgtcatcaaagaaaaacttatgacccaggcagaccgcttcagtgaggaggaggtcaagcagatgtttgcagcntttcccccagatgtgtgcggcaacctggactacagaaacctgtgctacgtcatcactcacggtgaagagaaggattaggggatcacaagtctccccgacattcaggggcagcaaacactgttgtggggtgtgacagggagctcttgcagccagaggctgcaggaaaaaggcttcccttgtcctacggttggggacaaagcaagaataaataatgctaatgaggtctg

SEQ ID NO: 180523 - DNA, 582 bp, Homo sapiens
ggagtcatcaaaggctgagcatttgctggaccccaacagtactgcagtacaggtgagacaaaagccagtcctttaggtagcaccgtagaggttgtaatgttcgacatgtggttcaactcttttctctccagggaaaagctgagaagtgggttttcgtttttgttttatctgcttactctatgctggaccaggcagaggagttgtaatgagtgcctgcttgctgattcaaactgccacctttgttctctgtagccccaggtgtctggcataaggcaggtcccatcagcactctgagacaagtggaatagaagcttttcctttgggcagcacccagaaaagttgaaatattggatgtgtggttcaaatctgcccctcctcctgaagaaactgggagctaggagacatctctcaatcagatagtgctgtgctgggggtaggggttatagaagaggtttgcctccaattttcccaccagttttaatttggctggttttacacttccaaagggtgcaggagcctctaaactagttcctggaattttacaaagggaattaattcatttattgctgttgaatcaatgta

SEQ ID NO: 180524 - DNA, 519 bp, Homo sapiens
tgggaggtaggaggtaggaggtccaagaggcccttgtgcaaagtcagggcagaactgatgtcatgtctggctgggaatctgacatccaggctgcaggaaggctcagctcatgattgtcctaaagcagttagagctggcatgtgagatccgaggctggtggtaggaaaggccatgatgcccaacctcttctgatgtttggcttctctctatggtgtctgtactaagcttacatacctctggtgatgaggagctcactacagatgttccttaagttacttcctgataaactcatcgtcaatggaaaatattgtaagttgaatgtgctttttctgtttattttttgagacagagttttgccctgttgcccaggctggggtgcagtggtgcaatctcagttcactgcaacctccacctcccaggttcaagcaattttcatgtctcagcctcccgagtagctgggatcacaggcgtgcgccagtacgcccggctaatttttgtaattttttttttttttttagt

SEQ ID NO: 180525 - DNA, 482 bp, Homo sapiens
agcacccatggctgctaggagaggaggaaggacgtgcagggacccacaatgcagtgaaagagggatgctgtttcaggaaaaaagcaagatgttggtgagagcacgtggtggatcctgaagtctctcttggccaagttagaaacgagtggacttgccactgcttgtgttggaagagctggtggagacgatgagcagccatccttgggcttcattttcttctgcctcgaggcaccactcgaggtgaggggtcctggttttgcctggccgttcctccccatcgtctgtgtccactcccggcccacttcccactctgcgtttcctctctgcgtttcaaacgcagagaggaagatagaaaagagagcttagtgtggggaaaaaaggaaatgattaacatcacgagaaggcaccagagttgaaaataaggccacgattgaaagagggaaacttcctctgaaagagtcgctgtttgcttaggagagatg

SEQ ID NO: 180526 - DNA, 393 bp, Homo sapiens
ctgaggacccggtctgtttcctgcacttctgtatcaggttgctcggagtaataaattagaaaactgtgtgaaagtgcctattttagaatttggcattttctagtttgtgaccttggacaagttatgtaagctatcatttccacatttctctatcttatttcacaaggtgttgtaataaagattatttaagcaaatatatttttactaattatgaaaaggaatggccgggcacggtggctcacgcctgtaatcccagcactttgggaggccaaggcgggcagatcacgaggtcaggagatccagaccatcctggctaacacggtgaaaccccgtctctactaaaaatacaaaaaattagctgggtgtgatggcaggcacctgcagtcccagctg

SEQ ID NO: 180527 - DNA, 341 bp, Homo sapiens
ctctattctgtgtgtagtaaaatctccctctgctactctcttcagaacacttgtgattacactgggccctggataatgcaggataacctccccatctcaaagtccttaacttatcatatctgcaaagaccctttaacatatacggtaacgtaggttcagaaatgagcatctgatatatctatgggagacattttttagcctaccactctgggggtaaaacaatcttttttttttttttttttaagacacaaagtcttactatgttgcccaggctagattcaaattcttgggctcaagcaatcctcttacttcagcctccctaggagctgcgactaccacag

SEQ ID NO: 180528 - DNA, 1493 bp, Homo sapiens
tccccactgctcagcactaggccggcagaatctgagcgatgtcttccacactccctgccctgctctgcgtcgggctgtgtctgagtcagaggatcagcgcccagcagcagactctcccaaaaccgttcatctgggccgagccccatttcatggttccaaaggaaaagcaagtgaccatctgttgccagggaaattatggggctgttgaataccagctgcactttgaaggaagcctttttgccgtggacagaccaaaaccccctgagcggattaacaaagtcaaattctacatcccggacatgaactcccgcatggcagggcaatacagctgcatctatcgggttggggagctctggtcagagcccagcaacttgctggatctggtggtaacagaaatgtatgacacacccaccctctcggttcatcctggacccgaagtgatctcgggagagaaggtgaccttctactgccgtctagacactgcaacaagcatgttcttactgctcaaggagggaagatccagccacgtacagcgcggatacgggaaggtccaggcggagttccccctgggccctgtgaccacagcccaccgagggacataccgatgttttggctcctataacaaccatgcctggtctttccccagtgagccagtgaagctcctggtcacaggcgacattgagaacaccagccttgcacctgaagaccccacctttcctgcagacacttggggcacctaccttttaaccacagagacgggactccagaaagaccatgccctctgggatcacactgcccagaatctccttcggatgggcctggcctttctagtcctggtggctctagtgtggttcctggttgaagactggctcagcaggaagaggactagagagcgagccagcagagcttccacttgggaaggcaggagaaggctgaacacacagactctttgaagaatgaccatgagacacagtggccatgggtggatctgaaagctggtgttgagcctgggcggcgtgagctctgtgttggacccacggaggagggagtcactgcagggaaagagggacactggcattccatttgtcagagcatcccggacgatgcagagggtgggagaactacatgctaaatttctttttttttttttttgagcctgggcgacagagcgagactccatctcaaaaaaaaaaaaaaaaaaaaaaaccacataggctcagtcttttcagtatctgctttactggttcagtaaaagccaggaaacacaactttgtggtaatctgaatgttattgaactgtattttgttcactttattgtaaatactggtgaacagtgaataaatggttgtatattcctaataagaaaaaaaaaaaaaaagacccaaagtacagcgagctgatgccgatctcatttcgcagaggtccgcctgctctcccctctccaagagtgtaatcctctgcttaataaacttatgccgctttgctatatgtgt

SEQ ID NO: 180529 - DNA, 1442 bp, Homo sapiens
tccccactgctcagcactaggccggcagaatctgagcgatgtcttccacactccctgccctgctctgcgtcgggctgtgtctgagtcagaggatcagcgcccagcagcagactctcccaaaaccgttcatctgggccgagccccatttcatggttccaaaggaaaagcaagtgaccatctgttgccagggaaattatggggctgttgaataccagctgcactttgaaggaagcctttttgccgtggacagaccaaaaccccctgagcggattaacaaagtcaaattctacatcccggacatgaactcccgcatggcagggcaatacagctgcatctatcgggttggggagctctggtcagagcccagcaacttgctggatctggtggtaacagaaatgtatgacacacccaccctctcggttcatcctggacccgaagtgatctcgggagagaaggtgaccttctactgccgtctagacactgcaacaagcatgttcttactgctcaaggagggaagatccagccacgtacagcgcggatacgggaaggtccaggcggagttccccctgggccctgtgaccacagcccaccgagggacataccgatgttttggctcctataacaaccatgcctggtctttccccagtgagccagtgaagctcctggtcacaggcgacattgagaacaccagccttgcacctgaagaccccacctttcctgaccatgccctctgggatcacactgcccagaatctccttcggatgggcctggcctttctagtcctggtggctctagtgtggttcctggttgaagactggctcagcaggaagaggactagagagcgagccagcagagcttccacttgggaaggcaggagaaggctgaacacacagactctttgaagaatgaccatgagacacagtggccatgggtggatctgaaagctggtgttgagcctgggcggcgtgagctctgtgttggacccacggaggagggagtcactgcagggaaagagggacactggcattccatttgtcagagcatcccggacgatgcagagggtgggagaactacatgctaaatttctttttttttttttttgagcctgggcgacagagcgagactccatctcaaaaaaaaaaaaaaaaaaaaaaaccacataggctcagtcttttcagtatctgctttactggttcagtaaaagccaggaaacacaactttgtggtaatctgaatgttattgaactgtattttgttcactttattgtaaatactggtgaacagtgaataaatggttgtatattcctaataagaaaaaaaaaaaaaaagacccaaagtacagcgagctgatgccgatctcatttcgcagaggtccgcctgctctcccctctccaagagtgtaatcctctgcttaataaacttatgccgctttgctatatgtgt

SEQ ID NO: 180530 - DNA, 1157 bp, Homo sapiens
tccccactgctcagcactaggccggcagaatctgagcgatgtcttccacactccctgccctgctctgcgtcgggctgtgtctgagtcagaggatcagcgcccagcagcaaatgtatgacacacccaccctctcggttcatcctggacccgaagtgatctcgggagagaaggtgaccttctactgccgtctagacactgcaacaagcatgttcttactgctcaaggagggaagatccagccacgtacagcgcggatacgggaaggtccaggcggagttccccctgggccctgtgaccacagcccaccgagggacataccgatgttttggctcctataacaaccatgcctggtctttccccagtgagccagtgaagctcctggtcacaggcgacattgagaacaccagccttgcacctgaagaccccacctttcctgaccatgccctctgggatcacactgcccagaatctccttcggatgggcctggcctttctagtcctggtggctctagtgtggttcctggttgaagactggctcagcaggaagaggactagagagcgagccagcagagcttccacttgggaaggcaggagaaggctgaacacacagactctttgaagaatgaccatgagacacagtggccatgggtggatctgaaagctggtgttgagcctgggcggcgtgagctctgtgttggacccacggaggagggagtcactgcagggaaagagggacactggcattccatttgtcagagcatcccggacgatgcagagggtgggagaactacatgctaaatttctttttttttttttttgagcctgggcgacagagcgagactccatctcaaaaaaaaaaaaaaaaaaaaaaaccacataggctcagtcttttcagtatctgctttactggttcagtaaaagccaggaaacacaactttgtggtaatctgaatgttattgaactgtattttgttcactttattgtaaatactggtgaacagtgaataaatggttgtatattcctaataagaaaaaaaaaaaaaaagacccaaagtacagcgagctgatgccgatctcatttcgcagaggtccgcctgctctcccctctccaagagtgtaatcctctgcttaataaacttatgccgctttgctatatgtgt

SEQ ID NO: 180531 - DNA, 325 bp, Homo sapiens
agaacaccagccttgcacctgaagaccccacctttcctggtgagtaactggtccttctaagctcagacgagcgatcagagcctcccagtgacactaaaaacgtggcattcattcaaaatattcatcgaggccaggcgtggtggctcacgcctgtaatcccagcactttgggaggccgagatggtgcatcatttgaggtcaggagtttgagaccagcctggccaacatggcgaaaccctgtctctactaaaaatacaaaacttaggctgggcatcatggctcacacctgtaatcccaacacttcgggaggccaaggtggttggatc

SEQ ID NO: 180532 - DNA, 1208 bp, Homo sapiens
tccccactgctcagcactaggccggcagaatctgagcgatgtcttccacactccctgccctgctctgcgtcgggctgtgtctgagtcagaggatcagcgcccagcagcaaatgtatgacacacccaccctctcggttcatcctggacccgaagtgatctcgggagagaaggtgaccttctactgccgtctagacactgcaacaagcatgttcttactgctcaaggagggaagatccagccacgtacagcgcggatacgggaaggtccaggcggagttccccctgggccctgtgaccacagcccaccgagggacataccgatgttttggctcctataacaaccatgcctggtctttccccagtgagccagtgaagctcctggtcacaggcgacattgagaacaccagccttgcacctgaagaccccacctttcctgcagacacttggggcacctaccttttaaccacagagacgggactccagaaagaccatgccctctgggatcacactgcccagaatctccttcggatgggcctggcctttctagtcctggtggctctagtgtggttcctggttgaagactggctcagcaggaagaggactagagagcgagccagcagagcttccacttgggaaggcaggagaaggctgaacacacagactctttgaagaatgaccatgagacacagtggccatgggtggatctgaaagctggtgttgagcctgggcggcgtgagctctgtgttggacccacggaggagggagtcactgcagggaaagagggacactggcattccatttgtcagagcatcccggacgatgcagagggtgggagaactacatgctaaatttctttttttttttttttgagcctgggcgacagagcgagactccatctcaaaaaaaaaaaaaaaaaaaaaaaccacataggctcagtcttttcagtatctgctttactggttcagtaaaagccaggaaacacaactttgtggtaatctgaatgttattgaactgtattttgttcactttattgtaaatactggtgaacagtgaataaatggttgtatattcctaataagaaaaaaaaaaaaaaagacccaaagtacagcgagctgatgccgatctcatttcgcagaggtccgcctgctctcccctctccaagagtgtaatcctctgcttaataaacttatgccgctttgctatatgtgt

SEQ ID NO: 180533 - DNA, 1345 bp, Homo sapiens
tccccactgctcagcactaggccggcagaatctgagcgatgtcttccacactccctgccctgctctgcgtcgggctgtgtctgagtcagaggatcagcgcccagcagcagactctcccaaaaccgttcatctgggccgagccccatttcatggttccaaaggaaaagcaagtgaccatctgttgccagggaaattatggggctgttgaataccagctgcactttgaaggaagcctttttgccgtggacagaccaaaaccccctgagcggattaacaaagtcaaattctacatcccggacatgaactcccgcatggcagggcaatacagctgcatctatcgggttggggagctctggtcagagcccagcaacttgctggatctggtggtaacagaaatgtatgacacacccaccctctcggttcatcctggacccgaagtgatctcgggagagaaggtgaccttctactgccgtctagacactgcaacaagcatgttcttactgctcaaggagggaagatccagccacgtacagcgcggatacgggaaggtccaggcggagttccccctgggccctgtgaccacagcccaccgagggacataccgatgttttggctcctataacaaccatgcctggtctttccccagtgagccagtgaagctcctggtcacaggcgacattgagaacaccagccttgcacctgaagaccccacctttcctgcagacacttggggcacctaccttttaaccacagagacgggactccagaaagaccatgccctctgggatcacactgcccagaatctccttcggatgggcctggcctttctagtcctggtggctctagtgtggttcctggttgaagactggctcagcaggaagaggactagagagcgagccagcagagcttccacttgggaaggcaggagaaggctgaacacacagactctttgaagaatgaccatgagacacagtggccatgggtggatctgaaagctggtgttgagccctgggcgacagagcgagactccatctcaaaaaaaaaaaaaaaaaaaaaaaccacataggctcagtcttttcagtatctgctttactggttcagtaaaagccaggaaacacaactttgtggtaatctgaatgttattgaactgtattttgttcactttattgtaaatactggtgaacagtgaataaatggttgtatattcctaataagaaaaaaaaaaaaaaagacccaaagtacagcgagctgatgccgatctcatttcgcagaggtccgcctgctctcccctctccaagagtgtaatcctctgcttaataaacttatgccgctttgctatatgtgt

SEQ ID NO: 180534 - DNA, 547 bp, Homo sapiens
tcacttcactgtttgctttttggcctgaggcagagagtgcctcccatggcagctcgtacaggatgaaccaagaggcagcacccaggatatctgaattgcctaaagccactgcagtgatgtacacacatagcgaagctttatttctttacagccatagacttgttgaaaagctgaatcacatactttgcttgatatttgactttgtggttaccaattccaggtgagccaccttcgagaggggtaacatcctgttgtcggaaaggtgcagccgggcagcagggaacctgggttccactttagccctgacatagaaggttttggttcatgtccctttggtctggtaggcccctttttggtgcttgtttacggaactgatttatcttgtttataatgttggtagacgggtgtatataccaagacctctggtttactgaaggtagggccaagagctttccagcagtctgttgagtggagctacgggtcagtcagcacacctggcccagagcaccgtgagctggtgaacctacttgtcccaggtgttgtagtg

SEQ ID NO: 180535 - DNA, 255 bp, Homo sapiens
ggttaactaataggacatctgagaataggccagaagtgatgagacagaattctagggcacagccaggataagcgtacttatgcacagactgaaacaaggccatcttttccactgagcaggggcaggaaagaggtatggttgggtaagtcgctcttaggttgcaaagcagaagttgtgagctgatctcctccacccataccacacagttcgcaagaacccagtaccttgtatcgtcgatcgcgtattaacaggttc

SEQ ID NO: 180536 - DNA, 268 bp, Homo sapiens
ggtcttgaggaactcgcctggcccggggagaggtgtcggcgctcattgcagagacttatcttgttccctcccttcttctctgccgttgtagttttacaggggcaagtcctgtccaacgtgtacggtgaggccccggccactgctttaatgagcagtaggtgtagggacggaacaatttcgtgacctcgaatctcttgcacttctatacctctctgtctccgtgtccataacacttgctggtcacccttcaaaagtctccagtccctga

SEQ ID NO: 180537 - DNA, 624 bp, Homo sapiens
attgtcactattctaaaaatttcttcctattttttttgttaataatctgttctaaaataacgcttaggataaaattgaaacttttcatgtctatggtttccatactccatatttttactgatttgaaaattgtctatccacagcctttgacacttctttggtttcccttaatttttcagtgattatgaagaataatttcacgtccatcctttatattctttaaggccctgggatgtagtttccttggatctggaaatttgagctcaggtaaaattgccagctgggatctcgttactcttgagcccttcttcctaatctgtggcttttccccatatataatattaaagcaagaaagatatttaggtggactttaaggaagaaatttcaactttcctacaagtaaaatgttgagaacagcttgggagtaggctgggaaggctgtctccaaacttttgagttttcattgggactctctcagtacttgaggctggcgtgtgcatcagattgtcttccaagagtatttccagatctaagactctctaattttattggcaaagcatatcttttagttggaggcccaaatggtaatttttaagaacttcttggataaacatgttcttatca

SEQ ID NO: 180538 - DNA, 680 bp, Homo sapiens
gactaagacaaactaagtaatggctatgtgaacaacaaaagcaaatataaaacgtggaataagctggggtttaatttggagcactatgaccttgggtgtgatattgactccttctgagcttcaattttattctttgtaaaatggaatcaaatgatcgtgaaggtctgcctaagtgtatgtaaagtgcttagcatataaaatacatggcacttaaaaagtattagccaaatgatgatcatttccttaaacctctgtaaaattaactactaaatgctggtactttaagaaaaatcatgttggtgctttcagaaaaagcaaaataatggtaatttttatttgttagaaaaattaatgagcagatgtacttgagtcatttcctcccttcattctagggcttcagagaattccagatgatgaaagctacagcttacttcttactttttgcctgttgattttctatggccagaacaaaccagagcagtcatgagccacccctttgttagtgctttttatctgtctccttcttctagtctaaaatatactttctcataataatgcagaatgtaaccgcgattcacaatcctgtttagctgcttggccaagacattcaccttgcacataggagccagctctaagtcaccactgcttcttcacctcatgatctggctgagggcaaagca

SEQ ID NO: 180539 - DNA, 410 bp, Homo sapiens
tgtttactagatgccagacacttttctatgggcttatcttttcaatcctgttcaaaaccccatggtaggtatccttcctctactaaggatgactctggccataaaagttaaataacttacagaggtcacacagctagtacaagtccaacctgtgattcaaacttatcagtttggttccaaaatcattgctcttaactaccaaactataaagtaatggaaaatgttctctgtgcttgatactggatacagcaaagtgggagagatttatgttttgttgctaaacaagcatcaatttttactatttatagctgtaaagattacaacaacatcacacaaagctttcccctccatgtatcattggcttgggtcacccattagaaacatgagttctgccagtaactctggtgcat

SEQ ID NO: 180540 - DNA, 1039 bp, Homo sapiens
ggacagcagttttgttggaacacagccatgctcatttgtttagttattgtttagggttgttttcacactatggtggcagagctaagtagttgtaacagactctctgcaaagtctcaaatatttactttctggccctttgcagaaaaaaatttgctgacttctgctccagatacctgtgcagggcttccttttttttttttgagatggagtcttgctctctcgccaggctgaagtgcagttggcgaaatcttggctcactgcaaccttcgcctcccagattcactccttcctcagcctcccgagtagctgggactacaggtgtgcaccaccacgcccagctaatttttgtatttttagtagaggtggggtttcattcaccatgttggccgggatggtctcaatctcttcacctcatgatctgtccacctcagcctcccaaagtgctgggattacaggcgtgagccactgcgcccagcagcttcatttaattgaattgtacaaaaacagttatgttcagttgcaggtttttattttatttggtcaaaatactgaaatatgcttactttatccggacttaacaccgtcaaaaaatgttaatcacttttacgtgcagcacccacagcacatgaaaactggcagttaattgattagaaggagctgggtggcaggatgtggatctggactgtctggcttcaaaccttgctctgcatagatttggtgaccgaaacgttttgtgacctctgtgccttgctttccgtacctgtaaaatgggagtaataataaaatctcccacataaggctgttgtagggtgaaaccaaataaagaatgcagcaagtaaacagtaagtatgagtcattattaccatgcaggtgtgtaagtgcttcccatatttccgagttattttccaaaaattccactgtaaacttgtttattggaaattaagtcttcatttccgctgaatgtagtagttgtacaaattatattttgaaatgttcttggaatgtgggctggacttactgcattataaagatggaaata

SEQ ID NO: 180541 - DNA, 1093 bp, Homo sapiens
ggacagcagttttgttggaacacagccatgctcatttgtttagttattgtttagggttgttttcacactatggtggcagagctaagtagttgtaacagactctctgcaaagtctcaaatatttactttctggccctttgcagaaaaaaatttgctgacttctgctccagatacctgtgcagggcttccttttttttttttgagatggagtcttgctctctcgccaggctgaagtgcagttggcgaaatcttggctcactgcaaccttcgcctcccagattcactccttcctcagcctcccgagtagctgggactacaggtgtgcaccaccacgcccagctaatttttgtatttttagtagaggtggggtttcattcaccatgttggccgggatggtctcaatctcttcacctcatgatctgtccacctcagcctcccaaagtgctgggattacaggcgtgagccactgcgcccagcagcttcatttaattgaattgtacaaaaacagttatgttcagttgcaggtttttattttatttggtcaaaatactgaaatatgcttactttatccggacttaacaccgtcaaaaaatgttaatcacttttacgtgcagcacccacagcacatgaaaactggcagttaattgattagaaggagctgggtggcaggatgtggatctggactgtctggcttcaaaccttgctctgcatagatttggtgaccgaaacgttttgtgacctctgtgccttgctttccgtacctgtaaaatgggagtaataataaaatctcccacataaggctgttgtagggtgaaaccaaataaagaatgcagcaagtaaacagtaagtatgagtcattattaccatgcaggtgtgtaagtgcttcccatatttccgagttattttccaaaaattccactgtaaacttgtttattggaaattaaaatgcattttgccacagaaaccgttataaatggagtattgacaagcccatagaagtcttcatttccgctgaatgtagtagttgtacaaattatattttgaaatgttcttggaatgtgggctggacttactgcattataaagatggaaata

SEQ ID NO: 180542 - DNA, 527 bp, Homo sapiens
ctctagagtatccccacgttgacacttcagtctccttccagaatgttatctccttgaaaaggccttttgtcttgttcagtgcctatccacaccacctagaacgaggtgcacactatttgcagtgcacactattttgaaaggatgaatgaaattgaccctctctaaccccataactagatatgaatttagagccaaatgtattatggggtttcttcccaccggttttgttctcatccctatcacataagaagactgaagtgttagaacatcttgtaaaaattaaccacagctgtgagccatttaaaacactctacgcagtgagttaggaaatgcccattgattgttggtttgttaggtaaatgggagagcaccacactcagtgcacaccgggtctcctgtgtgccaagcatgcacggcaggccctggcgatcagaggaggggcagggagtggggcctccttctaggatcttcacactgccttgctgttgaccccctggttgtggtggcatcccgcagcaaacccagga

SEQ ID NO: 180543 - DNA, 459 bp, Homo sapiens
gcaatggcatggccatagttcattgcagcctcacactcctgggctcaagtgattctcccacctcagccttgggagtagctgggactacaggtgcatgccaccatgcctggctaatatatttttagtttttgtagagacggggtttcactttgttgcccaggttggtcttgaagtcctgggcttgagcaatcctctcaccttgccttccaaagtgctgggattacaggcatgagccatcgcgcccaatctatactcatatctataaagttttccaacttcacttttatcatgaacatctcttctgtcataaatttatgcttacaccataatttttacgtactacatggtattacattatgaatttaatgaaaccttgacctttagggttttttgaagtgtttactgttttatgagatgtttaatgaaacattaacctcacatgcagatacagattgagag

SEQ ID NO: 180544 - DNA, 403 bp, Homo sapiens
ctacagtgagcagtgtaggtcaaggcgacactgaactccatcctgggcaacagactgaaactcttgtttcaaaaaaaattaaattaaataaaaaagaaaaagaagaataaagtaggaagactcatacttctcaatctcatcaagaaagaaagtgaaaagacaacccacaggagaaaaattttgcaaacaatatctgataacagattgcatcaaacatatattaatatgaagaactattacaactcgagtattagtaaactaaataaaaagacaacctaattattaaaaactgggcaaatgggctgaatagacatttctctcttttactttatttctttctttcttttgagacagtcttactctagcctgggggacagagtgagaccttgtctctaaaagatta

SEQ ID NO: 180545 - DNA, 370 bp, Homo sapiens
tcttttccctcaagaggtttgtattttacgtattcctttgtagatgtagcttcacctttggattacttaggcttctgttttgtaaatttgacttccatattcatgtatttctctctgaattgtttttgcttgcctttcttcctgaagaaggcttacagtttagctgaaaggaatcaccatcactcttctgaaggtttccttaactctgcttcatcttaacccctttcccagtaccttatcctctctccagaaaaagtcatttcactttctctaatgagctcttggaacacagatttggtaaatatattaatcattctatgctctaatgtatttgcttatgtgtctaccctctaagctttactcaggttac

SEQ ID NO: 180546 - DNA, 238 bp, Homo sapiens
ggagagttcggaggatagaagtcatcagagcacaatgaagccagaccctgcagccgccttccccttcgggggcttccttagaatgcagcattgcggggactgagctgtcccaggtgaaggggggccgtcacggtgtgtggacgcccctcggctcagccctctaagagactcggcagccaggatgggctcaaggcatgagccctcaaaggaggttaggaaggagcgagggagaaaagat

SEQ ID NO: 180547 - DNA, 229 bp, Homo sapiens
cagcatcctggggtcaccaccaaccataggaaagcaataacaagtaaaatgtgggcctctttgatgagaacttcatggtccacagaggatacatgggcataaggggatggaggcagaatgttctcagtaccacgagaaacacatgagcacagtgttccaagggtttgaatggagacagacactggtgtcctgcagggaagacttcgggaggtgatgttggataggacct

SEQ ID NO: 180548 - DNA, 727 bp, Homo sapiens
ccccgaacatgtcgcggctgtttctattgcaaaagaaagccaacattcacctcctttactttttcctaagagcaaattctattgaccaaaattcactaaaaactggaaattaaaactgcaatttttaaaaatttattacatacgaacatctcaagcccagtcaatgtaccccccgctaactggctgggcacagtggctcatgcctgtaatccagcactttggcaggctgaggcagatggatcatttgaggtcaggagtttgagaccagcctggtcaacgtggtgaaaccctgtctctattaaaaatacaaaaattagctgggtgtggttgcacacactagtcccagcctacctgggaggcaggaggattgcttgagcccaggaggcggaggttgtagtgagctgagattatgccactgcacttagcccgggcaacagagtatagatttcataataaagattcctcagactgtgcaaaacaaaatgtagatttttaactcttctcagttagtactctttctccttgaggaaaccaagtgggagaagacatagagacaaataatattcagaattaataaaggtgtagcactaagtcgattgtttcctgtacttaaatggttatataataggaaaaagacatatgttcatataaactctcagggatttatttttaaagagcaatctcttctgtgtgacctgtgatcagtagacgttaaactcaatctctt

SEQ ID NO: 180549 - DNA, 133 bp, Homo sapiens
tcgtgtctatagtccataaatatatgaggtagagaactgccgggttaaaaataaaataataccatgactcttgttattgctgcaactcttccaaaacttcctgccacacacacacacattcacactggattca

SEQ ID NO: 180550 - DNA, 647 bp, Homo sapiens
ttttgctagtatccattttggtgatacctgtgagtgtcttggtgacctaagctgcaggagcatgtgcaatttgtttttctgctcaggattgggggctgggggagaaggtggcggtgtcaggaagctgcatgactatctagtgaatgtgttactgagtcacaggggttggttcaccagtttgagatgggactcctctggaaacactcgcctggctgtggattactggggctgctctgcaggtttgagatggggatcacctagaaacaccaggcccagttggtgagcacactgatggcacaataaatcagtaatcagtccacagttagagtgttgcagtcactaggatgtggaaggcaaacctctttgagagtttgtttctaggatatagacagcagcagctgctttcctggagaaggctgttgtaatgacagggtagcctctgggatggaaggaggcagtgaccactagttcatggagcagaatatactcagctatggcttggctttctagatggtgctatatgtggactccttctctggggcagtatagccttgtgggcatcaagcagcttcctaaactaggctgctagagatggggtttcaccgtgttggtcaggctggtctcaaactcctgacctctggtgatct

SEQ ID NO: 180551 - DNA, 324 bp, Homo sapiens
tggtgctaggctgtagaccacacttagcaaggcagtagaggatgtttgttcttcaataaatggggtctgtctaaagagcctactagagaccagaaggatttggccagagttttgcagtaaggcagaatgtggtttggtgaaagaaagggccttaagggacaaaatgagcagcctgcctacagatgcagagatcatagggtttatgatattttggggggacaggagacctgtttgtggggatacgttagtgagtccctgagtcttttgaacctaaaaaaaatgtagcagtcaacttctcataatttttcatctttgcaaaatgtt

SEQ ID NO: 180552 - DNA, 336 bp, Homo sapiens
ggattgacaacagtatatgcaaatacttcaaatatatacgtatcacaagtttgtgcttgtgactgagaatctaaaatggcctccagtgatccctgcctgtctccaggcattcatgcccttgtgtaattgcctcccctagaaggtaggcaagacctgtgacttgcttctagtcaatagaagatggtaaaggtgatgaccatctctcctatgtttacattatataggacagcaacttccatctcactatcagactcgattgcctctctctccctttatggctttgatgaagtgagtgatcatacagagaggcccacgtggcaagcaactgagggtggt

SEQ ID NO: 180553 - DNA, 281 bp, Homo sapiens
gactggaaatcctatgatctgcttgaaattccatccagagatacggtggaaggtggggaacaatccacaaagcaaatttacttggagaggggtgagaaagaaataataaagttactttctgctcctcttcatagaaagtctagcttgtggccgggcacagtgctcatgcctataatcccagcactttgagaggccgaggcaggcagatcacctgagaggtcagaagttcgagactagcatggccaacatggtgaaacctcgtctctactaaaaatacaaaa

SEQ ID NO: 180554 - DNA, 352 bp, Homo sapiens
tagaaatgcctactaaaaataaataatgtaagtactaaagttgccttatatgtttaaactgtatatttagaaatcacagcattttcaaacttatgggtcttggcagttattggttcattttactctctttaggatttctttttcctaattgatgttaattagttgatataaatgaaaattttgagtcaggaaatcaattcaaataggtgtgaataaattaaaaaaaaaaaaagaaagaaaagaaaacttgactcggccgggctgatcttgaactcctgacctcaagtgatccacccacctcggcctcccgaagtgctgggattacaggtgtgagccaccgcacccggccaca

SEQ ID NO: 180555 - DNA, 203 bp, Homo sapiens
cgctagcagtgggccctgggcagctcagccctctcacctcaccctgggaacttctcagcatcaaatggggtcacatcactgaaagcatcagacatacagtaagtgcccagtgaactttcacttccctcctttcccttgaggaaggtcctccgtggcagtgacggtgtgggaccagagggtacagaactgggcagggctgagaa

SEQ ID NO: 180556 - DNA, 508 bp, Homo sapiens
caggaagatagcttgaggccaggagtttgagaccagcctggtcaacatagtgagaccccatctctacaaaacctaaaacaaaaaatttagctgagcacggtggtgccacctgtactcccagctacttgagaggataaggtaggaggatcgctcgagcctaggagttagaggctgcagtgagctatgatcacaccactgcgcccagtctgatagttttctaaatcatgaataggtggtaaactttgtcaaattttttgcttttgttgagataaatcatatggttgtatccttaattctgtgatgtggtgaattacattgattgatttttaaatgttaaaccaactttatactcctaggataaacgttactttgtcataatgtattgtcccttttatgtaccattagattcaatttgttaatattctctttagaatttttacatctattcatgaaagatattggcctgtaatagtcctttattataatatttttgtcagattttgttatc

SEQ ID NO: 180557 - DNA, 420 bp, Homo sapiens
tatagagagagggccttgctctgttgcccagactggccttgaactcctggctcaaatgatattcccacctcggcctcccaaagtgctgggattacaggtgtgagccactgcgcccagtctgatagttttctaaatcatgaataggtggtaaactttgtcaaattttttgcttttgttgagataaatcatatggttgtatccttaattctgtgatgtggtgaattacattgattgatttttaaatgttaaaccaactttatactcctaggataaacgttactttgtcataatgtattgtcccttttatgtaccattagattcaatttgttaatattctctttagaatttttacatctattcatgaaagatattggcctgtaatagtcctttattataatatttttgtcagattttgttatc

SEQ ID NO: 180558 - DNA, 272 bp, Homo sapiens
gattagtgaaagtatagtgtatggataaggcaggttctaccctgtcagacctcaactgcaattcagttctgaaactcttgttttaaaggaatatctacaaacaggagcccgtgctcaggagaccagtaatgctgatatgaaggctataacattcatgacattttaggaatggttgagtatctgaaccattttaacctaaaaaagaagacttaaaggagaatataataatgactttcagatacttaggtgactgacatatgaaagagggactc

SEQ ID NO: 180559 - DNA, 504 bp, Homo sapiens
tctagggtgtctagattgtgaccaaaaccggtgaagcctttgtgttttctgatgctgttttaaagcttattataattttcccttctatggggaaagattctgtgctgttttctcttaaagtgaaatgtatgttgttgtgtgtttttaaatagatgtagtttattttacagtccaaacctgttgtttcatctattcccataagatccacaggcagcatccttctccatttggatggggacagtgaggtttatataccttgattggtaagcctgtgtctgatgttttaagtgccttatcccttaaattgtaaactctacaggacttagaccatgtgtgtcttgttcactgtattgttaacagctggcagatagtaaagatttttttttttttttttttttttttaaataagagtgattaaatcagtttgttttgtgatgcttgtgtgaagagaagtgattagtgtaaactggctttgctttagggttttcattctctaaattcttg

SEQ ID NO: 180560 - DNA, 507 bp, Homo sapiens
tcagattcttgaactccatcccaggaaatgctgattcagcaggtttgaaataggacccaaggatgcagtttataaataggacccaagaatacagatctgtggatctcacccattagaattcacattcagctctccgggtgattctaatgggtaagatccacagacaatactaggagagacatcatcttcaattaaaacaactaaataatgactaagcaaataaatcaatcataaaataaattttaaaaataaaaaataaaaattatttatatgtatatgagtctgttaaaatttccacttgctctccagattctgagcactgcaatgtgaggttttgacaatcaaatttagtaccatacttgataatttatattaaataatgctcggtggctctttcatcatccagcgagtagttcaaggctaaatgttgtgtttactatcagtaacttaccttagctgaggttttcagatatggttacctccttattatcttttacccccttagct

SEQ ID NO: 180561 - DNA, 717 bp, Homo sapiens
gcttatggagaatacaaaacagggaggtaagagaagggcagggaaaatagcatgggggatcctgcagggtgcaggagagaggtgagggcagctcggctgagggtggtatggcgatcagcttcaggacatgcttgaccatagaacctataggacttgccgatggagtggctgtggagcataagcgaaagggaagaagcgagcttcatctgggtagatcagtgactggtagtgcccttcatcacagtgggaaacgatggggcaaaacaggctgcagcacagaaccacagtcctggttggtatctgtttcctctggaatggatgcccagtagccctcccagaagagagactgagtgggccactgggactcggtggaaaggctgcagctaaagacatcagtgagtcacccacaaaggggtggaaacaagccacggctctgcttcgatgtggtcttctctgagggcagtgggctggatgaaaccacctatttcttctcaaagaatctggttctcaaagtgaaccaaattttggtagattagaggcccaatgtttggagtcaagctaacctaggtctgaattttctctctaccacctacttgctagttatgagaccacaggcaattcacaataaccctcttgagcctcccttgcctctgagttaaaatggggagagaacccttatttcccaaggtgacagtcaatactgttaattccctccca

SEQ ID NO: 180562 - DNA, 706 bp, Homo sapiens
cagaagcctataaattataacaatatataatgaaatgaaaaagtaaaaagaagattgaatgatgaatctgggaaaatcttgttaggaagaaaattggaaatacagaatatctgtagatttcattaggaaaatttaagcatgtgtatttttaagtatgtactatttcgaaccaacaagggtggagaagattggaatacagaactatttatcattccagcaaaacaaagaaagaaggaaggtatgataaacaataaaattgtaaaactaaatatataaacatatgtatgcagcctatgtatattttcacctgttaaaagaggaaaattgttagatggggggaaaaataaacattttatactttaaagagatattattaaacaccaaacaagcttaaaagtttatttagtaaaactacaccatgcgactactaaaccgtacaaaatgttgtagtaccattaacatagaacaaagtgaatttaagatggaaggtatcaattggaataaaaaaaaagggacactacctaataattaaaaagaataatccatagaagaaactataacaagtatgaacttacatacatctaaaatagtctcaaaatgtaaaggcaaaagaaaaaaaaaacctctgccaaaattataaggaaaaatggacaaacccatacagtgcttcaatgtaccattgtagtggagtacccacctgttataa

SEQ ID NO: 180563 - DNA, 276 bp, Homo sapiens
atttcctggaaggtcgtggcaaatccctcttaccgctgtttgctgggggtcagggcaggaaggttcctgtcgggctgctcaattctgaccagtgaattttccagatatcaagtgtcagtcctctgagcccaagctaagccatcatatcccctgtgacctgcatgtacacatccagatggccggttcctgccttaactgatgacattccaccacaaaagaagtgaaaatggcctgttcctgccttaactgatgacattgtcttgtgaaattccttct

SEQ ID NO: 180564 - DNA, 539 bp, Homo sapiens
gcggcccccagcgcagtgccctgctgcaggcctgggggggccagcccgaggcgctgtctgagctcacccagtccccaccaggcgatgacctcgccccccaggacctgaccggaaagagccgggactcggcctccgctgctggagccccctcctctcaggatctcagccccccagacgtaaaggaagaggctggctgggtccctgagaggcccgggcccgcagaggaggaggaggagctggaggagggcgagggcgagagggcgggggtcccgggccggtcgccgcggggccgcgcccaccgccgccacccccaggagcgctggcggctggagtacctcatggagttggacggcggccggcgcggcctggtgtgcggggtgtgcgggggcgcgctggcctcgctcaagatgagcaccatcgagcgccacatccgccggcgccacccgggctccacgcgcctcggcgggcctgtccaggccctcatcgcccgggagtggagcgagaaggccgcccacctgctggccctggggccgccccgc

SEQ ID NO: 180565 - DNA, 383 bp, Homo sapiens
tgtcctatattgtctgattaatattgaaactcctttgcctttttatattattgaatctttaagctcttttctatatttgtgttatatatcttgaaaggggcaagtagtggtattggctttaatagaatctcaaacaatttgcttttgtaataaagtagcttctaccacttaaatatattgtcaaaccagctatacttgccatattttccactcctttgatttttcatttatcaactatcttgcttttttattgataaaataaaaattttatcaattaccaacttcatgatttttaaatatatatttgagcttcccttaactttatgtgaatacaaagaatatacatcatactttttgctttgtagaaacgtatttcaaaaagg

SEQ ID NO: 180566 - DNA, 467 bp, Homo sapiens
acaaaaggccaaacagggtgtgatcccatttctatgaaatgtccaggacaggcccatccagagacaggaggggatacgtggttgggaggaggaggaaatggggcagtgactgctgatgggaaaagggtttctttttaggggcatgagatgagatagggatagttgcacaatgctgagaaccagcgatgtgtatgctttaaatgcgtgacttgtatggtatgcaaatgagatctcaataaaactgttaaaaaaaaaaaaaaggctgggtgcggtggctcacccctgtaatccccagcactttgggaggccgaggagggtggatcatgaggtcaggacgatcgggaccatcctggctaacatggtgaaaccccatctctactaaaaaaacacaaaaaaattagctgggcatggtggcgggagcctgtagtcctagttacttaggaggctgaggcaggagaatggcgtga

SEQ ID NO: 180567 - DNA, 915 bp, Homo sapiens
aagaggccattaaggctctgaggcctcactggacttgctgggggttttggggctggtaaggggcagagtcagaactggaatcagtttggagtttagtgcatcttgcccaattacatataaactctcataacaggattagtcaatagaggaacctgcaagtattaaagagaaaaaagtgttttgaattgtgtatttatttgatatttagcatgcatttacatacaaagttgtcatcactccttacctacaattcctttctttgttttgttttgttttgtttttgagacagagtctcactccagcctgggcgacagagtgagattccatctccaaaaaaaaaaaaagaaaaaaaaaggaaaggttctggttgtggatgtacagtttctcctaagaaagaagcgagggggtggaatttgggaagcacttctggaatcggattaacccaggctcttatggaatttttccatctggctcggtaagttggatataaagcaaaattaagaggtctagttttccctatagaacttttaatatgtcaaaagctatatgggtctaaattccagtacttaagcaaatactgagtagtgtttaaattcagaaatagagttctattatgaaccccttgagaatgattttctctgaatcattatcagggaactattccacattgccatggccatataagtggggaaaagtaataccggattggtcctttcctggtctagttactcaggaggaaacacgtgtcatggggaaggcaactccctaatgaacttaacgcagtggctcactatacaggcagagaagctctgcctggacggatccaaaatctgcggcggactcgaaagggaccgcatcaccgaatgggacactacggcacactgggggccgcgcaaagcgggaaaaggagggcag

SEQ ID NO: 180568 - DNA, 284 bp, Homo sapiens
cctaatcaataatcccagtgtgaggctgccatgctgaccactcagaacaaaacaagcgagctaaattcatccactgaagaatgggtcaacaaaatgtggtatatccatgcaatggaatattattcagccattaaaaggaatgaagtactggtacatgctacaatagggataaatctcaaaaaataatactattataagtgaaagaacccagtcacagaaggccacgtatagtgtgagtccatttatatgaaatactcagaataggccaatccataaagacagaa

SEQ ID NO: 180569 - DNA, 191 bp, Homo sapiens
tgatttgaatcagggccacctaaagcaaaaattttctacataccttcctcctcttaatctattccatgaactcactgctccacagatggtaaaggtctgctgtttataagtggtcttgtgaaaaaattattaagtgatttcatgggtcactcccattccatctgatttaggaaataatattttggtttcca

SEQ ID NO: 180570 - DNA, 390 bp, Homo sapiens
gaggacttgggttcgagtccctgatccacagcttgccgactggggaccgtggattcactactgtacagctccaagctctttccctcatctgtcaaatgaggatggggattctcagtagcagtgccaaggatggcctgggaggttttgctcccccataatcttctttggcatctgctgccattctctgatgtggccaagtgacattttctcagtttaatgaaaagtattagacaaaagcagctttcaccaggcctttggccctggtgtcaaccagatggctgtccctaaaccaagcccacagagaaattatggagctgctgctggaagtggcacccacctcacagagctgtcacgatggctcagcgagatgctgcaggtagagtcttcact

SEQ ID NO: 180571 - DNA, 539 bp, Homo sapiens
ttctgccgggagcagatgactgtggtgcactctctcatacctcttggcatttccctttccagtattaagtactaagaaacagagaaaaactttttaaaattgcatttctcctcttctgctcccctgatgttaactacctgctttctacaggctttcctgagggtttttgatgaattcttcccctgaccttggcaagcgtctctctactgccatcctctagtcctgcaacaaaggctgtgtgatctcagagccattcacaggcaggctctgctcctgtttgcactggtcttttaactgctcttaataaagacttgagggaaatatatgaaaatatcataaaattattgaatagaatattaagaagaaatcatttcaaaacagtgaacggaaatataatggtaactcattatttccatgtttgctaatcagaatgtttataaatagatacaagtataaaagagcttcttattttcccacttttcttcttgtttattcacttatcagaaaacttggttagctaatagaaaaatatacaggtt

SEQ ID NO: 180572 - DNA, 312 bp, Homo sapiens
tggaaatcaagaggcatgaaacactgataatgttgtgatacagatgaagctcaaaaaggttaaaagtgaaataaaccattcacaaaagaccacatattgcatgattccattagataaaatgttcagattgggcaactctatagacaaagtgggtcagtggttggtagaggctgggggcaggaggagactagggagtaactgctaatggtaaggggtttctttttgggtgatgaaaatgttctgaaattagattgtgacaatggtgatgtattagtctgttttcatgctgctgataaagacatacccgagact

SEQ ID NO: 180573 - DNA, 325 bp, Homo sapiens
ccaacccaacctggtatctaacaaatgcttctccttctagttcaaagcaaggctatgacgtcacagaatgaaccccaacctcaatgtctgcactaagggaagggtagagcagctttctctatggggccacattttcagtaacttagtcccgtacttagaatcttatactccgccttctaataggtcttcacagcagctctagaaatctcaggcttcttttttaccactatattagggtacctttggttgaacgttcccaaaaccccttgagaaaatttaaggaaaatatgaacacacccccttttcatttgttgtaagtacaccg

SEQ ID NO: 180574 - DNA, 292 bp, Homo sapiens
gtactacttactgagtagcccctgaactttcagaaacaggatcagaaaggctgaaaaccaataaaaaaatgagcatcttaaaacgtgcttagtaatactcactagaagcttcaagtatgtttcattatccatttttggctggttagtctgcacaagtcactaacaatgtcgttctgcttctccaaagatcctggactccaggaactgctatcacgtcttttttttttttttttttttttgagatggaatcttgctttgacgcccaggctggagtgcagtggtgtgatcttgg

SEQ ID NO: 180575 - DNA, 501 bp, Homo sapiens
taccccactcctcctcctcactccagtgtcctcaacacccgccaagctcccacctcaggccccattccttccatgtggaatgctcttctctcaggaaaatgcccacattcctttcctccttcaagacttaacccactggccaacatggtgaaacctcatctctactaaaaatacaaaaattagctgggcatggtggcgcatgcttgtaatcccagctacacgggaggctgaggcaggagaatcacttgaacccaggaggtggaggttgcagtgaggagcaggttgcagtgaggaggttgcagtgaggaggaggttgcagtgaggagggggttgcagtgaggaggaggttgcagtgaggaggaggttgcagtgagccgagattgtgtccccggactccagcctgcacaatagagcaagactattgttcacaaaaaaaacatgttgtagaaaacaaaacacttaatttcctcttgattggatttcctggatctggcttctctg

SEQ ID NO: 180576 - DNA, 551 bp, Homo sapiens
ccaagagctattatcagtattttctaaaatgcaacctcttcttgcatgtctctgaagatatgaattacacttactgtaattacatttgtttcttttcttaattctgattctctgaaattacttattctgtttgctaagttttgtatcttctttcttgtttttcttaaaagttgggtgacaatattttacatgggtagtttttctgttaatcatagcttatctccaatgattaggaaaataacaactatgaagtaggacaaagtaacctggtttcttgtgttttagcattgctgctccctgttccttcctggttttgttaattacctgagactctgccctgttgatgttagtcagattctaagactcaccttgccaagcaagcactgctttgttattccaaagtgaagttcattcttactttgtctggaaagcagtctctgcatcttttaccttattatttccctcctttcatattatgtttcttcctttaccaattttaatggagcttccccttttttgtctctaagatctccttctctatctcaaaaaca

SEQ ID NO: 180577 - DNA, 405 bp, Homo sapiens
gagctgcagctggcccatctgaaaggctcttgtctactttggagatacgcgtgtctgttactgccatcccacagagccctgtgtgcgcccgcagacgcgactgcacatgcaggctctaaggacagggagcctttgttcactgcatccctcctgcccatgaaagcaagtgtgtttggagcttgacagtgtacgaagcacattcacacttatcaggacatcccatccaccctggcgacagaggcagttggcgggacttatgtgacctgcctgaggtcacatggtcttgatttatggtcttgagccatgtgctatcatgacatgtcctttccaaggcagagtgatgggtccagccctccctgctggggatggcttctctggctgtcacctttcacgtggatgctgcta

SEQ ID NO: 180578 - DNA, 373 bp, Homo sapiens
ggagacggtcttgctctgtcgcccaggctggagtgcagtggcgcgatcttggctcactgcaacctccgcttcccgggttcaagcagttctctgcctcagcctcctgagtagctgggattacaagcacataccaccatgcccggctaactttcgtatttttagtagagacggggtttcaccgtcttggccaggctggccttgaactcttgaccttgtgatccacccgccttggcctcccaaagtgctgggattacaggcgtcaaccaccgcgcccaactgaacactgtctttataaaaacacagtcctttcagatgtcgggacttattaataattaaatatattcaaatttatttgcaacaaaaaattaccttt

SEQ ID NO: 180579 - DNA, 227 bp, Homo sapiens
aacagttagacttccagatccttatctctataccccacctccccctctgcagaagagatagattcccttagggaggaagaaaactagagaaaataaagacactagggggagagtgtgatgtcagcaagatagtggaataaaagatacctggcatcactcttcccacaaaaatgcaactagaaattattcaggctgggcgcggtggctcactcctgtaatcccagcat

SEQ ID NO: 180580 - DNA, 296 bp, Homo sapiens
gcactgtggacaatgtagccccttccttcaagagcatgagtacacacaaacaagacaactctaagctgtaagaaccccattcaccgtgatgaagagataaaacaaacaaaaaactggaaaaagataaaaagagaggggggaaaaaagagtggttgagactatgaatgaacatgtgaaatctgacacattctagctggatgtagaggcaatatgctgatgggagttttctataggacaaacagaatctgctctcaaagttcttacaatttctagagctatctttggccaagagttgg

SEQ ID NO: 180581 - DNA, 213 bp, Homo sapiens
tcctttaactgttatggcctcctaattgattttcctgtctccattctttcctagcttgagtccgatactcacactgccatcttcctaatgaataaattaaatataattatatcattcccatgtctttttagcagttcctggctgtctgtaagagaaagtaccaactcctcagcaaggtataaatgcctcttcataaatgtgacctcaacttaa

SEQ ID NO: 180582 - DNA, 708 bp, Homo sapiens
gtaagttgtctaatttctctgccttcctttccttgtgtatagaaccatgatcactgtagggctttgtggaatgatgtgaagtgcacagcaggtcctcaaccaattgaaacagccatgacagtaacaataactatgaaaataaagatgcgaatgtacccagcattatgtttgataggtgattagcttgtacacacacacacgcacatacatatacatgcatgcacacatacaaccaatgttagtctccctctccactccccaaaatggattttggatttgaagaggcagcatttgggccaatattatctctctccaattaatgctgactgtcatggcattttaagaccaatctctggccgggcacggtggctcacacctgtaatcccagcactttggcctatatttttaataatatatattataaaagtgtaatgaaaaggatacaattgaatcagtatagcacccaaagtttctttctagaggtctgagattcaaggtaggacaaaaagctctggagagtccctcctatgttccattatctttaatccaaagagctcagatacctctattgctatttcctctggcactgcagggaagttccaatccacctggtccgcactagttgggcccagggagtatcggtctgggcttgattgttggtcagtggattgcacttttatgaagcaatacaaaataagggacagatca

SEQ ID NO: 180583 - DNA, 593 bp, Homo sapiens
cagggcacctcaaacagtttaggaatgaataccccgactggatctcacagctctaaacattacctacgtgtttctccaagtggctaacccaaacctctctccaggactacaagtttgtatacagtagtttatccttatccatggttttggttacccaaggtcaaccatggtccaaaaatagtaaatggaaaattccagaaacaattaagttatcaattgcaccccatttgtagaagtgtgatgaaatctctgctccatcccatgcaggatgagaatcattcctttgtccagggcatccacgctgtctaggcttcccaatgtgttagtcactcagtagctcagtagctatctctagggatcagctctattgttacggtgcttgtgttaaggtaacccttattttacttaataatggccctaaagcgcaagagtagtgatgctggccaattcacatatgccaaagagaagccttatagtgtttccttcaagtgaaaagatcaaagttctcgactttataaacaaaaaacatcggccaggtatggtggctcatgccttaatcccagcactttggaatgctggggcaggtggatcac

SEQ ID NO: 180584 - DNA, 171 bp, Homo sapiens
acccctgcactccagccgaggggacagagtgagaccctgtttcaaaaacaaaacacaacaaaacaaaacaaagaatacagacattttcagatgtgcaaagtcaggaaacccttggtgaaggtgtcaccaaaataagggtatcaaactaagaaagctgctgccgtggaatcc

SEQ ID NO: 180585 - DNA, 301 bp, Homo sapiens
cctccatgaacagtgccaatgtaagtgatggtaaagtcagcatgtctagcagcatatatttccactcttagaaaaaagaaaaaaatatctcttcctctcctgaaactggggctgcacactcaagaagatcttgaagtccccaacctcactgattaacagcagtgtattaattagtgtcttaaaaccatggacgaggtgaaaagcttagacacagtctgaacttggtttaaagttggcacatccagtattttactttttgcttgttgttggtttttaatcacaggtgagtgccactgatggg

SEQ ID NO: 180586 - DNA, 255 bp, Homo sapiens
gtagtacccaaacacacatgtcctctaccaactccctggggtgggcttcttctcaagaatagtgcagagaaagagggagggaccctgtgaaacagttaagttaggagagggtagtacccaaacacacatgtcctttaccaactccctggggtgggcttcttctcaagaatagtgcagagaaagagggagggaccctgtgaaacagttaagttaggagaggcgtcctcctgccgtgtgacttgggtcagcttgtta

SEQ ID NO: 180587 - DNA, 429 bp, Homo sapiens
tgtgtgtctaatttctacttatttgatacttttctagaaatcttattttctaatttgattttattcactttaaatttcttgagacttttttatgggctaatatatccaacttgataatatactgtgtgcacttgaaaataatgtatattcttcagttgttgcatatagtgttctaaaaatgtcagatcaggttcataatattgttctgatcttctgtgtctgtattgattttgtttttgtgttctactaattgctgaagaagagttattaaaatctgcaatgatttaatgatcctttaatgatctgtttcttgttttctaaattctgctctcttatgaaatgtcccactttatctctgatagtgatctttgtcttcaagtctattttacatgatattaataaagccttcttattttatatttaggttgg

SEQ ID NO: 180588 - DNA, 279 bp, Homo sapiens
tttacacccttgaaatgacagggagctacctggctttttaaaaaaataagctactaatgtgttcatttgacaaatatatgttgagcaccaagtacgtgctagtataaagaaataccttagtgcacagaacagacatagacctcatggaacttagtttggttaggagagttaggaattaagacacaaatatatagttagttatttcaggaaatgcaatgaaggaagaaggacaggaggccatgagagaatagtaatgacaaattaatatagattggttat

SEQ ID NO: 180589 - DNA, 785 bp, Homo sapiens
atgtgctgtagacgctaaaagtaattttaaaataagaattttcaatgttttgagtagtggttgcaatactagaataaatacatattgcttctggataaatacaattgcttctgcatattgtttgttgttgttgttgttttgagacaggttcttgctctgtcacccaggctgcagcacagtggtgcaattgtagtttactgtaaccttgaactactgggctcaagtgatcctcttacctcaaactcctgaatagcaaggactataggtgtatgccaccatggctggctaatttttaaattttctgtagagagggggccttgctgtgttgcccagttggatcttgaactgctgggctcaagcagtcctcctaccccagcccccaaaagtgctgagactgttaagtgtgagccatcacgcccagcctggtagtgattgttttgaatgggtgaaggctcatttcgatgtgtaagttctattatgtttgtttttaacagatattattactcatatctcataatacagtttgattattttcatttcagaattccatttttgtttctgttattttgagataattgtcttttagagagagacagcttattttggagcaaatccattgatcgttaggtaaaaatactcgtcatttgtagtttgtttctttaactgaactaagctttatttaaactaagctactttggtgtcgtcccttatttaaaaatttttctcagtggttacactgttttattttctttggcccaatatattacctatctcttgctctgatt

SEQ ID NO: 180590 - DNA, 218 bp, Homo sapiens
gccttcaatgttcccttcacccaatgaccatactcggtcatctcacctaaactgcaattatctcacaacagttagataattagagagctcttctcatgttcattttgtcaataaattttaataagtgtctgtgaaagtctctggaatacgttttaaatgggacaccgtatgtgtgagtttgtagtctattgagagagaaagacaaaaaagttattatg

SEQ ID NO: 180591 - DNA, 493 bp, Homo sapiens
ctggtctgttattttgcctgcgtcctggggcattggagttgtttttggcaacacagaataagaatgatggagaaatctggtgggaaagggaaaacattgttactgaaatttagtgctttccttaaaaaagaaatgaaactcagcaatactgaaattttgggtagccaaggggtaaccaccagtttaaggcagaactgagctattgtcagcagagtcaggcagcagtggacgttggtggagagggctccgctccttccagcctctgccagtgtgggccctgccgactgcaccttcccaccgctacccagagaccagcggctcaccccgcagggagggaactgtcaatgttctatagcatgggcttaattggaatggtttgagtgaaaccaaatttcagtcgagatcctgctgccagcaagctggatataacagtggcctttcactcagggcctggcactgaaacaggtccaggatgcaggagagcagcttggca

SEQ ID NO: 180592 - DNA, 459 bp, Homo sapiens
gtaggggactgtgcgggaagctgggggtggatgcatggtggggcccggggttctgggccgggatgcagccctactgagcccctttctggttctccacaggtgatggagacccgccaggtgtccaggagccctcgggttcggctgctgctgctgctgctgctgctgctggtggtgccctggggcgtccgcactgcctcgggagtcgccctgcccccggtcggggtcctcagcctccgccccccaggacgggcctgggcggatcccgccacccccaggccgcggaggagcctggcgctggcggacgacgcggccttccgggagcgcgcgcggttgctggccgccctcgagcgccgccactggctgaactcgtacatgcacaagctgctggtgttggatgcgccctgagcgcgctgcccgtccccatcttaataaagaccatgccctgcgctccggactgcg

SEQ ID NO: 180593 - DNA, 582 bp, Homo sapiens
gcgtggacaggttctggccatgttgcccaggctgttgtcaaactcctgccctcaaaccatcctcccacctcgcccagtctcactattctaccaaataacccacttgcagattttttgtttccctgtcttggtaagtttgagctctgctgacttggaagacttagtcctcaagggaggaattcttccatcaggggcacaacaatgataccattggaattggaaaatgagactgccacctggtcatgttggactttttaggccactgaaccaaccgcagaaaatggggttactctactggctggagttattgatccttatgaccaggaggaaactgggttgctgccacaccatgggggtaaggatggtgtgtctgaatcccgggtttctctggagtgcctcttactatttctatgcccaataatacatgttactgaaaaactgtggtaactaaaagaaggcaggacaatgcggaccctttaggaatgaagctttgcctcatcctaccaggtaaaaagcccaattatcggagcccaaggatttttggatacttacagaagggaacatagttaccaattatgggct

SEQ ID NO: 180594 - DNA, 770 bp, Homo sapiens
attaggtgcattcatccagtaagcctcctaggtaactgctctaggtgcaggaataatgcaggcagcaggacaggaatgggcgctgtcagctccccctagagctcagtgtacatacacccttcctttcctgggagggccgttccaggcccccaggagacaggacacgctgagctgggtggggctggggccaacgtgggcaggcctgtgagactctgcacttgggagctgggggctgtggtctgcggcatacccatgtctggaagcagcctctgtccctgcaggggctctagaccccagccacggatggctaaggaggagctaggccagggcacgcatagacaacccccgacattcacgggtgttcagccctaccctgggtgtggaggtcgtggcccagctgcctgacccagagctcggctcttccacttgcgcttcccacccccagcttcacaaggtcacctccaggaactcagtctttttgtgtgtagttttctggagaaggaaggtgatctccccactcccggggctgtctgccttccctgtagctggcaggtgccagaggcccccgcctgtgacatccggctttcctcccagcacactcgcctgagagccagcatctgtcttcttgggcctgctcaagctctcctccgtgtcagcccctcctccatgcccttctccctcagaccccaccccccatcccttcaccgcccactggggctcatcgctcaggctgtaggagggaaatggaaggatgtcctcccgggctctgg

SEQ ID NO: 180595 - DNA, 682 bp, Homo sapiens
gagatggggttttaccatattggccaggctggtcttgaactcctgacgtcaggtaatctggcgttcttggccacccagagtgctggaattacaggtgtgagctaccgtgcgtggctgagctcccttaatttctacctgaaggtagtctccagggaatgggcacacagaagaggaaaccagatagaccacagtggtcttgctgcgtgaggagatggagattggactttggagaggctgacacagctagaagttgcagagtagagtaccagagaagaggaagctactcagagaaaaagctccagaagtctatgaggtccctttgagtctttgttgaacattaggccatgcaactattggggaatttctgtaaatccagggaaaatgactgagaagttgtaagctgaaccattcgtagcattcatacagagcggagagctattcaagcttcagccattcagaatggagtgtctttgatggtcaccagaaatatttactggagtcacagggggttatttcttagtagaatgactacactatccctagagggaaggctacttcagaccttccctagaaaacctttaaaaatagtttttgaagggttcaaactgatactttcaaactttactgcctgccagaatagagcctaacatttttagtcaacagtgtaacatttaaaatattc

SEQ ID NO: 180596 - DNA, 435 bp, Homo sapiens
atagcagagctgggatttataaacaagtttctcattgttttctttttcaaattttacataatttattatggtatattttaaatacatgcaaaatagaacagatgtaatgaacccctggtattcatcacccagcttgaagttaccaactcatggctgattttgtttcatcatgcctctcctactctcattccttttttgaatattgtgtattttatttaggtatgtttgagtaaaagaaaacaagactaaacactggctgatgttaggggtttattattcttttaaataagaaatccagagataggcaatggcgggtgcatgtttagtggcttaaggatgttagggtcagaaatctcttattttcttggctttcctctcattatcacaaggtggatattgtagttccagatatcattttcactttctagacaagaa

SEQ ID NO: 180597 - DNA, 297 bp, Homo sapiens
ttcctgtaattggtaaagaaggtgacaaatcactcattttaatgagggggggagatgtttggtagtttgtgttgcacaatgaccttgtctgacatggatgttttatgagatactatttttttcttaaggcaacgttgtgacagaacatcagatagtctgatagcatgagattagctcttggacatcgggagctgctttttttttttttttttcctcagtctaattgttgtctctttataggtattctttttttctgtggctgcttttaagattttttttctcattgtcttttatttt

SEQ ID NO: 180598 - DNA, 381 bp, Homo sapiens
aaaatccttcatttaactgttaagttcaccaaatcacttcttacatcatagcaattacgtaacacttgccctcaccaatacactgtttaagtatcttactcttctctcaatatgaaactttcaagtgatggtgcaattaatctgaaatgtggatttaagataaagaataattcaaaaaacaggccacattaaagtgggttgccctcctctaccccatacccctgttttcataatctgtaactgactactgggaagattatcccaatgctcatgttctttgatctaggataaatagcttttaagagtaaataagcctcaaaaaaagtgacttctaaggggtctaactgctaaatacaactgattggacaactgagttagtga

SEQ ID NO: 180599 - DNA, 782 bp, Homo sapiens
gcggctggtgatcaatatctccgggctgcgctttgagacacaattgcgcaccctgtcgctgtttccggacacgctgctcggagaccctggccggcgagtccgcttcttcgaccccctgaggaacgagtacttcttcgaccgcaaccggcccagcttcgacgccatcctctactactaccagtctgggggccgcctgcggaggccggtcaacgtgcccctggacattttcctggaggagatccgcttctaccagctgggggacgaggccctggcggccttccgggaggacgagggctgcctgcccgaaggtggcgaggacgagaagccgctgccctcccagcccttccagcgccaggtgtggctgctctttgagtacccagagagctctgggccggccaggggcatcgccatcgtctccgtgttggtcattctcatctccatagtcatcttttgcctggagaccttaccccagttccgtgtagatggtcgaggtggaaacaatggtggtgtgagtcgagtctccccagtttccagggggagtcaggaggaagaggaggatgaagacgattcctacacatttcatcatggcatcacccctggggaaatggggaccgggggctcctcctcactcagtactcttgggggctccttctttacagaccccttctttctggtggagacgctgtgcattgtctggttcacttttgagctcctggtgcgcttctccgcctgccctagcaagccggccttcttccggaacatcatgaacatcattgacttgg

SEQ ID NO: 180600 - DNA, 374 bp, Homo sapiens
caaactttccacgaagcacagattctaatgttatttcgtcttctccaagggcttgaagagtcacttctggaaatggcaggagaccactagtcacttgagctcttaagtaatgctagggtgagtggtaggaagtttattcataggaggtgtatgagttggtcatagcggaatcgggggtatgctattcgaattcatacacgacacagggaggttagacgtagggtcttggtgaccacaactactgttgtgtagagttcacggggagagtgcgtcatatgttgttcctaggaagattgtagtggtgagggcgtttattataataatgtttgtgtattcggctatgaagaataaggcgaaggggcctgcggcgtata

SEQ ID NO: 180601 - DNA, 311 bp, Homo sapiens
ccaaatggtaactcgcctctgaagttactcttgaggccacaaatttcctttggtgacagcacttggaatggtggtggtgaggagggaagagacagctgtagcattgatggccatcatacctaaatactcctgggcttctccaccccatctgcatttttcatcagcaaaacagagtcacatgatttttgaaccacacagtttctaaagttctgttccatccgttgggggtagtacaggaggcacaggtggccatagaacacacacagcagggttccaggggcttccacaacactcctggagtcatccctatg

SEQ ID NO: 180602 - DNA, 132 bp, Homo sapiens
aggaatgtggaggccaggaggaagaggaagaagggcagcggtgtagagtaggattccaggtggcccaactttcatcccaccatttgccgaatgctgtgcgccagatgctcttccaggcgcttgacatctaac

SEQ ID NO: 180603 - DNA, 228 bp, Homo sapiens
tactaacgccaaggtggaaatgtgcagacgtctgtcacaatccatcactcacggaagatttctgcagcttaccatgcatccatacattccacgcattgttcctctgtcgtgttttttttttttttttttttaaagacagagtttcgctctgttgcccaggctggagtgcagtggcgcgatctcgacttactgcaaactccgtctccaggcttcaagcgattttcctgc

SEQ ID NO: 180604 - DNA, 487 bp, Homo sapiens
aataaatagttaatgacattgtcatacacatttacgtcagttaaaggatggtagacttccaatttcgcagtaactggacaggcatgaaagaatacaacataaaacagctttggaaaaaattggcttcaaatccatctgcaaggtaggaggaagaggggaaatttcataaaaatgtaaacatgatcatttattcctctgagtgcaatttgctggccagtagtttggcttttcctgtgtgtggtagtggaatcgacaacttctgcctatggccccttctcagcattaagcaagcttgtaatggcatcccaggtgtcactctggcccttaattacaggctctcttctggtttgtgactttgtccttttaccatttgaactgagacccatcctctgcctgcacacctgatgtaatctaccagccatgagtgaagtctacccttggaagactgattgtgctcagttcggctctaaataaaatctttccatta

SEQ ID NO: 180605 - DNA, 446 bp, Homo sapiens
gcggcgccctttttttgggggagacagagtttcgctcttgttgcccaggctggagtgcaactggcatgatctcggctcacggcaacctccacctcccaggttcaactgattctcgtgcctctgcctcccaagtagctgggattacaggcatgtgccaccacgcccagctaattttgtatttttagtagagatgggggtttcactatgttggtcaggctggtcttgaactcctgacctcaggtgatccacccaccttggcctcccaaagtgctgggattacaggtgtgaggcactgcacctggcctgacatgtacattttcaagaaaaagctagatccattcagaaaggttttacccatttattcatcagggttaggtttgtgcttgtttgcaagtatctttgttcacagtgggtgttaattaaaaataaatgccaacatataggta

SEQ ID NO: 180606 - DNA, 981 bp, Homo sapiens
tttggtatgaattatttatattattattgcggatttaaatttgtaaattgaatatttaaaattatttaaaatttagagtattaaggttagaaagagaaattaatcttatcccgttttaaggaggttgttataagggtaaggttatgtcttctgctcttgagtttattatgcaaatatacagaattttgttttatttttgacactgagcaagtgcctcaaaatatgtcttcttgagccctgcgtctgtatagtaatccatgtggagcccagttttttttttgttttttttttaagaaaaatacctggaaaagccttgcttctaatgtaggaatttttccttacagtgagatctatgtaactgacaatgtttgtgggtttcacttcagctgccaggaaatttggtattacatgagcatttcaaataaagcaacagtgtataattttaaggcccacattagttttcatttttcactacttttgacaccctattctaaatttttgtttcactttatcttttgcttttaattggtgttttatgtaaaatacttatacaatctttatggaatgagatggggcagaatggaggagtatatccatgtaacttgattttattccactttccaactatatcttctttctgtcttaaacctaggtgattgtatgcactcttggcttcactccagtctaccctgttggttttggggcacatgtaactgtccttattggagcacttagttgctgctgtgggcagtgactaactcattgagttcctatagatgaaatgtaatctgtctgctccaaagctatgtaaatacactcctgttgtggagatttactaggccattaactgcctagtagcatgttttaagttaaaagagcaacctgctgggtgcagtggctcatacttgtaatcccagcactgtagaaggctgaatcaggaggatctcctaagcccaagagttctgaggctgcagtgagcta

SEQ ID NO: 180607 - DNA, 769 bp, Homo sapiens
acacattccaaaggaattaaatgtaaaaaaaaatcaaactcaaagataactagaaaaatatatagatatttttctgattataatggtaggatggtctttcctagcatgcaaagaaaaaaaagcccatgaaaattaagagattttaccacatgaatatttagtttttctgtaccccacaaaaaccaccataaacaaaatcaggcctaagacaaatatttgtaacccatatgctagaaaaatgatttacattctcagctttatttttaactgattttattgggatataatttaccacaccattcacccatttaaaatggacagttaatggtttttagatattcacataattgttcaaacattaccacaattaagtgtgtaatatttttatcgcttcaaaaagaaacttttgtacccactaaaagtcactccccgttttctcccaaccccctagccctggggggtttctactttccatctctatatatttgcctagtgagaatattttatgtaaacggaatcatacaaaaaatgctctttttgtgcctggcttctttgatactaggagggaatatacaactttcctgtagagtaatttaggcatattcatagtttcaaagttatttatagtggttatccaataattcttatttcaggaatttgtcttaaggaaataagagatgtacacaataatttatgtacaaagaggttaataaagcattatttgtaatagagaaaaatggaaagaattcaaatgctcaacaatagcaaa

SEQ ID NO: 180608 - DNA, 362 bp, Homo sapiens
agtggtatgccctgtggcagcaagagtgacaagtcttaggcctacttctgctttcactttttcttttgtctattgcttaaaataactgagctttatattttgttcccctcatcatgtgaaattgcagatgtttactggtttcattctttcttttgatgaactaactccccctctaatggatggtttttgttttcaaaacaaagctgtacatttcagtttgaatagctccctctgatataataaagttgttcttttaacccatgtaatcaagatttcctttcattttaaacttaaaaataatttggaagatgtgagtgataaatttccatgcagctgatttaaatattctggttcattttcat

SEQ ID NO: 180609 - DNA, 588 bp, Homo sapiens
tacttttgttgttctcctacagttttgtgatacagcagacatttaataaatatttgctatttcacgactgtgatgttccaaaataaattttacataccatacacagacgatgcccaattagcttcagcttatttcatctgtgtgtataaaaaacattttttatggtgaaatgaggtcatatgattggcacgctttgtttaataaatcaaggtccttttaccaaacttttccttacaactcttgccaattcattcaatagctctggaacctgaagcttttgcctcactactaagctgtatttccaacttggcattttccttttaaggtaacttgttaccatagtgttccctctccctctccctctcaccccatcccctcacactctttttctctctctctttctgttcctttgctttcactaggacacatggtactgaagatttattttatttatttatttttatttatttgagacggaatatcgctctgtcacccaggcagggtgcagtggcacaatctcggctcactgcagcctccacttctcaggttcaagtgattctcctgcctcagcctcccaagtagttagga

SEQ ID NO: 180610 - DNA, 647 bp, Homo sapiens
caagagagtttgtgagtagacgttgacagtgctgcagagacgtgtgtgtgtgatgttaggatcttcagctcatggttgtccaagtgtctgggagagatgaactcagccctgctgtctattagaggctccagtccagttagtaccttggcagcttcacaacaatatccagagggctcagtggtgtggtgcccttctccatccagaatggagtcactttcgtgaataaatagggctcctggctctagctgaattatttttaagttagatcataggcagtagtaccacctagaagtcaaaaagttggccatgcttgagttatatcattgtaaagcagactttttgtaagtgtgagaaaaatgtgaagctttaaaaacccctctgtacaaaaaggtttccaccctagttaataatatcataacatagtaatttgttcctaatgtattaagtcaacagatatttattgaacatttaggtgctatattactcaactggagtaaattactttactcccaagaagtagatgtctgaaggggataggagtgaacatgtcaaataataaacttgagcctgggaggtggaggttgcagtgagccgagatcgcggcacactgcactccagcctgagtgacagagcgagactccgtctca

SEQ ID NO: 180611 - DNA, 766 bp, Homo sapiens
cttgcaaattgctgggattatgggtgtgagccatgagcccggccccaacaaatgtaattttacttctgtctttctgatttggatgagttttatttcttttgctatttaattgctctgcctaggacagccagtatttattgaatatcaggggtgagagcattcttgcatcatgtgatatcctacaggaaaaccattccattttccttcattggttatttcagctgtggtcatttcatggatgatttttatatttttgaggtaaaactctacctatattgtttaggatttttacgaagaatgaatattgagttctgtgaaatgctttttctctatctattgagataatgtgttttttatctgtcattctgtgcaagtgtgtatcccattgatttgagtatgttgaaccatccttgcatcccatgaataggtagcacttggatgtttacaatccctttttatatcctcttgaatacagtttgctagtataagggtcttcaagaagttcatggaaaaatacatattatgaaaaatttgtgcataaatttcacactttttgtaccaaaataaaccagtataaacttgttataacgtctgaacaggctctagtttgaggcactcagaaggataagacatcagtttgaaaagaacctctatcacagcaatacaaattctgttaaaacaagaagaaacatcaaatttacgatgagaccagacgcagtggctcaggcctgtaatcccagcggttttagaggcccaggcaggtggg

SEQ ID NO: 180612 - DNA, 359 bp, Homo sapiens
aactctgtaagcttactaaacatccttgagttctactcttaaaatgagtgaattttatcagatgcaaaattaaatctcaataaaacatttaaacttttgtcctattcactttgcaaaatataggcattgtcaaatgccattcaaatatgggtaatgccagattgggggaaaaatgtgcttggtttgacaggtaatttgttagccgctgaggataaactcatatgcgattccattcaatcattcaaaaatatatatcaaatactattctctgttagtcactgtgctagtaactggggacacctgatgagcaagatagcacagtcctgactttcccaaagcttagtggaggcaaaggcaga

SEQ ID NO: 180613 - DNA, 258 bp, Homo sapiens
gaaaaaaaatcacgatatgaatatttgacaccagaaaattagataaaattcaactttcagtgtccataaataaaattttattaaaacacagccaagctaattcatgtatgcattgtctgggactgctttcacacaattgtggtagacttgagttatcatgacagactgtaaaaagtttcacaaactctaaaatatttactctttgtccctttacaggaaaaggttaccgaaatctgttctactgagtgtagaatcaat

SEQ ID NO: 180614 - DNA, 335 bp, Homo sapiens
caaaaatttctgctgtggcagcttcaccaggaggaacatcctgcactgaactctcccagcatcccttgtcatttgcatgggcaatttcagtcttgttctcccctcgcacgctgtcctcaaagagttggtatcccatcagtcactgtgacagccccacattatagttcagtgtaatttgtttattgacttctgaataccaaattccttcaaggagagtcacagacccacagcatgctggggaaacacggctggaaaacatgtaaatacagatgcagtctggcagcttctgatggttgccactcagaaaatctcccggggcggtcttcttccaaggg

SEQ ID NO: 180615 - DNA, 694 bp, Homo sapiens
gattacaggcatgagccaccacgcctggtccattccttctgattttacaatgcatttctaaatgtgtgaaattttttaatgttctttttgcttacctgtattatctaatttttaagaatatgttatttgtaatgtgaaattagaatgttaatgtaactaatatctgacaacactgaccaaaaaaaaaaaagttctgtcaagtatttttaaaatttcaaaactttcaaaaaatgtcacttaaagggcaacatctggatatctaaatgtatgatatcacctttctgtttctcaagtgaatttcaagtaatattgattgtatagtcctttaaaaaggtaagctctgatattaaagtaacatttaaaataatagtttgtacttaaagggggaaaagtttttgtggttttagtgttaagacttagttttagatgtgaagaagggcccatctaatgaaacttctccctcaaagcaaatatgtgcaggaaagaacaatatttataaatattcttgtaattttcacaacacatagcaattccccatgagtagtttaatcaccacagtaagcgagttctgtatggttgctccaagtgagggtgagagtagagaaatcaggttttcttcttcctataccctctagaattcttatataaggtgatgatgtatcacaaaggaaattcctcaatatcatactggaaa

SEQ ID NO: 180616 - DNA, 184 bp, Homo sapiens
aagataactttttatattttgaggactaaaatcagatgactatgtttggcaatgaggtcatcactgaccttttgagagacccctttctagagctgcagcgatggtagtgggattgccgtgggttcagaggcagagagggcaggagggcgacagaggggacagtaagcagtcttgcagaaagaga

SEQ ID NO: 180617 - DNA, 292 bp, Homo sapiens
ggaactgacatgcagtacaattttataaattatgggttgttgtagcctgtagttttaacatgatacaaacatcacataattatcctataaaggttaatttcattgctacattgacctgacagttgcaggagtacaatagctgtcaataagataaaattgtgtttttggtggttttggagaaagctttgaggacttgttttaggaaaaggcatttaatctatttacaacattatgttttggtattactggcatttcttttaaagtaattcagcatattatcactataagctca

SEQ ID NO: 180618 - DNA, 228 bp, Homo sapiens
acggaccagcgatggcatctctgtcataaatctgaagggacctgggagaagctgctgctggcagctcgtgccattgttgctgttgaaccctgctgaggtccctgtcttgctccaggaacactggccggcaggctgtgctgaagctcactgctgccaccagagccactccagctgctggccgcttctctcctggaaccttcactcgccagacccaggcagccttccggg

SEQ ID NO: 180619 - DNA, 458 bp, Homo sapiens
agggttcatccctgcccgctctttggggccatctgtgagcaagccctgtgtcacttgtttttgctgacatggagagctgtgacatgtttgagagttaacaggaagctttactccatttttccatttagatttatagagtctacggagaagctgggacaggaggaaaagcattaggcaaatacagtcagtttgttgtcatctgatgcaatactctggacacaaataaatgactctgcccattattcctcttgcttcatttgccctgagacaaaaaggtgaatccactggaaaatgaacgaaaggtcaccctgttttacagcaatgtctggacatgctctgccagtaggttccaactactacatggtaatgtggtgatggtaccaagttactggaatccagagtgagtccgtgatttgtcatggacataagtactggaatgatgttatggtctcagctgt

SEQ ID NO: 180620 - DNA, 322 bp, Homo sapiens
tttaaaaaaaaattcacaggaaaaaaactattaccagatcatcaataactggttaaacatgaaggactaaatttacacatttatctctgcaacctttaaaaaaaaatctattaaaataacaatgaagaaacagaaaaggtatacacccagaaaaacattaagaagagcagaggagacaaaagcagaccagagatgtcaacccatttttctaagatggaaagcagacttagcagggcagagggcagaggaagctgaaacctaagagtttgcacagtagaaaatcaatacatttgcatcacagaaactaggaagattccaaaat

SEQ ID NO: 180621 - DNA, 232 bp, Homo sapiens
tttaaaaaaaaattcacaggaaaaaaactattaccagatcatcaataactggttaaacatgaaggactaaatttacacatttatctctgcaacctttaaaaaaaaatctattaaaataacaatgaagaaacagaaaaggtatacacccagaaaaacattaagaagagcagaggagacaggtgggctacgtcaggtgggctacgtcaggtgggctacgtcaggggggctacgt

SEQ ID NO: 180622 - DNA, 378 bp, Homo sapiens
gcaacctctctcaggccacacattgaggaagggatggtgcctgaacttgagctcagctcactcttttaagcctaacacgctctacaatggctgaggggtgcagttgggacattttgcagaccaggtgtgtggagtggaacagggcctgccagtcctgtgagtgagctacctggggtaactttgcatctggagctgtacggcctgaatggctgccctgctttttgtacatatattgatgcatttcgtttgggctgcttgcttcctgatacatttctctcaaccagttaaagcttcgatggaagctgaatgttgcaactgatgaaaagcaattagtttggatgacatttctgattggcttccatatcatactattaatca

SEQ ID NO: 180623 - DNA, 688 bp, Homo sapiens
tgtcacaggtaatctgcttctcttaaagccggctgatggtagaggttaaacacatccaccgcatacctttgcagcaacatttagatgagtgtttgaatctctgggcactacagcctggccacactgatgcataaacctgcccatggcaggggccaaggtcagatcacactgtccctgactgggtccctcttccctgcaggcccaggctctgcctgtatctgacgttgggcccagccttgtagcaccaccacttaggattattctgaggtgctgactgacactttaaggtttttgtcattctccacttctgagcttatcaatgggacaaaaagtcagcgcctcggccctttgctggcctttcagccacctggcaagcccatagttggacagctccctccagagagcggcaccttgccatgggtgaaggaagggcaggaagagaggatgagcacagcaacactgagcattttttatgcaccaagggcctataacccgcttctgagtattaacttctttaattatacagttagatactatgatattgttacacccattttacagatgaggaaactaaggcctccaaaggtcaggcaacttgctcaggttttcatggctagaacagggagggtcaggatttgaacacaggccctctggctctatctacactctgttctcttgatcagatgtc

SEQ ID NO: 180624 - DNA, 199 bp, Homo sapiens
ctcgaactcctgatctcaggtgatccacccacctcggccttccaaagtgctgggattacaggcatgagccactgtgcccggctgttgcaattttcaacaggatgatcaagaaaggtcatctcccctggagaagatgacattttagcaaacctctgtgaatttgagggaggagcacgcaggtgatcagttcaggagagtt

SEQ ID NO: 180625 - DNA, 393 bp, Homo sapiens
cttgtttaaaagtgctgagatacttgtctaaaagatgggccttaagattgtggtgtgcttttaataatgtgtggggtaagtgcctctagaggcaagcatacactatgcttgagtaactttctctccattctgaatctctccctaaaggacacagtttgtaaatgtttgttcatgtgaaaagggaagattcaggtaccttttctgtcctactgatgtgtggggctatttttatgttttgttcttcacttttttctgtacttgtgatttaaaggtgccagactggttaccctcaaggctagtgtccccactgtatcccaagaatagaaaaaataatgagaggcagcaaaactggcctgtgtctgagtccagcatattaggctgacccactctaga

SEQ ID NO: 180626 - DNA, 450 bp, Homo sapiens
aataaaggtataaattcaattaaaactgaggaagaaataaagtggttggaaatagaagtcttggaaatggaaaaatcatagctgttgatataaaagacacaacagacttgatgttctctagactggaaataattgaagacaaaattagggaaataggagctgagacgttcccccagcatggcacagattatatgaaaagcagtgaagaatcagaacagattgcagagttagaggttctaagatgcatgtaatggaaataaagaaggcaactctgaaagtggagaagcaatgtttacagagatcataggggaaagaaaacatttgagaactgatttagtataggttttcagattgaaagtgaagtctctttatcatgtaggataaacaaaggtataagcttaaaggtaaatttaaatataaatttaaaagtaaattttaattgatattctg

SEQ ID NO: 180627 - DNA, 429 bp, Homo sapiens
ctgcgcccatggcctctgataaatggaatgattatcgtcagattaatcggcagatctctttaacagtgattgggtctcttttgtcttcatttgtctcacagagcctcaccttgtctcatttgtctcacggagcctatcctaccactttgcacatagtaggggtacatgttttattaaaataagaagcagccggtcagatttggcttccttccttgggcagagtccactgcctgtggatgtgggttatattttactgtggggctcacagggaaacactgctgtccagcccatcctttggagagcttcctgagatttgtcttcatagcctcacatttcatgacccagaatagctcagtgccatccacattcttagggatttcatggttcatcctcctccccaggttgttcattagaatcttagagcaggag

SEQ ID NO: 180628 - DNA, 290 bp, Homo sapiens
ttcagagttgtcttcagactcagagtacatagttctaatagtcaaggttcatatagttcaaaagttaactgaggttccccctaagctgtgtggccatgttattcatttgaaatatgactctgttcatgtttttgttttaggtttttagttctaggagttttttcctcccatgcttgttagttttctattctttttaaagtatgtatgtgaaacattaaaaattcccaaaagtcagaaccataaaatattatactcaagaaggtgtaagtccatcctccctttcttcatag

SEQ ID NO: 180629 - DNA, 341 bp, Homo sapiens
acagccacttcctgggtgatattggcaaggtgcccgtgcagatggctttagttttctcacctctcacatgagagaattgcactagggccccagggcacagggtatgggtgaggttttctccatccatattccacttgctttaccttactcaaagttggagaatggtcaaacacaaaagctaaacgtttggggagacttagttgggacgctgccctttgcttctgcatttgttctgacccagctgctatcacacagcagagctgtgcaaagaaagagccaaaacaggactgaccacttcctctgtcagctcagctctcattttggctgcagagaacaatgaa

SEQ ID NO: 180630 - DNA, 126 bp, Homo sapiens
gaattgttgatgattaatgtaaatgcatcttgatttgtgggttggtttccaagttaaggacatagaagcatagcactgattaaaattaaattcacacaagatccactcacctaatttcaaacgtga

SEQ ID NO: 180631 - DNA, 219 bp, Homo sapiens
acttccttaaccagcgcttctaaaagtatgggaccagctgccgcagcagccactgcagcagcctcacctggcaacttgctggtaatgcaaattctcaagcctcactacagacctactaaattaaactctggggatgggtccagcaatcaaagtgtaagcaagtcctgctggggatgctgatgtgcactgaagttagagaaacgctggcctagggcaatt

SEQ ID NO: 180632 - DNA, 339 bp, Homo sapiens
ccaggatttgaaatctgcccagtgtgacccaaacactgactatgaaccgaaggatgacctaaaactccactctgtgaaagactattggatactatcttattcagtgtgggctgccctaacaaaataccctagagtaggtagcttaaaacaacaaaaatttatttctcaccagaaactgactttctagcacgtgatcacagacttccagcctccagaactgtgagaaaataaatgtctgtttttaatcagtctatggtattttgtgatggcagcctgactaatgcaaatctgttctgaccaaaacagactttatccccctaataaaaaaagccaaagatt

SEQ ID NO: 180633 - DNA, 526 bp, Homo sapiens
tccaaaagacccgtcgcttttcctgtgtcccacagctgcctgtagagttgtggcaccataaactttagcagctggaaaagaggccaggcctggttccctcatcctgctgggtcctgctgggcacactctgcagtgggcaaaggggtctttctccttcattctgggtttagaaggcagggttctaactgggagaaagtgttattgctccgaaaggcttcttgggggctgggcaggtctttcaggaactcataaggccacagcttatggggaaagaaaaagaaacaaggaagtgggaattccaagggcagagattcttgatatgccatgggactgtgccaaggaatggaagagcaggggaagggagactccaggcaaggagagtcccaggtctgtcctcattgagtcgaaagggcgtatggcatactagagcgcgtcacccacagccccagctttactgtaggatggggaagacctgccagccatatcccggagtggtgtctgggaagaagcccttgagcagacccat

SEQ ID NO: 180634 - DNA, 311 bp, Homo sapiens
tgatagctgcattatttacttcaacaaactactcaaacaccatacgtcacagtttgctcatctgtaaaacagggataaataataaagggttaagtggggtaatccagatgaagcacttccatgtaaggtgttaatagttgctattgctgccactgctgctgccagaaggatgaggtcgcaggttattttgagtgtctggctagaggaagtgcaggtactgaccaggatggggactgggagatgatagaggaaggaaaaagtagtaaagacactacagcaatagcatctgtgggtttaagtaggttgggtgt

SEQ ID NO: 180635 - DNA, 255 bp, Homo sapiens
cttttgttgggtgtatgtattccaaaaatcttgtttgtaacttgtctttttaccatctttagggtgttttttgatgaccaaaagttcttgattttaatactcagatttattttatggttatacttttgtgtctttaagaaataattgacttttgtttttctcattttcgatgcccatatctgttaactctatagttgacacttatttaaaggcttgagattgcagtggtagaatagatgaagaagatagtttaag

SEQ ID NO: 180636 - DNA, 704 bp, Homo sapiens
ggtctcacttcggtgaatccatctattcacacaagccggaaacctcttcatccttactctgtccaattcatcaagttctgccaaatttgcttcctaaaatccctctcatatagatgtactcttctccagctgcgccaccttcctacttcaagttctgtcatctcttcccttcttccacccccaaccccaatgctaatttttccatactctagccagagatcttattaaaatgcagatcttgtcatcccctgctgcctaaagctcctccatggctttcccatcgctctagtttaagtatctaaatcctaatgtgacctacgaaggttctgccacggcttccaacttgctctcacacctctccacactctagccacctggcctgccctaggctcctggaacaacacactaagctccctcctgcctcagggttttatgaatgcaatttctgtgtgtggaatgtgccttcccaagtaccaagctgacagctcctcatccttcagttctcacttcaagagctgatttcttagaaaggcctttctggattccccagacaagatagttccacgcagaggatctcacagtaccctacacatttccttcagggtgcttaccatgctttgacattatttgtgggattattaaggataatctcgtcccattagactccaatgactacagggagcagttagttttactcactgttg

SEQ ID NO: 180637 - DNA, 331 bp, Homo sapiens
acaatttacaaaagaaagaggtttattggacatacagttccacgtggctggggagacctcacaatcacggtggatggtgaaaggcacatctcacgtggcagacaagaggagaggatcaagtcacatcttacatggatggtggcaggcaaagagagcttgtgcagggaactcccatttttaaaaccatcacatcttgtgagactcattcattatcatgagaacagtgcagaaagacctaccaccataattcaattgcctcccaccgggttcctcccacagcatgtgggaattgtgggagttacaactcaagatgagatttgggtggggacac

SEQ ID NO: 180638 - DNA, 679 bp, Homo sapiens
gttaaaatattacagattgaagcattgatatagacaacaaaaaacaaaaaaaaaaaaggttaaatgataactttttttttgagacagggtcttgctctgtcacccaggctgcagtgcagtggcacaatcacaattcactgcaacctcaaactcctgggcccaagttattcccctgccttagcctcctgagtagctgggactacaggtgtgcaccaccacacctagctaattttttaaaaattttagagagatggggtcttgctatgttgcccaggctggtctagaattggcctcaagccatccccctgccttggcctgccaaagtgctggaattacaaacatgagctgctgtgcccagccaacactgtattatgtatattttactacagattttaaaaatggaaaacaaaaagaatgcaaatagttctcctttgcccaagtcctgatccctcagctagctgcgaaagtatcaccaccaatgatggttgccaggggctagttactgttcagtggctataagagtttcagccttgcaagatgaaaagagttctggagatggatgatggtgatggttgtacaacaatatgattgtacttaataccactgaactgtccacttaaaagtgattaagatagtaaattttgttatgtgtattttatcacaataaaaagcagttggg

SEQ ID NO: 180639 - DNA, 465 bp, Homo sapiens
tgctggaattacaagtgtgagccaccctgcccagctaaagacccctattttttatatgggcatattcttgttattttagttatttaaaaaaatagtgtatattaagtacctaggatggccaggtcttgttgataatagggtgacaagacaaagaagatccttgcaagagtagctgggactacaggtgtgcaccaccacacctagctaattttttaaaaattttagagagatggggtcttgctatgttgcccaggctggtctagaattggcctcaagccatccccctgccttggcctgccaaagtgctggaattacaaacatgagctgctgtgcccagccaacactgtattatgtatattttactacagattttaaaaatggaaaacaaaaagaatgcaaatagttctcctttgcccaagtcctgatccctcagctagccccgccaggttcgggggttcattaaga

SEQ ID NO: 180640 - DNA, 209 bp, Homo sapiens
  misc_feature (12)..(12): n is a, c, g, or t
gctgtctagagnacccgtttggtcgatcactgtactccaaatccagcctgggtgacaaagcaagaccctgtctcagtcagtcagtcaatcaatcaataataaatgtataccattgttttactaggtaaatattttatatttatctcctgatgaagcctcattttttcttacttcctcactatagtatttagtgttttcttcagcagtac

SEQ ID NO: 180641 - DNA, 288 bp, Homo sapiens
aatattatagtgagacttcatgtctccaaaaattttttttaaaaaaatgagccgagcatggtgttgtgcgcctgtcatcgcagctacttggaaggctgaggtgggaggatcccttgagcccaggaggcggaggttgtagtgagctgagatcacaccactacactccaaatccagcctgggtgacaaagcaagaccctgtctcagtcagtcagtcaatcaatcaataataaatgtataccattgttttactaggtaaatattttatatttatctcctgatgaagcctca

SEQ ID NO: 180642 - DNA, 356 bp, Homo sapiens
aggtgccgtctgtcacccctttccttgaccaggaaagggaactccctgatcccttgcgcttcccaagtgaggcaatgccttgccctgcttcggctggcgcacggtgcgctgcacccactgtcctgcacccactgtctggcactccctagtgagatgaacccagtacctcagatggaaatgcagaaatcacccgtcttctgcgtcggtcacgctgggagctgtagaccggagctgttcctattcggccatcttggctcctcctaagtcttgctcttttcaaggtaaattttgtaaatgttgttgaagtaagggtccttttggtttttggtttttgaggtttttgttttgtttttgat

SEQ ID NO: 180643 - DNA, 477 bp, Homo sapiens
ctgtgcagcctggctctacatggtgaccaggaacacggccgccaaccgcacccaggttcgcgtttgtgtgaatgctgttaattcatcactgcacacaaggttccagcagagcccgaggaccagaggccagcacacacctggtcacgtcattgtcacaagttaggcagtgccccaccccaccaccaccgtgtcctttatgccaggtcctatgaaggtgaatgccagctcaggggtgtgtgtggagccggtgcgcccgcggtccaccgtggtggctgctggtgcagtagcatctgtgttggcttctgtggccatgcagggctgcctgtccttccccttctcggaatgtccctctggggtctacgctccctctgtcccagtttaaatgctccctcgacccaccttgggttataaaagtaacacaggcttactgaagaaaattagaaaagtacagagttcattcttaacatcgataagcca

SEQ ID NO: 180644 - DNA, 353 bp, Homo sapiens
tgatgattcaacctccagacggttgacactatttccactatcatttgtatctgcagaaaaccaggttggccccacagtctcagttatgaggacctatgagtaccagggagagtcattttgaggttatttttaatgtaaaaacacttaaaactgttccgaagacaggacacacagtgacgtgaggaggatgaggaggatgaggaggatgaggaggacgaggaggatgaggaggacgaggaggacaatacagcagcatcgcaagttcccccacacaaccatgccccagaccaggtcctgcgccaggggaggatcagcagcaggccttcccctcccactttttgggacagcccaaa

SEQ ID NO: 180645 - DNA, 304 bp, Homo sapiens
taaaaaattatgagctccttaaaactccattggactgtgaactccttgagggaaagtattttatttattcagcagctgatacagtgctgacttgtagaagatgtttgaaaagtatctgtgggttgccttaggtgagagaggctaaccatttgaatgtagccatattaagcacccataactgacagtacatctccaaatgaagggcaactctctgctgacccattcatttaaaaactgtctactgagcatctactttatggtaggcattgttctgagtgctggtgtcttaattcaggctgctgta

SEQ ID NO: 180646 - DNA, 435 bp, Homo sapiens
tgggtgaccttgggcacgttgctgtcatcctccaagcctcagtttccccatgtgcctacttcatggggtggtttgaggcttctgtgagattttgtaaagcaattcccacatgcctagagcaaagtaagtgctcagttaacagtagctgttagtattctgtgaaggcatctccttaactattatagcctgttcacctatgactaacactgtcaacataactgctgcagctgggccctttttcttttcttctttttttttttttaattggcacagggtttcactctcacccaggctggagtgcagtggcacagtcttggctcactgcagcctcaacttcctgggctcaagtgatcctcccacttcagcctcccgagtagctgggaccacaagtgcacaccaccatgcctggctaattgttaaattttgtttgtagag

SEQ ID NO: 180647 - DNA, 376 bp, Homo sapiens
gacctcatgatccatccgcctcggactcccaaagtgctgggattacaggcataagccaccatgcctggccgggcagtatttcttatactttaacgttcatacggatctccaggagatttgttataaaatagtggttctgactcagtgggtttggatggggactgagattttgcatttctaatcagctctcaggtgatgctgatgcagactgtgaggcaagtcaataggggataagagtctatcttttaattgagaacttgccatattccaaaaaaaaaaagaccaagaggaagtactctcttggtggcactagtccagcaggaatccattgcattcacatcaaggtatcacctaatcctgcatttgaggccttgtg

SEQ ID NO: 180648 - DNA, 357 bp, Homo sapiens
gagatgaagataatggtaagaatttttgaagccaaatggaattaatctaggaaaaggccttggaggggggaagtatttagtgcctgtttggaagcaacggagagaggtgggttggcagaaaagaggaatcagcaccctactagggaaaacaggacatttaaggcctgttaagatttatggagaaaatgttgaaatgtgcataggagccaggagtacgccagggagaatgaaatgcatcaagtgaaggcagggacaggaggaagaggttagccatggaccacagacagcctgaatctgtcatgactcacttttactgaaagtcagttatgagccagaaaatatgcataaatatttgca

SEQ ID NO: 180649 - DNA, 177 bp, Homo sapiens
agcaggggtaaagagagcaaaggagaagtgttgaagtctgtgacccaaacttagagcacaatgaaacctttgcctttcccttatgttgtactgtggcctaagtagaagagttgagatatgaaatgcttatatcttgaggtgtggctctgtaggatgatgtggaaaggagttttcttg

SEQ ID NO: 180650 - DNA, 594 bp, Homo sapiens
tgatattatctataggtgcaattcgggaagttgcaaattttgtgacctctggccacatgagtcctgagcagtgagggactgtagaaactaggcctgcattttagcagagttcaggccactcccacaatcctaaccttgtggcctttcattagctttacaaaggcaatttcagccccagaagtgggaggtgatagttttaggaagggactattatcatccttgtttcaaggttaaactgtaaattcctcccaaagctcctaaaattagcttggcttatgcccaggaacaactggacagcttggatgtccaaaggaagacggaattaactgtgtgaaatttctctgtcttttttttttgagacagggtctcactctgtcacccaggctggagtgcagtggcgtgatcacagctcactgcagcctcaacctccttggatcaagtaatccttccacctcagcccgcggggtagctgggactacaggctcacaccactgtgcatggctaagttttaaattttttgtagatacagggtctccccatgttgcccaggctgttcttgaattcctgggcccaagtgatccatctcagcctccc

SEQ ID NO: 180651 - DNA, 541 bp, Homo sapiens
aataatacatagttactgtagttataaagacagaaaaacaggaaacaaaacaatacttgaatacagaaagaaagtgacgtaaagtagcatttaaccctgttttggaagtcaaaattaaattaacatataagcagtgatgaaggttttcaactcttacccccaaaagaatacaattttgtgcaccgtttttgggaattctggttcaatagcatgtgcactcaataatcaccaatgccatcttgtggcaaaaattcaccaggagctttatgaacagattagaaacgatgacatttttaagtcagttaatttcaaaatggagctctgaaactaattggacataacagaggctcctgttctcttcaaggttatattaattatatggttaagaagataaagcaatgggcaccattctttaaatacgaaataagctgactctactataattaaattttaaaacagcaaccaaattaaacaaacatttaatatcttggcacttccatgggggaagggagggaaggggctcatctgccttcccaggaag

SEQ ID NO: 180652 - DNA, 505 bp, Homo sapiens
ggaagaagggagcggggaaggcaattcggcatgtgtccctgagcgagcttctacagcccctgcacagagtgggtccatctgccacattcctgtgagtcctgaacgtgaacgcacggccggccactgtgtgctggccggacagcctgaattctgaggccaaaacttccagaaaaaggcattgagctggagggactggcccttctaaggaaactggatgcgctgaatgaattaaatccgagccgattatactctacacacacacacacacacacacacacacacacacacaccacttttaaaagcaccattatagccagaaaccgccgacaaaagccaggccaggctgcagccaaacacgccagtgtttgggtttacaactccttggcctccccagtgttgggggtggaacccaggaccctagacattatttaaaagcacatttgggtatatacttggcttttgaaaaagcacttaaaggcccacgcacaggccactcccgagacag

SEQ ID NO: 180653 - DNA, 528 bp, Homo sapiens
tcatgggtgattgtggcttccagtcctaccagccactcactcctcccctcactcagaaggagctcagcagtcacgtgtcagcccatcagggcctgtgtctgcttggtccatgacctcgtcatctccaatgacctgctcctttgctcctctgctctgcacttcagccatccccactgatggctgcccaggcccatgtcaccacctggaactgctccacccctgaaattgctgaatcaggcacctctctacccacagccttcaggccctccagcccactctcagtcccttgtgggacacgggttccagactcagcgggacactaggccttgcttcctcccctgctaccccttctgtcttcatttcccgccctccccaactgaagttccctggtccatcattcgagcacttttctgccaacatccgcagctctcttggccgcccgactcatggtcccacccggctggcagccccccagccctggaggaatcccagcagcctccagcctggagccgctctccccctacctcc

SEQ ID NO: 180654 - DNA, 600 bp, Homo sapiens
atcagtggctatcattagtgttagcatattttatgtgttacccaagacaattcttcttccaatgtggcccagggaagccaaaagattgaacaccccaatataaatcatcaagacagatcttccctggttacagtctaggagggaggtggggaagatacattttcacaagtgtttacccctcaagacagaattcgacacaaaaatagagatacaacagagtgttaagagcatgacctttggaatcagagacttggctccaatccctggccctattacctttcttcttatctttttaggagacagagtctcctgtgtggcccaggctgagtgcatagtgattatagctctctgcaccagctctgttattttctagcattataacttggggaaaatcatgtaatgcctctgtgggtaagtcttatacccatcctatagggtagttatgagaatgaccggaatttacagataagcaaaccgaagctgcctgcaccaccccctgcttctgccttcggaaatcctacccagccttccagcgcaagtgtcaccttttcatccatgaagcctttgtcagtcttcctggcaataaaatataggtccttt

SEQ ID NO: 180655 - DNA, 575 bp, Homo sapiens
gtgtagaaagaagtagacatgggagacttttcattttgttctgcactaagaaaaattcttctgccttgggatcctgttgatctgtgaccttacccccaaccctgtgctctctgaaacatgtgctgtgtccactcagggttaaatggattaagggcggtgcaagatgtgctttgttaaacagatgcttgaaggcagcatgcgcgttaagagtcatcaccaatccctaatctcaagtaatcagggacacaaacactgcggaaggccgcagggtcctctgcctaggaaaaccagagacctttgttcacttgtttatctgctgaccttccctccactattgtcccatgaccctgccaaatccccctctgtgagaaacacccaagaattatcaataaaaaaaaaaaaaaaaaaagaaaactccccctttcctagtaaaatctatccttgaatccctgaatctacacctgagatgttaagaaattcatttgcagcctggtgagcaacaggtggcatcttcaaagaacccactttgcacactaggtggtaacttcgaaagtaacaccttgtatttaacaatt

SEQ ID NO: 180656 - DNA, 598 bp, Homo sapiens
gctactgtccctggggcactgaggccctcctcagtgacttcctccacctcatcttccgccatctccaagccaccagtgtccaacggactactgatatgtcccaaactcatcatttgtttattcaccaattcagagcccacctttttttcagcactgagctagcctctccttgctagaagcttacggtcgaaggtctccagccatcagaagaagcacgtggagcgctgcgtccgtgttgtggttattcatccagcatgtgttgagtaagggttgcacctgtgcctggcattacgccgatgcgggcccgcatcggcgtaaacggcgtaaggtttgggtctagggtgtaagcctgagaataggggaaatcagtggaatgaagcctcctatgatggcaaaatacaagctcctattgataggacataggggaaagtgagctacaacgtattacgtgtcgtgtagtacgatgtctagtgatgagtttgctaatacattgccagtcaggccacctacggtgaaaggagagatgaatcctagggctcagagcagtgcagcagatcattcatattgcttccgggagtgtgggagtcagctaatactt

SEQ ID NO: 180657 - DNA, 288 bp, Homo sapiens
gccttctgtgtgtccacaccaccccgaggtgacctggactcagggaatctgtaactcttgtccttttctagggcctagggacctaaacattgcctaggagtctggggacatggtgagttgtcctaccatctggggaaagtcgataccctaatcccagtgaccgtctctggggaacaggcccagggccgctccctgctcctccttcctcccttcagggaaggctgtgggagcctgggggccaacgccccattgggcccagcccctccctggctgatgccatggtgatgg

SEQ ID NO: 180658 - DNA, 267 bp, Homo sapiens
ctcagaattctgcttggcaaaggattatcccattttgtttccagaaaaaaaaatgccttatgaaaagtcattttgatatgattgaatttagcagaaacataaagattttggatttgtcatgttcatttaacatccagctgttttctaattcttaaatgaaagaccaaaaaataatagtttgctaaaatgtttaaggatattagagaactgtaacgttatttttgcattgggtagtattataatggcattcagttcaggttaacaata

SEQ ID NO: 180659 - DNA, 438 bp, Homo sapiens
tgtggcagcacaacttcaattcctgcttctgtcttccctctgtgtctctctgtcttcacatggcattcttttatttatctctctttttttacaaggacaccagtcttgctggattagtgtccaccctactccaatatggactaattttaactaattacatatgttatgactctatttccaaataaggtcacgttctgaggttctgggggttatatctttttgaggaaaatgattcaatccattaacactatctgttcttccagagatattttatcttccaaataagcctggatcctactgtcttagaaatacaggaattgactttctctgggctgtgttttgatgccatgttttcaccttttaccaagcagagcaagaagaaatgacttaatgaatggaactattgaattcactaaataaaattcactaagaatcatg

SEQ ID NO: 180660 - DNA, 745 bp, Homo sapiens
tggatggacagagggacgagggacgagcatctgccgtcgtgtcccggctgccctgcagtcgcctccaacacccgctgctgcccgcccgctgcctgcctgcctggcatctctctctcccgggctgggaccgtctcttctccctcctgtcttctacatgggatggactcaggagcgctcaacagatgctctgaaatcaatgactctgaatctagaagtcaaccggagaatgtgctcctcagagggccctggaatcttcccctcgtgcacttgggtttcagtttgctgaataagacggactctgctgcctgctcttcagagaaggttttggtggaggactcccctcaggtgcccctgcctggatcccccactgccccagaaggctggccttcagatgcctgggtagctggcttgcttgacccaagcatggacaagtgagaacagatgaaagaggccagcagacccaggacccagccctttctctgccaccagccagcactcactctgctgtgtgacctgagaccaggcagaccatctctctgggtctcagtttccccctctataacaccaggggctggtcttcatgatcccagggccctccccagctgtgcccatctgcaactgtgagattctgagagcagaggagggaaggcgggatggcccctctttccccaccgcctctctctgtcccccagggtcaccccaaagccgccccctcccccggctccctggaacttccctgcagctg

SEQ ID NO: 180661 - DNA, 725 bp, Homo sapiens
gtgttcgatatctttgcaggctgaatggccagttgacttgagatgcatataccatgccttcccccttttatctttaaggattcatgacatgggctgctgttgagggaaccacacatctatcttgatggcagaaatacggtatttggaaatcctgggaaaacctctctcaggataacattttcagtagtaggttttcctccctgttacctctggttcctattccattgccctttatcagtacaggcttttgaaaatgccatggattaaagaggtcccactgcccagggctgagcatttctttgcccggcctggtctctgctagtgggtgggtaagtggagcctttggaagaaggaatcggtgtatggactgttcaagacagacacatacttatctaatttaggcatttctagctgtaggaaaggcaatgatgtgatctattccaatgaagagtttacactttggaaactcagtttcagaaaattcttccataatccaacctaaatcttttctgctttactattttgtcttaagccagagataggcaactgctgttttcccgtcttaaaactctagaaaactggagtgtagagaatgggcaagatgagaatgcctcgtctatgtatgtggcttagtcaaaagctatttcctgaatctctcgtgtttagattttctcatcaacgttaatgaccactttcagggcctcactccctgctccccatcatgc

SEQ ID NO: 180662 - DNA, 532 bp, Homo sapiens
tgttgagttgttgctctctagatggagtttgaggattttctaagccaaagcatggagtgaaaggggccaggccctcaccagggaatgttcactgccactcctcacacttaccaactcagattcaagacccctgcttggggagaagtggctgaaggcaggcagtccttcagctcctctacaagtttaaataatatcccagccggccgggtacggtggctcacacctgtaatcccagcactttgggaggccaaggcaggcgaatcacctgaggtcgggagtttgagaccagtctgactaacacggagaaaccccgtctctactaaaaatacaaaattagcctggtgtggtggtggatgcctgtaatcccggctactcaggaggctgaggcaggagaatcacttgaacctggcaggcggaggttgcagtgtgccaggagttcgagaccaccctgggcaacatagtaaaacccctgtctctacaaaaaatacaaaaattagctgggtgtggtggtgcatgcctgtagtcccagcta

SEQ ID NO: 180663 - DNA, 415 bp, Homo sapiens
acgaaatgccaacttaactccactggcattttcagattttggcagcgggaggcattccggaaactctggatatctgactaggtagtgaaagttggtaatggaatttgtaggcgaagacttaaagatatctatgcttactatgttgaaaactcagattaagatttttatgtgaaactaaaacatatttaaaaagaaaaaagaactgaatggaaattcaagaactttaaaaacaatagcatatttaatttaatgtagatagattgaagaaagagagaaatattatcctgaaaaatatgacaaaaaaatttcaaattgaaatcaaaaagaataaaattggagtgtaagagaaagaagaaaagtagtgaaaaggactgagatacatatagttgcaatactggaaggagaagagaaagac

SEQ ID NO: 180664 - DNA, 317 bp, Homo sapiens
tgaggaggctggacagccacgacggacgaagtgtggtgtcactgcagaccctgcagttcaagcttttaccacaaacacctcacagtgctgctccccaagagtgagggacagtaaaaccacacattgcctccttcagcatcttagtaaagggaaaggtggggacagtggatgttgaaggtggctgtgaaggagaagacaagaggccgacagtgagcacgtgggcctaaaagccacgtctggcagaagaaggggtgcaggcagccggctgtgtgggaagccctgtgtgtataaatgctgtagcctcgtcccttccttac

SEQ ID NO: 180665 - DNA, 370 bp, Homo sapiens
tgactctagaggattactgatcttccgtgcccgctgtgccaattagagaggcctttataggtcaaagtcataggaacgcacccacttgacagatgggaagactgaggtgcccacaggatggcagagccagaagtcaaatgcaggtgtctacatggccccgactgtgccctgtcatcggaccgggaggggtcctgaggaagtctttagtacggctttgctagtttgagtcttagagagtgtctgcaggaaataggaagcgggaagtaggtttttaaagaaaaaagtgtttatgatataattccatttttgtaaaacaaaaagaaccatccatctctttatgtatgagtgtttgtttagggacggaagatca

SEQ ID NO: 180666 - DNA, 461 bp, Homo sapiens
tctaccctaccttctaggacttaaaaaaaaatactttctctcataaagagaacatatttaccttgtagaaatattgttctgcctgctatgtagagaacaggttggtgcataggagaaagactgagtttgaagagacaggtgatgatagtcaatactattgaaaataaatgatggaggttgtgtctagagtggtgacagcggatatggagaatagtggacagactagaaaactattaaagaggtgggattgataggagttagtgaatgatggacatggtgaatgatgggatgcagtgaggtaaagaagaaggacattgtcaaagataactcaggcttttgacatgagcaactgagataatagcaatagtagtactatttactgagctagagaaagccagagaaggagcagagtggggtagatcagagatgatctggatttgaatatgatgtgattgtggtac

SEQ ID NO: 180667 - DNA, 207 bp, Homo sapiens
taccactgagcacagtgataaagtgcagtttcatatttttctctaaaacacactcacacaacagaaatataacatcaagatggaaaactgtttctgcaaacagcaggggcccaaagatgcagtgggtaaggtttgttaagctatctcgttctgatcactgaaaataacaaggtttgaccaaaaaaaaagcgaacaaattttactgaa

SEQ ID NO: 180668 - DNA, 402 bp, Homo sapiens
gtacaggttatatgcaaaaattatagcattttatatcaaggccttgaacatgcctggattttgaagtctgcatggagtcctggaaccaatcccccatggataccaagggacaactgaacatgctttccaggatcctgtacttacagcataaaaatcatatatcctcctccaaaataagcttaacagaaatcttatttttaaaagtcatgccatagtttgactcatttatctattgccacatttagaattcaagatcactactgtaaacgaattctacatacagtttaagattaggaaaattaacattcatgtgaaaaatattcattttttggtttttattgaatattttgtgcatttcctctgtgacaagaataaataaacagtaacacactggccaactac

SEQ ID NO: 180669 - DNA, 215 bp, Homo sapiens
tctggtgacgggatacggaaagaatgcctatcaattcaaacccacacatgcacacacacacacacacagacaacacactagaaaatgggcaggggacctgaacacatgcctcatgaacgacgatacccctaaggccagcaggcctgtgaaaggcactcggtatcatcaaggaagctccaaccacgagatgcctctacatcaggatggttcaaaga

SEQ ID NO: 180670 - DNA, 445 bp, Homo sapiens
gaggaggcctcatggaacttacaatcatggtgaaatgggaagcagtcatcttcttcacaagacaacaggagagagaaggattgtgtgtaggaggagctgtgaaacacttaacaaaaccatcagatctcctgagaactcactcactatcgtaagaacagtatggcggaaaccgcccacatgatccaatcaccttccaccagatcctgccctcaacacatgggtattatgaagattacaattcaagatgagatttgggtggggatatagagccaaaccatatcattccacccctggcccctcccagatctcacatattttttacatttccaacccaacatcatgccttcctaacagtcccccagagtcttaaatcatttcagcagtaactcaacagcccacagttcaaagtctcatctgagacaaggcaagacgttttggcctataa

SEQ ID NO: 180671 - DNA, 602 bp, Homo sapiens
tggcttttttagccaatcgtgctgttctacccctcagttcacggtgattggctcaaagatatggtcatgtctctcattaggccaattaaatcctgcaagactcaatttcagaactcttgggtgactataaaggaagcagacactctttcccactggaagtgtcataaaagcctgaggctgagaggctaccacatgcagccccaaaacagaactgaggctgagaggctaccacatgcagccccaaaacagaactgaggctgagaggctaccacatgcggccccaaacagaactgaggctgagaggctaccacatgcggccccaaaacagaactgaggctgagaggctaccacatgcggccccaaaacagaactgaggctgagaggctaccacatgcagccccaaacagaaccgaagtagagctgcagaatgaaccctggtaaccatttttgtatactgaatcaagtcacatctcactcctcggtttctagtaacacgagccattaaattctcttttagcagtagttaaggtctgtttggactgggtttcctatcatttgcaattcaaataacactaatatgctaagtcacccactgtaacggt

SEQ ID NO: 180672 - DNA, 249 bp, Homo sapiens
tggagcactgcagcatgccatcgcagtgtatgaacatactactattcatctcgtctgctgctgatagacatttatttttatttaagtttttgttgtttttgctattaaaaagccttgatggacatttttaaaaattctgtatagaaagcaaatgccaccttaagtttgaaaataagtgacaaaatgaaaaaacaatttcaacacatacaacaaatacatagttaatatgcatgagatataaagtgctct

SEQ ID NO: 180673 - DNA, 214 bp, Homo sapiens
atcagatccccgttagaaaattaaagctacaagactaccacggtaacaagataactgaacctaacagagagaagacaagacaggaagttcttaccatctggaatacgtagtatcagccagtcctgttttgcacagaaatgaataacatggcaaagaccgagtgtttttccggttcccttctctccatctaaaatatatgttgttaaagaaaacg

SEQ ID NO: 180674 - DNA, 438 bp, Homo sapiens
tcctagctctgcccacgtattagctgtgacattaactatgtgttaagtagccctcatgtgcttgtttctttttcaaaagatggagctggtactaactacctgatagggttgttctgagatcaggtatagttgtctgtgtacaactcttcgtcatttatggcactctgtttaggggtgcatcagtcagcattgctgattcttgctgctgttggtgatgatggtagatatccagttggagaaattattggatctttttaaccagttaacccagttagagagggactcaataaaaccaatttaataaagttccttttggcacaataattgaattacaattggggatgtaaacttaaaccttgacgtgacttgtcaccggaagttggaatttaagtcaagggttgaatttaaaagtagtggttagccagaaacaaggggtta

SEQ ID NO: 180675 - DNA, 176 bp, Homo sapiens
ccatcgtactccagcctgggggaaaagaatgagacttcatctcaaaaaaaaaaagaaagaaaaaaattacacaggattctccccacttctttttctcttgcaaagaggtggtgatgaaccaggtttgctcaggcagatgacaatactcttgaaagtggtggcagagagccaggtgt

SEQ ID NO: 180676 - DNA, 777 bp, Homo sapiens
cttggggactctctaccccccacccccaccccaccaattagctgccccggaggaggagaggggcttttcctgaatatcctccagatgccgcacagccggcttctgcctataactcctgtcattatcatgtgtttttctcttgttctcagccctgtgaggtgagaagggaaatcgaggcagggagattggggttgcagccgcttctgggaggaatagaaaaaaaatttgagagagagagagacccatcaggagccccttgaaggagggtggctagagttaggcagaagcaagagggtttctgtggagagcagggaaggtcaggaagggaccccagatagcatcactcccagggctctaaaggagttctatttgccacaccaagttagtggaagagagagactggacatgttctccttaactatctccctaccctttcttaaaatgttcacccacgccccctctgtatctccagctcagatcaaactatccaaagccccaggagaggacccctccccaaacacacaccaatatttctgccttgggagtgggaatataaataatcagctccaccccactcttgggtacagggtggtgagaaaggggaattgcatagaaatgtaagttcaactctatccagaggcagcctaggggatcccttatccctaacccctgccctcttgcctcagggtccatcaacattgaactttcttgtttactttccagagaatggagatgacccagctcacctgacttagtatgttaccttcctcctgctat

SEQ ID NO: 180677 - DNA, 418 bp, Homo sapiens
cgcacccacggcctccacttcaagagtgaggagggcaagtttgcattctcctaatgagtaatgcatctagaatcagcacaacttttccctgattcactcttttagtgaggctacttttctcaaggactcctagcaaccccagattcttattttatcagtttcttattttattcctgtcacttctaagtatttgccaactatcattttctcagttttcccccatctaagccacaaatgcaactaattagttatgaaagtgactaagtcttttttatgtaaaattaaggataagaatcttactactaatgttctctgaatgatagcataactatcatttaagaaaactccagggctgaatactgccagactagctccctacatagctcatctttcaaggaagttactgaggaatgaaagg

SEQ ID NO: 180678 - DNA, 191 bp, Homo sapiens
tgtcaatttctacacacacaaaaaaaaggtctgatggaattttgataagaagctgtagataaaattgtggagaattgctatcttaacaatagtgggtccttcaatccgtgaacatggtgtatatctcttttacttagatttctctctaattctctttataatgttgtagctttcactgtagagattttgga

SEQ ID NO: 180679 - DNA, 1768 bp, Homo sapiens
agaggatttgtgtctgcagattcttctctaaggtttgtgtctcacatagtgagagaatcagccagccagggaaatgggacaggattttgtctctttccccatttcctcttctaatgaactcctacctatgctttatgactgcattaaggggtcacctcctccaggaagcattccctcatctccttacgctggttctgagtgtgtcgttcctgcttgatcccctcccagcaccatgtgtgtgagttctcacagctcacaccccatagtattactatgttgtttctacagtgggttcctgtcaggggttccaaacttagctgtttaggaggatgagtagattgtacaaccacaccaggcgggcctgatcaaatacagtaagaagtgtccggattggcaaaccagcgggtccctcttctagatgttatcagagagatactgttagagagaggttgctagatgttaatagaggctgctgttagattccagctccctcctcccctggtcccttttctctcctcatgccaaaagatagacccagtgttgccagagcttccacttttaaaagagaagccttttaaaatataaactctcctgatttttaaatgttttcagttaagtttttaaaggaacattcataggccaaaccaaatacctgtgggccgtatgtggcccccggggccagcagtttgcagctccttggttataggtgcctctaacccattgcacaagctccctcaggcatttcatgtctttcctttccattccccctgggcctagcagggagctggcatgtcacagtgggtgctccctaattattggttattgacttgaatgctagactgagcaagcacctccctgctcacagggtgttaacatttttccctcagaactgtttgtatgtaatgctattctgaattgcttcagttccttacatactttagtgatagtctgtatgtgcctggaaaagtcatcattccttagattctagacaactctgttcttctgttcttttcctttttcctttctctctccgtcccctcaacatatgtttttgttttttgttttttgccagttcttttgtatctggccggttaacacagggcttcataacatggggtcggctgttattaagcaacagtggtttccggtagctcactgactttgccctctctgctggtaagccattgctgatttccatcctggtaacaagcatgattttcagatttaccttcatttgcagtgaacaattatagcaaaattgcttaaagaaatgaaccttcaggtgtggcggctcgtgcctgtaatcccagcactttgggaggccgaggcgggaggatcacttgagcccaggaggtctctaggctgcagtaagctgtagttgcaccactgcactccagcctgggtgacagggtgagacatcgtctcaaaagaaaaaaacaaaaaaacacaaaacacaaaaaaccttttggcccccttcgcccccgcgagaagaagccttctcagaaacctcatccgttgtgggccgcgcgcgcggcccccaagggatcagggaacactgtggcacaaacgctggtccccagaggaaaacccgcgggcccgagacacacgggcctgggaatctcccccctttcacatcaggccccgcggggcgtcacccccgccgtttctcggccatttccggatggggtcttccggggtccatccggggactcctctcaccgggggttcccacgccacctccgcctttccctttgcccgccccccggga

SEQ ID NO: 180680 - DNA, 679 bp, Homo sapiens
caacactctttatacactctttcagataaagtttccttgaaattggccagacatctaaaggggatgtggtttttggaggccaagctatagaaactagaggatgacttccaaaaataacgatgtttttctgaatgtcgctgcattcctttgtattctcctagttttgactgcttagatctttccggcctctcagactgaggcaagggagaagcaagagaaactcaccccgagccagaagctcaggccagtacagcttactcccctgccaccagagtgaaggtcagccttcaacacagacacaaggagccccagaaggggaggagacgtcatacctctgtccctccccagatcagtctcctggcaggccaggctctctgattcttatctctagttaccccttgtttttctcaaaagaacaggtccctaaaaaaggagggagtttgcatgtctcggggccacctttgctaagcaaatgtctccattctgaatacagaggcaagagttgggttggaggttttgcgatgctgaggtaaactcccagctctcaactccagaggcttagaaaggctcagggcttggtaactggaaccttgcatcgatggagcagaagttggaccgcaggcttccccatggagagctgagcctggtttttcttgggaaagaagttgatctttgccat

SEQ ID NO: 180681 - DNA, 206 bp, Homo sapiens
actaaatttctacacagagtccccagcctattcagcccttaatgttctctgaatttgctgaggtaaaaaacaaagatttaaaaagatatcaggaggaaggtgtgataacaactccacaacactcttgatactgaagaatagacaatttactaaagtcagatgctaaaaacaggacgtctgctcagcatcttggtgtagaaattgaa

SEQ ID NO: 180682 - DNA, 389 bp, Homo sapiens
aacttaaagactgtttcttaatgagtaaggagacgaggattctactggtaatgctggagaacttcaggtgtgctgtgacagaaaaaatttaaaaagccaagggaagcagacaagcagcattatgggcaatgaaatcagaagggacagaggcagacattttaaaacacaaagattcaaaacatttttttttctttgagacggagttttgctcatctcccaggctggagtgaaatggcttgatctcagctcactgcaatctccgcctggttcaaggggttctcctgtctcagcctcctgaatagctgggattacaggtgcccgctatcaaacctggctaattttttgcgtgtttttagtagacatggggtttcaccatgttggccaggatg

SEQ ID NO: 180683 - DNA, 308 bp, Homo sapiens
ccacccctcttcatgtcaccgacgcttcctcagtatccacaggtcacgccacctctcttcctgtcaccagcctttcctcagcatccacaggtgacaccacgcctcttcctgtcactagcccttcctcagcatcctcaggtcacaccacccctcttcctgtcaccgacgcttcctcagtacccacaggtcacgccacctctcttcctgtcaccgacgcttcctcagtgtccacaggtcacgccacccctcttcctgtcaccgacgcttcctcagtgtccacaggtcatgccacccctcttcctgtcacc

SEQ ID NO: 180684 - DNA, 225 bp, Homo sapiens
ggaatatcaagtgctcctctttgtggaacttgctactgtggccagtcctaccctggctggatttgtagacatctagggcacaaggcaagacctgctatctcacatccatcttctgtggcttttgcttgaagtgagaatcaagcagacaggagccagtctcttttgtttggcttctgagcaggtgtctattgttcaaacaggaggtttcatcttgctgcacgcaca

SEQ ID NO: 180685 - DNA, 175 bp, Homo sapiens
actatatttagcataactatacagcataaactatacagcataaactattctgcattgcaatattatgaaaatatgttatgattaacttttactatataaaccaaattctaatttcccccccaattaactcagtataggatattgtttatatagtaaaagttaatcataacatatt

SEQ ID NO: 180686 - DNA, 145 bp, Homo sapiens
gcttggtaaggacaacatctgggacccctgtgggtcagcaggacaggaaagttctctctgagtgggcagttttgaaagtagacgcaaaggacaagaagcagcctgctgatcatcttcacatcttcagtagagcctgaccattctg

SEQ ID NO: 180687 - DNA, 493 bp, Homo sapiens
tcactgggttgggaggacgtgcatggtggccagtgttggccagaatttccaccacacaggtagggaattcctaccaccacacagatggtaggcggaagtagccccacgagggtggatcacagtaaaatcaccaggaagccatcggctcttggcactctactgagtttccatgggtgttaaacagcccggtgacatcggttctggccggccagatgcacaggggcgcagccagcctcccccatgctcacacatgctcagcttctttcatggaagattgcggcatcatttcaccttccaggaacacggagcagatggtcgggtcacctccccgcccaaaccctcccatgactgccctgcatgggcccagtcccttccatggagctcctggggccggtcacagcctggccaccaccctcctctgcgccctccgcccaccgcccacttccatccgtcccagtctggggccatccctgtcttgggagagctgggccct

SEQ ID NO: 180688 - DNA, 315 bp, Homo sapiens
aggagagtgctttcttcttggggattggattggtgttttcacctattcttccattttttttttgaagatgagctgcttgtagaggtttggagacatcaactgacttctctcttttctgtacctcctgaggcacccaaagcatgaatacagtttttttcttcttcctctctctttatagacttggtctttgatctgtgatctatgagaaggctgaagcccccttacaggacagtttacaatttactgggagtacatggaagtcctggactagggtgatgtggctgcctcccattgcacaggagcgattagcggagg

SEQ ID NO: 180689 - DNA, 590 bp, Homo sapiens
ggtgctggctccagcaggcctggctgtagctgggatggagcctgctcaggggtacagggcccctgtcaagtctgcaggctgagtgggcagggaagaggaggcctttcataaccgcacaagcaagaaggagcgtcagccacggagcagggtgggcgaggaccccagcctggacagagtcaaccaaacaagcgctgcctcggggtccctgggagtcaccacatgctggccactccctgcaaggcactggcacgcagatttgcctggctgattccagaatgttaaaagcaaatgactttgaaaatggatgggttgggcatggtggctcacgcctgtaatcccagcactttgggaggccgagccaggtggatcatctgacgtcaggagttcgacaccagcctggccaagatggtaaaacgccatctctactaaaaatacaaaaaattagctgggcgtggtggtgcatttctgtaatcccagctactcaggaggctgaggcaggagaattgcttgaacccaggaggcggagattgcagtgagccaagatcatgccattgcactccagcctgggtgagagagtgagactctgtctc

SEQ ID NO: 180690 - DNA, 342 bp, Homo sapiens
aaaacaaaacacccccacaaaccacatgtgtactcaacccatgactatatttaatacagtttggattgtagaaaatactatcttactgtgacattttggtgaaaaacgattgcaaatcaacattaatccatattataacaagtcccaaagtaaaacttccatatgacaggcatgtatatttatcagtaatgaactcattaactatttctaatagaagcccttaatcaattttcaagtcaaacaatttgttttgtcaatgtttttcttgtaaaatctttttttatttttatttttttaggcttttttttttttttttaattgatcattcttgggtgtttcttg

SEQ ID NO: 180691 - DNA, 406 bp, Homo sapiens
tttctccacacccttatttttagcagattaaataattgtaacccctttaactttatcttctaagtctatttttggcttttatctaaggcccctttaaattctccatgttgcttttggaaagctagagtccagaaccaaggacaggtagctaaagtgtttcacataagagaaactccatcaacaaaagtattgcgaagtctgtacaagcccagggcaatcaatgaaatctgcatgtaaacgaggcagttttccagacaatacttttcaattagactaacttacaaacttgaggaataacgagaaactacaaagaaaacatcaactgcgtcttcaaagcattttcaagcacaaaccctaatacagtttactggatgccatttaattgggcagctctaagcatgtagct

SEQ ID NO: 180692 - DNA, 327 bp, Homo sapiens
tatgtaatcttctgactgaggagtggtagaaacttctgcaaaggataaccaagtgaaagagatcagaaaagtgacacctcactcttaagtgaaggccctagggcaacacactgaatatgggaaatgatctgaatcctaaaactcaggttttgtgatatattcccccaactaggtagtacaagatatttaacaaaatctcagaagagtaagaagagcccttgtttagctaggttttttctttcactgtgcattttcctgagactatagaaaagtgagaacaagcttgagcttggaaggcaaaggaaatagatctcaaatatggtggag

SEQ ID NO: 180693 - DNA, 314 bp, Homo sapiens
tccatttgagccattacaaatgagaaacgtctcctgcttttataactcagtaatgggaatgtgactgttgaaaataattattttctttgttttgagcccttaagaaaagagactttattttaatgtttttttttccaaaagctgaaaaaatgctttttaaaaatctttaagtatagtggttatattcagactatatttaatttaaaataagcaaattgtaacaaagtataaatattttaacattcagcaaaatgaaatgataaagctaagagactatcctatgatttgtatatttattggtgccaagaaaagtg

SEQ ID NO: 180694 - DNA, 360 bp, Homo sapiens
  misc_feature (25)..(25): n is a, c, g, or t
tgctgggattacaggtgtgaaccanccgtgaccggccaaggcctagttttcctaagtgtctttatgggaccctcacacctgtacaccaaactccttcaagaggcaaactctctcctaagagggagacaaaagaaacagggccagtggtttcactgtagacaatggtctatctgtcctgcagatgagtcagaactaagaccccttgaggaatcatgttgctttggtgccggctgtctggtttctattccatatcctgtgccgcacccttcccccagccacagtgacatctggaggctctgaccacagctggcaggctctgtggtaccgcagaggccaatcttcaacaggaagtcttggggg

SEQ ID NO: 180695 - DNA, 246 bp, Homo sapiens
gactcagaggatcccgttctagccgcgcagtggtttcactgtagacaatggtctatctgtcctgcagatgagtcagaactaagaccccttgaggaatcatgttgctttggtgccggctgtctggtttctattccatatcctgtgccgcacccttcccccagccacagtgacatctggaggctctgaccacagctggcaggctctgtggtaccgcagaggccaatcttcaacaggaagtcttggggg

SEQ ID NO: 180696 - DNA, 323 bp, Homo sapiens
ttcttaggaattttaaaaaagaatttcttttcaaaatagaattactttacctttttcaaaaaaattttggccctaaaaatctaaatacattttaaagagaaccaaaacaacagctcgtttttttgaaagttgctttttgactgtcttaaccttctgctagtgaccagactctctattcaataaagcctatgtgccctttgctcctaaagaccctttcagaatgtatgcattcctcttttcacgattgttgctttgtgttttcaaacacacaaacatatttcactacctggcttctcagaactgattcgaagcgataagttgga

SEQ ID NO: 180697 - DNA, 129 bp, Homo sapiens
gagatcagactgaagagaagcaaaggtagaaacagggaggccaagcaataaacaatttatgttcaaagtagtatatttgtatttcctgagatattgaaggagagtataggagataaagggttaaggatg

SEQ ID NO: 180698 - DNA, 422 bp, Homo sapiens
ctattttatgagctgggagcagaaaaatagagaatacacttctgcccttcatctttctaggtatcaaagcctttctaggctaagccacagctaggactgttctcttttacacagtgaaatcatttcgaagtgagtagcctagtaaatttagaggagtaaactattcttgcctatgtcttcatgatctataatggaagataaatcctgttagcctgggcatggcaaggcaattatttcaactgctacgtttctgtggaacaaacaaaacgactccaggcttatgcatttcctatttaacggagaagggaagcagcactatgctcaccatgcccggaacactggttgtcacagaccagtggcaaccagaatggaagacaggccttgtctattatcaccactggatatcaaagtcctctgggcta

SEQ ID NO: 180699 - DNA, 266 bp, Homo sapiens
ctcttttccaagaagtccaaagagacgcccctcatcgcaaaggaagtgctaccgtgctgcctcgatgtcccccttgggtgccatccctgaaacatcgaacctcccatacctcttctccagccgtccccctcatcctcgttccccgcctaccctctcttcaacttcattcattcatccaacattcgctgggggatttctacattgacacgccccggacagaagcctggggtaaagatgatcaggaacacgttccctcccgctaagcg

SEQ ID NO: 180700 - DNA, 793 bp, Homo sapiens
aaacctacactttttaaaaattttttgttgttgttgttcttgttgttgttgagacggagtctcgctctgtcgcccaggctggagtgtgcaatctcggctcactgcaagctccacttcccgggttcacgccattttcctgcctcagcctcccaagcagctaggactacaggcgcccaccaccatgcccggctaattttttgtatttttagtagagatggggtttcaccatgttagccaggatggtctcaatctcctgacctcgtgatctggtctcgatctcctgacctcatgatctgcctgccttgacctcccaaagtgctgggattacaggcatgagccaccgtgcccggccactttttataaattttaaaatgtacaattgttatttactatagagttatttttatggtcataatacaaattatatatgagtataaataaaattcatttctaaactattaatattttttccaaattgttatatatttttctttgaacatgtggcctgtctgcctgcaaacatgcagactttttgattcacatagagttaaatatgtattagtctaaagacaaactttaggtgtaagaaaattatggaataagtgtgtgtgtgtgagtatgagtttgtacctattttcagaaaagaacaatatgggaataaaaatcattttaataaggtggctactataaaactaaaaaccttaaaaaatgctgaaagcaaatgtatactttgtgctttgtattgaatttattactgtacaatccatgacttacagttctgaaccttttcatg

SEQ ID NO: 180701 - DNA, 572 bp, Homo sapiens
caagaacggagacgactgacaatagatagatacacatgttatataagttaatattttgtttgtaaacgatgtctagctgccttgacctcccaaagtgctgggattacaggcatgagccaccgtgcccggccactttttataaattttaaaatgtacaattgttatttactatagagttatttttatggtcataatacaaattatatatgagtataaataaaattcatttctaaactattaatattttttccaaattgttatatatttttctttgaacatgtggcctgtctgcctgcaaacatgcagactttttgattcacatagagttaaatatgtattagtctaaagacaaactttaggtgtaagaaaattatggaataagtgtgtgtgtgtgagtatgagtttgtacctattttcagaaaagaacaatatgggaataaaaatcattttaataaggtggctactataaaactaaaaaccttaaaaaatgctgaaagcaaatgtatactttgtgctttgtattgaatttattactgtacaatccatgacttacagttctgaaccttttcatg

SEQ ID NO: 180702 - DNA, 180 bp, Homo sapiens
atgactcccattttacaggtgagtaaactggcacttgcagatgtcaatgaatttgcccaaggtcacctatcaatcaatggtaaagagagaatgtgaaaaacaggcaaccggattccccttacgggcttaattaaaccctgtagatctcactgggccttcaagctggaacttcctgagagc

SEQ ID NO: 180703 - DNA, 649 bp, Homo sapiens
ctgggctcgaattcctgggctcaagcaatcagcctgcttcagccttccaatgtgctggaattacaggcatgacccaccacacccagccctacttaacttttgacacagattacttgctattgaaaaggtgcataccccgtgacaagaggaaacataggcttaaatttataagaagaaatttagtgaggataaatgccaagtcctgttctttatatcagaaaatcagttacttagaagtaacatgctgatttaaaagctgtttatatataaaaaaacactggaattttttagagcactcaaaagtatgaacaataatatgttgtctgacgtgtcattagtaagagcacactgacaagaatgcagggagaccgggcgcggtggcccacgcctttaatcccaacaccctctgaggtcgagacaggcagatcacttgaggtcaggagttcgagaccagcctggccaacatggatgaaaccccatctccactaaaaataaaaaaattagtcgggcgtggtggtatgtgcaggtagtcccagctactcaggaggctgaggtgagagaatcacttgaacccgggaggcagaggttacagtgagctgagatcgcgccactgcactccagcctgggcgacagagcgagactttgtctc

SEQ ID NO: 180704 - DNA, 434 bp, Homo sapiens
acttggagacaggcagcacagtggcagaatgggtagtgccgacatgaatcctggctcgctccctcaccaccggccatgctgagcacattattgacctgctgaggcctcagtttccccacctgtatcatgaggtccatcatgcttgttaggattaaacgtgatagtgtgcggcaagcactcaacacagtgtctggccataacaagtgctcagtgatccccagctgcagtttgtgtccttactgctgtgatgaggagactccatgggggagggggacaccacgtagatggcctgggggcacatatctgaatctgtgtcaagccacagacccacagaaagtgccctttaatttccgaaatcctttttgcccatttgtgaatatgggtggcatttgaacgctcatgggacagagagctgaattcctcttttgtgtttg

SEQ ID NO: 180705 - DNA, 534 bp, Homo sapiens
tcttcagcctctgaagcctttacattttaacaaagggaatttcagagaacgaggcttaagcttgggtcctactgatagttgatgtctggagcactctgttgaaaaggattctgaggcattaccaagaaaaagttgtgtgattatttggcaatgactttcaatagcatgacaatggacagtggtaagatatatgctatgtgtttgccatatctggcttaatacaaaggaatatatccctaaagacagagtatctgggacctggattggggtaagagtatagacacataaagattttgttgttgttgttcttgcatgtgttgaagagaagcaaagtggaatctagctgattatacacatgaatttgtatgctgtattttttttggtggtctttaacttactcttttattgccaagtgtaaatctggtagttcatatatatgttattaccttttacttactaatgtcttctacctaaggacttgtaagttgattttcagttcacatatctgacccttgtttttcttttcctttttgg

SEQ ID NO: 180706 - DNA, 348 bp, Homo sapiens
tatacaaaagtatttgcagatatgtgtctcaaatataagaaacttataacagttgtctctaggaaggaaaccaggtggataagggagaaatgtagaagagatgtttcactgtatatctgtgaaagattctgaattgtgtactatatattaactagtaaaaaattttaattttggggccaggcatggtggctcacgcctataatcacagcactttgagaggcagaggtgggtggattggctgagctcaggagttcgagaccaaagcctcgacaacacgatgaaaccccgtctctactaaaaaacaaaaaaaaattagctgggcatggcggtgtgcgcccataatcccag

SEQ ID NO: 180707 - DNA, 168 bp, Homo sapiens
gaacctgggctaggagtgaggaaggctgaagagagtggagagaaaaatgaaagataactctaaaaaagctaagagccattattgggtagtagaaacctaagataaacttctcactgcaattctcccttaaattaaattctcttttgtgtcttaatgtcagttagaggc

SEQ ID NO: 180708 - DNA, 215 bp, Homo sapiens
ggagggtgaggtagagagatcatttgagcccaggagttcatgagtccaggaattcaagaccagcctgggtaacatagcaagaccctgtctctactaccccccacagctgcagcaaaaaagaatcatgagagtcaaagggccatttttcttttttttttttttttttttttttttttttttttttttttttttatatttttatcaggaagaaaaac

SEQ ID NO: 180709 - DNA, 130 bp, Homo sapiens
ggtggttctttcccacttctgacgggctcaagaaaattttgatttttgtcatttatccagcttttgcttcgtggtttgactgagagtgccatcctttactggtttctacatatgaaggagaagggttgtt

SEQ ID NO: 180710 - DNA, 524 bp, Homo sapiens
tcacagactgctgtagacgaggtggtgaagagctcagacagacatggaacccagccctggacatgaagcagatggcagtgttagccacagaaatcacaaagaaccacacacctacgtaagcacaaccgtttctgctcacccgtctcggcattgtgcaatcacagttggcaagacggctcatcgaatttggaggggaagtttggaatggccagacttaaaacgcagactatgtggcaagcagtaataaaaactcactgtcgggacagggggaatacctcagagaaggaagcagtcatccttgacttatggagactcagagcagggggcctgtcagactgttgagtgggacacagatgtgcccatccatatatgcctgcccatgaacaagtaagcaaggcgtctaatatgaatcccaatcaaaagacacaagtgcagaaagctctgccctcaggtagattcatagctgagcctgcttcctgcatgggcaactctatctacatgaggcccaggacacatggcagtgg

SEQ ID NO: 180711 - DNA, 590 bp, Homo sapiens
tgcgtgctcatgtacatttatcttcaaaagtacacacaagtgcacaaaatcatttaaaacaatttctgactttccatcttctctgtgttattcatcttaataacatcattttgtacttttttttgtttgaaacaatttgagaattatagaaaagttgcaaaaatactagagaacttttgtctttcatccagtttcctcaaattgttaaaatttgtatctcatcttctttactatttttttccatcatatgtgtttttttcttctgaggcatttaagagtaacttgcagacatgatgtccctttatgcctaagagactatgctactagcattttctaagaacaaagacattctcttatctattcacacaacaaagatcaatatcaggagattaacattgatgcagtatgttagctaatctgcagatcttgttaatatttcaattgtcccaataatgtcctttatagcaaaacaataataattattattcattactaaaatgaagaaagaaaaagaattgatcagggtcccatctgggattatacattacatttggttcttaggtctctagtctgctttaatctggatgagt

SEQ ID NO: 180712 - DNA, 333 bp, Homo sapiens
gttgggagttacacctctaaagtgagtgagttctgattcactcattcaataaaaataagactttttgtcagtgaaaaattagcagtttatcccattcttttaatttggtgagaaaaccccagtgaccatgtccttgttccaccaattcttttaatgagaaaagtcaccgtttaggaaactcttggcttcatatgaaaattgcataacatacaatgtcattgaatcctcccagtcatgctctgaggtaaggagtataatatccatgttacagttgagtagcctgagacttggatggtcattgcgtggatcctttccagtttcttcagtctaaac

SEQ ID NO: 180713 - DNA, 361 bp, Homo sapiens
ctagccaacgaactttactgatggaaaaaacagatgtgattaaccagaaaaaacaagatgtttttgctaaaggtctataaagttagtttcaatattgtgttgatatttacgatagagaagtataaacaagaacaaagctattgtttgtggccaagcagagaccaattttacaagtatgcctcaacttaattagtatataagttccagtgagaattgtatgctctgaatggactcattttaagtggattataagaacacaatcttctaaataaacagtggaaatcattttgattatattctattttcagttggatgtgcatgcacgatagagatttatgtgtacaaagttgaaaggttgaat

SEQ ID NO: 180714 - DNA, 199 bp, Homo sapiens
aattagcaaaaactagagagagaattgtcaaacagtgccctattaatacaagttctatttgaaatacaaataaaaggagaagtgatgctggaagcccagcatcaaggtgtcaccaagtttggttttttctgagacctctctccctgacttgagatggccaccttcttgctgtgtcctcccctggtgttttcttcatgtg

SEQ ID NO: 180715 - DNA, 425 bp, Homo sapiens
caaatttctcaatgtgggtccatgatgagcgtttgaaagggaattcagtttgctgggaagtgaagatacaagctaccaagttaaggcatcatgataccaaaaaacacaaaggaaccattgcagggaagtgctgcatgaaaaatcttaggtttattttggcagtttgcagacaccatgtgaattgagacacggagacaagggccatgtaatccaagtatcacctgaaattagtagaagggacaaagctgaggatctgcatcagaacaaagaaggaatgtcttcctcatgtttgggtctatagaagacattaaagaaaacttccagaaagtgggtgtgagccaccgcacccagcctaatttttgtttttcaaaacaaaaatatttttgttttgaaaatttttgaaatgtttaatagcgacagggttt

SEQ ID NO: 180716 - DNA, 604 bp, Homo sapiens
aatgataaaagaaatgtacacaggttcctacacacatgtgtgcacatgcccatgtgcacacatacacacacacaggccgtcctcagtacatgggaaggtcagttctccaatgtagcttctttcacaagtcttaaaagaattcccctttcgatcatctatattcattcctcacacagtcctagaagatttgtcaaagtctgtcagttaaggcaggaaaaagccctagagctaacagaagtctatgtgtcagcatcgcttaagcttcagctttatcatctacactgtcattttcacactgcagtgtaacttacttgtttataagtctcccacctcaacatatagcaggtactcaaagaatgtttgctaagctgtaaagacctcctacctctaaggtcttttccaggcctaactagtccatggagtttggatctgatgaatcccaggtgggactccggctgcaaagtggagcttgagcaggggaaggtgatacgtgagtgtctgatattcccgttcctatctcccttagggatttggtttgggagcccgccgtggttcttaattagtggagaaggcaggcaggacataagaccttccaagcatgggg

SEQ ID NO: 180717 - DNA, 397 bp, Homo sapiens
cataaaaaggcaggaatgtaaggtcctctgagctggccgcatcatgatcaagccatcgtgacatccccctgcccttgtgataatgtactttgtgatattcccccacccttctgaatgtactttgtaggatacatcctccctgcccttgtgaatgtaccccacccttgtgacaatacaccctccccacccttgtcaatgtactttgtaacatcctccccgcccttgagaatgtactttgtaacatccacctcctgcctgcaaaaaaaattgctcctaattccactacctatcccaaacctataagaactaatgataatcccaccaccttttgctgactgttttgtcagactcagcccgtccacacccggatgtaatacacagccattgttgctcactc

SEQ ID NO: 180718 - DNA, 585 bp, Homo sapiens
tttctatctgtaaccctacttgcttcacagcagcagaatgaattccggactacctactgaataattcctcttggacactgcaaaggtcattctttccccacaaacctgctccttattctgagttctccatgaatggtttttgcaacttgttaaccatccaaggcagaaagacaactgggcatcatccttgattccttcttctccgtcagtccccctatatctagtcagtgaccaagttccaaatttattgcatatatggtattctcatttcattcccactgccttaacccagatttcagtatctactttataaatagcctcctaactggtctccctgcacccagttctcttttccaatctatccatcacactcctttttttcttttctttttgagacggagtctcactctgtcactcaggctggaagtgataccccatcttataaataattaattaataaagtggtatctaatattgttggcacattaaaagaacgtcaaatcatactcaaaatataaaatccactaagaataaagagaagtgatgtctttaaagtgtctacagctgtatgagcttctgatagcc

SEQ ID NO: 180719 - DNA, 481 bp, Homo sapiens
agaatgaattcagcacccattccttgctttttaaacctcaaaagttcccgactcagtgaaaggcttccattttgctatcctcttctctgtctgcattttactctgtaatttattgacatagaagaggcctcgtgcaggctttcattgcattagtccacttggaagtcttttctccaatccatttgacctcaagctgcttttttgctgctgctgcatgtaagctagactgatccagctcaccttatgctgcttttgaaggctgaaaagccctgtgaccaaatgtttagcaggctgttcagacagtggactgatggtttgatctaagtccgtttcctgccttacacacacctccccatcccccaaggcaaaggtggaaaacccagcaagttacataagttgttggagcagtccagatggctggctgctagcccaggcaaactcgctttggagcacttggggatgcctgcactggcaatgaaac

SEQ ID NO: 180720 - DNA, 596 bp, Homo sapiens
caggagcctctggaagtgtcacttgcccctttccccaaaaaagcttccataccatccccctaccccagtccaccgcccagagatggtggaggggtagtgtgggggcggcagtggaatcagttcaggctggaggaaattttggcccagcatttgctaaagggctgcagctagaagcaggtgggtggagagagtgggaagatagtagccttcttaaagggccagttgcaaaatgatccagcagactagggagctgctgttgggggagaagcatggtttctgagagccactgaacagcaacacagctctcttactgaggcaggggccagccaggggtcctggcagctggtctcctgattcctggggagcctcatacttcaggcacaccctaccccctcacagtggcggtcattcaaagaatgtggtcggtcattctcatttgccagatgagaaaacaggctcagagaggggaggggacttacctgaagttacagttaatgcgaagcagaatcagggcagaaacctaggactccagactccaggccagtatcctttccaggaagccacccctgctccttaaagccaagctcagcctctta

SEQ ID NO: 180721 - DNA, 342 bp, Homo sapiens
agacggcagccatcccagcccagagtatgttggagtctggctaggtagatactggatccactcctgtgtgaagatctgcgaacttgggaatttcctcaactccactggtctaaggacaccagcaaaagatttggtgggaaggcaaagtcaggaggctgggtgaaccacaaggcaatataacaggaactgaaagtggctgagaatttaagtcatacagcccagggatcagctagacctttctttttaatcattttccatacagcctgcctagcaagtctctaatagcactatgggggggggtaataataataataataataataatgataataggccgggcat

SEQ ID NO: 180722 - DNA, 118 bp, Homo sapiens
cttttgttaaatgtatttatttaaaataattttaatactgtggcaaaaggcatccttgcgaaattgcatttatctaattttttgttactgatgtttagaaataaatttgctaaatttt

SEQ ID NO: 180723 - DNA, 531 bp, Homo sapiens
ttatcctcaatccatttatgctgtccattttcctgtcttctgttggttgctaaggagattagtgtgaaatggggtccctgtcctaaggggttaatcattttacactgctcactccccacagaagtcataatctgctgtgtgtgaaatcatgtttagttgctgtgaaaatgattacgatgctccgaatggaacatgatggcctcaggtgggagataagtattcagagcagatggactccgagaaaatacaaaagtacttccaggaataatgctcgctccgaaagtagagtgggatgaagagatggtacaaacaatatgtaagaaaatatgaaaaaaaataatttggtatatggaacttgattctgctggtggatttcccagctgtctccttttctgttctttttttttttaagcctatcatagtactcttggagtacctaaaagataattatcaaaacccagaagatggtgggaaaaataagtatgaaagatggaaaggagttgtcacttttcaatgaaattcccaagttac

SEQ ID NO: 180724 - DNA, 354 bp, Homo sapiens
ttattttcccaaatccttctcaaggcactttctcatcttcattttatagtttggacaactgaaccaaccaaccagccaccatgacctcctaattggggtctcattgccagttgattccctgagtcagtctgctccctgctggaatggtcttgggttgactcctgatgacagtagtgtgagcctggaggctactctgtgaacacatttctccccgtacccttcatttaccaaactttaaccctcttgtcctatcatcatctttcccatttttgttttattttgttttgttttttcttcagcctgggcaacagagggagactctgtctcaaaaagcaaagcaaaacaaaacaagca

SEQ ID NO: 180725 - DNA, 557 bp, Homo sapiens
ctcagtgatccactgcctcggatcaagtgctgggattacagttgtgagctaccgtgcccggccatgttcattttttataaagacgaggtctcactatgttgtcccggctggtctcgaattcctgggctcaagggattagataattctttctctctctgtttctctctttctggtcaactttgttgaagtaaaatttacatacaatgaaattcacctattttaagtatacaatttgataaatcttgacaaatatatatatacacacccactttcatcgctccagttgtttccttggtgcccctttgcagaccctgccctccttctggtccctgggaactactgatctgctttctgttactattgtttaatcctttctattaatagaatgtcatctataagtggaatcttatacaatatagtccttttttggtctggcttcttttacttaacataaagctttgaaattcttctatgatgttatatgtttctttttattactgagtagtattccattgtatggatttaacatttgttatccattcaccagttggtagata

SEQ ID NO: 180726 - DNA, 449 bp, Homo sapiens
ttatagactttatttctgttcttatgtgacctctgtgacactgtaattatttatgtatttttcaaattctatttaggacaccagtctctcccagatgatttctactctatattgtggaagttctatttgctggtgaagctaagaggactgaggttccctaccctatttgtagagcagaagctctatcccaggcctggtaggctgacaatatttagacttcaattgctcccattccagcttgttcgtagattagagattctgcaacagaaaaggcaagtcaagaagaccaggggctaacacctctttcccccagcacctactcatacagcaggtgggtatcactgtaggagaagtgggcccttgtgcagaagttctgcccaggagggaaggaaggcctgaagaatgaagagctccaaagctctgcctgagaggactgactttatttggaa

SEQ ID NO: 180727 - DNA, 519 bp, Homo sapiens
aattaaacattgatttctactttttttaaagtttttttcatagttacataaatcaatcactggttaacaatgtattacttgagatagcaagcatagttaccaacaccacatcttccagacaatattcacaaagaataattacaccaatgtcagaactttatggtggcagattctcttcaaaaagcatgtttagataaaaagcaaatgacaaattatcaaatccttccttctctcctttttcagctctgtaagaaaatagagatttgtggctttttattttttcatgctagtatcatatagtatcactctagcatagtggctcagctcatgggatttagagtggccaactcacagcccttgggcaagctagtaaatacactgaagcctcagtttcctcatctacaaaacagaaataacaggacctaactcacaagggtccttccaaggattacatttaattagatgatccatggaaagagctgagattcatgcctggcagtaagtattcaataaatatta

SEQ ID NO: 180728 - DNA, 367 bp, Homo sapiens
caattttcagtgaacctggaaagttttgcctatggtatcaccttcttctcaatatcttatcttcttcctaagggacacacttcatttattacagtccattgaaacccattttccatgaagagtaacctgaaatggaagaaaattccagagtcataattttaaattaagttagcttgatggccttccaatagaatggaagaagcaaagaaagatgttaaattctgcctccctttttttcctcttcctcaaacagctcagtcctgcctttgtttacttaaaatgtatccaaatatttatttctcagtaggtttatggggtatttttaaggtatttgagatgttgtccagcgtagtatatttttgtctcc

SEQ ID NO: 180729 - DNA, 406 bp, Homo sapiens
tctggcgtaagttgatattacacttccctcctgttttccagcctacgaaatggggctgacatctgttcctttctttcctgggtatttgtgagagtaacaagagattgtgtctccaaagatgtttggaataacttcacagacagtattttaaatagatatcaaagtcagaaaaaaatcagataaatatgtaatgatacaaaaattcagagaactgatagctgtggtaacattgggaccatctgtgtgcactggctggccttggactcctgtgtcctcctttcccctgagtggtggccaggccctgttgggggaagagagttgggagtctgatggttaattcccccagtgctggtcaggccccatgttgggggaagagagtcggaagtctggtagttgattcccccag

SEQ ID NO: 180730 - DNA, 106 bp, Homo sapiens
cctgataaagcttcaatgagagtggaggcctaggccagtttactgccattctagtgttccttcactgcaccagcatctctccttgggcctcctaccaggttaccca

SEQ ID NO: 180731 - DNA, 312 bp, Homo sapiens
tatgtgctgtattattttggtgagtaaaacaaaatgagaatggcaagaggaaggctggagagctaagagtgagccatctcatgtagggcttgacagctataataaataaaaaatctagactttatcctaagaacagagtcattgaagagtttcaagcataaaagtgtcattattacatttatgttttagaaatattactttggctgctatatgcagaatggtgtagataagggccaatggtgaatactagaagagcagatagtagactattgaaggaatacaggcaagttaatgaaatagggagaattaatg

SEQ ID NO: 180732 - DNA, 443 bp, Homo sapiens
caaagaaagtaaaatatctctttcattaatatttgttaaatattaattacatgttaaaatgatattttggatatattgagtgaaataaatgattagaatttattccacctgcctctttttgctttcgaaggtggctgctagaacattttagattgtaagtgtggcctgcatgatatctccctctatgggacagcactggtctcaattgtagggtcactgaggacatggtgcttccctcctggtggctttcggatagttggtgttcattgaatgtcttttgagtggacaaatgagtgaatgaggttgacgcataacacgtggtttccacttacctactatgggacctagacaggctgtttcacttctcttatatctgtaatataagcagagtaactggagcccttttgttcacctgcagttggatctcagcgattagggttagg

SEQ ID NO: 180733 - DNA, 153 bp, Homo sapiens
aactcagggaagattacttaagagtgagctgcgagagaaggttgactgtgaaacctaggaagaggagctgcggccgtctgcatagaagatagtaataacttgaagccggctgtaggagactaaatcacatcaatttatggtacctctgagtag

SEQ ID NO: 180734 - DNA, 365 bp, Homo sapiens
ggtctcaagagaaatgctgaaggggcagccctgcttccggctgcttagcagagtggtggcgacagggaaacccaggcacagattgcagatcctccgcccagggaggatgaccacgataacaagactgtcttacgtttatttagaatcttcctttgccaaggcaatcgtatttatagtagttgctcattttgagtataactttttaaaaacattttgattttctgaaatttggatgtcttacaagcaacatgaggacttaatgtaaggcttttttccacctgaaaatttggtgtgaattaaaattgatggtgacttggaattgaggaaatacgttttattacatcatttaatctctaaataatctg

SEQ ID NO: 180735 - DNA, 408 bp, Homo sapiens
acacctggctcatttgacaaagaaaaggatggaatgggcagaggggagatggtgcagcaggtggagaattgggttcacccgacctctgccagtggcatttgacagtgctgagggctcccccttctggaaacactcttttctacaggctcctgtggccacacttcctgtgttccttctacttctctggccgttctttcttagccttctttgctggcttttccttctcaatctggttcttttccctatcctctctcattacatattctatctgctctcacctattctcacagcttcaattaacatctataaaccacgattccataattcaactgtagacaaaaggttatcctctgagctctagacttatataccaaatagtctgccccatgtctatgcttggatggctca

SEQ ID NO: 180736 - DNA, 376 bp, Homo sapiens
acacctggctcatttgacaaagaaaaggatggaatgggcagaggggagatggtgcagcaggtggagaattgggttcacccgacctctgccagtggcatttgacagtgctgagggctcctgtggccacacttcctgtgttccttctacttctctggccgttctttcttagccttctttgctggcttttccttctcaatctggttcttttccctatcctctctcattacatattctatctgctctcacctattctcacagcttcaattaacatctataaaccacgattccataattcaactgtagacaaaaggttatcctctgagctctagacttatataccaaatagtctgccccatgtctatgcttggatggctca

SEQ ID NO: 180737 - DNA, 218 bp, Homo sapiens
gagtcactttctacactgttctggagggcacaaattagaacgggtcagggggaagtgcagtgaggaaggagaaaaacacaaccatccaatatgattttctcagcaaaagagacaatatttccaatgtctagatgcctatttaattattccacttaagttcattcttagaggggtcttgtcaataaagtcaacccaggctcttggtgtgtaacagcgtt

SEQ ID NO: 180738 - DNA, 215 bp, Homo sapiens
tctgaaatgtctgtggttttgcagttcccatgtccacaaactcacttggttgaaaatagttcaaaatatccaaagcatgagggagggagtgcctgcttttcttaaaaaggaaggacttgatttcatctacttaaaaagccacccaaacctagaacattttccgcaagagaccccctgccccccgcctctccagaatggctggagagtctcagcac

SEQ ID NO: 180739 - DNA, 703 bp, Homo sapiens
cacgtgcagtggctcacgtctgcaatcctagcactttgggaggccaaggcaggcggatcactcgagctcaggagttcaagtccagcctaggcaacatggcgaaactctgtttctacaaaaataaaaataaaaaattagccaggtgtggtggcacacgccagtagtcccagctacttgggggactgaggcaagagtatcgcttcaacccaggcggttgaagctgcagtgaaccaagatcatgccactgcattccagcctgagtgacaaagtgagatcctgcctaaaaaacataaaagataaaaaataaaaaaattagaaaaacagaaaaaggtcatttcttgtttttgttttctaagtgtatgcacacacacatttctcaaatgccaaagtttgtgactaattcactctttcataaagtaaggctgattcagggctaccctaggcataaagacagtctcactcccttgcgttcccacatgctgtccagagcagccagtcaagagtggggtcagagcaagcacaccgtgaactgctcatttcacacaaaccttcttacttgtgctgccacctgagcacatctctaggggtatagaggatcaggtgaagaccctctgtcacaggtgttctggagaaaaagcccatgacatcttgtaccaactagtgtgtggagaacttaaataagatttattaggtaggtgcaaaa

SEQ ID NO: 180740 - DNA, 1007 bp, Homo sapiens
gggatccagaggaagagagtgagtttcatggagaagggatttactggaagcacttgcagtaacaacaagcaaaagctgccaattaaaaaaaaaaaaaaaaaaaaaattgtgcggccggctagggccacaagagaaggttcaaacccaatcggtgggcgccgcggcccaagaggtaaggtggaccttggcacaacggttgacccaagagaactcggtccatgacacaggtcgggggtgtccccccaataaaaaaacggcggcgggggacacggagcgcttctcgggcagcactcacaagtgggaggtccgaggggcactacgggtcctacccaaacagaggcgcccgagagcgacgtcggggtattaaaattaccggccggccggtagtgggagacacacaacgaacaaaagagaaaaactaacatacgaaacaaacgaacagaacagcagaacaagaagccagaccaatcaaggacagacaagaccagagaacaacaagagaacagcacaaaacaaaaaacaagcagacaacgagacagcaacaagacacagaagatcagcacacgacaacaaacagaataaatacgacaaaacaagaaagacgaaaatacagcgcaaaagaacagaagacataaagtaaaacagcaaaagggaggaacgaagagatggacagatagcaaaaagtacgggcacaagagaggccagaaaggagaggaggcagagacggagagagagagaaagagcaagataagaagagacgaaaagcaagacagcagaacaagccgagacggaagagaaaacacacaaagcagaacaagcgagagagcgacaagaagagagcacagaaagagaaggaacaggcaagaagagagagaggacaagaggagaactccagagagacaaagaagacaccgagcgcgacagaaggaagcacaaaagaagggagaggaagaaagagagaagagaaaggggagaatagggaaatagaaagaggagaggaaagagag

SEQ ID NO: 180741 - DNA, 228 bp, Homo sapiens
actcagaaacataaggagagaatgaaacacttggtattcagaacatttgtattctttatataaaaactcctccctctgtgcagctgtgagctttttctcttaagcccaaaggccttgttgtacgtgacttcataggaagctctgcctggggtcctagcacgggaccaggttagacactgaaaaagtaaaaccaagttcatcatcgtcactaccaccactgacaatgtt

SEQ ID NO: 180742 - DNA, 164 bp, Homo sapiens
acatagtaacatcatgtttctcagaggctgtcacgtcctctagatatttctacctagagatacagtaaacgggctcctctgctgtgtaccaccagcaatattacttgtggtctaaactggctggtcttcatcactggttctggtgctttaagtttttttatatt

SEQ ID NO: 180743 - DNA, 204 bp, Homo sapiens
ttccctacagagactgaagtcatatcagtactgagaaatatggttatgcagagatgaaaaaagaatatttaatatcaaggtaatctgttaataggatttaggaggagagggcccaggtctttgatcctgtaattgatgccaaacaagagctatgtggtaatgttttggataagaatttaatgcattttgtatttgttgatatgt

SEQ ID NO: 180744 - DNA, 303 bp, Homo sapiens
gattctcccagatcagcctcccaaaatgctaggattacaggcgtgagccactgcgctcagccttcagtagctatttttacttcagaattactagtgaagaaaaaaagaggatctttgtgaaatttctacaaagactacccagcactgatgaataaaaaaattaattgttgtatttgttaccctagcgtaactacaaccacaatgagaatatgattcatgaatagattataaactcacacaacacagattattttcagcaacagccaccagcttttaagaaaacatctaccaaacaacaacatc

SEQ ID NO: 180745 - DNA, 210 bp, Homo sapiens
cctgcagagttgagggggtcagcgccgggtggagttgccgacgggcggggggcgtcactagtccgcgtaggcacctccggggtccgcaggcgaggtgggcgtgcgggctgaggcgggtggatcacttgagcctgggagttggcggttgcagtaggccaagattgcgaccctgcacttcaacctgggtaacggagtggggctctgtcccgc

SEQ ID NO: 180746 - DNA, 522 bp, Homo sapiens
aatattgtgtgtgatgaaatgggatgcatgcataaagcacttctacataccaaaatccagtagtttctaaaggagaagtatttgtgcggttgttagagttgcaagctgaactagttatttctttcatggaacatgaaatgagtgaccaacaaactatgattatttagatttgggtatttggaagacatttttcttaaggtgaattaaatgagactgtcacttcaaggaaagcaacttaaggctgggagcagtggctcacacctataatcccaccactttgggagggcgaagtgggcggatcacctgaggtcaggagttcgagaccagcttggccaacatggtgaaacctcatctctactaaaaatacagaaattagccaggcatggtggcagatgcctgtaatcccagctactcggggggctgaggcaggagaatcgcttgaacccaggaggcagaggttgcagtgagcctagattacaccattgcactccagcctgggcgacaacagcgaaactccatctc

SEQ ID NO: 180747 - DNA, 585 bp, Homo sapiens
gttgaaggcggtctttggccatagaaggcggcctgggtctaggcgtggaaacaaatagcattcccacttctttttgtttcaacaagcagttttttaactgaaagaattgttctttttggcaaaactgctcagaggcagcttcccttttatgttcaaattaaagggaaatgactctcttcccttggacttgaggactgtgaactggagctgtgcgtgttctgtgataaagaaggaggtgtgggtggattttaatcagagctgaactgagtggtggagtgagctaatacacaggacaggttatgagctgctggaagtaagaagtggctgtcaggcatcactcatcaggagagacccatgggggccaggattggtctcactcaaaactgtatgcccaaaaccagtgcctgccatgtaggaagtgctcaggaaatatttgttgaacaaatggtaatacaattaatcactgaagaagacatcctccttcaccatagacagatccttctaactttccctgctgtttccaagtagagcccctgtgggaagaggactcactgtcatgcctcagcttggtggagtttcaccgga

SEQ ID NO: 180748 - DNA, 537 bp, Homo sapiens
aggcctgtttgaaggcagaagggtgttgcaggaaagaagactggcaattttagagaagtaccacataaatatggattcaaagaaacagaaaaaatctagaatcttgctattcaaagtgtagctctcagacattcaatatcacctgggagtttgtgagaaatgcagaaacctgtgccccaccttagacccacagaatcataatcagcattttagcaagaccacaggtgataggacactgtattttcaagtttccacacacagcattgatttttttgttcaaacagttattttatttatttattttttgagacagtctcactctgttgcccaggctggagtgcaatggcacgatcttggctcactgcaacctctgcctcccaggttcaagcaattctcctgcctcaccctgtcaagtggctgggactacaggtgtgtgccaccacactcggctaatttttgtatttttagtagagacggggtttcaccatgttggccaggctggtcttgaactcctgacctcgtgatccgcccgccttg

SEQ ID NO: 180749 - DNA, 320 bp, Homo sapiens
aggcctgtttgaaggcagaagggtgttgcaggaaagaagactggcaattttagagaagtaccacataaatatggattcaaagaaacagaaaaaatctagaatcttgctattcaaagtgtagctctcagacattcaatatcacctgggagtttgtgagaaatgcagaaacctgtgccccaccttagacccacagaatcataatcagcattttagcaagaccacaggtgataggacactgtattttcaagtttccacacacagcattgatttttttgtttctttgagtccatatttatgtggtacttctctaaaatgaccag

SEQ ID NO: 180750 - DNA, 440 bp, Homo sapiens
actgaatggttggttggtttgaatagggagctgtaggcccactgtgcactgacattaattgtaagagctagagatgggctaagatcaagcttatgggatactttgataaatcgtaactaggaggccatatgttgatatcattccagccaatagtcaactggtcaatctcagaaattcttaaaaacacatacagatgttgcagcttttttcctgaagtacaagccaactgttaaaatctttctctatgccagtactgaagtattttgagaacacacacgcatgttcagtagtctggtaccagaattaatttccactctgggttcgattctgcacacacatcaccctctggttgctttcctaacttggttctgattactggcctaactcaagtataaagaaatgaggggacactattattcatcttggcaagtgtgaggttc

SEQ ID NO: 180751 - DNA, 812 bp, Homo sapiens
ccattgtggtagaacttttagtcatataacaggcctgacgtaccatcagagaaggcatactggagagatgccatacaaatgtattgaatgtggccaggtctttaattccacttcgaaccttgcaaggcatcggagaattcacactggagagaaaccttacaaatgtaatgaatgtggcaaggtctttcgtcatcaatcaacactagcacgtcatcggagtattcatactggagagaaaccttacgtgtgtaatgagtgtggcaaagcctttagagtgcgttcaattctggttaatcatcagaaaatgcatactggggacaaaccttacaaatgtaatgaatgtggtaaagcttttattgaaaggtcaaagctggtgtaccatcaaagaaatcacactggagagaagccatacaaatgtattgaatgtggcaaggcctttgggcggttttcttgcctcaacaaacaccaaatgattcattctggagaaaaaccttataaatgtaatgagtgtggcaaatctttcattagtcgctcaggcctcactaaacatcagacaaaacatactgcagagagtcttaaaacaaaattcaatgtggaaaagcctttagatgttctcctaacttctgggttcaaataattcatacttattgatatagcttgtatatttgtcacttccgtctgaaatctcatgtggaacttttaatcccctttattggaggtggggcctggtgggagatgattggatcacaggggtggatttctcaagaatggtttagcaccacccgctttttgctcttcttgggatagtgagt

SEQ ID NO: 180752 - DNA, 283 bp, Homo sapiens
ttggtcacatgctttcccacaccctccacgttgagtccatcaccaagtcctgttgattctgcctctgaagtatcttcctcctctggctcttgcccacatgccagcccacagtgctggcataatggaccctcgtggcacttctgctcagtccccacagcgttgtcacagtgactatttaaaatcataaagcaggtcttgctttaatctccttgattctcgttgttcttagagtaagatttagaaattctcaacgtggcatctgtgtatcagtccttttccagtt

SEQ ID NO: 180753 - DNA, 1179 bp, Homo sapiens
  misc_feature (1)..(1): n is a, c, g, or t
  misc_feature (3)..(4): n is a, c, g, or t
  misc_feature (75)..(75): n is a, c, g, or t
  misc_feature (791)..(791): n is a, c, g, or t
  misc_feature (963)..(963): n is a, c, g, or t
  misc_feature (1178)..(1178): n is a, c, g, or t
ngnnagataaatccttccggatcacggggctgccacgggagtggcttccaccacaccatctcctgtcctgggtgntgtggggagatgagtctggatcctacctggattctgcctccaagctgggggaagaaagctcccatgttgtgaggcataaaaaggcccacatgtcaaagaactacagcctgccagcgaccacgtgactgagcttggaggtggatcatccctcagggaagccttgagatgacagcaggctgggagggatgctcagccaggaccatgcagccatgctgctccggcattcctgaaccacagatgctgtgagatgacatttttttccctctacatgtgtcagcacttcccagatgtgatgatggtatttgaaagagcatgatctggaaatcctgagccgtgctgccacaagaaaatggatgcacagaggacaaggccaggcagcgcaggtcttcattacactgagactttgcctgagtcccatggtgccccagtgccctggcctgggcacatcagcactgccttctgtccaggccccatgagtctcagatggtggaccctggtgacggaaggctgggtagatgccatggacctttccataggtcatagccacagctgagcacttggtgtcttactactcagtggagaggagaagtgtgctgaagggtggtaagagagtgtgtccaggggcccagaccagagtgggccatgcctcatctagagagcaagcatcttccagaaaggagagcccttgggtccttttacagaagcaatcagaaaancatcgggaatctcccagaagactgaatgtaagaggacgaagggtccgggcacagtggctcattcctgtaatcccagaactttgggagactgaggtgagtggatcacttgaggtcaggagttcgagaccagcctgaacaacatggtgaaaccccatctctactaaaaatacantattagctgggcatagtggcgcatgcctgtaatcccagctactcaggaggctgaggcaggagaatcgcttgaacccaggaggaggaggttgcagtgagccgagattgcatcaccgcattccagcctgggcaacaaagcaagacttcatcacacacacacacacacacacacacacacacacacacacacaaacgaaacaacaacaacaacaaaanc

SEQ ID NO: 180754 - DNA, 231 bp, Homo sapiens
ctccctcactggattacgtaagcttcatgagaacagggactttgtccatttcccatcctagtgcctgtcagtgggcacacaatatatacagttgttgaatgagtgctggataaatggatggggagggtggtgagaagtgaaacttgaagactccagaacagctatcttgaaggatcttacatagggaagtgataaagttggttttgtatttgaatagatcatatggctgca

SEQ ID NO: 180755 - DNA, 164 bp, Homo sapiens
atagctggcataacatcacacagctggcaattggcagtgaaggcattgaatctacatctgtttgaaacctattaaatattacaaagtctgagtacaaacaaggagcaggagtaaaacaggatgctgggagaaatattatgacacagatccagatttggggcttg

SEQ ID NO: 180756 - DNA, 524 bp, Homo sapiens
taaaaattcttcaagatatcccgttttcatgaaggaaaaggctctggtgcgttagcatgacatgaatgcctcaggctctggcctctccccacctgtcagccttatctcctggcatttttctacacccatatcattgggctcccatcatctgtcaggctccctcagtctgaaatagcctctttctccttctcctccagccatttatctaattcctgtttataggtattctaattcctgttaagactcagctcaggtatggtctccaccaggttttccccaagtttcctttccatattgcaaaacctttccttgcaccttctgtacactttgtttagatttctgtcaacatatagttctctgaatgtttcttatacaaaagcaagaacccaagcaaaatatgggacccccccttttttcttgccggccccggggccccaatttggttttttttttttaaagggctgccgggggggaatttttcggcctcctgccccgggccttttccccggggttcggaatttaac

SEQ ID NO: 180757 - DNA, 692 bp, Homo sapiens
ggggaagtgtcaaagaatttgaggagatgaaaaacttcaaatcagtcttttttaaaaaagtagtcaaaccagtctctttttaaaaaagtattcaaacctttcttccatcccctgcttgtaaactcacatcctgaggaataatgacttgaataattctaccagaatccaagaaaccaaattggttgggggcagggggtatgttgcttttattgtttccaagatgaagttctctgtgaaactagaatgtggttcctcttatagaaccctctggaattagcaaatgattcccaaatagtacaggtaagactcctgagtattaatgacttcattatattttgttgccgccatacttcaagtcaggatgcttgatgacttgatgtgatatgtgtgtgtctcctcccatccaccttaagataagcaataggcaatatccaattgtgtgagaacctgcattgttcacatgagcctttgtcctggataacagctcctgttcatcaatatgatacattgcactctgactttctacttctgtctttctttgtggatattcctttctcctctctgattgctttttcttcttagaccattactctagttgatagtgctaggttatcattggatcccatctccctctccaataagcctgtgattgatactaatcttcctcatgggacacattttataggatgcac

SEQ ID NO: 180758 - DNA, 554 bp, Homo sapiens
atcttggggctggaggggggagggcgggacactgctccaacattcttggcctcatactaagcactaggcagcggcagtccactactggaatactctgaaggtaaataaagcaataataaaggtcatatccatctcgactacagacaaaacaaagtcaacccaccatactaatgccccgacagaagaatatgcccatatcaatgcataaatattgtttatctcagtctctaatctgttctgtttttagtttagcatttagtcaaaacttgtatgatacacaaaaatgcaaggaaaaaaaatcaccccattaccaagagataaaatggcagaaccagaccaagacatagccccaatgtcaacaaacaagcaaactgatgggtttaacaatagactaggtaaaattgaaaaactggggaaggaggaaataagctagaaaaaaatcccctcaaactaaattagtattaggatcattacgggaagagacatggctccaaggatgaggacccaaagtcgtggaaatggataaaagtcagattcaatacatacttcaagtc

SEQ ID NO: 180759 - DNA, 788 bp, Homo sapiens
tccaaagagacccttgtggaaacaaaagcaaccacagtcaagctcacgtgtttgctctagcaaagaagctttggaaataagattttcatcctactggggttaagagaagcccatgagagtaactgggacttcccttccaggaatcagcatgcatatacagacccaaataatgtgagtaaggacagtaagaccaacaggagaaactaaagagacccacatatgcatgcaaacacaggtactctgtcttggataagctcttgaactcatgaacagagatgagttctcttcaaggactatggaaatcactttgcaagagctgttctgattatgaaaatctgaaccttacttagatatcctaacccagtcatcctaagggaatgcaacaaaaagttgcttctcagtcctcttagcacatctgaacacataatcactgtatacatgccaactctcgcataaaactggaaatttcttgagggaagaaatcatgtctgatacatgtctaagtcccctttggagagctgtaccactgaggccagcagaataggtggagcagtaagtcaactgtgcattgacccatcaataaattgtggagtttggaacttcccagtcaggagttgttaaagagtcctcacacaccccaggataatggcaaagcatttgggcatctgactcacagagtgccagattacacaggcaccagtcaaataagaccttgtccatttcctatatagtccccttctctgccccctccctagaaacagcagagcaagtaatacaagagggaagcc

SEQ ID NO: 180760 - DNA, 395 bp, Homo sapiens
atatatatatttctagacttcgggtgcctggctgtctagtttaagatgcagttagaggctcaaggaatttctagacaccttttaactttgcttgggtcactcctgccctggtcagtggccttaaatccatttgatgggttcaagggctccaggggaaagaggagatgggtgggagcagactctctgtcccctgggtgtgcccagctgctgggaggccgcgtccccctcgcccgttctggtggcgcctgcctgggccccattcactggctccttcccatcaccttccctgggcctggacagtcgtgctggctgcttgcacggtttgtaaagcacttttagttaaacgatctcagacacactacattgaagatagaactagatacagtctgagcccc

SEQ ID NO: 180761 - DNA, 356 bp, Homo sapiens
caaaagatgaagatgagagaagggagccaggggttcgtttatcaaccttgagaacaatcgggacgcataaaggcaaaaatggacaacaagtgaggcttggttttgaagctttctttctttcttttttccttagacggaatctcgctctgtcgcccaggctggagtgcaatggcgcagtctcggctcactgcaacctccgcctcccgggttcaagcgattctcctgcctcagcctcccaggtagctgggcttacaggagcgcgccaccaagcctggctaatttttttgtattttcagtagagacggggtttcaccatgttgtccaggctggtctcaaactccgctggcctccgccta

SEQ ID NO: 180762 - DNA, 349 bp, Homo sapiens
attcctgtggcttagtttgccctttacctctagcaacatgatgcttctcacatcctctctgtcctgtctgcttatcccctcttattttcccatgcagcctgaggctggaaatgacttcttattttgtacttgctaggttgttgttacagtctccgtggccaaaaggttaaggaaaaccaggaaatatttactcaagtctacctttttatcttagtatctattctaatatgttctttactcccttcatgtatttatagaatacacatacttcctattcatgttaactagcaaatgtgcagcagagcattgaattaaaggatgagtaattaacaaattgatggatttctca

SEQ ID NO: 180763 - DNA, 656 bp, Homo sapiens
gggtgagctaacactgcgaaatgtatgcaggtagagttgctcttccatttaagaactaagtcatccaaaagacagtcagtatttggaggacttgactcctactcctttttctttatcatcagatgggtgattttttccaaccatcacatttccaaaatgaaaatgtaacagcttgcaacaattgcaatatacttaagatgtaataatggaaaatgagatgttattgattggagagggaggagaagtaaccacaatggtatcatcaagtcagaggaagaaagaaaattaacagatgaattcttcaagactgagatttggttgccacccactacagatggcagagtcctgagtagcagtccccagacaaaacaagatatatatttaatatgtgaggcagtcctcgaaaggacgctccatatcctttcaattgcaaggggaattccgcattctagagtgcgtcgcagctaaaacttacatcctacatccattctatttgacaataatacacagacactcaactgtttgtcttgcacttttgtgtgagcaagacaatttcctttttaattccagtgaaacaaagtatacagtggagctattttaacaatacctaaatcaagccatatgtttttggagaggtatattaagtgtggcatgtc

SEQ ID NO: 180764 - DNA, 617 bp, Homo sapiens
atcatcaaaacagtatccctgaagatatacagtcctcttccagcaaaaagttccatatcattttttccctctggtctaggaatataacatcttccattaaaatattttctatgtcctatataccatgcactccaatctcactcctcataaacaaactctgtgcaagagggtgtttaatatgcaacactgtttcttcagatcatatttgttcctcaatttattttaatacagtgtctaccccattaccattctgaaaccgttctaacaaaggtcacccatgacagctaacctgttaagggccagatcttacatgaatcattttcagcacttatccttttttacctctctgtagaaaggggtgcctccttcttgaaatcctctccttccctgatttctgtgacagagactttcctggactttttgctgttctctggctaggcctgcatcagattgtcattgactttcagcctgccacccacactctgcctggtcttctgccctcctgccaaaaaagctgtgttctgcactctcttattcatctcatcttgttggttttgagatggaatgtcattagcatctgtattttcggccaagactaggacatttagaagccataa

SEQ ID NO: 180765 - DNA, 387 bp, Homo sapiens
ccgtttcctcagctgtaaaaagagagaattaaacttggtaagttttaaaattcctttctatctcaaaaccataaatatgaacaataagtctgtttttttaagtaatcagcagtataaatgtattatatgtaactttgtatggctaaacaacctattagaaattagtattttcccactttctctttatttttttcacaaatgatttgtgttgattttagaaaagttagtacaagtaaataagaagaaaattagttaaatttgcctgattatgctacctcggaaataaccaatattaacattttgggaggaattgtggatgtgtatagatataaacatatctaaaatgtaaaatggaattctattatgtataggatactgtcacctgtt

SEQ ID NO: 180766 - DNA, 185 bp, Homo sapiens
attaattaaaactacacagatacctttgaatagaggttcttccacagcctcccatctgcatctgctttaggtaagtaaaactacattcaaaataaaggcagagaccttgttttattcatatctttgttcttcctggtgcctaacacggttgtgtaaataaataatttattgaaagaagtggtttg

SEQ ID NO: 180767 - DNA, 580 bp, Homo sapiens
ttgacccccaggccttttcccctcaaaactaggcctctttctgtcaagtgtaattccttttaccagcagccagcaaactatggcctataaggtggcagcccatattttgtaaatcaggttttactaaaacgtagccacgcccattcatttaagtattgtctatggctgcttttgttctccaaaggcagaggtgagtagttacaaccacatggtctgcaaagcctaaaatatttactactggggtctaaacagaaacaataacttgcctaagcacagtgactcacacctgtaatcccagtgccttgggaggctgaaggtggaggactgcttgctgtttgagcccaggagttcgagaccaacctgggcaacatggcgagattccatctctacaaaaattagaaaaatagccagttatggtggcacatgcctgtggtcccagctactcaggacgctgtggtaggaggatcccttgagcccaggaggtcaaggctgcagtgagctgtaactgcacctctgcactgtccagcctgggcgacagagcaagaacctgtctcaaaaaataaaaaattaattaattaat

SEQ ID NO: 180768 - DNA, 223 bp, Homo sapiens
ggcttcagtcaagcgtagtaccaatttagcaacaattaatataaaataagccacagaaaccgacagtgccaccgcattctcctcccccactcaacccagcgaaacacacacataaaacaatgagagactgagtgacctcttcgagaccctctgtctgtttctcattagacctactgcatgtgatctgtgcttggccttggacgttgggtactacgctttggca

SEQ ID NO: 180769 - DNA, 333 bp, Homo sapiens
tctgtgtggggttggtggggagtctgggtgaacacaggtgggtgggagggttatgtatgcagacgcagaatccactgatgtgttggttttaactgagcagtgagatagcacgtgatccccaaggaaagcgtatgaaatgcgtgagctgagcagagggctgcaaggagcagcagcaccgggcaggcggtgaagatcaaacaggaccatgtatgcagacagacagtgcctacactgagaagcgtccccacatttccaccggagacaggctccttcatccctcttggtttactgtgtgttcccaaggaagcctctgcgtcacaaatactcattgac

SEQ ID NO: 180770 - DNA, 752 bp, Homo sapiens
ggggacagtgagtcctgaatggatttctgccctggaggtgagggcacccctggtgccagggagaggccctaccacagcacaaactgggctgcccttcctgacccagggatgaaccagcctgggcactcaggccacggctgtctccctgtgccaggctcagcgccctggggatgagggcgcaaagaaagagacggggccgacaacacaggcccaacagcaggccctgtgtctgggagcggcagtttctccccaagtaattttccacagtttggcttttcctccacacacaggcttgctcacagagttcagatggtggctggtcctccagagggttactctgggccactcacctgctcggtgaccccacctgcattgatttctgccctcatcactcagctgtctccagcttgcttctcaaagccctgtgcccatctcagggatatggcttctccagcccccagagctcacttcaccccatcagggcctggatcttgggtagttatgggaacccctaaatgcaccatcctctctgggccagggccaacatttctgttttctcagaaggatcaaagcccctttcctagccctgccaggaggaagcagttttgactcgtgcaaatatctgaagcccatttgggattttactttggtgagaaataaatacacagccatctgcaaatgatggaaatatgacttaagtaactttttggtcgaggctcctgggccagaggccagatggaaataagaccttg

SEQ ID NO: 180771 - DNA, 198 bp, Homo sapiens
tattatctaaataaataaacctaaatactagttcagactataaaatgagtctgtacgcttagaaataaagttagtcttgttaaattggtaagatttttaaccatggaaagattcccaagaagttgtgaaaacgcctaacgatttagattctgacatttagtggttttcattttcaggtaatttcagagtaaaacccgc

SEQ ID NO: 180772 - DNA, 212 bp, Homo sapiens
tgcatttgctgttcccaccaactgcaatacattccccctctgcaaggctcaattccttacttcattcaggtctgtgttcaaatgcagttttattagagaggccttctccaactcccttcctggaaatcacccacctgcccagaggggacctctgggttccctcttccctgcctactctgggtcatcgtctggggtgggtctctctccaggcc

SEQ ID NO: 180773 - DNA, 293 bp, Homo sapiens
aatgatgttgacatttgagctacagattacatggccgaatgttgaggtaggtctgttgtaattaaagagaggtttggaaacctcgctgggctaaaagccaggcagcaacatttctagcattacttctgtgaattatagctgcttgatgtggggccaatacacactttcatcagatcctatttcccttttttttttttgacggagtctcgctctgtcgccaggctggagtgcagtggcgcgatctcggctcactgctacctcctctgcctcctggattccagcgattctcctgc

SEQ ID NO: 180774 - DNA, 350 bp, Homo sapiens
ctaaagtgctgagattacagatgttagcacctaagcctggcctagaattattaaaaaaaaatgtacactccacagacatttgtatactcaaaagaagttacagttcaataacttacttaagtcaacttaaaattgaataatattcctagacgaatagcttgaattgcttaacaattgttttaaagccttttaaattgtagatattgattcattcagtgactagagcattcaccagttcctgggatgtgttctaggcactgaagtggagaacaagtcagatacagtccctgtacttttggaggctccattctagtggcacaacagacatttgaaaaattaaagaaatggtc

SEQ ID NO: 180775 - DNA, 221 bp, Homo sapiens
aacaatcaatacaagaagagagagacatgccagcagcaaggacgggagtgggttgtaaaccagggatggtgattaattcttcacaactgaggggcattaaaaaaagaaatcagagtggttcgtggctattaattttgttattaaaaataatcaaggaataaagaaataaggtaataaaggcctcgaatggaacaattctgagaatgtgttctgggcaaagg

SEQ ID NO: 180776 - DNA, 186 bp, Homo sapiens
cattacagaaaatgaacatatttcttgtgcatttgagttatagactgacactcatatttgccacatgtgttcaatgaccttcaggtacatgatttaatcatttactactactctttaataccaaataaagcaagaaattatgggtttacagacattgaacactgacatttggaaagattactctac

SEQ ID NO: 180777 - DNA, 296 bp, Homo sapiens
taagtaattatcatggggatgaggccaggtctcagggtagaatgggatgggcctaacgtgggtagggggttgtttgtggggtcaaggagcttgcggggcaccagttccttgtatttatgtgactagggcaggacatgggctagaatggcctcctctctttttgtgtctgagacacttaaattatcacttagattactgacctattaatcaactaatctatttggggaacaaaaagaccccatgctgatgtgctcacagcagtcaggatggggtgcagaagaggagataagtgagag

SEQ ID NO: 180778 - DNA, 153 bp, Homo sapiens
gatcacaccactgcactctaacatgagtgacacagtgagattctgtctcaaaaacataaataaataaaaaatttcatgttgtccgctccatcccaccctttgtccaaagtatccacactgcaaatgctacccacccattagtcacttagtagc

SEQ ID NO: 180779 - DNA, 457 bp, Homo sapiens
tgtattcctttgcttttcactcttctcaacagtttcacataagctaacaattgcttgtttaaaattaattttttgtattgttggaagagctggctgctcttccaaagcggttgttcctaaccaaagtgtaatgaaaacatcagttgagtcaggagtcaggagacctgatttcaaatcctctttctttttactgtaactgaggaaccccaaacacctttccttaggctctctaaacatccttttctgtaaatgaagataatgccctatctattttaaagacaaaagaaaatagtaggttacttgttaaactttaaaacatagtataaatacatgctttatttttgtggacagcaagcatttccatttcttactgcttggtcacttttaatagcttctgaattttaaaactagcctccctcaacttctgagaaggacagaaaacaaaaacaccttttgg

SEQ ID NO: 180780 - DNA, 521 bp, Homo sapiens
gaaacatccagttttattatcttcagtattacatgtgtgtacatacatacttagtacagtgaactgttactttaatatttacaatctgtatcagcaaaaaaataccattagattgtgaaagagattctcctttagcaacatccttatttttcctctaaggacatgtgctcatatgtattaagattcctatagattcagattcattaccgtatggtataaagtgatttttccctgggtattttcactatgttacccatggatttcttcataaaagacagacaaatgatagagcaatgtaattgcttaacatttgctattgaatgaaaatattttttgcatattcagcaagactctgggcttgaaattcatgcattgacaagaaattcctttagccttcatgggacatatctagggatatacttagaggactagaccatagaattttatttatctatttatttatttatttatttatttatttatttccttatttttgagacagaatctcactctgtcgccag

SEQ ID NO: 180781 - DNA, 207 bp, Homo sapiens
tcaggtttcttcactgaaagttaccctctgctccctgatttccatactgaattcttgagaagaaagtcactatgtgtggccacatctagggagtggggagttaaaatccacctccttgaagacggagtctctacatgaataaactggaattactctgcatgggagatttgtcccttcttcgtttatttattctatcatttatgttat

SEQ ID NO: 180782 - DNA, 395 bp, Homo sapiens
tttattgtacatctattcataaatattgaaatttttttgcttattggacaaaagcagaagaaactgctgtcatgggagaattgatgatgaatattacttggttcttcaggctatccattggccacagggcatactggcatttgcctcatctagctgtagggggatgttaagggtgaattacaatttgggaagttttctcaccaagagaaaatccagcaagtagtaaagcaattcaagtcaaataataggcctcgtttcgacaatcctgccatgaggtcatagctagtacaaatgattactagctactatttacttctaattaacaattcccctttccccttggtttcagaagtttctgttttgtcaggagaggagtggcatgagcagtgggcaga

SEQ ID NO: 180783 - DNA, 691 bp, Homo sapiens
ctgggattacaggtgcccaccaccacgtccagctgatttttgtatttttagtagaaagagggtttcaccatgttgaccaggctgatctgtactcctgacctaaagtgatccgcctgcctcggcctcccaaagtgctgggattacaggcgtgagccactgtgcctggccacacctagctaatttttaatttttttcaaatggagtctctgtcacccaggctggagtgcagtggcacgatcttggctcactgcaacctctgcctcccaggttcaagcgattctcctgcctcagcttcccaaatagttaggactacaggtgcataccacaacacccagctaatttttgtattttttgtagcttcttccctggcccagaagcttttttttttttcttgacacggagtcttgctctgtcgcccaggctggatggaagttcattacaaagctctagagcagaaacaaaaggaaggaaagtgcacttggaagaggccaagtgggcaactcgagaggcaagtgccccatccggcctctgatgtagggttctaggtgttggcatacttcagggcctcgcgtcccttctcccaattcctcccttggggtgggctgcctgcacacacactggcctgctagcacttgggagggagcatgcgtagtgtgtttactggagcatgcgcatgctcacctgaggcgat

SEQ ID NO: 180784 - DNA, 634 bp, Homo sapiens
tgacagttcatagttcctccagaaaccaaaaaatcagcatgccttttcaaatactcagggaaaaattttaatttcagtaattactgttcattgttattattcttcaactttactgaatgccttattccatacaagaaaaggcataaaaatttaatcccagaccacaggagcttaaatttcccttaaaacaagtcactcattcgtgattatttacataaaatgcttctaaagacaacccagagatttggttgaacctacagtgtgcaggcaatgcaaattcaggtatttaaatcatgggaagttggccttcggttccctaacaaaattagacaagtgcataattatcgtttaataaaacaaaaaacctacaatttggggtcctaacgacatacacaggaattcagaaggaaacctgaaatcctttctcctttaaaccttctatatctggacaagggccctcattatcttctacttctatagctccttctcttaacacaggagctaaatttccttgaaacatgttatgaagccactgccagcacggtggcacttgcctatagtctcagctactggggaggctgaggtgggtgcattccttgagcccaggagttcaaggccagcttaggcaacatag

SEQ ID NO: 180785 - DNA, 236 bp, Homo sapiens
tttcatctcttgttgattatttttgattgtgtgtcagtatatttccagtattgcagggttcactttgtcctccacaattatttccactcgcagaaacattcatcattttctcatcaccttcagttgttaaaatctcttactttgttgtggttggttgtacatttcttatttgtaatgcttttgtttgttaaacttaatagtttatgctgtaatagtttatgctgtaatagtttatg

SEQ ID NO: 180786 - DNA, 587 bp, Homo sapiens
ggaagatttggtattgttaaggtggcagttattcacaaattgacctacagattcaagcaatctttattttatagaaatgggtaacctgattctaaacactatatgaaaatgcaggctgggtacggtggctcatgcctgtaaccctagcactttgggaggccaacacaggtggatcacctgaagtcaagagtttgggaccagccttggccaacatggtgaaaccctgtctctactaaaaatagaaaaattagccaggcatggtggcatgtgcctgtaatcccagctactcgggaggctaaggcaggagaatcgcttgagtccaggagttctgggctgtagtgcgctatgccgatcgggtgtccgcactaagttcggcatcaatatggtgacctcccgggagcgggggaccaccaggttgcctaaggaggggtgaaccggcccaggtcggaaacggagcaggtcaaaactcccgtgctgatcagtagtgggatcgcgcctgtgaatagccactgcactccagcctgggcaaatctaccgtgggcaaatctaccgtgggcaaatctaccgtgggcaaatctaccgtgggc

SEQ ID NO: 180787 - DNA, 2927 bp, Homo sapiens
  misc_feature (934)..(934): n is a, c, g, or t
  misc_feature (939)..(939): n is a, c, g, or t
aggagtcatccatcaacactcctgctgtcggtgctgcccatgttatcaagaggtacactgctcgggcccctgacgaactgaccttagaggtgggagacattgtttctgttattgacatgcccccgaaagtgttaagcacatggtggagaggcaagcacggattccaggtgggactcttccctggacactgtgttgagttaattaaccaaaaagttccccagtcagtgaccaactcagtgccaaaaccagtgtctaaaaagcacggcaagctcattacgttcttacgaacattcatgaagtctcgtccaacaaaacagaagctgaagcagcggggaatcttgaaagagagggtgtttggttgtgacctgggggagcaccttctaaattctggttttgaagtgccgcaggttcttcaaagctgcacagcattcattgagagatatggcatcgtggatggaatctatcgcctttctggtgttgcctccaatatccagagactacgccatgaatttgactctgagcacgtccccgacctgacgaaagaaccgtatgttcaggacatccattctgtgggttccctatgtaagctgtacttccgggaactcccaaaccctctgcttacctaccagctgtatgagaaattttctgatgcagtttcagcagcaacagatgaagaaaggctgataaaaatccacgatgtcatccagcagctccccccaccacactacagaacactggagttcctgatgagacacttgtctcttctagctgactattgttccatcacaaatatgcatgcaaaaaatctagcaattgtttgggctccaaacctgttaagatcaaaacagatagaatctgcctgcttcagtggaacagcagctttcatggaagtgaggattcagtctgtggttgttgagttcatcctgaatcacgntgatntgctgctgccacacttcagcgcacgcacagaactaatcgtccccttccccctccgcttctcagaaaacagtttactcctcctttgctaggcccgatgtcaccactgaaccctttggtccagataactgtttgcatttcaatatgactccaaactgccagtaccgtccccagagtgtacctccccatcacaataaattggagcagcaccaagtgtatggtgccaggtcagagccaccagcctccatgggtcttcgttataacacatatgtggccccaggaagaaacgcatctggacaccactccaagccatgcagccgggtcgagtatgtgtcttctttgagctcctctgtcaggaatacctgttaccccgaagacattccaccgtaccctaccatccggagagtgcagtctctccatgctccgccgtcttccatgattcgctctgttcccatttcacggacagaagttcccccagatgatgagccagcctactgcccaagacctctgtaccaatataagccatatcagtcctcccaggcccgctcagattatcatgtcactcagcttcagccttactttgagaatggccgggtccactacaggtatagcccatattccagttcttctagttcctattacagtccagatggggccctgtgtgatgtggatgcctatggcacagtccagttgagaccccttcaccgccttcccaatcgagactttgctttctacaatcctaggctgcaaggaaagagcttgtacagttatgctggtttggctccacgtccccgggccaacgtgactggctatttctctcccaacgaccataatgtagtcagcatgcctccggctgctgatgtgaagcacacctacacctcatgggatcttgaggacatggaaaaataccgcatgcagtccatccggagagagagccgtgctcggcagaaggtgaaagggcctgtcatgtcccaatatgataacatgaccccggcggtgcaggacgacttgggtgggatctatgtcatccatctgcgtagtaaatcagatcctgggaaaactggacttctctcagtggcagaaggaaaggagagccgccatgcagccaaggccatcagtcccgagggagaggaccgcttctataggaggcatcccgaggcagagatggacagagcccaccatcacggaggccatggtagcacgcagccggagaagccatccctgcctcagaagcagagcagcctgaggagcaggaagcttcctgacatgggctgcagtcttcctgagcacagggcacaccaagaagcaagccataggcagttctgtgagtcaaagaatgggcccccttatccccagggagctggccagttagattatgggtccaaagggattccagacacttctgagccagtcagctaccacaactctggagtaaaatatgctgcatccgggcaagaatctttaagactgaaccacaaagaggtaaggctctccaaagagatggagcgaccctgggttaggcagccttctgccccagagaaacactccagagactgctacaaggaggaagaacacctcactcagtcaatcgtcccaccccctaaaccagagaggagtcatagcctcaaactccatcatacccagaacgtggagagggaccccagtgtgctgtaccagtaccaaccacacggcaagcgccagagcagtgtgactgttgtgtcccagtatgataacctggaagattaccactccctgcctcagcaccagcgaggagtctttggagggggcggcatggggacgtatgtgccccctggctttccccatccacagagcaggacctatgctacagcgttgggtcaaggggccttcctgcccgcagagttgtccttgcagcatcctgaaacacagatccatgcagaatgagccctgcgagcaatagagttgaagcagcctctgctggacagtggactgttctatttttttcaataacc

SEQ ID NO: 180788 - DNA, 375 bp, Homo sapiens
tcattcagttttatttttatgatttttgctatattaattcttaccaattttaaaccaacatttttaacctaaatcaatttattttacattattttcaacttaaactgcttatacttacatattccaatacattaaaatataaaattattacaaatgttcacccatgtaagatctaaaattatctcaagttccaggagtggtagtgggcttacactttgaaaaacatgactagatgcaaaatttgagtattcgtcttgatggcttaaaaacatattaaacatacgctgggcacagtggctcacacctgtaatcccggcactctgggaggctgaggcgggtggatcacggggtcaagagattgacaccatcctggcc

SEQ ID NO: 180789 - DNA, 251 bp, Homo sapiens
agaatcacttgaacccgggaggcggaggttgcagtgagccaagatcgacccactgcactccagcctggggacaaagcaagattccatccaaaaaaaaaagaaatgctgtcatttgcagcaacatgttaagtgaaataaatcaagcaggccaggtgtggtggttcacgcctgtaatcctagcactttgggaggccaaggcaagaggatcacttgagctcaagagtttgaaaccaacctgggcaacatggtga

SEQ ID NO: 180790 - DNA, 421 bp, Homo sapiens
tattcagcctcttttgcctaatttgttgatctgaaagttgaagatattaatgtctcttagagtggtaatttttgttagaccctgaaacaaataaaacaatgctttgaatcttaaatactgtgtgcttattgcctcaaaagaagacatatttcatcttgcagtaaatccttttttgtcttcatttctgactttttcttccagagattcaagatatttctgtaaatccattagacactcatagtttataagcataatggcaatcacagtcaatggagtggagaaactcaactttgttgtgttctgaattcgaagaaaatatttatcatagtctctgttacagtccttaaccgtagtccgtaaatgaataaactacccctccagaaacggaaaacatggatattattatcttaatgattaacct

SEQ ID NO: 180791 - DNA, 460 bp, Homo sapiens
tgctaagtaagaatatgaaagcaagacaatgacatctcacagtgtggactttctccaagctctacactagatggttggctgcccgatgagttgcttccttcaagtatcaatagtctagaaatcaaagttcctattgtattctgggagatttgggagatacttcagaagctgagtgttttctagtacactggagacatgaaatgcatgactgtgtctggtgattctgttacatcttccttcctgtctctccaagcgctcagggtttctctgacaaaggtagcaaacccaactatctggattgagtttgaaacacttggcctccccagagactttattaacatgaacatctttctcagaataattttcatgtatttgtttaaagcagattataaataatttgtattaatcttcttttgagtcatctagcaccagtatttgtagattatctctttgttctaca

SEQ ID NO: 180792 - DNA, 306 bp, Homo sapiens
tcttcaaaactcttcaactattctggcatactgaccatttaagtaaaacacttaaaaccagcagatattaaagaaaatcattttgaccttcatgctctttcctttgcaaaaatgaaattcccatgtaaagatagcctgcccacagtaaaaggaatggcaacacttttatcttcaaggataaagaattgagaccaataaaatactgaacagaccttgttagaagataattcagtcatatttccacaattaactattctgtgtcgaatccagtttattggtaactgactcaaactactttactcaaaa

SEQ ID NO: 180793 - DNA, 302 bp, Homo sapiens
agggagggaggggcggaggggcccactaggctaaagccacaccttgtctcccctttaagctcaatatgtcactcccactccacccactaccccctgagctagggctcaggaagcagattgttaattgaagctggttgggcagacactgagcatgtcctgaggttagaacactctgctcaggagcacacttgcccagttaggcactctgcaagtatttatggtgtgccctctgacaggctacagggagccagggaaagggcattttgaacacaaagtgagaagcttggttcatttaaagaaat

SEQ ID NO: 180794 - DNA, 1116 bp, Homo sapiens
ccctgttcttgactcaaccctcactggattaggctggcctatccactcattgtatctcctctctgtcagccacaaagaaagtcacacattttagctgatttttaaagccattcctcagagtttctcctactctccctactctcccatttggtcaacgacagggatgggaggcagggaaattctgggctgaagagggcaggtccctggtgagggccccaccctcaagctgaaaagcctgaaacagcagcccaaagtgagaagttaacatcccagttttctcactcaaatgttgccttttccagaaccacccatggcccactccatgccctcatcttgtgcccgtgaaaactgcaggctcagccagcaaaggcaggagaagcagctggacatcagagagaagtgccttacttcagagggacagctcgacggtgtaaatttcaagaagaatcccaggagacagctggactttgagggaagattaccttccttctctgtctgcttttcagctcctcttccctctgagagccacgtccaacagcaataaaatcccccacatttaccatcctccaattcgtttgtgctacttcatttctcctggatgcttgacaacagctcaggtgcagtgagtgtggaggcaaaaggctgccacactgaccctttgccctcgctggcagaaggtagccgccttatgctaaaagacatagggtccactgagctgttaacacttaagccatccacagagggcagagctaaaagagtactgtgacagttcctctggggcttcgggggtcgtgggcacccccgccccgctgatgctgctgtggggccggtacggaattcactcctgcatgtgcccaagagtgcttccccagctcctcctgtacctgctcacctgtgctccccctcccacgaggggtggagcgcagcgggttcaagggagtggaatttgcccctgctggcgccaacacagttggcttgttccagcacccatgcactccagttcccacccacaaaggggtcagggaactatctggcttcgtcaccacaggctttgcttcacacttactctgaactcggattcacacatctactccaatgtctttgattcttgttttc

SEQ ID NO: 180795 - DNA, 550 bp, Homo sapiens
atgtgcacatacgatatggatatacatattatgtatatacatatatgtacatatatgtatacgtgtccatgtacataatatatatttggttggccactacaagaccaaggagagttttagttggggttaccgacttgctggttctctggctgtagctgtaataaatcgtgaatcaactttaaggttttttggtagtggtgggttggtctggtttggtgtgggcttgtgggtgccttgtgctgggttttccccgatagaaaatcaagcaaaatctaaatgaggcaaaagggcgctgggtgggccaggtgacaggcacctttccaatcctgtaacatttatctcctaagtcacagttcgtcctctcggggggaaaaattgttttaactagacccccctcccctttctaaacgaaagtataaaagaaaatctagccccttcttcgaggccgagagaactttaaacgttagccatttcttagccgccggctaaatgaacagactcttaattcgtcttaaagtgtggcattttctctagctcgttcaagtacaac

SEQ ID NO: 180796 - DNA, 321 bp, Homo sapiens
atggagacaagttaatggataattctaggcaatcgtcaatggctgacagtatcgctgaaatgtcacctctgatgaagtatacatcgccatagaatatgtcataggacaccacagggatctaaacagagaaattctgcagacaaatgacctagattcttctataaataaactgcaaagaagaaaaaaaaagagagaacctacaaaggtcttaaagtataaagcaatgtggacctcatttgaattcaactcaaacttaaaaacaaaaaacaacaaaataaacctaaaaagtgtaacttaatcaggcaatgtgaacaatactaa

SEQ ID NO: 180797 - DNA, 728 bp, Homo sapiens
gactcagaggtcccaaccttatgatatctttgtacttgtatatccattagttttatttcagttacttatcagaagggaaaagaaaaaaatggcactatgcagttaagaggaccattgcatggagggctaaattaactattttttattttcatgaatgaggatcaaataggtttcagatgtctcgacatctatctggagatctagatgatgatataaaattaaaatgcagaatgtaagtgtaataaaatttgtttctccatgattacattaaataatctttgacatatatttttcttaggtatctctcatgcagagtagatcaacatacgatttgacacagaatagaattttaggtctaaagaaatcttagacattagtttaactttctcgttctacaaatcaggaaactgaggctcaggaactaacgtgacttgtggtggcatagtcaagagtggagcctgggctcctgaccttgaatccaatcctgtacccatatatcagtattttctgtaatattttacttgggcttgaagatcaaacaggtttgataattcaggcttcaaaaaaatttaacaaatttttctcagccaggaaataataagccacacaatccaaatttactttgcctatacctcctttttccacaatacataaaaaaggccatttgttttctagaatgtccttttgaggatagcagtgaattactatgcctcctgcaatgaaaagac

SEQ ID NO: 180798 - DNA, 556 bp, Homo sapiens
gtacccgacggcttcaggaatagtgctggtataatagaaagttccggacggcttcaacggaactttctttaaggtaaggataagtataacatgattaccattgcttttctcttcttcaagagaaacccaaacatttaaaaggtcatgagtgatgcaacagaaccagtttttgaatcctcttaccgggtaaaaagggggctcttctgtaatctacaatttcaaatacatgtgcatgtcatgaaaggagtgtttaccatttccagtagccatcatcttagaaagtaagactggaaaaacggagtcagaactgggaatgctgtcccatcagagcttgttggggggcactcacgtgctctgttttgcctgtggagactgctggtaggaatgatgatttctggaagggaagggaggttggtgctggcctactgaaaattaagctcttcttttaccttcttgcctcttaatttggtgactgtgagattaccagtcacaggtagtcactgactactgcaagttaaagttccgttgaagccgtcgagatcctgctagagtcacc

SEQ ID NO: 180799 - DNA, 468 bp, Homo sapiens
tataacaaaatgatttgtgcaaaaacgctgcaattgatatcatatctttcatgctaatattatttgcatctttgctttaaaatcatgctcaacggaactttctttaaggtaaggataagtataacatgattaccattgcttttctcttcttcaagagaaacccaaacatttaaaaggtcatgagtgatgcaacagaaccagtttttgaatcctcttaccgggtaaaaagggggctcttctgtaatctacaatttcaaatacatgtgcatgtcatgaaaggagtgtttaccatttccagtagccatcatcttagaaagtaagactggaaaaacggagtcagaactgggaatgctgtcccatcagagcttgttggggggcactcacgtgctctgttttgcctgtggagactgctggtaggaatgatgatttctggaagggaagggaggttggtgctggcctactgaaaat

SEQ ID NO: 180800 - DNA, 950 bp, Homo sapiens
ctcctgtatcagcctcccgagtagctaggattacaggcgtgtaccactatgcctggctagtttttgtatttttagtagagatgggtttcactgtgttggccaggctggtcttgaactcctgacctcaaatgatccacttgcctcagcctcccaaagtgctgggattacaggtatgagccactgtgtctggcccacctgttttttttgaaggcagaaaaacattcaatattaaaagcattcaatattatttcaacctgccttggctctagtgaatgttcatgatttgaaagaactgaaagacctaaaggcagtgtctctattgttgactacaaatgtaggctctttgttggactatgactataatcacacactgataatatgacgcaagtagaggcagtactactaagtatctagcaggtgctttgaaaccccattactaagtcccagaagactgtttcctaaatttgaagtggaagaattaaatgactcaatggaaccctttagctgtgggtccattgatgtgtgagttttagagctggaaggaattataattttgttgtttataattgctataatatagaaattataattgcttttctttctacttatgagttaactagatccagagatattcagaaagtttttagctctatattgcatggtgctgcgtgagcggaggaccctctgaatcctgaaaccctcttggctctcttccacggaaagaggcctggggccccgtggagctcagtgcccgttggctgctggtctcgctgacaataaagagcctgggttgcaacaaaacacacaaaccacaacaacaaaacacaaaaaataaacaaacacagggccaacaacaaaaaaacaaacaaaagaggggggcaacacacggaaccgaaacccgtgtgagtcgcttaagacacaggggaaaacgaggaaaggagagaacatga

SEQ ID NO: 180801 - DNA, 196 bp, Homo sapiens
atagtgaatggcagagtaagagttcaaacccagccagcctggctccagagcgttctggtggtccagcagatgtcctagacctatatctagtggctactagtgcccagcatccaaccttggtaccagctcccactcccaataaggtcaggctgaggtgcagattcctagacagagggattctcctgataggggccag

SEQ ID NO: 180802 - DNA, 426 bp, Homo sapiens
tgggtctcaagattcttaaatatcaaagggggtccagttcatttaatttaaaataccgagttgccacattgttccaggcacattattaaatgtgggggacagaggtataaatagtttattgacttgccctctaaaagcttacaatgtagggatatatgaacaggatcaagagctgttgatttctagcattttatgtgtcttctccattcatctttcagagttctagtaggttatccgggaggctagaatataaagtcttacagtgattaatgagctccaaagaggcacttaacattccacagcaataattcctgccttttgtttcccctttggtttatttaaacaaaattattgtgtgggagaacatttgaactcaagctatgtatctactataaaagctattccacctgactagctacctgccta

SEQ ID NO: 180803 - DNA, 238 bp, Homo sapiens
cacaagaaggaggctaaacatcaccccggatattgcagctgctacaggacagagctggaatttaaactggttaagacttgagaacctgagatctttaacaccactctagaatgtgcctcatttacatgacttggggaacttgggttccagcccgtatctgtgtgattccagaatgtactctctgattgtgaaaccacagttctgtttcatgggctcccacatccttggggacttattt

SEQ ID NO: 180804 - DNA, 512 bp, Homo sapiens
ttgtagcagaaatcattagtatcatcagttaatcaaagcaggataaaaacaagctctacataacagtttagatttaacatggaataaagtagaccacaaaggcttgagttccttgagtgtctcaatgtaacagataactgttgtcccagggaaaagctttaagttgtcctattccatgcagaaatttttaagggtagaagatgaatatagtatcctagctttttgtggaggaataaaatgtttgactaaatcagtagatgctggccaggtaatggccagaacatcgcagggaaccctgtgggtcagtggcttaaatcaacaattcattcattttacagtatgtttccctgacagaacagtaaacagacctttcagaaacacatatatatttggaaatataaataataaatcacttctgacaggcaaattgaacttcacaagtacttgggcagtaacaatccaggtatctagatttgtaagagttgtctatctgcagtacatgccccaatgtg

SEQ ID NO: 180805 - DNA, 275 bp, Homo sapiens
aaacggcaccaaaaaaataactggtaaaggacaaactgttcaggagatttcattaagaaaacattttcattaaggagcaaataaaactaaatccttacctatgagcatagaattgtcaagataaatctatagatctaacagaaaacaacaagggaaatatcttttaaaataaaactgcaatggctaggcgcggtggctcatgcctgtaatcccagcactttgggaggccaagccgggtagatcacaaagtcaggagattgagaccatactgtcta

SEQ ID NO: 180806 - DNA, 663 bp, Homo sapiens
tatcccctgtcgtggctcaatttgggaggctgagacatgcagatcacccgaggccaggagtttgagaccagcctggccaacctggtgaaactccgcctccactaaaaaaaagaataataatacaaaaactatctgggcctgatggcacatgactgaaatcccacctactcgggaggctgaggcaggagaattgcttgaacctgggaggcggaggttgcagtgagccgagatcgcaacattgcactccagcctgggcgacagagtgaaactccatcttaaaaaaaaaaaaaagtaaaataaaaaattaaatgaataaatgaaattgaactacctgcctaaaacccagaaaggtgggtggggctggggggaatagaaagagtattcagcattgaggctgatgcagttaatgctaagtcgagccatcaattctttgtgacatcattttccttgatagtcctgttatcttttcatccactaagttactaaagcacaggctcggaggttgtggtaggcagccctgtggacccattttagacttctgacctccaggactgtgagatgatacaccaatgtggttttaagccttgaagtctgtggtaatttgtcacagcagccataggaaatgaatgcaggggtctttcctcatgtctcattccactccac

SEQ ID NO: 180807 - DNA, 473 bp, Homo sapiens
aagcaacattcaggatatagagtagagaagcagaatagaaattatttgctattgggagtttccacagcaggtaggtataaagataaggtcaaaggatgctgtggcagtatcagtaaagaaatgcttcagagtaacattggttttagggtaaatagagaagaaaattaagtttggaaggggctgatagcatgaaaatatcctgaagaatcaaggaaatggaaatatttgatcaaatatctagctttgtgataataaaaaaaacagctagaagaaaaacaataacaagagctatcgtttactgaataccattatgtacaaggtattatcctaggtgcattaattagttagctaattaatgaaagggtttcactctgttgcccagcctggaatgcagtggcatggtctcagctcactgctgtattcaactcctgggctcaagtaatcttgcctcagtctccccagtagctaggact

SEQ ID NO: 180808 - DNA, 144 bp, Homo sapiens
cacctggccaatgcctacttttcctttaaatctttgcttaaatgttactttgtcagaaaggcctttctgtcctctcagactaagccaggctccccccagttaatcactcttacagctccctgtatttttcctaaaatgcactta

SEQ ID NO: 180809 - DNA, 230 bp, Homo sapiens
ttattactgatgataactgatttaactatccaaatttctaccacattgtgtgctgtgttttaagtcttggggacagagaattgagcaaagtacagccttaagtactgatagcctttagtggccttcttctaaccagatttcccctaagtctgtccacattggtgtcatctttgggtgctgatttactctgggccaggcaaactttacctggacttggggaaaggtatgaa

SEQ ID NO: 180810 - DNA, 294 bp, Homo sapiens
gcgatgacctcgaaagttccttcccattaataataattactattaataattaatagcaataactaatgataaaacagaacagttgcagcaatatactgtaataaaagttgtgtgaatgtggtctctctctctctctgattatcttattgtaccatactcacctatttttggaccttagttgaccgcttgtaactgaaaccatggataagagggggactattgtgtaaggaaatgaagtcggagatatggaatttcatttcagggcttgctttcctgatattcagctattctgta

SEQ ID NO: 180811 - DNA, 523 bp, Homo sapiens
cactaaggaaacagcatgtggcaagaacccaacagcttataaggaattgaagcctcaattctgtagtctgagaggaagtgaatactaccaacaactatttgagtaggcttagaagtaaatcctccctagttgagtctttaaatgagatgttcccagatgacactttcattgcagccttgtgagagatcctaaagcaaaagacccagctaagctgtactcacagaacccataaaaactgtgagataataattgtgtgttgttttaagccagtaaattttggggagatttgttgcatagcaatagataactcatacattcacacaaatgaactacagatgatgttaagtaagtgctatgaaacaaaagtcaagaatggaatgagagattataacaggatttcctaatttaaatttaggtttagatctccactaaatggagttaaattttatcaaataatgtcattaaatggtcatgtttagtgataaggaaaaaatatttgcaataataatttatactttaattc

SEQ ID NO: 180812 - DNA, 277 bp, Homo sapiens
actgttcagatttctgtattagctgatctaccagacaatcacggtgggatggagaaaagtaggtaaacaattactctagagcagtatgctatggccaatcttctgaaaaagactactgtattttggtgactcaacttacagatttttcatttagtctacaaatctcagcatgcaataaggctcctgcctcctccattcccatgaaaacgttctgatagagagtaccagtgatgccagtgatgaagctacttgttattacactatattattattggct

SEQ ID NO: 180813 - DNA, 219 bp, Homo sapiens
cagcatttgtaaggatgcagcattcaagataccatcctgggagcagaaatggccctcactagacactgaatctgcctacaccttgatcttggacttcccagcctccagaactgtgagaaatacattttcgttgtatataattgatatagtttgaatatatatatgaatatatagtatcgtttgaatatatgtctccaccaaatttcatgttgaacagta

SEQ ID NO: 180814 - DNA, 462 bp, Homo sapiens
gtcgtggctgccttgctggtgcatgggctagagcattagttctgggattgtctggttcattggttcatttattcccttgctcactccttcattcaataataattgagtgctcactcagttgtttaagtcacgtgaagggtacaaatcagcactaaaatgctgcctgtttagccacgacagacattcttcctcctgtgctgcatacgcattcaaagcccaatgggaattaagatccaaactgtttgttcactcatggaatactcatgcaataaattgtttagtgccctcagcaaagagtccttgccacaaagcttattagtgagcagtccaagttttccctcatcttattaaatataaaatttgtttagaagtgaaaacagaaaaatacgttctgaaaaaggtaagtttttgtcccaggaaagatgcttgtgggcctagctgtctatagttgtcccagttccc

SEQ ID NO: 180815 - DNA, 464 bp, Homo sapiens
tctttattcccatcatccaaatgctcagtattattatggtattacttttcctctttccttcctccctccatttctttgtctttttcattttaaaaatgctttgaaacctctatttccaggataacggttggctggacactctgaagggacctcctactaaagatctaaaaggtgtgtgtgtgtgtgtgtgtgtgtgtgtctgtttggtgcggggtgaggtaggcattttctttaggttaaaaatgggaagaacacatgattatcgagaaatacaatctagaattctggttaaagctagaattttaactaatttaaattctagatgaagaacagaacaagctgggcacagtgtctcatgcccgtaatcccagtgactctaagacattgacgtgggagggtcacttgagactaggagtttgagaccggactgggcaacatagtgagacatctctaataaaaaaaat

SEQ ID NO: 180816 - DNA, 358 bp, Homo sapiens
agtgtcctgcattttgaagtacagtgtgacttgaacatcagagtaaaaaaatgttggaaagcaataatctatatttactcacaaaaggaaatggattgacctattgcttttgctactgaaagtgaagccttaaaacaacacaacacagaaacctgattctggtgtgttttaacatgtacaatctaattaattttagaattagaaggatatggtggccagtgatgtaaacactcaagtagtttgccatcacataattcaattccataggaaaccagatctcattactttgtgtcatggcactagctaaatggagtcatttttcaagttaggaatagcaattatttggggagcaacaatg

SEQ ID NO: 180817 - DNA, 714 bp, Homo sapiens
tattaatcaatatattaagaaaatattgcattaaaataacatctaaagttataataccatactatttaacttttctttaggtatttccaaaattaataaactcaattatacataggtgttacatgtcaaaattagccatggtaactctcacttctataatctgacctttctaaaaacctgaaaatcaaaagtttatcttgaatacatcctaaaaatagcagtaaaaagtgacttcataatggtgttgccaaccttggttgtgaaacattttactatggactatttccctcatagattgtgcccattaaaaatggttctgctaaaatttatagtgtaatagtgactttgagaaatacacaggaaggaaggaaatgtttggtcaaattactgcttaattattccaaagctggagtgactggctttgttttgcgcccttttactgaataacttttgataacaatcaaactgaaaagtcaagaaattaacttttatggaaattgagtcatgccttaaattcatttttaattcttatactgcttatttagtaaccaataaaactaaaccaagttgtgctatgaagtgaaggatcataacttcaaataagcaattccattttctccattatccctacacttggctggcaaagagtctctaggaattttttaatgtattatttaaaattgaaaatactaatgttcatactaatatgatgtt

SEQ ID NO: 180818 - DNA, 189 bp, Homo sapiens
ataattgtgatgttaattgctagttgaaagaacagcatggtgtatgtgagacatatggaatagtccgtggcagataggagtactcagctatgtatattccagaaatttagactgtaggttcatcttagagattctctcttctttcccctctcccctttctccctcctttttgtcccaacccccatcggt

SEQ ID NO: 180819 - DNA, 693 bp, Homo sapiens
gtaggaagtgcaggcgctgacaaagagcctcagccccgcgggctcccctgctctccagccctctcttgctctctcttagacgccagacaggcgcttcgggaatgtatgtgggagagtttgaaaattcatggtgtttctttcaggctctctcagcacttactgcggctacctctgctctcccgccacctgcacgtctgcagagggatccccgccgaaaagttgagcctaaggcagctatgaaggagaccccaactcgagcttcactgttccaaagcggtgggccaggcggctggagagaaactcgctcccgtgaggccacacccaggcctggcgcacccaccccgcggcagcagtggagggcgtcgccctcccgggccttccgacgcagaccctgccatccggatgctgcgggaagtagggcatcctcacgtccctgactcctccggctccgcgcgctcacggaacccaagtggagtgggaagcggtcacacaggcgtgtgccgtccccgaaatcgttgctcctgtggtggtgacccaaagcgagacaaagcgccgcgccaatacgggctgcagtgattggaactcaaacacacacatctctccgcgaatgtgttccatccgtgtaaatatgcctgggtgattgaatggatggctgaatgaacgctgtgtggatagaaatataaatgttacatg

SEQ ID NO: 180820 - DNA, 319 bp, Homo sapiens
acagggcagccatgtttgaggcttcaaagaggtctagtaaatgagggttgaaaagattgttgggttcaggaactagacgattacaaattttgagaaaaccgtttccatttaatagaggggcagaaatcactttacataggttgaggaatgagtgggaggtgaggaaaaggaggtggtgggcatgaggtcagaatggtgaacacagaataactgagaatcatctcttagttctacccacagattttacagttgagggaaattttaccagttcctgaaaaagtggttcgttaagggggctagtcttttgagacatcacacg

SEQ ID NO: 180821 - DNA, 876 bp, Homo sapiens
tgctacgattactggtgtaaaccatcatgcccagccaggctgcagaatttttattttatcatgtcagtaacagagagctaatgaaggttttgctaagtgccacacttttgggtgattaggcttctgattatattcagtgcatgttagagggagggaggagtagaactgataagaagtctttcacagtggctcaagtgagaggacattaggctctgaaccagagcaaaggcaggggaaagttaaaggaagagacagatttgaaaggaaagtggtaatacaatcaatgatgtgttacagtcttgatgaggagggggaagaaaaaggagttgaagacatacctaagtttttgatagagcaatgaggggaaaaggtgatgctttttagtggaaatagggaatgagacgtgtaaattttggagggtagactagatgatatgaggagaatagtaagtgggaaaataagtatcccatggagaaagttctttaatttacctctataatctgttatagctcccttgaaatatccgttgacaaggttcttcatcttcattgtcctgttatatctgactcaatctctcatatgctcattcagactcatttcctctctgttctgggggtagatgaaaatgacaaagtgccattgttcttataagaactcgccccaaataaaaacttttgacaccatttctgtcgtacatcagtagcctgttggtggttgtttggatttgtagattagattatacagggttattgaggtctctgcattctttgttgttttcacctcctcgtgaatttaggcctagcttgttgttgcccagtctcttttctgtacttgagatctatgtgagaaaccgtcgattcgagggaagctgctaga

SEQ ID NO: 180822 - DNA, 500 bp, Homo sapiens
accatgttgccccggctggtcttgagcgtctaggctcaagagatcctctcaaagtgttgagcttacaggcgtgagtcaccgcgcctggcctatccttccttttggcggtgagagcttacagaatttttttttaaatgctgtgttttttttcttttttgtctgcacaatgaaaatgaaatagtgtaaaactattagttttagtggaaatttggaatctgttacagtagcctgataactcaggtaaattattatggctctaattagctgggcagtttagattcgaagaatgattgcccagcacttgaacagactagaagggtctgtttaaacactcctaattcctggggttcatttttatttataaaacacatactttgggccaggcgcagtggctcacgcctgtaatcccagccctttgggaagccaaggcgggcggatcacgaggtcgggagatcgagcccgtcctggctaacacggtgaaaccctgtctctactaaaaa

SEQ ID NO: 180823 - DNA, 149 bp, Homo sapiens
ccatgtaaaggtacaataacttccttatgtcaatccagtgaagactttaggtttttattcttgaaacaatgttacaaagaaagtttggtggaaatgtttggttgcatattgtgactcccttaaaatgtccctaaagcatctgtttgtct

SEQ ID NO: 180824 - DNA, 568 bp, Homo sapiens
ttgtgaagatagaattggcagcatttaccacaagagcctaaggaaagggaaggagacacagataactccaagctggtgggcctggacccttacctttgataaggatggcaacagtaaccaacacactggaggcaggaagggaacaatcaccaattcatttggaggcaagaagagctcagagtgtgggcaagtcactcaggtggtgctcactttagcagaaaggctgtgtagatgagtgtttagttaaagaactgacattttcacggatatgccttgaaagtatgtaaatctgtatttcttaaatggttagcaagcggagccctcaacagcatttatcacctgcatgaacagaattatttattgtgctgtgctcctgtgaatggtattccaggaattggaaagatgcgggcaaagttttgttttaaaattaactcttaaagaactggaatttctctcattagtagtaaaagcaacaagaggttgccaaaagcaaaagtgttgagaaagaaacatgttccctttactttttctttaaattataagtgaatgggcatgacacaaaacagcg

SEQ ID NO: 180825 - DNA, 671 bp, Homo sapiens
aaaatgttgtccaagttggcatcagagctggagagttttaagaggtttagaagcctggccgtcaatacctacaacagttatggaggcaaatgaaacaggcctttgaaaagaaggtaatgtggagttggtagcctccatattgattaagaaggggacctacttaccctctactgtaagagttacccgaagcatctgtgatggtccaggaggcttctgagatgaccaggcagcatcagtcttcagccactaagccgagaagatctgggaaggagtcagtcagagagccttgggccagggttccaggggctctgggagtggctgccagattgaacaggagaatctggaaccaggagtgagcagagctggccccaggccttggtggctgtgtactagttctgtgacctgcaatcagtcacttaacttctgtgagctcctctctttccgtctgtaaaaaaggaatatgtactacccacttcctgagtagatgttgaagatgttgtaaaaggttcgagtcaaccaattaaaagcaatagatcacatgaagatgagtatatcttctgtttgttgggacataatccagagaggatctttctccccagatattatgggatggccacattttacagctgagagtggtaagtgatcaggtgaagcagagtaagtacctgtgg

SEQ ID NO: 180826 - DNA, 584 bp, Homo sapiens
agaccccctacataactagcaaagaaatccagcaacatataaaaataattatacaccatgaccaagtgagatttgtctaggaatataaagttagtttactatcccccaattgattacaaatcaataaaacactatataaatagagcatcttaataaaagcagaaaatgcatttgtcaaaatccaacacattttcatgataaaagcactcaacaaactaggagtagaagaaaacttcctcaaactgataaagggcatctaggaagaacctacagctagtatcatacttaacgatgaaacactagttgtctccccatatgattaagaacaaggcaagcatgtccattttcactattctatttaacattgtactggaggttctaaccaagaaaaaaaattaaaaagcatccaatatggacagaaatatttaaaactgtctttatctgtagatgacaaaatctttatccagaaaatcctaaggaatcaactaagaaacaattagaactaataagtgagtttagtaagggtcaagataccagaccaatatacaaaaatcaactgtatttccatattcttgccatgagca

SEQ ID NO: 180827 - DNA, 480 bp, Homo sapiens
gtcacatgctgatttgtttgtggggcgaatatttggtaaagatcaacaattcaaaactcttaactagggtgattatactgtaggtggcaaggtctggaaaacccttcagatcactctatacacaaaaagcttgacatgtgatcaatggaaagtgcatggctcagggtgacccagattatgccgcgggaaaaaataacctcaagtcttcatctgcaacctgaaaacaagaagggtatttttctttctcgtgttcatgtccagcacgagtttgcagggcgtgtggctcctgatccacatggaggggacagttgccatcttgcatattgccacttattgaccagagagaggcttctgcagggtctcacatgaataaagctaaatactttggccctaaaggtgacacttctgcacaaaactcatttcgccaaactaacttctggtccctgcaggaataaattgccagtgtctgtttttttttta

SEQ ID NO: 180828 - DNA, 175 bp, Homo sapiens
gactcttaactccttttcttcatgattgcatatatgtcacagcctctgtacagcctcatctgacactcctgggcaggatttgtttcttcctcccttaatacgctcagagtaactctcacattgttttgcagtgatatgtttacaggtctctctcccattgacagtgaacctccca

SEQ ID NO: 180829 - DNA, 256 bp, Homo sapiens
ctgggcaccagtttttcctcatacctcactggatgcttccttctctgcctttcctggttcttcctctgcttcctgagcacttcacattggagaacccccaaagtacagtcattggacctatcttttctatctagattcattttcttgatgatcccagccaatcttataactttcgatactgtctatctgctgacaaattccaaattttatatcctctaaccagactcataggtccaactgcctactcaccatctcg

SEQ ID NO: 180830 - DNA, 150 bp, Homo sapiens
cgtggtagaccagggtagtcttggaaaatgcaacatttgggcgcaaaggcagaagtgcttgtcctcacctaggtcgatgggggtagcgccctagccagggaccatgccctcctctacccagcacttcccttacccccttcctcatcattt

SEQ ID NO: 180831 - DNA, 555 bp, Homo sapiens
aggtcagcgacagaagccgtggtggtttcatgccaccagtttacctttgtcctgagctgtggaggttgtttaaagctatagatcaaatgaagcctggaatataagggtgcagttaggatgattgctgtgtagttattttttaaaacggctttttgaggcataattaacataagctgcgtatatttaaagatacagttagataacttttgatgtatgcaaacacatataaaacatgtataaaaccctcgctgccgtccagatgatgaacctgtccgtcacccagaagctctctcctacccacacccctttctccccaggctgcagcagtctgcttttgggcctgtagattcgttgccttccttagagctttgtctaaatgaaatcctacaatatgttcttcttttggtctggcttccttccctcagcgtcattattttgggctccttggatgcgtggcgtgtgctgggcagtgttcccctgcgtggatgtcgcgtttgttcctccatttgcccgttggagcgtgtggagtgtttccagttcttgactgtcacaaag

SEQ ID NO: 180832 - DNA, 187 bp, Homo sapiens
atattaagggaacttaatggcattaatgttattgttcttcaatatgataatggcattttgattatctaggatgtctttatgagttgggagatgccttcggaagtatttaatggtgaagtgtcttgatgtttgcagcttactttcaaatggttcagcaaaaatcatactaaaatatgtatgtataaat

SEQ ID NO: 180833 - DNA, 393 bp, Homo sapiens
gttgggtgtggcggcacatgcctgtagtcctagctactcagttggctgaggtgggaggattgcttgatcccaggagttaaagtctgccgtgagttatgattgcaccactgcattccagcctgggcaacagagtgagaccttgtctctaaaaaaacataataatggaaaaagttaggtcataaatttgaaggtatatcccagaaggtagaaaaacacaaggaaattgaaaataagaaaaactgaagaccgggttaggagatatatatccaaatcgtaggaattctagagagaagagagaaaaaaaatgagaaattgaagaaaatgctccctgaaccaaagaacagtggttttcagacagaaaagagcccacctaatgctcagattggtgaatga

SEQ ID NO: 180834 - DNA, 180 bp, Homo sapiens
ataatgccactgcattccagcctgggctacagaatgagactctgtatctcaacaaaacaaaacaaaacaaaaacacaacagtctgttctgtggaggccttgggcagatgctgggagctctgagcacggactggtccctctgttgggagcctcttcccttcatccctcctggttaacttga

SEQ ID NO: 180835 - DNA, 294 bp, Homo sapiens
acatatagccggacctctccctactgtatctttcctagtaatagccgttccttacctatttaaatatctcatgtggcctccatcaaatgcttctacttcaagccaattttaaacatacttttcgcgaaaagatatgttgtttggctctattattaaaagctgcttaatgcctcatctgacaaaaaatttccccttacagattttcagagtatgaaaggttaagactgatgtcccttctacattacttaggagagctttcaaatagaaaagcaaaaactattttatatacattca

SEQ ID NO: 180836 - DNA, 630 bp, Homo sapiens
atgcccacagctcccccaggaccctgaggccagcctgtggagggcctgtgatttgaacccttctacgaggcttcaaatcagtgctgtttgtcctggcctcataaaacctggctgcccagttgggattggtgtcacttgccttgctgaactgggcactccttgggaagagggtgggtgctgcgagaaggcggtggatcctggctgtgcaaccttcgcaggtggctgaacctctctgtgcctcagtttgctcatctgcaaagggggctgggattcctgcctacatgcatgtgctcaagagggaaagccggccaggcatggtggctcatgcctgtaatcccagcactttgggaagctgaggtgggcggatcacttgaggtcaggagttcaagaccagcctggcctaaatggcaaaaccccatctctactaaaaaaaaaaaatacaaaaattagctggacgtggtggcaggtgcctgtaatcccagctactggggaggctgaggcaggagaatcacttgaatctgggaggcaaaggttgcagtgagccgagatcccaccattgcactccagcctgggtgacaagagtgaaactccacctcaaaataaataaataaataaataaataaataaata

SEQ ID NO: 180837 - DNA, 572 bp, Homo sapiens
ggggtaggggtgaccaggaggaagtggggacagcctctgtcccacaggaaggctggctagccccagtgggtatgggggagctgggcagggaagagggtggactcccctctccctgtgggagggtgtgctgggcccatgaggccctcatccactctcagccaccttcctgtggagccctagcctcgaaggccacactatgagtgcaaggaggccacccacagcgctgctcccgcttcacaggtggggaaaccggcccagtgtcttgaggcagcccagccgcctgccctgtgcttcccccagagccttctggggaatgagaccttcgttacacgctggcgctccttacacccctacagcctttaagctaaggcctccagccccatcgctgtaagaattgtatgctaggcattctgaggacatagatgggggtccccatgtcggaaggagccaaggtgttggaactgggtccagttcctgggctggctctggtgggagatctggaaccctatgctggggctcctggacagccctggaggcatggcatggacagtgtgtcagccgcacaccgaggc

SEQ ID NO: 180838 - DNA, 600 bp, Homo sapiens
ctctgcttccctaaagaaatgaagtaattagacatggttggaattcacatctagtctcaaaatttagttaaaaattaccaaaaattccagaacatgaagaaaatctgaaaggatttagctttcaccactgatttgagttcctcccactctttgggaaggtgctagcaagctgtgaagtggcccaaatatgagtagaaagctgaaagagaaatagctaaaagagtctacaaatacctcctgaaaaattgagatttggcttgaccttagactggagggaattattaggaactctagaataaggccaaaaaggggaaatgtctcatttctaaaatatacccttatatggaattattattattattattggtggggaaaagtctttatcatgcacattgtaggtttagcaggacccactacccatcaaatgctacccttgactgaaaatcaccgaaccagaggactatactatctgtggaaccaatttacgttaatgatcattatatgagtgcttgagtggccagtgaattaggtttacaactcaaaccaaacacctatttctcctgatctgacctttgtcagaggattgaggatcatctttaa

SEQ ID NO: 180839 - DNA, 220 bp, Homo sapiens
acagtttcaggtttatatgtcagtctttcatccatagctaattgatgttggtataaagagtgaaataatgatccaatgttgaatcttccatttcatgaatatgacataactctccaattatttaggtttcaaattttttgcccaagtgttcttcagttttcagtaaagaaatttttcacatttaaaaaaaatttcctgttttagccaatgcagtaaggca

SEQ ID NO: 180840 - DNA, 453 bp, Homo sapiens
gatgtgtaaatcaccttgccctaggcaaaatgtctggtgaaaatgtttatgccccataatacgggaattaaaaatcagcatttaaaaagctagtataggccaggagtggtggctcacacctgtaatcctagcactgtgggaggccgaggtgggtggatcacctgaggtcaggagtttgagaccagtttgcccaacatggtgaaagcccgtctctactaaaaatacaaaaaattagccaggcactgtggcgggagcctgtaatcccagctactcgggaggctgagatcacacactgcactccagcctgggtgacagagcgagaccctgtctctaaaaaataaataaattgtcaggttgcgttatgctcccctgtggtagaagtgtgggtggtgttatttaggtagtacttggagagtgcccgtcagatgtctggaaacctaatttaaagtagta

SEQ ID NO: 180841 - DNA, 763 bp, Homo sapiens
gagaaattggagttggatcggatttctgaagtcatgcattccaacctcccacatgcggcaaaagtttcttttgtgttcctgacagtcctctagcttttgttggaaccagacccagcaaatatattcatctgtattccaacaaacagttctgattgaggccaaaaatttttgtgacatgcaagaagagagtgcaaatgaaatgggtaacattgaataactaccatttcttcaattatgttcttgtaggggccttaacaacttgggaagagcttggaagattgacagaaggttttcctgaggaatcaattcagaagaattctgttctagctatttggcctccctgaacttccatttacttaatttgtaaaacggagataattatacctgcttttcaggattgctgtgattgaatgagaaaacctgtaaagacccttaaagtgtaggacactcagaaggtgcttaggggaaaagatggattattttatcattgttgttgttactattattattaataattattaggagagtgtcttagtttgggctgctacaacaaattccatagactgggtggcttagacaactgaaatttatttctcacagttctggagggtgtgaagtccaagatcagggcagcagtacactttgtgtctgtcgagggcccacttcctggtttgtagatgtccatcttctcctgatatcctcacatggtggaaagtaaagggagagaaaacaagctttctaatatctttttataagggcatta

SEQ ID NO: 180842 - DNA, 276 bp, Homo sapiens
ctgtagactttatgaacactgtatacttaagctatgccaaatttattaaaaacagtttttctttcttcaatgataagttggtcttagcttactataagtttttactttatgaagtataaagtaggtttgtttacaccagcatcaccacaaacacatgagtaatgcaatgggctacaacactgccacagctgcccactgtcactgggtgacaggaatctttcagctctgttataatcttacgtgatcatatatgcatatgggtgtcatatatgcagt

SEQ ID NO: 180843 - DNA, 211 bp, Homo sapiens
caccgcgccctgcctgatccatctacttcttaccacttctatcgctaccactctggtcccgcgaaagagatgacattgtaatctcttccctggatcgttccagtagcctcttaactggtttcttggtttatgtcttttctctgtttcagtctgttgtcagtgctggagccagagctgttaatgtgtttgtcagatcagaaccctgcaaaac

SEQ ID NO: 180844 - DNA, 538 bp, Homo sapiens
ttcgccaacatcattttgtgccactctgccttgctcccccatcctcctccagctacaccagtccttctctaagtttctgaagaggcatccttacatcccgcctttgtatttgtgagtccctcaccctggaattctctgtcccagagctgtgaatggctgactggttcccttgtcctcaaccaagggtctaactgtccattcccttatcttgccttatttttcttcatagtactcattgccactcgacattgtaaatatattcattttcactttattggttgtttcttgtctgtctcccatctgaacataagctccatgagagtaaaacttcatctgttttgttcactgctgaatctccaatgtgtcagggtgttttgccctctagagtaagcacccaaatacttattgaaagaattaatgaatgactaggtattagctaggaacagtatttcagaatgaacaacgctcaatgtcacaaaattctaatctggtttatttttgaaaatacaagagagaaacattcacagcaccattatct

SEQ ID NO: 180845 - DNA, 214 bp, Homo sapiens
gaacgttaccaaacttaacaaaccaaactaaaaactgagagcaaaagggggctctgcattctcaactcctaacacctcgttagcacagctggctatatttcctggtgttttaatgttttcacctgatggggtaggtccttattcataatactgcccaatggacattgttcttctaaagttaaagcatatgaagcatgaagttattgaggttgaa

SEQ ID NO: 180846 - DNA, 504 bp, Homo sapiens
cattcttaactttgaacacattttgtttctgttgatgagtgagaatttagtagactttgtgatagaatcagttttacacttctatatgacacttcacagtttaaccaacactttaacatagaaatgtagacagtgattttagatcatgctgatttcacattcctttctaggcattgctgtgcattcgacagacaagtggctgaaattaaaaatatgatttgtaattgtagaatattttgaagccagctgcttcatagatttcacagtgaattgcctttgttgataaaatatgctgtattaagcctttttaaaaaaagtttttaatactgttaagtaatttagacatcagaaaaaatatggaatttgtactttttatttaaatatattgtttgaaacctgtcactattttatcttgattttttttttacttgtgtttaaccataaatagaatgattacatgtatctttcaaaaacgttctgttttttgtagtttctttagtctta

SEQ ID NO: 180847 - DNA, 2103 bp, Homo sapiens
gcagcgcggagatctcggccgccaagctccgcctcccgccccgggctgtgccccggggctcgcctgaggccgaccacccgcaccccacctctagcggctttgctcgaggcccaccttcttcccacccccggcaaactccagtaggctcgccctcgctgactccccgcccccgcgtcaactgcaaggggcccgcccatagccagttccggggcggttgctcacatcgaccggaactccccgccccctcccgcggcccctggggccgtaggaggccgcagcgaggaggtagagggggcgggggtcgcactagggtgtccctagagaacgaggactctgaaggcgggacatttgggcgacccccgggcggggccagccattaaacagtcccacttctgtgccagacactgaactgggctcttgacgggcatcatctcttaatcctcagaacatcccagggagctccacaggatccccatatcctgggccatgagtgagttgaaagactgccccttgcagttccacgacttcaagtctgtggatcacctgaaggtctgtccccgctacacggcagtgctggcacgctctgaggatgatggcatcggcatcgaggagctggacaccctgcagctggagctggagaccctgctgtcttctgccagccggcgcctgcgtgtgcttgaggccgaaacccagatcctcaccgactggcaggataagaaaggtgacagacgattcctgaagctgggtcgagaccatgaacttggagctccccccaaacatgggaagcccaagaagcagaaactggaagggaaggcaggacatgggccgggccctggcccaggacggcccaaatccaaaaaccttcagcccaagatccaggaatatgaattcactgatgaccctatcgacgtgccacggatccccaaaaatgatgcccccaacaggttctgggcttcagtggagccctactgtgctgacatcaccagcgaggaggtccgcacacttgaggagttactgaagcccccagaagatgaggctgagcattacaagatcccacccctggggaagcactactcccagcgctgggcccaggaggacctgctggaggagcagaaggatggggcccgggcagcggctgtggctgacaagaagaaaggcctcatggggccactgaccgaactggacactaaagatgtggatgccctgctgaagaagtctgaggcccagcatgaacagccggaagatggatgcccctttggtgccctgacgcagcgcctcctgcaggccctggtggaggaaaatattatttcccctatggaggattctcctattcctgacatgtctgggaaagaatcaggggctgacggggcaagcacctcccctcgcaatcagaacaagcccttcagtgtgccgcatactaagtccctggagagccgcatcaaggaggagctaattgcccagggccttttggagtctgaggaccgccccgcagaggactccgaggatgaggtccttgctgagcttcgcaaacggcaggctgagctgaaggcacttagtgcccacaaacgcaccaagaagcacgacctgctgaggtgagcgttagcaggatgcacagtcccgggggtggccttggaggctgtggccacggctagtcacctttcaggggttttacaacaggctttccaatcctggctggcctctaaatcacctggagagcctcgaaaaaaacagcagtggccagtccaccgggtatgtcccaaacaaattctgattccacagagtggggctcaggcatctgtgactgaccgattgatttgatttgtttttgttttgtttttttttgagagggagtctcgcctgggcaacaagagtgaaactgcatctcaaaaaaaaaaagaaaaaaaatttacgcttcttaaccatttttaagtgtacagtttagtagtgttacccatattcacattgttgtgtgatttattttttgtcttttcatgcttcttttctttttatccccaaagttttgttattaaaaatttgatacacacagaaaatctgaaagaatcatacaataaacatcagtatattctccacctaaaaaaaaaa

SEQ ID NO: 180848 - DNA, 1972 bp, Homo sapiens
  misc_feature (1888)..(1888): n is a, c, g, or t
  misc_feature (1896)..(1896): n is a, c, g, or t
  misc_feature (1903)..(1903): n is a, c, g, or t
  misc_feature (1906)..(1906): n is a, c, g, or t
  misc_feature (1909)..(1909): n is a, c, g, or t
  misc_feature (1916)..(1916): n is a, c, g, or t
  misc_feature (1929)..(1930): n is a, c, g, or t
  misc_feature (1934)..(1934): n is a, c, g, or t
gcagcgcggagatctcggccgccaagctccgcctcccgccccgggctgtgccccggggctcgcctgaggccgaccacccgcaccccacctctagcggctttgctcgaggcccaccttcttcccacccccggcaaactccagtaggctcgccctcgctgactccccgcccccgcgtcaactgcaaggggcccgcccatagccagttccggggcggttgctcacatcgaccggaactccccgccccctcccgcggcccctggggccgtaggaggccgcagcgaggaggtagagggggcgggggtcgcactagggtgtccctagagaacgaggactctgaaggcgggacatttgggcgacccccgggcggggccagccattaaacagtcccacttctgtgccagacactgaactgggctcttgacgggcatcatctcttaatcctcagaacatcccagggagctccacaggatccccatatcctgggccatgagtgagttgaaagactgccccttgcagttccacgacttcaagtctgtggatcacctgaaggtctgtccccgctacacggcagtgctggcacgctctgaggatgatggcatcggcatcgaggagctggacaccctgcagctggagctggagaccctgctgtcttctgccagccggcgcctgcgtgtgcttgaggccgaaacccagatcctcaccgactggcaggataagaaaggtgacagacgattcctgaagctgggtcgagaccatgaacttggagctccccccaaacatgggaagcccaagaagcagaaactggaagggaaggcaggacatgggccgggccctggcccaggacggcccaaatccaaaaaccttcagcccaagatccaggaatatgaattcactgatgaccctatcgacgtgccacggatccccaaaaatgatgcccccaacaggttctgggcttcagtggagccctactgtgctgacatcaccagcgaggaggtccgcacacttgaggagttactgaagcccccagaagatgaggctgagcattacaagatcccacccctggggaagcactactcccagcgctgggcccaggaggacctgctggaggagcagaaggatggggcccgggcagcggctgtggctgacaagaagaaaggcctcatggggccactgaccgaactggacactaaagatgtggatgccctgctgaagaagtctgaggcccagcatgaacagccggaagatggatgcccctttggtgccctgacgcagcgcctcctgcaggccctggtggaggaaaatattatttcccctatggaggattctcctattcctgacatgtctgggaaagaatcaggggctgacggggcaagcacctcccctcgcaatcagaacaagcccttcagtgtgccgcatactaagtccctggagagccgcatcaaggaggagctaattgcccagggccttttggagtctgaggaccgccccgcagaggactccgaggatgaggtccttgctgagcttcgcaaacggcaggctgagctgaaggcacttagtgcccacaaacgcaccaagaagcacgacctgctgaggctggcaaaggaggaggtgagccggcaggagctgaggcagcgggtgcgcatggctgacaacgaggtcatggacgcctttcgcaagatcatggctggcccggcagaagaagcggactcccaccaagaaagaaaaggaccaggcttggaagactctgaaggagcgtgagagcatcctgaagctgctggatgggtagccctcaaccctgcctcaggctgattatctggctaggggaggggaagggaggccacttccttctttgggcacaggaaacattggcctgggtgtcctcaatggnggagcctngagggcnggnctncctgggntttggctagctcnnaccnggacggagcctgtggtacgagctattccgtggccaagg

SEQ ID NO: 180849 - DNA, 1878 bp, Homo sapiens
  misc_feature (1794)..(1794): n is a, c, g, or t
  misc_feature (1802)..(1802): n is a, c, g, or t
  misc_feature (1809)..(1809): n is a, c, g, or t
  misc_feature (1812)..(1812): n is a, c, g, or t
  misc_feature (1815)..(1815): n is a, c, g, or t
  misc_feature (1822)..(1822): n is a, c, g, or t
  misc_feature (1835)..(1836): n is a, c, g, or t
  misc_feature (1840)..(1840): n is a, c, g, or t
gcagcgcggagatctcggccgccaagctccgcctcccgccccgggctgtgccccggggctcgcctgaggccgaccacccgcaccccacctctagcggctttgctcgaggcccaccttcttcccacccccggcaaactccagtaggctcgccctcgctgactccccgcccccgcgtcaactgcaaggggcccgcccatagccagttccggggcggttgctcacatcgaccggaactccccgccccctcccgcggcccctggggccgtaggaggccgcagcgaggaggtagagggggcgggggtcgcactagggtgtccctagagaacgaggactctgaaggcgggacatttgggcgacccccgggcggggccagccattaaacagtcccacttctgtgccagacactgaactgggctcttgacgggcatcatctcttaatcctcagaacatcccagggagctccacaggatccccatatcctgggccatgagtgagttgaaagactgccccttgcagttccacgacttcaagtctgtggatcacctgaaggtctgtccccgctacacggcagtgctggcacgctctgaggatgatggcatcggcatcgaggagctggacaccctgcagctggagctggagaccctgctgtcttctgccagccggcgcctgcgtgtgcttgaggccgaaacccagatcctcaccgactggcaggataagaaaggtgacagacgattcctgaagctgggtcgagaccatgaacttggagctccccccaaacatgggaagcccaagaagcagaaactggaagggaaggcaggacatgggccgggccctggcccaggacggcccaaatccaaaaaccttcagcccaagatccaggaatatgaattcactgatgaccctatcgacgtgccacggatccccaaaaatgatgcccccaacaggttctgggcttcagtggagccctactgtgctgacatcaccagcgaggaggtccgcacacttgaggagttactgaagcccccagaagatgaggctgagcattacaagatcccacccctggggaagcactactcccagcgctgggcccaggaggacatgtggatgccctgctgaagaagtctgaggcccagcatgaacagccggaagatggatgcccctttggtgccctgacgcagcgcctcctgcaggccctggtggaggaaaatattatttcccctatggaggattctcctattcctgacatgtctgggaaagaatcaggggctgacggggcaagcacctcccctcgcaatcagaacaagcccttcagtgtgccgcatactaagtccctggagagccgcatcaaggaggagctaattgcccagggccttttggagtctgaggaccgccccgcagaggactccgaggatgaggtccttgctgagcttcgcaaacggcaggctgagctgaaggcacttagtgcccacaaacgcaccaagaagcacgacctgctgaggctggcaaaggaggaggtgagccggcaggagctgaggcagcgggtgcgcatggctgacaacgaggtcatggacgcctttcgcaagatcatggctggcccggcagaagaagcggactcccaccaagaaagaaaaggaccaggcttggaagactctgaaggagcgtgagagcatcctgaagctgctggatgggtagccctcaaccctgcctcaggctgattatctggctaggggaggggaagggaggccacttccttctttgggcacaggaaacattggcctgggtgtcctcaatggnggagcctngagggcnggnctncctgggntttggctagctcnnaccnggacggagcctgtggtacgagctattccgtggccaagg

SEQ ID NO: 180850 - DNA, 1785 bp, Homo sapiens
  misc_feature (1701)..(1701): n is a, c, g, or t
  misc_feature (1709)..(1709): n is a, c, g, or t
  misc_feature (1716)..(1716): n is a, c, g, or t
  misc_feature (1719)..(1719): n is a, c, g, or t
  misc_feature (1722)..(1722): n is a, c, g, or t
  misc_feature (1729)..(1729): n is a, c, g, or t
  misc_feature (1742)..(1743): n is a, c, g, or t
  misc_feature (1747)..(1747): n is a, c, g, or t
gcagcgcggagatctcggccgccaagctccgcctcccgccccgggctgtgccccggggctcgcctgaggccgaccacccgcaccccacctctagcggctttgctcgaggcccaccttcttcccacccccggcaaactccagtaggctcgccctcgctgactccccgcccccgcgtcaactgcaaggggcccgcccatagccagttccggggcggttgctcacatcgaccggaactccccgccccctcccgcggcccctggggccgtaggaggccgcagcgaggaggtagagggggcgggggtcgcactagggtgtccctagagaacgaggactctgaaggcgggacatttgggcgacccccgggcggggccagccattaaacagtcccacttctgtgccagacactgaactgggctcttgacgggcatcatctcttaatcctcagaacatcccagggagctccacaggatccccatatcctgggccatgagtgagttgaaagactgccccttgcagttccacgacttcaagtctgtggatcacctgaaggtctgtccccgctacacggcagtgctggcacgctctgaggatgatggcatcggcatcgaggagctggacaccctgcagctggagctggagaccctgctgtcttctgccagccggcgcctgcgtgtgcttgaggccgaaacccagatcctcaccgactggcaggataagaaaggtgacagacgattcctgaagctgggtcgagaccatgaacttggagctccccccaaacatgggaagcccaagaagcagaaactggaagggaaggcaggacatgggccgggccctggcccaggacggcccaaatccaaaaaccttcagcccaagatccaggaatatgaattcactgatgaccctatcgacgtgccacggatccccaaaaatgatgcccccaacaggttctgggcttcagtggagccctactgtgctgacatcaccagcgaggaggtccgcacacttgaggagttactgaagcccccagaagatgaggctgagcattacaagatcccacccctggggaagcactactcccagcgctgggcccaggaggacctgctggaggagcagaaggatggggcccgggcagcggctgtggctgacaagaagaaaggcctcatggggccactgaccgaactggacactaaagatgtggatgccctgctgaagaagtctgaggcccagcatgaacagccggaagatggatgcccctttggtgccctgacgcagcgcctcctgcaggccctggtggaggaaaatattatttcccctatggaggattctcctattcctgacatgtctgggaaagaatcaggggctgacggggcaagcacctcccctcgcaatcagaacaagcccttcagctggcaaaggaggaggtgagccggcaggagctgaggcagcgggtgcgcatggctgacaacgaggtcatggacgcctttcgcaagatcatggctggcccggcagaagaagcggactcccaccaagaaagaaaaggaccaggcttggaagactctgaaggagcgtgagagcatcctgaagctgctggatgggtagccctcaaccctgcctcaggctgattatctggctaggggaggggaagggaggccacttccttctttgggcacaggaaacattggcctgggtgtcctcaatggnggagcctngagggcnggnctncctgggntttggctagctcnnaccnggacggagcctgtggtacgagctattccgtggccaagg

SEQ ID NO: 180851 - DNA, 654 bp, Homo sapiens
actcattcaattctcacaataaccttttgtagtaatgacatgttctgttattgcccactggtcagcaagaaaacggaagctcagtgagtatcccccttaaatatccagcagcagagactagagacccacgtgcctggagtccagattgagggatccatacaagaattttttctgatctactttagcaactccctgccgatctccatattcttccctaccaaacaggacacttaggaaacaaatgatcaaagtggaagttatgacacctattttacccctctttgcagtatcgattcattccgtctctttcctgtcctatcagaagaaaggatgtctctgaacatttactgtaaaatttccctacaaaattttaatataaaaacatgttctgaaaaatctcctaggacatgataattcttttaagtctaagaaggaactataagcaaaatatgtaagcttttaaaaaaaaaaaaaaggctgttagtctaccaaccagaacatttggcttccattcttcccaacatttttatacacaaatacatacacgtatgtgtataggcatctataaaaaattagaatggcaataaggtattatacctagcatattttctcccctaatatttatcatgagcatcatcactgattaaaaatcct

SEQ ID NO: 180852 - DNA, 511 bp, Homo sapiens
acgttgacacttcagtatatttcagagaggactagaggtatgtgaagttggggagagtaatagctgtagaaatatatacaggtagcaaaccagtcaactctgggccttgtatgtcatgcaaatatgtctggactatctggcagatgagagtgtactactaaatggtcttacatagtcaagtaacatatccacatttaaatttaagaaactatctttttgatggcagtgtgaatgtcaaagagtccaccaattcaacaaaataacaatcatatggtactatgctaaatgctgaagactgtactgtgaatcagacaatccttgctctcaataagctttggtcctacaaggggcaccattttaaaactgctgtaattatccaggtaagcgccactgaggcctaagtgaaggaagaataatgctgacaataatgactaccattcatcgagtacttggtgtctgtctgtcctaacccttttagccatattaactaaatcttcaaacaatcacgtat

SEQ ID NO: 180853 - DNA, 560 bp, Homo sapiens
  misc_feature (8)..(8): n is a, c, g, or t
  misc_feature (60)..(61): n is a, c, g, or t
actgtcgnggctgacgtagcagggagatgtaggcagtccaggcgtgtgtccatcactaanngaccaaagcagtcaaacgtgaggacacagagcatgggatgctgtggagtaggtaaaaatcaatgaatgagatgcacactcagccacatggctagatcgcagaaaggataatactgagtaaaaaatgtacaacaacgtctatagatattttatgtaaacttaaaataaatgcaacatggcaaaaccccacctctagaaaaagatacaaaaattatcggggcttgatggcacacgcctgtagtcccagctacttgggagggtgaggtgagaagatcacttgagcccaggagatcaaggctacagtgagctgagattgtaccactgtactccagcttgggcaacagagccagaccctatctcaaaacaacaacaacaacaaaacactatggcaaagaatctcatttttagtttaggtgcagtccaggcccagtaactgcaagtgagagacatgccatttgtagttttccttcctgcattggggtgaatacagctttccgttt

SEQ ID NO: 180854 - DNA, 474 bp, Homo sapiens
tcagattagatcatttctactaaattgtcttcaggctcattgatgcttctgccaacttaaactcctgttgccctatctagtgaattttccatactgctttttatagttttcatctagaattcctatttgttcctttcccatagtttccctttctctgttgagagttctcattctttgagtaattgtctttatattttcctttttcagtccttgctcatagttttgaatattctttgaagcatttatgtgacaaccacttaaaactcttagcaaaatccagtatttaggaacagtcaagagtcagcttccactgactgatttatctcaatatggtttatgattttctctttcttttcaggaattttaatggaaaaatgccggttgataatatattttttacgtctcacaaataatatataattctgcattctgttttatttttctaagattgttgaatttcctcttaatagcttg

SEQ ID NO: 180855 - DNA, 423 bp, Homo sapiens
ataagatgaccaactgtttggaataaagaatatggtaaaaatactaccaagatatttctcagaatagttgcattatttgcatctgtatatatttgcccaccttgaattcagatttaaattcctggttccctttttgatgtatcactttaaaaggtatataatatagtctaatgatctaggtcagtccactggtgtggaaaatgaatgggataagaatattaagaaaaggcatcttgaataatattagcaactaacctgtgttgaatccttcccttggctcagggctgggcctgtggtactttatatagcttagcacagtctgctggtggaggataatgtgataatgtatgaataatgataagtttagtgaagtgggtaagagcgaacactgagattcagtttaaatctaggctccaacattac

SEQ ID NO: 180856 - DNA, 434 bp, Homo sapiens
gtagggtttgttcttgttgctgtttattgtggttgctgtttgtttagtgactttcctcataattatgccaagtctgtattctacatcatgtgtggccactgaattctttgcgcagttaacttagtggttagctaatgattagacagatttccttaacctcttggaaccaacacatctactctttgctgagaggctctggatccatgcaaactttcaacacctagccaggcagtttctaactctgcctcagctttcacgttctgctcgcacagagcctcaaggtcagtccaaggggggttattattgccttctgaagtccttcctgggcacacacgcagccaacacacgcacatggccatctgcacaccaggaggatgtcagagcttatagaagccccctatggcctggcgcggtggctcatgcctgtaatccca

SEQ ID NO: 180857 - DNA, 306 bp, Homo sapiens
actggaggcagatgacaaacctgctccttccagttggttcctgtgagagcaaaagtctatcagtggggcatcagcaacattccttcagcttggcagcagcaattctttcaggatgtgacaagctgaatacagcttgtagtgtacagtttacacgtatcagcgtgaccctctcccgcccaccctcatttccctttcagagatctgctcctgcttcatgggcctcttccccaagcttctaagtttaatatttcagattgtttatttccttccctcagctctagagatgacagttgcttcacccagttg

SEQ ID NO: 180858 - DNA, 270 bp, Homo sapiens
gacgaacagccccacccagtaggttcatggcttctagaaatgcccagaagttaacattataatagtatgaatcagacactgcatccagagtttgtacatttcatatagtaactcttagggtcttagccttcgtatttttcaattgtacaaactagataattaatcagagatatgaattcaatttgcctgaagtcctcagtaatgcagaccatgggctaaatcttagctttgtgtttctttccctttgatactattctttttttttttttc

SEQ ID NO: 180859 - DNA, 952 bp, Homo sapiens
gttgcttgacatctcaaagatatcttctaccccttctgtcatctttctcctaggactctccattctcttactctggtctttgggtccacacagccctaggctctgagttaagcatcagaacacaacagaacacaaagaatgtaacagtccctaccagcaccatttagtcaggagaatgacacactgccttgttccttcatgcatgcaggctgctcacctttctttctttccttttttttttaagatggagtctggctctctcacccaggctggagtgcggtggcatgatctcagctcactgcaacctccacctccccgattcaagcgattctccctgcctcagcctcccgtgtagctgggattacaggtgcctgccaccacgccaggctaattttttttttttaagtagagacggggtttcaccatgttggacaggctggtctcgaactcctgacctcaggtgatcagcccgcctcagcctcccaaagtgctggggttacaggcatgagccactgctcccggcctgctgctcacctttcttatagtttaggcagaatgcagatcacagcttaataaagaggacttaattctgctggcggcatcaagcacactgttggtacctcagatatgtttattgtttttattgctctttgtattaatgtgattgtgtttattactactagtcctgtaagaacaacgtatctgaattttctccccactccattttgcctggagggtatttcttgcctaattccctcctcccctttcaattagtttctctatcttaacccaccccaacccattccagcatctctagccatttcaaaacagttaggtggagtctggatcttgtaaggtgctttttgctactgtccgttctgttgatggtgatttacctctagcaccttgctttcttggaaatgttatgggcctccaccaagaaggaagcatt

SEQ ID NO: 180860 - DNA, 499 bp, Homo sapiens
gccctgttcctactaacttaaaagtgcactagctgagcctaggacattttcaacctgtttttaagattttcatgcaaatcttctgtaaactgcatttctggtgctaaactgatgcttaaatgtatcttgtagttttgtgtgttggcacagcagtcattaagcttgtctttggaaagaactgttttccacctctaaagaagacagcaaaaaagttccactgttaaataagatattctgtgtttatggcacggaattccttccacaattctgtgcttgccctctccctgctctgggaatccttcccaggatgtcctgttgggctccatccacccactgcccaattcaggaaaaagtaacccttacattctcagcacaaacctgactgttctctgctcttatcaagttcaaaggcaaaatgagcaccttccccccatcctcccctcaccatggacagaagaattattccatttcctcaggtcgctacttctaaactggaatt

SEQ ID NO: 180861 - DNA, 250 bp, Homo sapiens
ggcaaatgtttaaattatttaaaagttttaggtcttctgtctaggagccagggcttggagtcagacaccttagaagtgtacctgatgctctctctgttctactgtggtgaactggcatggaaaccactgtggtgactgagcatcccatatgcttgaaattctaagcaacatccaatgcataagtgatagtttgtcaggattttgtaagaattcccactacggtcaaatcacctattgtaccatattttgg

SEQ ID NO: 180862 - DNA, 616 bp, Homo sapiens
acagagctcagcaaaaaacaaaaacaaaaacaaaaaacagaaacaaacaaaaacttagcttatgactttggaggtaggaaaagctgaaagctccctacattcctgaaattaaatgaaagatttcactcttgtgtttaacctggccttcagatcctagattagcaaagaatttgatgtaccttctacaaacctgattttgttcattatgactccacaccttgcttgctttccttcactactctaggaatgtggaaaagtttagctggatgtagtcctggcctaccagcaagctctcccagagagcatgggacagaaaagctcagagaccaaaaccaggtgttaaaatcacacgattcactcaacttgaaaacatagtgagaagcaaggggaaaaagatggtgtattagtctattttcatgctgctgataaagacatacccaaggctgggcaatttacaaaagaaagaggtttaattggactcacagttccacatggctggggaggcctcacaatcatggcagaaggtaaaaagcacgtctcacatggcagcagacaagagaagagagcttgtgcagggaaactcccttttttaaaaccatcagatctcgtgagactt

SEQ ID NO: 180863 - DNA, 295 bp, Homo sapiens
cactaggcaacaactagatatctgggctatcaggaaaactgtcccaggaaggcctctgccctgatggaaggacagctagaaacacagttgtaacagctaccttttattgagcagttactatctgggaggcattgttagaaatacaaatatcgatttatttaaaactcgccgcccttttttttttttttttttttttgaaacagagtctcactctgtcacctaggctggagtgcagtggcacaatctgggctcattgcaacctcagcctcccaggctcaggagatcctcctgtctc

SEQ ID NO: 180864 - DNA, 239 bp, Homo sapiens
cttagaggaccccggttgtagttgtctattgttaggttaattcccagatcctagagacatgattgtttttgctattgtgaatgacatcttgtatcatcatctcttctagttaattattttgaatacagaggaattctactgatttttgtaagatgatcccttaactgaaaatactcagttatcttattaacaaaatttttatctattgcatctatacatttttatgtgtaggtgcaata

SEQ ID NO: 180865 - DNA, 531 bp, Homo sapiens
agggagcttcatttctcctctatgtggaccataatgtatttccactgtctcctttggtaagttaacagagtttcctttggtcaaggagttctaagtccaaattctccatgacttccctgaggcccagacatttgacccaagggagccaagaggaggcagaaaggaaaaccctggtgcctcaaccttcccactgcagcctgacacccctccccaccatgagccttgaggattgaagcaggctaggtcaccgagtgaatgcaggggcattgcgggggaaggacaggggtcctggaagccacggtgagggtctgtcacatccagaacgagctccctttccttctgtttcatttgaaggactgtgctttgctccctgtgcctgccccacccccctgtggttctagagaggctgtcaatcccaggcatggtagtacatctccctagacaccattattggttcaggaataggcaaatgaccaagctgaactaagcaaggtcttccttgggacttctgttggagacaactgggaaagt

SEQ ID NO: 180866 - DNA, 648 bp, Homo sapiens
  misc_feature (501)..(501): n is a, c, g, or t
gcatgtgtgactggggaggggaagtcttcctgggggacgggagtgttactgaggagtgagtccagggggtttgttgggaatactctgtacattccagcaatttggctgtgaacctaaaactgccctaaaaaaaaaagtctgtttaaaaatttgaacagttaaggccggtgtggtggttcacacctgtaatcacagcactttggggggccaaggcaggtggattacctgaggtcaggagttcgagaccagcctggccaacatggcgaaaccccatctctactaaaaatacaaaaattagccagacatggtggctcacacctgtaatcccagcacttttgggaggctatggcaggcaaatcacttgagatcaagagttggagactagcccggccaacatgctgaaaccctatgtttaccaaaaaatacaaaaattagccaggtatggtggctcatgcctgtagtcccagctacttgggaggctgaggtgggaggatcgcttanactcgggaggtggaggttgtggtgagccgagatcatgccattacactccatcctgtgcaacaagagcaaactctgtctctaaaaatatgtatatataacgtttagtaaccacaaaatatttgtctgaagtactcattccaatatgta

SEQ ID NO: 180867 - DNA, 205 bp, Homo sapiens
tttatataagctgtaaccctatatacaggtgtgaggagttagtataaacatattacagtccacaggaaaatcgaatttgtgtaattcaggctagactaaagcttagctttatgcaaagaaataaacagcatagttttgatttaaggggcttggtttttcagcctgagagaatgactggattctaagaacttgagggtgctgatgg

SEQ ID NO: 180868 - DNA, 647 bp, Homo sapiens
actgggactttgtcacaccaggttaacactgaaataataaggtaggtgttatgaagtggaaaaaagctattattacaagggtagggattaaagaagtacaggtatcaaatttttccttttaggaatatgttaattaaaaatcactgtttccatttttctgaatgtggaagtaatgctactgcatgaaacgattatctaaatggcgtctaatttgtttaaaaaggttagtgctattaacacttgatgaaatagtggctgtcatttcctgaatgcctcctctgtgccaggcacttccttgaccacttttccttcactgcttatagggaggtattctgatgaggaagtggtgacaaagctaagtggtttgctagtggtagaaccaggttagaattcaggcctgtttgattttgaaggctgtgcagtttttcctttatccccgattgagtcatcttatttcacattttgtattggaatggagacgagagtctattttctaccatgttctgcacattttagggctagcacctaactttctgttgagttttttaaaactttaaagctagaaatcaggccgtcactctgacctatcggggcttctgctatgtgcaaaatcatttctgttttcatgtttcacttaatgagcattt

SEQ ID NO: 180869 - DNA, 180 bp, Homo sapiens
tgctgggattacaggtgtgagccaccatacccggcctgtcttacttacatttcttaaggcttatttgtcacacttaaatagtacctcattttacacatatttaattgagcactgtttatctttcagtgccttcatgtgttgacagcagggactgtgctggagaatacagttgaattttat

SEQ ID NO: 180870 - DNA, 314 bp, Homo sapiens
attgtaactgtcagaattagtcctaattgcagatgcgaaagctgccattataataaaaacagaggcagtgcaggcattaaatgtagcagcctaatttgtgagactacagaaaaggtagagtaaatgaatatttcattactttaattaccagggactactcttttcttgctgtcttatgataagtgttgctgtaactagcaacagcaaacatccactaaaacataaagtgcaataatcgtcctgctgtcaggatcaccactttaaaatacgagcagggaaaaaatataatggtttatctatttcttagagattgc

SEQ ID NO: 180871 - DNA, 459 bp, Homo sapiens
gatcctcacagtaacccagcgaggtggacattatcatcatccccattttaccagtttggaatctgaatcccaaagcgattgagtgacgtgtcggaggtatcccagcaagtctggatgtagctctgggaattcagatgctgactcaccacgccccataactttaatgctggagggtgtgatgggaacatattcctaggtgtccagagaggcagaataggaaccgtgagggtgagcaagtcagacaggtgggaggtgggctgagtcagggcggggaggctggtgtggccgcagcgacatctggtggccagcgctcttaacagccaccaggttcctggcctccaggtgctacttcaactcctggcttgcacctctggcagcggagcccttcccctgtggcctcccagaggctccagccaggcgagcactgtgtgcccacatctggctgccctgtagggggac

SEQ ID NO: 180872 - DNA, 269 bp, Homo sapiens
cctccaggcttatcctgggtcattctcttcctcattcttgagctcgtgccacactgaccttccaattctctgaatatgtcatgccccttctcacctaaggacctttgtacacagtgctcctaatgaccaggaggctcttcctttttcctctttgcccctctgactcctacttatctttcctaagtcaatataaacagcagggtttgtaggaaagaggctgccctctctcccccattgcagtttaaggtcctttgctttacagcctccta

SEQ ID NO: 180873 - DNA, 266 bp, Homo sapiens
ctttaccgtttccaactcttgccctccctgctcttggatgcctccgctggcccaaattcctgggagttggctcacgccagcatgcaacctgcttgttgctgggacctgcgagagtctttcccttctctgccacagagactgtaactacataaagggaaaaagggggacttaagactgggaggctattatgaacctccactgggaaaatgaggagtacaggaattcccagaaggcagctgctcatgtgggaaaagtgtaaagttgaa

SEQ ID NO: 180874 - DNA, 389 bp, Homo sapiens
ggctgaaattttggctgggtgtcagtatacttggacaattcataacatttatagctacatgatttttcttatttcaaattcaagtctactatttctgaatctctaggagtgatgatatctctagcccttgagcacaatgtagccacagggtatacaaagcaaatcaaaagcaagcactggaaaaagttaaacctagaaggaaatataagtccaataattccactgtgccagaaaacagaattgtcattgggaaatttattaaagtgaactacatgaaactgctgatatacaactgtttttgacctgcaaaaacagaaatttcatatggctcaacctaatgttattttctgttattttctctctctttttttttttttgtgtgtgtgtgt

SEQ ID NO: 180875 - DNA, 376 bp, Homo sapiens
agactgctatagaatattccatgagttccacagttttatgtaaggggaggatagtattttcagttttgttcatgataactttacgaacaatagtcagcattttgtgaatcttttggacagcagtggttctttacgtcgtaacttttgggaatagttacacagcattttccaaagtgtgttctctgaagtgctagtttatgggactcattgagacccataaaaaggattataatttaggaaacactgagttaaacatttgttcaatactccatactctctaatagtctatacacctgaaatacagtaggtagtgtttcttgaacttatttctccatagcctccttttctgggaatcaccctgtaggactagtgttct

SEQ ID NO: 180876 - DNA, 215 bp, Homo sapiens
ccatggtcttgagtcttggcacccacaaattttttttttgtgagacacagtctagctctgctccccaggatggagtgcagtggcatgatcatagctcattgcagcctctaattcctgggctcaagcaatcttctttcctcagccccctgaggagctgggactaggcacatgccaccatgctcaactaatttttgaaatgtttgtagaaacagggt

SEQ ID NO: 180877 - DNA, 519 bp, Homo sapiens
ttgccctcaatgcctctactatggtagctcactcaggcctgccttcgtccaccaatccatccttaaacacctcttcaaagtagactgcagataggcagcaggtattccactttgtagattcaaaaaatgaaatggagaaagaaatgacaccctctatatcctactataaaattgtgaaaaagctaagaatgaaaacctgatatccttaacttctagtcctttagttgagatgctaccaaagagcaaaacaaatacttttcactattaaatctttttttcctttaaatcacaagagttcataaaaatcatgcctggttaggtaagattacaaggtataaaaaaatgaattggctgtgcgcggtggctcatgcctgtaatctcagcactttggaaggccgaggtgggcggatcacaaggtcaagagatcgagaccatcctggctaacatggtgaaaccctgtctctactaaaaatacaaaaaattagccgggcgtggtggcaggcgcctgtagtccgagct

SEQ ID NO: 180878 - DNA, 275 bp, Homo sapiens
tctgtgacacacgcacactttcagctggagtatcctctctatagcccctctgaacggtctgtgacacacgcatgctttcagctagagtttgctctctctggttttcggtctgtgacacacgcacgctttcagctagagtatcctctctatagcccctctgaacggtctgtgacacacgcatgctttcagctagagtttgctctctctggttttcagtctgtgacacatgcatgctttcagctagagtattctctctatagcccttctgaatggtc

SEQ ID NO: 180879 - DNA, 221 bp, Homo sapiens
aacagataaatttaaagtattgggtttctctggaagttctgcaaattagtttagttcattccacagtttgatgcagattgacccttggtgaaacttcacagtaaaatacacggaatcttaaatataattttaaggaacaaaaacacaaatctctttaatgaatttatattctgctgtcaacaaaggctttcaaggaggcaataaatgttctctgcaatccc

SEQ ID NO: 180880 - DNA, 747 bp, Homo sapiens
aaccatgagaagtatgacaacagcctcaagatcatcagcaatgccttctgcaccaccaactgcttagcgcccctggccaatgtcatccatgacaactttggtatcgtggaaggactcatgactacagtccatgccatcactgccacccagaagactgtggatggccccgcgggcatcaactgccgacagtgcactagcgcgttcgcggcgcattgtgccaaattcctctgtgccactcggctctcctggcttggaggaatcggggaaagcttgtggatcaaggtcaatatcccgatcatcatcttccaggtagcgtagatctctccttcacagctgtgtggagctgatgctggtgtctgagtaggtcctgaagtgcccgtggtagtacttaccaccctgccatgagtataaggcatgtgcgctcaattgtgcgatggggggagccgatcagaggggtgcactcactctcatggcccctactctgggctgtaacgccgcacgacttgtacggtgagtggtggtcgttgtgaccctatcgaagaaaggtgattgaacacaacatgcctttcaacgatcaggtcagcttggtgggccttgccctgttagccactcaaactgactctaattagctccatgggctcatttgtccatggctattggaccaactgtaagtgtagtcgtagcaagcggaactgcggtggagtgtgcagcttcatggccccaaaatggccttccaaggaaataaga

SEQ ID NO: 180881 - DNA, 526 bp, Homo sapiens
gtttttttcagtagtgtgtgatcttgacagggaggaggaggaagatgacacagaacacagtattgggagcgtcttccaagaacaccattgctcatagggaatgcaaaccagggaagccacagcatcaccttcactgccctgctaaatctcattcttacctcggcaccctctggagactgatattttggtgctggctctcaggttttctgcctgccttgcttaaggtgggaagagtctttggaaagactcaacaactcaaaggaatcaaaggaagctacacccgtcactccaaagatggaaggaggacctcactatttgaggtagacagctaggatctgcccactgaggacagactcctggtacccttggatctggtcattgcaaagtggagtatttaatgattcaccacaggagcttctcatgctcaggcagctttgaggcaaaagactctaaaaatccccaagtaagggtaatatctcagaaacacaaagcactgcgttgcatatggtttatcacatgcagtatt

SEQ ID NO: 180882 - DNA, 418 bp, Homo sapiens
cttgttatgaagttcatcacagtagtatccatcagcatatacactcttcttttaaaaaaaatatttatttgttttgagacagggtctcactctgttgcccaggttggagtgcagtggcgtgatcttggctcactgcaacctctgcctcccaggctcaagtgatcctcccacctcaacctcttgagaagctgggaccaaaggcatgcaccaccatgcctaactaattttttgtattttttataaagatggagtttcactgtgttgcccaggctggtctcaaactcctggactcaagcaatctcacctcagtctcccaaagtgctgggattataggcgtgagccactgtgccccaaaagaaaaaaaaatttcaaatttcataccttaaaaattatctcctttatgagataacacctgtgg

SEQ ID NO: 180883 - DNA, 748 bp, Homo sapiens
cctgggcaacaggagtgaaactctgtctcaaaaacaaacaaacaaacaaacaaaaaactaaccaaccacaaaccactccattgccaggtgcaatggctcatgcctgtaatcccagcactttgggaagccaaagtaggagtttcacttgaggccagaagttcaagaccagaccaacctgtgcaacatagagagacctcctctaaaaattagctagcagggtggcatgcatgtatagtcccagctacttgggggtgctgaggcaagaagatcacttgaggccaggaggttggggctacagtgagccgtgattgcatcactgcactccagcctgggtgacagagtaagaccctgtcttaaacaaacaaaaaattaaaaaagaaaccctccgtcagtatcaaaagaaaagaatggccacaaacatactctctaaaaactacttgccaatctcgtgaaactaggacgcaaataccctctaaactcaggtttgatgtatgcttgaagaacaagagagaaagttcaaaaagagctctagttgcaattattaaaatggacagatgagaactatacatgtgagtaagtcagtggcctattccatgctgtagaatcactggagagcaggagtaaagcaaagggacactttttttttttttttttttgggaaaaagggtctccctctctttttcccagcttggagggggggacccgagcctcaaattcggaaactcggggccaatagggtgtcccgggg

SEQ ID NO: 180884 - DNA, 688 bp, Homo sapiens
attgtggaagctttgttcttttgctctttgcaataaatcttgctactgctcattctttgggtccacactgcctttatgagctgtaacactcaccgtgaacgtctgcagcttcactcctgaagccatcgagaccacgaacccactgggaggaaaaaacaactccagacacaccgccttaagaactgtaacactcaccacgaaggtctgcagcttcactcctgagccagcgagaccacaatcccaccagaaggaagaaagtccaaacacatccgaacatcagaaggaacaaactccagacacgctgcctttaagaactgtaacactcaccgcgagggtcagcggcttcattcttgaagtcagtgagaccaagaacccaccaattccggacgcagtaggatgatggttatcagagggtaggaaggggtagcagtggtgggaggtagagatggttaatgagtataaaaatatagttatatacaatgaataagatttagtatttgatactagatctagtttttgctactacaacaatgtgattatgaaggaagagagagaccttctcatgttgttttatactcagtacctgttttaagaagaaacaacaaagaagtaaagccaaagacaggcagcctggcgccggcctgaaaccaggcctgggcctgcctggcctaaatccagtagttaaaaa

SEQ ID NO: 180885 - DNA, 215 bp, Homo sapiens
tccagaaagggcaacagaagaagacacagtctcaaacaaagaaacaaacaaaacctttatcttaatttttatgtttctatattcatttttctcttttgaccacaagtatcttgataataactctacttctgatggtaactgattatttatcaattatccaatccaaatgcctttaataaatcttctctatccctttccttctccttttctggttt

SEQ ID NO: 180886 - DNA, 387 bp, Homo sapiens
tgggcagaaggatcacttgagtccagaagttcaagttcacagcgagccaggtagggcacatgccactgccctacagcctggccgacagcaagaccctatctcaaaacaaaacacaaacaaaacaaacaacaaaagaaaacagatcaaatggaaatcttaggactgaaaaatacaataatcttactgaaatggctcaagagaagaatgaagatggtgagggaagaatgaatgaatttgaaaatataacaacagaaattatccaatctgaacaggaacctgtgggactactaaaaaaaaaaggtcagctgggctcagtggctcacgcctgtaatcccagcacttcgagaggccaaggtgggtgggtcacaaggtcaagagatcgagacc

SEQ ID NO: 180887 - DNA, 466 bp, Homo sapiens
tttagcttccaagatcccaaatagacattaccaagaaaatcttggagcccaagaaaatatctgtaatctccaaaaatacattttactgataataggctctgagttcttattactcgaacacggcataaataaaacccgtgtaggtttcaatttcatcatctctgtccccaacactcaaattttttccatcctagaaatccacttgatccttaaccctacctagagtacctcctctgacgtgaagcagttgccagttttcttacctcaaagaagatactatgactcccaagttataactctcagtgtacagctcctggaacacttctggtattctccttcgacctatacacttaacctgccttcccaatgaagatcagttacttgaaggccttcttagcacagtaccttacagttttcaattgtaacttaaggccaggcacagtggctcatgcctgtaatcccagca

SEQ ID NO: 180888 - DNA, 552 bp, Homo sapiens
gaggagaagaatttcaggaagcatgaggtagctcaatggcaccaaatgctactcagatcaaggaggatgaaaccagggaaaggttatgactttgataaataggaggtcctaggtcaccctagagaggggattctcagagggtaatagggctaaggttgtgacaaagctaaaactccaaatgagggcactattggagagaattgaccactgtaggaaataaaatggtagaaagctggagggactagcaagagaagagacagagtctgcagagttgtaggaaaagatgacctaggagagggggagatgaatgatgcaggaaaagaataggaagagcagaatcaagggggaaggagacaatggagctaagatacaggtaaacttggtgccggggttgggggcagggggggctctgggaaagaaaggagtcattctccaaggatgctacaaatcacaagacagtcccaaatgatctcatttctaaaaacatcacaaagctatgctggagagttgttgaagagaaagtctttaaaactatttccatggacattcatt

SEQ ID NO: 180889 - DNA, 181 bp, Homo sapiens
acgaaacactagagaccagtaacagcaaaatggcaaaaccagaagtcatgagtaactgataaatggttgtcccgtacattactgtagattcccatagttggaagcttcccagttgataaggagggcttcccagttggaagtggagaaaggcactacagacttgaagtgggaggacaaaggt

SEQ ID NO: 180890 - DNA, 414 bp, Homo sapiens
aagaatcaagagagtcaccggttaacctctgataaatttccttgtgcgttacgaatttagtattccccctcttcctgaagctaaacatccccactatgtgataggatatttactgttttgtacttatcactaattctcgtttctacatctcctcacccgtttttacgggtgtatttgtcctcaaattataatcaggcatgaccttagagatctagagctcgttataaagctaacattacgttcagttctcgtgctaaactagctttttctcactgttgatcccagggccaccaacatcagaatcgcttgaaattactacctcccatttcggtatctggaggtggggtctgctcatctattttaacatagtgagtctatgcatattgcagttttgcagcagcgtgcgtagaagca

SEQ ID NO: 180891 - DNA, 579 bp, Homo sapiens
gtgcatgccaccacacccagctaatttttttattttttctttagtagagacagggttttaccatcttggccaggctggtctcgaactcatggcctcaagtgatccacctgccttggcctcctaaagtgctgggattacaggaatgagccactgcacccaaccattgttgctgtttctgaatagctgttattgaaatgtggggggaggaggtccaaatggattctcaaagtgaagtatatgttacctgtggatttaatttagctgtgcattcccagtcctttactgtcatggataatagacatgaattgtgtatatatatattttgccatggatagtatttttcttttcggagaaggaggggtttgatttgggcaaagtgtttatgggaaagagacagctggtgaagtgtgagtgtgtggaaatacatgagaaacgcctgatctctccatgtcatctgcgttggtagagccctgtgcttgccaggtgttgtggtgacaggtgcaaaacaagggtgcccaatttagaggtaaatgctaaaaggccagtgtcatttgcgggtgaattatttaattacagaca

SEQ ID NO: 180892 - DNA, 475 bp, Homo sapiens
cccacgcttataatcccagcactttgggaggatgaggcaggcagattgcttaaggccaggagttcaagactagcctgggcaacatggcaaaaccccatctctacaaaaaatgcataaaaattagccagcatggtggtgtgcacctggtcttgaagatccactgagcaatcaagataccctcctgggacgtcaggcctcagatctgcagcagcttttctacatcaggttggaggagaatatttgaagttcttatcttcctccaaacgtaagaccacaggcccacaaatggaaggctgaacagacagctgtgtccccttgctgtctaggccgcctcagacaccacagatctcccggtatcactttatccatcaggccttggcagggaggccacaagtgggctgtcttgttccggcctgtggctgccagccttacagaccagtggagcaggagagatgggcctcagaggaagagcggt

SEQ ID NO: 180893 - DNA, 229 bp, Homo sapiens
gaaaattaagatgcggcatggtctaatttaaaaagattaggtttggcagtaagccttactgatgaaacaatttttaaaaataaaaatcttatttcactgatgtggagcctaacctgttttttttttggttgtttgtttgtttttttagatgaaatctcactccgttgcccaggctggagtgccgtggcacaatctcggctcactgcaacctccacctgccgggttcaag

SEQ ID NO: 180894 - DNA, 306 bp, Homo sapiens
cagaagtgctgccgctggttgtcgggcatcgggctgctgttgcatgccccttcaggaggccttcacattggaaacgtgagcatgagtgacctactgagggccagaggcctctgggcattctgggatgagaaggaagctgcacttgacatctaagtcctcttccatcccacagtttaaaatggcatacagttatgggatatttcctatggatatgaaatctgatttcatatgcacatgtgtatgagagagaacaatgtaatgaacctttggtgtacactccaacatggtatattttatttcattgta

SEQ ID NO: 180895 - DNA, 329 bp, Homo sapiens
aactaccacccagataacgctgctcacataaaaaggtaggtagcacatgtgtagaaaattcaaatagtgaagaaagctataatgtgaaacaaaaaaacaaaagcttttccccgtctccttattattatcaatttctgttaaagtttgtcccagtgcttctgcatgtgtttgcggttgtatctgcttttacaaaatgtaaacaatgttcaatagcttgcctttttaatacattgcttgaaggtctctccgatatcaaaaatattactattttattattttcagccattctagaatattttacatactggaatctcattaaacccccatcg

SEQ ID NO: 180896 - DNA, 546 bp, Homo sapiens
tgcggtggctcatgcctgtaatcccagcactttgggaggctgaggcaggcggctcacgaggtcaggcgattgagaccatcctggccaacacggtgaaaccctgtctctatgaaaaatacaaaaaattagccgagtgtggtggcgtgtgcctgtagtcccagctactcaggaggctgaggcaggagaatcgcttgaacccaggaggtggggcttgcagtgagccgagatcatgccactacactccagcctgggcgacagtgggaggctccgtctaaaaacaaaaaaataaaagatagctgggcatctgtggtcctatctactcaggaagctgaagtgggatgactgcttaagcccagaagttcaaggctacagtgagctatgatcatcccactgcactaaaaaatagtaataaataaggtcggggtagtggctcacacatgtaatcccaatactttgggaggctgacgtgagaggatcactagagtccaggagtctgagaccagcctaggcaacatagcaagaccctgcctctacaaaaataaaatt

SEQ ID NO: 180897 - DNA, 381 bp, Homo sapiens
ctcccaggttcaagcgattctcctgcctcagcttcacgagtagctgggactgtaggcaagcaccaccacgcccagctaatttttgtatttttagtagaaatgggatttcaccatgttgatcaggatggtcacgatctcttgaccttgtgatccgcccgcctcagccttccaaagtgctgggattacaggcgtgagccaccgcacccggccaaggtccactttttctctgctgtttgaaatctttagatggattccttttgccattagtatgaaatccaaaatccttaccatgataaaaagctttgcaagctctggatcctccccactagatgtttttttctccaattctcttcctcttcttcatgatccagcacaccacgc

SEQ ID NO: 180898 - DNA, 388 bp, Homo sapiens
gaacggacgctgctttgtccaggtttttcagagccctagaggcctggaggggagccagtgaagaaatgagaactctgctctctacagctcgcctgtttttcccccattaattcaactgtcctcctccttccttgtttcaaataacatttcggtaatacagacagatgcctacctgcagggtacggccataatgcaaccttgagggggaaatgttagggtttaaagaaacccagagcaggaaggagccccttacccccacaggatgtagagagacttcctgtcgcctccctctgcaagccatcgccagctttggagtacccggagaaggagcacctggtggaggttacagctcaggcaaaggtttggaggatggatgtcagacgtggtg

SEQ ID NO: 180899 - DNA, 223 bp, Homo sapiens
actctttcaccacgaaacaccaactattaatacttagtctctataagcctcctaggatcctgttgtgttcatttacctaggtgatgtacatcatcctaaattctgccttttcattttgtattacgatgtatatgtacagtacatatttttacattgtcattgtgtcattcttaatggtcacagctgcctgaactaaacctaaagtcagacagtcaggacagtc

SEQ ID NO: 180900 - DNA, 467 bp, Homo sapiens
atgtctaaatattctcttaagacagattctcaccagcagagcaacatttttaagacttgggatacttactgctaaattacttttcagacaagttgggcaaatttgcacttttgccagcgtgtggctaggaggttgtcatacctccacgctcactacaatcttcctattttcacaaatgagtcaatgaacgggctggatttgttgtaactgtctctcaagtgatgctttctattggattcccacaatatgactactgctaacttttaaggactaagttaccattttaaatggaaagatttcatcttgaatgtgaagctggatatctataaataaaaaattgcagttggttatttggtgtttctcgtattgctagtataagttccttaaatattatatagatattatttttatgatttagcatttatcccatgataaaactggaatcatgtatgcctcatacggattga

SEQ ID NO: 180901 - DNA, 357 bp, Homo sapiens
ggctccttgtctcctgcccagaccaaggagagacttcttccaattctacatctgcccaagtaccattaatgtttattagcattaagttctgtagtgaggaggatgagagatgcttgctaggctgagtgcattctttggagatttccacccagagccctcgctgtctgcctcagtttctccacctttgtcagtgattgagcatgtatccagatgccagagtgtgggccctggtagggcctggctgggtttgccactggtgaagctgcagcaagcacctcctaaaggacttggcaccaaagtccagctcctgcctcttttgacctcatcgccaaaggtcttcccaccaggccaggatta

SEQ ID NO: 180902 - DNA, 184 bp, Homo sapiens
gggattgcctgccaaagcgtactacccaacttcacttccttttgggtatggaccacgtgaaactgagtgggctttaaaggcctggccattttgactgaacatgggacaactccatttcagttccgaagcttcctctttgagggacccaaggtcacctgaggatattgggtactacgctttggca

SEQ ID NO: 180903 - DNA, 660 bp, Homo sapiens
gaccataggaatcttgattctctagtttggttgattccacatttttgtgcctcagttttctcatctaaaaaatggggacgactgcaacagtaactatgataaacactgtgtaggtccttacacttacatcatttgatcctcagttgctaaatgatataaatagtatcatacctacctcatggcatcataagtgtgaatgcatgtataacacttagcaaagagctaagtgaccacacagttcattaaatgttcattatgaccatcgtctacacacatgtaactaacacaggctcaactgcttgctcaactaaaaagattgcagtggctactccggcagcgggtgctgcttcactgccgctcatcatggcactgagcagatgtcctggagccagggagaaaggcacaggcgggctgctgccttcatcccgggtctcccccacccgcttgagtgtgattcaggtgttttaaagatgtgtttggtacaacgtggtttcttaacacaaaccagctaattttgtacttaactggggaacagcattgagcaggcagccatctgcgcacttgcagcccgtggtatctcacctctaaacgccgcgtgactgctgtgtcggggttctcagtgagaactccagcaaaagattctgtagtgaggaaagggcc

SEQ ID NO: 180904 - DNA, 114 bp, Homo sapiens
tcacaaaaaaaaacaaatgcaacaacacgcagaatcccaattagaaattatagactatcccaccttttctactgtgatataatttcagttagcatcttatacacagcttgaaat

SEQ ID NO: 180905 - DNA, 243 bp, Homo sapiens
gtaactggagaaaatctttcaaagtaaacccagtgtcggagctaccccagtgtaggttatcagtcctggagaacagattttggcaaatctagataaagagtggctgcttggcctaagcaagttttttaagggactagtaaaaagtcatttcctatagaagctccgtgtgcactccagcacaaccccgggattgctttatttgttttgagcttcttccccatccttcctttttttttttccccc

SEQ ID NO: 180906 - DNA, 270 bp, Homo sapiens
ggatgatcgagcaaggcttgggactcggcggaagggagcttgtgatgcaggctagaaaagaggagtctcttcccctcattatcccaagcaagtcttcccagggaaaatttgaaatagctgagacttgtgtgtgtcatccttcccggatcctttccctgctccacgttgttctcatgcttgccaagggccctgaaaatacagtgtggtgagaaatgctgctctgtgcccaaatgtagctgacttccctcctcttctccctcttcccaaagt

SEQ ID NO: 180907 - DNA, 376 bp, Homo sapiens
cattgcacaggcttatgtgaaatatgcaaaagctttgaaaaataagtgcctagaataatcccccataaaacttttagatagattattatgaccctattcttctggtacaaacataaatgtgtttctgataaatgtattttattatgttttgcttcatatgaacaccctattataaattcaggatggttaaaagcaaactttaagacctctctcttcctctggcagtcaggacaaggttttttaaaccaaaaacatatgtttaaatttagctccacatgtgccagctagctattgactgaacactgacatgtgtttgagctctagggatctcaaatctctctctgcttctctcctcagttctcttacaccacacatc

SEQ ID NO: 180908 - DNA, 244 bp, Homo sapiens
tctgctagcctgacacgtttcttctttgctgatctttttaaacagtttatgtcccacaatatttatccttctccctcacacaccattcatttccattactcactctctgatttggctatacccatcatttctgaaatagagaatgcctgaacttctttgaaaatccacatgtcaaaatgtaataaaaatgttttcattgttacattgttttaagagaaatgaatggcttgctcaaccatcagtt

SEQ ID NO: 180909 - DNA, 270 bp, Homo sapiens
agtgccgttgacagagacccaaggagacaagaaaggtgtgtgtctaagtggattccaccaaacagtggtgcctgagcatcttcttgccttgacttttagcagtcctgagaagtccgcccattttctcagcacctgatggcggaactccaccagaaaagctccaagtacaggccatggactgacaagctttttagttcttcgaatggtcatttattttcagttagattggcacacatcacgttagtagtgtctagagatgtactggataag

SEQ ID NO: 180910 - DNA, 177 bp, Homo sapiens
taattctgtcaacaccaaagtattgttacagactacaattacaacagaaatttagagaacaggacagtgtgagataaaggtatattccatgtgtgagttaaaaatcttctctgtaggcctcacagcacatcatatcactcatcaaaacgctggaccctttcccatgactcaaagtgg

SEQ ID NO: 180911 - DNA, 243 bp, Homo sapiens
cacacgcacacacagacggacatccccagtgacacatcccctcccagtcctagcactcaggacttagaagaaatgagcaatgagtggtgggaacagaggctgacacataggccctggaaatggacagaactggatttgatgcctaggttcaccaatcgcttgctgtgtaagcctgggtaaattgctctacctctctgattctgtttactcacttataaagtggagaggggaatagtaccttca

SEQ ID NO: 180912 - DNA, 411 bp, Homo sapiens
gatagctcatcttttaagtcccttccctaaaagcctgtgtggtaatgggtgtggagtctgagtctttgtttctagacagggactagcaccaatgctggagttaattctcaccttctgtacgaattcattttagagacattgatgtgtcctgagcaatggctactatttagttttaagtctagatttgtgagacatttccatttaattttcattaaacagtttttcaaaaattatgactatatgccaagttggtgtcattatgtctcttaacttatagctatagttattttaatgtgcatatatttattccttctatgcaatactttctgcttggtccggaggattagaaagcaatttgtcattctgctttgcacacaattccctaacttttgaggggaaaggagacatctg

SEQ ID NO: 180913 - DNA, 865 bp, Homo sapiens
ttcctaaatgctcgctttctcttgggtggagcatatttgaaggtccctgggagacttacaggacctctccactgcccttttctctggcatctgcagtgcactctccaggtgacctcttgcacagtgccctgctattttgccccatggcatcttaccattgggctcttcttgcccttcaggaactccttttgggcaggctctatctggatggctcaagcttgggtactttccatgctttcctcttggtccgtgggaaactcccacattcttagcatgccaggtgctgaaataaagtctacccactagtgccaccattccaggtctgggctccagccaacctcccacatgtcccattcagcagacattggtctctatgttcatttatatctcccaaataccagtaaattcatgtcaggctcttccagaactctctctcagtgacttgcttgtggtctttgacaacactgggtcaggagttctgccacccaggaaacatccagccaaggactcagatgcccatctgtttcttacaggcactcccagtctcttggtactgtcctaccttggtctgcgtcctcccctcgcccctaaagaacaagaaacagggaataccaaaggactccagacagatcagcaatcaacaacagatctatctccatgagcgtgctctctttcctgtgtcaaatgtgtcatctcatagaggctgcaggtggcagtgggggccatgggagctggaggaattgtgctgtcttttgcgtggctggaaaagtatttttctacaatgtgggggtacctgtgtacacttctgtccttaagactcagctcaaactccaacactaatcaagagtgcctgtcaacatcttgt

SEQ ID NO: 180914 - DNA, 343 bp, Homo sapiens
ctcccaaagtgctgtgattacaggcgtgagccaccgtgcccagccatctccaagatttctcatatggctttctgagactccctagactcttatagtaatccatccagaatcatttcctcatgcatagtttttggtagataaggtactgaaaaaatgaatttcatgaagaaccaacggcaaggagaagaaaaagacagacatacatgacacagtgatctctgtgagaacacccacgctattctagactctgtaaggagaaaagggaagagggttcttgcctgagagtatcttacaataatttggatacaaaatagttaaagccttcttttattttaatgtgtat

SEQ ID NO: 180915 - DNA, 372 bp, Homo sapiens
ggcagagcttgcctttctcccacgagaaatgagaaaagtctcaccttgtctctgacccatgtggaaaaaatgggtgagatcaagatcaattggaccagatggtacaaaggatcatgcgagtagaggagtggcccaggatggtggagttgggctgggaggagggtttaccctgttagaaaagtatctctcaactctttcccattgttgttaacctgggcctggaaaatgagcaggacacagcagtgaggggaacaggggcttcagagttgggaagagcggaatcttaatcccagctcagcccttcttgccaaaccactttaactcaacaaacttgtttcccaaactgtgccgtggggtaggaggtgggtgaga

SEQ ID NO: 180916 - DNA, 350 bp, Homo sapiens
tcatatcaaacacaaggataggatctgcttctctttagcatcaatccaaggtgaaaaatcaaaatgttacccacgacactaataaacagtagtaacagtgacactgtgactatagcctacagttcatgttataataaaatcaaacagacatgggactatttctagacatggcatgatgctatcttataaaaagcattttataagtaatacgtggaaattgagaaaatgtcccattttgatgccaaattcaccacatttaataaatcatccctggctgtttccatgtggggctaccagatccatatttctgactataagatcaattaaaatgattaagcagtgaaatgtag

SEQ ID NO: 180917 - DNA, 544 bp, Homo sapiens
ctcctcctgcatcagcgccccacccaacagagccgaccaggctgggaacaccgagaccgagagcgcgtggctgtgtctacaaaggcctcctctttgagggagacacgcgaggcacgggtggggcgatgagacaggatcggccggtccttgacagtctctgaagctgggagaacatgaccccatgctctcctgttggagtcaccacctctttgccaacagccaccaaacctccacctccaattaagctccacccccatgtccccactgccctccggacatctgttcaccccccgctgaagtctctaatgggttcttccgattccacctgtccaaggtaaaaccctgaggttgtccctcctccgcggcacctccaggtatctggttgctcaggctgaaatgtttcccaaggccctggctcctcctccttccaaaccccgcaggcagctgattagcaaactctgactctaacctcaaaacatgtccagaattcagccacatctccccacttccccgcctggccctgggccccgctattccatctcaa

SEQ ID NO: 180918 - DNA, 855 bp, Homo sapiens
caaactcctaaccttaagtgatgtgcccatctcatgcctgtaatcctagcactttggaaggccgaggtgggtggatgacctgaggtcaggagatggagaccagcctgaccaacatggcaaaaccctgtctctactaaaaatacaaaaattagccaggcgtggtggtgcacacctgtaatcccagctacttgggagactgagacaggagaattgcttgaacccaagaggcagaggttgcagcagtgagccgagatcacgccactgtattcagcctggatgataagctgagactctgtctcaaaaaaaaaaaaaaggcaatatagcaaaacggactctctgggttctgctgcttggatatcagaaatctgactccatgaaagtgcatcatcacaatactgactttgtgtataagcattgagtgtgtacacaaaatgttgaaacttcctcgataaatgagatatccttttcgtacatctgcatttgtgaaagataaaatttcttgagatctcagctctttgggtgactgcatatgcagtggtgacccagcacagtttccatcaatctcgtcaaaagacttgaggttgttgggcacagtatttcagatgaccacagttaaaaagctgggtatacacaattaacaaccaaagtgatatgcatttatacctttccctttatgaccaatttctttataaatatggctcatctgctcataactgttagacccacccaactgtcattagtaacctgagtgtttatgcttgcaaaaatgtatgttgttattgtctgttttattatattaagtgatgtataaagtattctgttgtgtttttatgtttctcaaataaattccccttt

SEQ ID NO: 180919 - DNA, 1102 bp, Homo sapiens
agtgggcccaggacaagagaaggctctgcaacaggtccagggtgctgtgcaagctgctctgccgcttgggccatgtgaccagcagatctgtcaatggcaggtaggggagcctttgggtaggcccatagaggtgagtcacacctccagcctttagaactttggagcaagagcaaagtatgttttttccctctgggcaggtgggggagggtgaggagggtgcagaggggaggagaggggatccactgtcagaccccctgtgctttccagatttgagcattcagtgagctgtcaggtggggcaggtactgggagcacatgcgccccccctccgcaccaccagttcccctgccaggatgccccaccctgagcctgaggctgcacgggcccaaaaaccactaggaaaagtgaagagaggactcaagctcagagagggaaggacacttgcccagggtcacagcaccaagtgaaggatagggccttgctcattcatctggattttcagaggctgagtctggtaccaggccaaggggcctgaccaaggagaacatccaagaagcaatcagtagagatggctcaccactgtctctgcaaggcttgccccaggtccagcctagcccctaggcaccacattggacagtgatctaggtgaagacgaaggcctcctctccctggcaggcaagaggaagatcagggggagcctgtccaaggagtcagtggagatccttggggactggctgtacttgcacctctgtaatgcctccccctggggccggggaagctgagcctttctggtcagaccaacctgtcagcactgcagatgtgtaactggttcatcaacggctggcagtggcgtctcccagactgcaaagatgcgaatcagtttaccctttcccgaggtgggggtgaggcctcagatgtggcccagcccagtggcagcagcccttcagggctgcctgtgtctgtcccagcccccacagatgtgctctccctgtgtgtgtgctgcgtgctgctctgctcaggccagcgtggaaagcctgcagcccccttcccacggcgggagccggagccccccaatactctgactcctggtagcacactcaccc

SEQ ID NO: 180920 - DNA, 468 bp, Homo sapiens
agacagtttaattggaggcgtggctcggacgtaaattcaaggagctgcggctagaaagtgaatttaaggggcggggctgagacaatttctatggagagtctctaaccgctttctccgcctcttcaatcccctagcctttatcgttctgggctgtaaggacaataatgtcatggatagtcgtctgccccacagacccccttgcctttcatgcagaggttctatcatgacaaatacagccaggcgtgaaaaaccttgggtacttttctggagctgtgaacagtacgtggctctggagtctgccttaatgaaccttgggggcgggaggcttacaagggtatggggaaggatggaaggtgaagaagggcagtggacaaagctaggctgaaaacatagcacaagccctgagccaatatggagaattgggtaagactccaaactctggtgctaggcagcctgggttcaagtctg

SEQ ID NO: 180921 - DNA, 331 bp, Homo sapiens
acaagagctcccggcccttgttgtttactgctttccatagtcatttctgagaaagagaaaggtaagccttttctgctctgagctagagctggtctgacaaacacctaggccatggtgttgtatggttaaaactaaaaatttcacaacaccaatatcagacaaagttaccccctcactaaactgaaagaaatactatttcacaatcatatttgagcataaaaagaacactgttcaaaccataatatgatcaaacatcccagctactaatagtgacggttaattattttattttttatttttttgtgatggagtcttgctctgtcaccaggct

SEQ ID NO: 180922 - DNA, 179 bp, Homo sapiens
taacacacttgtgaaaactaaaaaattatcattcgtacaatactactaactagatttcagcagttttttactagaggatggtgtttgtgcacggtcctttttcattagccttacaatgtacagtcataattttgttttctgagttgtttaggttagttttttgttccctgaacccttca

SEQ ID NO: 180923 - DNA, 457 bp, Homo sapiens
atattaagaaggttttatttctaaccttattattttgcaggtgaggaaactgaggcacaacaatgttaagtaatgaagccagatttgaacctggacaatctgactgcagaatcagtgctcttaaccattgtttcttatttagcttgctacatggcataaggctcttaaagatagtgacatgatgcagggtttctcaggatacaatctatagacagcattggaacagcagatgttgcaaatgagaaagtcaaactgagttaagcacacctccaaacctacaggtgaggcactaagctctgtggtttccaaatcatcgaatgctagagctgaagagggcctcagagagcaagactccagtcaaggaagaaaaagccagaccagaaacaataaaaagaaaacgagcaaacaaaggagtcacaaagaaacagaactgtggcaaatgacgcattagacgaag

SEQ ID NO: 180924 - DNA, 431 bp, Homo sapiens
tgctgcctctagatggcacaattacatttaagaaaaggaaaaagtctttgaaaataaatagaaaaaaaatcttagtactacagtattttaactttaaagaattgtgtattacatttttttaagagattaaaagtctgaaagataaaagaatagcttattccttccagaaaaggattatactaatttaatagttttgaagaacagctaggaagttcacaaatagatgctttaaactggtattagactaaataaaaataaaagtttcacatggtgcaatatcacagcgaaggcttataaaatgcatttttgtgtatgttttgtgtttcatttattttgctcaattttttcttgttaacttataaatttctgacaatgttgaatattatttctcatcagtacatcacagtttattttatattcaaaactgaatg

SEQ ID NO: 180925 - DNA, 1019 bp, Homo sapiens
attctaccataaaaatatcgagcaagttactttacttcttagagactcaggtctccaatctgtaatatgaaaactgtgttagtaactctttatgaatattgtctaaaaactaaataagatattcatgtaaagtgattatcacagtgcctggaagttgatgaacaatcaattcttgtttatttgatgaattggatatttctgagcaaatggtttaaattactcaatgtctttaggtcctcctttccttttaattaaatgaattaagtacattaattttactaagtgatacgattcaattttcattgaggaagttggacttccctccaagtaggtcatctaatataaaattataattttaagaaatttcaattactattaagatgttttcctatttctttacattaagaacaaatttcaaacatacatctttatcagtggtattctagcatattaacaataatgactgttattgagaattgactctgagccaggacaatccatatgactcaaatatattatgtctcatttactttttaagataaccctctaaaacaagtactgtttttatccccacttaactaatgaggaaccatcctcagtagaatcagaatttgaatccggatctatctgtctacataggatcagcattgaatcattagccatattgccatactttataaatgtaatataattcagtcattaagagacataatatgatagtatttttaagaaataaagattcctgttaatccttccacgtacaattccctgtaatatattagatcaaattactctatctcctgagaaaatacgtaatcatggatgataaccttgaagaagaaaagaaaagtgtatttacagcagtgtcttcgcagattaaagccctgtctatattactccaaaatatttaagtcaggcaagaatggtttgtattttttttttttttttttttttttttgctgtacccgaaattgttttgtaaacttagctcatgcttctttttgtttaactgatggaga

SEQ ID NO: 180926 - DNA, 258 bp, Homo sapiens
gatcaaaaacacaggaaaggattacatctgaaataaaatttggtacccttaaaatatctgtaattcaacctcagaatgagtgtatcttttaaaagctctttgaaaacacttccccactctctttgtctcttttctttataaggcatcttctctttaactccctttgggaaacttcttataaatgaggatttgcatctccagggattactctggttaggaaagtgttttattaaaaaatatatgtttgccacagaatgc

SEQ ID NO: 180927 - DNA, 463 bp, Homo sapiens
ttaattacctttccaaagatgattagtactaaccttggatatgttttgccacagttatagtatattttatatataaaataatttaatatttcattttggatacagtgcatgctaatgaaaaattcatgttgaaagcattgtgtttttttttgtttttgtttttttttgtgacggagtctcgctctgtcacccaggctagaccaagatcacgccactgcactccagcctcagcgacagagtgagactctgccaatatatttaccatttctggtgctcttcatttcatttattttcgtctggtatcattttccttatgtctgaagtatttccttttgcatttctcatggtgcctttctactggtaattgaactctttcagtatgtctgaaaacatctctatatcatcttagtttttggaagatgctttcattgggcttggaaatctaggttacgggttttttatg

SEQ ID NO: 180928 - DNA, 387 bp, Homo sapiens
ctgtctgcttccaagatggtgccttgatgctgaattcttctgagggaattcacatggcagaaggtggaaaggcaaaagggacagactccctccatcatgcccttttagagggacgcctaatcccatccacgagggcagagcctgcatgactcagtcacctcccaaaggccattccttccaatactgttgcattggggattaagtgttcaacatacggattttgggagacacatgcagaagaccatagcaactttgaaatctaattttgggggtgggagggcagacaccattcagtttcttccagaaaaggctcctctgctttcctgcctaggaaattatagaatgggatgttagctttctacaaatgaggtgggagaaagggagagg

SEQ ID NO: 180929 - DNA, 290 bp, Homo sapiens
acttagctgtgcatcgtggcacgggcctgtagtcctagctacttgggaggctgaggcaagagaattgcttgaacttgggaagcagagcttgcagtgaactgagatagcacactgcactccagcctggcgacagagtgagactccatctccaaaaataaaaataaaaaagaaggaaagaaagaaggaaaacacatgatgcaggatacgaaataaaaattcttcagtgaaataacgaataaaaaacaatcacaacttctggaaatcaagaacacacttagagaaatgcaaaa

SEQ ID NO: 180930 - DNA, 676 bp, Homo sapiens
gctctcttgctgctgcttgacccctgtggtcagccagtgtgagatctgctccaggcctcatctgtcggtccccaaccccctttccgagcctgtctgctcagcattgtgaagtctctcacccgaggccctgtccacaggcagaacgtggacattcagcccagctccacctgcccgggttctctctgcgctgccacctgtgcacaccatggaggccgtacgaaccctgggcagctctgtcccgctgctaagtgtcgggccactaagaaaccctgaattcttggttggtctgctgttgctaagccacatccccccctaccctggcatgtgtcgcttcttgttagacccaagcacaggtccttgtgttcaatcccagttcatccttgtggatccacattttcatcctagaatccactttcaccattcccaatcactgtcgtctatcatgagaaggtctggcatgcaagccttttgtgtctttataccagctactgctctaactttaatggaaagggctggctggggaggataaggcccagcgtccctctggctgacactgctgtcaccattggtccctgtggggtgatttcaaccagctccttgctggctgtcctggaacttagcccacatactccaccaccttgtcctcgggggtattggaagatacttttcctggggg

SEQ ID NO: 180931 - DNA, 787 bp, Homo sapiens
cctgtttgattttttgagacagagtctcactcttgtcgcccaggttggagtgcagtggtgcgatctgagctcactgcaacttctgcctcttgggttcaagcgattctcctgcctcagcctcccaagtagctaggactacatacgtccgccaccatgcccagctaattgttgtatttttagtagagacagggtttcaccgtgttggccaggctggtcttgaactccttacctaaggtgatccacctgccccagcttcccaaagtgctgggattacaggagtgagccatggcacctggcctagggttgttatatgtttgacatccgtcccatttgggaggccttctcatcagtcattttatgcctttaatgccattctaggtaggcaggaaaggggtcagggccagtgggcccatgtagcagatagggaaactgaggcccagagaggacaagccacttcttcaagaggacccaaactggatgccagacaggccctctgcctctgggattttgcccatatggctcaactggcctaagtctgctggcccaaggaaaaatttcaacccaaccctgccctttcccccattcctctcgtgcaggggagttggcgggcctgcggcagcaaataatagctacgcaggagaaagccagtctagacaaggagctgatggcccagaagctggtgcaggctgagcgggaggcccaggcctctctgcgggagcagtgggcagcccacgaggaggacttacagtgactccagcgtgaaaaggttcaggcagctggggagggg

SEQ ID NO: 180932 - DNA, 1343 bp, Homo sapiens
  misc_feature (59)..(59): n is a, c, g, or t
cgctgccgcaggcgccggcgtctcagctgctcgccgccccccaccccagagtgcgtgcngggtgactcccgccacctttgcgaccctcctgagcttaggggactgcgagcgggagggagtctcaggcccccggccgcaggatggtggcggagcggtccccggcccgcagccccgggagctggctgttccccgggctgtggctgttggtgctcagcggtcccggggggctgctgcgcgcccaggagcagccctcctgcagaagagcctttgatctctacttcgtcctggacaagtctgggagtgtggcaaataactggattgaaatttataatttcgtacagcaacttgcggagagatttgtgagccctgaaatgagattatctttcattgtgttttcttctcaagcaactattattttgccattaactggagacagaggcaaaatcagtaaaggcttggaggatttaaaacgtgttagtccagtaggagagacatatatccatgaaggactaaagctagcgaatgaacaaattcagaaagcaggaggcttgaaaacctccagtatcataattgctctgacagatggcaagttggacggtctggtgccatcatatgcagagaaagaggcaaagatatccaggtcacttggggctagtgtttattgtgttggtgtccttgattttgaacaagcacagcttgaaagaattgctgattccaaggagcaagttttccctgtcaaaggtggatttcaggctcttaaaggaataattaattcttctaacgggatcgcagccatcattgttattttggtgttactgctactcctggggatcggtttgatgtggtggttttggcccctttgctgcaaagtggttattaaggatcctccaccaccacccccccctgcaccaaaagaggaggaagaagaacctttgcctactaaaaagtggccaactgtggatgcttcctattatggtggtcgaggggttggaggaattaaaagaatggaggttcgttggggtgataaaggatctactgaggaaggtgcaaggctagagaaagccaaaaatgctgtggtgaagattcctgaagaaacagaggaacccatcaggcctagaccacctcgacccaaacccacacaccagcctcctcagacaaaatggtacaccccaattaagggtcgtcttgatgctctctgggctttgttgaggcggcagtatgaccgggtttctttgatgcgacctcaggaaggagatgaggtttgtatatgggaatgtattgagaaagagctaactgcttgagtcagtataatggaggcagggaaatagtaataaaaaatgatt

SEQ ID NO: 180933 - DNA, 441 bp, Homo sapiens
gagaagtctcagcattcagccagtaggggttgttcctgtcaaccccttttattgcttctgccccaggatcagtgaattaggaagatgccagtgtggagacaagccagcatggagcatgagggctgggcgtatgctcctaagtaagaagtggcccgtcttcccttctgattcttcctcctggtccccagtgcctgagcctttgaggctattcccctcccagacagacattgctttacttctgcctttgaattgaagccccattctttttgtagtcctcgtagcctcgattttaggctgatggctccagtaaggggtggggatgggaggtgttgcaggggttagaaggaaggaaggctgtctcttccattattccctatcatctagtgagaatctaatgggaggggtgagttagaatagatgcccatacaataggagtctgag

SEQ ID NO: 180934 - DNA, 315 bp, Homo sapiens
tagcagctctgggtttataaaatagcaatttttcaaaataaaacaacattttttcctctgatgagtgctcctttgggccactagtgaatgtttgttgactcctattcaccaatgattctaatgacaattttgctgtttcttcctcataccagaggagattaaaaccaatgaactttagaaggtagtgggaaagactgtgaaaggcagcacagtgacagcagagatggccgctgacagcctggggggataggaggaaaaaattactgagtttcagcagagcataacaatagatggtcatgtcctccctgagtcatc

SEQ ID NO: 180935 - DNA, 367 bp, Homo sapiens
cctggtttcaatgcaaacttctgcttttcctctgagaactgcctgactttccttttgctattcccaatccctagttgtcgctttttctatttatcaccaagaggagtgattctactcaatatatcccagaccacacttctcaaaactgaagaaagcttttcactcctactcaagcatttaaggtcccctctgacatatactcaatgaacctacccaaactctattcttctcattcaggagagagtgactgtttatagtttcaacacacctaacatgtcccacctttgtgcctatactcatgtccttctcctgccgcattttacctactaaaaatcaaaatcctatctattcttcaaaacaatctcaa

SEQ ID NO: 180936 - DNA, 477 bp, Homo sapiens
ttctttcacttagcatactgtatctgagattcatccatgttgttgtatatatcaattgtttgttccatttcactgctgagtagtattccattgtatggatttaccagagtttgtttatctactacccaactgagtacaatctgggttttcttccagtttttggcaattacaaataaaactgctatgcagtcttggcaattacaaataaaactgctaaactgctgtatttgcacataggttttatgtaaatactcaagagtgggacttacggttgtatggttaagtgcatatttaactgggattttagaacacataaggaaaggaaacttggtgataggaaactgtattcagaaagtaggtgtaatagcttccagattaaaataataactaaaagaagactggaggaactgaaattttattttaataaataatatccagcactggcaagaatatgggaacacgccagtttaatgccca

SEQ ID NO: 180937 - DNA, 495 bp, Homo sapiens
tttgccctgctctaaagcatcctctaatctgacaactggagtgatctttgtaaaccacagatcttgctctaatgttcacagtcacctcccttctcaaccacatccaccaccctcatacctcctccaatctaggcagggatcacacgctcaaaaacttacatgtggctcacacctgtaaccccaacagctcaggaggcctgggcaggaagattgcttgaggccaggagtttgagaccagcctgggcaacagtgagacccagtatctaaaaaaaattataaaaatagaccagatgcagtggctcacacctataatcctaacacttcaggaggttgagagataaggatcatttgaagccagttcaagaccagcctgtgcaacacagcaagacttcgtctctacaaaaaaaaaattaaaaaattaaaaaattagctgggcatggtggcatgctgctgtagtcccagctacttggaggctgaggtgggaggatggcttga

SEQ ID NO: 180938 - DNA, 658 bp, Homo sapiens
ctagcttctttaacatcccctccaacagtgactctcacctcagagctccatctcatccacccattttcatggaccacatgctgaatgaacttcaccatcactcagaattgcactgaaatcataacttaaaacatgccagtttttaactataccctctacttaacaactcttttttcttatttttgttttgttttgtttgagacagagtctcactctgttgcccaggctggagtacagtggtgcgatcttggctcactgcatcctctgcctcccaggttcaaaggattctcctgacttagcctcccaagtagctgggattataggcatgcaccaccatgcctggctaatttttgtatttttagtagagatggggtttcgccattttggccaggctggtttcgaattcctggcctcaagtaatatgcctgcctcagcctcccaaactgttgggattacaggcgtgagccactgccctcggccaacaattctttttttcttcaaatacgtgtatacttcaactttgttgagactgctaaggcctgactcctatactttcttccgacctaccagctatttcctgtcttcgcttctttctttagcctatttaggatctgtgatttctcacttcagatactctcttttcaatattctcaatccc

SEQ ID NO: 180939 - DNA, 209 bp, Homo sapiens
caatgattatacaagctccaagcataccctccacacgaacatcccaacacaaaaacaattcttgaataacataagttttgaatttttgattgtaggagatatgcaagaatgcacctgtgactactttgtacttactacaaaacttttagaagcactggtgctctgggctgttacttaggtaaggggcagccaatgactggacccagggt

SEQ ID NO: 180940 - DNA, 241 bp, Homo sapiens
ctcacatctgtaatcccaatgctttgagaggccaaggtgggaggatcacttgaggccaggagtttgagaccagcctgggcaatgttgcagtacttcatctctacaaaaattaaaaatcggctgggtgtggtggcatgcatttgtagtctcagctactccggaggctgaggctggaggattactcgtgctcaggagttcaaggatgcagtgagcagtgattacactgtcacacttcagcctt

SEQ ID NO: 180941 - DNA, 470 bp, Homo sapiens
ggtaggagtgcactctagtactaaatcgaatgatgatgaatcttactgagatgacatttgagtaaagacttggaagggagagaattagctatacaaaaggaactagccccagtaagaccctagccctggtaagagtgagataatgaagcaggtatggccagaatgatagagccttcttaagcctttaaaggactttgaccttttctattgaaatgggaggagtcatagaatttttaaaggctaattggtctctgctagactatgcgtgggacaggggcagaagtagggagttgatcaggctatttcaataatccacttgactgataatggtgattcagactaggttggaagcaatggacattgtgagaagtggttgaattctagttagacttcgaaggtaaagataataagatttttgacatattgaatgcagagtgtagaagaagagcgaagaataactccagggtttt

SEQ ID NO: 180942 - DNA, 427 bp, Homo sapiens
ttagaagcaagatggagtcaactatgtcagatttctcttactgtcataattttgcaaaggcagtttcaccaccagttaaagagcaaggtttccaacaacattgcccttacttcagcagcatgcactttggcctgaccaaccacaaattcagggcttcctactaccccctcagactagagtgagtcacaaaactcgggaaagtgctatattcacgattatacaaatgaacaaccagattgaagaggtacatggggaaaggtctggaagagtcccgagctcaggagcttctttctctgtagggtcagggtgcaccaccttcctggtacattgacctgttcaccaaccaggaagctctcctgagctttgatgttcggagtttttatatgggttttcagtaggtagatgtgattaagtcattggccacgtg

SEQ ID NO: 180943 - DNA, 542 bp, Homo sapiens
acaacagaatggcaagtgttcctaacttatgtatgtgatgaaaggagaaggcaatggcaaaggccacagggctgcagaaacaaggcagatgttactgtagttggagtgacagggcaggagatcctactcaaggagacagacatctccaatgccagggaagggcgacagctgcatcgaaggctcactgaaggcctgccttacttaatgtgagcagatggcttgcaggctgatcccaagaggacagcagggacaaagctggaaagcaacaagctgtaggtggctgggcacaagtgtgaagggcacccatttggaggcagagatgcagatcagggagaatgtccagtaaaagcccacagagttgagtgaaggagactgagggagagtgaaacctgcacatgacaggctgtcaggtagctttccttcgtccctttcctccatttactcatcagtgaaatgagaccgacagtcccacgctgcagcattgttttaagaaagggaaagtgtatgcagcccggtgacaaaggcttagcatgttgtaaggg

SEQ ID NO: 180944 - DNA, 345 bp, Homo sapiens
accagatagggcaggtgcagctgctgagcggagagagtgaagtatgtacttatggtgtgaagaaaattgactgattcaagagttgctgccaaagtgtgtgtggtctcgtgggctcaggtgagacccctgcccacgctggcatcgaaggctgtcccatgtctgacttgtatcgtgcccaataggatggggtcctgacagctctcaggatagatgggtcacccctgagccaatcctgcccagatctggactgagcctgcgaagttttctggttagctgttgctgtgagcatgcctccaaagtttatgccctgtggacatttttcttctgcttatagtgattcccaag

SEQ ID NO: 180945 - DNA, 333 bp, Homo sapiens
cgctgaatagcttgacttgggcatcacataaacaaacaaaatggtcccatagaacaaagtgactgcagtgaggtgggaagcgcaggtggagaaagccttcttccttccctcagtagagcacaccttcaggatggagtgaaggatgtagatgtaggacacgattatggtaaacagcgtgctgataaggacagatgcagaggagatggcaggggatatttcagcaatgtaaacatggccacaagaaagcttcaagagtgggaagaggtcacagaaaaagtggttgattttatttggaccgcagaaggacaggttcatcaaacagcctgtaaaaga

SEQ ID NO: 180946 - DNA, 666 bp, Homo sapiens
gaatcacttgaacctgggaggcggaggttgcagtgagccaagatcacgtcattgcactccagcctgggtgacacagcgagactccatctcagaaaaacaaaaacaaaaacaaaaacaaaaaaactgtacggtctgatccaaactgttgctgtattgattcctcctcttgcttactgcctgttgacttctgagatgatagtttccttccccattctcagtatatccctaattcatccttcattgagcatcttttatcataaagctgtattctctttgtattaatatccttaccgtgtttcacagggcagaaacagctgggcttataaacaggcatagtccttttgaaggatgtggttgatcctacaacaacacactttcctaaggatgacaacaactcaccccacccctagaatggctggtatgaaccgagtttccacacagtctagctggcaatggggtcaggagccgttttgctacttcacatcttttggtcactggtaaatattaaggtactttgttttctgttttgtgaactctctctcgctctctctcacgatatgtcttctgaccatttgtttctatttctgcatttactgggtctaaacattgtacagaggttaaaaacagcactccaatgggcgtttcccaggagggtggggttcagtt

SEQ ID NO: 180947 - DNA, 1497 bp, Homo sapiens
ccttcaaggagcttataagtgagggtctgccatgaacgctctagtataatgttagcttgctgggtctcagctgactagtcaacagaaagaagaagaagggtctctgagctcctccccacttacagatcctgtgtgactgctcttcctgcatctcacagaaaaagaacatttccagttgttctcacggacttcaaggctagaggtcctccagcccatccaggaccctgggagccctagatctctccagcactctcctttgaatgtctatctactaatcatctctacctgaatgtgctgtgtcaacatcaacgtgtcccaaaccaaactccttctgtcctcaccctccaacatactcctctgtaaccctagacttgggtggagtgggaggggagtttgctattgggccagttggctttgtctttgaccactgggtgctggatcttactaccttacgggagagggacacgtaactctaaagaaacagctggaagagaagatttccgagggactccttcagagcaagagaggaagacagagatgaattctacatagaaagcctgagaaggcctctcagagatggcttccttgccctccccagatgttcacagggttaacttaaaaacgaagcatcatggagctggcaaatcatctctgcatcccaaagacagtgcgacatgtgataatgactgtgaagcgcagctaagcccgttagcaggaatgaccagggagtgagaggcagcgctggagtgtcaccctccaacatcgtctctttgtttgaggatcactaggaaaggagccattagaaaaacgctagcctggtaataggagggaaatggatcttggcagggctgtgttacccattgagaaattagcaaaaaacattcagggaagaaagcaggggcttctgtgcttacccattgaggctcttggggaataatgacacatggttaccacctgaggaacccctgctgaggcagctgacttgcccagtggtctactacaggctcaggtgagtaggagggtccttcccaggaggggcagtgatgctcaggcagggctgggatgctcaggctccttgcaagagctgatcctcaagtctgaaccactccccaggcactgtgtcaggtactagggatggggccatgactaagacacggcttcatcctcaggaagctcacactccctgacatggtggcactggagccttgagggaggcaggacagacctcatcacccccattccacatctgtgggcaaccagggaggttggggggagacttggtttctttgtgaatcgattctttgctactttgcttagcatcaagttcctcttgtcatggcaatcactcagaatactgagagggtgaaagaggatgggcggtgcagcgggtccggatgaaaacttggaggggtgggaactgctatgatgtcaactgacagtgcccagagagcggggccatcacaccagaaatgcctgctccattgccacttctctcag

SEQ ID NO: 180948 - DNA, 1033 bp, Homo sapiens
caggttgtgaaggtcttggatgccaggccaaggagtgagacaccatcatatagggactaggggacataggagagttttaggatgagatctgtcaggagtaattgtacacttttttaaatacaagaatttttcttgttctgccttcattttagtaaaaacgaagcatcatggagctggcaaatcatctctgcatcccaaagacagtgcgacatgtgataatgactgtgaagcgcagctaagcccgttagcaggaatgaccagggagtgagaggcagcgctggagtgtcaccctccaacatcgtctctttgtttgaggatcactaggaaaggagccattagaaaaacgctagcctggtaataggagggaaatggatcttggcagggctgtgttacccattgagaaattagcaaaaaacattcagggaagaaagcaggggcttctgtgcttacccattgaggctcttggggaataatgacacatggttaccacctgaggaacccctgctgaggcagctgacttgcccagtggtctactacaggctcaggtgagtaggagggtccttcccaggaggggcagtgatgctcaggcagggctgggatgctcaggctccttgcaagagctgatcctcaagtctgaaccactccccaggcactgtgtcaggtactagggatggggccatgactaagacacggcttcatcctcaggaagctcacactccctgacatggtggcactggagccttgagggaggcaggacagacctcatcacccccattccacatctgtgggcaaccagggaggttggggggagacttggtttctttgtgaatcgattctttgctactttgcttagcatcaagttcctcttgtcatggcaatcactcagaatactgagagggtgaaagaggatgggcggtgcagcgggtccggatgaaaacttggaggggtgggaactgctatgatgtcaactgacagtgcccagagagcggggccatcacaccagaaatgcctgctccattgccacttctctcag

SEQ ID NO: 180949 - DNA, 334 bp, Homo sapiens
agggagtaacgggaaccctgatttacagtcagtcaggagtgtataggtgacaacctactacttgtgattaccatctgaggttgggggcagccttgcgggactgagccattaacctgtgggatctgactaacttcaggtacatatgtgtcagaattgaattatgggacattcagttcatgcctgctggaaaactgcttggtatggaaaaacccccacacatctggtagcataaaaaaaagagtgtgttttcaagtcccacacagaaaagacaggtatatattcccagcaagaatttatcagttttgcaggaataaggcatacataatgatataca

SEQ ID NO: 180950 - DNA, 362 bp, Homo sapiens
cctgcactggcctaatcagagtgaagctcatgaattctgtgtgatgactggtggaagatacacctgtaaaggaaatagtaacatgtcttatgaccacatacagagagctttccaagaatgcaggaaacatcaactagattaagccagtgctacttactactgcagataaactcaaaatatttggagtttaatgtaatagaaatccatttttcactcagaaattccagttagtgggggtgtttgtgttggtgcttggctggatgaagctgatgaagggtctgtattcagcatccgtattccaagaccagtattcagttaacagatggagaaaaagagtggacgatagtgcttgagggatctta

SEQ ID NO: 180951 - DNA, 442 bp, Homo sapiens
ggtgatagagccagactccatctcaaaaaacaaaacaaaacaaaacaaattagcttgtatttggttatatggacatattagctagcatctttggtttatcttaaatcacctttaaaggggaagatcttgaccttcctaaatattctcatacaaccacaattccgatcttaaggaataggttgggtgatttgagtttatgggtatgctgtacatttatttggattttgttactttaccttcttggaatgcatcaactggacagttaaaaatatacaatttattgaatttgtttcccatctgaaaaatcatatgtattcattacagaaacatcagagaaatagaaggaattttaaaaaatcatccctaattccatttctaaaggcaatcactgttaaaaattgctttggtgtatttctttgcaggcttttctttttttcatata

SEQ ID NO: 180952 - DNA, 278 bp, Homo sapiens
tgaagagaatggccccaggctatacaccgacaacatgttcatgtgagtgcagcagaactgcacagaaggagggaaaagtcacaacaggagagtaccgcaaggctggccccagtaagacacaagaagcgaagtctgcagcggcactctgagtcacgacagaagagtaactgcgaggccggtcccagtgacatacacgaagggaagtctggagcggtgctctgagaagcggtccaaggggctccccccgaggaacactttctcctgttgcagggtggtat

SEQ ID NO: 180953 - DNA, 549 bp, Homo sapiens
ccagactcagaaacaatagaatgtggactgaaagtaggatgcagaccctgcgaagggcctcacttatacctccatgccttgagaccaaattcacaccctcactgtagtttcacatagacatctagaatataatagaatggtatatatgcttacattgaatgatgcaaaattgtgtatgactttccattgtgtatattcagtcacagtctcctgacagctaagatctcctcatgagagatggggcagcaacagcaggaaggcgggacagagtgaagcatctttgggacaagccacgtcaaaggccataaaacagacagcacatatttgactaccccatatttgaggaccaaggacacacgtaatggtcagggatatagagcttgatggcagtagaaccaacgttaaagacaagaaagacattggaaaccagcaagatatggtgagaggaagtggtgagaaaagtaaagggagggattccaagcaagggcctcaaatgccgtcaggggtttttttctccttcaaaagatggaaggttcagaagaaaatggg

SEQ ID NO: 180954 - DNA, 273 bp, Homo sapiens
tgggaggggattggatcttggggtaggatccctcatgaatggcttagcatctttgcctggtcataggtgagttcttgctcagttaaatcatgtgagatccagttaagagtctgagacctcccccttctctctcttacttccactctcaccatgtgacatgctgtatccccgtcaccttctgccatgagtaagagcgccctgaggcccccaccagaaacccagcatatgctggcaccatgcttcctctacagcttgcaaaaccatgagccaatg

SEQ ID NO: 180955 - DNA, 196 bp, Homo sapiens
  misc_feature (132)..(132): n is a, c, g, or t
ccttttagttatagccaactcagaatctctagtatgaacaattaacctgctattagaagttatcagggtatccatctcacgccagttagaatggcaatcattaaaaagattacattgcggataacttactanttccagctgcagcttttcagggtagtcgcccttggtcgtcgaggtacgcgagctcgtaattgcg

SEQ ID NO: 180956 - DNA, 354 bp, Homo sapiens
tgtggcaatgaggacaaccccacactgggacggtgagcccgggcaggtgggtgggcagggtgcccggctgtgtccttcctccatgaccggtcattctaatggcctctttgcttctctgccctcttgcccatcccatggccaccttcccttttccgtactgtttttctgttgtttattttaccctcccgctcttttttctccatttttcctccttttccggctctctgcgattcgttttctttctccttgtctgtttctgtctctccgctctccctttcactgcatctctgtctatgtctctcttctgtcttccaaaattgtttttgtctgcgacttctcctggtttctctgtct

SEQ ID NO: 180957 - DNA, 855 bp, Homo sapiens
tcccatagtgctgggattacaggcatgagccaccacacccagccggccactgaaaagttttaaaagaagtttagactttaaaatatgcctgcacacaactatattgggcaaagaatatagttttacttgtccaagaactgttgattaatttgcaccaatttggaaatgataaatactaactttttatggtatagtcgtttttgtttggctgaatccagagattatttccttgtatatgtatctagaatatgtcctactagttattgtttggaaacatactcgacatctttaattttggagtttaattttggtgctataattcagagatttaaaaaaggtttgagaatgccttgctaagtgatggcaggcttagcacagtggcaggcttagcacagtgtttggcatatagctgggtcccaggaattatttacatatgtaatggaggaaggagaaatgttttattcaatgaacataggctaaacaattcactcttcatttggaaaaggtgaaaaatggggaaatttagataaattgattatgaaacggttattgttccggccctatctcagacttgttgttgttgttgttttttgagatggggcctctgtcacgcaggctagggtgcagtgatccgatcatggctcacttgcagcctcgaactcctggactctaatgatcctcccacttcagcctccttagtagctgggaccacaggcatgtgccaccatgtctggctaattttgtttatttttcgtagaggcagggtttcactatgctgcttaggctggtctcgaactcctgggcttgagtgatcctcctgccccagcctcccaaaatgctggtattgtaagtgtg

SEQ ID NO: 180958 - DNA, 838 bp, Homo sapiens
tcccatagtgctgggattacaggcatgagccaccacacccagccggccactgaaaagttttaaaagaagtttagactttaaaatatgcctgcacacaactatattgggcaaagaatatagttttacttgtccaagaactgttgattaatttgcaccaatttggaaatgataaatactaactttttatggtatagtcgtttttgtttggctgaatccagagattatttccttgtatatgtatctagaatatgtcctactagttattgtttggaaacatactcgacatctttaattttggagtttaattttggtgctataattcagagatttaaaaaaggtttgagaatgccttgctaagtgatggcaggcttagcacagtgtttggcatatagctgggtcccaggaattatttacatatgtaatggaggaaggagaaatgttttattcaatgaacataggctaaacaattcactcttcatttggaaaaggtgaaaaatggggaaatttagataaattgattatgaaacggttattgttccggccctatctcagacttgttgttgttgttgttttttgagatggggcctctgtcacgcaggctagggtgcagtgatccgatcatggctcacttgcagcctcgaactcctggactctaatgatcctcccacttcagcctccttagtagctgggaccacaggcatgtgccaccatgtctggctaattttgtttatttttcgtagaggcagggtttcactatgctgcttaggctggtctcgaactcctgggcttgagtgatcctcctgccccagcctcccaaaatgctggtattgtaagtgtg

SEQ ID NO: 180959 - DNA, 1027 bp, Homo sapiens
cgaggcgtgaccgaggggcgaggcgtgaccgaggggcgaggcgtgaccgaggggcgaggcgtgaccgaggggcgaggcgtgaccgaggggctcgccgcggctcctgcgcctgcgcggcggggaacggcgaccggctgaggggactaggggagcgcggtgcttcggtggcggaggtcacggtggcctccatcctaaagggctgcgggcgtcccggacggcggtcccaagcgctgctcacgctgctcttaagtgagccctggacgaggcgcggtgggccctcatagtccgcgccggcgccctcgctccacaccgcggcgtccggccctgggctcccgccgatgtccgcgtgggacttttaggggatttgtttatttttgtacgttaaccacactagaaacggccccagaatgggctgaaacgtgtgctgctgaagctgccacctaaactcccgagagaagcgccgtttctcctccatggcttctcgccgacgccctcgctgcggccttccgggcccctcggttgataaaaggactaaatagtgacggacatttttaaggctacttaagaaatggcaaaaatacatttagaggtgtgaacccgaacacactgcgcgctttaagccccgcgagagccggggccgcccgcttccgtgcgcccgtagctcctttctcgggtccgggattcgccggtgccggggacagaaacctcctgccttcttagttcatgacccttgtagatgaacttccctgttttctgcactgcttagaccagaagacgggaaaccgtgactgccgcacccttccctgaagcaggcactgcccgtcgtccatcaaacgcgaggactgcgcccacctcgtaggaagggacgccgcggtcctgctaaaagcctccggctctgcctgcccgagggcaccctttcccctccccggttccgagggcggactccattcctctggagccggtgtttccgggtgggccagcctccaatgcctttgaataaccccccttacattagattctgaccctg

SEQ ID NO: 180960 - DNA, 575 bp, Homo sapiens
tatcaaataacatagtcagacggtagtctaaaaatattatcattctaaaatattaaactaattacaaagagaaagaaagtacagatcctactggtagaagtaaattttttttaaaaaagtacattcccttaattcaagaactctagttgacaaaatttgtctttcataaaaaagcacaaaaatatcctttgataattaatcaattctattcttggaatttattctacagaatgcttcaacaagtatacaaagatgtgtatgggaatacatattcaatgttcttaataataatgcaaaattgaaaataaattacacatgtataaaagaagctagttaaattatagtacagcaggtcctctaataacatttcattcaatgttattttgctgtagcactgaagagagaaacaaagcccgggcgctgtggctcacgcctgtaatcccaggactttgggaggccaaggcaggtggatcacttgaggtcaggagttcgagaacagcctggccaacatggtaaaaccccatctctaccaaaaatataaaaaattagctaggagtggtgacgtgtgcctgtag

SEQ ID NO: 180961 - DNA, 491 bp, Homo sapiens
  misc_feature (79)..(79): n is a, c, g, or t
  misc_feature (81)..(81): n is a, c, g, or t
ttcatcttctctacccctaagaatatgcaagattaggtcatcattctatttcctctgaaggttcataatttgacttttncnccttagtgccttactaaacaaaaagatttacttcaagtgttactcttaaaaagtgggcacaagaaaaaacccaattatcccaaggagtttttgagaatgaaatatttactctcttctctccagtctcagaagataattcctctcttcttcaaaccagtactcctaattccactccctcctgactcctgttgaacactgcattaccaattactctcttctctggatttccaatctttgtttctctattggctcctatccctatctaaaatcataaacaaatcaacttcactttatcctcttttttcactaaagctattattaatccttctctttccatttactccccaatttagtgattcttcaaaattgtcacttttccattatgtcacttttcaagcatcaactcaatt

SEQ ID NO: 180962 - DNA, 321 bp, Homo sapiens
acatcatggtacatccctagggaagttgagatttactgagttaaaagaaataaccaccattgttattattataacagcagtaacgtgaccaagactttgcgttgtatgtactgatgtatgttttccttaaaacaactctaaggggcagtgcctgtgacctgagaggttaaggatataattgctaatagtagaggcaagattgtctaactctagactctttctttaaagtagaagttaaacaaaggaatgaatgggtaacagtggactttcaggagcccaagcagtgttgtgggagcaatgtcaataggacagggaatctct

SEQ ID NO: 180963 - DNA, 176 bp, Homo sapiens
aaattctcacacacattcacacgcacatcacatgcacacacacatgcacaatctcaaacgctcacacacattcacacaccccacatgcactctctcaaactctcacattcacacacacatcacatgcacacacacatgctcacattcacacaccccacatgcacacactcctcaca

SEQ ID NO: 180964 - DNA, 576 bp, Homo sapiens
gaataatattacatgtactacaaatatacaacattttatccattcataaattgatttgggttgtttccacttcttggctattatgaataatgctgccatgaacatttgtgtacaagttttcctgtgaatatatgtttcctgtcaattttttaacctaatgttaaacttttaaaattataactgcttctcgcaagtacctgccatgaaattttattcagaatggaataaaaatatttctcgtgaaaagatatatgaatgaacagaccaggctatcatcatatgaaccacaaagcaccacctaagaagtactctgtcaacaaagatggaccttaatcgaatcaggtctaatgagaacggcactgccaaacagaacttcctgtgacaatggaaaggttctataagctgtgctagccaatatggtagccattagccctatgcagcttgtgaaacaagaaactaagtttttgattttttcaattatttttcccccttaaagggacagggtcttgatgtctcccaggctagagtacaatcgtagcttactgaagccttgaactcctgcactcaagcaatcct

SEQ ID NO: 180965 - DNA, 498 bp, Homo sapiens
ttcccctccagagcctactatgagctttagaagaatagccataaactgtaatgagaactggatgctgggtgtgccttttccttagccagttgagtttgataaaggaaaaatttagtgtaagaaaagaagatttaattcccctgaaaaatgggtgagtttgctccaagctgcgccacatgtagggatcagggaccgtgtgcggaaaagataaagagtccacggcaactataaacagatgctgaggcctcacgaggtggctcacacctgtaatggcagcactttgggaggccgaggcggggggattgcctgaggtcaggagtttgagaccagcctggccaacatggtgaagccgcatctctactaaaaatacaaaaattagccgggcatggtggcgggcgcctgtaatcccacctactctggaggctgaggcaggagaactgcttgaacccgggaggcggaggttgcagtgagctgagattgtgccactgcactccagcc

SEQ ID NO: 180966 - DNA, 197 bp, Homo sapiens
gggcagtgaaaaggtcattgcattcaggtgaccttgtcctatcctactaattgtgtgactctcagcctctcagaaactcagctctcttctcttcaaaagagaaacaataacacccgcgtcctcataggcttattgtgaggcttgccttcagtaagccatgtatgtgaaagcatgacaccttgcataattgaataaga

SEQ ID NO: 180967 - DNA, 334 bp, Homo sapiens
cttggaagctaaggttttagaaatcagcagctgtcctgatggcaaatattgtttttatatttttctactgatgcttgtcaaaggaaatatttgaaaatcgccggctggaatctgaggaaaatactaaggagctctttgccaggagacttctgaaaggggtagggacatgcctgctgggtgtttacaaaaagtcccttgatctgtgcccctctagactttatttcccctctgagcatggactaaaaatccctatttcagttctattctttaatacccatttaggaggcctgtactggctctgacctgtattctgaacttaggatgagttcttaag

SEQ ID NO: 180968 - DNA, 773 bp, Homo sapiens
ctcaggtgacccacccacctcagcctcccaaagtgctgggattacaggcgtgagcctccacacctggccagtggcaccttgttatggccgcctgagcctactaaggcaaggctgggaaaaagtaccccatctcgtgtgtaccccatctcgtgcataccccacagagttccaggctgcctggtgctccaggtactcccctctaagggaagggtggagggggtgcagagatggagaacataccctttctggagtgacacatgaacccaagacccagtaattcccaaaggaaagtgggggtgaagcagggtgggctccagacagcacagagaggtcagggacagaagtcagaagagataaggtgggggtgtcccaagagccaggttacccagcctccaggctgctgttcacatcccccagtcggtggcgccttgttttttagtataaaagtattaagtattttgagatggagtcttactctgtcacgcaggctggagtacagtgacgcgatctcagctcactgcaacctccacctcctggattcaagcaattctcctgcctcggcttcccaagtagctgggacaggcgcccacacacactgggctaataggtatacaggtacggcagatcagaatagtatcagaatcgttaggaagctcggcggcgcttgggaggatggctggggcatgggaggccgggggacccgggcgggggagcgcctgtgggcaaaaactcctcaaaagcatccgggagcaaccaaggcggactatgacgtg

SEQ ID NO: 180969 - DNA, 587 bp, Homo sapiens
actggttgcattgatctctccctaagctgccacctgccatcgcctcccacctttgatcctttgccatcatcagtgtcttcaaacagcactggtgtgttctgcctgcaaaaacaagcgtactcctcagtggaaaaataccacattccagcttggtgaagcaggtggtgtgtttcataggatggagcagaaagtagcatctcttcttctcaaacaagaaggaagactattagcacatcagcacagaaagtcgtgcatgatgaatcttaagtgctgcctcataaatgaaaatgtggtacagtttgaaaaatcagctttgaaaatgtattaagtccattattcaaacccaaagtcttaatttttttaaaaaaccaattttcccatctttcaaataagggggatggagcagatgatgttcaagatgctcaaaattctttttgctccgtgagatctaaaacctgaccttggcatcacgtaatgaccatcacagtcaacactgctcacaacatatacaatgggatgcctggtatgttttacagctattatctggactaaatatcccatttcatttccagcctaggtagacagaa

SEQ ID NO: 180970 - DNA, 141 bp, Homo sapiens
atcctgggttcctagggtgggccaatgtgataacaaggctccttatcagagggaggcagtaggatcaacagtcaggagtggaagatgtgatgaaggaagtaaaaggtgggagtgaagcaaggaatcagccatgagccaagg

SEQ ID NO: 180971 - DNA, 574 bp, Homo sapiens
tgacttcctccggaaagtgcctccaaaatacctggcattttccattatagaacttgaaaacatggcagatccgataactactgcttattttttttaaattttatttatttatttttttaccaattttgttttgcctaaagtaattcctctgggacatgatttcccaactaattctccaaattctcataactctttcactagtctttttaggataatcttctattctaagacaaagcctaacttcagtaaaattgtgtacaaacacatacaacattaaatgaaaccagatcttaaacagagggtgcataaggagtgtaacatggggacttcaggggaaaatatgcattagaagggaaagagaacagagttaagatgccagtggaggttgaaattctgagaatgagtttcagaatatgtgagaatatttttgagaactatttttaattctcagtagagtatagaaggatgtagcctttgaatgacgttaaaaattcactagaagtgtgaagaatgttataatatcacatgcctcaaaacacaaattccttaacatagagattaaaatgttttaaaa

SEQ ID NO: 180972 - DNA, 235 bp, Homo sapiens
gtatgttctttgacttgaaaagaagagtcaatcttcttttatttcagaaaagatttttaaatttatatattgaaatatatcttgatctaaataataaatatagttggcccgccatatctatgggttccacatccatggattcaaccaactgggatcaaaaatattccaaacaacaataaaaacaataaacaataaacaacaataaaacaataaacaacacaataaacaaaataaa

SEQ ID NO: 180973 - DNA, 385 bp, Homo sapiens
aagatggtaacagtagaaagggaaataaatggttgaattctgaatatattctgacaattcagccaataggattttctgtaggatttaatgtgaagtgagagagaaaggtgttgagaattaccccagctccctctgcccctattttggcctgagcaactaaaaggacagagctgcccttgagtgaagtaaggagcttatgcatggggtaggtttggtggggggaccatgaacagtcagttttgaatggtaggtttgagtttatcaaacatccaagtggaactgttgagtcagcagtagcatactctggtctggagctcaggggagtgggttaggctaaacatatgaatttgagagtcctcaggtgactgcaagggatcacaggggg

SEQ ID NO: 180974 - DNA, 598 bp, Homo sapiens
aggtataattggctcacagttctgctggctttactggaagcagggtgctgctcagcatccgggaaagcctcaggaaacttacaatcatggtggaaggcaaaggtggggcaggtgcttcataaggcaaaagctggagcaagcaagggggtagggaagggaggtgccagatacttttaaatgaccaggtcttgtgagatctcacagggagagctcacttatcaccaaggggatggcccaagacatttgcaaggaatctaactccatcaccaaactatctcccaccaagctccgcctccaacatttgggattacaattcaacaagagatttgggcagggacgcaaagccaaaccatgtcaaaaacaaacaaacaaacaaaagttgctcttcggcttcctttgatggctcatccctttgctataataagaatagaaagctctaaattctaaatccacactgtcccacatgcagccaatctctgtatgtgaacatcaagcacttaagtgtgcgtagtgtgaactgaaatgtgctgcaggtgtaaaatacacatcagatctcaaagacttagaatgaaagaagaatgtaggggcagttggcaag

SEQ ID NO: 180975 - DNA, 233 bp, Homo sapiens
ctgaggcatgagaatcgcttgaacccaggaggcagaggttgcagtgagccaggatcgcaccactgcactccaggctgggtgacagagcgagactctgcctcaaaaaaacaaaaccaaaaaatcagagccaatggtgtaagttctagtctgaaagcctgaaggcttaacatccaagaagagccaattttttttttagttcaaatccaaagactggaaaagactgataatccaat

SEQ ID NO: 180976 - DNA, 284 bp, Homo sapiens
aattcttaatatagcatataagacctttcagaaatgtctcccaaactgtgtcctgaggacaacctacagcagaagcacctggggtgcacattaaacatttagatttttgaatccaactgtaggaatgggccccaggaagctagctgtattttaaaattaagacactctaacaattctgatgtacatcgaaatatgagaaggcccactctacataatatggccccatcttagagcatcacagcattcatcactacctatctttagcatgcttttcttaaggcact

SEQ ID NO: 180977 - DNA, 325 bp, Homo sapiens
ttattaattatataatttgctttaatagcaattttgatgcacagatgaatttatgaatattatgaaatcttttccagaacagtcagagagttgagttagccaaattcccttggccaattaatgcctggatgtggctgttatctcaccagagcagaacttctgggacttaggtataaacatcttcaaccataataaactcgatgctatttaggaacacaccagaaacaaatctctgcactggtggggattctactctaaaaggataagtactatatattgatgtaaagagagattacagttagtactaattaagcaaaaaattttg

SEQ ID NO: 180978 - DNA, 589 bp, Homo sapiens
aggggcaggcagaaaaaggaaagcaggcagttagatgtgatggtactgtccagaagcctatagcatggaggaggggatgcaggctggagaaccagaagaggtttcagaggaaaggacacttgagctcagtgtgaaaagactttcgagtgacccaaaaatcttaaattagaggctccctgttttgtggctttaaaataaaacattgtccttatgtctaatgtccttggttctcaagagggagttgtttcgtgccgtatttcaaagcatcacacttctacatttccgtctgagactcgccttttggacaggaatgcaccactgccagcagtcttggctttggtgggaagaaggtagaaggagctcatcaggttcatagaggaggaaataccaattcttagaaataaaatggttcataagaggtagaccaaaggtcatagagctctgttggctttgttcagtggcattcagggaatgaagcctcaatgtcttgtcacatttagggtgggaagagaaaatcatgtaggaacagctgtgcttaaaacataagcatatcatcttgggggtgaagttggggaggtgatctaagatt

SEQ ID NO: 180979 - DNA, 457 bp, Homo sapiens
atggacagatagacaccagagagatatgcgtatttcacctgcatgcttgaggctagagaaacatgatttattcagaactatttcaaatactgtaactaacctggtaattttgtttaggaaaacattaaattcggaatagaaggcaattcagaatacctgtctgttatctttgtcttgtcatttttgagatactcagttcctggaaaatattatgataatccatcttgctatgtagtatttcaagttatatgttgagcctctgagcttgcagagtgaacatttctattcatagacagtgctgttgacatcagtggggagatggcacaagctttgtgccctaggaaagtttaaaagctagaacattacactgcaaaccctatgtcaggaaactttgttgcagcaactaggcaaggaaaccctaccactgtacccataccttgttttagtagaattatgt

SEQ ID NO: 180980 - DNA, 208 bp, Homo sapiens
ttggaaagtatattgtgagaaatttttacccaaaagattttatttttatactctttgcttgatacacatacattgcacatcaacattacagagaaacacaagagataagtggaaggaacttgttgaaaaataaagcttgagaactgcttataaatcaaagtaagtttcagattgtgacatttcattgtaaatggcactaaaacattaa

SEQ ID NO: 180981 - DNA, 307 bp, Homo sapiens
tgaattgtgtatgtgtgtatatctgtatgaaatgtagtcaggatctgattttaccatttcccatgtggataacttgttccagcattccttcttatctcagagaaaaaggggtccttcttaacactaactcttccacctgttctttcagtttctccatctttccacctttcaaaatcctactccattacttaacctatttcatttctcatcttaatttctttttttctaccattttcatattttctgtttacaaatgggcttatgttccctctatttccttcaacccacatttatacatcagttaagg

SEQ ID NO: 180982 - DNA, 715 bp, Homo sapiens
tacaacttctgttcttttgcatggtgctatccagttgtcccagcagcatttgttgaaggctattctttcccctttgaatggtcatggcacacttgtcaaaaatcagttgaccattgtagtaggctgttcttgcactgctataaagaaatacctgagcctgggtaatttataagaaaagaaacttaaatggcttacagttctgtaggttgcacagaaagtaaagcagcatctgcttctgggaagcctcaggaagcttccaatcacagtggaaggcaaagcaggagtaggcatctcacatggcgagaatgggagcaagagtggtaggggtgccgtatacttctaaatgaccagatctcatgagaacttactcactatcgcaaatatggcaccaagccctgagagatctgccccatgacccaaacacctcccaccatgccccacctctagcatggaggattacaattcaacgtgagatttgggtggggacaaatattcaaactaaagcaaccatacacacaaagttttatttccagatttacagttctattgcattgatcactgacatgattactgttcctttgtagtaagttttgaaattaggaagtatgaatcttcctactttgtacttctttttctagatcattttggctattctgggtcctttataattccatatgaattttagattcagcttgtcaatttcaacaaataagtc

SEQ ID NO: 180983 - DNA, 366 bp, Homo sapiens
cttctcttcctcttccctccccttgggaagaaaggcttgccttcgaaagaagatagtgagttggcaaaaccagcatttactcacttcatttacccacttcaaaatcttgggattatcagagaacattcctcctcctcatcctgcatttccagttagtcaataagttctgctgattctaccttctaaatggtaaattctctccatcagcgccattgctgctgtcaccttaattcatgtgttcatcaccttggcataatctactggtatctcttagttgatcaatctgctcccagtttcttcctcatgcagaccatctgctacagagtataaaacattatcttgatgcaaaaaaagaccacattactt

SEQ ID NO: 180984 - DNA, 679 bp, Homo sapiens
aggtagctgtgggggtctcaaggactccctctttgacaaggctttgaccttgtcctacaaaacccagttatagcaaagatccttctaagggagttcagagaaaccccaccctggcccctccaaacgtgatacccaatgaagttctgttacccctattcataactcatcagctttctcttctgtaacccttgatacctcaccaagttccatcctctccctcaatttacccttgaactataggttcaatactgttgttgctgcatgcaaggttgaggtcaatctctctcccatattacagttctcatgacccacatcacaactgtcctgaataaagccttctttgacatttttaacacgatttcagtacaatctttttttacaagggacagggacttagacttgaaaccctgcttcacaagtctggaatgcataggggataatatgctctctccctgtgggaaggaaggagggtgtcctgagagtatctcccactcacatatccagaactctgggtcagacttctctcctcatgaccactccttgttgtcactccataaactgggtgagatgggggactgtggatacaccattacccagacagtgttctacggtggagctcgcctcctgcagtgatgggacacaatgcctgggagtcctgtttgccaattcagcccttacc

SEQ ID NO: 180985 - DNA, 389 bp, Homo sapiens
tgaagagatctggtggggaaaatttataaggtgaaactgaggtgcttgtgagacatccaggtacagatagattcagagaactggataaatggatctgtcacttaagagagagatctgggttggtaacagattcgggaaacatcagctggcaggtcaaaaatggtttaacactggtaaaatttcatatggttcaacctaacaaagagaagttgaagtcttaagagggacagtgtggtcagtgaatcaaagtccaatgagaaaactccttgcaacactaggagtaaagaacataagaaaaggagaatgagacagaatggtagaagtagaagagaaaccaaaaaaaaatttttttttttttttgagatggcgttttgctcttgttgcccagg

SEQ ID NO: 180986 - DNA, 111 bp, Homo sapiens
atccaaaatataatatgtatattattttaactttatgctattaacatattttattcaagaataagaaatagaggatcgcaatcaaggtcctatattacaccctgtccttac

SEQ ID NO: 180987 - DNA, 390 bp, Homo sapiens
ccaaccaccacctgcaactccaccaaaaacaactcagggatgtacctcagcctaggcaggcttcagctgcctggaattgtatttgaatattaacatagatccagccgggtgcggtggctcacacctgtaatcccagcactttaggaggagaggcaggaggatagcttgagcccaggagtttgagagcagcctaagcagcatggcaagaccttgtctctgcaaacaaatttttaaaaaattagccaggtgcagtggtgcatgcttgtgatcccagccacttgggagactaaggcaggaggatggcttgtgcccagaaggttgaggctgcagtaagatatgactgcaccactgcactccagcctgggtgacacagcaagaccctatctctca

SEQ ID NO: 180988 - DNA, 266 bp, Homo sapiens
atctacacagttcagaaacatcatatataccacagcccttctatgttcctagccccaccatcaaattctaccagcagcttttgtcactaatcatatcctcttcactaaaaaggtaatcacatttttataattcatgagtgattaatctgttttcatacatcatattggaaaatcatgttatattccagactcctgaggctgatgctatctctctcccacatatatcttagtttctaagagaaaaatatgtggtttaagctctgatg

SEQ ID NO: 180989 - DNA, 328 bp, Homo sapiens
gccccaagtcagttttaagtcctagagacaattacctaaagaagaggctggaactcctagaaggtaagaccctgcgacaccacagagtagatattcatggtaatgattccccacatcctccaaagggtctatagccatttattcaagtaactgtatactggggaagaggaaagacctgggcattttaaggactgctggatacagggtctaagctgacaccgacaccagataacgtgaagcatcatcatggcactggggcacgtggggaccatggaataaatggaattgtggcccacgtccaactcacagcaggtctactggatccacc

SEQ ID NO: 180990 - DNA, 479 bp, Homo sapiens
ggaaatagcatttgcataggcccttacaaagctttattctcggtcgggcacagtggctccctcctgttggcccagggtgctttttaaaaattgagatgtaattcacattgcacagtttcacttttgaaggtgtgaaactcagtggcttttagtcacgcattcacagagttgtgcagccatcaccattgtctacttctagaacattcactcgccccaaaaagcaaccccatcaaccatcactcccaagccccgggcaaccatgaacccacttcctgtctctgtggattggcttgttctggacatttcacacgagcgaaatcacacatcacttgaccctcatccccatgggcggccggacgggcagggtcctggcagcttcaagggctcttagagattgagtcgtgtttccagcacttgcgttcttttgctcacccctgagtctccgcacgatttttctccttcccacacacatctcactg

SEQ ID NO: 180991 - DNA, 433 bp, Homo sapiens
ggttaatgaggatgtggttctgcaacttgcacttccatttcaaagccatgcaggccattgatagatctgtatggctcaaagagatgccctatttgttttttatttttattttttcgagacaagatctggctctattgcccaggatggagtgcagtggtgtgtgatcttggcttagtgcaacctccgcctcccacgctcgttatcctcccacctcagcttccagagtagctgggactacaggcacacaccctgtgcctggctaaatcttgtgtttttctattttttgtggagatggggtttcactatattgcccaggctggtctcaaatttgtgagctcaaggtatctgtctgcttcagcctcccaaagtgctgggattacaggtgtgagccaccacacccggccaaaacttggcatgtttaattgctggcagg

SEQ ID NO: 180992 - DNA, 615 bp, Homo sapiens
tgcctgtctgtctgtctgtgagtgcttatctgtgtattgtgttctgcttcctgtggttacagaggcgaggtaggacataccaccaagctaagggggtcatcagctcatcttctgggcatgggaacccccactttcttttggtggtatatgcccactgagtactcccggcttgtaatacacaagtgttctcattcaccgggtattgcttttgctgcttgctgcatagcacaagtggaaggatgaagggaggaacagcctaattgttcctactattgtaacattacaaaaatcacactgaatattgattcgggactgcctcttggtccccatatctgctttgcccaagcttggaaaggaagaaacctgggcaaatatgtatttgtttatattatcaacttgatccaatacttctgtagaagtgttcaaacatttttaacagatatactacttttcaaacaaaatgttatgtagaggatcaatatattaggtaagagcaaaactgatctgcttgaagcagaggaggcagccctgaacatgaaccgctggtctcccctctgttcactgcagctcctgagaccctccatggaatcctagaactctgcagggcagtttaaa

SEQ ID NO: 180993 - DNA, 504 bp, Homo sapiens
tcctgcacacaggttctgatttgccctggcgtccccactacagtatgccttgttggtatgaaccagtcttcactttttctgttcttctttattactacaattaggaaatttttctgtcatacaagtcacaaacaccttgtcatccatgacacagaatgcacatatgctaatatttcatcgtatttaatttagagacctgtatgtgaaatgattctataaacactatagatacattgtaagtatcctctttgcacctttcaccaatcacacccattctccatgtttttatgctttcaggaacatgtgttgcctctgtaaacattacatcatactattttggtgttctcagctttacttttcagctttacgtactatactgtttttgcccttctgtaactttcttactcaacattgtttttgaaatccatttatatagatatcttattgtaatatattcattttaactactgtcggttattttaattatatgaatttatcatcatt

SEQ ID NO: 180994 - DNA, 285 bp, Homo sapiens
cattagtctcttttgtgcttttgcccctttcaccatgtgagaacacagcaagaaggcaccatctttgaagcagagcaagccctcactagggttggccctttgatcttgaactactcagcctttagaactataagcaataagtttctgttgtttataagttacccagttgaagggtggttttgttgttgttgttgttgttgttgtttgagacaggttcttgctttgtctgtcacctggctggagtgcaatggtgcgatcatagctcattgcagcctcgacttctca

SEQ ID NO: 180995 - DNA, 403 bp, Homo sapiens
agataacaccagacatgtggcgggtactcagatcatcctgaaacatacatcagccatgtcaagtggcctcttttctaccagtctcattccctgtaggttgcatagaatgaccaacctgaagtagggaagcctgaactaagagtctataaattggatttttgttccatttttgcttctgattagctgttgactttagacaatttattttagtatttagttttataatgtgacaaataaggtggttagactaggtgacaatactctgtaaaattgtgtaattgtgttctttttctatctttaaagaagatgataagatagctcagggctatgcttctgaaactggattccttacatccctgggaatagctgtttgccaggggtctgccaagtacatggcattttc

SEQ ID NO: 180996 - DNA, 158 bp, Homo sapiens
gtttaaacacttccatcaaacataaaacaaagccggtgtataggttataactttgtagacaacctgccgtggccaaccccactcagaatttgtatgctttcatattgcgttgatcttctttaaaaaaaacaaaaaccatgtattagtgtgtgaaataa

SEQ ID NO: 180997 - DNA, 378 bp, Homo sapiens
caacacttctttgtgtattttcttagctgttcgtttttctcgtctgtaaattatctgtttaggtccttcagatttttcaaaattggactgttatgttttcagtattgttatgagttcttgtttcaattatttatgacagttcattttcttttttaaaatagactttttttttcttagagaaataagaaaaaataaaaattaaaatagactttgtgttttagagagtttcaggttcacagcaaaattgatcaaaaagtatggagagttccggccaggctggtcttgaacttctgagctcaagtcattctcccacctcggcctcccaaagtgctgggattacaggcatgagccaccacacctggcccctttgcccatttt

SEQ ID NO: 180998 - DNA, 710 bp, Homo sapiens
cggatcacgaggtcaggagatccagaccaccctggctaacacggtgaaacactgtctctactaaaattacaaaaaaaaaattagctgggtgtggtggcgggcacgcctataaacccagctactcgggaggctgaggcaggagaatcacctgaacccaggaggtggacggaggttgcagtgagccaagatcatgccactgcactccagcctgggagacagagcaacactttgtctcaaaaaaacaaaaacaaaacaaaacaaaacaaaacaaaatcccaccctcagctccacggccctctctagccatagtggtccccttgttcagagctacactttctggcaacgtctaggcttgctgcctccacattctcagcacccacacaggcctcatgaaacatccaccagctttggtcctaccatgcaccaagcttcatctccagggccactcgtccatgttgctcggtccaacaggtactcctgaccgctcagcagcatctcgtctagttcttgaaactttctctccttccaacctccaagtcgctcccctcccctgatttcctctcatctgcagtctttcttctcagggtcctttagctccagcccagccctggattcccacagcctgccgagcactgccatgtagatggcacacggcatcttgaacttgggtgtctgagaccagctgtagttttcacacctgcctctgcccc

SEQ ID NO: 180999 - DNA, 194 bp, Homo sapiens
accatcctaagaaaaagaaaaggggggggaaactaagtaaaaagaatgaagaggtatgatccacactgtttgaaagctcagatagcttaaatacaaatttatggaaagttgcagccttttttcagaatacaattatagcaaatgtaaaaatatttcttcctaatttctttgacgtcctgggtcaacaaagcccc

SEQ ID NO: 181000 - DNA, 314 bp, Homo sapiens
ctacccattcaaaccagagattcccaacactgtctacgtattggactctcctggggaacttctgaaagcttattggatgccctggtctcaccccagactgattgcatctcctaggataggttgggagccctggtctaactgaaccatgatgcctcctgcctttcgtttcacgttttataattttcaaagctctttctcctaaagatcccatatgatttccagaacaacttttggaggtacatggaggcaggtagatgaaggcagcatgtgaatgctttgtccattgtgttattattgcattcagtggatgaaga

SEQ ID NO: 181001 - DNA, 318 bp, Homo sapiens
cactaaaaaaatcctgaaagtaaccagagagaaaccatgcattatctatagaagaacaccaattcaagtgacagcagttatttttcatctgaaaaactggaggtaagaaggaagtggcacgacatttttcaagtgctagaaaaaagcaaacctgtcaactcagaattttatatccagagaaagtatccttgaaggttgagggaaagtaaagacattctcagataaagaaaaattaagataatttgtgccagcagagctaccctaaaagaatagctaaaagtatttctctaaccagaaaggaagtgataaaagaagtaa

SEQ ID NO: 181002 - DNA, 948 bp, Homo sapiens
ctcagttccagaatacatttgattttacatcttatttgagtatatgatgtcagttgtagccatttccatctaactgtgcttgccttcattttaagctctgcttaaattctttctcatagagtgtgaagttattttgaaaatggtagcaacatctgaatccttagaaggatggccatggcactgggaggttgtgattgaaaagtccatgggtaaatgtaggatttcagcagtcagcagtgacactacagacctgacagatacacaactgacaaatcaaaacatttgtgtgaaaatgagtacagaaaggaatgattcagatgagtcagttgatcaccccagcaaaaataatcattgtcagtcttctctccatccatctgggaagtgagttattcttttaagagttgcaaagaagattcaggaaaacaggaaaaattaccacagctctttctggtgcttgtaaaaatacataatatggtgcatttttaaaggtggtggtctcagaaccacattttgagaactgtcaaagataggaaccattgtcagagttcagaagagagatcatttcaggctgcagtagtcagggaaagcttaatgaaagagactggctttggtctaggtcttgagagatggacaggatttgaatagatgagagcagggagaaaacatttttcgatgggtgaaatgccaagaacaaaagtacagaggtgggaaacaatagtgtaaggggagtgcagaatcaaatagtttgactcaaaggttcttaaatgtggtccatgaaagaaaattaaggccctacttctgtcaaatgacatcactcacttcagacttggaagaaatgggcagctctgcatatttctcttcagcatgcaaatgaatgaaactgttgatgcctctcagtgcatccagcttcacattttcatgtgcttgctgatgtcatcaaaggagaac

SEQ ID NO: 181003 - DNA, 581 bp, Homo sapiens
ctgagtgggagaataagaccctgtctttaaaaaaaaagtttcgggatgttttcccgtaacatttccactcctcccctgctgaccaggaagtagtcttatgaacagccgtgaggaaggctaagaggtgtagactttattttgggtcgccctgaccagatatatttggagttctgttactgttgtagcaaagggaatagatgttggttgccaattaatggtttgccactaacagtggagacaagagcatgtccttcgatgttgttggagtgttggacacatggaccactgagagcagcctggccagcgtcgctatcgctcagtaaatattagctcttgttattgacattactgttgctgatagaactggagtttggatccaggtggagggatggtgcagaggaaggaaggctggagctgagactccaggccccctccctgttagcagggaagcttgctgcattgtattccccctcaggacagtggtgacgaccaacccctctcactggataatggggaagagctcaaagaaccaatgtctatgggtgctttgtggtgcaggcctgtacaagcggcctttgtcc

SEQ ID NO: 181004 - DNA, 524 bp, Homo sapiens
ctgagtgggagaataagaccctgtctttagaagtagtcttatgaacagccgtgaggaaggctaagaggtgtagactttattttgggtcgccctgaccagatatatttggagttctgttactgttgtagcaaagggaatagatgttggttgccaattaatggtttgccactaacagtggagacaagagcatgtccttcgatgttgttggagtgttggacacatggaccactgagagcagcctggccagcgtcgctatcgctcagtaaatattagctcttgttattgacattactgttgctgatagaactggagtttggatccaggtggagggatggtgcagaggaaggaaggctggagctgagactccaggccccctccctgttagcagggaagcttgctgcattgtattccccctcaggacagtggtgacgaccaacccctctcactggataatggggaagagctcaaagaaccaatgtctatgggtgctttgtggtgcaggcctgtacaagcggcctttgtcc

SEQ ID NO: 181005 - DNA, 177 bp, Homo sapiens
aactcctggtctcaaaggatcccacctcagcctccctaagtgctgggttcactggctgagccaccgcaaccagccttagtttatatatagtgcttagagaattagctagcatctttaaaatgtggggtttttttcaatgtttaaaattttgcactgtaaatctttttctatgtgttt

SEQ ID NO: 181006 - DNA, 217 bp, Homo sapiens
cacacgtacgcataagcacgcagtcacacacaggtgcatacagacgcgcaaccacagcgccactctccctccccccacggagttgcctgtgtctcttgaggaacagaaagcaaagcaggagaccccagcacactggatggagggtcccgggcaggagggtcagggccagatggaggtgggaggagcggctggagggtggtgggggcagccagagggt

SEQ ID NO: 181007 - DNA, 422 bp, Homo sapiens
tgcctaaaaatttccagcaaaagggattccccagtgccttcgcaaagtctctagactccacgagaagaccttgtgtcctttccatctctcttatgccacaaaccagctgttcccctcagcagaggagacaagagctgtgctgattcttccctgccatacagagacatgggagctggagtgtgacctcggcacacccatttccttattgtccaggaatccagactacagccttaacctttgttaaggcttttagtaaattactccatcagtccaagagacaattaaaacaaaaacaaaatagcattgtgtttttatagcattgtgtttttagcacagcggtatatataaaaaaaatcaggccaggcgcagttgctcacacctgtaatcccagcactttgagaggccaaggcaggtggatcacc

SEQ ID NO: 181008 - DNA, 175 bp, Homo sapiens
aaaacaatttaaacaattgagggagtactgtttcttggaagcactttatcatcaaacagctgttaagaacaggaaacaaacaagaaaggagttaatataaccacaacctcttcgaagaaaatcaggatactgctgactcacaagttaactgttgttgcttcccatttcttgttca

SEQ ID NO: 181009 - DNA, 811 bp, Homo sapiens
  misc_feature (1)..(1): n is a, c, g, or t
ncacacacaccaacacaccacaccacctaacagctacgtacgaggcctgcctgttaaatacggacgagggctgggcggcagctggtgaagtccctggcggccctccacacagggccatggttcgacacacacctcccaaaacgccccacactctgggcctctgctggatgtggcctcttcctggagccccacctgggcactgaggtgaagagccccggagccctggcagacacgagggcttggggcctcaatggccgcatccactctgctccaagcccaccatggccagtcccgctccctgacaagggcaggcacgaagacgccgagggcggagcagccgtagtcaggcacctgtgtgcctgccgcacttgccttctgccatccgtgacctagagggctaccaccctggcaagatccgggttgtctcttctgggcatggtcctggcagaaggctcctgtgagcaggcaggagcttgatgactggctcacatgcaggtcacgcagcacctgagctgccccaaagctgccccatggggtcgcacgtcggagccatcatcacatcctgatggctgcctggggcagcgtgggaggccagagtctgcccagggctctccaagacgatgcttcaggtgtgctgggcccaggccatggtgccatccgccagacagccccgtgtctgcagcaagcagctctccacctcacatcatgggtatctacagggcacagccacagaactgatatccagaaatgcacgcgcacacacacacacatgcacgcacgcacacacaccctccaggtcagacatgccata

SEQ ID NO: 181010 - DNA, 703 bp, Homo sapiens
cccagtcctgctggatggggaattctgttctggctttgttggaggaacagccccgttagagtccagggctacctgcctttgcagtctctgtgtgcctctattctccttataaatatcaaaattgttaggtaaagtggttggcaggaaactctcaatccacccttaggaaaaaatgcttcctcttgttgagtctttgaaccataatccccttaaaccctctacactgagcacatataagcgctattgggatgattgtttttctagaacattttatgtcctcagaacttttgacaggtgccttttttcatcggcagtttgcagatgcagtgtgggtggaagaaggatactcctcattttaagtgaggaaactgaagaatacagaggtaaatttaaggcaaagctcaacagtcttaaaaacatagaagtgaatttgtagttgggactatgtcccatgacaaagatgtgactctctttcctattccctctgagttttgtacagatgattttggttgtccttagataaaagcccttcaatcaagattatattcaagaggaaagaagctgagatgtaagagagtggtcgaattatacgcaattatttttttttataaattttcgaatttcatgaagtgagcattttagagtttgaacacaaccatttaaaattaaaaccccataacactataaacacagttaaagctta

SEQ ID NO: 181011 - DNA, 218 bp, Homo sapiens
catatctacaatgttggagaattactatctgtgtaacactagactctgaagataggagataagaaataattataattgggctgagttcggtggcttacacctgtaatcccagaactttgggaggccaaggtgggaggatcacttgaggccaggagtttgaatccagcctggccaacatgaaaccctttctctactaaaaatacaaaaatctaccgggg

SEQ ID NO: 181012 - DNA, 718 bp, Homo sapiens
aggccgaggcaggcggatcatgaggtcaggagttcgagcccagcctggccaatacagtgaaagcccgtgtctactaaaaatacaaaaattagccaggcgtggtggcgcacacctgtagtcccagctactcaggaggctgaggtaggagaatcacttgaacccaggaggtggaggctgcagtgagccaagatcatcccactgcactccagcccaggcaacagtgtctcaaaaaaacaaacaaaaaacaaaacatacaaataagagctttattcttgtggtacttatattccagtggagacatagatgtcaaatcattaatcatactactaactttatagttagtagtgtggaattagacctagtgccctgagttgaaaaacattcaatctgagatatgaaaggttgagtataatttgttagaagaaagatagaagtggatgggtaatggaggaaaggatattcttagagggaatagcctgtgttcctctgtgaaacgggaatgattaaggtgagagaagaaatgaaagaccatgcgcctgttagcatagagggctggagatagtgtagcacaagaagatggaaagctaggtaggattcagatcatacagggcctcatacgccactttaagtatgtatctgaagagtaaaggagagtagggttgagaaagagaatgatatgaagacatttgtgtctttaatttcactctaggggcatgat

SEQ ID NO: 181013 - DNA, 537 bp, Homo sapiens
cttcctccccttcagttccctggggcaccctgctttcttccccataaattccatcttttgcgtaaccagatgacactgggtttttgtttcttgtaatcaaaggaatcttaaccaataaaactccgaacacagtgctacacactgtcccaagctatcatcccaatatcgccttcccagataatcactcagagacctcactggggtcccaatctcaaccctggcccacgcccccagcttttcactctaccctataactggtgcacttccaggttgcagatattatatttacaaacaggccctccctcgataagtgcttgtgagattgaactagatgtcccaaaacagcaccaaaagaacactctgaccactctacaccccttagcagctctgcttcatgcctggcgtctcactcagtatgcaaatatgctctagaaagctctaggaaaaccagacattattgtgtccactggacaaaagatatggaaactaaagcccagagaagggaagcatcttgtcccgggtgacttgccctgacac

SEQ ID NO: 181014 - DNA, 777 bp, Homo sapiens
aaaatctgcgctccagcagctgggaccgaggcatgagagcgttgaatcatgagtggcaccgttcgcaaaaattggtgtctttgtacaaagacagtgccacaacacaactcagtgaccatcgggagagcagcctcatgatgggcgatgctccatcagttttctcttgcgatcttttgcatagatcggtcccgccccgcatatggcgatgaggactcaagagacacggaaaacgttttctttctggaaaacatgaaataggcttgtagatggacaggaagtcaagggacaagcggtgcgccgcagagagcgaggacccactcttctattcctttgcggaggcacggacacacggtgtggcccgaaacagcggcaggagagtgagacccgggctccgaccgcggtgacggagtctcactctgtcacccaggctggagtgcagtggcacgatctcggctcactggaacctccaactccctggttcaagcgattctcctgcctcagcctcccgaatagctgggactacaggtgcccaccaacacacctggctaatttttgtatttttagtagagacggggtttcaccgtgttagccaggatggtcttggtctcctgactggtgatccgccgctcggcctcccaaagtgctgggattacaggcatgagccactggcccggctaaaaattttttaaatgtgtaccttatgggtttttttttaccacaatttaaaaaattaatttataatatacatgcagaaaaatgcacaaatgacaagtatat

SEQ ID NO: 181015 - DNA, 355 bp, Homo sapiens
gatcttcaatcttggaggtggagcctaatgggaaatgtttggatcatgggggcagatcctttataaatggattggtgccttcccagcagtaaatgtgagtgagttctagctctcctacttcatgcaacagctggttgtttaaagagcttggcaccccctcttctctctcttgatcactctcttcaccttgtgacacccctgctctccttttgccttctaccaccattgtaagcttcctgaggccctcatcagaagcagatgctggtgccatgccttttttttttttttttgagacagagttttgctctgtcacccaggctgcagtgcagtggcgggatctcggctcactgcaacc

SEQ ID NO: 181016 - DNA, 725 bp, Homo sapiens
gccaaagtgagtcacaagccaagtttaacttcaaggagcatgcccccaagcctctgattctaagtgctaccgtcttaacacatttgagctcctgtaacaaaatgccataagctgggtgacttataaacaagagaaattatttctcccagttctggaggctggaaagtccaagaccaaggcactggcagatttggtttctaatgagaacctatttcctggtttatagatggtgccttcttgctgtatcattacacggtggaaggggcaaacaaactctctggggcctcttttataagggcactgatcccattaatgacagctctgcctttatgacctaatcaccttccagagcccccacctcctaatgccctcactgggggctaggtttctccatatgaattctggggggacacaaacattcagaccatggcagcgctctcttccctcacagcgtggctggctctccaactacaacaccatgccccatggctcacttccaaggagactttctggagaggtttgtcctaagagacagaagaatgcatcctgcctcaagttttagttgcataggttcaccctacagtgaggtaatagttacacattcttaatgaaaagatccaaaagcccaatacatcctgttctgcagcatataaagcatcttcttcagacctggtccaagactactctgggatttttgagtcagaagagagccagagcctattcag

SEQ ID NO: 181017 - DNA, 201 bp, Homo sapiens
aaaaattcaacaacagcaaaccagcaaacagaaactcactgaggtagtgaagtgtaagcaggaagctgtgtggccaggtgtgaggaactgtgtagaactctgggaggaatgagagtagccccttcagcttcactgcttgctggtatgtgggagggagggccagggttccaaaacttccagttcttaaatagaagcctgcag

SEQ ID NO: 181018 - DNA, 310 bp, Homo sapiens
cacagttgttgaagatttacaggcaagccgtttggagtttaaatgtgagatgacaccaggggcctctaatgtacagtggagctttaagcatgatatgggggcagaaaatggtctgggaacccccttctctgagatcttagaagttctgttctattgactccaggcagggctgcagccacggtgcacttcatggactcataaatataacattattggacaaaaaaaccccaatccttctctgactgattaggcccagattggtcagcccataaatcaatgctgaataagaactataaagttgtgaatcaat

SEQ ID NO: 181019 - DNA, 387 bp, Homo sapiens
gcgaaacacggtcccctcccccaaaaaaagcacattttgatgccttgcacaaaactggcattgatttgaccaggacaattgagccactatgaggccgtattctgtgtcaagagaaccaggaagaacagagtatatccctagcaccaacaataaccattgtcttgggtctacaaccttgaacaagtcactaaacttttcagattggaatgccaaggcctctgctaactccaaggaagcctcagttacagtactgaaaatacataattatacataattacagcagggacccatgaggaaagttctgtaatgcagtatctggcttaaacaacatacgcaaattgtgagcagcagactagttaaccacaagctatgttgcttttgctatct

SEQ ID NO: 181020 - DNA, 695 bp, Homo sapiens
taatatatgtggacaaacaaaaatagcttcattgttaaaaatataaataagaacataatatatagattttctgcaacttgctttttcctctttgatggtcagaagaaataaactacttttgcatgtttaccacactacatttgatgacccattctttttaaaaatgttattttttagtaatttttatcttttgtagagatggggtctcactatgttgcccagtctggtcttgaactcatgggctcaagtggtcctcccacctcatcttcccaaagtgctgggattataggcatgagccaccatgcctggcttgatgactttgttataaattttcttatgttgtttaagggctgaactttggggaaaagcttcccacattcattacattcataagatatggattttctgattttcagcaaggccttggctgtacccgaaggctttcccacatttcttatagtgaaaggtttttggttttttgtttttttttccccccagtatgaattccttgatgtccaataagagttgagctctttgtaaaggctttcctacagtcattgccctgatagggtttatttccactatgagttttctgatgcccagcaaaggagatttgcccagcaaatctttctatacctgaaaaagatttcacatttaatatggtgatagagtttctctcctgtatgaaatctttg

SEQ ID NO: 181021 - DNA, 641 bp, Homo sapiens
ggagtctgaggtggcagtgaactattatgataccactgcactccaggagtgagaccctgtctccaaaaaaaaagcaaccattcgtttcccaaaagctgtttgcagtgttgcagtgccttacagccctcagagctttctcacacccatcggttcctcgtaagtcctgtgaggcagacagagctggagttaagagtccattttacagaagggaacactgaagcctccagtcatggagctgaggagtggcagaggctggagctcaggcctcttgcctccccagctgctcagcctgcccggctgcgtcctcactgccctgcaggggacacggcatgccaaggcagagtggctcctggatgaagctggggttttgggtcccacagcccgagttcccagcccagtaccaccatttcctggcttgggtggccccgtgcaattcccgaaacctctgagcctcgcagcagccctgtgaggaagcctcagtactgctcctacttgacagctggcaaaactaaggccccaagagagtcccatcacataactggctgacagaagagttgggatttgaatctcgaaataactcccttccatacaggaccctaccctgggctatcgctcgtgttcccatctccaccaacatcacc

SEQ ID NO: 181022 - DNA, 401 bp, Homo sapiens
taaagacctcagaatcctagattaatgaggcgccacctcatgggtttttacaattgcttgatctaaatctagagtcaggaagaactaaacgctggatcaagtgagccatgataagaggctatagagagtgaccttgagaaaaaggttatgagagcattactgtcacagtagactaccaggaggcaatgtcttctgtcctgttgggatcctgtggcttaaaatagatgagagcgggccagctgtgcctgtttctgatagacgtttggtgtttggcaaaagcagtgatgaaggtggaccaaacaaggatgacatcactaagacccaaagggatgactgagctgttacctcagactagaactgcctgtgggttggagataagagtttgaatgtgggtgtacagg

SEQ ID NO: 181023 - DNA, 589 bp, Homo sapiens
tttgagacagagtctggctctgtctcccagcctagagtgccatggcacaatcgtggctcactgcgaactatgcctccctatctcaagccccatcctctcatcctctcacctcagcctcctgagtagctagaattataggcactgagtagctagaactatagataactgtgcctggctaatttttagaaaaatctttttgtagagatgcattttcaccttgttacccaggctggtcttaatctcctgagcacttaagcgatgctcccgcctcagtctcccaaagtgctgaaattacaggcatgagccactgtgcccagcatgtacatctctttcactggctgtttctgagatttagcctttaaaatgaaccagtaaaagaaaataaattggtgagatgcagtggttcatgcccataatcccagcattttgtgaagttgaggtgggaggatcatgtgagctcagaaatttgagaccagcctgggcaacataacaagaccccatctctacaaaaagtaagagaacatagccagatatgctggtacaggcctataatctcagctattgccgcgtactctgcgtgtacactgct

SEQ ID NO: 181024 - DNA, 120 bp, Homo sapiens
aagatgtgagagagctagccatgaggatatctggggaaagatcattctatgcagacgaaacatcatgagcaaacatatatgtctggcgtatttgatggatggccggcgacaatgtggctg

SEQ ID NO: 181025 - DNA, 549 bp, Homo sapiens
gacctgcatttacaagatctgataagcctcccctcccctctctcaatggtttgcagcctgactacacaagatgattggaggggtttaagatctgcttcatttgaaagaaaaaaaatccctattaacctttagagattaattgctttggattgagtattgcctctcttaacatcttctaaaatgtaaatactttctggaaggaaggaacacattacgttttttacacattagtgagttttatcacatcagcctcctctatttgaaatagctgggcagaacgagctctaaatctctatctttagggagggaggtagagagccttggaagatatgagggatacgctagtcccaaggactaacacagggctggctgaccctttgtgattaccaaggacacggtaagggtgatgctgggaggggaggggagggagaggccctgagggttgtcgcttctgtcctggggcctttgattgctttagctcccctgtggacatgtgggaataaagctgcttctgagaggtccctatgaccccggcagccaggttaagca

SEQ ID NO: 181026 - DNA, 433 bp, Homo sapiens
catttacttcctaataaatttttactttcttcattgatcacaacctggggtagctgctcagaatgctttgattcctctcacttaccctgacctctatggtgatacatgtgttttacctctaactaatttaggatttttgcaatttttttaaaacaagcaaactaaaggaaaatacaacagcataggaacaataattttacaaggcacatatttcatattctaacgatgcaagactagccatgaattaacttgagtggctcaatttatagaacactctatctctagttctttcttctccttcaactttgaaactcacaagtgaaatggagaaacttcctgatcaccagggctctctcacacaacactgcttctcaagcaattggcttattggagagtccagtgcagtcaatgcatagcgtgagcaataaaagtc

SEQ ID NO: 181027 - DNA, 313 bp, Homo sapiens
gaacattttccttaacctatactggaggtaaaaaaacattgattaatgaatttttttaaaacaattccatcacctcacgttaaaataatttatatataaagaattcaacagtaaaatacaaacaagaaaaaagaaaaccacaggaagtaagaatcaaacatgtatcagaagtcttgccagtggaagctttgaatgaggaacagaatgacatgccctgatttatatcttaagaggatcactctgttttgtctgcaatagttgagaaaacactaacaggaatcaagagcagaagcagggatactagttgtttcat

SEQ ID NO: 181028 - DNA, 445 bp, Homo sapiens
cggcccagcgatcaccctataccaccacacccgtctaatttttgtagttttttagtatagttaggattaagtttggctgaattgattagaaaattgaaagtaaggggcttaaaaatgttagtattcatttttatctcatcccaatgaaatctagatataggcagttggatgctggcataatagcaccacaaagttattagggacctcggcaccttccagctcatgtctacaccatataagtgggtccttatgccctggtttctatatggcaattagagatgtcactgtcacgtccaaattgctggcagctggaaggtgaaagggacaagttggaagccaaagggcttgcttgctattatatttagtgactattgagtgatggctgaactttcaaatacataaattgaaagattacttataggcagtgctttccaggtgggtcgcc

SEQ ID NO: 181029 - DNA, 534 bp, Homo sapiens
gggtacaacatggtgtaccatctggcatctcctccatgatggcagaaggaactgccctctcttagtccacccccacctcccatctgtcctctcctcagttgcacatgttcccagctgtgttcaccatcagggaggttttcatccatgtccaacctcctaacaaggaactctggattccagctagaagatggggacagagaaatgtttaaaggcactcctaatgtcaacaagaagaatcaaattaaacaaaaaagcttctgagtggggtccagggcctcaagaacacatctttatactaggacttggacaaagactttgatgaagggaacaaatggggaaaatgcagtccctgcttgtcctctgtaaagctgaaggcggtataaacacttccagacattatttctagccagggaaagatgctgaccagttgcccaaagccaaagactgccaggagtaataagaaaactctttaagcatgattttcccatctgtttaatttcttatgctgaaaaagaagaaaaaaatataaataaa

SEQ ID NO: 181030 - DNA, 696 bp, Homo sapiens
atgttggtcaggctggtcttgaacacccgacctcaggttatccacctgcctcggcctcccaaagtactgggattacaggcgtgagccactgcgcttggttagaacttatttaactttttaggcacttggtaaacggtagctgttagtccatgtgtacttttttttttggtgggggggggagtcatgctctgtcacccaggctggagtgcagtggcaggatcttggttcactgcaagctccgcctcctgggttcacgccattctcctgtgtcagcctcccaagtagctgggactacaggtgcccgccaccttccatgtgtacattcttgtttaacaattcaggataggtactgttactcccctttacaaatgagactttcagaggttgattttctcatggtcaaacagctagtaagttgtgaattcaagattcaaactcaaatttagagctctcattttaaccactatgtaacaatgccccatgaggcaaagggataatatgtctagtatacattctggtatattaaccattgtcagcactggtgactgaaatccaagaactcttcataagtgggcttactaaacaaataattttatctgttgggtgcaagtcattttttttttccaaatacgattaagaacaatctgccatttatgggttttagctacaacagagaaacataagagggaaactcac

SEQ ID NO: 181031 - DNA, 728 bp, Homo sapiens
ggcagtctcttcatttaattggatttgcttcgtgtgtaaatctcctcaagacaattggcatgtagacagatggtgggagaacgagggctccgacaaattgcttcgagatcaaagtgttcagactggcaccaacgataaccacaagagtgagaaaacgtgcatccctcccacgggcctctcagaattctaagatttctccagctccgtttgcaagttgcactgggggctgaccaagtttaaagtgaggtttgaacttgaaacacaagagcttcaaaccttcacttgcagagttgatttttctaatttaaaacagataagagatgtcatatttgctgatacaaatatgattctaaagcagaatgtgatttttgtgtgtgttgctgcatttttattgtatttttattatcccaggaggtacctggcttctcagtgctttttttttttttaatctacaaatatttcatataagggacctttaatttacggggggttccaaggggaaagaaaagactgaattagatctggagggatagggctatgacactccggaggcaccccatgtggctttagggaagcgtctgggcacacgcggttccaatgcccctcagacagagcttaattccttcattgagccaacccggttgtggggcttgaacagatgtccggaatgtgaagggtttaacttacggttctctcaaaagggtcctagttacaggacgagctcagga

SEQ ID NO: 181032 - DNA, 143 bp, Homo sapiens
ttagttttatgtgggggcaatagtcactaaaggcttctgagatgcacttgaaagataagtaggtggggtgcttctgagaagactcttccatgttctttttcctgccagttgcacatgttttaaaaaaatactttccagcttgg

SEQ ID NO: 181033 - DNA, 293 bp, Homo sapiens
tagatcccagggagattaacaaagtctgtctcctctgaagatagaattcaagctgagttcttctagaaatccatgacctctagttcttctcttccagtgtcaactttatagcaacggcagtctgctaaactttgtgtaatctcaccctgtcatatatagcccagactttgaccaagaacttgtgaggaattcacacatattcaatatcttctcttccctctatctaccctctgttccccattctcatcctacatcattccctccattccagtgccctgccccgtggatttcag

SEQ ID NO: 181034 - DNA, 235 bp, Homo sapiens
catgcattcataagccgaagttgattttcatggataactgatggtagcacacacacaaaaatgattctggaaataaagtctttaagcacgaattttaaggttagaaactggagagcttttcaaaggaaagaggaatagtcacagagaaaaaaagaataatttggaagttatgtaatgtatgttaatagaatgagaaaacagaaaatagggagaattttgaaatatagaaataaag

SEQ ID NO: 181035 - DNA, 216 bp, Homo sapiens
gagcagcggtagagtgaagagatgacatggcaagatggagaagcacaagactgtgtaacctactgtgcaataagcaagagaaagggcacagagatggtaacaactctggcaggcgcagcggggccactgctgggaagtagggggtagaactgtggctctcggcaatgcaaacagcatcggtggcagccacagaattatttccactcagtggtcttg

SEQ ID NO: 181036 - DNA, 522 bp, Homo sapiens
aacaaacagaaaaactaaattattgctacttttacatatattttgtttatatgatatttcataattttaaatagcatgttcttcaagacctaaggtttgtttaatagaactagaagtactatgaagaaacaattttttagaaggaagtttaacagtgtaacaatatatgttttatatatgatgcatgtttactttcagtcattcatatcctcagaggactcttgtaaacttcaaggaagttttgactatatctggaatacaaagggaaaaatggaaaaacaaatatattttagaaaataatctagttaacagacatatcctgagtctctacctaatgtataatcagcaataaattaagtctttggattttctgcaagttctcccaagtctttcaagttatactgctatttgtgaggggtttttttttccctagaaatatctgtaaattctatgtttaattagtttctttactgctttatatatatttctgctaacagataatttgatcttgttaaaggactt

SEQ ID NO: 181037 - DNA, 410 bp, Homo sapiens
ggggctgacctagaggatccccaagctgctcacattttagtcactttatccatttttaggtgcataaggtatgcctgaagaatgattagaaggatttataatgaaatataaactctgatggtgcttgatttttccaaaggctattactttaacacagaaaaaagtgatggccctaacatcagatttatatattcataaataagtggcaacaattgtctgagtttgggaggtaagacatttgtcaatctgggtagcactgtagcaggcaggctggatgatcaagttcacttaataaattacttacccagctgtgatgtggaatagtgggaaatcttcaggagtaacaaattacttacttgtttaatatttccaacactaaatggaaagtgtgagcagcgttgaagaaataa

SEQ ID NO: 181038 - DNA, 287 bp, Homo sapiens
aaattaccaaccattctgtaaaatgagggttagaccaaaaaaaggcatatttctctagttcttttcaaacatttaaatgtcatactatgttgaacaaaagccagtgttgtactattagtccaacttactttcttaataaaatgccataaatctgttttactttgggatgtaaattactcttaactggtaagagaagaccattttcctagagcatcagtttattcaataataagtaaattaaaacagcattttattattaaacttagaattacagtattacttttttt

SEQ ID NO: 181039 - DNA, 557 bp, Homo sapiens
ttttttcaaagtcaatgaaagacattaacccacatatacaagaagctcagagaatctcatgcaggacaaatactaggaaaactgtattaatttggggaaacaataataataagaagaattaaagcttactgtcttgtcatcataaaaaatggaagccagaagaaagtgatttggtgtcttaaacttctgcaacaacaacaacaaaattcaacctaaaattctataattatccaaaaagtccttcaaaattgaaaacaaaagtaattcatttttagatgaacaaaatctgaggcagtttgtcactagcagacctgcactacaagaaatactaaaggaatttcaggatgaacagaaattattccacatggaagcctggaccttcaggaaggaaagaagaccccaagaaatgaatatacagtaccatttgtaaacgtattcactttactgattaagcaataaaatcaacaatgtactatgaggtttataagatatacagatgtatatggcaaaaataacacaatgtgtagaaggaaataaatggaattacatagctctta

SEQ ID NO: 181040 - DNA, 123 bp, Homo sapiens
taactgctgttaataaagagtttggattttagccactgaagatatttcgagaagacattatcctcatagttgtccttaacagtaaatcaaagactgattgatttgttttcctctcatttgact

SEQ ID NO: 181041 - DNA, 172 bp, Homo sapiens
caacaccacctggggaaattggcttaatggctcaaactgggactacagaaagaccaggttttaccccaaatccgaatactttctttgctcatcttcctgtcatgtagttttgcttctcttatctaaagaactgtgttattggagaaagctttggctaaattcttttgcaagt

SEQ ID NO: 181042 - DNA, 689 bp, Homo sapiens
agcatatcccagaaacaaagtgtattttagatgtctgcttatcaactctggttgaatgattttaagaacctagtttaagtttccgtaggggtaatatgattactcaggatgcattcgtctgcagtatacttcatgttatgtaggttttcccaccttttccaacatttctccaaaagttatccttctcccagtttaactgctaaaatgccattggtagggtctttgcacttcaagccatcttgaggaaaagcttccttctgagagttagatcatttggcaagggtcaagaacagaaagctgtgtttttaatctaaaggctaaggtcagatttattcttagatttctcttcagattcatctgtacttcaatatctagtttccatagcaactgagatgcagtttgcaggtgggtaagaaaagagaaatctttaggtgtaaagaaacttattttttaacctagagagagaaggtatcaggcaacaccttcatagtttttataggctaaagcctatattcttttttcaggacttcaatgtttcactgataggtgtcatttcctttttcctgaagaggccattcaactcttcttgacacagtcgcagaaaagattgctgcttctgtgttctgtttaatcacagtcaaactaattaactaaccaatttaacaagacagctaaaagaacttatgtgg

SEQ ID NO: 181043 - DNA, 738 bp, Homo sapiens
gtatagtaggggaggtccttgcttgctagataaacaaagcaccagaatacctcctgtgggagggctagagggaccctttcagggcatcattgcactcactgtgttcactgcattcttttttataccaagattaatgaaatgaacgctattgcgatgatgttgaagtattgtttgcactctattcccatccagtcatctcgaataggcagctcattcccctctcatatcaaaattttcctacaatactaatttgacctccaaaatacagccctacacctggaaagctttttttttaaagggtgaattccacaataaaaatcaacagctactaccatgtaatgagcatttcttatgtgcctgccacaagacacacaggctccgcccttcatgtcttctctcctaatcctcgcagccagccagggagggtgtactattcccatttcacaggtgaggaagctgagacatggagaagtgaagtgttctgccccagcttacacagctaatcagtggatcagattccattctggcctcctagcgtcaccttcccggttctgggggaagctgccacaggatgttcaacaagggagaggtgttggggctgccggtaagaggtgacactctggcagaagtccaggctccagaaaacaggctatgaactagaggcagttcagaagcacagaagcataatttaaaaaatctgccaccctgaatcctgcacgttggcaatttctcccccag

SEQ ID NO: 181044 - DNA, 676 bp, Homo sapiens
tctagaactctaaatcttctcagtaatgtcatacagagtctaacaagaggaaaagcatccttaagtcagtctatttagataaactcttcaagtccctatataaggacgtattccactagcaagccagtaaatttttccaaggtcacataatcttacatgaaatggaacctttcatcttagacttcatcaaactcaattttttcccttctagattcactttgtgtttatgcatgcatgcacgcgtgcacacaattctatcagcagctgtaaactacccacatattttcttaatctctttttttcagtttttcttcatccttaaaagaggttacatttcattcctggtcaactcttaaaaagaattatgtaatgttgggccttcatattaaagagagagactggttataagatcctttacagtccattcattttattctgatgtctaaccagatagacactagcaagcaaaacttccctcttaatcctggaccaaatgcataattttactgtcactttcaaaaatctgttatgactgaatcaaaatccttttaaagaaaggaaaaagctccttttgtgtcaaatagttgaacaacatgaaaacagtatgagccggttaaagatagattgaatttttactttacacggggatctctagatcgaccacagcatcagctgc

SEQ ID NO: 181045 - DNA, 625 bp, Homo sapiens
gtcacatgtgcatgatgtctcattacattccccttgggatcttggcatcagtacctcctaataacctccctactcctttttccattgtaaaaatatcccagcagcaaccaagctgtcttgagtccataccattacctcacagtgagcctggaaaactatctgatccaaaattcacagtctcctttatttactatctgtttcaattttcctttgtcatttatacttgcatttgcctccttttaccctaaccaatttttttctctcatgtgcatatatgtattccctctttcccaacactgtcataattacttcaaataattattcaatcctatcactttcatttttagattttcctttttggggggaggaggattattttctttttaaaaatgttaacaaaatatttcaaacttgcagaatataaccaatatccatgatcctatctctcagaattaattttttaaagaaataaaaacatatatttggagtctcctttgtacttctttccaattccattcttttccatccaccccaaatccatctactctcctgaaggtggtgcatattattctttttaccatttgtactcttatttatgtgtgctacaaacaatacatttttgtgg

SEQ ID NO: 181046 - DNA, 218 bp, Homo sapiens
caacgcagcatctcccagtttgcgatctgttcactagaataaactctctttcctccaaattcttctctagaaaacttttgttcatagctctttttaccctgcatggctttgtggccttatgcattggttatttggaaaatatcagttcactgagatttgcatacatgagggaatgagagtgaaaggacaaatagtttactattattataaaaatactt

SEQ ID NO: 181047 - DNA, 750 bp, Homo sapiens
  misc_feature (750)..(750): n is a, c, g, or t
tggtctggctacacaatgttactagacacatctgatgtgaagtactcttgaaagactctgtagattactcatgctagacttttggctttccttaacctgggggttccctgaagcagaaagaattttatttatccctatattcaagagtccaggagagtgcccaacacaaagcaggtgtttcataaacacttgctaagttaaaggaatacacaggcaggcatggtggctcacagccccatgcccatggaactctgatgaagcccacagatcatagttctccgaaatatgtagcacattctcaaggacaaaactaacacttattttttatacaaaaactatcctgtgatttgaatacatagtttgaaattatgttctaggtacattttaaattacttaccttgagggtgccttttgagaaaacgttgaagaaaataatatattagtgattctttggagctcacttctaatttgaagggatttagttcatttttttcattccaataaaaatgaaaataggccgggcactgtggtgcatgcctgtaatcccagcactttgggaggccaaggcgggcagatcacttgaggtcaagagtttgagaccacgcctgcaaaaatggtgaaaccctgtgtctaccaaaatccaaaaaggaaaaatatctgggtgtagtggccagcgcctatagtcctagctactcgtgagactgaagcgagagaatcacttgaacctgggaggaggaggttgcaataacn

SEQ ID NO: 181048 - DNA, 628 bp, Homo sapiens
ccagaacctggctaaagggtgggcttcagggagtttcctctacaggggtctctcccacctccgtactccaggaactcttttgttcactggttactttattcaacaaatattccatgagcacctacacagtgccaggctctgggctgggtgaccaggagggacaggagaccccatatgtcgggaggtggacagacagacctctagagaaaaggcttgtaagaccaggtcgttggacacctgctccaggtcagtttccctgcgttcggttactcattccttaagcatttattgaacacgactgtgtaccagccacttcaagacccagacaccgacagttcttcattgctacagggacagtgacacgcaatacaggcccctgccgcagtcacatggaaggattctcatcattgttgcacccatggacacacacaggactgttctgtttgtcagcacacacacataggtgcacacactcgcaaaagtttctatggtcactatcagttatatttcacccatgggctcacaggacagcttctttctctctctctctctctctcctcacacacacacatccctgcccatttcagacatccacagtggtaaacaaggcacctacatctacacccca

SEQ ID NO: 181049 - DNA, 516 bp, Homo sapiens
tattgtacatgcgtctacattgttagatattagacattaatatctaacaaatattccttaaatttatattgtatatattttatgttgtagagtacataataaactgcttatgtttttccttaaatttatattttatatattttatgttgtagagtacataataaactgcttaagttcagatgtttaataagaagctttttatagtaacaaaacgtagtatgttctaatctgaaatttgggagagatatggcttaaatttgataatttagactgtgtaactaaggcaggtcctaaaattgcatgctcattactttgaagaaaagttattcttttgacaattaaatctcaaaatttaaacatgtagaggaattacatacagaattaaacagaaatgaatactaagtgaaaattgttttttaatatataaggtccataatgaaaacagtgatgtcaaaatggaaaaaaaaactaaaaatgcaaacaagtgcaaaagcaatatttccccctctgctagca

SEQ ID NO: 181050 - DNA, 218 bp, Homo sapiens
aacatgtagccattcaactggcttgttctaaccttctccttcaaaaaagcaaagttctctgattgaataaatgactgcggagtcaaagtataaatgactcaatagaatccttcagacttgagcttcttggctgccattgttctcttacaggtaattttaggtaagatagcccatcaatagagtaccctgagtttcttggtttgcacaattacttaata

SEQ ID NO: 181051 - DNA, 859 bp, Homo sapiens
  misc_feature (764)..(764): n is a, c, g, or t
  misc_feature (767)..(767): n is a, c, g, or t
  misc_feature (815)..(816): n is a, c, g, or t
  misc_feature (832)..(832): n is a, c, g, or t
attctgcatggtgactctagaggtatcccctcacgttatacttctcatgtaaaaaaatttgggggggatgggaaaaacaaagcagagcccaagaattgattacaaaaaatatttttagaacttcatatctcttatcaaatgggctaatttaattgatcttaactatgaaaaaatcattaaagggatctacaatcaaccagtagtatttctgcttttttcatttagataaggatattaatttgacttttcaaaatgaagcataggaagagtgttcattatataagaaagtgctatttagaagcttatggaatattgtatttaaatattatagttgggatcaagtatcatttaaaaaatcacagaaatttacagcattctaagaccatttagtccactttacttaagttacatagctagtcaaaaactcagtctttcagtatactccagttcaacatcatagctcagcagtttgtctccggtattaagtatggagggacattcctatcaatggccactggcccacaggatggtaaacaatcaactgaaagacacaagttaaaagaaatttcattagctacgatgttagtttttaagaagaaaaatgtttttaaaatcacacagctctttaaattgaaaagaggtgaaggagagctttttattcgacaacaataccaagtagtttttttttttctttttttttctttttttgagacagatctcacactgtggcccaggctggagtgcagtagcatgatagttacagncanaggggtcccaatctagaccccaagagagggttcttggatcttgtgcannaaagaattccagggtnatgccacagtgtgaagtatagcgtgag

SEQ ID NO: 181052 - DNA, 636 bp, Homo sapiens
tattggcctgtagttttttccttttgttgtgtctttgccaggttttggtattaggatgatgctggctttgtacaatgagtggaagaggcatccctcctcaatttctgtgatagtttcaatagaattggtacagttcttctttgtacctctggtagaatttggctgtgaatccatctaggctgagacttttttggggtaggtttttattactgattcaacctaaggattcaatattggtctgttccgtgtttcaatttcttcctgattgaatctttccaggaatgtacgtgtttcttctagattttcttgtttgtgtgcatagaggtgttcataatagtctgaggatcttttgcatttctgtggaattggttataatgtcaccttagtcacttccgattgtgcttatttggatcttctcttttctttgttaattttattaacgatctatggatcttgtttatcctttcaaagaaccagcttttggtttcattgatccttgcatggatttttgggtccaatttcgttcaattccactctgattttggtatttcttttcttctttcagctttggggttagtttgttcttgtttttctagttcctccggggaagatgttagatcattattttgagatctt

SEQ ID NO: 181053 - DNA, 315 bp, Homo sapiens
gttaacacttcctccatctctcccctaggggaggcaatttgtcaaagattgttgttggattttacacacagggaaatctaaggaaggtgtggaaaccagaccaggactctcgtctccctgtttacagggtcttaaatgggggagccactttgggttctttccacaagattgctttgtaaaaaaaacaagaaacaaacaaaaaactcaaaaaaacagccctgacctaaatattcacaagggaccttaggcaatatctgcaaacaaaagtgaatgatgagtggaatctgtcatctttacaactaagacagctccaga

SEQ ID NO: 181054 - DNA, 469 bp, Homo sapiens
actgcacttcagcctgggtgacagagcaagactctgtctcaaaagaaaaaacaaaagataaaatcagaaatgaaagaggagaaattacactgataccgcagaaatacaaatgactaaaaaagactaccacagacaatcatatgccaacaaattagataacttacaagaaatggataaattcctagacacatacaacctactatgattaagtcatgagtaaacagaaaatttgaacagaacagtaatgagtaagaagattgaattggcagtaaaaagtctatcatcaaagaaaatcacaggatctgatggctttgctactaaattctaccaaacatttaaagaagtatactgattcttctcaaattcttccacaaaattgaacaggagggaatacttccaaactcaccgtacatggcatcactctgatactaaaagcagacaaaaacactataaaaagaagctgttacaa

SEQ ID NO: 181055 - DNA, 828 bp, Homo sapiens
gtgacatgtgctgactagagcaggaggggtagccaaggctccaagttctattctggacctgttgttgatttgaggtgtgacattcagcaatctgagctgatgttctgtagctctgattggtttctcatcttctgcagagagagtgaaagaggctgtgcttgcaggggaaaaggtgaacactggtctcctgtcctttaggagagcttcaccattacacgtcctgcctctcatttgaatttccaggcttttttagagtctcgctctattgcccagattggagtgcagtggtgtgatctcggctcactgcaacctctgcctctgggtttaagcgattctctcacctcagcctcccaagtagctggaattataggtgcgtgccaccatgcctggctaatttttgtgtttttagtagagacagggtttcaccatgttggccaggctagtctcgaactcctgacctcaagtgatccacccacctcggcctcccaaccaggcttttttaaatgcagaaaccgccgcccccagagttaatatggaaacccagcaatgttgtttatgttttacttgaattcgtttcatcagaattgcattccttttaacagtgtgattagatcagctcttagaggggatggcagcttcagtagggtttaggacaggacaggaatatttgtgtggggcacacactttggctttgatagcttgaggataccaggtacatgataatttagatggataacagaaacttgtgtcccttgagagccaggcatgtattagatgctttcatacattatttaattgtaatacaaaccaataaagtattcccatttt

SEQ ID NO: 181056 - DNA, 431 bp, Homo sapiens
cctaaggtctcctacatgaaaaaaaagggggaactacagcagtatgagcaagaaatcctggtggcttctaggataatgataagaaagatggaaagaaagatgtggactaattcaaaatgtattttggaatagaatcataatgattggatattagatacaagaataaagaaaggagcgaaaaaatgactcctagatttctggttgaaacatctaagtagattgtggtgccatttcctgagacaagaaagatcacaggaagtgcaggttagtaaatatagtcaagaatctcatttcggataacgtaaatttgagacgcatgagagatctctaagtggaaacatcaataagcagttggatggactaatattaacagtcctaacaagagagggagacctggcctggagacacagaagatacagaagctgcccagc

SEQ ID NO: 181057 - DNA, 241 bp, Homo sapiens
gtaatccatatgggagaggggccttaggttcttttcactccagtgacatagcacttgtaggattttttttatcttaaagactgttggagaaccagaaaccagcataaaaaagccctggaggcaaaggttgaaatggggatactcctggggagagggctgcccttagaaatctgagaatttcctgtcaatcaacatttgcctggtctcacaggcctccatgggctggaaataaagtgaaaat

SEQ ID NO: 181058 - DNA, 188 bp, Homo sapiens
aaatatataagaagcaaatttaatacactaggaaaactcccatagaccagggcagtaactgatggcaagtggattttaactcagctccattaacccattatgtcttaagagcaccatttctgttaaaattaaagaaggttttacacataaggaaattcacttgattatggagaaaaggaaaacaacag

SEQ ID NO: 181059 - DNA, 425 bp, Homo sapiens
gtgccattatagctcactgcagacttgaattcctggactcaagcaattctcctgcctcagcctcccaagtagctaggactacaggcaggcgccattcctctcagctaatgtttttattttttatacatatggggtctcgttgtgttgcccaggctggtattgaactcctggcctcaagcaatcttccctcttcggcctcctaaaatgctggggttacaggtgtgagccacttcactcactttagagattttcactttatgaattgataaatacagcattgcatcacttaatagggatacattctgagaaatgcatcatgaggcagtgtcatgatcgtgcaagcatcacagagtgctgatacaaaccgagatggtacagcctactaaacacctaggctatatggcggtatctgttgctcctaggct

SEQ ID NO: 181060 - DNA, 253 bp, Homo sapiens
gaagaggcatgtgggaaacctctgtgctgaggccaggagcaggaggagcgtgtttgcttcgctgtcggaggacagtgtccacatggccctagagtcctttctgccactggggagtgaggtggaaagtaaacacacagggcgggcggctggctttgtttctccttggctttctggttcagggcctgcagggagcagctgcagtgtgtgtcagaagtgagggtttgagagcctttatggtttcattctctcttgc

SEQ ID NO: 181061 - DNA, 162 bp, Homo sapiens
tgggcactgtagtcccagctactcaggaggtggaagcaggagaatggtgtgaacccgggagccagcaaatgtttattaagcatctactacattaggcagtgtactaggtgccgatatggttgtgaacataatagagaaatacctgcttgctttttagtgcaa

SEQ ID NO: 181062 - DNA, 547 bp, Homo sapiens
  misc_feature (19)..(19): n is a, c, g, or t
atcagccggtccgaaaacnacatagaggcaggttacagacaaaaaggagtgggaattgaagataacctcaactatgactttcagaactgaattaggagaaaatacgaagagaaaactattaatacacaaatccaaatggaaggagaccaagactttggccacagggcagagagaaggggggaaacaaaagtcattttcaggaagtggcaaaatttaccagccaactaacccaataaaaggatagcaataagctaagtcaatttttgaagtttaacatattaaagaactacagacgtgggaaatatggtttgaataataagaacaactcgatgcactaacagtttgtttttgtttttaagaaacagggtatccttatgttatccagactggtctagaatccctaggctcaagagatacttccaagtagctgggaccacaggcacagggcactgcacccagcttcgatgtactaattttgtatttttagtagaggcggggtttctccatgttggtcaggctggtctcgaactcctgacctcgtgatccg

SEQ ID NO: 181063 - DNA, 667 bp, Homo sapiens
ttttaagggagagtgggtgggtgtggctacaaacgtgtagcaggaaagagccttgtgatgaagtagttctgcattttgactgtagtggttacaagctacacatgtgataaaattgcctagaagtgtaatacacacacacaaatgattcatttataacttgaaatgtgaattagtcctatggattgtaccaatgtcaattttttggttttaataatgtactagaattatacatgaggagagatgcacggtgcatgaacagaaccttcctatacattttgtgcaacttcctgccaatctctaattactctgaaataaaaaagatttctctaaagtttttggggttttatgtattacttattatcgtaaagtaataataatgataaccaacacttaagtagcatttgctagggccaggtatatcagggcatttaaccctcataacaacctgttatgagctgaactgtgtcctcccaaaattcctatgttgaagccctaatctccagtactttagtgtatttggagatagaagcataaatccaataaaactggtattcttatgagagaagatcagggcaaagaatgagagagcaagtgagcacgcacagacaggtatgcacacagagggactacaatatgaggccacaggaaggaggcagacatctgcaag

SEQ ID NO: 181064 - DNA, 109 bp, Homo sapiens
tggagatccacacctgactaggaagaagaaggatgtgcaaaaccttcagtctgccaaagtaacaatagataaccaaagaagccccagagaagcatgttttcctttaaat

SEQ ID NO: 181065 - DNA, 329 bp, Homo sapiens
atctgtgcatcaattccatagactgtgacagaacttctagaacttaataggccagaatcttccaaaacaataagtttcatctctaggcttagagagcagaaaccattttcccattgtggagtaaggagtgagagtccagtgagaggaactttccttcaaaaaatggcagaagacagaatctgcattatcatattatgaatgccccttgtatatacggcagcaagtgaatagatgaacaaaagaagaaatttgactttgttctttctaaggaaagatgataatgcagaaccacttcttaggcttgtgaactaacatggtgattaaggtgt

SEQ ID NO: 181066 - DNA, 617 bp, Homo sapiens
cagttcaaatcttttgttttagatattagagaggcaggaagtgactctctactgtgtagcatgatactcagagcccaggaacttcttcagaatcccagtttgacttccaaaacgccagtgtcttgcttttatttactcttgtgggtggcagtaagggaagggagcatatctccttagcaaaacatctcatcagaacacggtccatagcacaaattattaattaaagacttacgtggaggctcaaatatagagccaaagcataaccatttaacaattatccttcaaagcaattttattcttggcttttggtggaaaaaactcttaaaaataaaatgataattctacatatgggatttgtgatgctatttagcaaggatatgctttattgcctgacatcccctttattttggcagaatactatgagatttctcattacgtttccatttgctgcggaaagtggagaaaagttcagaggggggaagactaattaaaaaaatggttgtctactaatccattgaactaagccttcttaacagtcatgctcttcttaatagtatgaacacacattttgtattgattgcagagaataaagaaaaagaaatgacttgttttgaact

SEQ ID NO: 181067 - DNA, 332 bp, Homo sapiens
aaatctgttaaaacagagtctggtctgaaagtgaaacatctcctttccgcttttcttatgcctttaatggttttttaaactactatatttagacgcagaaaaaaaataactgaggcaagatggttctggtttggaaaaagccagagagagagagagagaaagagagagagagaggttaggatataagcctaaatgctatcaaatgcctagtgtttagtagttatgaaaccgaggcatcaacttaatatccttctcccagcaaattatccagggcaaagtcatcgctggggccagaaccttttcaacagattggactcgctacatggtgctga

SEQ ID NO: 181068 - DNA, 249 bp, Homo sapiens
tcaacagggtaatgtatggtaaatggtctaatataggactataaaagcttataacaaagtgaaagctaccaatactattagtctaaattgaggagcagagccttactctaatctcatctttcttccgtgtaagaaaactccttactggcttttctttgcaagaatgctctggacgttttgtctcttcccccactccacttcacttctcctatcccttcatttcctttctcttctgtctcctcttcctcc

SEQ ID NO: 181069 - DNA, 404 bp, Homo sapiens
aatcccctccaacaggcatttcctcatctgaggcatcaaagaatgaaaaggggcctccctgctcacctggcctataaggatcaagcctggtgcctcattgacttctttaatcaagtcaccaagtgcttactatgtgccaggcattattccaaatgcttgaccaaatatgaatacatacaaataggaacccccataagatcctacaaggcaggcttgactttacagactgaagtcagttacatcagctgtggaacttaattctataaacatagagaactgaaggtttaatgtaggtgttcaaatttactcacctggatttaaatctgccccccatacacacttgttttttccctcataacacctgagttgcttaaatgatgtgtgtgtgtttgtctgtatacatg

SEQ ID NO: 181070 - DNA, 184 bp, Homo sapiens
acttcactgcactgcatctctggctctgtaattgaggggcagctgcttcctggtaatgcaataaaacccaagggcccaaaagaaaggcttagaatactcctctcccctgccctcaactcccaagtgcctttccaccaaactgctgtgtgggaaagtcacctctccagccttgtcactcccgtac

SEQ ID NO: 181071 - DNA, 593 bp, Homo sapiens
ctggcttctttcacttacagtgttttcaaagtttattcatgttgtagcatatgtcagaacttcattttttaatcactgaataaacttcattcttttttatcactgaatttcttttccattggatgtatagaccacaatttatccattcatccattgattaacatttgagttgtttccacctcttgggtattgtaagtagtgctgctgtgaacattcacaagtatttaagtatctgtttttaattctttagggtttacatgtagaagcagaattgctaggtcatatggacatcttgtttaacttttgtggaactgccaaaccaactggctacactattttacatgcccaccagcaatgtaccagggttcctattactccacatcatccccgacccttgatattttcaattttttaaaaatcttttttctttttactttccttagtctttcctgtgtcgtatctttttttttttttttttaaactaaaattatatgacaaatagcacttatgtacaaaacttatgcagtggtaaaacccataatatttggatgaaaacaaaggttgtctgaattataagtaatgtcaaacatctc

SEQ ID NO: 181072 - DNA, 545 bp, Homo sapiens
ttccttctgtcacgcacattttcaacacttgcagcctcatttaacgtcaacttacattccttcatctgtggatccttgctctctggcttggttcttttggataataatgccaagttcctacccatcacaggaatcgtgattggaatccaccagcccagcaccctgtactctggtgccccaagtgattacatgtgagcctcccagaaagaacaaatattgctcttgccactcctctccaatgctgacaggactgagtcctggggcaagtggatccgggaattgcattgcagacaatttcgcagtaattccctgtctggagaagcacaccagttaacactagactgtcacagccctaggagaggtaagaacaacaaagcccacattaccacgatgtcttctggtggcaagaaatctttctcccaccaccatccccttcctcccggaatcccttgccccttcctatgtatctcttctgctctcacttgaccaccttaccctgcttactcataacctcaccttgcacagtgccaacacggcctctcaag

SEQ ID NO: 181073 - DNA, 213 bp, Homo sapiens
tgatgctgaggtgatctagaggatcccgttcaatttctacacatgtaacttaagtaattaaataagaagatgtagaagagaaaaattctctgaaggatcattccaaagacatagttggaaattttgattatgtgctaatttaggtaatcttaggattttcaggagtgtggtcttatatctgtttgttcatgtttcttaagtttagaagatgaa

SEQ ID NO: 181074 - DNA, 269 bp, Homo sapiens
agtagctgggattacaggcacaccaccacacctggctaatttttgtatttttagtagagacaggttttcgccatgttggccaggttggtctcaaactcctggcctcaagtgatctgcctgcctcagcctcccagagtcctgggattataggcatgagccactgtgcccggcctggcatgtattcttaacttgtagggaaattacttcagagcacaagcctcgctcattacatgtacagactcctggccctcgtgatcatggaatggccc

SEQ ID NO: 181075 - DNA, 407 bp, Homo sapiens
cttccattatctgagtgcctacccagctctctccagagctcaaggtcctccttttcagccagaggcctaggtgaccccaactctatgagcaaaactgaacttagcatccattatcttttctcccaaatttgctgctgcttcttttttttttttttaaatagagatagggtctcactatgttgctcaaactcctaggctcaagtgatccacgttccttggtctcccacagtgctaggatcacaggcatgagtcactatgcccagccccaatttgcttctttacctgcattctgtccaggtgactcccaaactaagcatctttcttagcatgaagtccctctcagttgcctatcactaacaaacgcaaccgataagaacagtgaccatggccctgcccctagcatgaac

SEQ ID NO: 181076 - DNA, 403 bp, Homo sapiens
ttgcccctcgaagttcccaggcaagagtcagagaaaggttccctgtgtcctcctaactccatggtatggatcagacacttacatgtgcagatcctctttctcccttggctcacagcaccctggcaactctcaccaaataaatcctccttccaaatcctttctccagtcttattgtttactccttattacttgccatgtgggttttagggttgtctaactagttctcaacaataccacttggaaaatgtgtaagtactactggatgttgtcccttaattcattttaatatctgatgttcacataccttggtgtctcagttaaaatttcttattttcttatagaagcaatagcctggttctataaagacattaatgatattttttaaataaagttttaatccaga

SEQ ID NO: 181077 - DNA, 244 bp, Homo sapiens
ttaatgaaaggggaacttcatgtctctcattctcttcagtatcctgggcaactgtgttccccacaaatgcctgccatgctcttcctcatgctattcccttatctaaatttcccttcctatctgtctccattccagccctcaggtcctgaagatgtcgggcccacccatgttcctatgtgggtgctctaggttctagcactccatggtcattgcttgtgtacaagcatgtaatctcctttcatcg

SEQ ID NO: 181078 - DNA, 529 bp, Homo sapiens
agggaaaaagtctaaggaaggcttttattatttatttatttatttatttattcttcttttttgagacaaagtctcactctatcgcccaggctggagtgcaatgactcaatcatggctcactatagcctcaaccctctgagttcaagtgatcctccctcctcggcctcttgagtagtgggactacaggtgcacaccaccacgcccagctaattgctgattttttgtagagacaggctctctccatgttgcccgggctggtctcaaactcctgggatcaagtgatcctcccatctcagcctcccaaaggcctgggattacaggcatgagccactgcacccggccctgaggaagatttttaaacaataaactagcaagaggcccagtgaggtggctcacacctgtaatcaatctcagcattttggaaggccaagttgggaggcttgctccagcccaggagttcaaggttgcagtgagctatgatcatgccactgcactccagcttgggtgatatagcaagaccatgactctg

SEQ ID NO: 181079 - DNA, 109 bp, Homo sapiens
ggtggcattctttagcataaatctgttaggcattcagaacaagtctctgacttatgctttatttttgcctttaaaaaattttacttgtggacctacattccaaattgaa

SEQ ID NO: 181080 - DNA, 580 bp, Homo sapiens
ctgaaatctgaagacacgtgtgcagaaagagactttcagaaaaaattcactggagcaatatgaaagtgcaaattacaagtagtctatatgtccgtcacttgggaaatggcaatgaatattcactggactcctgccatgtttcatctaattccatagttggcaagctacagctcaaggacagaatacagcccactgttttttggtttgtttatttgttttgtagagatagggtctctccttcttgcctaggttggtctcagattcttgggctcaagcagttctcctgcctcagcttcccaaagtgctgggattacaggcttgagccactgtgcctggccagcccactgtttctgtaaacaaagtttcattggaacataacgacattcatttgtttatatataatctatagctgctttcatgatacagttgcagaattgattagctacaacataagactgtgtggccctcggtgttgaaataaaatatttactatctagccctttacagcaaaagttcactgacccccgatctaagttaaaatgtcttcaattgtaaaatgcaccgttactttatgtaccac

SEQ ID NO: 181081 - DNA, 195 bp, Homo sapiens
ttctgatgtttatatactaccttctacacttttctgtttttgcgcagctacattatttttaaagtaccaacatataaattaatgttgattcaagtgttagtatagaagctgatatttttaaatgactacatcattttgactttaacagcttttagaaagtattatgaaggtgaatcgttgttgattgtaattgtt

SEQ ID NO: 181082 - DNA, 109 bp, Homo sapiens
tgatgaggaaacagaggctcagcttacagtacaggggagatctaaagctaggacaggtgactgccgcgcccaggctcttgacctgtaggccctttcctctccagaggct

SEQ ID NO: 181083 - DNA, 366 bp, Homo sapiens
actgacaccttgactttagcccatgaaactgatttcagactctggcttccagagctgaagagcatatatttgcattgttttgaggcactgagtctgtcataatgtgttgcagcagcctaggaagctggtccacggtaggaggcagccccggggaggaatgatggtccaggctcagaagccatgcatgtcacctcccctcatgttccatgggcgagaacctggccacatggcagctcccaactccaagggaagctgggaaatgtagtagagctggacacccacatgtccacttagtaccgaggagggtgggggcgctgggtggacagctacatctccgtcacacgtgttgtattgagtcctacagcc

SEQ ID NO: 181084 - DNA, 598 bp, Homo sapiens
ctaggcaaggcctggtggtggcttggaccagggtggtggcaatggggctggagagatgtttggattctggcagattgacagtatttgctcatgggttggatatggatatcagagatgagaggagttaaggatgatttttaggattttggtatgattaactagaaggacacagttttcatttaccgattggggaagcttataggaggaacagaattgagggagaattatcttgatttggggcattctaaattctataaccaaacagagaatttgtataatcttctggacagaagagtctgaagttcagggagaggtctcggctgtagttgtcaccatatagtatttaaagccacaagactggatgagatcacagataatgagtgtagacaaagaaggtaagttatgtaaggactggatcatggaacacttctgacttaagcagttagagatatgggaaaagaaagtatttcaaggatgaggactggctggtagtactaaatgctgctggaaagtcaagtaagatgaggactgagaactgcccatttcattgagcaactggaagtcaatgaagggagagcttatcaagagccctctcact

SEQ ID NO: 181085 - DNA, 689 bp, Homo sapiens
tataaaagtgctctgtgtttcagaaactctctgtgccttctctgtcttctatggtgggattccccttaatttatcatttaatgtattatatttgaactgtgtgtttatattttttccttctacactgtgaatatagagacaagttctgatttatctttgtctccaagcagtacctggcatatggaccattatctctcaaagcaataatttcggttactgggtacagagaattctacgtagttaatagttttcagctgttcaaaaatcaggtatccagtcagtgtgttttttgactcagggacatacatattaaggcacacttattagggcaccaggtcaaggagtaacccctcccaccaccccttatctgattggaatatggccagcctattcttattcctgccaagttatttttccagacaacattttataaaacccaggtatcttgtaattgtattttactcaaaggaagtatactctaaggaaattgtgtggccttgaggtacacagccattaggcatttaaaaaatatatttaaaaagttttatggaatatttttaaattactgaaaatcagaatcacccagatttaagagatcttaatattttgctacatatttgattcatatctttttgttgtttaaagaaataaaatctcacagattcaaagggtccctccccatccccttc

SEQ ID NO: 181086 - DNA, 367 bp, Homo sapiens
agtgttgggattacaggtgtgagccaccacacctgacttaagtctatattcttttaaataaatactaattcttggtgagttatacaatgtagcatatttgggtacagtgagaatatgtgaaaattttggccagtaatgtatttttatgaactattgaatttttagagtcttgctctataccatatgtagatttcaacatcacctttagtcatggcatgttttcagtggtaaagaattaaatcatgagctacctagtcaactctaaacagtgaaacactggttacaccattttatgttaggcctttcttttgcgcttctgtttactttttttttggaatttgtgttagtctgtgtttgatagaaaatg

SEQ ID NO: 181087 - DNA, 521 bp, Homo sapiens
tttaatgtatccctgttccattaatgcatatgcatatttaatatactgcttaccaagaaaatgttttcatttaatattatgtgaacattttcccatgtcattaaatagccttataaaacaagatatttaattgatttaaattacttgatcatatgcagtatcataattgaatatcttactatcaaattttttccaatttttaatgtaataacaaatattacattgggtatccttatacataaatcttttagaccacttgtgattatttcgtggggtaaattgcccatcccaaatccccataaaattaactttctatgttatgaaaagttgcacagagcttaaccaagaagacaaggaacgccatgcttggagcactcagcattaacgaaaactgtccccacttctcctcgtatttattaatctttccgccagtgccatggaagagaagggctgctttgttcaaagtcttcaggcacacaggtagggttacatggtgatgttcccatctgcacttatttccc

SEQ ID NO: 181088 - DNA, 355 bp, Homo sapiens
tgggatattaatgctgtataattgtgtgagatcacgggagacaatcaaaaatgttccagtcctcattaattgaagtgtacattgttcgatgaaaagtgcatcataaattaaataggcttaataaaataaagtgaaattactggggagaagttgcctctgttggcaatccttagtctgaattttttttttttttttttgcctggaggtctgtttaaaaagaaatagcattacttgattggcccttcatcccaattaataattttaacttcgataaattctgatttcagagttatgactagtcacatcttagcttttccccttgctggttaattggggtgctggggttaatctaaat

SEQ ID NO: 181089 - DNA, 455 bp, Homo sapiens
acagtggcacaatcttggctcactgcaacctctgcctcccaggttcaagcaattctctcagcctcccaagtagctgggattataggcatatgccaccatgccaggctaatttttgtattttttgtagacacagggttttgccatgttggccaggctggtctcaaactcctgaccagccctccttgaccttccaaagtgctgggattataggcgtgagccattgcacctggcccagttccctgggatacatgtgttttaattcattttctgttgctagtaacagaatacctgaaactgggtaatttataaggaaaagaaatttatttcttacagtgatggaggttgagaagtccaacttcaaggcaccacatctggtgagagccttcattccgatgacagccttcatgctggtaagattttcttcagagttccaaggtggtgcacggcatcacatg

SEQ ID NO: 181090 - DNA, 113 bp, Homo sapiens
tcaaatccacaccaaggagaggttctaactcatatgtaggataacatttgtgatgaagcaacaggaatctgattcccactaaatcagtaaagttcccactgaaaaggccagtt

SEQ ID NO: 181091 - DNA, 128 bp, Homo sapiens
atataaaaatgctgagtgaactgtaaaactgaatacagatgttagtaatttaagccggtttccagctgagccagaccatctgggtttccttgctgccctccacccaaaggtctcccaaatggggcggg

SEQ ID NO: 181092 - DNA, 121 bp, Homo sapiens
ccaaatttatcatcagtggtcacctcagagcacctgaattcaggcctttaagtgcaagtaggatgcagaattctggaagagccagtaagtctgtggctccttgggtactacgctttggaag

SEQ ID NO: 181093 - DNA, 349 bp, Homo sapiens
tgatccgcttaaggagctgcgaatgagagtcaggcccagtgctgtggctcccacctctaatcccagcactttgggaggccaaggcagaaagatcacttgagctggtctcaaactcctgggctcaagtgatcctcctgcctcggcctcccaaagtcttgggattacaggtttgagccaccatgctcaactggaatcttttaatgtaagatcttttatatatatatatatatatatttatatttaaagagatggggtctcactatgttgcctaggttgtagtgcagttgctattcacagatgcaattatagtgcgcctacagcctacagcctcaaactcctgggcttaagc

SEQ ID NO: 181094 - DNA, 405 bp, Homo sapiens
gacgtatcttccttaaaagtaagaaccactcatacctaacagttcacctagcatagcccatacaccaatatttactgggtattctttcctgtcttccttatcatctcttttcttagcctctcttgctctgttggttttcttcagacttacaagcaaaatgagaaaaacgaagtctctagaagtccaggctctatgtttcatcctatttctcgtaagtttactgaggtatcaaatctaattatggcagtcgtttaataactgcaaaacaaaaatatttagagatctggcaatcctcaaattagagcttcttctgatactatctttaaccattaaaaatctatttcacatcccacagaaatatccacatctttccactttgcctaagaaaatgtgagagttgccctt

SEQ ID NO: 181095 - DNA, 116 bp, Homo sapiens
ggccagccagtggcatccaggatggatcacaccgaagttctgcagacactggctcctcggagaatggatctcctggtgtgtcaaaagtgctttccagcgattaggatgcagtgtaa

SEQ ID NO: 181096 - DNA, 185 bp, Homo sapiens
ctgaccttctgcaagtcacctctctgggggcactaccacaggaaaggcaatgtgcaagtgatgggactgcttcatccaaaggtcaatcccaagctaaatgaccctgtcattttgcaggccgaggcacaagggaggccccattcatcttccctggagtcggcatccctttgattgcggggccacct

SEQ ID NO: 181097 - DNA, 587 bp, Homo sapiens
taaggacacacataggctgaatataaaagaacggaagaaaaaatgcatgcaaatgttaaacaaaagggagcaggggtggccatatttatgtcagacaaaagagactttaagtcaaaagttgtcacaagaggtaaagaagaacattatataatgacaaatgggtcagttcactagaaacatataaacttttaaaatatatatgcacccagtttcagagcacccaagtataagaagcaaatattgaccaaactgaagggagaaatagatagcaacacattaatagtaggagatttcaaatgccactatcaacaactgatagactatcaaggcagaaaattaatatgtaaacaaaagacttgaacaacactgtaggcaaatagttctaagagacatatatgcaatgttccatccaatagcagcaaagtacacattcttctcgagaatatacagatcattctccaggatagatcacttgttaggtgataaaataagtcttaacaaatttaaaaagatcgaaataataccaagtatcttgtctgatgacaatgggatgaaactagaaatagtagcagaaggaaaactgaaaa

SEQ ID NO: 181098 - DNA, 703 bp, Homo sapiens
ggggtgttggtatattttggtgatggtaactccttgttgtagaacctaaaggcaaccacagtaaaccaaagagggctaatctttctcaggcatatgcccaggacggctacccagtcatgctgatacctgcagggagactgaggaactatctttgggaataatatcattggagggaaactgatatattttagaaaacgggataattttattgattccctttaggaaaaacgaggagaatatgggagatattaatgaatgaaatttaagttctaaatcatgattttaaataccggaatgaaattaaccaggcatggtggtgagtgcctgtagtcctagctactcaggaggctgaggtaggaggatcctttgagccgaggtgtttgaggttacagtgagctatgatcacaccactgcactccagcttaggcaacagagcaagaccttgtctcaaaacagaaacaaaaacaaaccccctccaaaactagaatgacgtatttcacttaatgtaatgtcctccaggcttatacatgctgttgcacatgacaggatctcatccctttttatagctgaatagtattccactgtgtatatataccacattttctttatccattcttccattaatgggcatttaggttgattccacatcttggctattgtgaatagtactgcaataaacatgggagtgtagatgtctctttga

SEQ ID NO: 181099 - DNA, 342 bp, Homo sapiens
ggacatccgatagcctagctaacataaagactttggtggaaataacttttaagaacctcagagaatttaaaactaagaagtagaagcaacccaaggaagcttgaaccatatggagcttgtgttggggaaagggaaagagtgaagtgaataatcttaccagcagccttgtgatagaggaagagaataaatgtaaatcaccaactgaagaaagaataaaaacaaaggactgttttagttaatagagaagaagaaacagttttcaaggccagaggccttggaagcattgaactaagtaaagtacattatactgtttttacagtttaattaaattatcagaaaaca

SEQ ID NO: 181100 - DNA, 972 bp, Homo sapiens
ccacgcgtccggaggctgggggggaagcatctacattttcacatcctgcctattcggagcagcaagctggaggtgcgagggcccagagcaaaaacacacactgagtacctggtctctgccaggaactgtgttaggcacgagggatgggccttggaggagacacaggtattgtccttgagagtttccactggtgaccttggctgtaaagaggagaaaatgcagaagttcatttcttgccaaattgctctagctagaacttctagtacaatgttgaggagatgaaacggtgaaaccacgtatccttctcttgttcctgatctttgggggaaggctttaggtctttcgccattaagtatgatgttatttgtggatttttcataaatgccctttatcagactgaagtatagcggtgcggtcacaacttgctgcaggcttgaactcctggcctcaagtgattgtcctgcctcggccttccaagtacctgggactacagatggagtctcgctctgttgcccaggctggagtgcagtggccctgatctcagctcactgcagcctccacctcctgggttcaagaaatcctcctgcttcggcctcctgagtagctgggactataggcgcccgacaccagcatgcccagataattttgatatctgtagtagagcccaggtttcatcatgttggccgggcctggtctcgaacttctgaactcgaggtggtaccagcctggcctcgagcctcccaaaagtggcgggggcatcggacgggcggtggaagccaaccaataacccggggccgcaaaatagacctgccaagtaaagacaattgcccgctgtatcagtgtgattacgaggtcacacgacacgacgcagcacagcggggtgtaggcacacatgagtcggagcacagaaacacacggggagcatgcagagcagacgaccatggacctggcgcaccacaccacaagaggctg

SEQ ID NO: 181101 - DNA, 768 bp, Homo sapiens
tggccggcatctgtagtcccagctactcgggaggctgaggcaggagaatggcgtgaacctgggagatggagctttcagtgagccgagattgtgccactgcactccagactggccgacagagcgagactccatctcaaaaaaaaatcagctgggcatggtggctcaagcctgtaatcacagctactcaagtggccacagtgagccatgatcacgccatttcactccagccttggccatagagtgagaccctgtcgcaaaaataaaaaaaaaatagctgatggttttgggagtcacacagacttggactgaagttcccatttgttctaaactcataaagtttaaaacaacctctctgagcccctggaaggtaataactactttgaaagatggctgtaaagattacaaatactatatagaatacaggtctagcctttaccagttgtttaatggtagctgttaagaataggttggtttggccggggacagtggttcacacctgtaatcccagcactttggggagctgaagtgggcagatcgcctgagatcaggagttaaggaacagcctggccaacatggtgaaaccccatctctactaaaaataaaaaattagccgggcatgatggcatgcgcctgaagtcctagctactcaggagactgaggcaggagaatcgcttgaacctgggaggcagaggttgcagtgagccaagatcacaccactgcacttcagcctggctgacagtgagactccatctcaaaaaaaaaaaaaaa

SEQ ID NO: 181102 - DNA, 415 bp, Homo sapiens
attatccgtcctatcgccaattggcagcgggttatatctttttctatatatattcgagggtatagagaaaccatatggctttcctgtatctttgataactcttgccctgtgaaacagataactgcaccacttgaaattatatttagcttttcctttcagcactcctctcttaaaatctatttttccatttctctatacctttgtattccctctctcaaggaaaaggaaatcattttccttctgctcttccaacatagcttcaccttcaccttaaattttaaaccttctagaacaggattactctaaatgattttttaaaaagcattcaagatcgtatgacatattattcaggcattaaccgcatttattgtcaaatgctactgcttctcaatccctacctctccctcactctcgc

SEQ ID NO: 181103 - DNA, 336 bp, Homo sapiens
attatccgtcctatcgccaattggcagcgggttatatctttttctatatatattcgagggtatagagaaaccatatggctttcctgtatctttgataactcttgccctgtgaaacagataactgcaccacttgaaattatatttagcttttcctttcagcactcctctcttaaaatctatttttccatttctctatacctttgtattccctctctcaaggaaaaggaaatcattttccttctgctcttccaacatagcttcaccttcaccttaaattttaaaccttctagaacaggattactctagcgattagggttataagctcctgtagagcac

SEQ ID NO: 181104 - DNA, 596 bp, Homo sapiens
ctgccctgcagctcctgctgtttacatttcactcggtgtagccataggcagagacctcagggagaacctgattcggcttggattgagtcaggttccaccccagtccagtcagttgtggactgagaggtgatgaggctgggccctttaagacaaatctgggtgggtggagtctgtgcttaatgaagttgtgatgttagctgatggcccagaagggactggtaggtgcctctcattgtctggttgggaagcattctcttaagtccaagatgatgataaatagtattaggccaggtgccgtgtcatgcctctatacccagcactttgagaggccaaggtgggaggatcgcttgagcccagaagttcaaagccagagtgggcaacataaagagaccctgtctctacaaaaaacaaacaaacaaacaaaccaaaaaaaccccacaacaattagccaggcatgatggcgcacaccagtagtcccagctactcaggaggctgaggtgggaggattgcttgagcctggcgggtcgaggttgcagcaagctgtgatcacacctctgcgctccagcctgggtgacagagtgagaccctgtctcaaa

SEQ ID NO: 181105 - DNA, 237 bp, Homo sapiens
gcgactagaggatcccgttcttgtgctgggccctttaagacaaatctgggtgggtggagtctgtgcttaatgaagttgtgatgttagctgatggcccagaagggactggtaggtgcctctcattgtctggttgggaagcattctcttaagtccaagatgatgataaatagtattaggccaggtgccgtgtcatgcctctatacccagcacaagaaacgcacgccagcacaagaacca

SEQ ID NO: 181106 - DNA, 742 bp, Homo sapiens
gtgctggaattataggcgtgagccatcatgcccagccctccttaattttttaacatgaattaataggacctggacacacacagcctcatttatatcggcagccatcacagcctgccacatgtcagatgaggtctctggggctctcactccttgcgtcgggggtgatgccacatgtggcccagctgtaggtcacattcagctcctgtgttcaccaggatcagatggaatgccagcacatcttaccctcctgcgccctgggagtttgtaataatctacgaatacgtagatttatttcagagaacattttccgaatcctgttgcgcatacgcacaaaaatattggctgcagtgtgtttataaccatgaaaattccaaaatagcttcaatctcctgtgagaggggagtggtggaaggccctccagcacgtgcacagaattctttcttcagccatgtaaacatgaaaataagggttaaaaatgacttcattatggggaaaagggacaggatgcaaattgttcaaatggcatgatgatattataaggaaagaaaaagatgttataaaaggtcacataaagtcacccacaggtcagcagtcatgtcatgattagctgctctgtgccagacacaggctggaaattggtagatgctctccccaggaagtgggcagcagcccctttgtgcctctgtcacctctgttaggctcctggaagcccccttcattgctgcatgtaatgacatcttcg

SEQ ID NO: 181107 - DNA, 721 bp, Homo sapiens
ggttttaaatgagacagtgctgatttttaaaggcaacctaccagaatggaggttgttgattattgattctcctttttcactgcagaatattagtacagctgttttgagtttgttttgtgcttaataaaccttacatcaattttgcagttcctagggaacttggaaaactagggatagatcatcatttttgttatcagtagccacaacttttttctcctcagtgtcgttggggtttcttttttttcccctcaccgctagatgttttgaccgaacattatgttcagtctgttctttgctacccttctcctgtcccatcatgcatgactgtgttctttcttgtttttttccttctactcttcaacagctgcccctgacaaatgtgctaaaaataacaagtagacttacatatatggagagattgggtacatgagacatagtagctttagggcagcactctgggcttctaggaaacaaggacaggaaaagtcagtgagattgtaatatgcacttatttttagcgtcttaatagtgctttcctgaaatactcctccttagtgtttggcttatacaacatatatcacgtttgctgaaagcatgatgattctttttcatatcttttgaaataaaatgtatttcaccttaggaattgaagtttcagagcaaagtcgttccttagtgccacgtaaaacatcatatgcagaagctgatcgaaagctgcttt

SEQ ID NO: 181108 - DNA, 151 bp, Homo sapiens
ttggcacacctgacagtgagaggagagagggagaataggactcaaaacattgcagtcgggggccacctagcattggtacaattagttccatctagggtagcctctgccatttaaaaatatactcagtgaagtgaagttggaaagcttgtaa

SEQ ID NO: 181109 - DNA, 787 bp, Homo sapiens
tgccagccaggctggtctggtcaccactgcaatgaatcctgccctgttggctactatggcgatggctgccagctgccttgcacctgtcagaatggcgccgactgccacagcatcactgggggctgcacttgtgctccgggcttcatgggagaggtctgtgccgtttcctgtgcagcagggacctatggccccaactgctcgtccatctgtagctgtaacaatggtggcacctgctccccagtagatggctcctgtacctgcaaggaagggtggcagggcctggactgcaccctgccatgtcccagtgggacgtggggcctgaactgcaacgagagctgcacctgtgccaatggggcagcctgcagccccatagacggctcctgctcctgcactcctggctggctgggagacacctgtgagctgccttgcccggatggcacatttgggctgaactgcagtgaacactgtgactgcagccatgctgatggatgtgaccccgtcacaggccactgctgctgcctggccggatggacaggcatccgctgtgacagcacgtgtccacctggccgctggggccccaactgctctgtctcctgcagctgtgagaatggaggctcctgctccccagaggatgggagctgcgagtgtgcccctggcttccgaggacccttatgccagagaatctgcccccctgggttctatggccacggctgcgcccagccatgccccctctgcgtgcacagcagcaggccctgccaccacatcagcggcatctgtgagtgcctcc

SEQ ID NO: 181110 - DNA, 105 bp, Homo sapiens
acttctagtacaatgttcagtagggatggtgagaggggatatcctttccttttttctgaccttagggggaaagtactcagtctctcacttataagtatgatgtta

SEQ ID NO: 181111 - DNA, 703 bp, Homo sapiens
tgtactttagctagaactttttgtagttcttgttcagcttaaccagctaaaatataaagaatacaattgtaacaggattttcttgaacagcttattaataataggagcccagttaattctgcatggaaagttggacttagatatctgtttgaatatgataatatttagagtatataaaaatgacccaaatctaccaaatctagagacgaaagctgcaaatgtctgagatgcaaaatacactggataggattaatggccaattagacattgcagaagaaaagttagtgaacttgaaggcccagcaatggaagcttttcccctgaagtctgttatccttctactaaggaggaatggtgtatctcttattcagttggtatatcctagatatctgtcgtgcacacgtgtgtgtgtttcctaaaaacagtgaagacaagagtcttccttttggttcatttcatcactcttgcctaaaagcactgcctcaagttgtcaggactcattcattcctaagactggaagtgtttataaggaaatataaatgtttgagggtattatacctttgactgcttaggactgtttttgtgggatgaatagtgagtatactggtatattgcttcctgcttttaggatctgctttggtgaaagcacttaagactctcttgataaacactgaatatttgttgaccttgtttatctaatgagg

SEQ ID NO: 181112 - DNA, 201 bp, Homo sapiens
aactgggacacagcaaactgtagcacttaaatgactatggttttcccctatggacatcatttggaggagagagggaagtgacaactaaagttttgagaactgaagagaatcatgtaattccacatcttcgattttactgctgagagaaggagaatggatcaaggccaccctgctgattaagagcagagtcaggagaggatt

SEQ ID NO: 181113 - DNA, 714 bp, Homo sapiens
aataacaaaaaaatatcaagtgggaaggtgaggcagcttgggcaatgtatgggcatgaggctatggtggtgcaggaataacagccagtctgggtagccacagaagcacccagaaggaagtggctttggagccggtgtaggacacaggaggcagcatggacaggctaggctgggatggggccagctaagctgggagacagcaggctgactggggcaggtgtcagtgctgaaggaaccctgagaactcaaacctctatgttccaaagacccccatctccatacctcaagttcaagggctgggtacaagatccagacctcaaaacccccataagtgctgtcttctgacctcccactgtgatcctgaaagtgtgagcagagattcagccctctggggcagtggaccccatcctcaggcactgcagcaccatgctgagagtgttatcaggaccagtggtgagcatcaggcctctccatggacagaccgcacccagtgggcctctagcagcccactcttgtgccagagagaagcacagaaaattcacttccaggaatacctggagagcacacaggcctagcctcttatccaagtcccctgggctacaaagcaactcccatcctggcatgtcttgaagcacgtactactgtgacttgctgcacagtgagcagaccctgaattctgaaatcacaatttttcctacacacaaaaaaggacaat

SEQ ID NO: 181114 - DNA, 597 bp, Homo sapiens
ggggcgtgagggaggggtgtcaagtaccagtggaggcacggggaggggtcctgccctgcacctcagtttcaggggagggctctgcaggctgacagcagctgggtgacagcaggaagcagctgtggtcagcagccactcagggctggcatccatcctattgtctcactgaaactcatgacagtgggaggtgaaggtgacccccagatagtccccagagccagtgctacatgggaagccctgccctcctggggacagggggatggtcttgggggatgagagtcccactaaggagctgagcccttcctgctcctaagcccgcagcttccctgctcgcctacagccggcgagtgcagcacaggaggccaccgtagtgccatagagcgtgcacctaggcgtgcgtgccagtgagctcagtgggacggttcggcaggaacacggcttgaacccacaccaaggctggactcggcacaggccagagggaagccccacaggcctagctgagggacacaaaaagaacaaacgcaccccccgcgccacagtggaaagtccccagaagcagcagtttctacggcacagcagtgaccactcccgtgccac

SEQ ID NO: 181115 - DNA, 343 bp, Homo sapiens
gttgagcacagggaaaagttactgaaactagattgtccaggtgaaggcaggagccttctgccacatccattcacataatgcttatctcagctcttcctcgtttggaaagaccccagggccccaagcctcatacctgctctcgtggttccaaaacttgcagactcccaggttgtagcccaggcaaaccatacaaagatgggtctcccaaaacttaaaagatgtgaaacaagaagtggtttcttggattctcaagcggttgagaatccgagctcaggaggtcaaagtgggcttggtggctagacgccaggcaccagcaccagctgggtacccttgagtggttttt

SEQ ID NO: 181116 - DNA, 348 bp, Homo sapiens
tgaaggatctccactctctaggcacagcctcggtaacaccgattacagctcacaactggacaagcagggaaagcccagcactttggaaggccgaggtgagaggattgcttgaagccaggagttggagaccaccctgggcaacataggtagaccctgcctttaaaatagtaataaaaataacagttgtggtggtgcacacctgtagttctagctgtttgggaggctgaagcaggaagctcgcttgagcctagtaattgttacagtgagctataattgtgccactgtactccatcctggaagacacagcaagactccatctctccaaaaattaacaaacaataaatatat

SEQ ID NO: 181117 - DNA, 653 bp, Homo sapiens
taggccgtggcagccgaggagggaaatcaggaactgactcgccctgcaggagcctgccagagcccctctctccccggggcagaaggaactggggtgcaagggaacgtggcagagccatgtgcccccaccgccttgttgcacatggaggaaaccaatgccccacaccagaagctccatgccagaagcagaattggagccgggtcttctgcctcctaatcctgcgctctctgacccacatcaggggtgatgagaaacaccaacagccgagagttaaactaagagtataaaacttgggtgccgcggattcatggatgcccaggcctgcgctctgctggccgggggctgaggcttcctccctttcctcttagtattcatcggcacacctcagtcctccctgcccttctcctgggccacaattctccccaagaaatcaccccattcaaaccttgcattgtgaacccaattctttcttccacggaaacacttcctgacccttaggaatgatggcagaggaccctaggtaccacccttcagcccaacgcttgaaaggcgcccagcatcctagcagcccctccctgcagggcctcctgttcacagtagatgttagcagcttttgtcctgaaccctcaacagtgcccgtgactaacggtgag

SEQ ID NO: 181118 - DNA, 550 bp, Homo sapiens
ggtgtgagagcacacccctcagccatgctgtcatgcctgaatctgatggacattgacagagtccaagagccaatgtggcagggcctgtcctggaacgcatgcaaattgattcatggaatatgggctatggatagaaatttagctataaggtggttagaattatgtacagagatatgggtttgcttgataatttagacattgttaacaccctcacagtctctcttctgctgactattcctgtgtggttgtgtaaataatggcttggaaagaagaatgagtagctacctgtgaaataaaccatcagttagatagatcgacagtttgtgtactgatttattaggaaaggtttaacaggccaggccctaatattttttacagcaaatattgatctattagaattacagccagagaagtctgagttcaggtagttcctgcaggagcagtcagaattggtgctcttatttcaaggcagagagaagggaggtctgctaataatagctctaatagcattgtgctaacattgtctttacccctcaaatgctgggtttgc

SEQ ID NO: 181119 - DNA, 465 bp, Homo sapiens
cccaaacacttcttaatctgataaacaactttagcaaagttccaggatacaaaatcaatatataaaaatcagtagcattcctatacaccaaaaacatctaagctgagagccaaatcaagaatagaatccattcacaattactgcaaaaagaataaaatacctgggaatacagctaaccagggaggtgaaagatctctgcaaggagaactacaaaacactggtcaaagaaatcatagatgacacaaacaaatggaaaaacattccatgctcatggataggaagaatgagtattgttcaacacacaaataattcaggctttagaaggagctggaagagagaagacatggatggacgtggggctcacacccattaggaggctaaggcagtagtagttggggtggcagaatattcagtagtacactaagactgcctcatgcttagtactgcagtagtactacagaatgc

SEQ ID NO: 181120 - DNA, 883 bp, Homo sapiens
cttatcttttttattcatctaatttcaagtaaatatgtaaaaggtaaaattgtttttccatctactacctaaaatcatcttgtatatcttcagtgctatgtatttttcacaatgggaagcagtgagataaagaagtaaagaaaatgggaagagaagcaacaaacaactgcttaattgatagttctttgaaagcaagggtaaactggcagaagaaaggagttaatgaacaggagaaatgttcattaatatggtctgtgtttgagaccatatatgaaagtgggttcttagggaacatttaacgacgacatctttcaagatcaagtctgggaagaagaaagggaccaataggatgaaaaacccccagttggcaggagtagcaataactttaccaacatttgtaggttgtcaacataaaattaccaaggttaagtaaaagcttaaataaggccgggtgcagtggctcacgcctgtaatcacaactttgggaggccagggcaggtggatcacaaggtcaggagttcgagatcatcctggctaacatggtgaaatcctgtttctactaaaatacaaaaaaaaaaaaaaaaaaaaaaaaattagccgggcgtggtggtgcatgcctgtagtaccagctactcgggaggctgaggcacgggaatcacttgaacccaggaggtggaggttgcagtaagcccagactgcgccactgcagtccaggcgtggcgacagagtgagactctgtctaaaaaaaaacaacaacaaagcttaaataaaaccagcagctactttttgctatttcttttatatagtgatactctttcttgtgaatttcctcttcctcttcctcctctccttctcctcctcctcctccccctcctccttcttc

SEQ ID NO: 181121 - DNA, 802 bp, Homo sapiens
gttgatttggctgacttagaacaaattaataatgatcttaaacaaacttaagggactataccatagactcaagcagtaatagcagcactcataaatagactccaacgtgggtaaattcagagatctgatggtttccttaaaaaaatattacaaaaagttaagtgatttattagtctcccatttgctccagctggaggattttgatctgaagaaggaagaattccccaagtattctagaaggaacttacttcactgaactgcaggttaaactgtggaaatcttacttctttgcactgaatttaaactcctgacaaagcgttgcttaacaggctggggttggaggattagggagaggctgttgaataattattcatagtagtcagtgaaactggaatagaagcaatgtattttatcactagttgaaaatataaattaaatcaaggaaaattctttatagctgaaaattgttacaagatggctgcagctggagggaaaatacatgtgcccaccaaagcgagtaaatttaagatgaagatcctctttggaagagataactgaaatgtaattcctcaattcagtaggtggaataacaaaagagaacaagtaaaattgcaacagaaatcagaatataacagggtacccataagcaacaattataatgaagacagtgaagaatctctccgacccttgcttgttttcagtgctgtcaatgcaaagattaggcagtgtgctgtttcctacacaacaattcttttagaagaacctcactgcaacacttctagaaaaagtggtgataggactg

SEQ ID NO: 181122 - DNA, 201 bp, Homo sapiens
tcaaccatgatttatggttcaatcatcttttcctgaaacaggactatataggcaccaaaattgtggcttttttagaaacactgtgcaagtaattcttgccatgtctctatagttgttgggtttcattattatgttatgaataggtgaagctaagaataatagtttatgctgtaatagtttatgctgtaatagtttatgctg

SEQ ID NO: 181123 - DNA, 205 bp, Homo sapiens
ccttcctttacccaggggatatatcgagagcatcatctctcaggaggaggtgagatttttaagttgatccaaagggaccatgggttttaaatgtttcagaaatatttttatatgtcattcctcagaggtatattcccagcagaataaaggaatgtaaagaattgtggtgtctatcatatagtagtgcaggagaaacagcaaagta

SEQ ID NO: 181124 - DNA, 182 bp, Homo sapiens
attcagctatttgttctattcctcaaagaattcctgtatcaacaaagagcttcgtaagagaaggcctgaatatgaaaggcgggaactctgtctctttagggctctaagcttttcttgaaaggaagaaaaaaataaatagtcaaacttcagattatgaattgtgcttgctgatactactatta

SEQ ID NO: 181125 - DNA, 276 bp, Homo sapiens
caccccggcaacatccattcgaagagcttatccgtacctcccctcctttatccccaaggtcactgggtcagagctcacggagtcattcacaacacgatgtttaacactgagaggctctggaagtgctccttcaagactcagaagaagacccattgctgagacaatcgtgttctctctctctctctggatcaccgcccagagacaaggacttccggagaccctggcttccccggctgctgcctctcattcctgcacctgtgggatgagagttcgaag

SEQ ID NO: 181126 - DNA, 645 bp, Homo sapiens
gtgtgctctcttgctcttctgctttctgccatggaatgactcagcaagaaggccctcaccagatgcactcttcttgaccttggacttcccagtttccggaactgcctaatctggtcagctgctgtgagctgcaggagaaggagaaaggttcgcttgggagcactgctgaggaactgatggcagtacgagatggagctaagattggaactgaggtctggctataaagctgcctttatgtccatcgcatcctaagggctgctgttgctcttctgcctctacactgatggactacgtcagaacatcaatatgctgtattgatgataatggatgatattttcttagttgtgccaatattactcttgagggaagaaatgatgccaagccaggccaactcctactcctcatctgattcagcccagtgatgagctctgtcaagaagacctccaagatcagccccctctatgctctcatagtcccctctgctgattcctattaagtcctgttcttgccagtgagacgcctgctccagctttgccttccaccatgagtaaaggctccctaaggcctcccaagaaacagatgccaccatgcttcctgtacagcctgcagaaccatgagccaattaaacctcttctctttataaat

SEQ ID NO: 181127 - DNA, 125 bp, Homo sapiens
ttaagttattttgtttgttttatatttatttttgaaaggacagaaaaagaattaaccaaattgcggagatggattggggtaagggaagatgtgatcttttaaaacttttaatgatgtataattcg

SEQ ID NO: 181128 - DNA, 570 bp, Homo sapiens
gcggattattccccctggctcaggaatcatccaccaggtgaatttggaatatttggcaagagtggtatttgatcaggatggatattattacccagacagcctcgtgggcacagactcgcacactaccatgattgatggcttgggcattcttggttggggtgtcggtggtattgaagcagaagctgtcatgctgggtcagccaatcagtatggtgcttcctcaggtgattggctacaggctgatggggaagccccaccctctggtaacatccactgacatcgtgctcaccattaccaagcacctccgccaggttggggtagtgggcaaatttgtcgagttcttcgggcctggagtagcccagttgtccattgctgaccgagctacgattgctaacatgtgtccagagtacggagcaactgctgcctttttcccagttgatgaagttagtatcacgtacctggtgcaaacaggtcgtgatgaagaaaaattaaagtatattaaaaaatatcttcaggctgtaggaatgtttcgagatttcaatgacccttctcaagacccagacttcaccca

SEQ ID NO: 181129 - DNA, 592 bp, Homo sapiens
gcacccggtgaaactgccttgagtacttgacataagtcagcttggtcttctaaagagggcaggttacttttcatcaactcctttttacacctcaggacactgagactcacagggcggtattgaatttccccttgtcactattagccagcgacaggatggggcctggaactcggtgtcctgctgactccttctgggggcttttgcttggtttaatagctttgggaaagagcacctcagtatttgtgtgtctgtagtttcctcttttaaaactggagtggggcagtgtcacgctgtgactcgttaaaccaaatcaggatgagagtgcctccggggaattgtgtccttgtgcacattaacgcccctcacataggtgtggcgtcaataggaagtggtgagtcaggggagagggggttccgtggactagaaaaaactctccttcgacttctatttagttctcagaaggggataggtgatgttgatccaataatggactaagagccaggagaagggctccgcgggaggatctcttgagctcagcagttcaagaccagccggggcaacatggtgaaacaccgtcttaaaaacattttgt

SEQ ID NO: 181130 - DNA, 648 bp, Homo sapiens
agtgctgggacactgaacggcctgagcggcaagggaggccccctttctgccaggctcactgctgcacttttagtccctgatggagagaaaagaatgtccatattccccaaaccgttccatgcgggaattttgcacttgcagttttctttggttggagaagcactctaggaagaggatctcagaaggtggcaagttacaatttggggctcccaatgggagtgaggagctgactgagtcagcccttcccacaaggcctcctttctggtagtgtgtattgaggagggagatggcccgctctgccctggtataacccaaacctcagggctgaggccagagatgtgggttgagcccttcttgctaactagtttttagctgagactggatttgtatggccggggttggggacagacaacaggacatgcaggctttttcttttgacctcctgggttttctgcctggcactgcaattgggagggaggcagtgaggagccacaactgaaagaggggtgtggagatccccaaagctctgttgcagacacagcgggtgcctgcgaaaactttagtgatgccagaaaaccgtcctggatgaggctgcagagcgggtaagctgcttaggtggtttggtgctcagagagggctgtgtatgcc

SEQ ID NO: 181131 - DNA, 315 bp, Homo sapiens
acttttttgacactgccacatttttgttctattaccctttcaaatacttcttacctacttcccatttgtggctcctccttaatcccacactctcaatcacacagatttctaatcaattttgtttcttccttcttctttgtaccccttgtgcaatcagtccccaagtcctgaagtgtacttcaggggagaagagacacatttaacttgccatgttgtcatctagtattcaatttgaacatctcagtctcttttcaggtgcctaagatgttctagaaatatactctggaaaacttcgagtcagatattaaaatcagg

SEQ ID NO: 181132 - DNA, 1138 bp, Homo sapiens
agaaacaaccaagattgccgggagcctccagaagctaggaagaggcaaaaaagaattcgcctacaggtttcagagggagcacatctgccaacactttaattttggacttctgacctccagaactttgagacagtacatttcttttatttttattccctagccccctgcagtttatgggactttactatggcagcctcagaaaactaatactcattttatgaatctgaatgctcattttcagaaacttttaaataacttaaaagaagaaatgcaaatggccaactaaggaacaactggtgcatcttaatggtaatcaggaacttgcaagatagtaccacagtgaggtactattaactgccaccagattggcaaaaactagaagaatctggcagactcaaatgttgtcagggatattgcataatgggaactctcattcactgctggattatgaattgttggaaccactggaaaactgtttgctattgtatccattaaaggttggataggagaagcaaaagcaatgtgggagaaaccaagtaaaattctacaagaaggtagcaagttagaggtctgagaaaaatctctaaccaggttccaccaaggtggtggataagtcagtggaaagctggatctctgcctaaagtcacggtaggatgagaagtagaaacgagcaaaaacaggctagagtgcacatctatctgacctcatcccacactgacaggtgccttgcagaagaaactgctggtacacttttccagagagttgcacacattcctggcctggaagttggaagagcagaggcaggagcgtgggctgctcactgtcccacttaacccaacaagttggcagattcacagcaacctgagaaagccaagggcacgggccccatgttagcctgtttagcataatgactgttactaaacttctaccttctaaatcctgtgtagatttgtctgtgatcaagccattacccagaaccaggtcagacagagaacctgggaaatagttttagcttagctgcattgacacaggatgaaaccaccatagttcaccccattgtgatcttgacatctatacatggctctttaaatcatatgtaacttccaaataaagaccctagtagattaaaaaaaaaaaa

SEQ ID NO: 181133 - DNA, 739 bp, Homo sapiens
aaggtgatctagaggatcccggtatacataacttggttccatgctttgttggtataaatatttaagaaatatttgttgattgaatgaataataaataaatgaatggcttccttgtgtttcctgccttctttaccagggttatttgccttcaactttcactggaccctctatgtatcaggcatggtcttaaattctcttcacacattattcagttgagggtagtcccatctaccatatctccatagaatcggtcccaagcctggtacttagaactgccctgcattgtcaggctccccctttgccaggtggtgcctccctaatctgaaatcatggactgagtaccttcaaaagaaaaattaaaccaaagatcaggaggagatgcttctgacttagtgagtctagaagaccctggcctcccttgcccactctgcccagaaactgaatcccagagagatgaagttatgggtttcatacctgtgtctgcccatcaacccaagggggacaaatgccaacatagaatgacagagagggaaggaagaaagtgtttttcctaattaattggctctaaaagtggagaggaaccaagttgggttattatagaagcatcagcgtccgacacaggtcttcaactgccatgcaaataccccctactctgcaccatgcagttcccatggtttactttgttgtgatgtaactgtgcatgtttctacctgacccattgacacggctttgtgcgtga

SEQ ID NO: 181134 - DNA, 860 bp, Homo sapiens
tctctgtctctagctctagctctcactctcactctctcctggtcaccctgtctagctcctcaccttcctttctccccttcctgggagtctcctgacctctggccaccaatatttgtgtatggaacagataaaggatataggattgctaatctaggccaatccactggtgagtggaggaggagcagggggaggggattatactgaaaggagccctgtctttggggagaaagagagagtagggtggacgctggcctggcacgactcccctccacatacccacacaggtcagggtgtgtgtgtgtgtgtgagtttggtctggagctggacgggctgactgtctcagacaagttacttaacctctctgtgcatcactttttctaactatgagatgaggataatacattccaaaaatgcagtgtggatttaaggtgagaatgcacgtaagttgcttagcatggtatattgtaagggctcaataaatggcagcttttatcatcactccagactcttgtcctttctccggggtccttctggagccaggacagctgcatcttccaatcccctcctcctgccactgcttctccattcttgggggcccaaattgcctctcagttcctggacccatcccccttgcctggctcccagggctactcactatggtgtccccgtgtaggggatgaggctgggatcctgccctctgcccacaaggtctggagggacacacttcttcagtttagggtctgtttttcccttctctgcaggcctcagaggggaggaaaggggacagccataaatgatgtaggggaagcgtacttgctgagggggacaataagggatgagcagcgtccagaaacctaaat

SEQ ID NO: 181135 - DNA, 405 bp, Homo sapiens
cgatcacgtaacaacgtgtatgtacttaacactactgaaccgaacaacggttaaaatggtaaattttatgttatgtgttttctaagattagaagagttctggagattaatcacataacaacgtgtatgtacttaacaccactgaacctaacagtggttaaaatggtaaattttatgttatgtgtattttactacaatttttttaaaaaaaagaacttaagggaggacaaacatttcagtggcattgatagaaattagttagacaaaagagtctttttgctttacggctaattaaacattacaaggtactgctgaagggggctctggttttgctaaaagggaaatacaataatttatgagatttttgtgcagctgatctcaaatataaaaacgaggtttgtggtcc

SEQ ID NO: 181136 - DNA, 320 bp, Homo sapiens
aaaaaattagtatttcagtggtagtctgtagaaaaacctacaacttttgcattttcctgagacaaagaagtagcagaggagacattctctctctctgtttttttttgtttgttttttgtttttgtttgtttgtttttttctgagacagttttttgctcttgttgcccaggctggagtacagtggtgcaatcttggctcactgcaacctccacctcctgggttcaagtgattctcctgcctcagcctcctaagtagctgagattacaagcacacgccaccacgcctggctaatttttgtatttttagtagagatggggttt

SEQ ID NO: 181137 - DNA, 571 bp, Homo sapiens
tggctggtttcattcccctcctgtcatggtcagcccgtctgatcctaacaatgtaagctaagtcctctccccaccaacggaagcatctgccatcagtcttgctgccctgagcctggcaccagagttcactccagctgtagccttcctccccatctggctctccaggttcatgttctagacttttccttctttctaagttgtcttttttgttcccttcagattctccctcctggggtctgaagctctgctctgctccccagatctcttggctgtggttcagagaccctgtttggaattgcacagccctgctccttcagcctggacacctgtccccttaagtttttggctgggcatcttgtttccaacctagtctctttaaaccccctctattcaggctctcagtcccacctctattaattcacaggacagttgattgtttaaaagggcatagaacacttcccctctcttttgctccctctcatgtgaaatgctggctctctaatatggtttggctgtgtccctacccaaatctcatcttgaattgtagctcccataatatgagaggaccctg

SEQ ID NO: 181138 - DNA, 152 bp, Homo sapiens
ccaggtagtgaacacagtactcgatacataggtttcaatcttcattctcctcccacccttcaccctcaagtagactctggtgtctattgtttctctctcaatgtccacaagtcctcagtgtttagctcccacttttgagtgataacgtgggg

SEQ ID NO: 181139 - DNA, 434 bp, Homo sapiens
tcggagtgtaagaggagtgcagagtgctctccgcagctagtaattagtggacagatgagatgtaaatgaagatttaatattcagtcttaccaactttcagggtgagggggtgatactgagaatggggtgatcaaacttcttaggactgtagaaattttatatttattatatccaaatagcttaaaaatgaatgcaaataagaaataggggaggctttatgagactgtaggttcttgtgcttcacagctaatgggcagaataccattgggaaaacctgaaggatttatctccatagcaaaacaaagcaaggcaatattcagcagagtatttctctgaaataagaagtataagaagtctaaggctttctgtgtttgttatgaggcctctataggtagacagagacacagcaggggaatatctaagatgaaccaggt

SEQ ID NO: 181140 - DNA, 308 bp, Homo sapiens
acataaaaaaaaaaaagagagaggacaaataatcaagagttccaattaataactaatttttaaggcctttgggaaaaaaatttaaatattattgttaagacttttttgccccagcagtttcctttccaagtcatactgaacactccttccaatctatttatggacataaagtggacatagggattatgataccacatctcttgcttgaaatcttccaaaagttgaggcactgttacctacaaaatcaaatccaaaattactttgagaattcaaaggatcccttagatctagttcctctttgagtactc

SEQ ID NO: 181141 - DNA, 563 bp, Homo sapiens
cgcagcggctcacgcctgtaatcccagcactttgggaggcgaaggcaggcagatcacctgaggtcgggagttcgagaccagtctgaccaacatggtgaaactccatctctactaaaaatacaaaattagccaggcgtggtggtgcatgcctgtaatccccgctactcgggaggctgaggaaggagaatcacttgaaccgggaaggtggaggttgcagtgtgccaagatcgcgccatggcactccagcctaggcaacgagggtgaaccaggtccaggaagaaggtgcaaagacagcattccaggtaaaagaaacagcttgaacaaaaagtgtgtaggggaaccgcaagcggtcttgagtgctgagggtacaatcatccttggggaagtactagaagaaagaatgataaacagaggccagtttgttaaaaacactcaaaattaaagctaggagtttggacttgtggcaggaatgaaatccttagacctgtgctgtccaatatggtagccaccaggcacatgcagccactgagcacttgaaatgtggatagtctgaattgagatgt

SEQ ID NO: 181142 - DNA, 415 bp, Homo sapiens
aaccccctcccgtccctccatctccaccttctctgtgcttgggtgcaccctgtggatacagccggcctgagggaccgcagactcgtcgggctgctttctgatgagaggattaacaaacaattgccggctgcgaccattttgcaggacaggcatcttctgcgcgcaggccacgtcgggcctgcccgggctctggctgcctggaagtgctcccgctgttcaccccgcggaattaggggttggggggcagttccccgcaaatggtaagatgaagaggcctgagcagtttcgtggaggggaagaaacaggaaaacctcttcaaaagacaaaaagctggcactgcattctctctctgtagcaggacagaactgtctaaagacaagacccctttggccaaaataaaggaacctgaaacatt

SEQ ID NO: 181143 - DNA, 923 bp, Homo sapiens
cccaaggttgttatatcttcatgtcctcatttcttagggaggtaccttcagaaccaatagtgacccctaacttctctggtggtcggttccatgaaaggcaaaggagtgtgagagaggagtggatggtcaacctcccactgccatggtaacatgggtgctggctgatgggagcagaaaataatttagtgaaagtctgtgggggcagtcacaagatgtctgagaaaactggcgagccagctgctgaaaacagggacaaggaagcctccgtggctggagcccaaatcacactgcagacccagacaccgtgaccaccaccatggactccagagagagcagcttatagtactcaatcagctgccactaccaccatccagaacaccagatgttgtagccatggctgcagcaggaatggatgtcccactgtccctgctcctcggtgtgacttgctcccaagttcagggcaggtccatctgattggctgagtctggaatgtctgcctgtgcctcagctgtgagggaggcagggaaagtaagccttttcagcttctgtcgtgggaggtgggctctgcctcctaccaagaatcaaagggtggaggatcttcaaacacaggaaaagaacccggatcctggcacccccaaattttcagagtccatttcagagcataagaaattgagggtccaagatcattcatgtaagaagtttagagggggaagaaaagaatgataaacgaaaagaacagcaatagtaaaggatcttttctttgtttcagtaagatgaagaggcctgagcagtttcgtggaggggaagaaacaggaaaacctcttcaaaagacaaaaagctggcactgcattctctctctgtagcaggacagaactgtctaaagacaagacccctttggccaaaataaaggaacctgaaacatt

SEQ ID NO: 181144 - DNA, 225 bp, Homo sapiens
cggcagctatccggttcaatgggtgtgaggagtcagttatatgttagggattgtttaggtagtgggggcaagctatccggttcaatgaacaaggacaggaggaagagcagagccgggcactgtggtgcctgcctgtccctaggcgggacgaccgtcagctgtcggggctgagccggtcgggaaggaaacaggatatgaggaccttcattcatcccttacatttct

SEQ ID NO: 181145 - DNA, 195 bp, Homo sapiens
cgctggagccttctctaattccctgaaactattatttttctcccttttctgaattcttcgatacacactcaccaagcgttctggttatttatgtttatgtcatcttgcttgcttgactatgagcttcttgcaggcaggggatacatctgactgaaactcttacccctaatacctggaactccaccactgcctttg

SEQ ID NO: 181146 - DNA, 102 bp, Homo sapiens
atgtaattgtgctattgagattgtgggaggtaaatatggaatcagggaaatagaatgggctgataatgtgttttcctaaagaacagatgggattggccgtgc

SEQ ID NO: 181147 - DNA, 410 bp, Homo sapiens
cataatcacattattttcaggataggggaacagagagagacccagaggaataaagtattttgggcaagatcacacgatagatataagaaaagcagagaagaataaaggatcttcagaggccaagaaacagcataagcagtgctggatgcagaatattcaccagcaccacctagcgcacaggatgcagggcagggtggaatatgatggtgcccgcccagccacagccagcagggggacgggccatcccggaagcacttaagcagcacgcactgtggtgtggtggacgcagaagccaactgaaagttagtcatctcacagtgaccttgtgcttgttaggctagacgaggtccctgtgagatggccaagccacatctgcacaagggcctggcctgggatgaggacaaagcagg

SEQ ID NO: 181148 - DNA, 237 bp, Homo sapiens
cattcaagaaagaaagtctaaagactataatgggcgtacctgttgctaaatttgtaaggtttcatttctaaatcaaattagagcattaaaaagcaacttaattggagtacttttctttaactctcccacaaatggctttgctcagctatatttcattattgtgcttttagctttcactaaggccatacaaaaacatcacaccttctggtaacacatgcacacacaaatatagataca

SEQ ID NO: 181149 - DNA, 519 bp, Homo sapiens
ccagtcacgattactcaagtgatctgcctgctttggcctcccaaagtgctgggattagaggcgtgagccactgcacctggccttgaaatatctatcttaatatatcctgcatcatttcacgcagtgtgaccggcgctagaaagttcttgtaggggcaggaatgctgtctgggtgtcaggggtagggacttcatcatttctctagatctagggacagttggacttgagagaggggtctcatctgaatttcagtcagtctactttcttcttctgaagcttcccctttaaagaggcttttggtattaaatgtttgctactgtatcaatggacttttaggatcacagaatccaaaggcagtatggaacaagagagcttaaaaattagagtatgagaccctgctgtgccagtcgtgtggcttagaagtcctgaccttgagcgaataactgtccctctatgaggctgtctctgcatctgttaaatggggataaataatacttgctttacttgccttttaggatta

SEQ ID NO: 181150 - DNA, 768 bp, Homo sapiens
gcttttaacatgtataacaaatattaaaaatgtatgctatgacaatacggttcattgttatggtttctttaggttcatttcactttcatggatttacaagcactgtaaatcttgggcctgttatctttgcacattttcttgtgcccattttcatctaaggagaaattaaggagtagagaaaggatgtaagtctccttaaggctactcagaattataaacagtaagaaatagaagttctatagcaagattcttaaactgttgaataaaatcttcctttcctataaaaagactgttctgagtatccatacaagtatcatttataaccacaggcagggtatgtatgggctttgatttcaggtgctgtgttttgctgaagtctgctaacagcctctacatcaaattcataatgatattaaaatctatggttcttagaaaaagaatggttgagaatgtgttacaaaagcaatttgtctcatcatgttaatgttgatgccctcttatcccagaacctggctgaagctggagtcaaaatctatattggtttaattttaagtggccttgtgaacaagtgcattcaggcaatgaaggaactgaaagctacttagaccacccaggctcctggttgtggactctcggatggggctgggcattgttaaaggaggttgaacctacatgcttaaagtttctgtgaaggaggagttgaatttttaggacaatgtcagttgcttttattgtaatcatggtgacaaactgaatttattaatgagc

SEQ ID NO: 181151 - DNA, 175 bp, Homo sapiens
caaaaagaaaggacactggaaggatgagtgttcagaaggcaatgagggaaatagccaagaccacgagacaaagaggccatcggccaaggctgccgcaccttggggaaccaaatactgatctgatcaggctggcaggagccgaaggacgtaaggaacaggacagaccgggaacctt

SEQ ID NO: 181152 - DNA, 362 bp, Homo sapiens
tggaaggctgcagtgcaagtggttttcgtggtaactgcattttgcagggagtgtcctgaggcacagtgctttcagtctctgtggaaaacactaacagctagatctggggtatccaatcttttggcttccctaggccacactggaagaagaagaattgtcttgggccacacataaaatgcacgaatatgatagctgatgagctaaaaaaaaaaaattgcaaaaaaatctcatcatattttaaggtttacaaatttatgttgggccacattcaaagctgcccttggcccgcgggttggacaggctcaatctagatgtttatgtgactatgacatgcaggcagcctgcccagtttgttttaaagt

SEQ ID NO: 181153 - DNA, 567 bp, Homo sapiens
ttcctccccgttgcaacagcagttttgagtagttgcaacagagacgtatggcctacaaaacctaaaatatttaccacctggcccactgcactccagcctgggagacagagtgagactctgtctcaaaaaaagaaaaaagaaaaaagcagttaggcctgctgtgttagctttttctgcatagaggcctacaccaaatatgacttatttatcatgttacttttcctgtttggagaatcaatgaaagaatgagaatgcttaattcctgagaaaagtagatgcatgctctttagaaggaaaaagatacagaaagaaggtgaaagccgcttaagacaaattgtagctcttcacagtttcattcattattgaagatctttagctgagcttggcttatcctcagagttctctgagaatgtgcttctcaaagtggaaattgtttagcatatggggtggtgaaaaggactgaagaactttggtaataaaaaccaaagcagcaggaaggaagtggtctgattagaaccaagtgcttgagcagggaaagacagcgtaagaaagagactgaagctgctg

SEQ ID NO: 181154 - DNA, 334 bp, Homo sapiens
agagtcacacacccttatgaaggtgtattcgtatatgacagaactaagaattctgaaaactactacttgctaccatatggcaaattaccaaggctccgaacatctgtcatgtatttcaaaaatgattcactaaatattaatcccattacatgctaatgaaatatccctagttgccaagtaattttcaaaaatgcaccaactaattaaagaccaaatcacatatttgactaaaggacacgtttcatttaactcttagctggacactttcattgaactctggattgcccagtaaccaaatgtaagatgacattgtgtatggtgaccaggccgaact

SEQ ID NO: 181155 - DNA, 293 bp, Homo sapiens
accttggcacggttcttctagtcctataagtgccccgggcctgcgagccccgcgttttgttagtaccgccccctattcctgttagcccgccctctagtctaatatggatcgccacttctgtctgggtccctgatgttgttagtgtgagtaaaggcccttgttttgcaagggtctctaaattggtcagggcccctttaacctgttaaggttgcttggtcctgttaaagccctccgttcttgttaggactcctcgattgcctgggtccccaatcctgtcagggcccccatttccc

SEQ ID NO: 181156 - DNA, 185 bp, Homo sapiens
caaatattttgaagcttctgcttacctcagtaatttaaaaaacattttaaaatcaataatctcttctcttttctcacttacttgaaaatagacacttgattttctccatagggaattaaagaggctattgaaagcaagtggggcagacactcgcttgagcaggaaccactgcatgctaaatgcat

SEQ ID NO: 181157 - DNA, 311 bp, Homo sapiens
ttttgttccaagccagttttcttctctgttacagctaaggcatgagaaagaatagactaccagcttatttgacttttgataagttcatgaagcagcaatagccactttcaggtcataatccattcttttctctctgtttagttgctatagtttatttttttgccttgcaaatatgggataaatgtggctactaacattcaaatattcagacaagtttcttgacaaaatcagagaggtgttttttgcctgttgtttcttttggtttgttttctttagaatactggacatttgctctaagttatctgtcatgt

SEQ ID NO: 181158 - DNA, 411 bp, Homo sapiens
cacagtgagaccctgtcaatcaatatgggcatgcacctggccctacaaaaatacgcctggttacttggggtagtgagtagcttctcggtcctccccattccccactgtcctctccattccccactgtcctctggggagttcttcttgtcctccctgggcaaaaccttgacccttgcttctgctttacgctcatttcggtctcatgaaaaaccatttcgctgatgcaaaactctgctttcaacctaaacataatcaaacatttccactttttttctttttttttgagatggagtttcactcttgttgcccaggctggagtgcaatggcgcgatcttggctcaccacaacatccgcctcccaggttcaagcgattctcctgcctcagcctcccgagtagctgggactacaggc

SEQ ID NO: 181159 - DNA, 354 bp, Homo sapiens
cgatcaggttctctccttttctgtgtgcccgacaccatgatacccaggaactcggactgccgctagactcaggacaaacaacaaagctggggatgctcacttatcatcccctgggaagggaggcctgagagctggtactggttggccaagttcctggcagagggccttggtttctctggcagggaagaagtcaccatacgtctccaggcactggttagcttgctgcctccaaaggagttaactgtgttcttcactagaggactcaggtgtcaagcatgctggcaaggtactggctgccacctgaaacctccagaaagctacattgttcttttccaggttctgaaagagagagta

SEQ ID NO: 181160 - DNA, 402 bp, Homo sapiens
  misc_feature (52)..(52): n is a, c, g, or t
  misc_feature (55)..(55): n is a, c, g, or t
ggagttttattaatgaattaggaatttcagaggccacttctttctgcccttnccncacccacccctcctcctgccccagtcccagccaacactgtttttctcctggatggtcacatcatcctgactccctgcttttgctcttcttgccctgcagtctgctctaacatatctgtcaaagtaacttcgttagtaaaatttaggttacattatgtcatgtctctgtacaaaacccataaataactcctcttcccattcagtgcgaaatcccacattctctctctgtttttttttttttgtttgagacggagtcttgttctgtcacccaggctggagtgcagtgagccgtgatcacgccactgcattccaacctgggcaacagagtgagaccgtgggggaaaaaaa

SEQ ID NO: 181161 - DNA, 969 bp, Homo sapiens
aatttaaattgaatatgtatttttatgttatagtggaaagaagatgaacggggagtcagacagcttcatattaaaattctggtcctacctcttactcacttataaaatatgggcagtcttccttaggcttgttgtgaggattagtgataatgtatgtgtagtgtaagtgtataacatgatagaggaacttaggaaaagatagctgtaattcctttgtaatcggccccagaaacacacatttctctacttagtttgtacttactaaatcccatatgtctattcatttgtatttatatgtttatccttctttaaagtatttgatatattggtacaacttattgctgagattaagttatctgtccacacttgtattagggttgcctggcttatcttataaattcagaagcattcaagctgagtttttaatttttccatttggtgctaaatagaatactggataattataattcagctttctaaaacgtagcatttttaaagtaatacatgtgcatagtttaaaaagcaatttattactaaaagccttatcaaaataatattttgatttttggccttcatacaggctgttgaaaagagcagataaaggatggaaaaaaggaatggaaagggagaggtatttcggcagcactggttctttgtgtgccaacggcttaaaacctttttttttttttttttcctttgagacctatatgattgatagaaagctattatgtgtccattgacagagcttagaaaaaaaaatgtcttcatgaaagccaggaggataaagtaggtatataaatctagagaaagcttaaacagcggttgttgttgttattctaattttgccttgtttttccttttctcattattactccttctcagttagcattgcctttggcagctttcccaaggaaagtaaaagttgtcaagtgaatataaattaaaatgcctggtgatggaaaatggagt

SEQ ID NO: 181162 - DNA, 348 bp, Homo sapiens
caaggctgagaatttttaaaatgacaaggatatcatacctcagaaccaacccctgccaaaatactacaggataaatatagagaaaaccaaaccaagttatattaagtaacaattgctgaaaaccaaaagaaaagagaaaatctcataaccaaccagaggaaaaaagatcaattgccttcaagggggaggatgatttaagacaaaaacaacaacaatccagaagtcatcggaatggttttttgttttcttttcgagacggagtctcgctctgtcgcccaggctggaatgtggtggcgcaatctccgctcactgcaagctcttcctcccaggttcactccattctcctgc

SEQ ID NO: 181163 - DNA, 537 bp, Homo sapiens
gcaagagtgaacttgaacttcactcagtgcaagagtgaacacacactttgtgccggctttaaagaacccagcacaaagccagtctgcatggcctagagacatattttgctggacaatgattacttgtttttctttttgtttttcttgtatttgcctgtttgattggttcctgacataccagaaaatcactgtgaaaacattagcttaacatttgttaaggaaacaaaaagacttcggtgaccacaccttataaaccaaacagttttgtaaatcactttggaaaatttcactaaaaaaaaaaaaatccttcacaatataataagtaaagaaaatttaaaaccacaaaacattactgtgtttgtaggggggggttctgatttacagagtaaccacatagtaattataattattagaatgtccagttttcaaaaacgttacaaggcatacaaagaatgggaaagtgtggctcattcaaaggaccaaaataaattgacagaaaatatccctaaggaaacccagacatcaaacttaccagac

SEQ ID NO: 181164 - DNA, 560 bp, Homo sapiens
gccctagacttctttctccaggctcccgttgtgtggcttggctgcccactacctcattcccatcaatggacaatggctgggagagaaagcctccgtgactgtatcacggaacagtctccactccaggttatggatccactgttgggcagttctacactgctcacatccggatgccgattctgccagcaaatccatctgattctatctctctctccggtctgtctaactctaggttctgcacatgtctaacatgtggttgtgtgagtgccagagtgcaagctcttgggaggcaggggacacatttattgatgttgtatcaccaacatttagtacatgcctgctaaaaagttactgtcaacatatttgttgaacaatgattactggatgggtggatgaaacatcaatatgacttgcccaagggcagttatgaatgtctccaaaactatttcaggggtaattcatgaacatgtcctctgaggattcttcttccatctctaagtcagttcctatgatatgactacctcagggcaagaaagtcactgtgtccctgctacaacaaa

SEQ ID NO: 181165 - DNA, 284 bp, Homo sapiens
ctgagcaacaagagtgaaactccgtctcaaaaagaaaaaatgagtgacacttgattcttaccttaaaaggagcctgagagctaatagtgtaaaatgtgcaaactaataattgattataatacattaaggtaaatgcataataaatttttacataaagatcaaagtaggagagagtaattaactttgaaggaggttagtaaagacctcacagaggggaggtaacaggaactttaaggatgaatggtgatttgcagatgataagcagtgacatggggcaaaaaagc

SEQ ID NO: 181166 - DNA, 265 bp, Homo sapiens
gactcatgcaccataattggaagcaccaccctagcaatatcaaccattaaccttctctctacacttatcatcttcacaccaggcattccgaaccaaataaacaccttcatgttagccagacttcctgaaactatcgcacactaaaatctattcattggcctttcaataaacagttcttgagcacctactaataatagccaatcttgatgagggcttaccacggccaggctcttatgtaaacctcataacatcttgatgaggcagg

SEQ ID NO: 181167 - DNA, 815 bp, Homo sapiens
gctccaagcaggtgccttaaatgaatggtattgggtatatcatgggttttaataaagagtggtaggaactgtggcaaattgaagagtacatgctctaaggtatccacttgttagttctagtatattgttggcatgaaggagtgtagactttgaattgctgatcttctgatttcttttcaaaaagaagccagaagtctggaatttttaaattgtgaattttctttattttaaaatgttgatgaacaatttaaattttaaaaatgtgtatacttagggataaatctgataaaaataatgaaataataaacttaatgaaataattaaatgaaaatattggccgggtgcagtggctcacgcctgtaatcccagcactttgggaggccgaggcgggcagatcacttgaggttaggagttcaagaccagcctggcccacgtggcgaaaccccatctctactaaaaatacaacaattagctgggcatggtggtggccatctgtaattccagctactcgggaggctgaggcaggagaatcacttgaactgaggagacagaggttgcagtgagctgagattatgccattgtactccagcctgggtgacagaaccctgtctcaaaagagaaaaaaaaaaaaaagaaaagaaaatataggaccttttacactgaaaattataaaacattgccaagagaagttaaagaagacctaaataagtggagatataccatctgcatgatttgaaagacccaatattgttaagctgtccagtcttccccaaataatctaaagattgtgtcttccccaaaatctcagcaggact

SEQ ID NO: 181168 - DNA, 508 bp, Homo sapiens
agcatgttaaaatatgtggtctgaagttccctatcactctcgatttgcccaccagccgggtctgcggtgcccgtgcaaacgctgcagctaggatataggggggaggaggggcgggagaatgacaaagttctaaatgcagcagtctgagccctggaatatctttgctttcagcacataaactttccagtcctggctgcctagccattttattcctgcattcacatttcgactcttcaaaatcatatcttgcagtatcgcaggggccagtacattgccccagagcgcaccaaacctggtataaacccagaaagggaaacaaaaatggatgtgtgctcaggaaaaagggggaaaaaaaccgtgtccagaaaatgtccggccgcacacatttcctggcgaacatttggaatctatagctttaggaaaaaccgatctgggacgcgctagtccccaggaactgatgcccccaccctcgggggattgccggcttctccgcaccctggggcggccg

SEQ ID NO: 181169 - DNA, 850 bp, Homo sapiens
agacaagaagcctcagaatgacagtaaagagtcataggtttgaacttacccttctgcagatcccggacaagatcccagaaatgacacaggattccttcagtgccactttgtcaggcaaaaatccctgtggccactgtgacctctgtccagggcttctcttggacccactgggctcactctgcccgcttggcccagcaggctgtgctcagctcacacccacttggatcctgtgcccaccacagctccacacttagcccgtggctgagccaggcatgctgcgagtggcttccacattgggtgccagcatgtagaagaggagaacgtggtggcatccaaaaactcagaaatgtcagcaattgcagcaccccaaggagtgttatagcttttgcttggggagtcccattatctgggccctcagaagtgtcacggctcttcactcctgtagctctgcaagtgggagcatgttacgagctcttttatttctgccactcacagcttggtgaacagggatgtgttacagctctcttgttcccacagtccagttcttgtcccatgactaagaggaatgaggtatgtggacaatggagagcaagtaaggcagaatagaagtttattgagtcaaagaggaaaagctctcaactgcaaaaggggaccaaaagtgggtagccgtctgtgaggctgattgcagggtttttatatgtttggaatgaggaggtgtaggctataggtagccttggaaaagggaatattcgatcggttaaaaagcattattcagaaagaaccaatcagtaaagagtgggcaaacaggaatagaagttttcactctggtcatggactctattcagaactg

SEQ ID NO: 181170 - DNA, 269 bp, Homo sapiens
ccagcgtggatgctgaggcccaggaggtgctgagagtgagtgagggctgctagcatgttgtcacctttcactaagacatggtggttgtggtgaacaatgctgctaagatatggttgtacaaatgtctcttggagtcctggttttcagttcttcagggtgtagaaccacaagtaaagttgcggggtcatagagtaattctgtgtttaattttgtgtgtgtgtttagttttttgagaaactgacatactgtttttcacaccattttatatt

SEQ ID NO: 181171 - DNA, 294 bp, Homo sapiens
agaagcttttcctagagtaatggaaatattctcaatgtggttttggatggtggctccgcagggtctgcagtggacacactcgctgacctcatgcaatccggcgactctgctgcagatgctgggactcgtgggcccccaccgtcgggggagccggtccccataaactctgccgtcgcgggggccggtccccgtaaactccaccgtcgcgggagccagtgtctgtaaactccaccatcgcgggggccggtccccgtaaactccaccgtcgcgggggccggtgtccgtaaactccac

SEQ ID NO: 181172 - DNA, 554 bp, Homo sapiens
taatcagacctgggaagacagacacactatgcagagatctcaagtgatggcataagtccatcatgctacggcaaggtcttctgacctcagcattgttcacatttggggccaagtaattctccactgtggtagtgggggtggcgtcctatgcattggaggatattgagcggcatccctaggctccactcacgagctgccagtagcatccctcccacaagttgtggcaattaaaaatgtcctccaggccaggcaaggtggcacatgcctgtagtcctagctacttgggaggctgaggcaggagaatcacttgaacctgggaggcagaggttgcagtgagccgagatcacaccactgcactccagcctgggccatagaccaagactccatttcaaaaaaaaagaaaagaaataccatgtcaggcaaaaaggcattcctttgtttatttctttagcgaacatgtactgaatactcacagtgagtaagggaaagtccttaccttgatggatttttgcgcataagtaaatcgacagatattgtaaggtcaggttgtggtc

SEQ ID NO: 181173 - DNA, 757 bp, Homo sapiens
gaaggaatgtaaaagtagctagggcttatcgtggtatcatagcattatagggtatgagacctttggggaaactgaggctcacaaaggctgataactttacctagagtcagtgactgctaatggcagactcctagcgtctgtacttttccacacttacccgttcatatgaaatagtctgggaaggtctcttttaaaatgtatcgtgacctctcctataaacctcaaggttacatatgttaaagaaatgtagtcggctttcctcatgtgccgaattctgaatcaagcttacccaaacccccaaatcatttccacagagcagaggaaaaaaacaaaacaaaacaaaacaaaacaggcaaatgtgaatcatgggaacctattataatgatatatagcttgtcataacacattataatattacagcaaatgtatttaactcactgaacgttctcagggggctcttagctccctttaaaagtgttctccaaatctctgcagcaagatggagctgcctagtccacctcacttttgaccaaaccaccgttacgagaatacctattgaaaacccttacactgttgctgtttccctgggcttaaaagtatgtttggttttgtcagtacctggaaacaggaagttgagatttgaggagaaatctttggcagttgtgcactaagcttgcgggagttaggagtctgttgccacggaaaccacactgctgcctcatttattaatggaggcttggtgaacttccggagatac

SEQ ID NO: 181174 - DNA, 249 bp, Homo sapiens
tcggtcctgcaagcgtagtacccaataacacaatttttggaaaaacaacaaaatctatctagtagatatggacatgctggaccagcctgacaaggctgcaccaccagcactgcctgtggtctcatccttgggcaagacctgctaggctaccaggacagggttgactgtagatagagacaattgagaacttcccagatgccaggactacagtctgaactgccttgggtactacgctttggcagtcctttt

SEQ ID NO: 181175 - DNA, 270 bp, Homo sapiens
ccctgaggattcccaggtcttttcccctcaaataaaaaccaaaagaaaagacctaatcttaaaactactatgtaaggcttcaagggctctaatctgcacccagtacctgggacacttagggcaagtacactgataataaaacaaaatttaaattgaataccatgctcatcaataatgaatattcaccatcaacttatgattccaactacatgtgtgctacattcagaggtagccaaagtaaattttaaattctgagggttttgttttccg

SEQ ID NO: 181176 - DNA, 334 bp, Homo sapiens
atttccatttgaggatgcttatcctatcctcaccgcaatgatggttggaaattgtgtctctgcattgaactgcacctaagcagtaagcagaagagctgtactccagatacttgtgtcaggggatataacggaactctctgcctctatcaaagctcagaggaggattgcctgagggaatagctgtacctccattcatttagtacatccatttcgaagtctatccttgggttatccagcttagtgagacctataaatctgtaccatatcatatcaaccgccacttattaccctttactgaattacactttgatatttctactagtggcctatgtat

SEQ ID NO: 181177 - DNA, 721 bp, Homo sapiens
tattcaatttccaaaccaaatttcaagagccccctcgtcttcctccccttcccccgttacctctatgaactgaactctgcatttgttacctaatgcaagtctgttaaaatgggccattcgtcaccagggttaagtttgccagtggtaaatgtcgttcctgtaggttactccacagacagaacataattagtactgaggtcctgagagtggctgttagtatacatagattcagggataaaacttgttcgtgttttcagggtttctgtaggattattgcttcacaactggttgacagatggtggggttatgcattgaaattcaattctaaaaatgctgtccctttctttgttattcttttatatgacatctttggtagactgtgttttcatctgaaacatggcgttttaaaaaatgaaattgggcatgttcctttcggcagaattgtgcttaatagttggtgaggtttctatgggcgatgtggaaaacctacagcggcacagaaacgtatttactgttttcatgaggctgagactaaaagaaaggtagttaaacagaattctgcatctgtgagccatacttccttatgttttaatgtcagtccactcactttttttgcacagaataaatgacaagaaactgcacatggtcctggttttgctttgcatcattatttatggacatttagagattaagtagtgaaatcttcaacctccctgtggtt

SEQ ID NO: 181178 - DNA, 196 bp, Homo sapiens
cattctacccgaacaacaaataaaaggctgaagagactaaaattaaccactcttttagatccacaggagagtgaggtcacaggcaagctgcctcccccagttgtacagacagacaggcaaatacaggaagtcctgacttaactggagcaggctcagtagtggaaaggactgcaggaacaagtgttggggtagaaaa

SEQ ID NO: 181179 - DNA, 363 bp, Homo sapiens
caaggtctcacagctgaggtaaagctcacatgcatcacatctccttctcatggtatctggatgcccataaaatagagtctaaactcttgattgtgatgtaaaggctctcaatatgatccagtcctaccattccatccacttgacctccagtgaccaccattgcacttatgcctgagtgccattgaaattgctgttgcttctgtctggaataccttctccaacccttgtatgccctcataatttctctctgtttgcttcttcaaagctcagatcaaatatcacttcttttgagaaaaagataccactgcgtcatttcaaccgttcttgccaggtgaaattaatgtaattgactgaatgattgtg

SEQ ID NO: 181180 - DNA, 136 bp, Homo sapiens
agaggagaccgggggtgaaggaggtggggaggaggtgaaggaggtggggcaggtggctctgctgtgagaggaggaggtgagcaacccccttgaaggtttctttctcaaaatgtggacctctggcatcctggtatgt

SEQ ID NO: 181181 - DNA, 634 bp, Homo sapiens
ggcgactctagagttcccctcgaattcgacgtttcccctaatatttttaatgagtagaccttaaatcttaccttataacttaagattaatatatagcctcttattgctgacatgttttgtccatatgtgtatgtatattgtccttttaccaatacatctcaattggtgataatgatttttgtgtcaataaagataattactgttgtatgttttccaatataaaggaaaaacaaggagcctataataataattcaagaaaactcaattaactatttcgtgcatacctggtttctgtacccaggactccaaagtcttatgtgaagaagatgtcgaggttgggtgtggtggctcaaacctgtaatcccagcactttgggaggccgaggtgggtggatcacgaggtcaggagttcgagaccagcctggccaacatagtgaaaccccatctctactaaaaatacaaaacttagctgggcatggtggcgggtgcctgtagacccagctactgaggaggctgaggcaggagaatcacttgaacctagtaggtggggttgcagtgagccattgcactccagcatcggtgacagagcaagactccatctcaaaaaaaaaaaaaagaagaagaagatgtccaag

SEQ ID NO: 181182 - DNA, 614 bp, Homo sapiens
gacctcatgatctgcctgcctaccttggcctcccaaagtgctgggattacaggcgtgagccaccgcgcctggcctaatttttatatttttagtagagatggggtttcaccatgttgttcaggctggtctcgaactcccgacttcaggtgatccgcccgcctcggcctcccaaagtgctgggattacaggcgtgagcccctcactgcgcctggtccaaagtaggtacattttcaagaaaagttacataaaccaggcgcggtggctcacgtctgtaatcccagcactttgggaggccgaggcgggcggattgcgaagtcaggagatcaagaccacagtgaaaccccgtctctactaaaaatacaaaaaattatccaggcgcggtggcgggaggctgtagtcccagctactcgggaggctgaggcgggagaatggcgtgaacccaggaggcggagcttgcagtgagctgagatcatgccactgcactccagcctgggcgacagagggagactccgtctcaaaaaaaaataaataaatagaaaagttacataaaaagaaaaggaaggtattttcattaatatttaattaacaagaaaatgcagttaaccataactttg

SEQ ID NO: 181183 - DNA, 597 bp, Homo sapiens
cagtgcagcctcgtgttcaagtgatcgtcccacctcagcccctgaagtagctgggactacatgtgcgcaccaccatgaccggcttgttttttgtagagacagggtttcatggcattgccctggctagtctttaacttctgggctcaaatgatctgctctccttggcctcccaaagtgctgggattacagacgtaagccactatgctgggccaccaagatactatttatttccctgaatatgacgtggactgttcctgtaggctggtcccttcacctcaggaccctctttgctggtattgtttggggcttctgcgcctgtatatggggatgggacctgaccctgctgatctggccagcactgccagggtttcctgttgcccatctctcggtaaaacatcccttataaacctttgcaaggaaaaacctctgttttcttccctccatcccatttttccttaatgtgctaccctcgtctgtattcataggaactttatttaacacttgagaactgagagtaattgacatttctttcttggctgtccttcattctgtgcacccagacctattgctttttctaccacattctttttctctttt

SEQ ID NO: 181184 - DNA, 586 bp, Homo sapiens
gattaagggatttattatagaaattggtccttcctcaaatagtagaggagctggcggaagtaaaggtcttgaaggaaagtgagaggattagagaaagtttcaccagaagttcttgcgtagggttgggcaggtcagaactgcaggatgctgatgagggaccatagcagggaacggatgaaacattccaaaagctgctgctgcctctgtgtctgtggagttccaaaccctgtggtctgcagccatgtgtctggtgctgggtggagcccttgctgctcaacagggccgcttgttaggaagaaacagggatcagagcagaagaaagcaaagacaagctggaccccattgggcacctgccgttgtccatcatggtgtttccatcaaccttatgagagtggtggcctgttttcaggttcactttccaagtctcattaagctccccatatggctagccgtaccccaggaccatagcgggaagggtattccattaaatgagagttcctggcttaccaagttgacagttgtatgattcagtgtactctacaaataaggacaacatccttaggactatactgccgtgagccgctgg

SEQ ID NO: 181185 - DNA, 667 bp, Homo sapiens
attgtgatccgctatcactagctctgcgacgtttctccatctctccccctcttcttgggcatccctgtaccctgagagacaaaaatgttgaagattagaccaactaataaccctacagtggcccctaattgttcaagtgaaattaagagtcaaaattcttcaaaattaggaatgtcatcattaatgaggaaggcatgttgaaagccccaagacaggctgaaaactagatctcttgtgtcaaacagccaaaatatgaaggcaaagttttagagggaaattaaaagtgctactccagtgaatacacaaatgataagaaagtgaaacagttttattgatgatagggatagagttgagtggtctggataaaagatcaaaccaccccccaatattcccttaagccaaagcataatccagagcaaggccctgactctcttcaattctctgaagactgaaagaggcgagggaggtgcagaagaaaagttggaagctagcagaagtagggtaatgaggtttaagaagcagtcgtcggcacatatttctgtgtattcaaccctataaagtgaatacgtatttagcactttgtaatatataaaactatggctattacaatatgcggaacacatgcaaaatataaccgtactctattttaacttcataagagagatgc

SEQ ID NO: 181186 - DNA, 215 bp, Homo sapiens
tatagtatctacacatgttaaattattttaatttgacattttatttttgcaatgaaaatttatggtctaccacattcatgcatttcctaatctgatcaagaagttaagttccaactattaactcatggaataattaacttggaaaaagctcatcaaactgtaagcaatggttgattctaattctttcttcactttcaaaagcactggcatgtcag

SEQ ID NO: 181187 - DNA, 428 bp, Homo sapiens
gataaataatcccaaagatgaagcagggagggaaaaagaaaatcaacacagaagcccagatcctcccgcagcagctgtagagaaattaacgttgtcagttactgaacaaaggcaagacccactcacaagcctggttaaacaatacagaggaaaatgacaaaacgtgattcccacgaatcaacacgctcctgtctgggcaaacgagctttgagaatccctttttggatcccaaaaaggagaaggcaaagttacctgtcagcttaatggcctgtttccaaaattacactcttatttttctgtgggtggtgggagttaaaaaaaaggaagccctgttccaaccacaaaagcaggatcgcgggtatcgtagcagatggaacggtagaagccacctacgctgggtgagcccccggatgatccctgccaccact

SEQ ID NO: 181188 - DNA, 377 bp, Homo sapiens
ctggaatcccatactctactgactggaatgcaaatggcaaagacattttgaaaaacaccatgggactgtaggaagtcaagcattcgcttcccatacaacaacacagcaaaccctctcctaacttattcaagagaaacaaaaacaaaagacctgtactcaaatgttcagtagctttgctcataacagccaaaaactggaaataactcaaatgcctaccaactgggtaaactggatgtaataagtactcacaaagtgatctcagttctaaaggtatttttaaaaatcacttctgaacaagattaatgaagacttcatagataaaaataacacctgaggctaggtgccgtagctcataactgtaatcccagcactttggg

SEQ ID NO: 181189 - DNA, 612 bp, Homo sapiens
  misc_feature (557)..(557): n is a, c, g, or t
  misc_feature (564)..(564): n is a, c, g, or t
  misc_feature (590)..(590): n is a, c, g, or t
agagctccttgacattatcattattataattattactgttactgttaaatattttactgggaataggaaaatctaagcaatttttgaaggctttactgagtgagaaaaaaatacttattctttctccatagttctatacattttaaattttaatattctttagttgattattgctaagaccttgaaacacccttttccccttcaaatctctgttaatcttcaagttaaaattttctgtttatatgcattcttgaaagtatatgtattcacttcctattacagtatcaattaccacaaatttagtggcctaacacaaaagaaattcttatcttacagttctggaggtcagaaatccaaaatcaatctcaatgggttaaaatcaaggtgtcagcaggactgttacccttctggaggctctagggaagaagtctgttttgaaaattcctttctgtctcttcttcaggctgcccatattccttggctcctggctctgtatcacttcaacatctaacatcatcacatctccttttctgactctctttttttttttggcaccncgatccnttccttcctttaaagaaacatttttncctttaccccagataaatcttg

SEQ ID NO: 181190 - DNA, 162 bp, Homo sapiens
ttaacttcttatatgtactaatgaaaacctaaaataaggatatttcacttaaccagagaggccagaaaagtgatatttgaactgagttttgaagaattactggaggttaaggaggaagaaagtgtgttttaggcatagaaaacaacattttcgaaaagttcg

SEQ ID NO: 181191 - DNA, 711 bp, Homo sapiens
gccatttcggtggtgcctgttcttaatcctttaataaattattttgaatgattttttaaaaggcagtgtgattgtgaggtgagtttagtacaaattaaaaaatgtcacatcagttgcaaacagacagcacataattatgagctaaacactgtttcagaaacagtagtgacaataaataggattcggtataattagtcctcctgggacagatctcttcctctgttctttgccatatattttaataatgagattagccatctaatgccaatataaccagactgtagtattaatacacagaaaaattattgctagtaacagaagatttaaagacatgagggtgatccggattatatgcctgcaggttaaaaaaaaaaaatgtttcttaaactctctttatcaatatccttttcgtgagccactgaattcttttgtttttctgatcatatgaataacccgtcttaagtatgaatattgtgacaatagtaatagcaattactttaagagaatatgtttctatagagataacagaggggtttttccctaccattcctgtatgaaggtttctgtgtttttaattaaaattttaagaaattcatctttgtcttagcataataaaataaacctcactagacaatcaggacaccttgttattcttagatacattattatagctcaagaaataacaaatgttaagcctggaggatttgtatt

SEQ ID NO: 181192 - DNA, 454 bp, Homo sapiens
gtatgtgttggcatgtgtatgtgtgtacacgtgggttgggagaggcagaaaccaaagggaagacagggtttccagagaggcagcagcagccctggcttctccccttgagtgtccaggctgctggaacaaatattccattacctactgtgtgttaagcactgctcctgtccttgaactcacaggaagacaaaaacaagacagttaggttcaagcaatatttccaggtgccagcattgttctaggcactggggatacaaaaagacacattccttgccctccaccaaggtcagacacgacacacccctggagtcggtggcacttcagtgagtagagccctgtacagggcacccaggaagagctgtgctcaagaccagaaatcgtggagaaaggcatagttgaccctgtcctgggcagcaaaccctttgagaggggccacatcccctaccctgccctg

SEQ ID NO: 181193 - DNA, 134 bp, Homo sapiens
agaagtctttcaaaaagaagatgtatatgaaaattgtatatgtacatgtacacacatagattcccaagagaggatctgcaaagatacacaccaaattgttaaccatagttactgctggtgtgagggaagttcag

SEQ ID NO: 181194 - DNA, 260 bp, Homo sapiens
tgggagtttgcaaggggaggggacattgcaggcaggtggaacagcatgctgagttctgggggctagtgatagcaaaacagagacagaaggtaaaagaaggtatgggtgaggcatgctcagaagctttgactaggtctgcaagcagttgaagggtttaaagtagggaagtgacatgatcagatttatgtttaattttttttccaactctttatttcataaaatagagtaagtgttcctaagtttaggtttagaagttgata

SEQ ID NO: 181195 - DNA, 675 bp, Homo sapiens
cgtccgccgttggggcccccagcccgcgcgcgtgaagcagctagccgaccaagccccggaaggcgagtgccggagggggcgggacagctcctccggggccagcgggcaccaggcttgggggctgaggcccagcggcccgagaccaactgggctgaccgaggccgcctccccgccagccctggggtccactgcccggggagcagctcccttccgaggtcagactcgggcttcatcctctcttgccgcgcgccgagcggttttcaactctcactgctagaattcctccaaccacccaggatagcaggaccgagatacatggccacccatgacccggagcgtccacttccagggacaggcagtggtgattggcttcggttgtcatctgtgccatctgtccatggttcgagaagctgctgttcacgttttggggaggatcatggtttgagggctcccgtggtagaatttggggagctctcataggcagaaggctgagaaaagttggtgctgtgggaagtcaactggcagccgatggagtcgggacccgggaggaatggaaagggaacccagataggaagctactgcagtaggctcagagaggtgatgacggcagggctaagacagcggccttgggcggtgactgggaagaacgttgaacaccgtgtttgggctgaagaa

SEQ ID NO: 181196 - DNA, 332 bp, Homo sapiens
ccactgttgtgctttcttggctgtgattaaggtaggtgttactatgtgtaagagagtcacgtatagttttatgatgttatgtatgcttaattatgtggtttataaattaagttttgtaattctgtttggaaatcactaaacagtttttaaagttcagttcaaaaaaatttctatgtccgctaacgaaattgtctatcttgtttttctatgccgagcttttgttttctgtggctaaaaacatgtggaagaaaatgttatattccatgcttgggaagatgccatgttttagtcgacctgaaaaataaaacatatgtctagatggttatgtgtcc

SEQ ID NO: 181197 - DNA, 350 bp, Homo sapiens
agggagtaagttctatcaagagaaaagtccaaaaagagtcaagattatagagggtaaaaaaaaaagaaaagaaaaaaaaagaaagtaaataagaagaaaaaaatgaaaaggcaggggagatagaagaaaaatgaaaagaaaaagagaaaaaaaaaaacagaaagggaagtgcaaaataaagataagacttgctaccaacagtttctctgatggaatgggtactcattccatcatggctatggctacagcaggaatctagataaacattttctatttcacatgactgaatttgaaaaacaacagcatatacatacatcagagactttcagacaatagagcaactacccccg

SEQ ID NO: 181198 - DNA, 778 bp, Homo sapiens
aacgtgaccagttttcccacgtgagacgggtctaggtgtagtcttaaatctatgtttacattgccaggatatacaaatccctcggagaaagaacaggagtgctttaagatttttcagtataaattttactgttagttagcatatagtttgtcaaaatattttaatgaaatcagtgactttttaaattgaatataaaagtgtcaaaataaatgtaaatatgacgtagcttgcatagtgagagacagacctctaagaagcagtaaaatttaataatagcaattttcaccagtgtttttcatgccctgtggttatctgtagcatatatttagagtatatgtatgtgggcaagggttggggccaggaattaaagacctacacaacaaaatacatgatactgaatttggagaactggtcacaacatgccaaagaaaatagaagagaactaggaactggacattgtatttcataactgaaatgatgagaaagaactggaaaattgccagccttttaaccttttagaaatagctatgtgtgtagttagtacaggagatcattttcttagagcagtttgttctaaattcaaatatgtcagcagacttagtggaattcaaagtattttagaaataaaacatctaatgttggaaataagagagcacaatatcataaaaacagaggtagtttaacaaagtttttagattgtccaagagtttatcaaacccattatctattatggtaaagtctcgctgagtaggatgtttttaacttaggctactccaaa

SEQ ID NO: 181199 - DNA, 384 bp, Homo sapiens
  misc_feature (181)..(181): n is a, c, g, or t
aattatctcatccatttaatagcaggttgaattaagtgtttcctgacctcttacctgtctttcccaatgactctgattttcttgggaagggttttgagcagagagatgacatgttggtagtggtcttacgagtttcactttgacagaatgtgtaggatgtgttggaagggtgctacacccnttttaaacaaccagatctcctgagaactcactatcatgagaacagcaagggggaaatccgcccgatgatccagtcgcctgccaccaggcccttcctctaacattgtggattacaatttgacatgagatttgggcaaggacataaatccaaaccatatcaaaggggataaaccagatgaatgcagagaaaccgtcgaattcgag

SEQ ID NO: 181200 - DNA, 598 bp, Homo sapiens
  misc_feature (395)..(395): n is a, c, g, or t
aattatctcatccatttaatagcaggttgaattaagtgtttcctgacctcttacctgtctttcccaatgactctgattttcttgggaagggttttgagcagagagatgacatgttggtagtggtcttacgagtttcactttgacagaatgtgtaggatgtgttggaagggtgtattagtccattcttgcattgctataaagaactaactgagatggggtaatttataaagaaacgaaatttaattggcttacagttctgcaggccgtacaggaaacatggctggggaggcctcaggaaacttacagtcatggtggaaggaaaacaaaggggaagcaggcacgtcctacatggctggcgccaggaggaagagggcgaagcgggggtgctacacccnttttaaacaaccagatctcctgagaactcactatcatgagaacagcaagggggaaatccgcccgatgatccagtcgcctgccaccaggcccttcctctaacattgtggattacaatttgacatgagatttgggcaaggacataaatccaaaccatatcaaaggggataaaccagatgaatgcagagaaaccgtcgaattcgag

SEQ ID NO: 181201 - DNA, 263 bp, Homo sapiens
atagctgtaaatgaatatattataaaggaaataaaacttcaaatcaataacctaactttataccttaaggaactaaaagagaggagtaaactctgtgcaaagctagcagggcagaagtaataaataatacgagcaaagataattagagaataaaacacaataaggaaaactgataaccaaagttgttttttcttaaagatcaacaaaatagacaaacttttaaactagattaacttcaaaaaaaaaagagagtgagagaaaag

SEQ ID NO: 181202 - DNA, 362 bp, Homo sapiens
ccctcaatttgctacaatttttaactatcatttttgccaactttattttgaaataattttaccctcatttagaagttgcaaaaatagtacaaaaatttattctgtaacttcggtagcttcccctacagataacatctttggaaactatagtaaaatgagcaaaaccagtattacataattcacacttgcacaatactattaactaaactcagaccttattggagttttgcaagtttttacatgcactcatgttttttgcattgtggggaggtgtacagtcctgtggaattttgtcatacatattgatttgtgaaaccactatggtaatcaggacacacaactgtctgatcactccaaaaagc

SEQ ID NO: 181203 - DNA, 474 bp, Homo sapiens
gaagatcaggctccctgtctgcaaatgcctgagcagatatggtttgagggcccccaagaattaggacccatgtggagggtctagtcttccccaggccacactggaagaattgtcttgggccacacataaaatacactaacactaacaatagctgatgagctaaagaaaaaaaaaatatccaaaaaactcatgatgttttaagaaagtttacaaatttgtgttgtgccacattcaaagctgtgctgggccacatgcggcccacaggctgcaggttggataagcttggcctgagggatggcctggggtaggtttcagcttaatctaagccatggttctctttctcttgaccctttccccaactaactttttaactttttatagatttagaggaagttgcaaaaatagtagagttttgtgtaccttgacctagtttgccccaagggttacttgttacataactatagcacactatcc

SEQ ID NO: 181204 - DNA, 863 bp, Homo sapiens
  misc_feature (521)..(521): n is a, c, g, or t
gtggctagcagaagagaaagaaggtttaaaatgccaacagccagaaacccatctgtggaggaatctcccaatcctcagactgataagataataagtagagagttccattctcatacctcctggacacaggtggcagtgttcccactgtcaggagtatatttcatatataggacacacaattacaaaagcaccatataatgttttctttattgaaggaactagaatataattggattttcctgcaatccctgtgtttagaaggcacatatctgtaatcttactctcaacagcatgttctgcaatagatcatataaaaaagaaacctgtaagaagtcttcccaaattcttcaataattctaaaaatctgcacagtatttccaatgacaagttatgaattggaaataaacctttctttctttcagtaatgaaaggacaagttttgatcagccataccatgcgccactacacccagctaatttttgtgtttttttgtggaggcagggtttcaccatgttgcacangctggtcttgaactcttgggctcaagggatccacccacctcagactcccaaatactggggtaacagatataagccattatgcctagcctagagacccaacttttaaagaaccagctaggataccatctgaggtaagaaagtacaaggggtagagtgagcatttggattttattctgtccctaacgtaagggtatggttgaggcctcttactcctcagatcaagttggcaaactgttggatatctactcagtgccagccttgttcaggtcctgggaacccaatatcaatagatcagaacagaacactgtccttaaggaacactcaggttagtgtgggaaacac

SEQ ID NO: 181205 - DNA, 929 bp, Homo sapiens
gtaagatgtgacttgctcttccttgccttctgccatgattgtgaggcctccctagccatgtggaactgttattatatccgggaaaaatctaagcaagtcatcacattgctgatggatgaaccattgctgtgtaaagagagggaagtggcatgtcggactagacagcgtacctcccactctatattgttttctaaaagacaacttggttcaagtaactcactgacagcgtgcacttctgcccccacaccggatatttctgcttcagagaagaagtataagcttcctaagtttggaaggttacataataaaacccatggatcaaggagtgatttcaactttcaagtcttattactgaagaaatacatttcataaagctatatcttccatagatagtgattcctctgatggatctgagcaaagtaaattaaaaaccttctggaaaagattcaccactctagatgccattaagaacatttgtgattcatgggaggaagccaaaatttcaacattaacaggagtttgaaagaagtggattccaacccttatggatgactttgaggggttcaagacttcagtggaggaaggaactgcagatgtggcggaaatagcaagagaactagaattagaagtggagcctgaagatgtgactggattgctgcaatctcatgatcaaacttgaacagatgaggagatacttcttatggatgagcaaagaaaatggtttcttgagttgaaatctactcctgtgaagaagctgtgaacattgttgcaatgccaacaaagaattcagaatattacataaacttagtaaataaaccagtggcaggattagagaggattgactccaattttgaaagaagttctactgtgggtaaaatgctatcaaacagcatcacatgctacagataaatcttttgtgaaaggaagag

SEQ ID NO: 181206 - DNA, 930 bp, Homo sapiens
atttctaggaatttttacatattttggatatgagttctttgtcagatagacatattatagatattttctgccatcctacaagctacaaaaattctgtagcttgtcttttccatttctaatgttgtcttatgatgagtagaagtttgtcattttggatgtgagggcaatctggctggctaggcaggagtccttttccttcctcaccgctgtatgtgtgtctctcctaaagttggattcttggtcaaagaggatgacctttgctgatagaagaggatttttctttggtcaagggtataggagtagctgcactccctttttaggacctccaaacaagctctcaagatctatttgtaggagaacatggggtaaaaatagttttaagttggtaattttcatgaagttcaatctgtttttcttttatggtgatatagtttagctgtgtccccacccatatctcatcgtgaattccatgtcttgtgggagggactctgtgggaggaattgaatcatgggggcaggtcttttgtgtgctgttctcatgatagtgaataagtctcataagatctggtggttttataagggggagtttccctgcacaagctctctttctttgcctgccaccatccacgtaagatgtgacttgctcttccttgccttctgccatgattgtgaggcctccctagccatgtggaactgtaagtccattaaacctctttcttttgtaaattgccgagtctttgatatgtctttatcagcagtgtgaaagtggactaatacatatggttaatgccttttttaccttgtcagagaaacttgcctatcccaaggaatatgttctatgttttcttccagatatttatagttttaactaggtctgtgatccatctagaattagcttttgtgtatattgtgagatagagttcattcttat

SEQ ID NO: 181207 - DNA, 1466 bp, Homo sapiens
aagtggggaccggcctgggcccttgagcctggctggagtaggtggaatatcctggggagaggaagtttggtcgttgggcagcggccgactttcctctcaggaaattgatactttatcaacatagagattaattatttgtatttgggagcagcagaactggggaccaattacctgtcaagagttttataaacccgtgacataaactgttattccattgctttcatcctccatctcaccttggaacttgtattacttatggcgttcaggagacaagtgaaaaactttgtgaaaaattactcagatgctgaaataaaagtcagggaagcaacttctaacgacccttggggtccctctagttctctgatgttagatatcagtgacttgactttcaacacaatttctctctcagagattatgaatatgctgtggcacagactcaatgaccatgggaagaactggcgccacgtgtataaatcccttaccctaatggattatctcatcaagaatggatcaaagaaagttattcagcattgcagagaggggttctgtaaccttcaaacactaaaagattttcagcacatagatgaagctggaaaagaccaaggttattatatccgggaaaaatctaagcaagtcatcacattgctgatggatgaaccattgctgtgtaaagagagggaagtggcatgtcggactagacagcgtacctcccactctatattgttttctaaaagacaacttggttcaagtaactcactgacagcgtgcacttctgcccccacaccggatatttctgcttcagagaagaagtataagcttcctaagtttggaaggttacataataaaacccatggatcaaggagtgatttcaactttcaagtcttattactgaagaaatacatttcataaagctatatcttccatagatagtgattcctctgatggatctgagcaaagtaaattaaaaaccttctggaaaagattcaccactctagatgccattaagaacatttgtgattcatgggaggaagccaaaatttcaacattaacaggagtttgaaagaagtggattccaacccttatggatgactttgaggggttcaagacttcagtggaggaaggaactgcagatgtggcggaaatagcaagagaactagaattagaagtggagcctgaagatgtgactggattgctgcaatctcatgatcaaacttgaacagatgaggagatacttcttatggatgagcaaagaaaatggtttcttgagttgaaatctactcctgtgaagaagctgtgaacattgttgcaatgccaacaaagaattcagaatattacataaacttagtaaataaaccagtggcaggattagagaggattgactccaattttgaaagaagttctactgtgggtaaaatgctatcaaacagcatcacatgctacagataaatcttttgtgaaaggaagag

SEQ ID NO: 181208 - DNA, 281 bp, Homo sapiens
ccaacaccaattcctaaactttcttaaaacattatgagattttttaaaatttatttttattttttagcttatcagctatcagtagtgttagtgtattttatgtgtggcccaagacaattcttccacgtggcccagggaagccaaaagattggacatcccctgatctagaacaaaggctaatgagcaagaagtttacttggtagtgatcccattgtgctaaagtgagggatcaggggaattgaacaggaaatggcggtggtggtgggtggggtatactgtga

SEQ ID NO: 181209 - DNA, 210 bp, Homo sapiens
ctgtcgggcagagcgaggtgtgcagtggcggtgccaccggtggcctcccacttggcttggacagctggtcgcccacatcttcaggcaggcctgggcgttgcagcagctctgggcctctgtcctccactttccactgatgcagccatgagcacgtgcatggcacacctgcctgatctgagcacacctgtgcagcgccttccatgagatccc

SEQ ID NO: 181210 - DNA, 557 bp, Homo sapiens
tgttggcttttgggtcgaatccacacttcttatgatatggcagaggcaatgatacccagtgtttcacgtgttcccttatacttctcagctgacttgacatcacatcaggctatgtgactggttcaggctaatgggctgtgagtgggagtgacaagtgtcacttctgaaacgaggcatttagttggtgatacaactcactctttttcatgcgtccctactgtggaaactaggaagcccacatgttccagatgatgcagctaccagatggcccagccctattagtttgggttcctgagtgactatgtgagcagagcccctcatcactctgcactgaacatggaatttaggtgaggaataacattttctttgttaagccactgagactttggtgccgtttattgccacggcataacctagcctatcctgactatacaggatggtttatgaagtcctctgtgatctgtcttccatttacttccctggcttcattttttgttcctctttcactctctaagctccagctctggtacttcctttttcccctggctacaccacat

SEQ ID NO: 181211 - DNA, 137 bp, Homo sapiens
caagaaattaaaacaaaggtttaaaaaatcacagaagagtaggggtcagtttgtttacctagcacagacagatggttgtatttctgtagttagaggagcaatgcagaaagacttccaaagttccagatgaggcacat

SEQ ID NO: 181212 - DNA, 122 bp, Homo sapiens
tctgtggctttaatactagccatcctgatgggtgtgaggtggtaccccactgtggttttgtgtttcctgtctttcgttaatacaattaatactgcaatgaggctgggtgcggtggcttgcat

SEQ ID NO: 181213 - DNA, 248 bp, Homo sapiens
cccctttttaaactggagttaaataactaataactttttctatatacataattttaaacttatactctgttattgtttgttttctttaagatagggtctcactctgtcactcaggctggagtgcagtagcataatcatagctcactgcaacctccgcccctaggctcaagctgtcctcacacctcaacttccctagtagctgggactacaggcatgtgccaccatgcccagcttatattttgtacttt

SEQ ID NO: 181214 - DNA, 408 bp, Homo sapiens
aggcagaagaatcacttgaacctgggaggcagaggttgcagtgagccaagattgcaccactgcattccagcctgggtgacagagctagctagactccatctcaaaaaaaagatgaaggaaatatatgcaaaatgattggactggatttaacaaaaaagcatgagacaagtaccaatctacatttaagtgcatatatgtacgtatgcactataaagatccagatggtaaatatgagcatggagaaagacagaagacgacacacaacaagattatgcactctgatcatttgaggctgacaaggggttttcctaaagaaaatgagagagacgggctgagtgcggtagctcacgcctgtaatcccagaactttgggaggaccaggcgggtggatcacctgagttgaggagtt

SEQ ID NO: 181215 - DNA, 294 bp, Homo sapiens
attttccctgagaacacagggattttgccctgctgtctactaagtgtccagtgccttgttgagaagtctggtgttggtctgattctcaaccatttgtggatgcctatcttactctttctggaagcatctaggattttctgtttatgcctgctatagtgaaatttcataaacatatatctgagggtagagtttttttgtgtgtttgtttgttttttaactgtttttagtgaggtccctttattggaccttttcagctgaagacagctgctacctttgaaagcttctggtaaattt

SEQ ID NO: 181216 - DNA, 585 bp, Homo sapiens
gtcctaattaggagcccccacctccccttaactgtgaggtctgtagggctcatatagctgcacgtgctgcagaagaggaactgcgacaaatgggactgagcttactggagagtgatgaggctctgcgagccatggggtgtcaacagagaaggagctggggattttctccagaagagaagctgggggagacgtggttgatctcctttagcagcagaagaaacacagtctgaggctgagggaccagacggatcagtgggtcccttgaaggcagagttggggcaggggcatcaaagatgacaggatttggctttagcaaggtcagcgcttcccccaggtgggatgatccatttactgattgattaattcagcaaacattcatctgtgaggtatgcactctatgtgaggccctgtgtctggaggaacaaacatcaaataggacagggttcctgttctcaagctgcttatagtctggaggttgcctgggaagtaatgagtggccctgcactcattacctgtgtagggccgctcattacctgggtgtaatgagtgtgaaagcagaggctggacaagcacgtgggagcgggg

SEQ ID NO: 181217 - DNA, 411 bp, Homo sapiens
gcatgtaccaccttgcccagctagtttctttgatttttgtagagacaaggtttccctatgttgcccgagctggtcccaactcctgggctcaagcgatcctcccgcctcagcctttcataagcgctgggattacaggcgtgagccaccatgcccagccaagcatatggttaagccatctacagtatttttcaagaccaagacttaaaaacaatttgcactgttcattttacatattaagtgttgaagattttttttgttaaatatcactacttctataaatcatgctttgtggattattctgcatcatacactgggatgtattggtgttcaccgtttatccagcaacattattccaacactgcttgagccctcaagagtgagccacttggccaggcacagtggctcatgcct

SEQ ID NO: 181218 - DNA, 333 bp, Homo sapiens
ctttgaatttgtttaccaactctcagattactggaatgagaggatcctcctcaaggccttacaatggaagttttagaactaaagcctggaagccctgtcttccacagtaggaaacaaacagatgaaatacagtggaccctcgaacagcatgtttgagctgcgtgtgtccacttatatgtgaatttttttcagtaaatttacactgagtggcctgcctttcctcccgcctcctccgcatcttccacctctgccaccctgagacagcaagaccatcccagctaatttttaagtttataaattagatagagttggggtgtgcgtctgctgtgccgg

SEQ ID NO: 181219 - DNA, 193 bp, Homo sapiens
acacccagccgggagatgtcacttctgggtaaagatgcgagatggaacacatacatctaccttagatctctatcattttaactccattaaaatgatatttaaggggattaagtaaaaaagacgcaaatccacaaagtcaagatcaggaggactcaacagcaatgaaattgtggatgctgggaagcacaagata

SEQ ID NO: 181220 - DNA, 336 bp, Homo sapiens
  misc_feature (38)..(38): n is a, c, g, or t
gaggtcgctctggattatcccgctgatccgcttagctnagtctcatgcaggttaatttctcaaattactaatgtttaataagtactaccatttcaaaagcacagtcattacaaaccactcgtaattgacatcttactacatacataaaacaacttccatacacagaaaattctgggagggatggaactggcaaccaaaatgagtgactgaggccacagtctcaaccaatcaaggtttattaagccagctttagggcccatccaggaaaaaccaacacatatgtaactgtttttccaaagagattttcaggaggtttcctatttatgtgtttcctta

SEQ ID NO: 181221 - DNA, 153 bp, Homo sapiens
ggagagttgagttttggatattccgatgggttgcaaaaaggtactgtgctttcctgggttctttcaaattgtaatcagccttttatgtgcctgtctgacccttgatgttaggattgtttgaactgatactttttgaacattttctcaagttta

SEQ ID NO: 181222 - DNA, 110 bp, Homo sapiens
gaacggaccgctagcactcttttcttcagacaaacaataactgcatttacagaacacttcctaggagccagtctcagcacaaatgcctgccatgtcccagcttgattcct

SEQ ID NO: 181223 - DNA, 813 bp, Homo sapiens
actgtcccacccagtctggaatcctgagacagactatagaatttcattaaaaatcttttaaagcagagttttgtgggggtttttttttttttctgttctcaggtatcatatcagtgtagcactattcacagatcggcacaaaggacaaggcgacttcttattattttcctcaaccatgtgaacactaaggttttcattctgctacctcttgggtttgtacttcatggatctcatctattcaataagcaatcaagcactttgcaatgggtccagggaaggttagtgtcactttgaccctggcccacttcccactggcaccatctagaacccctgctaaacttgtcaagaactgatactcacatagtaaaactagtgacttctgccctacatctctaagagcttttacatactccagcatggtttgagaatttgactttaaactcaccttttatccagcaggaactattactgaacctgcccctagctttaaaaaaaaaaagatcagctggccgcggtggctcacgcctgtaatcccagcactttgggaggctgaggtgggcggatcatgaggtcaggatttttgagaccagcctggccaacatggtgaaaccccatctctactaaaaatacaaaaaaataataataataactaggagtagtggcaggcacctatagtcccagctactcgggagactgaggcaggcaaatcacttgaacccaggaggcagaagttgcagtgagccaagattgtgccactgcactccagcctaagtgacagagtgagactccatctcaaaaaaaaaaaaaaaaaaa

SEQ ID NO: 181224 - DNA, 308 bp, Homo sapiens
gtttgggtaccctatcctgaaaggtgtagtatatagtttttcagaattggaatactaattatttttgtataaaataatcaataaataatggtttttctaaggtggttatttgtagattatatcttttatctgtctgtgtacttgggtcaaaagctagttgtgagtctcctcatcttaattcaagtaggcttaatatacgtgaccttgaatcttcacatcctgatggtttggatgtatccagttgaactacagctgctttatgccagtgttttgtaaataattttcctgattgtattgggtttcttttt

SEQ ID NO: 181225 - DNA, 272 bp, Homo sapiens
gatgtcactctgattcgtatggtaaggctaaccttgacacgtactcaagattggggctttgaaagtcagacctgtataaacaggcaatttttaatagcctatgcagatcaattattatccagaaatcttattcatataactaaactacttttgagagaatattctcatgagaacaaaacctctcaaatttgaaaacttcaagttattaatactgtgtttgcattattgatttatttttattatcttaatcacactaaatagtatttctcagt

SEQ ID NO: 181226 - DNA, 177 bp, Homo sapiens
ctgaaacattacactaaaaggttttttggcaacgggttgtaaattccttcaatgtaaattattgatattgcaataatgctgcataatgatgtagtcaaataagtcatgagtttggggaaagttaagctgaggtatgactatctttacaactgccccaatcctttactaaaaattatg

SEQ ID NO: 181227 - DNA, 1648 bp, Homo sapiens
ggatagacccttcagtggagcgggcctccactcccctgaactgcccagtcctcctagaagactaccagtccccaaagatgtatattccaagcaaagaaatttgtatgaattaaaccgtttatataaacacatccatcctgagttaagaaaaaacttagaaaaagattatatcagtgaagtttctgagattgtttctagtcaaatgaactcagggagttcagtctcagcagatgtgcaacaagcccggtatgttttgaaaacacaaatgacagttctcaaaaagatctgaactcagaaagagaatacttggaatgggatgaaattctgaagggagaggtgcagtccattagatggatcttgagaatcaacattggattccatcaacaatggtctcctgatgaaggtgatatttccaggggcattgctgatcaagaaatcattgctggtggtgatgtgaaatataccacatggatgtttgaaacccaacccatcgacacacttggggcttattcttctgacactgtagaaaatgcagagaaaattcctgagctagccagaggagatgtctgcacagctcggtggatgtttgaaacaaggccattggactcaatgaataaaatgcatcaaagtcaagaagaatcagcggtaactatcagtaaggacataactgggggggatgtcaagactgtgagatacatgtttgaaactcaacatctagatcaacttggacagcttcattcagtggatgaggttcatttactgcagcttaggtctgagctcaaagaaattaagggaaatgttaaaagaagtataaaatgtttcgaaactcaaccattatatgttattagagatggttcgggccaaatgctggaaattaaaactgttcacagagaagacgttgaaaagggagatgtaagaacagcacggtggatgtttgaaacacagccgttggacacaattaacaaagatatcacagaaattaaagttgtccgaggaatatccatggaagaaaatgtcaaaggtggggtgagtaaggcaaagtggttatttgaaacccaacctttggagaaaatcaaagagtcagaagaggtcatcattgaaaaggaaaaaataataggtacagatgtctccagaaagtgtggatgtttgaaacccagccattagacattctaaaagaagttcctgatgcagattctctacaacgtgaggagataataggtggtgatgtacaaactactaagcatctatttgaaacacttccaattgaagcattaaaagacagtcctgatataggaaagcttcaaaaaatcactgcctctgaagaagaaaaaggggatgttaggcatcaaaaatggatttttgaaacccaacctctggaagacattagaaaagataaaaaggagtacacacgaacagtgaaacttgaagaagttgacagaggagatgtgaagaattacacacatatctttgaatcaaacaatttaattaaatttgatgcatcacataaaatagaggtggaaggagttacaagaggtgctgtagagttaaataaatctctcttcgagacaacaccactgtatgccattcaagatccccttggaaaatatcatcaagtaaagacagtccagcaagaagaaatcgtaagagg

SEQ ID NO: 181228 - DNA, 2170 bp, Homo sapiens
ggcaattcatagcagccaggttggcacttcaagaagcagccaggaaatggcaagaaatgaacaagaagggtccaaagtacagaaaattgatgttcatggaacagaaatggtctctcatcttgaaaagcacaccgaggaagtaaaccaagcatctcagtttcatcaatatgttcaagaaactgtcattgatacacctgaggatgaagagattccaaaggtttcgactaagttgttaaaagagcagtttgaaaagtctgcccaggaaaagatcctttattctgacaaagagatgacaaccccagccaagcagattaagactgaaagtgaatatgaagagactttcaagccatcatcagttgtgagtacctcttccacttcttgcgtttcaaccagccagaggaaggaaacatcaactacaagatatagtgatcacagtgtcacttcctcaactctggcacaaattaatgctacttcttcaggaatgacagaagaatttcctcctcccccacctgacgtacttcaaacttcagtagatgtgacagcattttcccagtcccctgaactgcccagtcctcctagaagactaccagtccccaaagatgtatattccaagcaaagaaatttgtatgaattaaaccgtttatataaacacatccatcctgagttaagaaaaaacttagaaaaagattatatcagtgaagtttctgagattgtttctagtcaaatgaactcagggagttcagtctcagcagatgtgcaacaagcccggtatgttttgaaaacacaaatgacagttctcaaaaagatctgaactcagaaagagaatacttggaatgggatgaaattctgaagggagaggtgcagtccattagatggatcttgagaatcaacattggattccatcaacaatggtctcctgatgaaggtgatatttccaggggcattgctgatcaagaaatcattgctggtggtgatgtgaaatataccacatggatgtttgaaacccaacccatcgacacacttggggcttattcttctgacactgtagaaaatgcagagaaaattcctgagctagccagaggagatgtctgcacagctcggtggatgtttgaaacaaggccattggactcaatgaataaaatgcatcaaagtcaagaagaatcagcggtaactatcagtaaggacataactgggggggatgtcaagactgtgagatacatgtttgaaactcaacatctagatcaacttggacagcttcattcagtggatgaggttcatttactgcagcttaggtctgagctcaaagaaattaagggaaatgttaaaagaagtataaaatgtttcgaaactcaaccattatatgttattagagatggttcgggccaaatgctggaaattaaaactgttcacagagaagacgttgaaaagggagatgtaagaacagcacggtggatgtttgaaacacagccgttggacacaattaacaaagatatcacagaaattaaagttgtccgaggaatatccatggaagaaaatgtcaaaggtggggtgagtaaggcaaagtggttatttgaaacccaacctttggagaaaatcaaagagtcagaagaggtcatcattgaaaaggaaaaaataataggtacagatgtctccagaaagtgtggatgtttgaaacccagccattagacattctaaaagaagttcctgatgcagattctctacaacgtgaggagataataggtggtgatgtacaaactactaagcatctatttgaaacacttccaattgaagcattaaaagacagtcctgatataggaaagcttcaaaaaatcactgcctctgaagaagaaaaaggggatgttaggcatcaaaaatggatttttgaaacccaacctctggaagacattagaaaagataaaaaggagtacacacgaacagtgaaacttgaagaagttgacagaggagatgtgaagaattacacacatatctttgaatcaaacaatttaattaaatttgatgcatcacataaaatagaggtggaaggagttacaagaggtgctgtagagttaaataaatctctcttcgagacaacaccactgtatgccattcaagatccccttggaaaatatcatcaagtaaagacagtccagcaagaagaaatcgtaagagg

SEQ ID NO: 181229 - DNA, 1181 bp, Homo sapiens
ggacatacaagatggtggctgggtcatgttaattgggaaaaagaacagtccacaggaagaggttgagctaaagaagttgagacacagtttggaagatgtctgcacagctcggtggatgtttgaaacaaggccattggactcaatgaataaaatgcatcaaagtcaagaagaatcagcggtaactatcagtaaggacataactgggggggatgtcaagactgtgagatacatgtttgaaactcaacatctagatcaacttggacagcttcattcagtggatgaggttcatttactgcagcttaggtctgagctcaaagaaattaagggaaatgttaaaagaagtataaaatgtttcgaaactcaaccattatatgttattagagatggttcgggccaaatgctggaaattaaaactgttcacagagaagacgttgaaaagggagatgtaagaacagcacggtggatgtttgaaacacagccgttggacacaattaacaaagatatcacagaaattaaagttgtccgaggaatatccatggaagaaaatgtcaaaggtggggtgagtaaggcaaagtggttatttgaaacccaacctttggagaaaatcaaagagtcagaagaggtcatcattgaaaaggaaaaaataataggtacagatgtctccagaaagtgtggatgtttgaaacccagccattagacattctaaaagaagttcctgatgcagattctctacaacgtgaggagataataggtggtgatgtacaaactactaagcatctatttgaaacacttccaattgaagcattaaaagacagtcctgatataggaaagcttcaaaaaatcactgcctctgaagaagaaaaaggggatgttaggcatcaaaaatggatttttgaaacccaacctctggaagacattagaaaagataaaaaggagtacacacgaacagtgaaacttgaagaagttgacagaggagatgtgaagaattacacacatatctttgaatcaaacaatttaattaaatttgatgcatcacataaaatagaggtggaaggagttacaagaggtgctgtagagttaaataaatctctcttcgagacaacaccactgtatgccattcaagatccccttggaaaatatcatcaagtaaagacagtccagcaagaagaaatcgtaagagg

SEQ ID NO: 181230 - DNA, 344 bp, Homo sapiens
agatctttctatcagcacctaaggatatgactctgaaggctgtgtaatatgccatgtatagatgtggagtaattatttactcaaccttttctctaatttctggctgctttggtcctagacaggagctgttactgtctcccatgtgatctgctttttatccctatgctgacagtaatcaaccactttttaaataccccttataacgaacataacaactcatatttatggaacactttacagtttatgaggtggccacaatgttcaatccaacagtcctgtaaacttgcactgatgtccccattttgcaagtgagaaaaataagactctaagtgacttgttcaaga

SEQ ID NO: 181231 - DNA, 779 bp, Homo sapiens
caatccctcatgtcacttctatcaacatctccaacggcaagtaccatatctacacttagggttttccagtctctaaatctgactaaaatctccaaatactggctgagtaattctgcctgaatatgctatttccctttaaaaaccagcatattgaaaaccacattcattagcctctcccatcccttacacgtttatacctcataacttttctttaatggtactacccagtcaaagcaagaccaaaaaatcaggctgcctctgacaccaatgctttctacacggagccatatctaagctttgtggattctaatttttcctttgcaaatagtttcttcatttggtattcatagacaccaaaatccactggtgctcaagtccttgatataaaatggtgtagtatttgcatataacctatacacatcctcccaaacactttaagtcatctctagattatagtacctaatacaggatcaatgcaatgtaaatggttgttatactgcgggtcggggttgtattttttttgttgttgtattgttattttttattgtttttctttctttttctggaggcagggtctcactatgttgcccaggctggtcttcaactcctgaccttgtgatccatctgcctcggcctcccaaagtgctgggtttacaggcgtgaaccactgcacccggcctgaatcatggttttttgaaaccattggcatctgaacctgtagctctctctggtagtgtcgtgtggttttaaatgtcatgtgagctgagttactgacctca

SEQ ID NO: 181232 - DNA, 714 bp, Homo sapiens
ttggaaaactcaaatagtaggcgtggctttgtttgaaaaacattaagggcaggaaataatgtttttgctcatagatattcaaaagtcatagtcataaaaccagcaaagagaaaaagaagaatgtttaacatattatgatgtcattggagaaggttcattatactttatgcttctgcataaagtatagttttccttccttttcaaactttgagaaaatacactattctcttacaaaacataatacatacccaatagttcctccagttaaataataataaaataaaatactatgttcattctttcatactcatggatatgctgacttaactttgtaaaaagatgccaaagcttcgtaaattaatctaaatcaaattataatctcaatcttaatcaaaattacaacaggacattttggggagggaggaaactagataaactaaatctaaatatttaaaaaaaagatccacagatagttatatcaattttgaaaaaaaaaagcaaagacagggaatccatcctgccatatcttaagaaatactagaaaggaacagtaataaacatgatatggtacaggatctcatctagggtgtgtctggaaatgcatgggccatcatggatgtcacaatgacagggcaacactactgacattgagtggacaggcccagcagtgctaaacatacctactctactaactgtgccccctttaagaaactt

SEQ ID NO: 181233 - DNA, 359 bp, Homo sapiens
caccatgcccagctaatttttgtatttttagtagagatggggttccaccacgttggtcaggctggtcttgaactcctgacatcatgatccgcctgcctcagcagcctcccaaagtgctgagattacaggtctgaaccactgcacctggcccaaagtctttatagttaactgcaaggtcctatgtggttataatctccttctcctcatctttacctctcttattctatgtactccaaccacaccatttcccctggattcctcaaacatatgccatgctcctgtctttatattaactggtctttcttcttggaacacctctcccccagatagccatatggttaactccattacctcctttg

SEQ ID NO: 181234 - DNA, 636 bp, Homo sapiens
aatttttgtatttttagtagagacagggtttcaccatggtggccaggctggtctcgaactcctggcctcaagtgatctgcctgcctctacctcccaaagtgctgggattacaggcgtgagccacctcgcccagcctcagtaaacatttttaattggatgacaagggatggggccatgtcttccacatcactcattcactcatttattcatcccctgcatacgctgtgggtggcctgccctgacactggacactacttctccactctctgctacacataatgtctctgtactcttccctcaggatgtggcacatgggctctgcctgaaagtcctccctctctgctacttccctccctatcactagctacctccaattccaccaggagcctaagactgtcatttctttaatcctgcaagaagaccccctttctcggtgccctacacatccccctgccacatggctacaccatcaggcatttcccagcatctgctgcctgctctgctgctcaaggggctgggcgagaagacagcccagttctgttgggatcacagttttgtcctcagtgcgtagcacaggttctagaacacagctacaacaccatactttgtgtgatttttttggagacagggtctcac

SEQ ID NO: 181235 - DNA, 162 bp, Homo sapiens
ctgcacttggcctaaaatttttcattttcaaattcagttccttggccacactgaccatattcaatgctcaatagccacatgtggctgggagctatggtactggacagtgcagatatacagcacgtccaccatcacagaaagacaacgctgttctaaacatgt

SEQ ID NO: 181236 - DNA, 314 bp, Homo sapiens
ataggattcagacctgaatgtgtactaagccaagtaagcttagtgacagtcatccatgttcagtcccttaacaaggctgtgtattgtccatgtggataattttggtggtgggtttctgtctaatctacagtgactttgagtttgtgcctagggagactctagtgaaatgtgccaaggcctagttcagagagtcctgaagtagtgcgctgtgcgtggcacacaagatgattctgtgagacactgatgaatactttttatttgaaaatttatatgctttgctttttgtgtatatagggagacatttgaaattcact

SEQ ID NO: 181237 - DNA, 133 bp, Homo sapiens
gagaaatccgcaagtagcctaatatatgttggaattgtagtgaccaaagaagtgtgggaacagaaaaaaaatatttgaagaaatagtggttgaagagtgtccaaactggatgaacactttaaactctagtgca

SEQ ID NO: 181238 - DNA, 336 bp, Homo sapiens
ggtagctcctgataggacaccatgagaagggcacatcacctctgcggtattcttcccaaaaatccataactgcagcctaatcatcagacaaatctagggacacaaaatatctaaacaagtactcttagaaagcatcaggccaggcacagtggctcacacctgtaatcccagcactttggtagggcaaggtgggaggatcacttgagcccagcattctgagaccagcctaggtaacactgcaatatcccatctccacaaaaaataagaaaaaaattagccaggcatggtgtcaggtgcctgtaatcccagctactcaggaagctggggtaccgagct

SEQ ID NO: 181239 - DNA, 531 bp, Homo sapiens
aaagtaactggcccccactccaccaaaaaggggcaacattttaaaacacctctatatttactgctttaaccattaaaatagctaaattcatatcctaaagacatctgtgttacatcaccaagaaaaatttctgaaaacattaatagaccttttaaagtttcagccgaaccttttaaaataaaaataaaaaccagttataattttggactgctgtaggtgattttttttttattttttaattttttttattcaaagcgactctttggatcaacaattagaatttattttttattggctcttacaatttgcttcacatgtaacatccatttggtatatgcctccctgggaggttattggtcatctaatttgaaatgagaaagaacaaagggcgaaagaaaaggagcaacattcctctcctcagctcactaatacgaatgtgtgtcaccttttaaataccacccagtatgacagattaatcggaatgaattaataggcagaagagagagaggaggatctttaaaaagactaaat

SEQ ID NO: 181240 - DNA, 394 bp, Homo sapiens
gtacagccattttggaaaacagtatggagatttatcaaaaacaaaaaattgaattaccgtatgatccagcaatcccattagcagatatttatacaaagaaaaggaaaccaatagtgcttcatgtttgccaggttgtggtggctgtggcaatttctatttttttttaatttttaactttttacagatacataatatttaaacaaatttatggggtacatgtggtactttgttacatgcagagaatatataattatcaagttgaggtatttaggatatccgttaccatgagcatttatcatttctatgtgttgggaacttttcaagtcctcacttctagctattttgaagtgaagcactattcacaatattcacaaatatagagaatcaacctaag

SEQ ID NO: 181241 - DNA, 334 bp, Homo sapiens
agagctaggcattgaacatcgatggctgataacatcacacacacttaaagaaatatctatatcacaaattatcaaaaaatgaacctgattctgataaagtctcaagatctaactaccaatttacaggaaacacaggggacagagaaccatattaaaccataccacagggacacagtcagtaaaattcagactgtggcaaactttaagatagaaaatgctggtatctccaacaacaatacagagaaaagaaggtgagggacaaaaagagagaaaaacagggagaaactatagatcaaaagagacttaagggacatatcaaccgttaggttgtata

SEQ ID NO: 181242 - DNA, 551 bp, Homo sapiens
tgcatcgtgtactacgatatagcgtacatacaactatacaggtcaggatgtagcgatgttatgcctgtaatctgaacactttgggagggcaaggcgggcagtatcacgaggtcaggagttcaagagcagcctgatcaacatggtgaaaaccccatctctactaataatacacatataagtagccggcgcgtggtggcgggcgcctgtaatcccagctactcaagaggctgaggcacaatgttagaacatttggtgaaaaataattaaacggtagtactgctttcaaggtgttcacaatcctgaggaaagggatgaacacaaataatttaaatatatggcagaatgtgatcaaacaatacaacaggtcagattagtgatcaaacaatacaacaggtcagaaagtggctggtgaggagagcttttatttgatctgtgttttgaataatgtaagatttggagaagcaaattctctaggcaatttgcctaaagcattagcactaaagtggtatagctagctcactgtatttaaaaggtaaacaactttaacaaat

SEQ ID NO: 181243 - DNA, 377 bp, Homo sapiens
tgctgggattacaggcgagagccaccttatctggctgcctcctctttaaaaagaaatgaaagtttgattaggaagacttttagtaaccaagaatcaaagaaacatcaaaagagaattatcatgaattacatttaaaatggaggcactgaaattcatctctctcttttaagacattgtagaatgtataaggggagttccttagaagtattaatattataccatttcttattaaataatgcaccttatagcattggaatttaatagtaccaattattatgtcttaaagtcctcttagaatgctttgggtcattttaaggttattataacgattggagagttcttaacgttagtaaaagcatggatttgcctacacagaa

SEQ ID NO: 181244 - DNA, 409 bp, Homo sapiens
agccagccccacccaacaaagtccccattgagaactgaaaccaagaggtacaacccagggccttttggacaagaggtatctagcaggaaggtagggaagacaggacctacagcagataaaagcatctgaagctcaaaagaggaactgagaagcatcacatgcacactcagccatttcctctccccagttctctgtgttctttgagtagaacaactgatccaaacgaaaggaatccatgtcctgtgaccacgccaaagtgttggctgagaagtggaagggttcttggaactagcccacggcacccaactccacccaggccctcaggtctcctgctctccaaacttctcatctccccatctaatcttccaagaataagaggtactgggtaaggaatgagactggaaggaat

SEQ ID NO: 181245 - DNA, 446 bp, Homo sapiens
aagtgttgttctcattttcctcccaccagtagtgtaagagaggtgcattgctccacatcctcaccaacttgtattattattttctatcttttttgttttagcttttctggtgggtgtgtattgacattgcactgtggcttgtatttgcatttccctgttggctaatgaagctgagcctcttgtcatatggggtatttttcggttcatttgggaaccctgttggcctctctgcctatccaggcccatttatctcctgggatgtctgtctttttcttactggtttgtaggcacgttataagtatgaatccttatattgcattaattacactgtacagatgaccttttcactctcttagtaggttcttctgatgaataaacattcttactatagtccaatttattttttttatggttagttttgtgtcctatttaacacatctttgcca

SEQ ID NO: 181246 - DNA, 331 bp, Homo sapiens
cagccactgatcccgtatcttagctggagattgtctccaagctcagtcaaagcccagaattcacaagtaaaaaaggacagtgagctgacccagcttcaatcttgcctcagtggatgccaagggccctgctgcaggagccaggggtcagggctggggtcagggctacggccaggagggacaggatctctgaaaccacaaacctgacccttccctcataattctgtaagcccatcttcaatgattcctaaccttttttgacaccttcatgcccctcaaacactttaaagcctgctttgacacaagatgagttagcttcaatttggagccacca

SEQ ID NO: 181247 - DNA, 818 bp, Homo sapiens
agcggagcctgtagaacttccggcagcaactgcaattaggggtagtccagtgctaaattgtcgcagccttgaaaatattctgcttcgttatttcgggcactccacagattctgtgcgaaggcagccatctttagttcgtctttcctagagagcgttgagaagattctgctccattttttctgattatggattctgttcagaaggaagccgaattttaagtcatcgttctaggatagtattttagtatgaaaatttccagacctatagaaaatttgaaatacttgcaccatgaatatccagattcagctccattttctctggtggtagatctccatggatgctattgagaaggtacttctcaaagtccacgaggacaaggacatctttccaccgaatgccacctggtttataacaaaagcatgaaaaacaaacaggaatttctcaatgcagaaaggactgaagctgtcaaaggtgtgctttttttctgcacaaacaagtttccattgaatgatagaataaagagatactgacttccccggagcctccaaacttgagtagtcaggtaaggatccttgagtaacaagacagcaaagtaagtattatccctcctgggattttggttggttacaacattgtgttgagtatttgcattccatttttcccttggggaattacactttctgagacctcaatttaggaggcttaagtgaagataatccatccccagttacacttggcctgcataaaccaagcagatcaaaaagagtgctatgttcattactcaatgaattggtcgatattggcttccttgatatata

SEQ ID NO: 181248 - DNA, 1175 bp, Homo sapiens
agcggagcctgtagaacttccggcagcaactgcaattaggggtagtccagtgctaaattgtcgcagccttgaaaatattctgcttcgttatttcgggcactccacagattctgtgcgaaggcagccatctttagttcgtctttcctagagagcgttgagaagattctgctccattttttctgattatggattctgttcagaaggaagccgaattttaagtcatcgttctaggatagtattttagtatgaaaatttccagacctatagaaaatttgaaatacttgcaccatgaatatccagattcagctccattttctctggtggtagatctccatggatgctattgagaaggtacttctcaaagtccacgaggacaaggacatctttccaccgaatgccacctggtttataacaaaagcatgaaaaacaaacaggaatttctcaatgcagaaaggactgaagctgtcaaaggtgtgctttttttctgcacaaacaagtttccattgaatgatagaataaagagatactgacttccccggagcctccaaacttgagtagtcaggcattgggatccgtggaaggcttgttaaatccaaatagattggtcctactccatccgcagagttgctgacgaggtgcgtccaggccttctcctcacctctcagggagatataccatgcagtgccttcagttatggtgttgtgactgaggatgcttcggtcagacatgtccctgaaaacctgcatagagctgcacttcaagggaagttattgaatatgtcctatccaactaaaacaaggaaatgatgaaaaaaataaaatcactttccagaggcctcagggctaactggagacagagctcagactgcaactgagaaaagttggactccaaaacctgtactctgagctttactgcatgagaaagttattgaaatgtgccttgtgacattcagaataagtgacttttcagaggtctcagagtcagtaagagacagaactcagattgtaaccaagaagagctgaactccaaacttctgtgtccggaattggtgggttcttggtctcactgacttcaagaatgaagcggcagaccctcgcgggccaggtctgctcagcaactcagtatgttgactttatttcctgagagagaacagagagaagaaagaaagtggagga

SEQ ID NO: 181249 - DNA, 336 bp, Homo sapiens
tattttatgaatacaacagaaattcatctcaatcttaattgcctttaagaaagggcaaaaattggctgggcacggtggctcagacctgtaatcccagcactttggagggccgaggcgggtggatcacgaggtcaggagatcgagaccatcctggctaacacggtgaaacccagtctctactgaaaatacaaaaaaattaaccgggcgtggtggcaggcgcctgtagtcccagctactccggaggctgaggcaggagaactgcgtgaacccgggaggcagagcttgcagtgagccgagatcatgccactgcactccagcctgggcaacagagtgaga

SEQ ID NO: 181250 - DNA, 364 bp, Homo sapiens
aggattacacggtagattcaaatatacaacgtcataagaccactcatttgtttaaccattcttattaaattataatttaatttttgagaaggagtcttgacctgttgcccaggttggagtgcagtggaaccatctcagctcactgcagcctccatcttccaggctcaataagtcctcctacctcaccctcccaatagctgggaccacaggtgcatgtcaccacccccagctactttttttttgttgttttctgtagagacggggttttgccatgctgcctggactggtcttgaatacctaggctcaagtgatccttcctccttggcctcccaaagtgcaaggattacaggtgtgacccaccatg

SEQ ID NO: 181251 - DNA, 491 bp, Homo sapiens
ccttttaatatgctgatagctttttaagaattgtggcactgtagtgttttttcatgaattgaggtctggctgacagataggaaacatgggatagtcattttctttgtaactgttattgtcaactggaattaactcaaggtccatagcatttaaaataatatagaatcagaaaatgcctagggacatctccatattctcaggtaacagtgggctcttttcagtattctgagtagctagggtgatctcaagtaattttttaaaaatttcgaaaagagtcactatagcaaatagttactaggctccaagttaaaactccagtggttcctacttgggagtctttgcagatagacctagcaacagaactcaagcattttactcatatctttaaaaagcagcagcatcaggatggtaattggaagtgacctaaatatttccatattagaaatcacagggcatgggaacttgtgatttataatggttgatgttttttt

SEQ ID NO: 181252 - DNA, 281 bp, Homo sapiens
cttactgtgactcaccataacagctattattaaaatataaaacaagcttacaacttgctatgaagaaaaagtaaactttttttaaagggcaaaagatattcattcttcaacaaatatttattactagacaatacagagaaagccagtctaaatgttaaacttattaaaagctgctcaaattctacaggagttgagaacatacaaattaaagttaaggctgtgatattttacatccatcagactgggaaatattaagaagagctataatatatactaatgga

SEQ ID NO: 181253 - DNA, 425 bp, Homo sapiens
gaataatctctgcttgggaggttgagtgtggcgctaaaaacaaacggataaagcttccaccgctataagctccaaaagccctgtgtgttgctcaccctcatatccccagttcgctttaggtactagaaactcaaaaactcagtttgctagagatacaaatcagcctttcattatgtggtttaaaatgtgcctgtatcagctttctaatttccacccacataatatgcagaagaaacacagcagaccctttttacaaagcttacaaaagttaggtaagagacacacaagaaatacatttacgtgttctaatggatccatttttacagtgtcaatatttacagcatgaatttgcatgtctctcagatggttataactcacaaggaaatccactgtttcatcttatattttcttttcttttttttttt

SEQ ID NO: 181254 - DNA, 344 bp, Homo sapiens
actctccctactgtatcctagcgcctaatggacagatattagttcagaaacactttataactaagtggccatagaggcaggcctgaagcctattttcattttctgtttcagtttctgaatctgttcttatttagtcttcccttaaaggctatctggcgcctccgtgatgcttaatcaggacaagcttgcagatgggtacaggttgcaggcccttgcctctcttcccttaaccccacagcagccagtaaaccacctggacacagaaagagacccacatattctctaaaatgcctgaatggaacaatctagaatctaagcattccttataggatacagtagggaga

SEQ ID NO: 181255 - DNA, 210 bp, Homo sapiens
  misc_feature (190)..(190): n is a, c, g, or t
ctttctttctttctttccttttctttcttctttctctctttttctttcttcctttccttccttcctttttcttttctttctttctctctttctttcttcctctctctctttttctcttccttctttctttctttatcctgtagttaagtttcccttgggatctctttgggaaaatggagtactgcatttnacaaggcaggacttgaattt

SEQ ID NO: 181256 - DNA, 339 bp, Homo sapiens
gatttcttaataacaactttaacacattattccttatctgagcattagaaacaaaatatggatatgcagagacatggaactatccaacctattgcatttactaaggatgggaaagcactggagggagctaattgagtccatgctgagtaattatcaatggaaatgagtttggccattttcttttgcactgggaaatttaaacaaaattgttgagtagacattgatactgtatttgtgcattcattaaagtacaaaagcttctcattttaattcataggacatgaattagaagaaagaaaggattacacagaaataccatgcagcataaatgcattcatg

SEQ ID NO: 181257 - DNA, 634 bp, Homo sapiens
ctaaggcaggatctcattggccaggactgggtcatatgtacatgcctgaaccaatcactgtgaatggggtcgggtagaattgtttggatggggttctgggtcatgtctccatctccaaaaccaggagacagtgtctgctctggattgtgtatcagtcaggggagaagagttactgtgagtgtctaggataagagatttactacagggactagacctcccataattgtgagaggagtgagaaagtgaagcccagaaaaggacttaaaggataaaagtcaccaaattgagaaaccaagcacatccaactacagacgtgactgcaaaaaagtgatggaggggtctatgggaagcagttatctttgagtctacagccaagaatctggccatgagcctaagctcacatttggtaatcagggccagaagttaggaaagggagctggaagcagcatagtgcagagcaattatgaaaacaatcacaatccagttcagtaagtgtttaataagagaaatcacaagacacaatgggagccccaaggggttacagaatccagcctagacaccaaggaaggcctcttggaggagacaacatttgagatgaggcctgaaggatgagaagagagccagaggaaatggg

SEQ ID NO: 181258 - DNA, 407 bp, Homo sapiens
ctagacaacggcttctcacactgcagtgtgcacacggtcacctgagaatcctgccaaatgcagatgctgatgtgtcggtctgccacgggccctgggattgagcaggtcccaggctctcaggtggtggcagatacctctggtccaaggacctcactttgagaagcagggatgtggtgcaaaggccaggttgtatagatggcccatccaagtgtggagaagggcaatgactaggccacgcctgtagcccctcgggggcttcctgctttatttagtggtagaggcctgtctcccttcctttccaagggtgtgcctgcttctcttccctctacccacccagttcaggtctgagcaaaaaaatccctggacatacagagacagcaggctctggattagattaagagtccagg

SEQ ID NO: 181259 - DNA, 128 bp, Homo sapiens
gtgagaggggaaagaatgtgaaaattgggtgttcattaatagaaagaatgtgaaaacagaacttcttacttttgatattctatggcagtaaactgtgagatgattactggagtacagggagtttatct

SEQ ID NO: 181260 - DNA, 527 bp, Homo sapiens
tggttataccgcccttaacccgttttcccaaaaaaaaaaaaaaaaaagaaaaaagaaaaaattctgagagtcaactgggtgattctgggttgcacagctgatctctctatgctctttcacatgtctgtggttagctggtgggtgacctggcatctgatctacaatggcctcatgcacatgtctggcattcacaggctgttggccgagtgcttcatttctacatgtagccttctatcctccagcagactatctcactgtcatgcacatagtagtccatggttccaagtgctgcaagagagattaagcctcaatacacacatgtttttctaggtctctgcttggatcccatttgctgctatacaagcctatattcaaggatagagaaatagactgagttctaatgggaggagccacaaaattgcatcacaaagagacaggaagaatttgtggccattgttggagtgcatcacattgtctttccccagtttatcctaaaacagccactaatttaattttgttttacaact

SEQ ID NO: 181261 - DNA, 329 bp, Homo sapiens
ctgtggctcctgctgctgacactgcctcctttctgcgcttccctgcctagggatgtctgtgttccttgggctcagcctgggccctcttctccttctgcactctcaaaggaggtgtcatccctcccagtggcctgacttccatccaggtctccagcccagatctcacattttcatttctgactttccaccccactgtgactcagagatggaagactcgtgcccctgccccagactcctcttccccagggtctccagtgcagggagaggaagcgttgtctgccctcttgtccacaaaagaaaaggaagttgtgttattgacagctcctcct

SEQ ID NO: 181262 - DNA, 449 bp, Homo sapiens
gtgaagtttaggtgaaagaatttggatatctaattgctctagcaccatttttggaaagtgctatcctttctgcaccacccccccactccttttttttgtaacagactctcactctgttgctgaggctgaagggcagtggtacgatctcagctcaccacagcctcgacttcctgggctcaagtgatcctcccatctcagcctcccaaattgcagaaaagtacttaaacatgacaccaaaagtacaatcgataaaataaaattaataaatttgacttcattaaagataaaaaattctgccctctgactcagttaagaggatgaaaatacaagctacagatgggagaatatattatttgcaaacctaggtatgacagatgactcatacctaggatatattaagaactctcaaaactcaacagttaaaaaaaaatcaatttagaacatgggcg

SEQ ID NO: 181263 - DNA, 259 bp, Homo sapiens
ttgggggagagggagcatttctctactgtcggggcccctcctccccctagcaaggatttggttggaggaggcctggctgagggctgttccctcaaggcctcttctccctgcaactagcctttctcgggaaactatttaagcccaacattcattcaacaagcagcgcctcctaccagggcgctgggtgtgggagaagctggtgactcacctctcccctcctctgtgaaagtgcttctagggcccgcttaggagcccagcc

SEQ ID NO: 181264 - DNA, 392 bp, Homo sapiens
gcagttgagggaattctcagccatctgtcaacaaacgatgcgatttaatagccatgaatatcatacatgcaacgaggtacaccatgacatcgtgcacttggaaaagttcctcaaatccccaacctcttggtggaagcttcaagcacgtggatgtctgcacacgcattccctctcccacaaacactgtacacaaacatgtaagatactggattacaaaaaccatctttgaaagagtaataccctatttgttaacaggtaatttcagctcaaagtagcttatgcttgtggtccttgatggaaagaaaagcctggacttggaaatgcaggggaaaaccatggtttccctcttacaagaggtgccctggatggggttcccaggtttaaagatacaa

SEQ ID NO: 181265 - DNA, 621 bp, Homo sapiens
tggtctaaatcagctgcatcccatttggtacccaggcaaggatttttccatacctatctttttgctggtggtaatgatgagttttgtcacttgctataacattctctgtccgtcttttgtcttttatgtaaatacttttgtgacttcattgtaaccagcattttgtaatactcttaacagcagaggggattaaatcatgattcacttctgaacagtacaatcagcagtaggaaaacgaggagggagggagagggaaattgtccaccacttcccaatgataatgcctggctcggaccccagattcacatcatacttgaagttcataaattctgggcactgctcagcttgaggaggcaggcattgctccttcatatttcagggtgagacaaatgctctgttgaagccatgccactacaggatacgttcacctctgcttgctttcctccctaagccagagtgtagttaaacatttatatgtcccaggccaggagcatcaaattaagaggaggttagctactttccctggctcttaaaaacatttgagtccaagtatggttctctggcttgagggtggccatttgttgcctcactgtttttattaggacatctggagattagagg

SEQ ID NO: 181266 - DNA, 319 bp, Homo sapiens
ctaacctcctgttgttctctcacactccatatcctagcaaatcacgtgggccctattttccaaacatattcagaatctggcttttcctcagtgccgccaccaccaggctgatacaggccaccaggactgctcggctggacttttacaagcaccttgtgacggtgtcctgttcccacccttcctgtgtctacactgtattgcctacccaacaaccgcagtgagcatgtctctctctggctcagaaccatccaagggcttctgtgtcacttataataaaatctgcatccttagaaggatttacctgactggatccctccct

SEQ ID NO: 181267 - DNA, 510 bp, Homo sapiens
ttatcctccacaaatgcctgcctatatgtctatcccaggtgaaaaactatcactagcttcacgatgtggctctcacttacccgtgcaggtttgactggccatatgctcccaatcccccgccatattactctgttccaacctttggcacctttgctcacaccattctttctttccagagctctcttctctttccatttctgcccacactccaacccttctggttaaacctgtcctcatgttttaagataccctgcaaatatcatccctttgtccagctaacaactcttgccctcactactgctgcacatacctgttgaattcaaattccccctctgtgtgctcccctaaatcctgtgttcactgcagactggtctcgccgttcctcaaagggccaagcacagtcctgactcagggcctttgcacgtgttgttccctctgcctgggatgctcatttcctaaatattcactaaatatctggcttccttacttcattcaggtctctgttcaaat

SEQ ID NO: 181268 - DNA, 346 bp, Homo sapiens
ttgggggtctgggccacgggagggaggatttgggggcatgaaagagaagcaggctgagtttccagggacaactttgctgcagactggggatatgttctgtacccctcattttgttcggcaagctggcgagaccagctggtggtgtggttttagttcacctagtggcacatcgggccttctgagatacgaaccgtgtaatgctaagcgtgtgggcgtttttagtcacgtggagcgtggttccgagcagaaaaggagatctgtgagccgagcctctatattcttcaggggctgaccgcattctgagggtttccatccaagtcagcgtgacaagattccctagcactta

SEQ ID NO: 181269 - DNA, 285 bp, Homo sapiens
gaaccacagtgggaagaagtcggcccaggctccatctggtgcacggggcagaggcatccctcagtcacaggaggcatccctcccgagctcctcgaccccaaagactattttcaggaaccctttgtaacatggctcttatttttatacatcaatgttttcctaaaatggaagccaaaggcacagcatcagatctaaccaaaccactgacctttttagggtcatcacatgtgccaatttcacctacttctcatatcttcctattttcaaagctcccctcaccctcaa

SEQ ID NO: 181270 - DNA, 682 bp, Homo sapiens
ctatacagaaaagccaatatgagaagcaatttgatcaacaatcactccctactgtttggagtaaccaccctcatgactttccatatgggagctgacatttgaagtaaattcttatctctattcaaagcatctaaatacaaatggtatgtccctcctagctggcaaacatgtaggcctcgcctggattttcagtttcaactattttggaagatgtctgtttctttgaagtatccctaaactatattttgtgtcaccacatagcctacattctaaagtttaaattaaactaacccaaatacatcttccaaatatggtgaaatataccccaaaatgttctagccacttttgcatgatgtggtaatacaaaattaaatttacaaaaatatgcagctctttataaatatatcaatataagtatgatatattaagctataaaacaaaaatactaaagttaaagctgccaaaaaatttgtagtgaggtcaggaatggtggctcatgcctaaaatcagtcatatttatatgcactagcaagaagtctaaaaggaaaattaagaaaacagttcgatttacaatgacatcaaaacaataaaatgcttaggaataaatttaaccaaggcagcacaagacttgtgcactaaaagctacaaaacattgctgaaaggaattaaagatgacctaaat

SEQ ID NO: 181271 - DNA, 190 bp, Homo sapiens
tcactcagtctcaagcaaaacagacaatctaaagttgctgctctgacaggctctcttcaaatgatttccatttccttgggcaagaactcagaacaagcttgtccaggatgcatgcggcccaggatggctttgaatgcggcccaacacaaatttgtgaactttcttttttttttttttttttttttttttt

SEQ ID NO: 181272 - DNA, 572 bp, Homo sapiens
ccctctaattattattgaattattgctttaatttcatacatccactctttccagaatctactttttctttgacattagaatttggagttttgcaactacgcgtaagtttagtcttgatttcatgtttgcctgtgtgaaccaatgtctgcctttctttacaacatttcattattaagatcttaattgtgattcagtctttggtcaactggcaaacgagttccccccaaaagtaaactccaagaatgacttttgttgccctttggttgcctcattcaaatgacagggtggatccaaatttaaaatactgtggaactgttctaatgactctgaatttagggttcctgagggagagtcagctctgggatgcctgtgtgcctctaggattgtttcaccttatgattcaataaattttccagaaaaagaatgtattggggtatgtctaggggtggctcctcctgtcccccacattctaactggaaaagaggaatccgtttcgatctgcctactctgatctaccatccccacacacaacatccccttacctaggccaattctgaaaatgtttactgtgc

SEQ ID NO: 181273 - DNA, 401 bp, Homo sapiens
tttgttactcaggaggaaagggctatcttttaatattccagacccactgaattgttttgattaccttgtgcttactgaggaagagtactagttgattctaccgcatacatatcctatttcctgtcattaatatatcttagtgtgacatgaaagggttataaaataaattttattgtagtaaaaaatatataacaaaatttatcattttaacagttgcaagtgtacagttttgtggcatgaagtatattcacattgttgtgtcaccatcaccacccatccatctgtagaacttagtctttcccaacagaaacttcttacacattaaacactaacttcctattctccccttctcctagtacctggcaaacaccattctactttgtgtctctatgaatttgact

SEQ ID NO: 181274 - DNA, 344 bp, Homo sapiens
tcaccatgttggccaggctggcctcgaatgcctgatctcaagtgatcctcccacctcggcctcctaaagtgctgggattacaggcatgagccaccgtacctggcctgtccttcgtttttaaggctgaaggatattccactgtacctataaaccatattttatttatccattcatccagtgacagacacacgggttgcttacaccttttggtgactgagaataatgttggtatgaaccttggatgtacagccctgtaacatttttttggataccttgatacaaaatgatctcgtcctttttctttgcacattattgacttccattttcctgttaaccatatacca

SEQ ID NO: 181275 - DNA, 125 bp, Homo sapiens
tcctttacctcctcagaaactactcttcctaaaatataagttgaaatccatgggaaaatttctgctttgatttttttcttagacattttgtagctttcagttatcattctgtgtggatcatcatt

SEQ ID NO: 181276 - DNA, 253 bp, Homo sapiens
gagtatgaaatacctacacacacacacacacacacacacctttatatacgtatgcagctgttagaaagctaaaatttgaacaaaaatatttctattttccacttaatgaataattattgccataacacaaacctactctcttttaaagtttgaataaaattgaagaaaccaaaggtgtttatgtaattaaaaatagcaccaaagaactaaaataattagcttttggtgttagagaaatcttaaatgattcaag

SEQ ID NO: 181277 - DNA, 314 bp, Homo sapiens
ggaccttctcactctgttgattttaccccctaaatctgtctctaaatattcatatttcttcatccccaggccacttttatttgacacctggattaccacagctgcctacgccgagctctcaatctttgctatactccagctagagtgggccttcaattccaaacctgaatatgtcatcattctgcttcaaatatgcccaatgaaacaaaacaatagtctattgctccttacgaagacatgacagggaaagatttattgaactggaatgtacctgaaatgtcatgtagtctatagaccgtcctccagatgaacac

SEQ ID NO: 181278 - DNA, 681 bp, Homo sapiens
tcctcaataaaacagataaataataaagccataactcacaaggacaaatagggaagatgaaaagtcaacagtacttggtgtcaaaaaaggaggcagacaagtgaaaactcccaaaacacacttgagaaaacagatgctttaaactgtcagtgggaaaatcagagacgcagctgcacttacgtcacatcaagaacctccaaaggcataagaattgatggaattcaatcttcctatggaaaggaagtagacaaagagctgaaaaaagaggactggttgaaagcctatttacaaattagcaccctcagatctttcctacaccaagcaatcaggacgctgtttctctacagccctgaaagactgagtgctttgatctagaagagtgtaaaataaagtgaggataagaaactatcaggcatgattaagggtaaaaaccaaaagcagggggattaagtgaaatgttacacattgattattgagacccacagccttcttccccacaacttggtaattagagttttggctgccaggtacccctcaagaaaggagattggaagttatcttcttgaggaatctgatcatcaccaagaagaaagacacaaagaatagtgacagtgagagttccctaaggaaaactgtccaagcaattcaccgttcagaagccatagttgataggttccaccc

SEQ ID NO: 181279 - DNA, 370 bp, Homo sapiens
ttacagaccatctctaaaccaagtgtatttaagtcagaaatcagtaataagacgaaacttttctgaaatcatcattttaaagtttaaaaatacagttcaaaataactgatcgtctaagaagatacactcaatatcaatgtaatcagtacatgtaagaatttattggattaagaaatggtaactaaagtggaaattagggtctccagtgctcatattacaaaagaataaagtccaaaattccatgcattaagcattgaaataaagacattataaaaataacaatagagtaaagcccaagagaaaaaatctttaaaaagcagaaatcaatacattcaatgccatcccaattgaaatcacaacaggatttttg

SEQ ID NO: 181280 - DNA, 918 bp, Homo sapiens
ttatatatatatatatatatatatatatatatatatatctcctcatgattatatatatcctcatgattttatatatatatatatataatttttttttttgagacatgtgtgcctttattagctgagccactgcttgagggggatgaagcaggaggagtgggtggccctgaagccggctgtgcttcacgggcttgtaggtgatggagaactcgcccaggtagtggctgatcatctccggcttgacctccacctggttgaaggtcttgccgttgtagacgcccaccatgctgcccaccatctcgggcacgatgatcatgtcccgcaggtgagtcttcaccacttccggcttctccatgggcggcaccgccgtcttggccttgcgcaggcgcttcagcagagagtgctgcttccgccgcaggccccagttcagccggcaccactggtgcgcactgtacagctgtatcagctgctcgtaggacatgtccagcagctagctgctcgaggtccacgccgcagcaggtgaacttgcggaaggtgatacatcctcttcgcagacagcagaaaaacatcagatttgtgatttaattgggagttttctgggatcgaacagtggcttcgtttacagtcgtgacagcttgagccagagggtgccagccagtgccatgatgtgaccaaggccatcaacagcagagccgcaagggagcaggagccttggtccctgaggacatgctggagctaacttgggaatcctgaggtggccacctccaaaatgttacatgaaagagaaaagtaaacatctaacttgcttaagctgctattgttttggggtttgtcatttacagccaaacctaatcctcattaaaatagtggtggaactggaatttgaaccagtttactcccaagaccaaaaaaaaaaaa

SEQ ID NO: 181281 - DNA, 322 bp, Homo sapiens
tactggttgtcaaaggttaaaccaggactgactacacaaattctcagcagaagcttgttagaaaaacagattctggcactccagcctggtgacagagtgagaccctataaaaaacacacacacacacacacacaaaacccccacaaaaaacagattctgaagcccatgtaattttgattttaaaaccaggtttaggggctgggcgcggtggctcatgcctgtaaccccagcactttgggaggccgaggtgggcggatcacgaggtcaggagatcgagaccatcctggctaacatgttgaaaccccgtctctactaaaaatac

SEQ ID NO: 181282 - DNA, 344 bp, Homo sapiens
cctaagcaaattaatgcaggaacagaaaaccaaataccacgattttacttaaaagtagaagctaaacaagggtactcacgtacacaaagatggcaacaacagacaacggggagtactagaggggagagggaggaagagggcaagggttgaaaaactattggttactacgctcaatacctgggtgacaagatcaattgtaccccaaacatcagcattaggaaacacaccctagtaacaaacctgcacatatagcccctgattctaaaataaaagttaaaattatttttttaaagtaaacactttggattgtaactcaagtataaatgagcccacacacaatctca

SEQ ID NO: 181283 - DNA, 398 bp, Homo sapiens
aggcgggatctgcccgtgcagcaggagtgggccttggagactgatgggcccaggttcaaacctggcatcctcactttttgcattgtcaccttggacagcgtgtcacctctctaagctttattctcctgtctctaatatggagctcctggggcagtattttgcccagtagttagaaacgctcaatcagatcctgtttcagagtagcccagctgagggctggcacatacagaggactcagtcggtgtcacctgctgttattgtcatgactgttacgatgatgacacaggatgccagactggacctcatgagggcagagattgtacgtttctaaaaattgtggtatagtataatttacttaagtaatgtatgcatatcttgtacagctcacgttttacaaa

SEQ ID NO: 181284 - DNA, 183 bp, Homo sapiens
tttctgatatccagagagaatttctaggccacagcaagaggaggcagaactgaggtagagcccagtggactacttgagctgaggaaatggagctgagagtccaaggagactaaggcagcactgcttcagatccacctaccaaaaaataaaagcaagacccaaaatgatcacactgtttcctga

SEQ ID NO: 181285 - DNA, 331 bp, Homo sapiens
gggattacaggcatgagccaccgtgcccggccaagtatttatcttctgtggaactaaccactacgctcagcattttggagatctaggactgggaagattgcggtcagttcttgctcttaaagcactctatccagctggagaaacatgatggccattcatgaaggagtttgagtcctgtccattgtttgtaatggaatccagattaaacatctactgtccaaataacagtcctaacaatgcaagggtcagaaaaaaggtcagcattattggctcgaggtaatagaacagacctcatggagatactgaaattggtggtgggcactgaaggttg

SEQ ID NO: 181286 - DNA, 632 bp, Homo sapiens
cagaacatggttctgagaaggtatttttgcaggagacctgggctttggtccttgagagctgggattccctagattatccctagtttgctgtaagtcgaaatgcaagttatttttgtgtttcaaatgagataccatatatgtccatttcataagtcggatttcttatatcatttttttcatttttaaaatttatttttggctgggcacggtggattatgcttgtaatcccagcactttgggaggccgaggcaggcggatcacgaggtcagaagttcgagaccagcctaacaaacatggtgaaaccccatctctactaaaaatagaaaaaactagccaggcgtggtggcgcacgcctgtaatcccagcaactcgggaggctgaggcaggagaatcgcttgaacccgggaggcggaggttgcagtgagccgagattgcaccattgcactccagcctgggtgacagagcgagacgccgtctcaaaaaaaataaataataaataaataaaaataaaatttatttttatttattttttgagatagggtctcactctgttcccaggctggagtgcagtgtcatgatcatagctcactgcagcctcgatctcccaggctcaagtgatccttctgcctcag

SEQ ID NO: 181287 - DNA, 420 bp, Homo sapiens
ctctaagggttagcgtgatgtgggcagacaaggaaactgaggcaggggcagggaagactttgcttctaggagggaagctgggattcctataagacctccacctccccaccatggcttcctgttgctttggagcccttcttgtggagacattccctggcactctcttccatggcagcacctaaatgggaagaggaaacagcaaaaaccctgcaggagaacttcttgaaccaaacgcaacagaatagaaaaggaatgcaggataacccagttaatggagaacatccggggtcaagcatgaactgcactgtgttgtctttatgaaagagaaacaaaaactcaggaccccaattcactgtgacagaaggaaaaaaaaaaactggaagctgagtcatgcaagaaactgcctttccttttgttcct

SEQ ID NO: 181288 - DNA, 240 bp, Homo sapiens
aaactatatcctcttcctctctgaaaccccaaacatcccaaagtctccttcaagccagacatcctcttggtctactgtgcatggtgtctgcacggtcctcaagtttgcctcagggaaagtgcctgttgccatcagaaagaaagaatgcagcaggtactgatttatctcaggcaaaggagctcttgtggtgggtttcaacaagatatgaaaattgtaggttcttgaacactccttttcttc

SEQ ID NO: 181289 - DNA, 524 bp, Homo sapiens
ctaccaagtgtgcctgaaagggattttgtatccccatatcaagagatcgtcaggttaaggaaggaactgccaaggaggacttttggctacacatctggtcctcctatgctttggtttcttccaattctgcaatattgggctaagtgttgagagtgggtggtatagaagcagatttaattgaaccacaggctgtgggatgcgcctgcctcaaggcttgctgtttagatcactcaaagagctttcagacaaaatacctgagacactgaatatgaaaatgggctctgctagtttcttagaagccttgcctatcctggcagcctggcaggaaaagctagcctagaaggagtgcctgctaaggttagtataagtgaggtacatcagcagaccatgtggtaggtattactgaatcttttctgtatttcctttaatgtcattgtcttatgcagcttttatgaattaattaatcagttttcaaaaggccatgttagtgagactgtcagagcttttaacccctccttagtata

SEQ ID NO: 181290 - DNA, 727 bp, Homo sapiens
aaacacaaataaagaactccgagactaatagaatacatttaacaaagttgcaatagtaagccattccctatcagtacttaaagtgtagatggattaaactccccagtcaaaacacatagcatggctgagtggataaaaacaaaaccaaaaccaagcctaactatatgctgtctatttaaggatgtacataaatggacagtgaaaggatggaaggagatagctcataccaatgagaccccaaatagagcaaagatggctgtgcttgtatcagaaaaaagggactttaagtcaaaaactgccagaagagacaagaagtctttattatgataaaagggtcagctcccaggaagataaaataattgtaaatatatatgtattcagcataaaagcacctaagtatataaaacaagcattgacagaactgtaaaaagaaatagaccacaaaacaataataataggcgacttcagtagtctatttttgataacagacagagcatccagacaagatcaaaaagaaagcagaggattttaataacactatagactaaatagacctaacagacatatagcggacattacaaaactcaaaaagcagaatacacattcttctcaagtgcacatggatctttctctaggaaaggtcatatgttaagtcacagaacaagtccttacaatttcaagaattatatcaggtatcttttctgatcacagagggatgaaattagaa

SEQ ID NO: 181291 - DNA, 284 bp, Homo sapiens
agtagacagctcttccaattttacaaagacatttctgtaccatgcataacgtcaagcataaaatatggaagaaatttataaaagcaataactagtccttttgaagactgaagaaaagcacaaatacattacacatttagtctcccaaatgttaatctcattggaggcaagaactaaaacttcagagcttactatgtattccccggtattcagctaaggaactagtggagtctccggagccaggtttcacagcttttacccaactaaagaatctgcttggctcca

SEQ ID NO: 181292 - DNA, 872 bp, Homo sapiens
ttttagtagagatggggtttcaccatattggtcaggctggtctcaaactcctgacctcatgattcacccgcctcggcctcccaaagttctagaattacaggtgtgagccactgtgcctggccaggactcttaaatttttaaaatgaccgttttctttttttggacacaactacagcaagaaataatacagatcttcaagttggcaactcattcaatatctcctacagaaggtcaggaacctagaaactgtgttccttcagggtgcaaacccatgtgttccttaacagcagaaaaaggtcagtgggcaagaccagaacaaattagatatgatttgttttttaagttgaggcttagccagaagggtttgtatggacctcttagattaaggtttgtttcacagtggggataatgtttgctatgtcaataaacaggtacttttctttcatcattctccaaatttggttcttaatgagatctgacatcccctcttccattagaaggtattgaaatccagtggaccagtttctccaagatgtctcttgaaagtaaaactctgcttaaaatctgttttttccagggctctaatcactactctgttaaattcctcaaacttgtaatgccccaaggcttgattttttccagataatggctctatcgttgcacataccctgattctgtcagcatgtgtcattggcaaaatagctttctctgccaaagctttctgacctttggctccatcttagctttgttagcaggaaaggcctgctacccagagtcagagtcaatcagagaattgttcatgtggtccttagaactttactccttacccttttatcttttctttaaactttcgcctctaaatctgccaggga

SEQ ID NO: 181293 - DNA, 171 bp, Homo sapiens
cactgattctgtgccattggatttaggaaactttacactaggcagtgaggaaccataagttagaaagatcatactgacttagtgaggagcgtggcttggaaggggtaaagactgaaggcctgatgatcttaagaagttacatgagataataagaaaaatcatatatgctaa

SEQ ID NO: 181294 - DNA, 378 bp, Homo sapiens
gaagtgaggagcgtctctgcctggctgcccatcgtctgggatgtgaggagcccctctgcctggctgcccagtctggaaagtgaggacagtctctgcccggccgccatcccatctaggaagtgaggagcgtctctgcccggcagcccatcgtctgagatgtggggagcgcctctgccccgccgccccatctgggatgtgaggagcgcctcgtcccggccgcgaccccgtctgggagcctcccagcgcccaggacccctgcctgagcagtgagaggccctgattgatgcccaggacagcaagctttcccaccagcaccaacctcaccattttctttcagtatttgaggactgaaaagaaggcttcataatgatgggtacc

SEQ ID NO: 181295 - DNA, 360 bp, Homo sapiens
attgcaagggtggatttgaattctggaaatttggttccagagacaataattacataacactttctccatagggtacagcctgtctaataggctatagtaaatcacctcagcttgttataggtcgggcatgcaaacatttctccattttactccctttggtaatgaatctagtaatagatggaaattttccctagattcactgtgttagtcagttggggaagtttggaggcaaagatacaggagtttatggggaggtagtgtacataaatataatcatatgctatataaggaagttttggtcagcagcagaccatatataggatatgattatatttatgtacactacctccccataaactc

SEQ ID NO: 181296 - DNA, 219 bp, Homo sapiens
taaagagtgatacagactgcaatacaataatagtaggagatttcaacaccctactttcagcaatagatagatcatccaaactgaaaatcagcaaaaaaaaaaataaaaaatttctgaggtactaattgggattatcccgtattcgaaggccttttggaacaggtggtgtctggttggatatagggggggtaccgagtctcgaatacagaaatctagggc

SEQ ID NO: 181297 - DNA, 410 bp, Homo sapiens
tatccacactattttgtgggcttttatgtttcaaaaaccataaagtacataagcctcacttttgaacctagaaagaaaatggataaacttcattgtctgagacagtcatttcttcagtgaatctcatagattctcacaaatgcaccatccaagggagactgtacaaacatgttcactgaagcattatttataatagggaaatgtggagaaacttaaatattccttaatagggaatgaattaaataagatatatccctatgacagaatattacacagtagtgaaaggaataaatgacatttaaacataatgggagagactaacctcaaaaacctgatgttgaatttttatttatttatgtatttgtattttattttttgagacagggtctcactctgtcacccaggctgga

SEQ ID NO: 181298 - DNA, 188 bp, Homo sapiens
agccatagtgtcctcattctattagtgtacaaactgagggtcccagctgtgaagatgagttagtaagcagttatcattcccccagtcagggtcccacctcactgctgcaagggataagtccatgttttcagatgaaggtatgatatggattaaatattgaagaacagcctctcctgtagttatgctaa

SEQ ID NO: 181299 - DNA, 529 bp, Homo sapiens
tgacgcacacacacgcacagccgacaagacttgatactaactcaagtagtcatatgatcgattaagatttgggcgtgcttagggaagaaagagctaattaaaaagaaatcaaggttattacagtccatgtatcttcctgtgtatgcttttaaagtccttgtaaccattgagttacagggctttaactcctgtgtctgaaaaatcacaaacactgatgacaatcaaagcctcatcttaaggccccgtctaaatgcaatcatgatcgcatttagattcacatgcatttataggaaataatacaaagaaattgtatatgccattcacccagtttcctacgatggtaacatcttgcctaattatagtatactgtcacaaccagcagttgacattaacagaatccatctactgtattgagatttcatcagtttcacatgcagtccatttcatgtgtctgtgagtgtttacttctattcaggtttatcaaatgtgtagatttgtatggccgccaccacagtcaagatgcagaaca

SEQ ID NO: 181300 - DNA, 770 bp, Homo sapiens
gtcctgcaaggctgtttgttgtgattggtcaatatcctaagggcaaaaatggctttttgttcctttacctcactgggttcccattttcccttttattttggccagataattccttcctatttttgtgttgcttttaagaaaattgtgaaaatattttgtccagaatttttggctgcgttcagtagaagaattgttgtggggcaccataactggaaactgaattctcttattttactttcaaaatctgacaaataagaatggccctactaatttttgggggagaaataatgttgacagacagcacttctttatcaagagatgtgcctatttagtcctgaactttatttcaaatctacttttctttgaatggtaaagggagacctacagtttttctccaaaatcttgataactgaagcagagtttaaaacaaacaaaaccctttgctatgcagtcaatgaaaggtgtttgaaagttcagataatctggatagagtcccctttgcccacctgctatctccttgatgtcagctatacttttgatttgctaatgtgtgtagcatccaggtttcaattctgggccattagaaataaaattgtccttggatctttggcgtttcttgcctcggtggccaatctgacaaaacaatctgttgaccatcataattggacagttgaaagtatgggcctcagagtcagacatctctatcactttcattttacaatttttctaggcctcatttttgtaaatgtgggtgataatatccctactaa

SEQ ID NO: 181301 - DNA, 346 bp, Homo sapiens
ataatcttagaaccattttgcatattctgtggtttaaagaaagacacaagaaacagcaagagtgagaggtgggggaggggaaaattcctcttcacagaaaaatgctgccagctaataaaatggagaaggaatagcaaaattagaaagtcatcactttgcaaccaccagtgtgataatcaactcaagtgaggattatcaacggatgctaaaatcaccggatggaaggtagctgaggaacaggatagccatggagtctcaaagtgtcaccccacagattactcactaatggcaaaggaaaacagataagcttacaatggagagatcggataaacacctactcggccgc

SEQ ID NO: 181302 - DNA, 970 bp, Homo sapiens
cacagcagatgggaccgttggccttgagtgtatggttaccttgcctgtgatcagaggaaggtcagcccagcatgttcaaggggagtttctaaaggctgtggtcagtagtggccagtgatgatgtctgccttttggccaggtcggaggagtggagcacacacgttaaacttggcttcctcgctgggcgcgggggctcacacttgtcatcccagaactttgggaggctgaggcaggtggatcacctgaggtcgggagttcgagaccagcctgaccaacatggagaaactccgtctctattaaaaatacaaaattagccaggcatggtggtgcatgcctgtaaacccagctccttgggagcctgaggcaggagaatcgcttgaacccgggaggctcaccgcaacttggcggtgagccaagatcgcaccattgcactccagcctgggagacaagagcgaaactccatctcaaaaaaaacaaaaacacttgtcttcctgtactttcctcctcccttccaggggaaaaggggcacgccttgaaagggtgttaattagcagaaccagtgtggccagttcaaggaacttgaactgacttgggataaagctaaactcagtttcttaaatgacttgtgtcatttgtaacttggaagtgggctgggtagcacgatggggcccagccaggatggaaggcagagccccatgcattcttgcccttcctcttgtggccctcacatgccagtgtgctctggtgctccagcatgccccgtcttcactccatggccccttctgtcctgtcagggaccagcagcgctcaggctctgctgagcccaggagaggaatttgactcaggaagaaccttctgtgagtctggtttttggaaagcgatgagcagagatgaatgattgcgacttgggtgtgtggatgggtttgggatttctatttgagccgggcagcgttcttccttccttcctgtc

SEQ ID NO: 181303 - DNA, 570 bp, Homo sapiens
ctgttaatctccttatgcagggacattttttaaaataatgtatgtggttgggaactgtaaaaattcagaaatacatattattcaaaaataatacaaaaaaaataggagattcagtaacgcagaaagctacaaaataaccaaaagccttcttatttaaaggcagattatcttaacaatctgctgtgatttcttctaggagaaaaaaattatacctatatacagtatatgtttctatctttatgtacattactgtttgaaactttgattcctgaagagcaaggattcagatagacagggattcatcaaaaaataaaacaacctattgactccagagtttaattaatgagagttaataggcaagattaccttagttctttttttttaatcttttttaacaaaagcatggccttgctatcacagtttaaaactgtacaatttaaaactttcttaacaaatctcatcttagagttctttgaaaaggcagtcacatctgcattctttctatggacatgccgtattttatttaacttacattcatttgatagacatttaggtttacaatcttttgct

SEQ ID NO: 181304 - DNA, 231 bp, Homo sapiens
gtccagaaaacttgtatttacactctggccctttattgataaagttttctgatccctggtttagattattaacgtctcaagtaagtatcagtatggttagatttagttccactgcgcccagcctctttttctttttgagacagggtcttgctctgccacccgggctggaatgcagtggtgcaatcacagctcactgcagccttgaactcctggactcaagcaatcctcctg

SEQ ID NO: 181305 - DNA, 368 bp, Homo sapiens
taataaaggaagtgaagagagagagagaaagaagaaggattgttaaacagttgtccttaaatctagacaaggtcaaatgttcaaaaacaaacttctcaccacttttctaagagcaagtacaaatactgaagtgcacacatcttaacaatggagaggctaaagtcattaactaagtgactcaagtactgcatcttttctccaagtaaagtaagaatttaaaatgcaatgttattctttccaaacattttctcttcccatttggtggcctgctataagctgagtatcattattcttctgttatattttttagatcattttagcctggtgtgcatacacacatacatgtgtgaaatatatatatatatata

SEQ ID NO: 181306 - DNA, 2556 bp, Homo sapiens
atacaaaaaaattagccgggcatggtggtgggtgcctgtaatcccagctactcgggaggctgaggcatgagaatcacgtgaaaggcgggggttgcagtgagccaagatcgcaccactacactccaactgtgcaccacagcgagaccccatctcaaaaaaaaaaataataataataataaaatcatctctgccccaaagctatttcctcagatgcaaacattttccttgaccatagccaattaacctctcaacatctaatccacctccctttggaactggctgataccttgagaaacctttcttctccacagagggtctgccagttcagatgctgaaaagtttttctatctggagaaacccataagccatactattagacctatgccccaaagagctaagctaagttaaacacacagtgtttacaaatgagcagctgaaaaggcacacaagcttaagttgcagaagacacacacttgattttccttgctatggagggccctttagaacattccctacaaagttattttagaatgtgaagagacagctgggagcggtggcttgagtctctaatcccagtactttgggaggccaaggcgggcagattgcttgagcccaggagtttgagactagcctgggcaacatagtgaagccctggtctctacaaaaaatagaaaaaaaattagccgggtttggtggcatgcgcctagacccagctactgggaggctaaggtgggagggatggcttgagcctgggaggcaggggttgcattgagctatgatcgtgtcaccactgcactccagcctgggctacagagccagaccctgtctcaaaaaaaaaagaatgtgaagagacagagaactgaatgcaaagaccctaactcaataaaactttgttttcttcacatgcaaaacaatcagaaatgctctttgttttgtaatctggccaccagccactaggcccatataggggtggaggagcctagacctgctaatctcggcgcatgtgagtggggttattgctgtcctctcaacaagaacccagttttgagagacaggacttgctggatttcctaggctgactaagaattcctaagcctagctggggaaggtgactacacctacctttaaatacagggcttataactcagctcacacccaaccaatcaggtagtaaagagggctcactgaaatacaaattaggctaaaagcaggaggtaaagaaatagtcaaatcatatatcgcccgagagcacagggggagggaaaatgatcgggatataaatccaggcattcgagccgggaggggcaacctcgtctgggtccctcccattgtatgggagctctgttttcactctattaaatcttgcaactgcacactcttctggtctgtgtttgttacggctcgagctgagctttcgctcaccgtccaccactgctgtttgccaccgttgcagacccatcgctgacttccacccctccagatatggcagggtgtccgctgcgtttctgatatagcaaggcgcccattgccgctcccaatcgggctaaaggctcgccattgttcctgcatggctaagtgcccgggttcgtcctaatccagctgaacactagttgctgggttccacggttctcttccatgacccacggcttctaatagagctataacactcaccatgtggcccaaggttccattccttggaatccgtgaggccaagaaccccaggtcagagaacaaaaggcttgctgccatcttgggagcggcccaccactatcttgggagctctgagaacaaagacctgtccgttaacagtttccctatactgatccagctcctggagtatctgctccctgacatgtctctatgtccagtccccttgtcaagatgcatgtagatgcattagacacaacagatgtcttttgattctccatcaaaatcaataaaacataaaacatttggataacataaaaattgcaggtgacctgaatgccagtattgaaaacaggtccatttaaagcccaagtcatggcagagtaggctaggaggattccttccttttggcttcactttcagggatggtcattttaattaaggtggggatcattttaaaatcacatataaacacaaacaatattattaaatagtgatttctgacataaattagggaaaaatgtggttcacatttcagtcaaacaatatttaataattagcttttccctgcttagcgccatttataagacaggcatttaagagtcaaaaaaacaaacaatgttgctttactcttaatagccaaaaactggaaacaaccccagcactttgggaggccgaggcggttggatcacctgaagtcaggagtttgagaccagcctggccaacatggtgaaacccatctctactaaaaatacaaaaattagccaggcatggtggcaggcacctgtaatcccatctactctggaggcaaaggcaggagaatcatgtgaaccagggaggcggaagttgcagtgagccgagatcatgccacagcactccagcctggatgacagagtgagactccatctc

SEQ ID NO: 181307 - DNA, 599 bp, Homo sapiens
agatggtcaacagggagacggatgtgcagtcgggagtactgggtcgagtggtgcgtctctggacaggggccccagggtggctgctttcctcttccttcacaaacaggaatacactaacctccaaaatgaggctgacttaggtctccccagcatcgacagacagttttacagagttagtatctcaagttctagatgcaaattgcccggatttgaatattggctccatcatttacaagctgagtgaccttgggcaagggacttaacctctctaatcttcagagtcctcatccataaaatagacacagaaagtgcacctatcttgcggagttataagtgtataaagagataatccacataaagtgcttagcgcagtggctagcatgtagtaagtgcttaacaaatgacagctattagtattattagcattatgcttctgaaagcgtaagctgtacatcctctggaaggagaagaaatgaacccaggacacttcccctaccagtctcaggatgaacatactaagaaaaagttgaagattctatcagatttcttggacaccaatgaaagaacgtcactaaccatgaagaatgtttccatcataa

SEQ ID NO: 181308 - DNA, 118 bp, Homo sapiens
tgcctcagcctcctgaatagctagggctacaggcctgcatcacgtgacacccagctgattatttattttttgtacagatgggggcctcattatgttgcccaggctgttctcaaactcc

SEQ ID NO: 181309 - DNA, 229 bp, Homo sapiens
gcacacttagatttcacagatttagtaaggaaaaaaatgttacacgtttatatgtcgaaatggtattttgggtaagcatacctgctttctctgttaatgtggctcctagaaattttaaaatggcatgagtagccacattgtatttctgttggacatgcgcagatgtgcaagtatggagtttcacttcctccgtgcagcagccaccttcctctcccatgccctccacctg

SEQ ID NO: 181310 - DNA, 152 bp, Homo sapiens
aataaaaaacttctttgtattatataaaggtttagatcagaactagtaaaacagaatgctgtttctttttttttcttttctattttactttaggttctgtgggtagatgtgcgggtttgttacatgggtaaattgcatgttgctgaggcttg

SEQ ID NO: 181311 - DNA, 323 bp, Homo sapiens
taaccaacaaagagctgcagtggttctattggcaggcagaacagactttaagacaaaaatttttgctagaggtaaagaaggacattttataatgataaaaggtcaagaagaagatagaagatgtaacaactaaaaatatatgtgcacctaataacagagccccaaaacacatgaagcaaaaactgacagaattgaaagaagaaataattctttgacaagaatagctgcagactacagtaccccacttttaataatgaatggaacaagtagacatgagatcaataaggaaatataaaacttaaacaatagaacaactacaaccg

SEQ ID NO: 181312 - DNA, 247 bp, Homo sapiens
atagcggatcccccaaacgcagagaggaggcatatggaataaaggtctttattccagtgacctctgctcattggaaaactttgggctggtagatttcatgattctgacgctgtatgtcctcttgagttacagtgagtgatgaggccaaatcgcagggtggatgatgtgctttttttgggctaataggtgttaaggaggcatgctgtcctttggcgttaagacagatcatttcctcagttgggtaatg

SEQ ID NO: 181313 - DNA, 613 bp, Homo sapiens
attgtgacatatgagatacagtaatttggcatatgtattaagtttaattgatgttattgcctttgctctgtaaaggggatttgtttgatgtcccagtcaaaaaattttaaatacatcttgttcccttttaagatttccctagtggcacagtttccttacagttaaataattttgcattttttccctctcataatttaccatttacttcactcaccttaaaaaaaatcactaaagtaacaaaatcattcaaaacaaaatgaatgaaaaataaaatagtgtctgttaattttttcagatctcatttccactattgagatatattcctgttttactttagaagtattttctaaaatacacatagcaactcctttttttttttttaattttatgcatttagtggtgattttgcttcgtttttggtctgttttgccaaatatgcatagtacaacttgctaaaatttttgtaattaatgtacatttaaagtgcaggttttgcaatttaaggcaaagccacgttagcaatgtggacccttttaaatgtttcaaaccaatgacttaacggaaaaagccagtcaaggcacactctacacaaaaaccaacttagaactctcta

SEQ ID NO: 181314 - DNA, 1237 bp, Homo sapiens
aggggtagcgattcccgtaacgcggctcttcgcgtcccggattccggtggctgcgtccgcgtcgcctctcccagactagatcgaagggttccccccacctcccctctgtgggcggaaagagcggaatgttccatttttctgtggaataacggggtcatgaactggagcccgggtgctgcccgccgcccgctgcccccgccctcccttctcgccagggcgcctgcggcctctcttcgcggccttccccgagggactcagagccgcgagggaccgcctagctcccttggggatggggaaggcgtgggagcctcttggggaaagtgaagagctcggtggccgtgactccgcacgagactgcggcagattgtggcggcggcttctctccaagacttacgatttacggaatggccatcttccataattaacaaataaataaatgaaatttaatgtcagggtcaaatgaaactggaaacaaagcttatctggtgatatatcaaattatgagagtcattatttggatgtaaggatatatgacagatagactcttaggagaaatgctatgacctcctgcttcttggtattccttgtgtgatttcctcctcttgagtgtgaaggcatgtatgtcattgagttatataagatagtgcccatcttgctagtgtctctctctctcttgtggctctgaaaaatcaagctgcctgccatgtttgagctttgatatggaaagacccacatgttaaggaactgagggcagactctgccaacagctagctttgaaactgaatctcccggccaggcacagtggctcatgcctttaatcccagcactttgggaggccaaggtgggtggatcacaaggtcaggagttcaagaccagcctggccaagatggtgaaaccccatctctactaaaaatacaaaaattagctgggtgtggtggcaggcacctgtaatcccagctacccaggaggctgagggagagaatttcttgaacccaggaggcagaggttgcagtgagctgagatcacgccactgcactccagcctgggtggcagagcgagactccatctcaaaaaaaaaaaaaaaagagagaaagaaaccaaatctctcagtcctacaacctcaaggaactgaattttgccaacaaaagcagatccttccccagtcaagcctcagatgagacagcatcctcagctaacaacttgtttgcagcctcatgagaactgaagcagagaaccc

SEQ ID NO: 181315 - DNA, 1993 bp, Homo sapiens
  misc_feature (1831)..(1831): n is a, c, g, or t
  misc_feature (1878)..(1878): n is a, c, g, or t
  misc_feature (1894)..(1894): n is a, c, g, or t
  misc_feature (1945)..(1945): n is a, c, g, or t
  misc_feature (1949)..(1949): n is a, c, g, or t
gcaccggctcgcggcgcgtggaggctgctcccagccgcgcgcgagtcagactcgggtgggggtcccggcggcggtagcggcggcggcggtgcgagcatgtcgtggctcttcggcatcaagggccccaagggtgaaggcgcggggccgccgccgcctttgccgcccgcgcagcccggggccgagggcggcggggaccgcgggttgggagaccggccggcgcccaaggacaaatggagcaacttcgaccccaccggcctggagcgcgccgccaaggcggcgcgcgagctggagcactcgcgttatgccaaggacgccctgaatctggcacagatgcaggagcagacgctgcagttggagcaacagtccaagctcaaagagtatgaggccgccgtggagcagctcaagagcgagcagatccgggcgcaggctgaggagaggaggaagaccctgagcgaggagacccggcagcaccaggccagggcccagtatcaagacaagctggcccggcagcgctacgaggaccaactgaagcagcagcaacttctcaatgaggagaatttacggaagcaggaggagtccgtgcagaagcaggaagccatgcggcgagccaccgtggagcgggagatggagctgcggcacaagaatgagatgctgcgagtggaggccgaggcccgggcgcgcgccaaggccgagcgggagaatgcagacatcatccgcgagcagatccgcctgaaggcggccgagcaccgtcagaccgtcttggagtccatcaggacggctggcaccttgtttggggaaggattccgtgcctttgtgacagactgggacaaagtgacagccacggtggctgggctgacgctgctggctgttggggtctactcagccaagaatgccacgcttgtcgccggccgcttcatcgaggctcggctggggaagccgtccctagtgagggagacgtcccgcatcacggtgcttgaggcgctgcggcaccccatccaggtcagccggcggctcctcagtcgaccccaggacgcgctggagggtgttgtgctcagtcccagcctggaagcacgggtgcgcgacatcgccatagcaacaaggaacaccaagaagaaccgcagcctgtacaggaacatcctgatgtacgggccaccaggcaccgggaagacgctgtttgccaagaaactcgccctgcactcaggcatggactacgccatcatgacaggcggggacgtggcccccatggggcgggaaggcgtgaccgccatgcacaagctctttgactgggccaataccagccggcgcggctcctgctctttgtggatgaagcggacgccttccttcggaagcgagccaccgagaagataagcgaggacctcagggccacactgaacgccttcctgtaccgcacgggccagcacagcaacaagttcatgctggtcctggccagcaacaaccagagcagttcgactgggccatcaatgaccgcatcgatgagatggtccacttcgacctgccgggcaggaggagcgggagccctgggtgagactgcattttgacaactgtgttcttaagccggccacagaaggaaagcagcgcctgaagctggcccagtttgactacgggaggaagtgctcggaggtcgctcggctgacggagggcatgtcgggccgggagatcgctcagctggccgtgtcctggcaggccacggcgtatgcgtccgaggacggggtcctgaccgaggccatgatggacacccgcgtgcaagatgctgtccagcagcaccagcagaagatgtgctggctgaaggcggaaggatcgctcggctganagagggcatgtaatgccggaagatcgcacagctggccgtgtcctggnaggccacggcgtatgntccaaggacggggtcctgaccgaggccatgatggacgcctgcttgcaagantttntccagcagcaccagcagatgatgcgctggctgaagggggagagg

SEQ ID NO: 181316 - DNA, 1989 bp, Homo sapiens
  misc_feature (1827)..(1827): n is a, c, g, or t
  misc_feature (1874)..(1874): n is a, c, g, or t
  misc_feature (1890)..(1890): n is a, c, g, or t
  misc_feature (1941)..(1941): n is a, c, g, or t
  misc_feature (1945)..(1945): n is a, c, g, or t
gcaccggctcgcggcgcgtggaggctgctcccagccgcgcgcgagtcagactcgggtgggggtcccgccgcctttgccgcccgcgcagcccggggccgagggcggcggggaccgcgggttgggagaccggccggcgcccaaggacaaatggagcaacttcgaccccaccggcctggagcgcgccgccaaggcggcgcgcgagctggagcactcgcgttatgccaaggacgccctgaatctggcacagatgcaggagcagacgctgcagttggagcaacagtccaagctcaaagagtatgaggccgccgtggagcagctcaagagcgagcagatccgggcgcaggctgaggagaggaggaagaccctgagcgaggagacccggcagcaccaggccagggcccagtatcaagacaagctggcccggcagcgctacgaggaccaactgaagcagcagcaacttctcaatgaggagaatttacggaagcaggaggagtccgtgcagaagcaggaagccatgcggcgagccaccgtggagcgggagatggagctgcggcacaagaatgagatgctgcgagtggaggccgaggcccgggcgcgcgccaaggccgagcgggagaatgcagacatcatccgcgagcagatccgcctgaaggcggccgagcaccgtcagaccgtcttggagtccatcaggacggctggcaccttgtttggggaaggattccgtgcctttgtgacagactgggacaaagtgacagccacggtggctgggctgacgctgctggctgttggggtctactcagccaagaatgccacgcttgtcgccggccgcttcatcgaggctcggctggggaagccgtccctagtgagggagacgtcccgcatcacggtgcttgaggcgctgcggcaccccatccaggtcagccggcggctcctcagtcgaccccaggacgcgctggagggtgttgtgctcagtcccagcctggaagcacgggtgcgcgacatcgccatagcaacaaggaacaccaagaagaaccgcagcctgtacaggaacatcctgatgtacgggccaccaggcaccgggaagacgctgtttgccaagaaactcgccctgcactcaggcatggactacgccatcatgacaggcggggacgtggcccccatggggcgggaaggcgtgaccgccatgcacaagctctttgactgggccaataccagccggcgcggctcctgctctttgtggatgaagcggacgccttccttcggaagcgagccaccgagaagataagcgaggacctcagggccacactgaacgccttcctgtaccgcacgggccagcacagcaacaaccccagtcacgtgtcacacggaggatcaagtcctgctggtcggacgtgggtgactcctcaggcacgttggggtcccaaggttcatgctggtcctggccagcaacaaccagagcagttcgactgggccatcaatgaccgcatcgatgagatggtccacttcgacctgccgggcaggaggagcgggagccctgggtgagactgcattttgacaactgtgttcttaagccggccacagaaggaaagcagcgcctgaagctggcccagtttgactacgggaggaagtgctcggaggtcgctcggctgacggagggcatgtcgggccgggagatcgctcagctggccgtgtcctggcaggccacggcgtatgcgtccgaggacggggtcctgaccgaggccatgatggacacccgcgtgcaagatgctgtccagcagcaccagcagaagatgtgctggctgaaggcggaaggatcgctcggctganagagggcatgtaatgccggaagatcgcacagctggccgtgtcctggnaggccacggcgtatgntccaaggacggggtcctgaccgaggccatgatggacgcctgcttgcaagantttntccagcagcaccagcagatgatgcgctggctgaagggggagagg

SEQ ID NO: 181317 - DNA, 1910 bp, Homo sapiens
  misc_feature (1748)..(1748): n is a, c, g, or t
  misc_feature (1795)..(1795): n is a, c, g, or t
  misc_feature (1811)..(1811): n is a, c, g, or t
  misc_feature (1862)..(1862): n is a, c, g, or t
  misc_feature (1866)..(1866): n is a, c, g, or t
gcaccggctcgcggcgcgtggaggctgctcccagccgcgcgcgagtcagactcgggtgggggtcccgccgcctttgccgcccgcgcagcccggggccgagggcggcggggaccgcgggttgggagaccggccggcgcccaaggacaaatggagcaacttcgaccccaccggcctggagcgcgccgccaaggcggcgcgcgagctggagcactcgcgttatgccaaggacgccctgaatctggcacagatgcaggagcagacgctgcagttggagcaacagtccaagctcaaagagtatgaggccgccgtggagcagctcaagagcgagcagatccgggcgcaggctgaggagaggaggaagaccctgagcgaggagacccggcagcaccaggccagggcccagtatcaagacaagctggcccggcagcgctacgaggaccaactgaagcagcagcaacttctcaatgaggagaatttacggaagcaggaggagtccgtgcagaagcaggaagccatgcggcgagccaccgtggagcgggagatggagctgcggcacaagaatgagatgctgcgagtggaggccgaggcccgggcgcgcgccaaggccgagcgggagaatgcagacatcatccgcgagcagatccgcctgaaggcggccgagcaccgtcagaccgtcttggagtccatcaggacggctggcaccttgtttggggaaggattccgtgcctttgtgacagactgggacaaagtgacagccacggtggctgggctgacgctgctggctgttggggtctactcagccaagaatgccacgcttgtcgccggccgcttcatcgaggctcggctggggaagccgtccctagtgagggagacgtcccgcatcacggtgcttgaggcgctgcggcaccccatccaggtcagccggcggctcctcagtcgaccccaggacgcgctggagggtgttgtgctcagtcccagcctggaagcacgggtgcgcgacatcgccatagcaacaaggaacaccaagaagaaccgcagcctgtacaggaacatcctgatgtacgggccaccaggcaccgggaagacgctgtttgccaagaaactcgccctgcactcaggcatggactacgccatcatgacaggcggggacgtggcccccatggggcgggaaggcgtgaccgccatgcacaagctctttgactgggccaataccagccggcgcggctcctgctctttgtggatgaagcggacgccttccttcggaagcgagccaccgagaagataagcgaggacctcagggccacactgaacgccttcctgtaccgcacgggccagcacagcaacaagttcatgctggtcctggccagcaacaaccagagcagttcgactgggccatcaatgaccgcatcgatgagatggtccacttcgacctgccgggcaggaggagcgggagccctgggtgagactgcattttgacaactgtgttcttaagccggccacagaaggaaagcagcgcctgaagctggcccagtttgactacgggaggaagtgctcggaggtcgctcggctgacggagggcatgtcgggccgggagatcgctcagctggccgtgtcctggcaggccacggcgtatgcgtccgaggacggggtcctgaccgaggccatgatggacacccgcgtgcaagatgctgtccagcagcaccagcagaagatgtgctggctgaaggcggaaggatcgctcggctganagagggcatgtaatgccggaagatcgcacagctggccgtgtcctggnaggccacggcgtatgntccaaggacggggtcctgaccgaggccatgatggacgcctgcttgcaagantttntccagcagcaccagcagatgatgcgctggctgaagggggagagg

SEQ ID NO: 181318 - DNA, 154 bp, Homo sapiens
ctggctgaaagagaaacaagaggttgtgacagtgccaggaacggggcagactcttaagcagtagcgctgcttctctccccacttcacacaaactactgtggggcagcataagagcctgtgccaagccgagaggcatgggcaagccgaagctcag

SEQ ID NO: 181319 - DNA, 106 bp, Homo sapiens
gttcagctattcagaagctcccaaaccctgccctcttgggcttttcatggagactgcactggataggcatgattgacaaccatgaagaaatgtgactggacctaaa

SEQ ID NO: 181320 - DNA, 940 bp, Homo sapiens
gcggaatattcctggtttgctggttctctgtgacaatttggttactctggaaacattggtttatgaagccaggtgtgatgtaactctaaccctgaaagaactccagcagatgaaagacattgaaaaactaagattactgatgaatagttgttctgaggataaatatgtgacaagtgcctaccagtggatggttccctttcttcatcgttgtgagaaacagtcgcctggtgtggctaatgagctattaaaagaatatttagtaactttagctaaaggggacttaaaatttcccctgaagatatttcagcattccaaaccagatctgcagcgaaacaattattcctgatcaggaccaactgatggcaaatagcactagagtgcatctatacctgtgaacgaggatgatcaactctgtctttgctatgagcctactagaatgtctgccagaaagaggatatggtgatacagacagaggcaagacacataagcttcatgacaactggtagaccaactggaacaaatttctcagtgtgtcagagcctttaggaaaaaacgtggactcgagaaaccaataccatgttgttaaggaacactcaatctaagctcagaagaggcacgcaagctgaatgggttagaatgggacgaggcacactggccggaagcagctcctgtcaggagtctccatggagaaagtgctgcagaacttgtgaactatgccgcagaagtgtcccatgtctagatctgatggctggtagagatattacagaagcctcgggagccaatcgctgaaactccccgggtgacgagcagacggcgggcgggcaaaacacacggatgccaagggaaccctacggagacacaaaaggaggggcgccaagataggtccaacgcgagggacccgggtaaaagccgaaggataaagggagaggaaacgaggaca

SEQ ID NO: 181321 - DNA, 425 bp, Homo sapiens
tagatcgcgccactacactccagcctggtgacagagcaagacttcctctcaaaaaaataaataatattaaccagtaccataagcactgtgctaagcatgttacgtgtattgtcatgtgagcaagatgtaagatacacaagggtagggttttgtctgtttggtttactattgagtccttggaacttagaacagtggctagcacattgtagccactcaacaaaaatttgataaatgaatgaaagttctcccataaaggccacgggatttatcctggtactggcaaagtgacacgcagagatttgaaaccaggtggtttcagtcaacacctcactgcctctgttatcacatggttcagccagcacaccctcatccagcccatcttgttttcaattaaataaacaccctttggcaatggaataactaaa

SEQ ID NO: 181322 - DNA, 845 bp, Homo sapiens
tactctaatacttgaagggggcctgcctctccacacctgtgggtatttcttgcaaggtggagacgagacactgagaaaagaaataagacacagagacagtatagaggaagaaaagtgggccaaggggactggtgctcagcaagtgaggacctgcaccagcattggtctctgagttccctcagtatttattgatcactatctctactatcttggcgagggggatgtggcaggactatagggtaatggtggccagagggtcagcaggaaaacatgtgagcaaaggactctgtgtcataaataagtttaaggaaaggtgctgtgcctggatgtgcacataggccagatttatgtttgactttacacagacatctcagtgcagtaaagagcagtattgccgccagcaggtctcacttccagccataaggcagttttctcctatctcagtaaatagaatatatgatcaggttttacactgagacattccattcccagggacaagcaggagacagatgccttcctcttgtctcagctgcaaagaggccttcctctttcactaatcctcctcagcacggaccctttatgggtgtcgggctgggggatggaggtctttcctttcctacaaggccatatctcaggctatctcagtggcgggaaaccttagacaatacccaggctttcttgggcagaggtccctgtggccttccacagtgcattgtgtccctgggtacttgagattggagaatggtgatgacttttaccaagcatactgcctgcaaacatttttaccaaggcacatcctgcacagccctaaatccattaaatcttgagtcaatatagcacatgtt

SEQ ID NO: 181323 - DNA, 532 bp, Homo sapiens
attataagccctttaatagtcagtcctttgacaagattggtatcattgggtccctatgcttgaattactgtgtttaatctgtcatttgaaattatttgtatctatcaggtctgctttacacgaaacacctttttctggtatgagaacttcatttgattaaagggaagggggatggtttggagattgagtctggagataaggctgcatctctgactgttgtccttttactgatactccttcctatgctgggcaacttaatctatctccttgctttgtaaatcttgcttgtgcgagaggcagtgtccggctgtgacaagactaataattggggtcaggtaaactccaatttggaacatctccacttagcagctttttttactttgggcaaagcatatcttcttctgaaaatgagcatggcaatgcctgccatgtagggttgtaaagcttaaatgaggtaatctattcaggataaatatatacagtgtagttccacagtgtttggaacttggttggcattgttgggccaggaaca

SEQ ID NO: 181324 - DNA, 649 bp, Homo sapiens
gggacccagagaacagagagaagagaagctgggcaccagcctatctgtgttcagcgtggtgccaggagaacctcttcaacacaggaaatggtgagttagtgagagcctcctgggggaatttgtgctgtccacaggaacctgtacaagactggaaatgggagaatacccctgcccctcaacccccacgactccactctgcttctagactgagacagagagctacctggatattttgcaggaacaagtcctgagtccaggaagacccctataagcctttggcccttgagcaggccagcaccaatgccacagccccagcagaggctgcagtcatagtgcctgggggcagtaagactgcttcatcctcttgccggatggggctcagtgccagcttctggctcagtggtcctgcttctttctgaactcagctagtaggtgcagccccctgttttaccaggaaacacccaggcagcagggcaggtggccctgctcacccccactgctggaagccaggtgggcaatgcctgctagagtttccagctcagcaatctctcctctgtctaaactcagccagtgggcacagcctccttttgtcctgggaagcacctggatggcagggcaggtgaccccacccatacctgctgctggtagc

SEQ ID NO: 181325 - DNA, 435 bp, Homo sapiens
ggttaattcaaagaagacaagaaagaagagaaatgaataatagataaaatatgagactaataggaagaaaagtattgaaggaagtcaaaggaaatacatgtggataggcaggttgaagccagattgcatgtgtccttcaaagccaaacggaggaatctgatatgatttgctcggcaatgggatatcactttagattcttagacagtgatgctgcctaacaattatacttgacagggattagtcagtaattaaatacataactgaagagaaaaaaaatttacacatcactttttaacatcagctagtataaaaactcagaccagtcgtttacctattagataaactaagatcctaatctgataaatagcccttctacttgaatacattcattacaattcctggtcatcagtggtcaatctttaaccagacaaaaag

SEQ ID NO: 181326 - DNA, 744 bp, Homo sapiens
agtgtaagggggatatgttaaaagattttcttctaataacaggccagccataaggttttttcccccaatttggcacatgaagattataatagaagaactattattatattaaattaactaatcttacaaaatagatttttgtgctttttatattatgtttaatttcagattttgcagcaccattatattcagagcaattatgtgggtgactgctctatgagtcaccagctgaaatagaaaggttgggctctggtgtcctatttgattgggaagctggaaggacaggctgtattgagcacagacatttttcataattatgttgcctgcagggttgccacctgtcctaatttgatctgattaaggtgaaatgcaaaaacggttctcatttctttcagagtggagtgatgccaagcttcatctcaggaaggaagaagagatgaatacacatacaaccaaggaggggagggttgtgtctctaatactctgggaaactgggggacattggcctcactgtgattggtggtgttaagtttgtagacaaattctgaagagtgttttggcaggaatgatggaaatgttaaatggaacgatactttaacccggtggtagtcgcactttggggagtgtgtccaatttaatgcctctgaatggtttgcaaatatgcatgtctaggtgactcactgacaccaatatgatcattagggtttgcctcaaggatattgcaaaggtgcgtagccattaaaa

SEQ ID NO: 181327 - DNA, 828 bp, Homo sapiens
ggaagtctgtttgagaacagaggcaggctcagatgggagcagctcctaccccgggccgcctatccccctttaccctggggtttcttttagctccaagcatccattccagtctaacaaatctggtggcagagtctctttttttttttttttttggagacacaagaaggtcctccccctcttgttgcgcccccgaggtttgggagttgctagtggggccaccaaaaaatctctcggggctctcaacgggcggaagccctcacggccttctctgggggcctccaagggcgggattcctctttgtgccctttcaaaggccctccctgtgggaggtatctcgggggcgatctggcagggccgttgtgccaccccacggtgtctgggcctaacttttccgtggtatctctaatttaggtaaagacagacggggccgggggtctccatacctaaataatgtccacaacagaacgggtttggggtcttgggaaacttcctggaagccttcaaatttggtatccacgttggcgcctcagggccccccccacaaatgggtggctgggggactcccaggcggcggtagaagccctcttggaaccacgagcccctttggtgtttctaactggagaaccacctaagaatcttccatttttctgtgcgaccaaggggggggtgggcgactaaaaatggcttcggctcctcaaagccctaccagtttccatggtaggaactcacctagggggactttggccaaatttgtcattggccccaggccccaccttggaggggaaaccttgccaacatgtgggcgggcagacctcacgggttttccaa

SEQ ID NO: 181328 - DNA, 139 bp, Homo sapiens
atgccctcccaggactgctggtagtaagtgtggatttcaaatgtcactcctagcagccctgaggctgacatcggatagagcagttcctcaaggatttcagagtccaggacatgggaaattggggtggtttgttttttag

SEQ ID NO: 181329 - DNA, 141 bp, Homo sapiens
atcttgtcttcgtgtcttcgtgtcttcgtgctctgacttctgtctttctgtctcaaaaataaataaataaataaaaataaaatcctgtaaactaaaatggaactcatccaaatagaatggtaccttccttaaaatgttgga

SEQ ID NO: 181330 - DNA, 519 bp, Homo sapiens
gggtaagagacaagagccaactatttcagggtgaaaaagatcagttagaaacctattaatatataaaagttaaaggaattacagtatgaaaaatgtaaagaatgactggcagtcccactgccttcacgaatgactatgccaaaaagggaaaagagtttaacttgaaaataaattatactaaatgttcaaggactaacatttaataagggagaagagtgatatggtagggaaagctttgtgccaactttcaactgcagctgtagtgaaatacactaaaagccttgtcttaagacaaaagcagtaaaataaaaacaatggttttaaacatatccccagtgtcaactgctcatgaccataaatttgcctttttctaatgaacaactaatgggataaaaggccatataagggaaaaagtagtcgaaaatacaatcgaacaaacttctcacacaagactaaaccataaaacctgtttacaaattttcatacatgtcagaattaaaggtaaaaacactcaaagct

SEQ ID NO: 181331 - DNA, 521 bp, Homo sapiens
gaccctctccctcgttccgcccaggaagggacccggggaaccccctgtgtcccacgggccatagtgaaagcacttttcctttctttccccacctggccatccccgcttacggagaaaccagtttgtactcttcgtgcaagagccctggaggagactttagggtgtctaccatttgctttaatctcccctgattattaagtattcggcctctttagagaaatgtattcaagacttgggggtttccttcctaattctccgagtcccaaggaacgcatcttaataattaggaggactttttccttcttcattcccttcagtgagtctctgtggaaggaggatttgatgtatatattcatgtgttcctccatcctttaggaagggctttgaggacttcttggctctgcgttgtaggaagataagaagggggaaacactgactttggagatgtgacaaaactctttgtttcactcacatatctgtagagtacttccctccttatatcggttgccttccttctgtcc

SEQ ID NO: 181332 - DNA, 285 bp, Homo sapiens
ttttatatatggaatacatagatatatttatctcacagtaacacacatgtgcacacacgcacacacacacacactcacagcccctgcatgctggtagtgtgagattgtataccccatactctatatgattctgctttgtattcctttgtatatactgttccccatagcgtggaatgtccttttctccccttgtctgctgagagcactctagttgctctaaaacccattttagctttgcctcctctgaaatcttttgtgctgcctgctgacggttactttctggcg

SEQ ID NO: 181333 - DNA, 452 bp, Homo sapiens
ctggttcctcaaattcaagtatttaaaactgaactcaccaactcctgtcaaacttactccctaaatatttctcaaatgtgccttctgtctatcatgctatcattgcccttgtttaagctctcatatcctgcttttattttaaaaaccattcttagataaaacatccctctccttgacgcctttttctatctcctctggtagcctcctaagtgatttatacagatctaaaatcttaccattctcattcccttgcatttcatggcttcttaacaccaagggaataaaaactccaagtatgttagcatgacacacaaactttccatcatgtggcacctgcttattactttccagggtcgcctgtattcactctgctttttaaactttccatgacgtggcacctgcttattactttccagggtcgcctgtatttactcttcttttcatacttcaca

SEQ ID NO: 181334 - DNA, 243 bp, Homo sapiens
attgtctctgaaaaaaaaagaaaacaatacatacatatataggcgatcataataataggtatcacaaattatttgaaaagttataatgggagtttactggtatattcagacacaaattactaaaacagaattattgaataaatgtacaaagtttagatgcttatattttctttttcaaatttttcaggaacatattttattgatttttcatgcctttctatctactaaatataactatacttc

SEQ ID NO: 181335 - DNA, 619 bp, Homo sapiens
ggtgggaacagcctatatgtagcaaagcttttatgtaccaaaaagtactgtaatacccccttactcactgtccacctattgaatcatcatttgtgacctcccctgcaatctaatgccaaaagcctggtgattcaagacaaaactacaaaaaaaaaaacagcagaggacatcagggaaaacaaaatagcatttcaacatgtattttcaaaacctacacaaaagcagacttcatgaaagataaaattcgttgtttaaaataagtacttaattttgagactaagcattagctatttgtagtaagagtcctaaggttttgcagataaaaagtgtactctggccaggcacggtggctcacgcctgtaatcccagcactttgggaggccgaggcagatggatcacctgaggacaggagttcgagaccagcctggccaacatggtgaaacccgtctctactaaaaatacaaaaaattagccgggtgttgtggcaggcgcctgtaatcccagctacttgggaggctgaggcaggagaatcacttgaacccaggaggcagaggttgcagtgagccaagattacgccattgcactccagcctgggcaacaagagtgaaactccatctca

SEQ ID NO: 181336 - DNA, 346 bp, Homo sapiens
atcaattaaatccgggcaatgccacatactctgttctctctcttggggatttagcatacatttacagaattgttaaaaaattgccttgtgtctctagtttttaaatttaacggaaatggatttttgtcatcgtatgagagtggggatccctcagagcctgttaattctcaaccttgccttctgctgcctcccttgttgaaaggccctggattttcctttacaccactgctgtaggcaaaagtcatggggctaagtcagtcccaggagggacactgactcttctttcatggataatccttttcccctggcactcaggtgggatcaaaaccgagtcatccactattcc

SEQ ID NO: 181337 - DNA, 523 bp, Homo sapiens
ccaacgttttaacttctagaaactgaccaagggggatggtacctacgaagtactcaaaacatatttattagataagttagtagacactgtccaaagtattgtgttaagaagaattgtgagtctggacccaggttctggagagaagatgagaacactggtgtgtgtcctgaggtttcaggatgggaaagtgttggcacataggccatgtatttgccatcccagagaaagaaactcagtctccccaaaattaagaggaagatgacacagaaagtcagtaggagagccaggtaaaatgcaatcacttctttccaagacctttatctcttacttggaagtcaaaatgaacacatttgtaatggagaagaaatccatggtcaacagtgaggtgctgatcaaaactgcaatcagattggattagggagagatcagagtggatggacatcagcatggaaggctttctggaggaagcagaaaatcgagttgccccttgatgagcgattatctggaaacttcctttgttgtc

SEQ ID NO: 181338 - DNA, 106 bp, Homo sapiens
gcacccggccgttgctcattctcgtaacagtctggagatgaggaaccttgttccttccattttctctcttcaccatcccctgggctcaaggtgttggcctctgtat

SEQ ID NO: 181339 - DNA, 719 bp, Homo sapiens
ctcctccagcaggaagtcagtcccagaatagttgttctgctccctcccttctaataagtgctgcgctgagtgtgcttgctttgccagatggttaaaacagagcaggggatagaaggacagatgtcttcaccctcatggagttcaccttccagtaggaggaggcgataggccggggtctgcacatgtgcgtgctacagcctgttccacgtagagacaggatttcaccatgttggctaggatggtctcgatctcctgaccttgtgatccgcccctccctcagcctcccaaagtgctgggattacaggcgtgagccactgcaccctgccagaaaactcattcttctactccatcctacagttttccctaagagagaaacaataaaacgccaccacgaccaatggcaaaaagctggcacccactccacgacttttcatatctacacgtttgtacagctttatttttaagcattctgaaattctatgcaggagagaccccagctaggtttagggagtcctagggtttgtggagtaaatgaagtttctccctagaattagggagggtagagacaggcagagaactgacaatcctaacagctgctgtcctcagagccactgtttctgagagctgctcgctgagtgcttctagcgagttaaatggtgttcgcccaaaagacctgttcacgtcctgatcctgggaacctgtggctgtgatcttatttg

SEQ ID NO: 181340 - DNA, 876 bp, Homo sapiens
aatggacctttctccaaggaaaatatacagctggctaataagcacatgaaaaggtgctcagcatcactaattattaggaaaatgcagttcagaacttttgtgtgataccactttgcactcattaggatggttactttaaaaaagtaataataataattattggtgtgtatgtggagaaattggaacctctgtgcagatagtgggaatgtaaaatggtatagacgctgtggaaaacagtgtggcagttcctcaaaaaattaaacacagaattaccatgtgattaagaaattccattttgcatatgtaccccaaagaaatgaaagcagggtctcaaagaggtatttgtaaacctgtgttcacagcagcagcattcacaatagctaaaacatggaagctcaagtatgcatcaagagatgaggggatacgcaaaatggtgtgtacatacaatggaatattattcaatctttaaaagaaattttgaaacgctctaacatggatgaagcttgaggacattatgctaagtgaaataacccagtcacaaaatacaaatactgaatgattctattgatatgagtatttgtgcaatcagaagtcatagagacatagacgctgatccagaacattaaaaaaaaaaaaacagtaactcaacagtggagaatctgggcagacttccctttaaccaggttaagatctccggtaatgagtcaaatctacatcatctgcctctgatatgatgcactgaaaggacacatcgtccctttctgtggtgtccccgacactaccagaaaataaccagaatccaaacaggagacagcattcagacaaacccaatttgagggacattctacaaaaggggtagtcacaagacgggtaccg

SEQ ID NO: 181341 - DNA, 253 bp, Homo sapiens
aggaacaggaggaggaggaggaggaggcacaggaggaggaggaggaggcacaggaggaggaggaggaggaacaggaggaggaggaggaacaggaggaggaggaggaggaggcagcggcggcactgtgggtcttccacagggtgtgcccggaggaggtcaagactccactgccctgaagcaaacaaggcgtccagcccgagccagggtcacacgcccaacaggtaggatccagcaacccctgcgcagcagcccc

SEQ ID NO: 181342 - DNA, 602 bp, Homo sapiens
gtacacgagaagcaaagttataagagtggttgaattttcccaagagaaagttaaatgtttctaggacagaaacctgatgggtgttccggtaatggtgagagaacccaggagagagtggtattccacaataagggtagaaaatgcttttagaaagaactgctaatcatgtgaaacaccgctgtggggtgagtggaggtaaagacaggaacacatccaacgacttaacaacaaaggggtcaccagagaactgggttcagtgataaggtggcaagcccagggtaaatgggaaggaaagatatagacagcaaggtgctcgcctggttgtctgaaggaagacggagaaaagacagcacaggggctttgaagtttgggtgacttaagtattctaggaaaggagaaatgaatggagatagatataagatgcttgtagaggggtgtttggaagtgggtgctccagtgagacttggcatggtggaactctcacactcaacaccattcatttcactagcttatgaagatgctcctcccctctcctcacccactcatctccttcattctctcaggaggctgagggaacaggattgaaactacaatctaatacg

SEQ ID NO: 181343 - DNA, 152 bp, Homo sapiens
accctgagtctgtgggggcttgtggagacctcagatgcctggcacccacagtgtcacttcagctgggggcctaggtgtggctcagactggggcgcaggtatgaatgtaggggtggcaacaagagtgaaggtaccaggtctaggggcaggagg

SEQ ID NO: 181344 - DNA, 420 bp, Homo sapiens
ccctcaacctacgaggactccacttgacttcatcctgaaaacacacttaggtacaggtaagtatgctttcagtgtcccagaacagcgtattcgaaaccagatcacgccaccgctcagctggacctgccacccttataataaaatcaaaactcggccgggcgcggtggttcatgcctgtaatcccagcactttgggaggccaaggcaggtggatcacctgaggccacaagttcaccaccaacccggccaacatagtgaaacctcgtctccaccaaaaatacaaaaatgagctgggcatggtgggaggccagggtaggaactagggtgaggcaggtgagccacttaccttgggtgcaaaatttaagaggcaccaaaaccctcaagaattaagaattaatgcaatactttcacttcttccttc

SEQ ID NO: 181345 - DNA, 175 bp, Homo sapiens
ggagaatcggttgaacctggaaggcgaaggttgtagtgagccgagatcacaccactgtactccagcctggcgacagagcgagactctgtctcaaaaaaaaaagagtggtggtggtcagagatggggcagtggcagtggaggtagatatggatggactagagaaagatttaggaat

SEQ ID NO: 181346 - DNA, 287 bp, Homo sapiens
cactgcactcacgccagcccaggcaacaagagaaaaactctgtctcaaaaaaaagggaaataagacttgtcaagacaggcggcataagttcaagacctctattgtgcaggctggggactacagttcccagcaatatattatatacttgaaaattgccaagagagtacattttaagtgttcttaccttaaaaaacaaagtatgtgaggtcatgcatataactagcttgatttagccattctacaatgtgtacctatattaaaatgtcatgttttacatcatctttatc

SEQ ID NO: 181347 - DNA, 345 bp, Homo sapiens
tctaggggctttttagtctggcaaagtccaaactcaaaattcatttactcaaactattttcagtgggggtttctttgcctggtactgtgtaagtgttggagatacatgaacgagttggacaacttgttgtagaagagagccccaaggagaaatgggtgtgtaccaggagcatgaagcaaaggcattttgagggcacttgaggtccattcattcactctccagccttcctcccttaatgtaatcagtacccattctgaagcccctggctccctcctccacttctggggtgcagcaaaaatacttcttcagggaagatttttttgactcattgatggggagagattc

SEQ ID NO: 181348 - DNA, 829 bp, Homo sapiens
agccaaagggggaataactgcagaggaggaagggtcactgggctgcctgcagcagccctgggctgaggaagttccctgcaaggtgactactatgactccagaagaaaagataccaacaggagtgtctcctggacttttagcaagggattatgacctctgcccatgcccagccattgctctgtggttctgccagcaatgcgtactccagatcatcagtttttttcgggaaccatattctgtccttaagttggattcttcaagctttgagagtgcctgggagaaaacacctttgggtttacagatttatattgtagcccaaggccccactaaccagatagcattgtccttcccaatggtcactcttctacgacatcccccaccttcccaatggtcactcttctacgacatcccccacatgcagaagcaagaagaaactggtcttctcctctcaagcacttgtaaagaaacacaaggggtggggtgacttgcattcatttcttcccattgcaaaggtggcacccagcactgaggaaagcaagccaggatacccaggctatggaagtattcatatagagaggatgaaagggtagggctcctaaggaatgactcagctggcatgtgagagccaggccaggaaaaggtcatagtcagtcacacctgctgcaaggaaggggctgcctcaggtgggatgtacatattctctagagcagatgggtgtctgcttgagggttttagacttgggtgcatgaaaactctctgctatggggagtttgtgtgggctaggccagaaggtggctagcagaccctctacattatgtgcgctgagcca

SEQ ID NO: 181349 - DNA, 410 bp, Homo sapiens
agtgcaatggcatgatctcgcctcactgcaacctctgccttgtgggttcaagcgattctcctgcctcagcctccagagtagctgggattacaggtatgtgccaccacacctggctaatttttgtatttttagtagagacggggtttcaccatgttggtcaggctgttctcaaactcttgatctcaggtgatccacctgctgaggcctcccaaagtgctgagattacaggctagagccaccgtgcccggcttgtgtgtccagattatcatcatcaggaatctttcaggttgaagcaggaaagacaggtgtgcaggcgtcccaacaaggtggttggtcattgcaaatcctctccccttcagcaattgtttccaaggtggaggtagttaaaatgaatatctagacagcccttg

SEQ ID NO: 181350 - DNA, 311 bp, Homo sapiens
tacaattaatcgcatctgaatcctctccaatgacatcttctcagttcttcctcctcacacttcctaaatgccagtaactcccccaggctgtatctccacactgccccttagtgagctgaccctgccattcagcctctcttctgtggaccagctcccataacacgagttatgtcctctcctccaagctccagtgcaaactttcaacctgccaacaagatacctccaactcagtgggttcaaaaacaaccaccatctttcccacccacactagttcatccttctgctttccttcaagaccctaatctccctga

SEQ ID NO: 181351 - DNA, 146 bp, Homo sapiens
cctggatctcagaatcaagtttcatgctttataccactgagttgattaagcccctgaaggctgggcagtgtttttaatggattgtttctagttttgataaagtgatgggggaaaataagcttagaatctttagtttgaaaaggaat

SEQ ID NO: 181352 - DNA, 543 bp, Homo sapiens
gatcaaaaatcactttcctgaagtagtttacagtcaagagatgtccatgaattgtcattatcagaatgggtacagagtttacagagttgaaccttggagaattaaagaatgtttaatggttaacccatttatgcctgaaattgtaattttttgaatttgaaaaatcagaccttggtgatgaccttgagcagtaggatattaataactcccacatgcttagtgttcaaataatggaacactaggcataaatggattaaataatgcaggaatggaaagtgtgaacagatgtacaactgctgtagagcttgtatcagttgtcagaaaccttccaacaaagaaaagcgtaggaccagatgggttcattgattaattcaatgaaatgttaaaagaaattaatgccagtccttctcatagccttccaaaaaaactgaagaggaaggaatatttccaaattcattagtaggccagcattaccccagtaccaaagcaagacaggccacaaaaaagaaaactatagcccaatatccttgatgaatatagatg

SEQ ID NO: 181353 - DNA, 390 bp, Homo sapiens
atcttaaacattcagtgataaaattgacaattagctggtgtagctttagcaaaatttgaaagtcagccttctattttcataacaacattggattttctgttttcattcttgtctctttgcaatccattgtatacatggaacccaagggattgtgtaaaaaatcaaacaaatcagccatcatgttgttctcttggctaatgggttcatatgacttctcaatgctttctgaacatatccctactccttactatggcctaaagaccccatgtgatctgaccccagatgaactctcttttcttatcaaatatacctagccaggtaaatcttgtctcattctttgccacatcaagctgtttcctgcctgagggccatcgtcttgctatgtcctca

SEQ ID NO: 181354 - DNA, 291 bp, Homo sapiens
gccagtgacattaattctggcaatgtgctgacccccctctcagcagggccatgggcacagagaagacaaggagagtcccggttaaggggctgttcccgaaggacagttttgtctccagcgtcatcggccggccattgctcacttgtgctgtggacgcatgtgtgggtgacgggccttccgccacgtgctaagggcaaagtgagcctgctccctaccacatctggaattcattttgcagtgggttatgggaaggtacagttctggtttagtgtgatcaaagtcagttaggct

SEQ ID NO: 181355 - DNA, 108 bp, Homo sapiens
ccttctggaatagatttaattccactgtaaagaatcatcaaatattttcttttggcatgacaaaagtcaggcacctgtgtcatagcttgaacttgaaaacatgacagt

SEQ ID NO: 181356 - DNA, 550 bp, Homo sapiens
accggagtgcatgtcttttgcagaaaggaaattcttgaatgttaaaagaaagagaaatgaacaaaacttttcccactttggggtctttttcttatccacaagacactggactaatgagtgtctgtaacttgcacagatgtcctcatctagaaggtctgatgggacattcagcatgcattgctgtctgctgggaggaggactgagaattttcatggctgcatggctgtgttcctttatttatttgcccctcgtggaaactcgtgggtcactcggatgtagcaacaatggatgacgagcaaatgctgagtcaacccaaagtgaacatggcatgtaggagatgcgcaagaggaaattaaaaaaggcctgatgcagcttctctctggttccctctgtagaggggctggagagaaggttggttttaatgatgaagatggatggaaggatggaaactgcacactcattcagaccacagaggccagaagacaccggatgccgagctccttcccacacatggatccaggagctcaagccattccccttcatgtgggag

SEQ ID NO: 181357 - DNA, 388 bp, Homo sapiens
gggatatagaatttaaaggtcagaaaggccaaagtggctgaagtttgtaggccaaattattggagggggaggagttgaaccaacagggagctgggaagatgtgaagagagtacctccttaactgaatactgatcagcacactcctgtgaggaaaccatcaaggtgagagaaaggacctctagaaaaaagtagacagaaccaccaccagagctcacacatagccagaaatagttcctgatcccactagccaaagttgaaagatgttttcaaacacaagacatgaagtagagtcctcagaagaatattgcctcaagaatggggacaaaccagccctggacaaaaacctgttacggacctgcttaataacatttaaaaggagcccctgaga

SEQ ID NO: 181358 - DNA, 223 bp, Homo sapiens
ggtggggctatttgtgcatattaattagatctctgaatccaactacacatataagttcattatatatcttcactggagtcttgactgtttttgtttattattagttgatttttttaaagcttctgtgcttcaatgaaccttttacattaataacttatttttgagaatcgagttttaaaaaattgtttttgacacataattgtacgtatttgtggggtacagt

SEQ ID NO: 181359 - DNA, 216 bp, Homo sapiens
tctttttacatctgtatagtgtgttaaaataaaaaaaaagtctttcatcaaatttgggtagttttggccatttcttaaaaatagtccctcttcctccttgtttctctctttcctctggaactcccaccttttcttctattagctgcatgttggtttttgtctgttacaaattgagctactgtaatcattagtgtgtaggtctttgtgtgggaatat

SEQ ID NO: 181360 - DNA, 3125 bp, Homo sapiens
  misc_feature (4)..(4): n is a, c, g, or t
  misc_feature (8)..(8): n is a, c, g, or t
ggcngagngtgagggtgtgagggtcgcgctcctgctgtctggactttttctgtcctactgagacacggccgacatgagatgatgaacctcaagtaccaccccagacaacaaggctgcttcatcaggacacaaacctgcctgtaccaggacctctgacctgtgtgcagcagagacactgaggataccattggcatcaatgtcaaaagtgacttcaatctgaggaacaccttggggttcaggaggtatgcccgtgaattcaaacttgccaagcaggttgttatccttggacatggcacgctcaccttcataaacctgaataagcacaccaggctggttgtcagaataggtaatgaaggtctgtgtctgcttggtaggaatggtggtattacagttgatgaggatggtcatgactccactagcagtttcaataccaagggaaagaggagtgacgtccaagagcagcaaatcttgaacattttcagacttgtctccagacaggatggctgcctggacagccataagcaacagcttcatcatggctgatgctcttattcagttcttttccattgaagaagtcttggagaagcttctgaatcttggggatactaatagaaccaccaaccaggacaatatcatgaatttgtgacttgtctggtttggcatctcgaagggctttctctactgggtccagggtgccacagaacaggtcagcattcaattcttcaaactgggcacaggtaatggaggtatagaagtcaattcctacatagagagaatcgatctcaatactgacttgggtgctggaagagagagtacgcttagcatgttcacaagcagtacggaggcatcttacagctctcttgctctcactgatgtccttcttatgcttgcgcttgagctcagcaataaaatggttgaccattcggttgtcaaaatcttctccacccaagtggttgtctctggctgtagacttgacctcaaagattccatcctcaatagtgaggattgacacaccgaaagtgccaccccccaggtcaaagataagcacgtttctttgtgctccaacctttttgtctgaacttttgtaaacaatagcagcaacagttggctcattaataattctaagtacattgagaccagcaatagttccagcatctttggtaacctgaaactgagagtcattaaagtaagctggcactgtgaccacagcactggtaacagtcttcccaaggtaggcttctgcaatttccttcatctttgtcagaacaatagaggatacctcctctggatagaagcttttggtctctcccttgtattctacttggacctggggcctgtcagcatcattcactaccatgaagggccaatgcttcatatcagactggacaacagcatcatcaaatctgcgtccaatcagacgtttggcatcaaaaactgtgttggtggggttcattgcaacttgatgctttgcggcatcaccaatcaactgtttagtgtccataaaggcgacatagcttggagtggttcagtttccctgatcattggcaattatctctacttttccgtgctggaaaacacccacgtaagagtaggtggtgctaagatcaataccaactgcaggtcccttggacatggttgctggcatgtagccctggctccgataaagaagaaagccacaggaacccgagagctgcaggcgagttcaatgagctaggatttcttaatatatatgtgataatgttttaactttgataattgacttttataatgacttgagtagtcttaaattgtctttcatttaaaacttttgttcttttaaaaaagcaccaagtctatgctactaacaaaaatttccttttaccatgtagactacttgggatgaaaataacttttcataattactatcatgaagggaggagagtggaaagttgccagatactgcagcaagatataaagatgaattcttcaaatgaggaagcaaactttatcaagtggttgaatttcttagatcaccttgttggacataatttcttgtaaacaaattatgcagtcagtgtcacgttcatgcagagtcttttaacttaaaattcattacaggtaacactttcaaaaagaagttctgtagtcttgcatactatttaccacaccatatttactgcacttagcttcattatggaggaaagaacaatagtaaactatcaataactgagacaataatcatattcattagtgatgagtcaaacaggttatacttattttttaaaataaaaacatttgtaaatttttctctacgtttttaaaacaacagtttaacaatagcagttctgttattttagctttaattttttgtaccaacagttaatttgctcatgcccaaagatttacatttataaaaaatgttctgccatgcaagttttaagagatttttgaattgttgacaatactcagcacagtcacatgtctctcataaatccacccagacttaagaaccaattttcagtgcaactcatgaagacaaagaatagccattataaacacattgttgaaaatcatttaaaaaatcattaaatttttttgcatttaatattttttcagctttcttaagatataattaacaaaaattgtatatattcaagttgtgttatgtgaggttttgatacatgtatacatagtaaaataattaccacagttaagctaattatactatacatagtaaaataattaccacaatcaagctaattaatatatttattatcacacataattctttttcttgttgtggtgagaatacttaagatctactctcttagaaaatttcaggtatataatacattattattaaccatagttgccatgctatacattagggctccagaacttattcatttcataacttcaagttataaaagtcacgataaaagtttgtgccttttgcaagtttgtaccttttgatgaacatcttcccatatcttcccattttcctcagtcccctgcacctggaaaccacccttctaaactgtttatatgagttcaccttttttcagattccacatataagtgagatcatgcagtgcttgtgtttctgtgtctggcttatttcacttagcataaagtcttccaagttc

SEQ ID NO: 181361 - DNA, 299 bp, Homo sapiens
cagtttctatttatacttcctgcaattataggcttcttggcctacgtacgtcttttctctcccaccagacagtgagccccttaagaagcagggtgaggtcttacatttcctagtggccagtattgagcctatcaaataactgatactttataaacatctgctgataatgatttgatggaggacctgaggttggagctgaggaaggtaaaaatgagtgagtgggccttctgggtctcagacagggaaggaggagtagaaagcacacagctaagaagtggaggtaagccccttcctcacag

SEQ ID NO: 181362 - DNA, 297 bp, Homo sapiens
tgtgtttgaggtaaagttaatcagataatataaccagacagttgtatgaatatggttttttgtgttttttgtttgtttccattctggaagatccacttataaatgaaagttttctcaaatgggacgtccttaaattggatctcagtgaattatagttgttattgttgtttaagaaatatatttgaaaacatacttactctgtgtgaagtacacagtttatatgggaagctagttccgtggtataccttagctggagacctgtgtaaggactttttctgtctaatattgagtgcaggt

SEQ ID NO: 181363 - DNA, 317 bp, Homo sapiens
ctggaccctcattatgctgctattctcaatatcccaacacttgatttctattgacaactcctaggctcaactgttccgcccacctcagcctcccaagtagctgggaatacagccaccacacctggctaatttttaattttttttggtagagacagggtcttgctatgttgcccaggctggtctcaaactcctggcctcaagaaatcctcccacctgggcctccccaagtgctaggatttacaggcatgagccaccatgcccagctcccttcctcccctttgctctcctaactccatctcagcatccgcccctgagga

SEQ ID NO: 181364 - DNA, 178 bp, Homo sapiens
cacaaaccacaatttttaaagagaaagaagcgcaagatgacttatacccaacaacccttttttggggcaaatattagttggatttttatggcatttttccctctaaagagcttagctaaacgtgctcaaatcaaggaaaaatttcctgacactttgtttttcacctagttttagcctc

SEQ ID NO: 181365 - DNA, 644 bp, Homo sapiens
cccaaattaaggagagcccattaaatgaacatctcgggttccttgcgtgaaaatctcaacaggttgcccttatgaatcaagaagcaatcctcctgagttttgtcccccgaaagaaaaagcagcgactactatacataccttaaatttaaccaagagaactggctagatttatagagaacagcaatgaattttgagccaagtgttcacctaagttccagtacacctaagttccagtcctgatgggaggatccaaaatggaatctgagctgtttaagaatatatattgtcagtcaggcgtggtggtgcacacctgtaatcccagctactcgggaggccgaggcaggagaattgcttgaacccaggaggcagaggttgcagtgagccgagatcaaaccactgcactccagcctgggtgacggagcaagaccctatctcgaaaaaaaagaaaaaagaaaagcaatagctccctgggtgtcaggtatcagtgagaatgggaagtcaggtcttctctgactcctaggacattcctctctctgtctttgggggttgaattccttgttagaactccatcttgttaaaggggcctcgcacctgccccttgccttctgcagcagccctccttaatcctctccaacaggactgaa

SEQ ID NO: 181366 - DNA, 331 bp, Homo sapiens
tgatagcttcgggatgagggctggtttccagaaagaccaaaccatgtgattagagggttgaaactttcagctccatcctctccttagggagaggagagaggggcgagagattgaattaatcatcagtggccaatgatttactcactcatgctgtaagatctctaaacaacagaattcagagagcttctgggttggtgaacacatgttggtgctgtgaggtggcgtttccagagagggtgtgggagctgggtgctctccccaacacattgccctgtgcatctctaacatttggctgtttctgagttgtgtccttgatcataaaacagtagta

SEQ ID NO: 181367 - DNA, 385 bp, Homo sapiens
aggcagctgctggctgtcctccggctgctgtgagacccccaccttggacaggatgagggtggctccatcccggacattgtagtgtgtaagggtgtgtatgtaggtgtatgagtgtaggtgtgtgtgtaggtgtatgagtgtaggtttgtatgtgtaggtgtaggttgtgtaggtatagatgtatgtggtgtgtgtaggtggtgtgtgtagatgtgtgtggtgtgtgtaggggtgtgtgtgcaggtgtgtaggtgtatgagtgtgtaggggtggtatatgcaggggtgtgtatgtaggtgtatgaatgtaggtgtgtatgtgtaggtgtaggtgtgggtaggtgtaggtgtgtggtgtgtgtaggtgtgtatgtgtaggtgtaggg

SEQ ID NO: 181368 - DNA, 452 bp, Homo sapiens
ccatctgggtgagagagagtcacgctgatggcggagggacggcagcgccagggccactggagggcgcggcttctaacaggggtgcgcctttcgggtcaggaggcctgctgccactttgggaggcgtgtgtgtgtaggggtgtgtgtaggtgtgtaagggtgtgtatgtaggtgtatgagtgtaggtgtgtgtgtaggtgtatgagtgtaggtttgtatgtgtaggtgtaggttgtgtaggtatagatgtatgtggtgtgtgtaggtggtgtgtgtagatgtgtgtggtgtgtgtaggggtgtgtgtgcaggtgtgtaggtgtatgagtgtgtaggggtggtatatgcaggggtgtgtatgtaggtgtatgaatgtaggtgtgtatgtgtaggtgtaggtgtgggtaggtgtaggtgtgtggtgtgtgtaggtgtgtatgtgtaggtgtaggg

SEQ ID NO: 181369 - DNA, 901 bp, Homo sapiens
gatgtcctgccccccgcccgccacacaccatccccaaaaggaaatttctaatccaattaacagtcttaggttgggctgctgaaacaaaataccacagcctgagtgacttaaacaacgacaatttatctctcactgttctgaggtctgagttgattctttgtgaaggccctttcctagcttgcagatggctaccttcctgctatgtcttcacatggcaaagagagagctagctttctggtcttttcttataagggaccagtcccatcatgcccatcatgaagactcgatctgctaggatctcaactaaacctaactatcacccaaagagcccacctccaaagaccatcacattgaatgtgagagtttctacatatgcattgtgggaaacacaaacatttacttcaactgtaactattgaagcaaaaatgtccccccaccatagacatccagcaccacagtagtacatttattacaattgaacttacattgacacgtcattatcaacgaaagtctgtaatttacattagggtttattcttggtgttgtgctttctatgggttttgacaaatgtataatgtcatgtattcaccattatagtatcacagaagtttcactgccctaaaaatcctgtgttctgccttttcaacacttcctgtcacccaatttctatcaactaatcttttgactgtgtccatagttactgtcttttctagagtgtcatacagttgtgaagcaggaagcaggagtgaactccggaggcagggactttactccggaccagattgaagactagccgaaacagggacgaggttaaagcacctctccataagacacgcccaccagcgccatgtcagtttttcgttgccatggcaacaacaggacattatcgacttctttcctc

SEQ ID NO: 181370 - DNA, 632 bp, Homo sapiens
aatcaggaggccatgaaatcccagtgagccaagcctccgtcacccaccatgtaaagcacggagcagcttgaaaagacattgagagaagtaaacccacaggttcagtggccagtggcaaaggacaagagccacagaggcactgggacctgaaagctaagagagcagggatgcgggtcacagagggagggatgtttggggctacaggtggatagaaaggaagatggagttgagtttttgacctgttgacttaccgtagtggtaggatacctggtgaggcttgtggcctgcattgggcattctgggtcacaactctgaatgaggttggagcagaggtccagctgtggtgaggattggcacagtcgtgcttgtgggactcctccttggtccaactctaatgctcaacctacaccatcacccctgtgcttgctcctctaatgcctaagcactgtcattcctttatcactagtagttgcctgttgggtttgctccatttgtcctcacaggttagctgccctggaaggaaactccaccctgctcagagacgcactgaggctgagacccaagggaggcccctctctgattggacagcctcttgatagactgggggaagctccctcacagcccatcagggt

SEQ ID NO: 181371 - DNA, 360 bp, Homo sapiens
aaaaaatgaagagtaaaacattttacattaagtagcaaaaccactcatacatctgaaagtgagctaacagtattttggtggtgtgtgtgttgggggaagtatacataaggagtggtgaaagaggaaaggaacacccacctaaccaactagatccataaaatcaaccctggcaccagtaatgtaacatgtcatagccagattgctgtcttaaactacaggtttggaagatgagatccagagagtaattggaattttaaaattcttattcaatgacattaaatatcttaacttataaaaaaattattggacatttagaagtttgaatggataccttttattttttaatttgagctactgtgg

SEQ ID NO: 181372 - DNA, 586 bp, Homo sapiens
agctatttcagaggctgaggtggaaagattgatcaagcccaggagtttgaggctgcagtgagctaagactgcacactgaactccagcttgggagacagtgtgagaacccgtctcttaagaacaacaacaaaataagctggggcgatgggtaagttaaaaatatgctgccattggccaacaaatcgagctgtttaaaacatgctcttactcccaagccagacaatttgataatcgctggacagaaagatggagccatttctggctgtccaatgacctaacccctttcaatacatataagatcaacctggggatagtcaatgtttggcaatagtcaagatttaggaattaaaaaacctctaaatatcaaaaatatgaaaaagaacaaataagtatgtgtttattatataccttacatatagagagatttactgggttttgtgtatatgtaaacaaaaatacatttaaaataggaaaggggctagaattacacacacaagaatataaccatgattttatatttttctgatggaattaggcagatgtttattttctgccatggctttcttgatctttacagtttctaaaa

SEQ ID NO: 181373 - DNA, 591 bp, Homo sapiens
aggccctaagttatctcttattcatttttgtagtactctcccttttccagcgtgaaggcagtcttccaagctggagaaaatagaactcaaataacagctgggtggctgagccttccccaagttacacatctctctcttccctcttcctctatctctcaacattgctataaagacctttcttatttagatttaactttattgtcagggcccagcaccttctggagtatagccttggtaatagtacaaattgtaattaacaaatgtgttaatcaattacaattagtcatacctctggatacccacacccttggccatgtaactttacagggtcctctctatctgggcagagcaatctgcctgacctcttaattctgagctcagccatgtgatgtgctttggcgaatgggataatgcaagttattgtacctgcaagtaccacatgtacatttcccagctatcccccaggaggatgaagggcatcccaataaacttggccaacctggccaagactatcttagatcaaccaacagccattcaacccccagacaggtgaacaaacccagccaagatcagcagagccgattaaccaac

SEQ ID NO: 181374 - DNA, 514 bp, Homo sapiens
agaatacaaatttgttgcccacatgaaaaatgagtattagtgttaataactgtttagactaatgaaaaattgtaaagtctatgtaaatatttatcacctcttagaattgaaaagaaccctagaaacatttgatctaaccatcttgtacagctaagcggaatgaggccagagatataattggcttgcccaaagtcacaacatttgttagtggtaatagtgctagaattggcctcaggtttcctttatactactaagggttgcaagggcatgggctgtcaggcactttcatacatagtttgtggaattataaatggccacaaatattctggctagcaacctagtatcatagaacagaaattttagtgtgcatacctttttattatttttttttatttttaatttttgtgggtacatggtaggtgtatatatttatcgggtacctgagatgttttcgtacaggcatgcaatgcataataatcacatcgtggagaatcgggtctccatcccctgaagc

SEQ ID NO: 181375 - DNA, 386 bp, Homo sapiens
cttgcttttcccccaaaagcacaccaaaagcacaatggttgaagaaactggggggtcacatgcaaaggactgaaataaacccttcccttacacaagacacaaaaagcgacacaaaatccactgaacactaaagggcaattgtgaaaccaaaacctccaaggaaaacacatagggtgcatgtctagtgtgggaaaacttgaacctgtgcacctaagccacaaacagaaaacacataggaatcaaatacccatagaccatacaatggcttcgccatcttgcttttcttctcaaagggacacagaaatcaccgctaacaaaagctaatgtgaccatgtgagactaaggacaacttcagagcttcacatagcttcaacactggagagaaa

SEQ ID NO: 181376 - DNA, 240 bp, Homo sapiens
acaggtgtatcccaacacacgcctagctaatttttatatttttactagagatggggtttcaccatgttgtccaggctggtctcaaactcctgacctcaggtgatcctcccatctcagcctcccaaagtgctgggattacaggcatgagccaccatgcccggcctgcatttttctttttcaagaggactctttatagattatgcgtgctcattctggtgactatgtgttgggcgataacat

SEQ ID NO: 181377 - DNA, 582 bp, Homo sapiens
tggcctgtatgtctctcttttgataattactttttgctttcaaacaagatggctggatattagcatctgtggttttgcaaatacagcctgggtgatgctccctaaatcatgattgaagaaaacaaaaaaacccttaaaaacacccttaaaaacattatttaagtacaaatgtatcggagtctggagtgctgtacagtcaggtaaaacatgaattcttaaaagaacttccatctagataatgaaaataattggaaaatttggtacaagaaatacgtttctcgcaaatgcacagccctctgagcatgcatgggtaaaggaggcatagaaacagggctggatactctcactctctgccttattgttgcatagggcttcacaactaatcaagttcctgggctggaagtcaggaaaatagaacactaattttccagcttagcatggaccaggcttgcttgtttgtccagcaatcgacggtcacccactgttgtagaagtattcactaagtacaaatgtgctaggcatggctgaagcaaggaaagatgtacaagaaacctaaacattaaattgagaggtaagatctac

SEQ ID NO: 181378 - DNA, 651 bp, Homo sapiens
ggcttttttactttttgtagagacgaggtctcactgtttcccagattggtctcgaactcctgagctcaagcagtcctcctctcttggcttcccaaagtgttgggattacaagtgtgagccactgcacccagccaaggtgttccttcttaatcataatctttaaaagaaatttttttttcagctgctgtataaataagatgtcattatttggatgcaccatggttgattcagttaatcccgttgttgagcatttggattgtttccagtcttctgctgttgctaacaatgcagtaatgaataatttttttatgtgcgccattttatactgacacaggagtagctctaaactagactgctattaatacaaatggcgctgcccagtgggtaagtacttacactcccacaagccatgtgcgagagcgtcttccccttaaactcaccatgagtgtagtgtcgaatatttggtatttcgctagggacataagagacaatctgaacttcagtgtaggtttcatttacatcccttcttatgaatgagaatttttttttatatgtttaaaggcctgtatgtattaatctaggaactgtctattcatatccttttcaccatttttctatggggtgtcttttccttagaggagctgtttataa

SEQ ID NO: 181379 - DNA, 692 bp, Homo sapiens
  misc_feature (208)..(208): n is a, c, g, or t
  misc_feature (250)..(250): n is a, c, g, or t
  misc_feature (257)..(257): n is a, c, g, or t
  misc_feature (263)..(263): n is a, c, g, or t
  misc_feature (276)..(276): n is a, c, g, or t
  misc_feature (314)..(314): n is a, c, g, or t
  misc_feature (338)..(338): n is a, c, g, or t
  misc_feature (340)..(340): n is a, c, g, or t
  misc_feature (348)..(348): n is a, c, g, or t
  misc_feature (352)..(352): n is a, c, g, or t
  misc_feature (355)..(356): n is a, c, g, or t
  misc_feature (365)..(366): n is a, c, g, or t
  misc_feature (371)..(371): n is a, c, g, or t
  misc_feature (373)..(373): n is a, c, g, or t
  misc_feature (390)..(390): n is a, c, g, or t
  misc_feature (403)..(403): n is a, c, g, or t
  misc_feature (425)..(425): n is a, c, g, or t
  misc_feature (432)..(432): n is a, c, g, or t
  misc_feature (456)..(456): n is a, c, g, or t
  misc_feature (692)..(692): n is a, c, g, or t
ggcctttccaggtcttctcccggtgaaccggatgctctgtcagtctcctcctctgcgtcctcggccgcggcccgggtccctcgcaaagccgctgccatcccggaggccccagccagcgggctcccggaggctggccgggcaggcgttgtggcgcggtaggagctgggcgcgcacgggtaccgcgcgtggaggagacactgccctgccngcgatgggggcccggggcgctctttcacgccgtaggcaagcnggggggnggttgnggtacctgcccancgggagcttcccttccttctccttgctgctgctgctcntgatccagctcgggggaggcacangnagacaaangganganntcttttagnntgaananagtagagcagctgatgnatgggagttccanacgctcaatcttccgaattgantggggtnaaattccgaaaatttttaagggcncccaccttcggaaaactattccccatgatgtggtatggtccactggctcttacagccctcaagccggcaggggtcctggtgtgccagggcaccgctaattgaagaattctccaatttagtggccagaactcctggggcttatcccatcgtgctttggtaccaagggctctccttcaagtatgggtggactatgatgcggcgggccacgacgtttcagcagccactatgactctgtn

SEQ ID NO: 181380 - DNA, 492 bp, Homo sapiens
agtctacaccagcggatttttcatgatgttatcttgcctagaggtagcaaaggcatcacatccctgcgagacagaaaatgtctcaaataggcatctgtaaatgagaacagcatgggaaataaagcctctatctggtgatacaggcgcaatgctatgctgcactgtgaatgacatggcactaagcaaatcaaacttctaatgttgaagatgggctctcaccagaagagacagatgccatccacattgatgagtactaattcaacaccccagtgtggaataccacctggccctcctcacacattccagagaggtggtcaaagttaataactttagaggctcttctcaatctagcctctgggtagcaaagagaacagtgggaggaataaagagaaaagttccccaaacgaaaaatgctgccaagacatgcatctgctccccaccccatataggaggggatatatacgtaagcctgaaggttcctgattaactaca

SEQ ID NO: 181381 - DNA, 435 bp, Homo sapiens
cccaatcttctttgtcctacaagggctttctattcttcaagctaaagagacaccagtgattccgttcgttcattcagttaacatttaggggccacagcttgtgctatgtcctgagatttgccaatgagcagagctcagagtattgaaaagacaaacacacacgccaggcattttactatgctatgttgtgtgcatgacaggagtacacagggcatccaggcaccagtgagaagggcctttcaccagacttgagaggtcagcaagggtgctctaaggaaacaccttctaaaccgagagcttgaaagagtgagacaggaaagcagtaagagggagcgttctgaggaggaaatctccgaggtgggacagggatgcgtgtggagagaatgcccttcccatctccactcttcatgaggtctctattctgtcagggtctgt

SEQ ID NO: 181382 - DNA, 268 bp, Homo sapiens
ccagtctgcgttatgtagcaagaccccatctccaaaataagtgcctgtaagatttgagatccagggagggagttgtgaaatgctgttaaagcttaagattgagaagtgttctattcagaaggcaggccctcattcaggtgggaaactacaagacccctggttcttggctacagaccaggatagggttcacccaacttggtcccactgagaattctgaacttactctctaactatccgaaactcctcccggccacagtctggcagaggt

SEQ ID NO: 181383 - DNA, 536 bp, Homo sapiens
tgacctcatgatctgcccacctcgacctcccaaagtgctgggattgcaggcatgagccaccgcgcccggcccaactttccttgactttctaattgagcttcataccttgctttcaagggcctcctcttccagcaagcctgctcatgtcttctcagttaacctctcccatggagaaactctctgtcactcagagtttgcttgaatcttagctttgatgcaaaacaggtctgggagcctttggattttaagaccaaaggcactactaaactgccagaggaaaaagaagacagaatgctggacataagactgactctgattctcactgaatgtcaaggctattttgtgaacagccatgttggttatccaagatagaaagccaaaacatttcaacatgtttctgactctagtttctgttgggtaactaggggagagggaaaaatttgggatatgttttatcagtcctttaatcgtcctctatttagacatttacaaggccaaatataactgtcagctgcaagtgttttgaattgcatagt

SEQ ID NO: 181384 - DNA, 597 bp, Homo sapiens
atagggtagccttacactttacaatttaacattagttactacgctctcatacaagaatatgtcacttcttcaaccaccccttaacaacaaaaaacccaagcaataccaaaaaataactaagagaaatacctgtattaaattttatcaggacttataacaatgaatcaacaagatctcacaaatgaaattttatcctatgtcatgaataagaaactgtttagatctgcatcaagcttccattagtacaaaatgcttcgaatttcatttagttttggtttgaagttgaagttactgtctgactgaggaataaccgtacttttcattaaagagaaaggtgttttgatggagttaccttgttgggcctaggtacttaggtattacggccataaatcaatgggatgtcgctaactttatattgcagagagctctttttattgctccaatgaaattcacgattccccttttttttaaattgatacagggtctcactttgtcactcagggtgaagtatggtggtgtgatcacggctcactggagccttgaactcctggctcaagtgatcctctcacctctttctcacaagtacctgggattaca

SEQ ID NO: 181385 - DNA, 327 bp, Homo sapiens
actccaacccacaattcattgaaagatttataacaggccaataatgcgcagaaggattattcacatactcaaacaaaaattataaatttactatgatagatttttattaaagtatgtataactaaatgttgaaaggtctagtctcagaaatttttattaagaaataaatttctcacccattatgttcttgtatttattctattattaatgatacatatattaaactacatcttcaatcttcctgtttcttttttaattctatttaatcatatcactagattaaatagaattaaaaaagaaacaggaagattgaagatgtagtttaat

SEQ ID NO: 181386 - DNA, 343 bp, Homo sapiens
cctccgccttctgagttcaagtgattctcgtgtctcatcctcccaagtagctgggattacaggcaaatgccaccacgcctagctacttttttgtatttttagtagaggtggggtttcgccatgttggccaggctggttttgaactcctgatctcaagtgatctgcctgtgttggcctcccagagtgctaggattacaagtgtgagtcaccgcccccagccaaattgttttctttaaaaatctctctctctaggccaggtgcagtggtgcatgtctgggagcccaaggcgggcagatcacttgagcttaccagttcaagaccaagcccagccaatgagccgaaa

SEQ ID NO: 181387 - DNA, 643 bp, Homo sapiens
gcctgtgctcctcccttgccttctgccttgattgtgaggcctcgccagccatgtggaactgtgagttcacgaaacctttttttctttataaattacccagtcttgggtatttcttcatagcagtatgaaaatggactaatacaggggccaaacgtgactgtgacaaacacctccagttttaacctgtttcctagagaaggaataccatcggagctcctctggaacatgtccttgtcttctcagagtgtgaagtgtgtgtgtgacagtgcttttctgaggactcaggtgacctggaggctggagaacagcatggagcaaggaaaacaaagacgatgtgctggagtgtatgttgctttcataattatgtgaaagaaaatgtagagaaatttgaaaggagaactggttatcagtagtgccatcctgctcaaatatcttcaaatacacaccaccatccatgtgtgggttgattaaggagctgacgttcattagatctgcagtctcctgacctgatgtgcatcagaatcactgggagaacaaacaaacaaaaatgaatccaaaacaagcaacgaacagacagattctcaagtcttgccaagtccaaagattgatttggtggagaaattgtactttgaaagctgcccag

SEQ ID NO: 181388 - DNA, 486 bp, Homo sapiens
gctctcgaggattactcgaatcgacggtttcctgtattgttttccctcatacaatttccttcttgctgtctccctccatcctcttcattgaggccttcagaattcctattataagatttgtttaatctatcccacaaaccctacacacaatctctttttttgttgttttcttggcagagtctcgcatcgtcgccggggctggagtgcagtggtgtgatctcggctcactgcaacctctgccccccaggttcaagcaattctcctgcctcagcctcctgagtagctgggattacaggtgcgtgagccaccacgcccagccgattttgtagctctttaggttgttccaacaaatattattagccatttcagttgttgactatttatattgcatttatatacatttgttttctggtttttccctgtcgcaaatatagaaaagtaaggaaacatagtctgaaaattaggagaaaaaagtatatatggagg

SEQ ID NO: 181389 - DNA, 400 bp, Homo sapiens
atctttgctaatctccaagatggggatatctaatgcaacatttctcaaccatatttgtctgtggaacccccccttttttttgagtgttctgtaggattgatgttttgcagaacccatcttgagaaataccatcttgttggaattaagtcctagaagcactcacaggcttgactcatcttcctttacatgcataccttctcttttgagtggcaagactgtgggtctgccttatcagaacttgggaattccatctttaaaataaactgtgggggctttctgatcctagctgttctccctatatatgagtgtgagtgtgctagacagctcactgagctgaaatcaaagaaattttccaggccatcttcagggatctgagtataattcattgaacatgagacct

SEQ ID NO: 181390 - DNA, 714 bp, Homo sapiens
gcagaggaccctactcagacaagtgactgaaatttggcatcattaagcgcaagtcatcaatatctcatgaagctgtagtgaaagcttctctgggtgctttatggaagtaacaaaatatatttgctcatacataataaaaactacatttcaacaatataaaaatggagagcatcagttttcattttactgcattaagctctcttattcagtctagtgtactaatattatgcatacaaatgttatattggttattagaaggtcagtgtatttggaagatatgtttaaggctttttttctctatagttacatcatcaataatttcattacatcatatatgttatcttgtcatttttttcaattaattatcttattctagcaaatttgtattttacaaagactaatgatatatgagatatgtctcaggccaacttccaccacagtataaacatgttgaaaaataggagaaaggatttgggatatttacatttaataccaattttattttttgagacagggttctcactctgtcttccaggccggagtgcagtggcataatcaaagctcactgcagccttgacctcctgagctcaggtaatcctcccacctcagccaccagagtagctgggattataagtgcccaccaccatgcctggctaattttttgtattttctgtagacatggggtttgccatgttctccaggctggtctaagtc

SEQ ID NO: 181391 - DNA, 588 bp, Homo sapiens
ttgagatagggtctggctctgtcacccaggcaggagtgcagtagcatgaacatggcttactgcagcctctgcctcctgggctcaggtgatcctcccacctcagcctctctagtagctgggactacaggtgtgtaccaccacgccccgctaatttttttgtgtgtgtggtttttttgtagagatgggattttaccgtgttgcccaggctgctctcaaactcctgggctcaagtgactctcccaccttggcctcccaaagtgctaggattacaggcgtgagccgccacacctggcctactgctcaattttttaaaatagctgctgtaatgcattcaacactatctcatttagtattttcatatatgcttctgagtttaatgctttagttagactcctttgtggagcacaaccaaaccagaatcttaggtgtgatattgtaggatcaggactatgggaatgagatgctcatggttagactttttttgaaggccaaaatttaacactgatctctggggaagagcctagctgtgaataaagcccctgattgtcatagaaagaaaagtccaaaggtagtggctcttgcctgagg

SEQ ID NO: 181392 - DNA, 139 bp, Homo sapiens
gccggaccgcaaacgtgattcactggggaggactgtgtggtttgagatggtggctggatccatgcacttgcatctggcttttcttcctaaggagacagtgtgttttctgaaagccgctcctgtcttggcaactgggtac

SEQ ID NO: 181393 - DNA, 284 bp, Homo sapiens
ctcaaaaccggaatttctagctgtgactcaaattggcacttcacattggcatctcaaacgcattatcttcccctacaaatatggaacatgacaggatagatgcaagaaatattggcaagaaaaatctgatagaacctactaagggactgaatatagatagggaaaagaatcacaaataggactaaggtgtcaagcctgtaagactaagggagtcatggtaccaacaacaaaattaagggaatcacaagaaattattgtggaggaaatacgttgtagatgttgaa

SEQ ID NO: 181394 - DNA, 313 bp, Homo sapiens
caaaacttgagaattagtcaaataaaattgtgagctattaaagtccattttgacatccttttaatgcacaattttttcttctaattgaaatataatccacatataaaacttacccttttaaagtatacagttcagtggtttttaatctgttcagaaccatcactgctgtttgcagaacattttcatcaccccagaaagaaactccttatccattagcagtcactccctatttccccctttccccagtgtctggaaaccactcatctattttttgtctctggattggtctattctgggtattttgtgagagtgg

SEQ ID NO: 181395 - DNA, 436 bp, Homo sapiens
tacctcaggctatgttctattggccacgagtgacagtgagaaacagtcatattcaagggtttggtggcttggggttaaaatcctctccacgtacatattaacacagcttttctgtatcaaataaatgttatttatctctcttaaaatcaactgattttcagtagagaaataaccttagaaattatcatgtttgatgcctctatttcaaaatgaaaaccacccatccaataatccaacctcacagaatccctgaccccttgcctagacaccaaagttcctacttcctgttttctgtctctttgaaactgacactcttttctttttctttctggctcaaaaatgtccaaaagaaaaccactgtggtcattatgggagccatgctccatgaatttcctgtgtcaagttcaaagtttaccttggatagattaagtaaaca

SEQ ID NO: 181396 - DNA, 370 bp, Homo sapiens
acaggagttaaatataagtcctgaagaaaaacaaatgtttcatatcacacttactttagagtaaagcttagttgtagctgtgtacaataatcagttgtaaaaaggtgtttccattcttccattgtccttttggcttatttctcttgtcttattcaatttgctgtggatttgtttttgtagtgggaaaattaatttgagctgaagtgtgtcaggattacttagcaaaaaattactgtttgttgtcccacaaaaaaagtagatactacttaaccttttttactccatgtcatggatgtacttatgttttcaccttgtggaatactgaatcaagtttacactcttaggatcttagaatagtggttttcgctct

SEQ ID NO: 181397 - DNA, 516 bp, Homo sapiens
tagatcacctgaggtcaggagttcgagaccagccggaccaacatggagaaaccccatctctactaaaaatacaaaaattagctgggtgtggtgttgtgcacctgtaatcccagctacttgggaggctgaggtaagagaatcacttgaaccctggaggcagaggttgcagtgaactgagactgcgccattgccctccagcctgggcaacaagagcaaaactccgttcccccaaaaaaataataagtactgtcttgactgtggtcatcaaaaatatttgattaagggttagctagaaagcctgaccctttcacagacagacggaagggccaaaagaaaatagattgtttgcagtggggcaagaaggataagaatcctatggaaaaaaaaataacagagggatttgtttagtgagcgctggggagaggcatttgttttcttgcttgaaaaagaaacacacgttgggtgcggtggctaaagccttaatcccagcactctgggaggccaaggtgggtggat

SEQ ID NO: 181398 - DNA, 528 bp, Homo sapiens
tgaacacactgtttttggcattattctgatgaagtttgtgaggacatgcaataaaagaaaaaaaccagcaaagaggaagtgatcaggaaaagaccgagtcagaaactagcctttggtaaggagagatttttaatcacagctgcagccatattgtaaccatcatcagttacatatacataagggatagttcttggaaaacacacaaaggcagtatcataggatgtgtcatcagcgatggctagcaatcgctgatgaggcatcgatgtggtgaacgaagaacacttctacactgctggtgggaatgtaagctagtacaaccactatggaaaacagtgtggagattccttaaagaactaaaagtagatctaccatttgatccagcagtcccactacttggtatccatccagaggagaagtcattatacgaaaaagatactggcacacacatgtttatagcagcacaattcacaatggtaaaaatatagaaccaacccaaatgcctcatcagcgatggctgggtaccgagct

SEQ ID NO: 181399 - DNA, 132 bp, Homo sapiens
gtgaaagagtgagtgactgagtgaatgagtgattgctccaggccagagtgaagatctctccctggtgggggtcatgagactcggactcccagacgtgaggtttggggttggtgaggaatgggtccagcttct

SEQ ID NO: 181400 - DNA, 254 bp, Homo sapiens
cacataaaactattacactgggcaaacaaacctaaatgttttatttatttattttttggaaacccagacagtgggcaaaattttgtatgtaagtgtagttttctatagagttaattaatacatttcatcagttttttaaaagggcatgtgaccataaaaattaagaaccactgaactaaagataagcaaaaattaagccagtttaaaaatgaaataaactaagttagaaaacaaaagaaaataacattcactgt

SEQ ID NO: 181401 - DNA, 467 bp, Homo sapiens
gcacgtccccctcaacctgaaatcaaagtgaaaaaagtaggctgggggcggtgattcataatcccagccctttgggaggccaaggcgggtggatcacctgaggcaaggagttccagactaccctgatcaacatgctgaaaccccgtcactactaaaaatacaaaagtagcagggcatggcagcgcacacctataatcccagctacctgacaggctgaggtgggagaatcccttgaatgcgggagacagagattgcagtgagccgagatcgcgccattgcactccagcctgggagacaagagcaaaagtccatctcaaaaaaaaaaaaaaaaacgctacatgactacatgtaacagctactgggaacattttattgaaattttttaagccctttaaaatgttagggtagtgtcttaggaaatcagggatttccaaaggcaggacttcacgacgccaacttgagtgtga

SEQ ID NO: 181402 - DNA, 503 bp, Homo sapiens
ctaaatacaatccttagtatctcactatacaacagcctacaaaatagctcccagagcacaactacagaagagtctcctttgggcgtacagggatccccgatacgcccaaagactttggtttcccggaagctgcccggcgggtcatgggaataacgccgccgcatcgccggtcggcatcgtttatggtcggaactacgacggtatctgatcgtcttcgaacctccgactttcgttcttgattaatgaaaacattcttggcaaatgctttcgctctggtccgtcttgcgccggtccaagaatttcacctctagcggcgcaatacgaatgcccccggccgtccctcttaatcatggcctcagttccgaaaaccaacaaaatagaaccgcggtcctattccattattcctagctgcggtatccaggcggctcgggcctgctttgaacactctaattttttcaaagtaaacgcttcgggccccgcgggacactcagctaagagcatcg

SEQ ID NO: 181403 - DNA, 390 bp, Homo sapiens
gtttgagcctgctgccacgcatgttttatcctggtaaatgcgaatgattagatggccttgtggtgcgaagtgatctcaacctattctcaaactttaaatggtgtaatgaatgccctggctcgctggcgtggagccgggggcggctcgtggctcggcggcccgtcacgcaccgcacgttcggggggggggcccctggctcgggggggggctgttgtgccccgccgtccctcttaatcatggcctcagttccgaaaaccaacaaaatagaaccgcggtcctattccattattcctagctgcggtatccaggcggctcgggcctgctttgaacactctaattttttcaaagtaaacgcttcgggccccgcgggacactcagctaagagcatcg

SEQ ID NO: 181404 - DNA, 428 bp, Homo sapiens
cagcagacggtaagaccctatggagctttaatttattaatgcaaacaatacctaacaaacccacaggtcctaaactaccaaacctgcattaaaaatttcggttggggcgacctcggagcagaacccaacctccgagcagtacatgctaagacttcaccagtcaaagcgaactaccatactcaattgatccaataacttgaccaacggaacaagttaccctagggataacagcgcaatcctattctagaggtcatcaaagccgtccctcttaatcatggcctcagttccgaaaaccaacaaaatagaaccgcggtcctattccattattcctagctgcggtatccaggcggctcgggcctgctttgaacactctaattttttcaaagtaaacgcttcgggccccgcgggacactcagctaagagcatcg

SEQ ID NO: 181405 - DNA, 438 bp, Homo sapiens
accccattcgcccggtgcaatagccacaccagccaccactttcagatactgcagtctgctctgggctggtgaatgctttgcgggagtgatgggccaggacacagacttgtcgttgtcatggtcgtagctgttctcaggatccacgtgcttcgaacctccgactttcgttcttgattaatgaaaacattcttggcaaatgctttcgctctggtccgtcttgcgccggtccaagaatttcacctctagcggcgcaatacgaatgcccccggccgtccctcttaatcatggcctcagttccgaaaaccaacaaaatagaaccgcggtcctattccattattcctagctgcggtatccaggcggctcgggcctgctttgaacactctaattttttcaaagtaaacgcttcgggccccgcgggacactcagctaagagcatcg

SEQ ID NO: 181406 - DNA, 899 bp, Homo sapiens
taagggtccaacttcattctttgcatgtggacattgtttttccttgtaccatttgtttaaaagactatattaccccctccctcccacatcccagtagatcatcttggcactcttgttaaaaatcagttgaccgtaaatgtaagagtttatttctgaactctcaattcaattgattattttgatctatatggctatctttatgtctttattactgtcttcgttacttgattactgcagctttgtagaaagttttgaaattgggaagtgtgagttttccaactgttcttctgtttcaggattgttttggctactctgggtcccttgcatttccatatgaattttaagatcagcttgttaatttctgaaagaaaaaaaaaacagttggggttttcatagtgattgctttcaatctgtagatcaatttggggatgagcaatacatttgattgtattattgtcagaaatatgttgactttggaagtaacaaattagctaattagaaacaagtcttttggagtaatgagaaaggaatttgttgagctagtgcatcatttaatggaggcctttgaaactcagactaaggcattcaaattttattagaaagatatttttatagtttttttccctgaaattggtttgcatatgtagatgattttattatgattccagtactattatattttccataccactaaagagggctttttccatacacaagtggatgttttaaatcagtcaaaaagaatgcctttcaaacagagtggccactgctaagcactgtaggagaataaaagaactgtaacacacacacacacgggaggctgatatgatctcggctcactgcaacctctgctcccgggttcaagtgaccctcccacctcagtcgacgcggccgcgaat

SEQ ID NO: 181407 - DNA, 545 bp, Homo sapiens
taagggtccaacttcattctttgcatgtggacattgtttttccttgtaccatttgtttaaaagactatattaccccctccctcccacatcccagtagatcatcttggcactcttgttaaaaatcagttgaccgtaaatgtaagagtttatttctgaactctcaattcaattgattattttgatctatatggctatctttatgtctttattactgaactcagactaaggcattcaaattttattagaaagatatttttatagtttttttccctgaaattggtttgcatatgtagatgattttattatgattccagtactattatattttccataccactaaagagggctttttccatacacaagtggatgttttaaatcagtcaaaaagaatgcctttcaaacagagtggccactgctaagcactgtaggagaataaaagaactgtaacacacacacacacgggaggctgatatgatctcggctcactgcaacctctgctcccgggttcaagtgaccctcccacctcagtcgacgcggccgcgaat

SEQ ID NO: 181408 - DNA, 912 bp, Homo sapiens
taagggtccaacttcattctttgcatgtggacattgtttttccttgtaccatttgtttaaaagactatattaccccctccctcccacatcccagtagatcatcttggcactcttgttaaaaatcagttgaccgtaaatgtaagagtttatttctgaactctcaattcaattgattattttgatctatatggctatctttatgtctttattactgtcttcgttacttgattactgcagctttgtagaaagttttgaaattgggaagtgtgagttttccaactgttcttctgtttcaggattgttttggctactctgggtcccttgcatttccatatgaattttaagatcagcttgttaatttctgaaagaaaaaaaaaacagttggggttttcatagtgattgctttcaatctgtagatcaatttggggatgagcaatacatttgattgtattattgtcagaaatatgttgactttggaagtaacaaattagctaattagaaacaagtcttttggagtaatgagaaaggaatttgttgagctagtgcatcatttaatggaggcctttgaaactcagactaaggcattcaaattttattagaaagatatttttatagtttttttccctgaaattggtttgcatatgtagatgattttattatgattccagtactattatattttccataccactaaagagggctttttccatacacaagtggatgttttaaatcagcctcccgagtagtggggattacaggtgtccgccagtcagcacgcctggctaatttttgtatttttagtggagacgggtttttgccatgttggccaggttggtcttgaactcctgacctcaggtgatctgcccgcctcagcttcccaaagtgctgggattacaggcctgagccaccatg

SEQ ID NO: 181409 - DNA, 269 bp, Homo sapiens
tgccctgaaatttatgacaaactcttagctgttatttatttatttttccattgggcagattggagaatacttagttcatacacattttggtggccatattttcttgaagaaaacatggaacacataccgcctttcatttatatctttattcattaattcagcaaacatttagtgagtgtctcctttgttccaagtactattctagtcattatgatacaaatatgaataagttgcttgtactttaaggatctaataatcagtgattgggg

SEQ ID NO: 181410 - DNA, 458 bp, Homo sapiens
tgtcggaaggttgctttttgtttggggttttttgttttgttttggtcaattccaaagaacacactggcaatgttccctgctctatataaccaacagactcctcaggcaacttgcacgaaggagaatacagtctggagtctgaggtggtccttaaatatttcctcaagcttgcttcctcgtctgtgttgttaatagccaagtgattcgttttgtggggtagcttccccaggctcccttgggctggactatttatcatggcagcagctggagataagctggacacaaagaggatttgtgtctcaggagagctggtccctagatacagaaagtggaggaattttctcattaggaggaagtcagtggtggggactctgggctttcctcctgtgcccccagtgcaaacagtagcagggagggggcgtcctggaggggagatgtacttgaagatgctttcactg

SEQ ID NO: 181411 - DNA, 327 bp, Homo sapiens
tgcccgcctcggcctccccaagtgctgggattataggcatgagccactgcgcctggccctcttttatttttagttgatatgtaatacttgtatatacgtaggggatacagagtgatgtttttatacatgtataaaatgtggaatgttcaaatcagggtaattaggatagccatcaccccaaaattatttttttatgttgggaacattcgaaattctctcttttagccttttgaatctatccaataataattgttaactgtattcattctatagtgctatggaacaatagaacttactcctcctatatagctataattttgtatccct

SEQ ID NO: 181412 - DNA, 160 bp, Homo sapiens
gtagtgtaggttggtcctccccttgtttttcgagggctctcatctcctgcttattagtgaggacttggattagcaggtggctttcacatcataggtccctcctctctccaggaagcctcagaattaatagtagaagcagcaccacccacagctctatttg

SEQ ID NO: 181413 - DNA, 229 bp, Homo sapiens
gctgggtgatctagaggatcccaggagatcatctggaaataagagggtcttctcttttgcctggctccctatgcagccctatcttaccccctgcaaaggtcccagggatgtggctcagtcactgctcctctcttcatctgtcaccacttgcttgatatcctacagctgctttaattccgagaccatctgcagaacatgacaaaatttgtccacctacccacgatgatct

SEQ ID NO: 181414 - DNA, 225 bp, Homo sapiens
aggacaacagaggaaggcacccagctcctggtgcctggggttgttggaaccctcctctctccccttctccttctgctcaggctccaggttcccagggggtaggaggagacaccagaatccacaagagggagactgaagtttgcatgaaaagagccgatggctgggagtcaggagacttggatctggccctgactgtgccctgcaggctgctgtctttgcatctgt

SEQ ID NO: 181415 - DNA, 725 bp, Homo sapiens
actgcaagctccgcctcctgggttcacaccattctcctgcctcagcctcccgagtagctgggactacaggcgcccaccaccacgcccagctaattttttgtatttttagtagagactgggtttcaccgtgttagccaggatggtctcgatttcctgaccttgtgatccgcctgccttggcctcccaaagtactgggattacaggcgtgaaccaccgtggctggccttttcaactggggtaggcaggaactcttcctctgatcctcattgccttagcggcaccagggttagaatggctgctgttggagcccacgtgtttggaggtttgggatcagatgagatgacctttcttaccttgaaattcaagggtttttttcttacacctcttgactgccctgtagactcccagtatgacattgatagagcatccttttggagaccaagatgcattcccaaagctataaacacgaacatgtgtgttcaggcttcctccttaaatacatgttgtcaccaaaagctgattcctgcttttgtgcaaaatggctcttggtgggtctgccactctgagtgatcagtcatgtcagatgccactggacccccactacccaagtgactttccctgactccccagccttggagcttatgtgggtcaagctgcagtctttggtgaggggtgggagatagaagaagccagtgcagaaggtcctctttattccctattccctt

SEQ ID NO: 181416 - DNA, 552 bp, Homo sapiens
tgcatcccccagggtcttttcccctcaaaccaattgtggcacttgcttccttcggccctgttgcctatctacagctgtgcttactgaagtgagactataatttgctacagcatgccagagtattaatagacaattatttattgcaaatctgaaccatttatactgtttactggctgacacaatgtaaaattttgatccaaatgttaatgtgtccatgacattgcataattctgttccacgccatggtttttctcttctaaatgaatcgaatttgcagtacaaggaaatggcatttttaatggatgaatgatttacagcctcaaacttacttataaggctattatttgtgtaactgagggagaattgactaattgcaataacacagcaaattagacaaatttaggattatactgggaacaaattcatagggagaaaatcatagggagaaaaatgaaaataacttgcaaagttcttaaagggtaagtgaataaatctcactttagctttacagggcaattgtattttgagggggaaagaccctgaggtaccttt

SEQ ID NO: 181417 - DNA, 386 bp, Homo sapiens
agtctggtgagagcaaaataaaatattgtttgcatatgtgggcagtttaatgtccacccaaatttatgttaggagtatgcatgtttggtaaaggttacatttagaaaagactggtgtcaaaataaattaatcttcagaaaatcttgcatatttttctaaaatcatcagcttgagataatgttgggggcaactaccaaatgtttttctacaagggtaaccatgaaaaatgacaaaaatcaaggtttaatatcctaaatcacctgcaagtaagtaaaaacaaggtcagtattaacatagaaagagatgtcaaaagaagcaattgtttttccttcttttttctttttggtctcctcttcccagactcaagtgatcctcctgcctcagcc

SEQ ID NO: 181418 - DNA, 495 bp, Homo sapiens
cccagcccagcttattttctgttctgctcctaagctagccaatactctaatcttaattgctatagctttataaaaggtcttgatatcttacaatgttaagtcttccagatttgtttttttcttcatgactgccttgactattcctggctctgcatttccatataaattttagaatcagtgtgtcaatttccacaaacgtatctgttgggattttagttaggactgcattgaatctgacaatgttaactttacctaaagccctgtgctcctagaaaatagcaaaggtcaagaaatctcctccatcccttgagttccaggaaattgcttagtgcaaagaacaagcctctcgcatatgatttagagaagactcccagatgccttccttgtttacatatgacatgctcagtcacagatcctccaaattcccattctttgcctcataaatgattagctaaactcttagtacttagtgattaatctggatgaaatatctgc

SEQ ID NO: 181419 - DNA, 293 bp, Homo sapiens
gagaggagaaagggaagattgtggagatagagctgagagaatgacaagaggagaaagagaaaagagaaaacgtagagaaaaggaagggagatgagaaagcaaaggaagatgggatggagaaaaattcagaaggggcttttatcttagtcagcatatttcttgagctgtggccaacggcaccccctttcagttctgattagttttctcagcatttaaaagctcattggttgttttatctaaaagaatagttcctataaaagaatagtctcacctagggagtgggagattgttct

SEQ ID NO: 181420 - DNA, 461 bp, Homo sapiens
ttaagttgaaccagaagaaaagtgaaaagtagagaggtgaggagagctctttaggacaacacgaggtcagcagcagagagatctgatgagacggagcagtgatcgcgaggtagagggagcaaggtgggagcaggagaggagcagttttgggagaggacaggacccagcgtgggatgcttagaaagagtaggctgggcagccttcaagggtcggccattgtgatgagaggtccaggagctgtctgtctgcaccggcactgaagtaacccaggctgatggcaggaagtagcaaaggccactgaggagtacactaagctggaaacagaggcccagccattagctttggcaaaatggaggggaagagtcattatatcaagagcaacatcaggccaggcgtggtggctcacgcctgtaatcccagcatgttgggaggccgaggcaggcagattacttgaggtcagg

SEQ ID NO: 181421 - DNA, 109 bp, Homo sapiens
ctacattgcctcatgtccatcctgatttgggagtgcgctgctgccttatgtaagccgcatgacctccccggggtgactacctttctccagctctgacctccaggtgtgc

SEQ ID NO: 181422 - DNA, 334 bp, Homo sapiens
aaagttacactatactatttcagagtaactgtgaagaatctaagagggagctttgccaaatggcacttagagcccaactaaaactaaaacttcttaaaaacatataataccaatctacatggttgcacagcagggctcaagggcctagacaaaatataggactacagagattgcaagataatacagatgggatttttggatcagctgggacctatgagtaagaagtgaagaactggagggtgctatcaaattatactcagacatgactgagatttgatagtaaaaaataatagtatgattaaactgcaattacataaatgaaaccttataaaat

SEQ ID NO: 181423 - DNA, 816 bp, Homo sapiens
ctcctgaagtaatagcatagtctaccttcaagtgatattaaaaagtttaaagatgtttaccagaagccctaaggcaaacatgaatgaaataataaaagagagaagcagaacaaagtgttacaccaaatcagcaccccccccaaaaaaaattcactccattaacacacaaggaggcagaaaaagaggataaaaggaaagctggaatggttgtattcatatcagacaaagcagatttctgaagaatactacccaagataaaaagaggctttacaaagataaagggtctattcatcaagtggacctaacaagccaaagcatttgtgtacctaatatagtatcacttcaaaatacgtaacagaaaaaagactaaaatgcaaagaaaaatagacattcagaattatagttggagatttcaatttaccttccttaataattgataaaacaattagatagaatcagtaaagatacagaagaattgaatattatcaaccaacttgacttaatgagatttatagacattccacctgaccagagaaaaatacacattcttctcaaatgcacacaaaacatttaccaagacagagcatattctgggatatataacaattcttaataaatatgaaaggactcacagcatataaagtattattcagaatagccaagacacagcatcaatctaggtgtctatcaatggatgaataggaaaatatgggggggatatacatatacatttatttaaacagactacaattcctattattcagccttaaaaaagaaaattctgttatttgcaacatgacacaacagatgaacctg

SEQ ID NO: 181424 - DNA, 176 bp, Homo sapiens
aagtcttcaatagatatggctgcttaacttcgtctcaattggtgcctctgaaatgtttctcatcatacaaaacccctttctgtcctatcacccagcccccagaacacattctgataaatccttctgataaagcccaaattcctaaacaaagcatctaaagtatctaaagttctaca

SEQ ID NO: 181425 - DNA, 411 bp, Homo sapiens
tcttattcactttcctctcctaggaagaatggggccacctagagcagtgggcatctctgggacatcagaggatcttgaaaggggaggtgaaggcatgaaaacagattccaagcatggtctagagctcggccctcgcttggtagtaacacagtcagaattctcagtcagacatttccgttcccaccgcagttcacaagaacggaatgctgaggcttcctggtacagctgccaagaaactatgcccacagccttcccactgagagccagatggagctacattttacaggcctaagcggtggtttcctttctttgcttatgggacaggaagtttcagatccattctgtggagtaatgaaggacagctaggaggaggaattctcactctccacggctggaaagcaaggctttgct

SEQ ID NO: 181426 - DNA, 354 bp, Homo sapiens
gtgcaggtgtggacccggcctctgggtttgaatcctagatctgcttctcattgagtgtatggtctagggcaagccatttcaactctctaggtcctagttttctttcttttttttttggaaatggggtctcactctgttgcccaggctggtgtgcaggggcgccatctcgggtcactgtaacctctgccctccaggttcaattgatcctcctgcctcagccttgccagtagcagggactacaggcatggaccactacacctggctaatttttttttcctgcctgccttcctgcctgccttcttgccttcctgcctgcctgcctgcctgcctgcctgccttcttgcctgcctgcct

SEQ ID NO: 181427 - DNA, 584 bp, Homo sapiens
ttctggaggatattgactatcccccttagacgtggtatgtcatctcaggaaattcattgtcccttaatatattttcctgtcttggaaaagcattttgttaatagtgattctggtgatgatttaaacaaaaatgtatttgattagacgtactatgttgcaggtacttcatggttacttacctgatctgatttgcggtcctgaattacttgactggtttcttgtttgatagagattttctataaaattttggttgtgctgtttcctatagtagttgaatatgtgaccagtttcatagtagtattttcctcccttaattgaatatgagatcaacattttccaagaacaggtctggtttggaacatctcagccatgttacatgtacattgagaactttgagatcctgcttcttagtggtggcagctacagaggagtgggctgaggacaggtgaaggaggagatgatgtaataagagtgtgcttgcctttgtttagttaagaaaaatatgctggatttgtattttggtttgtaaaaagaccacttctgtgtgtaagaaattagccattgagacaatccatgttgccttt

SEQ ID NO: 181428 - DNA, 285 bp, Homo sapiens
aggtaccaaaagtatggcacagagatatgtggcagttccacatatctcaatcaacaaagctctaactctattagaaactagacatttaaaaagtactttttttgtaacttcatctgagtcaggtttctcattgaataataatctgtcagttttgtctatagtatgttccaattggaaaatgtttaaggtagtacatgcctcttttctccataaaataccccacatttgtttaactatttgacatagtcctattttttccatctttaataattgataaaattttcc

SEQ ID NO: 181429 - DNA, 610 bp, Homo sapiens
ataaatcttgtctgggaagtctgcctagcctcctattaatttctgttacactgacagccaagaaccgtgcactagtaagagtaacattttctgtccctaataactaacggatgtaaggcaatgatcatcagtgagtaatacaaaaaacactagacattttgtgccttctgatggaagaacttacatcccaagatgatcaattctctatcagtgatgaaatactcataccctcgccccagacgttttgaaatcagaaactttgggagtagtgcctaacaatgttttaatcaagccctccaggtgattctcatgcacattaaagagaaccactgctctacatccaataaccaacttaacagaaatacagaggaacatattaaactactccaacaggatacaatgggcaacatccaaactgtggggaaactatagataacctaggtccttcaacgaagaaactgcaagcgaattttttttaaactgcatagataggtgaaatttatattttaagtttcttttattctacagcaaccaattgtaacatgcaggcttcgttttgctcctgattcaaacaacctaaataaaataccattatgagacaactggaaac

SEQ ID NO: 181430 - DNA, 140 bp, Homo sapiens
ttcttttaacgttttattataggaaattcaaacatgcagaaggaattgtaccatcaacaacacacacccatcactctgctccaacaatgatcaactcaggcctatcttgcttcatcctataccctccctcgcttgcttcc

SEQ ID NO: 181431 - DNA, 367 bp, Homo sapiens
ataaaaaaaatacaagtttcaagctttaataacagaagggtccatttcaatgtttatccaaaaacaactgtttctgggactcttggactggtttcagtaccacaggtgcatactgaagaatgatcctgaaacccttgacaaggagaatcacacacccttcccacatggacactatctcctgttttctgctcagtgccaactttggtaatggtctatgtggaaagttgagcttccccaggtagtcaggagtatcataatgctatgtagccaggtttaatgtggttgacatataggagttgttttttaaaaaaaacaaaacccttcagttgatatattttttccattaagaacaatgcttttgtccagg

SEQ ID NO: 181432 - DNA, 674 bp, Homo sapiens
agacaggcatgattttagccctagtgctcaacacccataatggagaaaaatgtatttctccctcctgccttttggcctcctgtgtccattactgggaataattaggaaaactgtcagaacttttgtagcctatttaaggtctagagtatcatcttactgctttttcacacctttacttcacattttgcgtatttaatctgatcattcttggcacagatgttacatgtgacaagcccttctcttccgtagtcatctgcttcagtttaattagcagaatgttctttctgatctgtgtgctttgccctcctgcaaacccaggagaagcagtgttagagtcttgtgctcatttgctgacatgcttagatttggtaatgagatggaggactcttaatatgcacacctcgagtaactttattttgcagtcagaagatttttcacattagaaagtaattcttatgtatattcagaattaaaaaaaattcttgttgttacaacaacaaaaatcacttgcaaatgaagtgttttagtaagtaattttagtaagaatatggaaagcaaatttgagttgacctgttctttctttctgtttctctgccctgggagtgattaatagccacaggccccagcacttttgagtcagggttgaggtgacctacctactctttcagcctacc

SEQ ID NO: 181433 - DNA, 589 bp, Homo sapiens
tttcattttaaatggctttatattggtggattttttttctctcatgcacatgtattactattgaaacttcaatataaaaataaataatttatacccattgaaatacagaaaaataagtaaataaataagaagaatggactgtgttccctaagtataactctgaaatttcacacagaaggtttgtgaattactctgcctggcaaattatgtcctcttggccacttcctcaggccctcagctcttttagaactcaggcaggacctggtgaaattcttttattactgaagagctaaaatgcaaaatctgaatggtaatgcagacttaagtttcaaagattcctccatcagggaaaggagaagtgaggcagaggcaacagtaccggggcaggtgttagatgggtccaacccctggttccaggcttagggagatcccttccccttttagaatctcaacattttcatctgcacatggaggtggtaaaaccctccaacagggtgactacctttttacagaggaagtttaagaaagcagtggcaagccttggattactaagtattccactgcctttccatgtgttttaaagcagttc

SEQ ID NO: 181434 - DNA, 269 bp, Homo sapiens
ctctgggaagccgtgctgttgtgtgagctcaacacaatgtgttgggaagaaatggttaaaccggggtcctgcagggcactccacagctgagaccagccgctgtgaacatctgcacaggacagagtttggaagacaagtttgtgccaatagttagaaatgcagagagaggccgggcacagtggctcatgcctgtaatcctagcactttgggaggccgaggcgggcagatcacaaggtcaggagattgaggccatcctggctaacacggtg

SEQ ID NO: 181435 - DNA, 542 bp, Homo sapiens
agtaatatcagtcatgatgcaagacaccaagcagggatggcagataaaggaaaggaattaagatgtgaattcctcctaagggctcagaagcacgctagatattttacatacagtatatcatataaccattacaaacttgtaagataagaaacagtaccctctttttacctctgaagaactgaggattggagagaaacatacctaagattagaagtaagatgtgccaggcctagcattacagctaggtctgtcagggatcaaatttgcctttttcattccaccaggcttcatgcccctcaaaaaagtaccaaaacacaggatggagtaaataacattcagaagtcagataagcaggtggcattggtaagcagcagggctctaagctcaagccaggactctactgtcccactggagagatggtaagagcaagcaaggacacaagtgctatatctagtaatgatgtcatacttggtaccaataaccttcacaaagtcagctcccaaggcccactgctatcaaagtgaagctagaagtcagggcac

SEQ ID NO: 181436 - DNA, 247 bp, Homo sapiens
acggtcctgcaagcgtagtacccaaagcaatttaaataaatatcaatttttaaaagatacgtatttacctttcaaatcaacagattacattggatgtcttgagcgggtccataagtgcttagcctaaaccaattcattttaaatccctgtaactttttgtaccctagcgttctcttcacaccttttggttacagtttttcttcccccccaaaaatgctgcaagtgagttgggtactacgctttggca

SEQ ID NO: 181437 - DNA, 194 bp, Homo sapiens
cttcccagaaaatcactgtaaacaatttagttcgcatcttttctgaactttacctgtgtatttataaatatttacataaacacacacacacacagcagttttgattttatttttcaaactgcgataaaacggcacacataaagttctacagcctatatttcttgcctttttttttgttatttgttactgtctgt

SEQ ID NO: 181438 - DNA, 208 bp, Homo sapiens
ctagaagctgcttggtggagccctggtccggcattgtctgtagagtgtgtgtatacgtgtgtgttttgttgctggaggtttaattttgttattgtttttaaatacatgggtaggactgggtcagctggatgagtcggagaggaaaaaccattgatctgtttctgaaatcagatctgcaaatggtggccttcttcgtacgtggagaaag

SEQ ID NO: 181439 - DNA, 193 bp, Homo sapiens
gccagtatcactacataaagtatatcgtaagagtttaaaatttctttgcgagtttccctcaccacccaactttagacaagatggagcatatctcatagaatactgtgttcgtagctccctggattatttctttttctcccctcttcactgtggttatggaattcatttgaaatacaactgggtttcttcattt

SEQ ID NO: 181440 - DNA, 153 bp, Homo sapiens
aatttacactcacattaagatcatatttttgcctagtgaaaaaaaagagaatgatgcccttggcccaaagtaaaggcttctccgggtggatgtgacaattggatgagaccacgcatggcgacagcttcatctagtgcctggcacacagcacgt

SEQ ID NO: 181441 - DNA, 690 bp, Homo sapiens
tcactcattccttacgtccaagtgttagccaaagccacctccagaacaacaaacttctccctggtcacgtcaggagcctgcccctttcccgcctggcccctcaggcacgaactcccaggcctcctagaatgctcctccttcactcccacctcgggtctccctgggccccagagaagcctccaacagccacacgacccaagcaggccccaagtgacctgtgaccacccacaacccctcggaaacagatctgccagcctccttgtggatttcatgcctctgtcttccccgagagacagttccctccttgagggcggggactatcttccttacttcctgccatatcacagtggctggaacctgccacctgtgacctgccacccaggacatacttctatttgggattacccaattgcacgagtgttgtttctttttttagagacagggtctcactctgttcaattcacccaggctgcagtgcagtggctcgatcatagctcgctgcagcctccaactcctgagctcaatcaatcctccagcctcagcctcttgggtagctgggaccacaggcacacatcatcaggcccagcaaaaaaaaatttttttttttttgagatgggagtttcgctcttgttgcccagggtggagtgcaatggcgcgatctcggctcaccgcaccttccgccacccgggt

SEQ ID NO: 181442 - DNA, 328 bp, Homo sapiens
tcagctgagctgaggagacaggccagggtcatagatagggatgcctgggtggcctggtcatggctgatccttcttgtgtatgacagactgaaagtcaggtgtgtttaaagaacgtgaagctatagaacttagttgcagccaggcacagtagctagcaactgtgattccagcacttcagaaggccaaagcgggaggatcatttgggcccaggagttggagactagctggggcaacatggcaaaaccccacgtctacaaaaaatttttaaaaattagctgggcatggtggtgtgtgccagtggttccagctactcaggaggctgaggtgg

SEQ ID NO: 181443 - DNA, 971 bp, Homo sapiens
tgtgtggctatgtgttacacacatctcttcacccagcttggcctccaacataattcctccactattgtctgtgtcgtaagctgaattaacttacctctgtggaacattaggccacaaagttgggacattaaaggcctctgttaatgtgtggacatattaacactgaaagccattattggccattaacaccttaacctgattttttatgggcatgagtcagattagtcatggatgaagaaagcacggaggaaaagatctagaacgcagggcattgctaaggagggtggatgtacatgctgatatagggacagcttagagcattagggagctgctaagagagaagagggctggaatagcaagccaagagttacgtgggctcagagggaggaggaagccctcccaggtggcagtctgcgaaatgaggaaaggtcccatagagaagatgtcatttgagcagatctgttttgatagacagtatttagatgcagcctaaacgaagagaactgcatgggcagagactctgaggcaggaaagtactgtctagggcaagcttgggagagcagtgcagacattcatagtgtaacaagaacatataagggaagaaggagaggtcagggaaggtttattggaaagatgacagagaggaacctgagtgttaggctgagctacttatcagctatcttgttggcatatagcttctgctgactgctaatccaaggtgagttcacttcgtgggtggtagatgaatgccatttagtacacgtggaagttaccccagtgcctcccactttagactacaggtcataactcggtgtgggagtagagccattccacccatggccaggaaagctgtgcccagttacaagtcctgtgacgccttaacataggaatagttctgtttttcaaacaagttgtcgagaagttaccaagaaaataaagaaccttcttcccacagaagaaggcagccagaa

SEQ ID NO: 181444 - DNA, 529 bp, Homo sapiens
gtgaccacactgaccagccagaattgtctactgagttagcttgggaaattgacaggaaagcgctgcatcagcacaggctacagcgtactccgatcaaactccgatgttgtgccttggatcctgtaacttcagccaaggaaaccataggtgacatcggtctggatttaagaaccgctcaagaaacgaagcaggcaccaaaatggtaccagttgctgagtaataaatacaccaaattcaagtctgagatacagataagtattgctttggaaaccgatacaaagccaccagtggatagctttaaagcaaagggggctccccctcgagatggaaaagtgctggaggctgggaagttcaagatcaaggcactggcatctggtgagggacttcgtcctacatcctcacatattggaaggctgaagagcaagagaggaactctctccaccaagcctttttataagggcacctgatctcattcattagggaggagctctcatgacctaatcacctgtttaagaccatatctcctaat

SEQ ID NO: 181445 - DNA, 821 bp, Homo sapiens
gtgaccacactgaccagccagaattgtctactgagttagcttgggaaattgacaggaaagcgctgcatcagcacaggctacagcgtactccgatcaaactccgatgttgtgccttggatcctgtaacttcagccaaggaaaccataggtgacatcggtctggatttaagaaccgctcaagaaacgaagcaggcaccaaaatggtaccagttgctgagtaataaatacaccaaattcaagtctgagatacagataagtattgctttggaaaccgatacaaagccaccagtggatagctttaaagcaaagggggctccccctcgagatggaaaagtacctgccatcctggctggacttgaccccagggacattgtggctgtgctgaatgaagagggaggctaccatcagattggaccagcagaatactgtactgactcctttattatgtcagtgaccatagcatttgctacccagttggaacagttaattccatgtaccatgaaacttccagaaagacagcctgagtttttcttttactactctttactgggaaatgatgttacaaatgaacccttcaatgatttaatcaacccaaactttgagccagagagagcatcagttcgcatccgtagcagtgtagaaattcttcgtgtttacctggctcttcagtctaaactgcagattcacctctgctgtggagaccagtcacttggaagtacagaaatacctttaactggattacttaaaaagggcagtacagaaatcaaccagcacccagtcacagtcgaaggtgcttttacccttgaccctccaaacagagcc

SEQ ID NO: 181446 - DNA, 358 bp, Homo sapiens
agagatggggtttcacccgttgtccaggctggtcacaaactcctgagctcaggcaatccgcccacctcggcctcccaaagtgctgggattacaggcgtgagccaccatgcctgaccacattaaagcttttaacatgctaatctgagtggttattgatgatggtaagatcaagttcggttgttttgtagtcattagatttaatggaaataaccattagcagagcaatgccttgtgttggattattcactatcccgttagtatcctttgttttcactttgataatacgattgccttttattgagtagaaaggaccagtatgctcaaggagttattgattcatagttgagaccaaaaaaag

SEQ ID NO: 181447 - DNA, 459 bp, Homo sapiens
ctcactccttcttcagttcactgtaactcagtgtcttcccctcatccaaacctattgtggaaaaaatatcagttaccttaaggtgaatttaatctattatattttattacctccataagtatctgcatttttcagttaattgtgggaaataatattttcagttttaagaattggagagtgttgctgggattacaggcgtgagccaccatgcctgaccacattaaagcttttaacatgctaatctgagtggttattgatgatggtaagatcaagttcggttgttttgtagtcattagatttaatggaaataaccattagcagagcaatgccttgtgttggattattcactatcccgttagtatcctttgttttcactttgataatacgattgccttttattgagtagaaaggaccagtatgctcaaggagttattgattcatagttgagaccaaaaaaag

SEQ ID NO: 181448 - DNA, 705 bp, Homo sapiens
  misc_feature (56)..(56): n is a, c, g, or t
tcgcccttaagcagtggtaacaacgcagagtacgcgggaagcagtggtaacaacgnagagtacgcgggaagcagtggtaacaacgcagagtacgcgggaagcagtggtaacaacgcagagtacgcgggaagcagtggtaacaacgcagagtacgcgggaagcagtggtaacaacgcagagtacgcgggaagcagtggtaacaacgcagagtacgcgggaagcagtggtaacaacgcagagtacgcgggaagcagtggtaacaacgcagagtacgcgggaagcagtggtaacaacgcagagtacgcgggtaagcagtggtaacaacgcagagtacgcgggaagcagtggtaacaacgcagagtacgcgggaagcagtggtaacaacgcagagtacgcgggtcctaaaagttagaactgagcctctctctttcatactcctttattgttttgctaaggtttgtgttatagtaactacaaatttgtttccctttttgtttacatctatgtttccttcattaaatatcaatttttaagccttagaaatacttcttattcagccgggcgcagtggctcacgcctgtaatcccaaccctttgggaggccaaggcaggaggatcacgaggtcaggagatcaagaccatcctggctaacaaggtgaaaccccgtctctactaaaaatacaaaaaaattagccaggcatggtgg

SEQ ID NO: 181449 - DNA, 508 bp, Homo sapiens
tcactggggaagatgaaaggaagtgcagacatttcctctgcctaatggatgaaaaagaactaatggacagggaaaacatctccaagtgcaaggaaacaattttgtctgagagggaaacactgttatattacttctgaagtgttcagaaagtataaattaaatcaattgcaagaaagcattatatcacagtaagttcttattgagtgaaaaacaagataaatatagcactattggaaaatgctagacttactgagcttgttgtaataattgatctaattaagtttcaaaataaatagaatattaacttacaaagaaaatttcacaaggaggaaagcaaaagaaggaatatgaacatatagaaatattcttaatacagaagaccccaaaaatgtaaaaaaaaaaaatgaatgatcagaaatcccactgatatcaggagaggaagatcttgctgtaaactttcctcttcattaaataattttcaaaaatgaccaataatattatctacttc

SEQ ID NO: 181450 - DNA, 360 bp, Homo sapiens
ggatctgcactgggagtcacttttaattttctttattaggagatccaaattcaaataagggcttgtttcagtggttctcaaattcatctgcatattaggaatcacctgggatctaaaaaatgttccaaagcctatgccatacctattacggactgagtgtgtccctcaaaatccatatgctgaagttctaagccccaaagtgactgtgtttggaggcagggccctcaggaggttattaagattaaatgaggtcacaagggtagggcactgaccccaggtcttaataggactggtgtccttataaaaagatacaccagagccaggtgccagtagttcccacctgtagtcccagctaccagc

SEQ ID NO: 181451 - DNA, 658 bp, Homo sapiens
agcagcctccctggctgaggccttcttgctatgcagtagtgcaccgtgcccattccaattgtgtaaactcctgcctagattctgccaagctcttttgaagatctggttcaggatgagcctgaactgggtcctccatctgtcactgcccctttttcacagacgggtggggcgctttggggcctgatgctttctgggaggagcttgagggtaggctggtacctggcaggtgaggagtggagtctacagctccaaatgtgaaaatgaaataagatcaaactcaaagaggggttgaggacaagtgagcaagtttgttgatgattaacttgcagatccttcccgtgtcccttaccctctggactggcctttgctgggtgagccttgcagtcaaagccggcagctaggatttggggtgcacatgtctctctgctagggctctgagggcatggggactctgttcttggagctgagaaaccttgcttctctttccttccagccttgcgggccttgcccgtgtgggactgcatcagagcgtactgaaatcactggccctcatctggtttcagagctgccagttaagctgttagattctcccacccctggtgacagtgatgcacctaggagttaagggagtagatttggagacccctttaaaaaaaaa

SEQ ID NO: 181452 - DNA, 280 bp, Homo sapiens
gtcacgtttcctgcactctgactcactcttcatatcctgactgctagatgttgggtctatatctcactcgggactgcattttattcacctctacattctgtggaaagtaatttacaaagactggtagcaatctttgttgagccaaggaaagagttctcagtgtgagcacatttatttattcccataggagacttctgtctttactgttcactggaatcatttgggattacttatgtatttcagaatatttcagctattccttccttgtgagatctccttg

SEQ ID NO: 181453 - DNA, 388 bp, Homo sapiens
tgaggatccagatggatgacaaggacacaggactgccattgagaaatgaagatgaactgtgtcacagatgcagtggattactgactgcccttgtaatagtccattttgcatctgttggtaattcattgaggctctcaagtcctgcatcctgaggatccagatggatgacaaggacacaggactgccattgagaaatgaagatgaactgtgtcacagatgcagtggattactgactgcccttgtaatagtccattttgcatctgttggtaattcattgaggcactcttggttttctatgagtttgtattttttgaattcaagaattgtaacatcactgttagatccctccttatttaatgagagaaataaaatatttgacacgagaaaa

SEQ ID NO: 181454 - DNA, 1231 bp, Homo sapiens
agctgctctagaatgtagcaatggtgggctcctttgggggccatctagaagcaccctgcccctgggcacctgcctcctcactggaggagaccagaggccacgtcccagccctgtgcttccagctctggaactgcccttgacttcactggacaggcctgagcaagtcgtgtaaccttcagggactcagctatgcccactccaggctctgtgaaaccaagacaacctcacgtgctcagttcctcagctctgcaggagccaggctgctctgggttgcaagtggatggcaagcttccttgtgacttctcatcctggcaattttctggagtgtttgtgactggactttaacatttccaaaatgtggcgacagtgactgttaagtcttcccaaagacgagggttcctgggagccccagggtaagtggcagactaaggctgcaagcatcaggacagcagagaccaaattcatcattgaatcctcaacatctagcacaatatgcctggcataaggtgaagagaagaagagtatgaactaccacgaaactcatttccctccgtccttcaatcaaatacaatgaccttcagctactctcaccattctctactgaaaacatcccaactatctggaaagaactcacctaaagttccccaacatcaaataaaccacgttccaaaagattcagagccagagagaaacaaaacgccctttgttgatgaagcatttactcatacatacatacaagtgtgtatatatatatacacatatatatgtgtgtgtgtgtgtgtgtgtgtgtgtgtgtgtgtgtgtgcgtgacaatacaaaccatccccccccactaatccccaatccttcctccttcgctcttccttgtttccctccgcgccttcctggcgcgtctcccttccaggcggggttctctcatcacctttttcaacatccccccctgccttgttcggtcttgtggggtgggcggattcttcccgcttaaacgcggcatatccctcttctcttataatccgcggatacccgtttgatcaaccacgtgtcacacgccccccatatccgtccgattctgtgctagggttgccgccctgcttgcagacctctcgattctccctcgattccaggttcgagatacccccttttcttcttcccttccgtcaccccccgcctcctttccttcgtttcgcgtctttttattcctactggttcttttttcccgcccctcaccccc

SEQ ID NO: 181455 - DNA, 488 bp, Homo sapiens
ggcctctcgcggtagtggatccttcccgcgggaccttgctggggaatgtacgttacagaaataggtttgtaggtatgtagctgcagaggacgtttacttctgtgcaatcactggactcagtctgtaggatatgcccttagataaactggccaaaaagtttttggaagagtcgaacgcggtggctcacgcctgtgattacagcagctctgaaggccgtgaggggcggatcgcttgaggccaggagttcgagaccggcctgggcatcatggcgaaaccccgtctctacaaaaaatacagaacataagccaggcatggtgccgcgcacctccagtcccagctactcgggaggctgaagcatgagaatcgtttgaacctgggaggcggtggttgcagtgagccgagatcgcgccgatgcactccatcctggtcgacagagcgaaactctctctccaaataaataagtaaaacgttggaataataagaatgca

SEQ ID NO: 181456 - DNA, 185 bp, Homo sapiens
  misc_feature (13)..(13): n is a, c, g, or t
  misc_feature (20)..(20): n is a, c, g, or t
ctagaggatcccnctgagancacgccactgcactccagcctgggcgacagagggagcctcacatacatacatacatacatacatacatacatacatacatacatacatacggcatgcagacctgtaccctgctgcaccactcccgtatgttttttataccaagtttttcttcttaaaccccttca

SEQ ID NO: 181457 - DNA, 405 bp, Homo sapiens
tatgctagatatacatgtaagtcactcgcatgagataaaggcaaaggtccacatcacttacacttctctcttcctttaccttttcttcagaggatacctaccaggtacctcttactcatgacagacatgaatacaactatatcaatgaaaacattaaatgtgaatggattacagaatccaatcaaaagggaaagattgttagactgcataataacataattcaactatatgctatctactagagacacactttagacttaaaggtattaataaattgaaagcaaaaggatagaaatggttatatcatgcaaactacgatcaaaagaacactggagtgctataccactatcatacaaaatatgccttaaaacaaaaaagctagaaataaaaggaacaatttataaa

SEQ ID NO: 181458 - DNA, 153 bp, Homo sapiens
caacctcatcctagaaatttctgcacgagccaccccttaatttgcatataattaaaagtgggtacaaatattactgtactagtagtacggaactgcctctaagctgttattctggacacactgcctatgggatacccctgacccacaaggaat

SEQ ID NO: 181459 - DNA, 435 bp, Homo sapiens
gagagtagaattgtggttaccaggaatgtgaggtttgggtggagcggggtgggttgggaaggtgttggggagcaaaaaagacataggacatgtttaagaaacaatatgcttggctagcatgcatagaacgtgagggtgaacagtggggaattaagttttaaaaagtttctgaagtctagtaatagcacttgggatgtcaggataagaggtttttttgaggagtttttgtttgtttgtttgtttgctttttgagatggaatctcactctgtcacccagactcaagtgcagtggggtgatctcagctcactgcaacatctgtctcctgtgttcaagagattctcctgcctcatcctcccaagtagctgggattacaggcgcccgctgcaacacccagctaatttttatatcttttagtagagacggggtttcaccat

SEQ ID NO: 181460 - DNA, 631 bp, Homo sapiens
agacattggcccaacacaatgctctctcattggatagctattttcatagcaaacccaaatttcaaaatgtcagcctgataaataggggagatttgaaaggatacagtcaaggtgtttcgttttaatacttaaagaagaaaaagaagcctactcttgtttctaacaatcttttagagctttaaggaaagaggatgttgtattttgaaaagagacctggttgtatcttgtctagaagctattttaatatatacaaccattaagtaggttcagatcatattatgaggctcatttttttctctataatagggtgaatattagttagaactcagtaaccacaaagagctataaaagtttaaaacataatgtcttacttttatttccattttcttctgagtataggtgccgtcttggtatggtaaaataagatagcatctactagattctggtataatatatagcctggtagggtggctatgcacatagactttagagttgccttatagctctgaaaactatctttactggttttcaaaaccattggctgttagattttggacaatatttagtatctccaaggtttccctttctcatttctaaaattaggataaatagcaccagctacatagggtta

SEQ ID NO: 181461 - DNA, 368 bp, Homo sapiens
ctctctctcaaaaaagaaaaaaaaaatatgtatatatatatgtatatatatatatttatatatgtagaagcagtgagtagaatggtggttacagagactcggggaggaggaatggggaaatgatggtcatagggtgcaaagtctcaggaggaatatattgtgttttgagatctattgcatagcatggtagattgctaagagtaaatttcaaatgttctcaacccaaaaaatgttaagcatttgaggtgatggatatgttaactggcttcatttaattattccatattgtatttataagtcacaataggactttgtggcccataattataaacaagtataaattgtccatttacaattaaaaatcaatt

SEQ ID NO: 181462 - DNA, 429 bp, Homo sapiens
gaaacctcatcagcaattctaattttgccctggactttgatctcgctctgcccccatttgccttgtgatattttattgcctttgaagcatgtgatctctgtgacccacaacctattcgtacactccctcccctttgaaaattgctaataaaagcttgctggttttgcggctcgggagcaacacagaacctgctgacgtgatgtcacccccagagacccagctgtaaaatttctctcttttgtactctttctcagaccggccgatgcttagggaaaagagaaaagaacctacattgaaatattgggggctggttcctccgatactgtgggaaattgaatagatgctattttggagaatttcaacatcttttcaattttctcctcccagctccctccttggtggaaagcagcttgggtcctggaggtggac

SEQ ID NO: 181463 - DNA, 435 bp, Homo sapiens
gaaagagctttgctctcatttttttatttaaaaaagtgtttatttcaaatagattgaatcactaggtgatgggctgattctttcaaaaaaatttaatgacctccccattatacaaacaataaatgtttattgcagtaactttaaaaaagttagaaagccacaaagggaaaaataaaaatcacctataattcacccacccagatataattgctattgacatgttgatacgtattcctccaatctttttcatacacatgtaaatgtagtttaacagattggaagaaatgtgctataaaatggttgataacttacttttttatttaatgatacttccatgaccattttctaacattgttaaattttttccaaaatatgtttgatcagagcatactgtctaacctatgaatgatacacctactgcacataacctattgg

SEQ ID NO: 181464 - DNA, 113 bp, Homo sapiens
atcactgactaatgaaaatgctctttctggaaatgaggaactaacagtcaaaattaagtgtgataaggtgaagaacctactgcatgtcacagacactggtgtaggaatgacca

SEQ ID NO: 181465 - DNA, 502 bp, Homo sapiens
attccccagttttgatcaaagccagcagtgactaaacatggtgtgcgggcagtacttaaagctccctgagggaagaaaagcctcatcactcagcaacccctttggcaaaataaagggtaacattcattgggtttgaacaagtgaataaaaaaaacagctccccaatttttggaggaaaacatgatagaataaaaaaaaaaaaaaaaaaaaaaaaaaaactactgacttaaaaaagcccttctaatccaatcttaaaattttcacaaatccatgtaataactacaaatctatttgcagttggaaatccagacactttaaggagggtctcaacaaagtcatgtttcaaaacataccagttattttattcattcatttattcaatatttactaagtccctattatgtgtcagatacagttctaggccccaaggatacagcctgaacaaaaagtccctgatctcaaggagaaagagagataaatagataacatatcaggtggtgat

SEQ ID NO: 181466 - DNA, 172 bp, Homo sapiens
tcttagctttttttctgttagtataaatacagtataaatctctatttatatcactcttctttattatttggtttctcttcacagtccaatgacaactttggtctttaatttttttaaagtgcctggagccaggtgaggaagctcaagtcagggagctatggttttgctttgg

SEQ ID NO: 181467 - DNA, 308 bp, Homo sapiens
caccgtgttgcccagtctggaactcctgaggtcaggcaatctgcccaacttggcctgtcaaaatgctaggattacaggcgtgagccaccgcgcccggctgtgtatgatgtttttagtttcaatgttgacatgttttcaattctcttagttatacacttaggaagttttatatatttttacctattaaatactccttggaaacatctatttctctctatctctaagctaccaacattccctcatctggactaaagcaaaagcctcctcccttcttttttccaggcctcttctctacctggcccagtaat

SEQ ID NO: 181468 - DNA, 654 bp, Homo sapiens
ctggtccttaaatgctggtttcccttgggtgctagctaatattggaaatatcagccattctcaactaataattcctaattatatccccaatttagactttttattctaagttcccaatttgaatttcaagttaccaactagacatagccacctggatgtattcacttattaaacaactgagtgccctcaatgtatcaagcactgtcctacatgttagggagacagcagtgaagagacacaatcctcagccttacagatcttacattctagtttggtgggggcaggttagatgcctcacaggcactttaaatccaacatacgtggaaccagacttatgacctaacctctaaccctgttcttccttcctacattctatgttttctccttctcccttgcccagcccatgtattacttattcagtcactatgtcctgtctattctatctcctaaacatctctttactacatcccttccttcatccctcttccactgccttagttctacctttgtcatttctcatctggactgctgcattagcctgttaactggtttctttgttttctgaaaggaagcatcaatctatcctcaatattagaataatctacaatgttttttcacctgggcatgtctttcctttttttttttttttttttt

SEQ ID NO: 181469 - DNA, 303 bp, Homo sapiens
tcattttgagacaatctaagatggtaccatcttaccaaatacatgaaagtaatattgaataaaggcagcattttcacaagaagataatattatttaattagaacgttacatgaagttacattttatcttggccatttgtatgcaaactttacaagtcttacattgataattaatgcatgcaaaacattgatcttgattcatatttttcttttgagatgggtcccattctgtcactcaggctgaagtgcagtggaatgatctaggatcaccgcaaccttcacctcccaggctcaagccatcctc

SEQ ID NO: 181470 - DNA, 313 bp, Homo sapiens
ttcctcccattttacacataccatcctatacttgctttttccctctgaattgtacatcatcttggtgattattccttgtcagtccacagaaagcatcttcactgttttcctcagccgtaatggtagacggagtgactttaagcaaatgtagatataaaggctcatcatggagaagtttccacagctagggtgatgggtcaagctgaactgatgaacaagaatggagtgggatagaagattctgcatccactggggctcccaaaccatttgcacagcctattccctctgcttaacatgccctcttaccacattc

SEQ ID NO: 181471 - DNA, 335 bp, Homo sapiens
ttcctcccattttacacataccatcctatacttgctttttccctctgaattgtacatcatcttggtgattattccttgtcagtccacagaaagcatcttcactgttttcctcagccgtaatggtagacggagtgactttaagcaaatgtagatataaaggctcatcatggagaagtttccacagctagggtgatgggtcaagctgaactgatgaacaagaatggagtgggatagaagattctgcatccactggggctcccaaaccatttgcacagatcattttgcccgtggctgggtctggacttcataagaagcttcttctggggtaggtgaga

SEQ ID NO: 181472 - DNA, 241 bp, Homo sapiens
gtctctagatctgagcaaaggttctgaatgaagcctttatagattttggtttaaaaacctgctgaatgcataaaagttctcagtaatataaaattactgctcattgactcagcaatccaccttcgtatgacactgctattgtgactatctaccaataatttacaattttactttacttaatctaatttcaaacaataatactaccacaaccacttcttctcctttctctcctcttccttat

SEQ ID NO: 181473 - DNA, 486 bp, Homo sapiens
cagtctcatgcacactcacagcttcagttaccgtcttgatgccagtggctgctggatttactctctagcccagaactctccaagctcacggccttgtgcctgactccgacttggcatttcttcctgcttgtttcatgattatttcaaattctaaatgtctgccctagcctaatcagtctaaggtcgccaggaacagacccacagtctgacagagtgaggtttatggctctttgcagtgaggaagaccataccagaacaccgagaaactgtggggcatgtcaacaaaaaagaggatagagttgttgtaggacttggagacagagtggtattaggtgaagcataaatgaagcaaaatagaactgtgtctaaagggaccaatattaagtctgactgcgaagcggacccaggtcccgtttccttgaaaactacaacgttcaaatagacgtggaacattgttctagaaatcccttacttgaagctctgcag

SEQ ID NO: 181474 - DNA, 276 bp, Homo sapiens
tagcaaggtgtttttggtgttggaacttcgggatgtgatccagtaggtggtgcttaggcatactggttagttggtaggctcttgcttggtcatgtggctcccctatattttctgacagttgcagtcatgctccctctcaatgttctgaaagtgtgggcttctctcccacttgaatgctggctataaattgtggcttggcactcttgggctgcccaccacagctctggggcactctcagggcttatgttcctcccctggcttggaggcagcagagga

SEQ ID NO: 181475 - DNA, 264 bp, Homo sapiens
caaccgagctcgtaccctttgccagctagacgggaggtcaatacgatggggaaaagcctgtgaagagattgggcagcagccacacctgctgtcacctccactcccctctgatcttggaaacatatttgccctttacaactcaactcagctcacccaccttcagagacttcttggcccatcttagctggaagggatctgttccagcgctgagcttttattttgcttagcatctactcagatgccttgactgtgtgtgtctcacag

SEQ ID NO: 181476 - DNA, 401 bp, Homo sapiens
tcaaggaggctttggaatttcatagtgaccacacacagtctgatgatgaagagctttggatgggcccctggaacaacctccatataccaatgacaaaactgtgaccaattttttaaaagatattttaattaatttttacttacatttttaataaactgtgctttttattgtcactgagaaaacaatgtatggaatttatatcatgcacacaagctaaaactttgaacaatatgctttaaaattttaagagacagatttgcactcacattgttatcaattaatcgtttttcccagaaaatccttttggacatactttcactaaataacctatcgtttaaacatttagctgttttgttgggtcttgaatttttgttcattttaataaacaagaaataattact

SEQ ID NO: 181477 - DNA, 331 bp, Homo sapiens
aggccatttcaggctaatgcgtctttcccaaatagcattctattggtcaaaatgaagtaattgggaatgtgtcccatgatatagcatactctctaagcggtcaaatctaaggaataatttttggggaaaagccctgctttatattctggctaggcctaacaacgataacaataacagcagtagaaataaccaccatatgttgggtatcactctagcctggcgctgagctcagtgcttcacacatactctcacactgaatccacaaaacagcctgatcggaagattctcattgatatggtttggctgtctgtcccctcccaaatctcatctc

SEQ ID NO: 181478 - DNA, 258 bp, Homo sapiens
ccatgcttcagctcaccccacaatgcaggtgttagtcacgtccccacgtctggctgctcgccaccctcctggccatatctcactgtgctgtgacttttcactatctgaccacactgagctccttaggagaagcaagtgcatttcttcaacccttgttctcatgtgtctattcacagcgcatgccacacaggggcagcaacccactcgatgatgggtgaattactaaaaacaaggccggctcagccaccattgtgttac

SEQ ID NO: 181479 - DNA, 618 bp, Homo sapiens
aggtggctgagactctttcaacaccaactccgctttcattgccttctctccctcaacccatacctatggtatcctgggggttgttctcacaaccaattgaccaagaaagaaaaaaaatcaagtctggtttacacattggtctgcatatgttggtttcatgcaaaagtggatagctaaaacactatagccccacccaagggccaccctgaaggacagtggtcaaaaagaaaaaaaaaatcctcccagggaacagaacttcaaggagtacctttggccacttgtctgaactgagacatggccagaagtacagacttacactaattaatgggtagctgctaatggcttggctagatagggacttagaagaaacaggtctggaaggctggtgacaaggaagtctgggaattatctgtggatggacctctgggaatgggcgcagactgaagatatctgtgccctaggttaatgcccactgatatggtttggctctgtgtccccacccaaatatcatcttgtagctcccataattctcacatgttgtagaaggcacccagtgggagatgactgaatcatgggggagggtctttcccatgctgttcttgtgatagtaagtctcat

SEQ ID NO: 181480 - DNA, 364 bp, Homo sapiens
tcatggtgcccattatttcacagaccaggaaactttaacacagaaaggataacttacctaagatcatataattagatagacccaaatttctaaccgaagggctggagaatgcaggggtataatccacagagcatcattaggtagactgtggcagaattaggtactttcacttctctttgccaatcaaggacagcaataacgtcagtcctctcctcttcatgctgttacaagcaggctgcagtcaccagaacagaccagggtttttcaccttaggaatgtccttccctttccgtataaagacgctctttactgacagtattaagatagacttgggttattcttttttctagtaatggtgagggac

SEQ ID NO: 181481 - DNA, 911 bp, Homo sapiens
tggctttcttctgtgaatcgagctattagatccctaccactcccaccactcctaccatcattactagaacgcatgttagtcaaaatactctacatcccactgtggcaaaccaagctgagtctatcagaatccttgtcaggcaatgttctatctgcagttggacaaagagttaaacctattttttatttctgactgccaagctgttgactttaaggatgtccttagtcaataatatcctatacctcatgtggaagatggttttgaggtaataatgctgacaagcagcggcaaaagagaagtgggaagtcaagatgacatcaatctctgattctaggcatccctaagatcagtttcacctgtgcaccagacgtttggttttgtaaggcaacatatctccctctttagcctgaagttatgatgaagtgggtttatatcacttgcagactactacaatagtcaagttaagatgtccaatagacagtttgatatataaatctgaagccaaggagaagttttgcaatcatcagattatgactaaagcaatgaatgatctctaggcaaaacggtatcatgacaagcaaagtgtgctcaacagagtcctctgagtaagaacagcatttaaatcataggtagaaaaagagaagtctactaaggaggtttgggtgttaccagaattagaagaggaaaatccgttaaatgtggtgtcactggagcctgtttcaaggagaaagtgggtggcagtattaactgccactgagataggaaagactgaggactattccttagactgtgcagcaaacacagtgtggcgctggcaacagcagtttcagtaaagtagtgtgggtagacatcagattacaggaggttaagtgagtgaaaggaaagcagcagagtcaacaagtgtagacaat

SEQ ID NO: 181482 - DNA, 323 bp, Homo sapiens
atgaaacacgtagaaccgagagtagagcactagtggaaatgggaatgcagcaggagagacatctcacagacacttgagagaatttggatttagagacatcttaaaagcacttaggggatagtagagaatgaatcaaagacaaaatgagggtttgagcgccagcaagtggaagaatgatgctgactttaataaaaacagaaaagttagaagaggatgcagtttgacgagtgagatgaactgggttttagtcataaaattatagaattttagaaaattacattaggaaggacctggactcagatttttttttttttttttttttt

SEQ ID NO: 181483 - DNA, 264 bp, Homo sapiens
aacaggaagtttacttaaactaatgaccacagatgcctaaaaatggttaaatgtaagaggtaggcattatagaggatacctgtggaaaatgtttgctcatatgtcaaagtttacccaggaagcttcctttatttatttccaagcatctatataaagaaaggctgcacttgattgcgtaagcatgagccttttgttaggcagcgtggatgttgcaagtttaaaccccaactaggaaatgaaaagtgagtttcctcctaaatagtt

SEQ ID NO: 181484 - DNA, 281 bp, Homo sapiens
tcaaaggagagaaattcacttcggtgtgccaccaaaactgatagttcagtgaaaagccaattcaagctcttggctgaaataaagagctcttcatcctttttaaaggatataaacaaaccaaacaaaaacagtttgagtaaaatcactataatcagaaaactagtactaatactagcagcagtacatttaacttttaggacaatagaacaacctaaaaccttacatcttgtctagttataactctaaaccagtaccacccacccctgtccaatctggctaca

SEQ ID NO: 181485 - DNA, 613 bp, Homo sapiens
tgtgcccccacaggcccctgctctgcccggctcgtgtccttttcattgggaggtgccatctgattgagtgtttagtaccctccaggcactgtgctgcgggctttgtaggaatcacttcacttaatccccaaaaggtgagtattcatacaaacccagactacagatgagaaaaccagggcctcaagaggtatcgctctccacacatggccacgcagccagtgaaactcaaggatgcagagtccagggcccacactgggagccattgcctctcgctttgtctgcttcgggccacacgtctcccgttgaagcagaaatcaggtccctttcagttctggctcccacatgccaggcacagagctggccttgaaggggcctcagcaaacatttccttgattagtacatgaggcaggtgtcatcccctgcaacttctgtaactatctgcttctatgttgcagcttaactatatgctcttcaagggcacagatctacattctgaggcctaacaggctgtgcgttcagcaactatttgcaactaagtaaatactggctacaatgagagctctttcaagtagttcctatttcccaggtactgtgctcagttcttcatgtgtat

SEQ ID NO: 181486 - DNA, 263 bp, Homo sapiens
ctgtgggaggataaggcagaattattttagaaggtcaaggaaaaccttagtaagtcctcaagtagagcagctgtgcagggcaggacggcttctgaacagccacaccaagcacagtgtaatgacacccttgcattcactggtccaaaaattatattatacctcgaggtagtggtgcccctcctgcaggccccaagtcatgcctaatggcttggctagtaaccttttatgtaatctatttctctgagttcttgacctactccctt

SEQ ID NO: 181487 - DNA, 432 bp, Homo sapiens
acgaagggcgactccagtatctcccagcctctcattcctttccagacctaagtcattagcggacccagagctccttgattgaaggagataaccagtaccctggaggaaggtccttgcagcataaatcttccttcaagcctttccgaagtgacctatggccactcaccagggtgtctgtgccttggggagagggaatatccaggctccttagggattactagacatgggctctaagtttatgcttattcctagggacccaaaacgccagtgtgctccaccagtcaaaataagggcttaagggggtcaggggacagatggaatcttaattccaggcctcctcagtgggccccagtggttcacagacccatcctgtggttacttcctcaatgccaggaaaaacctagaatagacatatttggtagttggcacagt

SEQ ID NO: 181488 - DNA, 350 bp, Homo sapiens
tcccctatcaattctcaggagtgcaaagagagacaaaaaataaacatggttggccaatgtttgtttttagggtgagttctatactatttttctattattattttgctttatttactgtggttggtaactgaatctctaacatcaaaacatgagatgttctgccagaaagagattacagaagaaaagcctatgaaaagaaactgggtttgtcagtgaagattttatttacaggagttttgcaatcggtatctttaatctccataacaattgggctattctactgctttgaaggcaattgttcaataatgagaaggtccctgtgaggctaagcttggaaggaagaatgtaac

SEQ ID NO: 181489 - DNA, 160 bp, Homo sapiens
atgcctttaagttactgtccaggttcctctcatttcagcctgaagatctcccattagggcatttcttataggcaggtttactagcaacaaattccctatctaaaatatgctcaaagagcaaaaggaaacccatagacaaaagaatgaaaggaaaccagga

SEQ ID NO: 181490 - DNA, 676 bp, Homo sapiens
catttcagcctcacaatgttatgaggaagggattattattatgcacattttaccaatgaggaaactaaggcccagaaagaaatgttaagcaacttgcccaaggtcacacagctaggaattggcaaaactgggattagaacccagggagcctaaccaaggagtccagaatcaggcattctcgctccccctgccacccacttggacctgtgtagcggatggaggcttcacactgcacagagcagtcccacagcctccatccagagagcagggcagaagctaagggcctgggtccctgggcctttgagccaggcacagggcctgaactcctcagctgactttcttaagtccagcagaggcctcagcacaggaatcgtcagtcacattcacaccgttaatctcggcccatccttctgcccagttaccttcaattagaatcttgattttatactgtgcacttgtcattcctcacagctctggatgactacacggagtcagctgacttcctttttaagtctccatccaagtcactgatcttaaatgttcacttggagtagatctaggagcaagccttgtagccccaccactagggccccaagccaggccgacgacagcccccaaatccatcagcacccagtgggcataactgttgtgaacctaccaacctctgcccagcctg

SEQ ID NO: 181491 - DNA, 701 bp, Homo sapiens
aacaaactgcaaaatcagacccagcaaagactacagatcccagaattaccagatacaaaaaagaattatattcaaagatgagacaaagtacagcaaaggaatcagactatcaaagtggaccatgtagatgtgggttgatttcttgtcctggactgagagctgctctgggaccccagctctatgcagggcttctaactgacagacactgcatgtgccttctgtcccctgcaccttcgatggccaaagtggaagctgcaagaatccagaacagaaatctctgaagctaaagccagctttgtgcttgatttcttcccagggctctagtttccattttggtctctgcagattcatttttttttctggttcagcaatactgtgttttaaatgatgtcttatatttcatgcagtgtcttatttttatcggtcagaagggttgaaggatccttagactgccacactcaatcagtggattctgtcgttcagtttttttttttgagacggagtctcgctctgtcgcccaggctggagtacagtggtgtgatcttggctcactgcaagctctgccccccgggttcatgccattctcctgcctcagccttctgagtagctgggaccacaggcgcccgccactatgcctggctaattttttttgtatttttagtagagatggggtttcaccgtgttagccaggatggtctcca

SEQ ID NO: 181492 - DNA, 339 bp, Homo sapiens
gaggataagaagtggacagattctgaatatatttcaaagatgcagaggatgatatctgctaatgggttggctgtgactataaaagaaggggaaactaagggcttcaaggttttgggcttgacaaccacctaaaggatgaagctgccgttaactgagatgggaaagaccatgggtggagctagttgatagcaaaattttaaaactcaggatttcagttttggatgtacaggtctaagatgctatgcatctaagtggaaatgctgagtaggaagttattgaggctggagttcggaaagaggtctgcactggaaatagaaatgtggagatcatcaatatggc

SEQ ID NO: 181493 - DNA, 833 bp, Homo sapiens
tcataaatatgcaacatgtggccaaggggatttctaggtaggatgctgaagggccaatgaacttattttaactgggtatgattgatcaggtataggaagagaaaaatgagctaaggagagaactgtttagtttgcaggtagaatttagagaaaatatagaagaaccaggacttgctaaggtagaaaataaaattacttcatgtctccagtttcttgtggtggcacaagattctcagatggtggcaggttagggaacaattcaaaggtgtggctgtaacaccttttgtaaacatctcacaaagatttaaggtcatacctagcagaccttctctcccaggtagcgaagtgggcttctaagacacttcaaggctctgttccatagcagcctacacacctagtgggaaggggtctgtcctgaaaagaattatggatgcagctgttgagacatgtgggaaagcccaacaagatttagagaaaaccctccaagtttttaggggagttgtgctgactgttgctagtttggattaaagggacagatatagtccaaaatgaaaaaagccctctatgccccaaatgtctcagggcagaacacaggctgagaaagttaatcagctgcaaacacaggctatttctttccttttttttttattttttactttaggttaaaaacaaacatgggatacatgtgcagaatgtgcaggtttgttacataggtatacacgtcccatggtggtttgctggacctatcaacctgtcatctaggttttaagccctgtatgcattaggtattggtcctaatgctctcccttcccttgccttccactccccgacag

SEQ ID NO: 181494 - DNA, 333 bp, Homo sapiens
gtttggctccagaacctgtgctcactttaactttcatgtcactgtatcgcttcttatgaatgtattcatgttgtgaatttattcatgtgatagatggcaagcacagagaccgtatttgtaggcattttagtgaacagttaaaaatgagctcgtgaagagagacagacaagtcagtaggagtaataaacatttactaagcccctactatatactaatgtagctaagcttgggagacattttctttctgtcttctcggatatgttcctattttctttctagatgaaaagtatcaggaaaattgatgatcgaataactctggattgggagccattt

SEQ ID NO: 181495 - DNA, 161 bp, Homo sapiens
acctaagtgtatgagttgtcctctcttctttattcctagagaatcctcagcatgtcattaccaaagcactataatctatgacattgatttctaattattgctttatttctctgtctctcccactaaagttccttgaggttatggaacatgtctattccaaa

SEQ ID NO: 181496 - DNA, 137 bp, Homo sapiens
cagcaacagcaggtgcttggagaatgtttgttgaatgactaagtgaaggctgattgctcagccatgtctttcctgcaggaagaggagacctggcctcccttgggaagcgtcaggttgcagagggcctcagggcccca

SEQ ID NO: 181497 - DNA, 434 bp, Homo sapiens
aaggaaggcagagtcaaaatgtgcctgtttgatctgtttcttagtcattgttcggagttccactcttcttgagtaggatttctcaacagtggcactattgacattttggacctgataattctttgttgggcaggggtggggggagctgtctgcattgtaggatgtttggcagcatccctggctctacccagtagatgccagtagcaccccaagcccagttgtgactaccaaaaatatctccagacattgccaagtgtctccctgggagcaaaatcattcccagttgagaaccactagtctagggggaaatgagcctactctggctttacttatatagaaccaggactttatgcttaatctaaaacccatattttcccctttatgctacctcttccctaagagcattctatagagtaatagtcctgtaagattct

SEQ ID NO: 181498 - DNA, 776 bp, Homo sapiens
cggatccatctggaattgatttggtataaggtacaaagttagttttatattttccagatgacagcccatttgtcccagtgccatctgttaaatagcctctgctctccctcccagatctgagctgtctctcgtttactcccacatctatttgggttcacttctggaccctgcgttctgcttcatggatgtctccatccagatgacctcatgttggccagcatttttgaaacattggggttgttggagtggttggattttccctggaattgagtgagaaattcagaagactgaagcccaggcttactgtctacctttcacggaggcctagccgtgagaggacagaagaaggcatgtggcgaatcatgacagcagacaaagacaaagagaaggaccgggactgagactgggactgagagagagagaaaagagacaaagcaagagagagtgagaattcaaggccacgccggagctgtaccttggaaggaggagccaaaaattatgctgagagtgatcacagtgaagacgaggacaatgacaacaatagtgcacacgcacagaggagtccacgaagaagaacaagaagaaaccaccgaagaaaacgtctcgttatgaaaggacagataccggcgagataacatcctacatcactgaagatgatgttgtctacagaccaggagactgtgtgtatatcgagagttggaggccaaacacactgtatttcatctgtagcattcaagacttcaaactgccatctcagcctcagtccagttctgagc

SEQ ID NO: 181499 - DNA, 789 bp, Homo sapiens
  misc_feature (760)..(760): n is a, c, g, or t
cggatccatctggaattgatttggtataaggtacaaagttagttttatattttccagatgacagcccatttgtcccagtgccatctgttaaatagcctctgctctccctcccagatctgagctgtctctcgtttactcccacatctatttgggttcacttctggaccctgcgttctgcttcatggatgtctccatccagatgacctcatgttggccagcatttttgaaacattggggttgttggagtggttggattttccctggaattgagtgagaaattcagaagactgaagcccaggcttactgtctacctttcacggaggcctagccgtgagaggacagaagaaggcatgtggcgaatcatgacagcagacaaagacaaagagaaggaccgggactgagactgggactgagagagagagaaaagagacaaagcaagagagagtgagaattcaaggccacgccggagctgtaccttggaaggaggagccaaaaattatgctgagagtgatcacagtgaagacgaggacaatgacaacaatagtgcacacgcacagaggagtccacgaagaagaacaagaagaaaccaccgaagaaaacgtctcgttatgaaaggacagataccggcgagataacatcctacatcactgaagatgatgttgtctacagaccaggagactgtgtgtatatcgagagttggaggccaaacacactgtatttcatctgtagcattcaagacttcaaactgccctttagatanttctccaagtcctctctgcgtttggagga

SEQ ID NO: 181500 - DNA, 1056 bp, Homo sapiens
cggatccatctggaattgatttggtataaggtacaaagttagttttatattttccagatgacagcccatttgtcccagtgccatctgttaaatagcctctgctctccctcccagatctgagctgtctctcgtttactcccacatctatttgggttcacttctggaccctgcgttctgcttcatggatgtctccatccagatgacctcatgttggccagcatttttgaaacattggggttgttggagtggttggattttccctggaattgagtgagaaattcagaagactgaagcccaggcttactgtctacctttcacggaggcctagccgtgagaggacagaagaaggcatgtggcgaatcatgacagcagacaaagacaaagagaaggaccgggactgagactgggactgagagagagagaaaagagacaaagcaagagagagtgagaattcaaggccacgccggagctgtaccttggaaggaggagccaaaaattatgctgagagtgatcacagtgaagacgaggacaatgacaacaatagtgcacacgcacagaggagtccacgaagaagaacaagaagaaaccaccgaagaaaacgtctcgttatgaaaggacagataccggcgagataacatcctacatcactgaagatgatgttgtctacagaccaggagactgtgtgtatatcgagagttggaggccaaacacactgtatttcatctgtagcattcaagacttcaaactggtaagcatttttaatgtgctgttcgctctgctctgtattctctctttttccagttccattggctatctcttattgttactccatcgctgttgacgtggttaccagttcaccttttgagtgctaactgcctcgtggcagtagcactgaaatgagggttactagttccatcttttcagctttgtaacacttactctcataatgcttatattgtaaacaatatttctgaagtttttatccctttagtaactgttttgacaatttcgggtagtcccttgaatttctgaagtaggttgtttcttctcagccat

SEQ ID NO: 181501 - DNA, 967 bp, Homo sapiens
  misc_feature (2)..(3): n is a, c, g, or t
  misc_feature (308)..(308): n is a, c, g, or t
  misc_feature (413)..(414): n is a, c, g, or t
  misc_feature (416)..(416): n is a, c, g, or t
  misc_feature (418)..(418): n is a, c, g, or t
  misc_feature (421)..(421): n is a, c, g, or t
  misc_feature (425)..(425): n is a, c, g, or t
  misc_feature (435)..(435): n is a, c, g, or t
  misc_feature (442)..(442): n is a, c, g, or t
  misc_feature (452)..(452): n is a, c, g, or t
  misc_feature (465)..(465): n is a, c, g, or t
  misc_feature (478)..(478): n is a, c, g, or t
gnnatgctcttaaccttgtaaatctgatcaagcttcagatgccttctaacttagtttatcagtaaaatgttagaacttaacaaacatttccgaagacagtgttaaatgaggtacagatataacaggaaagtttattatgtgaaaatttagtcctttagaaatacgttttagggctgggcccagtggatcatgcctgtaatcccagcacttggggatgctgaggtggacagatcaattgaggccaggagttcgagaccaagcctgggcaacatgccaaaaacccatctctaccaaaaatacaaaaattngccaggtgtagtggcatgcgcctataatcccagctactagggaggcagaggttacagtgaagattgcgccactgcacttcagcctgggcaataaagtgcgactcnnananggnttantccagatgcngtggctnacacctatantcccaacactttnggaggctgaggcnggaggatcttttgagcccaggagtttgagaccaccctggacaacatagcaggaccctgtctatgcaaaaaaattagctgggtatagtggcaggcatctgtagtcctagctactcagtaggctaaggtgggaggactgcttgagccagggagatcgagattgcagtgagtcatgatctcgccactgcactccagcctgggcaacagagcaagaccctgtctcaaaaaaaaaaaaaaaaaaaagtgaagtggcatgatctcgactcactgcaacctccacctcccaggttcaagtgattctcctgcctcggcctcccaagtagctgggactacgggtgcctgccaccatgcccggctaatttttgtatttttaatagaggtggggtttcaccatgttggccagactggtcttgaactcctgatctgaaatgatccacccactttggcctcccgaagtgctgggattacaggcatgagccactgcctggccg

SEQ ID NO: 181502 - DNA, 308 bp, Homo sapiens
gcaggagaatcacttgaacccgggaagtggaggtcgcagtgagctgaggtcatgccactgcactccagcctgggcgacagagagactctgtctcaaaaaaatataataaaaatttcccccttctacctccttgaccagagacctcactgcagggactctctgggattttcctcttgagcccaaatcagctgagctgtggtagtgagtcctgggcccattcctccctccctgcagagttgggagattttgaaattatcaggcatgggcaggggccagggcagggcggattaattcctctgcagcctgct

SEQ ID NO: 181503 - DNA, 998 bp, Homo sapiens
ggaagaacagaattgcagggcaagaaagaaacaggaattctgttttagatacataataccatatatacacaagtgaacatgtcaagtaaatagttaaatataagattctgaaactcagaaggtcttggttatgttcaaatcagtagattcttaacactccactttatctcatttccgtatcccatgattcatctggattaataatcaaatagtttcaacttcctacatataaatattcatagttacatatcacaaatgagttcctctgttcattgatggtttttattttacccctgacatctaaggtaagagagagagaaagatgggaatggaggggaatgagggagggagagaaaacaaacacacttgtgtgcacggacacacacacacgctactgtccatacctcggacaaattgcttaatctttctccagttcctactttcctcatctgtaagaggaaaagctgaggttttttctcaagctatactatttaatgattctaagctttatgtctgttctaaatttgaatgccacattttggaggttcttactgagacttttaaataagaatgattaccagagactaaactagaactgacctgctcaaattctctgctatatatttaagtataatcagagacagctcagactattttaggaaacaaacttcttgcttaatttctaaacttaagtggcaataatttatactcacatggcaataacttatattcaagcttaatggtttggtttggtatagattgcatacttgcactcttaaaaggtttggttccattctcaggattctgaaaaaaacaaacaaacaaacaaaaaaaaaaacaaagctggacacctggcatatttagtagtagctctaggatgttctgctgttctaaaagttcagatacaaaggtcacctgtccttccttgttatctatgagttcaagaagctaatgcaaaaataaaaaaaaataaaaattcaagagcatttctctaggtt

SEQ ID NO: 181504 - DNA, 451 bp, Homo sapiens
gcgtgagccactgcacctggccaaaagtcactttctgtagtgtgggacatctttatgctgcgtcctcagctgtgcctgtggcctctcctcccacagctgcggccccagagcagcacgtgatggggactgtctgcaggtctggcaacagtcccacccacaccatccagcatgagagccgcccagccacccgcccgaaagtgcagtgatgaagcaggaggatgattttatatatcatcttaacacatttaaatgtaaaaggccccacaaggctactgccctcatactggacagggcagctcccaccagacagagcctgtcacctcctctggggacatcacagtggctacacagtcctacttggccgcactgtaggccgccttctctcctagcatcattctgatgtaaataaggaagtaacactatgtgtattggaatcaatgagaaaattgag

SEQ ID NO: 181505 - DNA, 623 bp, Homo sapiens
tcagaaggtcacctatgcccaaacacaaagccaaatctcagctagaagggtccctggagatcatctaggcacttaatgagcatttatcaagcactcctgtaggcccaccactggagacacagacgtgaaactgaaaaggtccccacccttattttataagggaaacaagatttaaaggagtaaacaactctttttgaaatctcatttgctcaggaaggaaagtccatattctgccccactttccacagagagcagcttagctgggggcagcagtcacatcaaggtaaggctggctggtgcatcactggcacacctgcttccctccatcttcctaactgtaacttgggcagcatggtttagtgcttaagagtgtgggctttggagttagacactgagaatcaaatcctggtgtccctactcactactgtgtgaccctaagttacttgacctctggactcagtttctccaactgtaaagtggcatcaggtacagcattaaatgctggctcatggtagaggcttactcccctcctggtccccttaacagtgaaacttccccagaggaccccgcactgccagtccaactccttcaccccctgctctcacttcagcccatctccactg

SEQ ID NO: 181506 - DNA, 464 bp, Homo sapiens
gggcttcagaggcccaaattgaggcgcaatgatgagaggatgtggtggtctactctgatgtcaatcttgagggctaggtatgtcccaagatctcttattactgctgttaatgatgattctaatagctaccatttgtcgagtacttattgcatgccagacattgcacaaagcaggttacacatacggtctcatttaaaacttgtgaggtaggcacctgttgttatccctattttccaggtgaagaaatctaggcactgacataaataacttgggatcacactgctaggaagtactggggaagggaattcaaaccatggtttatctgaactatataactgttacatctatttagaagtctgcctttgataaatttgcccaacctttttttagaattcacttacagtttatacctgtgtgaaccctttcattcttttttggtatatgcataatacaagttcattcca

SEQ ID NO: 181507 - DNA, 610 bp, Homo sapiens
aaggctagaggagaaccaggcacccagataaacagcataaagggactggcagtgttccagttctgaagttggccagagagtttcttgggtatacattttattattttaaattcatgtgaactgggccacgatcttacagtctatgttattctcatgtgcagaggttcaactgatgtaccaagttctttattagtgacacactaaaaatttattgcttatgcattttataatctaatgtgctttgtccagagcatagaaagtgttctattccatttagtcattcggagactgaggatccctctgttttgtgccaccatcacagtcagcctgtaacctctaagtcagcgtggatatggaaaaaagaggaagattatgcatgagagattttcgagccagtcctggaagtagcataagtgacttcaaattccagtggccagggctcattcaggtggttccaatatagttgaactgtatgcccaagaagaagaagtggttcttataattctttcccctaaataattgtgttagacaaaaaccttgataacaaaaccagataagggttatataagaaaggaaagtgacaggccaaccacattcacatagaggaaaa

SEQ ID NO: 181508 - DNA, 300 bp, Homo sapiens
ctattctacacaataaggtattaaattaggaaaatcccaagttgagagactggagttaggacaaggaacaggacaaggaggaacagtcagtgggtttcaaacacaggtaccactggtaaaactgcatatctgcaggtgaaagaacatggccttttacttataaatacagccaaccaaagtccaaattgagggcagatgtggataggaagagaatgagctaagtctgaggtggctatcaactcagtcttcaaacaagtcagggagataaacagccctgttttggtgtacagttgggtttca

SEQ ID NO: 181509 - DNA, 269 bp, Homo sapiens
tctgtatggccgagccccaagctggataaatatagatcttcaaaaataaaaggatatacagggggtgacctgcccacttgggctgaattaactgtgaggtcatggccccatgctccaggccacatgccagcaggcccatcctcacgcagctctccttgagcccagccaggctgggcaggaatgacagctccctggcttccaggcctggtgattcatgaatgcgagtttgggaggaattttcatttccacacagctctacctctcgtctc

SEQ ID NO: 181510 - DNA, 505 bp, Homo sapiens
atccttgcaaggtttgaaattgcctcaaagagtagtctgttttggtctggctgctctcccagattgaagggatgtgagattaggagctattggccaaggcctttttggtcacacagtctgggactcagagagagcccctcagaagctagagagaagtagaagtaggaactcagcagagaagaggcttcagggtcatgcctggccatctttgactattggaaggttagtgtgtttacctgggtatggtgttttggggggcataactgtgttgggagcagttcctaagggcagagttgttcacagttcacatagcaggtgtcacactggggagcaggtggcatattagatgattgttcaggcacttccaatcctgagatcccatggttctctaaaggcatgtcaatgaaaagagtcaaactctgtgaagtatttgaagagacttattctgagccaaatatgagtgaccaatggctcatgacacagccccaggagatcctgagaacat

SEQ ID NO: 181511 - DNA, 500 bp, Homo sapiens
cctcacgatacctcaatgaaaaggttaacaaacaaattagatataattgaagaagaaattaataaactagaagaactaccaaaattattcagaatataacacagagaaacaaagagatatcaggaaacatgcataatagagtgagaagatctaacatttggctaactggggttctagaagaaaataatagagaaaatggacaggtaacactcaaagggaaaatgcctgagaaattttccagaattgctgaaaaatatatatcctgtttcttttttttctttttctttttccagtaagccttttgcactcctaaaatcctgtttcagaaatcacaatgaatctcaagaatgataaaaataacccacacttagactcctcacagagaaactgcagatcaaagacaggaagattacattaaaagcatccagaaagcaatcaagatgtatttcaagcctggcacggcagctcacgcctgtaatctgctgaggcgggcagatcac

SEQ ID NO: 181512 - DNA, 610 bp, Homo sapiens
gctaatgtataagggcacggggtgggggagtctgaagcaggtagccaccccaggagcttcctaagccctttccaaatgaacaaaatggacggatgaacacacgctgctccctgggttggctctccacaagcctcagcatgtaacccagctctggggaacaggcaacttcagatgccacttttaaaaagggctgagagcagaaccttggaaagtatacatctggagcagaaagaaagcaacacaggagaaccaagatgaagagatgtcactaaggtccagggagagtttcaagaaggaaggaatggcagaagtaccaaagcggcagtggttagagaggaaaagcagaggaaagaccacccaacttggcaatgaggaagccacttgtcaggctgaggatcggaaacaaagtcacatttacaagggattatggatgaagcacaactgacaatctactcactttacaaaaattacctaactcctttacatgacaggcccggagcaaataacggaatggaatagttaatacaacccacgcagtgcatgacctcaggatgcctcagctgggtggggatacagacattaaatacataactacataatgatttaatga

SEQ ID NO: 181513 - DNA, 703 bp, Homo sapiens
aaatgttataactcctttccttcttagaagagatctgaaaggaataaaaaggttaggattacattctgctattatgttcataatacaaagatgatctcctctatattctgtttttgtgcaaacgactctaacaaatttccagtatcttacatgtgcaaattacaactgtcttcaaggtaaaagttaattgagagaaaaaattaataggttagaatcttattttttcttttcttgcttcctgactgttatacctactaaagggatgtggggtgggagggggagtcttttttctttctaaatcattctgctagtgttatgttgactttctctcaagtacaccctgtggtctcagatgatcacatattttcttacgttactcatattgatacagcaccttggcttatgggttgacatatattacctgagctttgatgacacctcccaccattgacatttcctggtggtggggtgtactgagcctcttatgcatgaaacataagggaacaggctgtttcacaacagcattttcattctttgaaaatcaattactgttcaccccaaatggtatctgaagcccccatcagtgttgcttcacattgtttcttacccctacagcaatgtcttgagtgcttttgtgtctttgctgagacggaaaaaaagttcctcacatgggcttcaaaatattccagttatactgtttgta

SEQ ID NO: 181514 - DNA, 404 bp, Homo sapiens
actcatatattaactcaacaccaacaaaattttatctgacctgactagattccctatgttctacattccactgaactattgttgttgtctctattttactacttacttaggtatatgactcatctgtagtagtaattcattattccaacaataactcagcagtaagtggtgagaagaacgtgattttatttttaaaatttatttttactgaggtaaaatatacacatgtaatgcaccctctttaccacttgtaagtgtgcagttcagtggtaatatttatattcttgtatttatattcttttatttccccttcatcccccgcttccccttctggcctctggtaaccatcactatagtcaccatcttcatgagaaccacttttttagctcccatatatgagtgaa

SEQ ID NO: 181515 - DNA, 722 bp, Homo sapiens
caaaaacaatattgttaatgttgtttcctttctgaatttttatctttgttgtccaattcactcttctaattatcagtttttataaaatttcatgtgggcttatcactgggagacaagcaaggaacataaactacacactttgctctctgtgagcatactggatgacagatgtgcaactaataatcattgacagactttgaaataagtgaaatgactggtcactgatcatgatgtatatctgttacatacataatgatttgtagactgaagagctagcagtatagtttgtactccatgccattattcacagatactatattgaagtttgaactgtgttgctggcagactggcattatttagctaacctgtggtaattgaaattcctgcatgtcagaattctgcaaagtaaggactacctgtatctatatatttttttctctaagcactgctttagttttatctcacaaattttgacattttgtgttctcatattaattaaattcaagttactttctaattcctcttttgactttctcattgacacataggttattttataagtgtgtttaattttctaatatttggggggacttctgagatgtctttttattatttatttctaattaattccattatggttggttaatatactctgaatgatttccattcttataaaatcattgcaatgtgttttcaggtcaagaatacagtctattctgatg

SEQ ID NO: 181516 - DNA, 543 bp, Homo sapiens
aaagattatgtatccaaaaaaaaaaaaaaaaaaaaaaagaaaaggagcagggaaggacagttctagttaaagccaaatggatgtgagtctgacaagggtgtctttgatttatatttcctaactgcaaattacacagaaagtgagaatggggaataacttttattaagtatttatgtgccaggcggttagtgtggccttcatgttattacatttaatcctcaaatttctacaaaggaataattttgcatgattttatgattgacggagcattttcaaatctcctctaattctcataacatctctgtgaggaaggaatttttatccttattttacagatgaggaagctgtttggagataatttaagtgacttgcctggggaatctagccagtagtagagtactgattaatcaggtgctgacatctgctctgctttgtgtatgtaattcagcagtgcttcaaagatccaagaagctgtagcagatctcaatacactctcctataaaattagtgaataatcaccatgacaaaattggtatggcggaa

SEQ ID NO: 181517 - DNA, 868 bp, Homo sapiens
ccttgatgtcctgcttgttcatatctgtggcctttactctgtttggaatgactttttctctcctctctgtcgcagactcctattagtccctcaaacttctgttcagatgtcacctcctccaggcagccagtctagacctccagtgctgggctgtgttccctcttcctctattagagtgctcatcagagtgcacatggtttttacgatcctctccatcacagtcagcaagggctgactacagaaccccctcgtaattgagtatctcaaatactcctcctggcacgccagaaagctcttgagaccctttgctgaatgaaagctgaatggtggctactagaagaagaaacagtgggcgtgtttctccaattgaacaagaggcttagaatctaacaatggatgactgaggtgactctcagagaatggtccctggtgcagcaccccgaacctaccaggtcagaaatttggggctcaggcccaataatctgtattttaacaagtcctcctctgggtgattccaatgcctgctaaagattgagaaccactggtttggtggcctgatccctggtcttaaggcaggtggtttcattttaacaaacccactcactccatcctttcatccaatatataccaaagatcagccatgtgtcggactgtgtactatgtgatgggaggtcttgaagagcacgcttaccctctctgtctctctctcgctctcttacaggtgcacatacatgcacgtgcgcaagcacacacactcttagctggctaataaggatgaagagtgctcaaggccacagtcaggaaatacacaggaattggggggcagtgccttgcctcaagagggagctccagagaagggttctggaga

SEQ ID NO: 181518 - DNA, 445 bp, Homo sapiens
tgctgggattacgggtgtgagccaccacacctggacgtgttttgtttttaaattctcttttttcatctttcctgcctttttctattattctgtgacctaatgagtaatggagggagccccatgaagagtggagtctgccttcaggagcagactctgcctggcatcccagaggagtctgtgtcttgaagcagtcagtgctcccagggctgagccgctggccctgaacaaccattccttgaataaagaaataaagagtgaggctaactcaagacccatcctggctccataactctatttccaaagtcttttttttttttttttttttttttgcttaacattgcagggcacctgctctatgctcactgctgggatcacacaggggaatgagtagagctctccctggcctcagacacccccacttagtgagaaggttacctgtggggac

SEQ ID NO: 181519 - DNA, 671 bp, Homo sapiens
  misc_feature (11)..(11): n is a, c, g, or t
  misc_feature (18)..(18): n is a, c, g, or t
gggggggggantgtttgnagaactacctctggggatataaaaggaatgacagccgaatcttcctctacctagctggcctggattcaacaaagcagcaacaaaaactattccataaaggtgtttcctcccttgggggattaaaatccaagggaaactccaaggtggtaaggtggcaacagcaaaggagcaaagcagcaaaggagaaacctacctgagagccacgctcttgaaacccacagggagcccaggcctgcgtatccaccgggacaggcagcccaggactcggttgttatgaaaaccatcttagtgttgatgtggcactgcgaatttggaaagtgctttaaaatcattcatattcctagacctgtaattaatcaaaagattgcaccaatctatagccacagccattatggtcactgcagtcattttccagtgctcttgaccaaagagtgctgtcaccatggtgatggtggcaggggttgggtgggaagtgaacacagcagttagggggattggccaagctttctggagtttggaggcagggctaactcataacatgtagaacaccagatctctgctaggagagactccaataggggactcagcctcttaaaaattgctaccattagccgggcgtggtggctcacacctgtaatctcagcactttggga

SEQ ID NO: 181520 - DNA, 400 bp, Homo sapiens
agaaacacatagacctaaatgaaatcctaattttagtgaaacatttttgtacacaaatgtgacacaatttctatttgtccaataaaacctgttaaatgtttcaaaatcttttaccacatcttttaacttaaaatatgattaaaaggtctaccttgccagaccagtgcaagaaacacaatgaccataggagaagtagcaaagaaagagaaaaaaacacctccaaatattttatgcctggaaaacttggatcatgaagaagatgagaaaaaaaaagtaggtcattgtaacttgacattcagaaataagcagcaacattttattctcactgacctgtaagtcaccctccagctccgaatttcatcactaccttacaaacggttcctgaactacctcagcatgg

SEQ ID NO: 181521 - DNA, 734 bp, Homo sapiens
ttgttcttaagacttttctcttcccttggggacttcatgtccttaagacctttcccctcccctgcactgcacttccccctgtagggtagaggttaattggtcacctgactgaagtcaatattcaacagcagaaatgttaaacgataacccatcccacattcttgccttggacccagaggcagccaggccccaatctctgcacctctacttgcgcccccatacagcctgtttgctgtgggaggatgagaagccaggtggttttgcaggcagacagactctgagagtccgtttatcttatacaggatctcttgactttttcttcttgtaaccttattaaccttcattccagagatgaaaaagacagacccagtaggggaataatcagggtgaacacgtatatgaaattctttcaaaaacctaaaaagcatttaagaaaagaaaaatagtttgtgggttgccacctctatttttttgtttataaaatgggaagggtctggattgccctgtgacttagggtgtgaggaggctttctcagttcagaacttgttgagagataggaagagtagtcagacaggtggagattactaataaaagctaggttggggctgcgtgtgggggctcacacctgtaatcccagcactttggaaggccaaggtgggaggatcacttgggcccaggagtttgagaccagcctgggcaacaaagtgagaccccatctctacaaaaaaaaaaaa

SEQ ID NO: 181522 - DNA, 828 bp, Homo sapiens
cagaatatcggtgaaagtattctttacctgtgggtggacgaaaataagagatgttcttatacaaaaatctcagatgacagaaccaggcccagaagtaaagaagaaaactgaagaggaagatgttgaatgtgaagatgatctcattttagcatgtcagccggaaagttcggttaaagcattggattttgatatcagtgaaactcggacagaagtagaagtagaagaattacctccgattgatcatggcattcctattacagaccgaagaagtacttttcaggcacacttggctccagtggtttgtcccaaacaggtgaaaatggttctttccaaattgtatgagaataagaaaatagctagtgccacccacaacatctatgcctacagaatatattgtgaggataaacagaccttcttacaggattgtgaggatgatggggaaacagcagctggtgggcgtcttcttcatctcatggagattttgaatgtgaagaatgtcatggtggtagtatcacgctggtatggagggattctgctaggaccagatcgctttaaacatatcaacaactgtgccagaaacatactagtggaaaagaactacacaaattcacctgaggagtcatctaaggctttgggaaagaacaaaaaagtaagaaaagacaagaagaggaatgaacattaatacctgaaactataggaaaggttaatttgcctataattatatatacattccatagtcatcaaggaatatattgtgcagagagagtatccttgactgcttaagtcagccagttcagcatggataccaacattagcttttcttcttgg

SEQ ID NO: 181523 - DNA, 212 bp, Homo sapiens
tataatgttctctctccccacaactcctttatctctttgctgaaatcctaccatactgccctttcaaagtttctctcaaatatctcctctcctacatctcttctccctttcttttctgagacacagtctcgctctgtcgccccgactggagtgcagcagcacgatctcggctcactgcagcctccgcctgccaggttccagtgattctcctg

SEQ ID NO: 181524 - DNA, 257 bp, Homo sapiens
atgaagtctttgggcctgagcttttctgctgatacatcaacaaaacatcactgctttttgcataaaacttcctgggcttttgagtcctttccaccacccttgttattcctcagagcatactgctttcagggagatggtatcaatccccctatgttcagaatgagaatccagcagggaatgggtcagggaacttctgggtgatcactcactcccatatcccattagagtttgggagtgggggtctggcttagcctgca

SEQ ID NO: 181525 - DNA, 456 bp, Homo sapiens
atcaaaaacgtagtgtagcttatatagcttagagaaattgtggatctatgaggacatgtgaaggtactgggctataatgtggtcaatgtgtctgaaaaaataacagttctgggccaaccaagtgtggctcaagggatcactactaagaatggttcctctttgggtagagcagagggaagagacactaaagggaactgtaatcaccagcaaaggaacacagtgaccatcaatgtctgaggactggcacaatgaaggataagaaagaacctctctgtacgaggcctactccctttcagttccctttcttccccattgtgtcccagtggaggacctgataatacacctgacccatatctaagacatgcagttggcagggctgatagtaggtaaggttcacagtatgttaaaaagtcacacgaggccgggtgcagtggctcaatgcctgtaatctcagca

SEQ ID NO: 181526 - DNA, 582 bp, Homo sapiens
ttgattagccctactatacaaggttcacatttctacctatttccaactttcaagtactactctgagggggactactgcaagcaaacaataagggaggaatgtgaggtaacatacttattgctttcagcaggcagaaaactgaataaggaaataaggaataccaatttcttctcttttcaactatattcagtactcgttcccaaatcaagcatatctaccacggagaagagcgactaccaacttgtttctttttctccccagcaaccaacacagagaacactcagataacaacaacaaatactataattgttcccagaattatgtaagtatagatcagctacgaccttctcattaaacaacttttttttttgaaatggggtctcaaaacaaacacacaaaaagagttaagattaggatcatggtatgtaacaaacatagcagtttaaaaaatgtctaggcctgggcgtggtggctcacgcctgtaatcccagcactttgagaagccgaggtgggcagatcgtgaggtcaggagatcgagaccattctggctaacacggtgaaaccccgtctctactaaaaata

SEQ ID NO: 181527 - DNA, 1874 bp, Homo sapiens
  misc_feature (852)..(852): n is a, c, g, or t
  misc_feature (1533)..(1533): n is a, c, g, or t
  misc_feature (1723)..(1723): n is a, c, g, or t
gtccctctgagtcttgctccctcatctgtcaagtgtagaaatagttgtatgataaaatcattactacttataaggttgctgggtgaatgacaaatttgaaagtatttgaatgtaataggcaatgcttagtatgatatttttattttatattccctaacactcagtataaaagcaaatctgaatgcaattaagctcttcaaatcaaatgcctggatttatttctttgattgttgtttttgccctgaaagttctatgtcctagataaatgtgtgccttagataactgaatgactttctcatatgcaaagaaggcaccagctttctctctctcagatctttctacatctccaggatgactgtagccctgcagaaaataacacttgttctctagttgtgcctaagtaccatttggaaagaggtggcctagatgagtgcaatgaccacccataaagccatacagaccagcaagaagaataagcaaaactataccaaacccacaacctcggtctagctagaagatagagaatcctacaatcttcagatcacgtgtagataaaaaacgttgacaccaaatcccagcagagctgaatgtcacactgtggccacaagctctgggaaaacagtatggaagagagaagagggaagtgtcagtggagtcaaagattgattggaggctgttggtggaaagaacgtcaatcttttgcataaaatactgtaaagattcctggtgagccacagcactgacaatgaggatgggacccctaagtcccagccttgtgcctgtgcacgattgaaggcagcagtctgggaggcattgcttagggcagaaaaggacacaaaggaagagagaagngagaaacagccattggaaactgggtggtaaaacaaagaggaagcaaaagatgggaaatttcagatcctgcaagaaaaaagagatacgaaaagttggaagacacacaacctctctcactttcactcccaaataataataaaataaaaaggtaaagaggaagtatacttagttacactcacagaaaagaattctcttaaaccaggagggttgtaaatagtataaatccatgaaataaaagaacctaaatctatatcaaattaccataaaagaaagtagaacaatgagataccatctcatgccagtcagaatggtgattattaaaatgtcaagaaacaacagatgctggcaaggttgcagagaagtaggaacgctttcacactgctggtgggagtataaattagttcaaccattgtggaagacagtgtggtgattcctcaaagatttagaaccagaaataccatttgacccagcaatcccattactggatatgtactcaaaggaatataaatcattctattataaagacatatgcacgtgtatgttcactgcagcactattcacaatagcaaagacatggaatcaaaccaaatgcccatcaatgatagactggataaagaaaatgtggtacatatataccgtggaatactatgcagccataaaaaggaatgagatcatttcctnttcagggacatggatgaagctggaagccattatcttcagcaaactaacacaagaacagaaaaccaaacactgcatgttctcacttacaagtgggagccgaacattgagaacacatggacacaggaaggggaactatctaacactggggcttgttgtggggttgttgggagaaagagagcatcagggaaantagctaatgcatgctgggcttaatacctaggtgatgggttgataggtgcagcaaaccaccatagcacacatttacctatgtaacaaacctgcgcatcctgcacatgtatcccagaacttaaaaaaataaaataaacaacaacgacaacaac

SEQ ID NO: 181528 - DNA, 240 bp, Homo sapiens
ccaaaatcctacacagaatacaaaacacaactatctgaggtaaataatagaaggctgatggagggagaaatcaaaattcgaagaatgacaaagttatgagtttcatggggctttcctcccatgttcccagcttaagagtcaagagcagtcctaattctggaactgtgcagcagatgtgaacagaaaaaggtccaaaagaaaggctgactttctgaccaaagagctaggataggatggagg

SEQ ID NO: 181529 - DNA, 380 bp, Homo sapiens
acttgaagctaaaggctcatagcatactgaactacagtctttggtaaaaagtgaaatagtagaagagatcaatttatccaggtattgaatcactggacacatccaaacaatattaaaataatccttttttctatctacttcaaaaaataacactactgttttttgtttgtttgtttgttttgagacggagtcttgctctgtcgcccaggctggagtgcagtggcacaatttcggctcactgcaacctccgcctcccgggctcaagtgattcttctgcctcagcctcccgagtagctgggattacaggcacgcaccatcacgactagctaatttttgtatttttttagtagagatggagtttcaccatattggccaggctg

SEQ ID NO: 181530 - DNA, 307 bp, Homo sapiens
taatttttgtattttttgtagagacggggtttccccatgctgctcagactggtctcaagagatctgactgcctcagcctcccaaagtgctgggattacaggcatgagccaccgcacctggccagaatagttatttgagagtaattcatcagttcaacaaatacttatcaaggagatatagcagttaacgaaatagacacaaatattttcccttaaggagtttactttctagcggggagacactaacagtaaacaaaagaagttaaataccatatctactttgacagatggtggtaagtgccatggag

SEQ ID NO: 181531 - DNA, 578 bp, Homo sapiens
ggaaaaggaagaagacaaagcagcagcagcagcagccgccaccaccaccaccaccactgctgtcatcctctaattttacacaataataaatgaagactggcggggggaaaccctcagagttggtggcatttccttctcaggtaagccaagctagttacagggatcagtgttcctagctgtgagataatgatagttactctgtccttttcatattctaggcatttgagcaccttgtctcttgggccctccctgcccacttggcctacccaaccttattattcatcctttaaaagacttagctcaaatttctgttcataaccacaggaggaattactccctccctcctctgtggccttacagaacttctcattctgctagtgtagcacttctcaaactgccgtggctaactggagtgaaaaatcaatgcaggtaagcaaatagaagcatatgtggcatgcattaagaatttaataatggttagagttaatattacagaatcaccttcatatgtccttgtcttttaagttatttcattagtaggacattccagaagatgagaaaatacttctcctgagcca

SEQ ID NO: 181532 - DNA, 246 bp, Homo sapiens
tcagcaggcacctagcttctagaggaagagggaactacgagttctcttcaagataagctgtatcacatctacttcttaaaattttactttcaaatttattttacaacactgtcttgacaaatagtttcttatacaaattactccagtatacaaatatacacatttaagaatactactttgaggtgttaaattttcttttttttttccttttatttatttattattattatactttaagttttaggg

SEQ ID NO: 181533 - DNA, 323 bp, Homo sapiens
gggacgtgaagtggcctccctaggtaaggctgcttagctggctagacacaggctagggaatcaaagtcgatcctcctaacctcaagctcaatgtctctgggttagacaagaaggacctgacattttgcatatagagggaatccaacagaatatgacagatcatttcagcttggccttgcaggcaggggaaggagtgtaattaaagatcatcttcttggtaatcccagtagggagtcaacagctaattcaaagtggatcaatgccagcatccgaggagggaaaacagctctttcaaaccggaaaaaaaaccaggaacaaccaaa

SEQ ID NO: 181534 - DNA, 182 bp, Homo sapiens
tcaccactgtatctttagtgtcgggaagaagggggcagaaagaaccaggaactggagccaggaacctgggctcacagtgatattagctgtgtggtcttgggcaagtcacttcccctctctgcgccttggtttcaacatctctaaagtaaacggtttgcattagatgaccctcaatgaccctt

SEQ ID NO: 181535 - DNA, 404 bp, Homo sapiens
ggagcccccaggccttttcccctcaaatatgttactactgtgacatttagcccttagttttaaagttattattattattattactattattttagggaaaccagagaatagtcttaaactcacatcatagactgagaagaattaactgccaaataacactcacgcagggaatgaattgctggaggagaccaagacctgccctgcagctccccttatctccagcagagggcagacgcatcaagatagtgacagggccctcaaaaatggaaaggataagattggtgaatttgacttttactattttacgtactggcggcggaagagaaacaaaaaaacttgtgcctcatttggaagcggtataaaaattgggacagttgaaaacattttggggagaaaaaaccctg

SEQ ID NO: 181536 - DNA, 359 bp, Homo sapiens
ctgccttgaagaaaggagaactacctaactaaagctctgttctacaagctcctccctattttttaacttgcgggagctcaagaattccatcctggggaattctctcacttgtatactccacccactcccatgtccatgcggttcttctgtgggattttagatttctgaactgtagagtactcaggagcccatcgtctcggctgctctcctgctccaggaggcgcagggggtgtgtgtgagttcctcagggctatcattaacaaagtaccacaaactgggggttggggtggagggacgcggcagacaacagacatgcattctcagtccaggtgcaggggctgacacctgcaatcccagca

SEQ ID NO: 181537 - DNA, 455 bp, Homo sapiens
tggtccttcgaactgcctggggtctcctcactgcctctggaagaaggcatatttcacatggaaatcagcacttttaaggaggcaattactcctttaaaaaaggtttgttttccattagtttctgcaaacatcctgccttaagaaaattcacctcttgatagaaaaatctatttaataaaaaataagaggtaagacaatattctataagaaaaaatatatttatgtatatatgtgtatatatattcacatattctcataagaatacacaatacatattcttacatagaatacatattctctctctcattctctctctctctctctctctctctctctcggatctaagtttctacatgttttcctgcattcatcacaatttcaaccttgtaataaaggcacaaataatgctggctctttgtaatgcctgctgtttgtaagatccctaaataaagact

SEQ ID NO: 181538 - DNA, 257 bp, Homo sapiens
ttatacagagagacagtattgattagtgagagaaactgttttgccagaagtgcaaatatgaattagtattaaggatataagtcagtgtgaacctacaccagtctttcaaaatgtttgatatttaaaggagaactcataaacatctatttaattgagtgcctagctgtgcactcacattgttaattacctgagttatctaattttatcctaacagtaggttattttattctcatttgacagctgagaaaactgaggta

SEQ ID NO: 181539 - DNA, 438 bp, Homo sapiens
ttgtgagtttgagatgcggcaggcatattaagtagtagcatcaaggatgtaatttgaattctcaacctgtggtgcaaagaggccagagatagaaatttatggggtctttttctttgaagagatggttgctggaagtgattgagattgctgagtgaaagactgtagagatagaagaaagggcaaatgaggctagatctttggagaagatctgcatcaaggtgtgtggaatgaggaagcggagtcaggaaggaggctggagagggggaacctgagagcaggcgccgcagataggagagcgcatgcacaccggagtggaggggagcacagaggagggttgtagcattcatgttttgtaagtaactacttattacagtgaatttctttgtaaggttggagttttaaggagccttagaagcctgtaggttttcaggtccttag

SEQ ID NO: 181540 - DNA, 490 bp, Homo sapiens
ctcaaatacactgtttaaaaaatgtttcctattgataattatattacttttctttgaaaacctcccaacctagatcattcacttaattttaatttttctattcttgattatgtgtttcttcccctgttgtattctgctgagtaatggcatgattggaaagagtgcccacttaagttaaagcctggctacacaggtgtagccttgaagaagttgtgagccttatcgagcctcaagtttctaatgtctaaatggggccactgattcttcactctgggttgttttgaaataaaggagatgtttatgtatgtccacatacagaaacaaatggatatgaagtacctcagtggagagttagtgccttccccttacccaactccatgaactctgaataatcattttgtttgaactgggaggcaggacaggcctctgctctctggggaggacaggcactgacccctctgcagtctatccaggcaagtagctctgaaga

SEQ ID NO: 181541 - DNA, 457 bp, Homo sapiens
agtatcttggttttaccatggtgtgatcaagtcagatttctgtcttacagaactgtaacataataaatctgtattgtttaagctactaagtttgaagtaattttactaaaacttgaaaggaatttacattttgcttttaaagttcttatttttgaaactttagacagagatcaacaaatcctcaacaagagatagctcaatttttacctttgcaaaaggaattatgttacatatctatgagaatgaataactacagcacagaaaaatactcataagtaatatattatttgaaatcaggagtctaataagagaaaatgcaaatgtacccttttctataagatttagataaattacatgaaaaaatatgtgtgataagaggtatgtgttctgagttaatacatataaaatctgaaaaaattgcaacaggaacaataaatatggaaattgaaatcacaaa

SEQ ID NO: 181542 - DNA, 159 bp, Homo sapiens
ctgatgaaatttaagggtcgaaggtggatttagcagtaaactgagagtagagtgcttagttgaacagggccctgaagcgcgtacacaccgcccgtcaccctcctcaagtatacttcaaaggacacttaactaaaacccctacgcatttatatagaggag

SEQ ID NO: 181543 - DNA, 438 bp, Homo sapiens
tcagagaatgtgataggttagatgtgttgaggaacttcaggcattcaaggagcaacacagtatggagaaatacaataacatttagctaggccaatctcacaattgagcgggtgagagaaaacagtgggtgaaagtgtgtgtgtgtgtgtgtctactaaggagacagttgtgtgtgtgtatgtgtgtgtctctactgaggagggggttggcatgtaagccatgaattttatctgaaaaatcacagtgagaggtaataagaaataagcagagcaatgtaaatcaagtatggctagattatagatggatcgctaatgattgactgagaaccttagattcaatcttacaaattctatgaagaagagtgacaagataaaagtgatataagtgaatttttttaaaaaagatagatacgccagccaagtatggattgaattacaa

SEQ ID NO: 181544 - DNA, 799 bp, Homo sapiens
aaataatctttcagggaccttaacgttctctaaacatatatttaatctagttactcttttaaaaactttagtgcataaaacctgtttttttcacattgttttaattttcacttagaaaagtgtcttttatctcattaactttggcatccacatgaaggcatgcactatcagcagggctccttcagctagaaatgttgatgggataggctgagtgctgtgatcccagctgcccttctgcttatagttggaagctcgatgctaaaggtggtagtacagatagaaaatagaagtgcatctgagccttttccattttgtggagttgatatcggaacctggacagccaactttcatacctcttttatgtaagagaatgaatccttatgaaggataaacctctgaagtcaggtttttgttattgggagctgaaagtaagtgctcactgctagagaaaggtcagaccactatatacataaattcttataaaatgtgattatgactgagatagattaaagatattttttcaatttgaaaagaaaagggagagaaaaattggaagctaaccaaataggactttgtaaatcactggcataatgcggccataagtcactgaaatcatcaaactaaaatattgccttgctgaacaaagaacgtcatgacaagaaaaccttgaataagtattcctaaaaatcactgtcttctgaatttacagagtatagtgcatttggcagttagtttccctatattatattgggagactatatcttttcgaagaagtctaacacattattagtagtaagtc

SEQ ID NO: 181545 - DNA, 412 bp, Homo sapiens
tgttctgttcaataaccaattttagggtagagatagagatggtaacttatagttatgaaattctgataagctaacaaaataaaaatggatccaaccaatcagaatatattagtccttaagttgaaggcatactagtgggacatcataacagagtgaaaacttgggggtcatcctttttgtctcttcgcccccaggaaaagcagggcaggcagggaacagcagtgggtgaacctcttctctgctcagggatttcaggccttcacacttgctctttcctttgcctctaagatgctgccattggcctccaaatggctccttccttcatcttgagatttcagtgctaatattttctcctttgagggatttcttctctgacctagctaatccaaagcaacctctatgcctcacctgg

SEQ ID NO: 181546 - DNA, 210 bp, Homo sapiens
gcacccggtcaagatttttctcttgattattggttttaagcaatttgttcatgcactgtcttggagcaaaataatgtttcttgtatttgggatttgttgatatttttgaatctgtgggtttatagatttaatcaaatttggaaaatatgcattatttaaatagttttgtctttttcttcatttttctcctcttcttgatggaccccaatt

SEQ ID NO: 181547 - DNA, 796 bp, Homo sapiens
gattttggtttatattttgtctcttatttctttacacatgacacgttgtgttctggtctggaaatgacagcgtctgaggtgttgtgggtctgattctgaccttagccgtggtagttgtcttcttgtgtgtgtgtgtgtgtgtgtgtatatatatatatatagagagagagagaggagagagttttcattcaactttataatgttgtgaatggtgcctgttattaagattgcatcattcactgagtagagttttaatttttttcaatatgaaaaatggaccaggtcatacatagatccagccctaacaagtgagaaaaaaaaatgaaaaaaagaaaattggaaattatgttacagcctgaatatttgctttgaaatctagaggctaattagaatatatatgtaacatctactaaagcgatgaataaacttagataattaaatgttaccatttaaaatacatatctctacttactggactctattctttctcatttctctgcctgttactttttatatatcaggcttatcaaaagtagctgtgctcaaacatcctgaagatgtttcaaaagtcacatgctcaaatcaatgctaataacctcttgggaactaaggggtagtagaatactgtccaatatggttatttcattagcaaggtcttcctatacaatgagtcagaagagaaaagctgtaaacttcccagctcaacctctaaagctcatgttttttctttctctctgtaagcactgttgctgtggcctgtgtatgaactggatgtgccaatgctgttattaagatt

SEQ ID NO: 181548 - DNA, 232 bp, Homo sapiens
tagaagttgctagtatccatttgatcagcagggaaaagagaagcaggactttgaagaaagagaaggcaaacataatgaaaacttgttatactgttcataatttacattaaattacattaacgtgggtatatgatatgtatgtacatgttaattagttcttacctaagccccaatgtgatcaattattatgattagatagagccctctaaaggtgtttagatagtagttaatc

SEQ ID NO: 181549 - DNA, 362 bp, Homo sapiens
tcaggaagccaccctgaacaaacctttaccctacaatttttctttcaaaaaaaacaacatcttctgtgccaaccttccaaaaaaatcattgtagcgccatattttttggtggggagttggggagaacctaagtgcaaattagcaaatacagtgcactaggattcttatcactgaaatgcttactgtcagcaaatcacttaaactctgcatgagataagggactgaaataagtgaggtttttaagctaaattatcactgagggttctaggttcctgttttggcattctaaataaatgttccacacagctaagaggaggatctcagccctctctaacagttttctagaaaacaaatctgagcca

SEQ ID NO: 181550 - DNA, 483 bp, Homo sapiens
tcctcagcctcctgagtagctgggactacaggtgcatgccaccatactattttttatttttttgagacggagtcttgctctgtcacccaggctagagtgcagtggcgcaatctcggcttactgcaacctctgcctcccaggttcaagcgattctcctgcctcagcctcctgagtagttggagactacaggcgcgtgcaactatgcctaatttttgtatttttagtaaagatggggttttgccatattggccaggctggtcttgaactctgaactcctgacctcaggtgaaccacccacctcggcctcccaaagtgctgggatgaggcatgcgccactgcacccggccaatttttgtactttttttttatttttttagggatggggtctcactatgttgtccaggatggtctttaacttgaactggcctcaagctattcccctgcctctgcctctcaaggcactgggattataggcataagcca

SEQ ID NO: 181551 - DNA, 469 bp, Homo sapiens
acccagtcttcagggacaaaattctgagagtcatctctgactccatctcacaccctctcggcactcagctcctcattaagccctacgattacgtccgtctttcccgcgacagtccctcctctgcccgatttccacggctcccatttcttgattgaatcatggtggccgcctccccactcagcacccaggtctttcttcttgcctgcaaatcagacccgcagctttgaatcctgcaagtgctcccactggcctggcacggtgctccccagcaaatggaccttggcacatgccattccctaccagtaatgccctcccttcagcctgccaaattcctcccagctcttcacgactctgttcaacagacacttcctctaggagggccgaccaatcgccgctgggctgggttaggggacactcccctcctgggttctcctacctcatctttctcagaacttttggggcaacaatt

SEQ ID NO: 181552 - DNA, 127 bp, Homo sapiens
ttaacaatttccaaacacaaaacaaaactacatcaatcaaagcactttggtactggtataaatgtagaacaccaaagtaatgaaacacaatgcagcacagatataaactcttgaatatatggtcaag

SEQ ID NO: 181553 - DNA, 287 bp, Homo sapiens
ttttagttttcatagagatggggtctcactatgttgctcaggctggtctcaaactactgggttcaagtgatcctccctccttacctcccaaagtgctgagattatgggcatgagccactgtgatcagctgaaagatttttaattattaatttagtttatttaaatagaaattacatagatagaaataacccaattagattggtatggagctgtttaaatttttaatttttctttaagtcaatttgttaatttatgtctttctagggatttgtccattacatctaagt

SEQ ID NO: 181554 - DNA, 284 bp, Homo sapiens
gtttgtgctgccaggttcaaatacccatctcacggataaggctctcattggctctgcttgggtcatgtgcttgcctcacggaccaatcactgtcatcagaggtattggatgctgtgattggtcagccctggaccacgtaactaaccactttctgcagccaaggtgagcccggtctatttctaggagaatggcaatgggaatgctctctaggcagatgaaagccaacagtccacgtcaggaggtgaatgtgtgttggaaagattaaagtgacaagcaggaaggat

SEQ ID NO: 181555 - DNA, 184 bp, Homo sapiens
caaggtgcctgcttgtacagagcaagtataaacaagtgtgctgtgagagggacacctggtcatgggtataacatctaggcatcaggccctccaacagaatgaagaaatatcccttgaaaggcacattttaaatatcctccaagaaatcccccagagccacaccaggacagggataaagttttag

SEQ ID NO: 181556 - DNA, 837 bp, Homo sapiens
ttgtagaggtagttgctattaatataaattatggaaaaatatagcttgagaaagtcagtagtgtgtattcagtcattaatttcttgggttttaataaaacgttttaacaaatgttaacagaaaatgtagcaatgcatggtagtaggaatattcacttttattctgaagcagaggaaggaaatctgtattttggtaaatatagttactattctagtgagcatatatttatggtgtaagtagactatcacaacttagtatctgcttcccattgttaattcacccttagtagtaaagtcctcaggcactacccttgatcttagccagaaggcagagaacaattcctcgggtaaagtttgattaaaaacaacaaaaattcatagaagacaaggatataataatagaatttgggctcactggagaccaaggaattttatcttctacgctttacccaacttcccactccaaaaaccagaacaaaaacccatctaaatgtatctttggccataaaaaagcctccccatttctgagcatctaagaaacgtacatatgggctgggtgcagtggctcacacctgtaatcccagcactttgggaggccgaagcaggtggatcacctaaggtcaggagttcaagaccagcctggccaacatggtgaaacctcatctgtactaaaacacataaattagccgggtgtggtggcgggtgcctgtaattccagctactcaggaggctgagacagggagaattgcttgaaccagggaggcagaagttgcagtgagccatgatcgcgccacagcactccagcctgggcgacagagtgagactccatctcaagtgt

SEQ ID NO: 181557 - DNA, 757 bp, Homo sapiens
agttactaacaatggttccatcactgtgccaacatattttcttttttcaatatattgggaaataattctcccagtctgaaaatctgaacacatttcatgtgacttggtatcctcatatgtcttgggcttccaattctccattcctagtttcaagttcatgaactgtaaaacaaaggattagactaaatctctaaagttctatccagatgccaaattcttttctctttccatgatacctaagatagatgccaaatattgtcttttacctggtgtttgtgaacatgacatcacattacaggagtagcagatactaaactctcactctgtaaaacactgactgagttccatgagccagatactgaagtgagcttgttcacatatgttctcatttaatgctcataaccctgtgaagctgggaattgctgggacattttatttatttatttattgagacggagtctggctctgtcacctaggctggtgtgcaatggcatgatcttggctcaccgcaacctccgcctcccgggttcaagcgattctcttgcctcagcctccgcagtagctgggattacgggcacacaccaccacatccagctaattttgtatttttagcagagatggagtttctccatgttggccaggttggtcacgaacacttgacctcaagtgatctgcctgcctcagcctcccaaagtgctgggattacaggcatgagccaccatgcctgcccgggacccttgttttagaaggatgactg

SEQ ID NO: 181558 - DNA, 176 bp, Homo sapiens
cccttctggctaagcacacacctctttttcctttcactgataaactctgcaagtagctgattcccactcaccaccccaaatccctcctctgaacacctcttctaatcctgtgctcctggagtgcacagggtctttctttcatcatgccccagcactcctcctgctcaacctgtctg

SEQ ID NO: 181559 - DNA, 338 bp, Homo sapiens
actggtaaaatctactagtgagttctctactgaaatactgggtacatttttcaactaaagtcatggaaacatttagtttcccatgcataaattcagcaagcagaatattctagtgttccccctagggtagatagacattgtggtttattttgccattaatatttgtcagaggattagaaactccttattcaaaatatttatcttaattctatcacatgtaaaatgtttaaaatttatgttcaaattgtctcataagaatgttaaaaaataagacaaagaacagtcaagggttttggacttactgaaaggtagataacgattcaaatttaattaattag

SEQ ID NO: 181560 - DNA, 435 bp, Homo sapiens
ggattcccaaagtagtgccgagcgaaatgggaagagcctgcatgatttagcatctttgataatagaacggaatggaaagtccggccatagagggtgatagccccgtatataaaatcatcggtgtggaactaagtatgcgacaagtagggcgggacacgaatgttctgaacattcgtgtccatttcttcccaccttctactcccaggttcacattggatggaaaacatattaatcagaaatgatttggaaaatcattaatcatataatgagaaaaatgaaaagaatgaagtgtgtttctgataagaaaataagaattggaaaatggaaccaagatatcttaaataagaaaagtgacccagacacctccattcagcacaaagcacatcagagacgaagaccccagccatgttccccgacagcctcggaccaaggtgg

SEQ ID NO: 181561 - DNA, 416 bp, Homo sapiens
aagacaaaaaccaagggctactgccatgaccagtgctctgatcctaaagcaaggtgtcactccaagagaaggggctgctgtccttgccaaggacccagagcagtggtgcagagattgtgcccaatggagaggcaggccagaagaacagagagctctgtagttctccctaaagaggagatgacttacttgaaccagaatgtggggaagttcagcctaagggtgctgtggaatacaatggaaattttagtgttaagcaattagagatgttagctacagacaagcaaatttggatcccagtggaaagtttaacagggagaactagggaaagagatgctagtaagagccctcttggcgtgcaaacaagctgctgttgagacgggaaaagttcccttacccacctttcagggcgtgtgatg

SEQ ID NO: 181562 - DNA, 270 bp, Homo sapiens
ggttcagccaaatcccacatgtcctgatttccatctgtatggtggttcccaagtgtgtttgtccacatgaaccaaatctgaagcagccaaaagaaaggtgggggatagagcagggatatcagatgtcagctcctcttggtcccatccagtgctatctgtgccctcaaacaagtgcccatcctacttcttgtaagaagaaagaaaactttttctaattgcccctttgaacgtcattgctactactgaagatgccagtaaaatatatatcca

SEQ ID NO: 181563 - DNA, 348 bp, Homo sapiens
acaagaccttttgaatgcttatacaacagcatcttttatctgaaccctgagtttttcaattcttttcatttattcagtgtcttctgtggtgtcttcccttttccagagcacttatccttctctgtcaagcttctttcaagtatctttattccttttgactgtaacaggttctctgaactcttcaggtctatgccatttgcccagtactaccagcatctcagtctggattattcatcatcttagatggtcatattttctattattcacctttttgtccttctatttcttctctgattggcattagcatattcattcactttttcagttattcatcagatatttactgag

SEQ ID NO: 181564 - DNA, 388 bp, Homo sapiens
ctcgggcattcatcgtttatatgccaggaattgctaacctaagctctgctatttgaaggcttaaagactgcagatcaaaagtagacacagagggcctttacaatgagatgataggccagtagctgtcattctttattcttagtgctcatctaagccatgaccatgtccttcagatgtagcttttagatacttttcatgtgaaagactggatacctctagtcgacatgtcagggccccaaaggaatcaagtccctttggcataccttcatgtcctcttttttttgtttttctgtacttcaatagatgcaaattcatttactctttggtctgcctgtgttgggtattctcagcttggggaaactcaatgagccagcacaccatcctatga

SEQ ID NO: 181565 - DNA, 177 bp, Homo sapiens
ccactcgcgaaaagacaaatactgtgtgatcctacacagatgatccatggaaaattgtcaaattcataaaatcagaaagtgaatgttagctgctagcaggtaaggaggagagggggaagtgaggagctgttattcagtgggtacagagtttcagttttgcaagatgaaaactttctg

SEQ ID NO: 181566 - DNA, 302 bp, Homo sapiens
gagaaacctgctgcctgcctttagatttagagatattaacaattcagaggaggaaagaatggagtttgtatctctttgccacttgtgagatatagatttgtacagatgtgtccctgaagccacatatccagatctgttttaaacttgccatcctgtttccatattccagagcaaacatttgagagagatgggagaaaacagtcaagaatttatttttgaatttaattattcattcatatgtttaacaaaagtttattaaatgcttactgagggcaagaaaccgtgtaggcaaaatagataag

SEQ ID NO: 181567 - DNA, 334 bp, Homo sapiens
tccccccagcagccaaccccagctccttctctcccaggaatacaccttgcacctcttacctgagcaggtaagaggcctgcgtgctttccagaaggcactggtgcatgtgacccatggaaaacatgccccactgtgccatcatccagggcggctccagctagcatcttgcttcctcatgcccacaggttaggtcttccagtggcagaaaggttgggcctgtgagtacccacagtccacaagaatccagctggggagtgagaggctggtccccgcccctgctgataagcaccccctagtggtgatcttgacgccctcatcacttggcttggatggg

SEQ ID NO: 181568 - DNA, 500 bp, Homo sapiens
gggctggtggatgcttactatagcacatgacgagacttccctggtgaggtcgtagacgagtgcactagttgactgactatcacagtggtctgaggttcacgatctcggaatacaggcatcatggtcttcgctgggtccatcgcagccctaggtacacagcttagagcctagagaaacttgtgcatgcgctgaatgagttgttctagagaaagttcaccaaggcattgtttgtcacttgaaacattagaaacacaaatgcctatcaaaagcagaatagatgaattaactagggagcttttatactctgtaagaaaccagagcagtttaatgaaacagttacgtagatcaacatttttaaaatctcaaaaatacaatgttgagctaaaagaaagtaaatggcggaaggatacatacagtatagcaccatttataagagtttaaaactggctgagtgtgggggctcaggcctataatcccagaactttggaaagaggcctagg

SEQ ID NO: 181569 - DNA, 596 bp, Homo sapiens
gggctaattttaaacacagctcgaatactgtgatgtgaatggaaacaactgaggaaggaaacagactaaaactcatctattacaaatttgcaaaggtttgaccataacaagggttggtgtggaacaaaggcaacctgcacatacttccgatgggagtgtgaactggcatgaccacggatggcaacttggcagaatctcgtatatgggaaaacgcacacatctctccgcctggtgatctcagccctaggtacacagcttagagcctagagaaacttgtgcatgcgctgaatgagttgttctagagaaagttcaccaaggcattgtttgtcacttgaaacattagaaacacaaatgcctatcaaaagcagaatagatgaattaactagggagcttttatactctgtaagaaaccagagcagtttaatgaaacagttacgtagatcaacatttttaaaatctcaaaaatacaatgttgagctaaaagaaagtaaatggcggaaggatacatacagtatagcaccatttataagagtttaaaactggctgagtgtgggggctcaggcctataatcccagaactttggaaagaggcctagg

SEQ ID NO: 181570 - DNA, 179 bp, Homo sapiens
gggctaattttaaacacagctcgaatactgtgatgtgaatggaaacaactgaggaaggaaacagactaaaactcatctattacaaatttgcaaaggtttgaccataacaagggttggtgtattatgggaagactcagttcaacctttggctgccatgcttcactcgggatactgcacat

SEQ ID NO: 181571 - DNA, 336 bp, Homo sapiens
acttagtgaaactgaagtttcctaaggaaatcatcaattatttttaatccaacaggtacccccatgtacacacacacagtatttgtaaaaacatcaattctgaaatacagctagctaccccctttaatatgcacataccacaaaattaaaatgcccaagcatttttttaagagatggggtctcagtatgttgccaaggctggttcaaacctccaggttcatgtgatcttcctgcctcagtctcccaaagtgctgggattacagatgtgagccgccatgccctgccccagtatccttgttttgctatacataaatttgagttattagataacagtca

SEQ ID NO: 181572 - DNA, 521 bp, Homo sapiens
taccctttggatgtgactttctctgatcgctcttcaccctatccccagctcacctctttttctgtcctcactctttcctcatcttatgagcacagattcctcagcagaaattagtgttgtgcatcagtaggttgctagtgtggtgaactggaacctgtgactctagctgtgaattctctgtcatgtgtgtgatcagtttctaattcttgggcactaaccaggaggcatgtgcctgcattactgtgaagcttgtaggaggcagaaaaatagttggaattaggaggaagatacatggtgggattgaatcattttgccacttatttttctctctttaaacagtcatctcactagacggttattttgatgacaaaagctgtatcatttgtcttgggagactggtgatttacctcttttacaaaagaatcgtgacagaggaggttaagacttcaggctagatagatggggccagaagattggactttaaccatcaagataatttactgagcgatcagagaaagcat

SEQ ID NO: 181573 - DNA, 412 bp, Homo sapiens
ggtgcgcgcctgtactcccagctactcgggaggctgaggcatgagaatcgcttgaacccaggagacagaggttgcagtgagccgagattgtgccactgcactccagcctggcaacagagcgagacttcatcaaaaaaaaaaaaaaaaaaggtgtcctttgcggccaaggggaagctgggctgggggtaaagctgcatggtgcagggtgacaaatagacaactgatgggctgcagtctggattgtgaggaactgaaaggtatacagttccagagctgaaactaaaaagcatgggatctcaattaacaaagaggaaagcaggaaatgaagaaaaacttaaaagactgcaaaagtaagaaaaaaggaaaatagtataaaatgtaataaatataatagaagtaatacaaaaagaat

SEQ ID NO: 181574 - DNA, 323 bp, Homo sapiens
ctggagaaaagatggaacgtagctacagagggcaagggaacgaagtcacagctgtgaccacagtaaatcttttctacctctctgggtggggcaactgaggtcagagaggttaagggactcacctggtgagtaagtggcagagcctgtatttgaactcaagttgggttggcttagcagcctctgctctttgcactatgctgctcttgttcaagggggactcagagaaaagtctggggagcagggaatgctgaaagctaactgcctgactttgcatggggccagggtgcagttctcgggatcacaaactcaccccacactatgaa

SEQ ID NO: 181575 - DNA, 523 bp, Homo sapiens
tcttattgggagaggaaaggaaacattccatcaactggacaagcccaggctttatccttgatcgaagaatttgctttaatgaagcacctgacatgtgagtgagaaaacactgaagaggactgttctcgtagcctcattcagaagaactgacgaatggataatgaatcgcacagtttaacccaagggtcatgtgtgcatttacaccttctccaattttggaaggaataacatatacagatccttgtctctcttcgttctaattttatctgtgctttagtcataaaacccttttctgaatacctctgtttcatgaatggaaaatggaggcatgagtctcatacacggagctcattttaaagtacaatactaggcagctctttccagttcatggttaatccttgtaattgccacataattaaattacccaacatgcatcatcagtttccaaaactatggatctagctcatttctgcctcttttgctctaacttgggaataattaggaggacaatgttctttcacta

SEQ ID NO: 181576 - DNA, 387 bp, Homo sapiens
gtcacagatcaactctctaataggtggttctaagtgtgcaggttagtaacaatatgcttgaggcaaaggctacctcctatccttccagaatggcccaggtcaagctagaattatcctgtgtcatgttgccagttacagcagtaatggtactgctcagaactggactaaatagaagacattttaaaaaggcaaatgcaaagatggaaatccccaaaacagccattgtccagttctggtgagtatatactccttgggatcttatgtaggccctagctacaaatgacctagtaaagtaaaaataaaattgggctcgtagaaagatgtgaccactctattttatgttggtagcacattgatatacacctattataacctattataacttat

SEQ ID NO: 181577 - DNA, 434 bp, Homo sapiens
ttgaatcttgtaatgaagttaataaaactatgttaatgtgtttggctgagagcttagaaataaaggctctggctggcgtggtggctcacgcctgttatccctgcactttgggaggccaaggcaggtggatcacttgaggttaggagttcgagaccagcctggccaacatggtgaaaccccgtctctagtaaaaatacaaaaattagccaggcgtggtagcaagcacctgtagtcccagctattcaggaggctgaggctggaggatccctggaacctaggaatcagaggttgcagtgagcccagatcgcgccactgcactccagcctgggcgacaaagcaagacttcatctcaaaaaataaaaattaagttaaaattaaaaaaataaaagttctgcttcccgtctcctgtgattgatgttgggtactgtttctca

SEQ ID NO: 181578 - DNA, 320 bp, Homo sapiens
ctgcacctcttgttccctggagtgtaggacactgtgtgtactagagtgctggggaattggccaccctgctggatccagctggcatcatgatgctacaggcccctgggtggatatgggggatgttaacagggctacagggatgtagagatgcaggggcactggactccggggaagattgtagttttgtgggggctgagctctcaaaatggagccttgctgcagctgcttgggtctcagggggatgggggggtggaacacagagaaaactccttctctggaacattgctgtcatgtgaactctaggcagctccctatacggg

SEQ ID NO: 181579 - DNA, 230 bp, Homo sapiens
accacttgcccacatatagattaataggctatttagaaatgacgatactttagggacaatgaaaggtacagatcctacaaagccttcccccaaaacaacatattatctggtctgtcatagaaactgaaatttgcatattattcttccagttggattagaagctatgcattaattaatatgcaaataatatttagaagactgtatcatcatctactaattatgaattagta

SEQ ID NO: 181580 - DNA, 478 bp, Homo sapiens
tctgtgtaagcttagatagcttaaagactgggtagggaaagaacctggcaagggagggcttccccgcatactgctctaaatcttccaggggaactttacagagaaaaccacagccagctagttgcaatgtcacacaaatgaaggattcaaagaaacaagaggtggaagtccaccttggtaaagtcatcctgtgctggacccctccagctgcagagcactcctaacaatgtgcaaactgcttgctctaagcctgggttctggcacagttgcctaatgactcaggcagcactgctaccaccacttccccttggaggctggctctacagtctagactgtgctggaggcgatcatttttgatactgggcccacattttccagcatgtattcacagaacctcattccaagtgctgatttcttgggccccaaacagctatcagcagggaatcttcattagaaaagagaaacacattttgcagga

SEQ ID NO: 181581 - DNA, 408 bp, Homo sapiens
agacagcaagacctacccccgttctcttccttctcctcctcagcctgcttagcttgaagatgacaaggatgaagacttgtatgatgatccactttcacttaatgaataataaatatattttctcaagtttttaaaaatgttttctctatgcttacgctattgtaagaatgtagtatataatacatgtaacgtacaaaatatgtgttaatacaggtgtccccaatttgaggaaccgggccacagaccaggaggtgagcagaggctgagctagcaaagctttatctgtatttccagccgctccttactgcttacgttaccacctgagctccacctcctgtcagatcagtggcggcattagattctcataggagtgcaaaccttattgttatgggatctttggggtgtcga

SEQ ID NO: 181582 - DNA, 383 bp, Homo sapiens
caggagttgtccatggtcacagagctcagtcaatgttgacatattaggcacctgcccaatcatcagaataaactgcttacaaagtacctgtgcacgtgtgcataatttgtttaatctggaagagggcactgtctccagtcctccctgttcctcttaaaccaggtcaaggtcagaatcaaaatgcctgagtcactagtgcaaaaggaaccatcagtaagaacaattacaaggttgaccccttgagttatgggcttcctcaggcacccatgtctgtcccaggtctttcctggatcccccagaggcagcacacacctctaagcagttttctaaccccctaacctaattcccatcttgttcctctgtcggtagaaatagattgatca

SEQ ID NO: 181583 - DNA, 628 bp, Homo sapiens
ttttgggagattaaattaaaaatggggataacaatacctattctgcaggatcattatgatgattgaatgtgtaaagatagaaaaggtgtttaagcaccacacttggcacataacaagcatccacaaaagttagtttttactccttgattctctccttcctcaagaggatcacttggatcacctctttccatatagtgtctagtctagtgtattacatgacattatctagtttagcctaaggttaggcttccttttcttatactacctgttccctaggagctttgagtctatatttatatacatttgaacatgtaatgtgtatgtgtttggaagtctatacaactgcctatagtgtacatctgtatacaagagccataggtttccagctattctcacatttagtttgagaaacttcagagggttacgttaaaattgctgaaaaggggccaggcgtggtggctcacacctgtgattccagcattttgggaggccgaggtgggaggatcgcttgaacccggtggtggaggttgcagtgagccgagatcgcaccactgcactccaacctgggcgactgagtgagactccgtctccagaaaaaaaaagaacaaaaaatttcgggagcacttaa

SEQ ID NO: 181584 - DNA, 471 bp, Homo sapiens
aagttgaatctttcctggattcacttccacacgaaacagacgaacgagaaagatatgagttcacttgcttttttgttttgtgttcactgcaggcttcttccaggagttatcccagggcagggctgagtgtaatgggaggatgaggcaggagagtaggtgagccccaaggtcctgagagaagcttcagagacttccaggctctcatctccaagtgggggattgggttgagtttataacctcctttccaatgcagtatcacagagtagttgagagtgctcacatactgaagccagtttggactcaaatcctgccctagccatgtgaccttgggcaaggtctctatgcctgtttcctttctatgcctcagttttctctccgtaaaatagacataactgtaatacccaccttacatcgcttgtagcattgtgagggataaatgagttatcacatgtgaggttctttaaacaatgc

SEQ ID NO: 181585 - DNA, 297 bp, Homo sapiens
ttttatctttctcatgaaatcctttttaagtaaatgtcttataaagtgatatgaacttagctttttaccagatgtctatctgtatggttgaaaatttcttttgagatctattcaggtggtttcctatctactgcctttgtctatttgtgtctgcttttcacttctctttcagataacatcagtactgaatgtatacttggtgtttaatatttattgtttaatatttgtatagttctccatataattgtataaagattaaaagtatacataaaacatgcatttgttttgaattgttta

SEQ ID NO: 181586 - DNA, 173 bp, Homo sapiens
acttttaggttctggtttgtacagtggagtggatagtataaattattgatttaaggaagaggtaagggaaagtgggagacactgtttcatttttgaactgttaggcttgggatgcctgtggttcatttttttgcatggagatattaaaaaagcagttggatacgtagctttga

SEQ ID NO: 181587 - DNA, 137 bp, Homo sapiens
tgtaaatgtccatagcagcactgctcataatagccataacgtgcagacaacctgccccacctgggttcctagccagccttctttctcaccactcttgagtgggtcttctcatacctgtcccactgggcacccaagca

SEQ ID NO: 181588 - DNA, 323 bp, Homo sapiens
acacacgaatccacagtgagatcttccatccaggagaggacccttgtaggtaagcgaacttaactgcaaaaaaatgcaagatagctacttatactaaccaatacaaaccaccattcaaatctctggacaaccaagggtcactgcgttatttgagaaaaagcaagtaccaggaaagagaaaaatacagattatatgactttagggaaaacaaacaggaacaacagatcaaaccagacatccacacaaacaccccaattactatgttaaaggttttaaggggtatattccttaaaaacaaaccaactacaaaacaggcttccttg

SEQ ID NO: 181589 - DNA, 658 bp, Homo sapiens
cctggcctgaaccatggaagtgaaacacgggctgtacacgggattgaggccctaagttttaggttaaatgaaggttgccaggtggaggtcattaggggaaggtgttaagtgaaaatgctatataaactgcatgctgtttgcaagtggttgcagtttcctgcttagcccaatgccactgggccatgtggttatgttgtccagcccaccaccactggactttctcttctgtgtgtaagcccttaataaaaccccttatcttctttgctgactcttggtctcttcttcagcctcttgaacctggtgctctccctattaaggttaatcagggttcagaacaacaaccagttagtaatttatagtttgccatcttcaaaatgccttttggttcggtgagataaagtggctaaccaggagtaagcaggtggtatgtgccagggcttggtctaaaacacctaattatttgagctcaactccttccactgttccacccccagctcctcaattgccaagcctgttttctgtaatcagactgagcctgtgagacatttacagccggctctccaccactggactgaagcagaacagcgaggtaattatctgaataattcaggtaatggcagtttattttccctaaattacctggataattacctcaagc

SEQ ID NO: 181590 - DNA, 248 bp, Homo sapiens
atactgtgccctggcactttttaggggtaggggcaggagagtaccagaaagagtgggcttttccctaaagtgtgatcctcgggattttaaaagctattacacagaagggttttttcattgattatatttgtgaaatgctgaattcaacacagttaaactagtgtctttacaacaaggcttccttcccaaactcttttgctgtgctcacgtgctccactgaggaaaatggtagcatatggtgttttttg

SEQ ID NO: 181591 - DNA, 237 bp, Homo sapiens
acgaaagagaaattctaatatagctcagatctgaactataatctgctgagtgagattagtctatctcagcaaaacccagaaggtggtggatagggtcagaagagagattagtgttccaaaggtttcatgtggagccaggggaaagaggagatattttgaattctaatccatctctgctagctttttctaagttgaaacagcccttctgtttaatagttctgctttctgtgctttgca

SEQ ID NO: 181592 - DNA, 195 bp, Homo sapiens
tttgccaaagcgtagtacccaacactatattcagtttgtaagaaattaccattatcacatttcctgtttgtcttggagaggttgtcctatctcgcaccacatagtagggaattgtgaacaacactggacagaaagttaaagccttggattctgtactcttcattcctgtaaaccttgggtactacgctttggaca

SEQ ID NO: 181593 - DNA, 169 bp, Homo sapiens
tgagagattgtaaacatgctaaatgtgagactcccagacctcctactcctctgttcccagaactttacgctccacacaagagtccagaagacttttctggggaatctggcccaaatgcaaacaacaaaagataccaatactgggaattcccaaacagcccacccagatc

SEQ ID NO: 181594 - DNA, 635 bp, Homo sapiens
actgcctgaatggaatgaagagaatcataccctgactcattagagtgatgaaaaatttctcaaacttaccaaaaatgcccctgacaagaagatacaagatcagccctgtcccttctctcacggagctacaatgaaaataacagcaatgactcgggggaatcaaccagtaatggtaaggaaaaggaagagagtgactctaggttatcattcattattcaccattccccttttgggctcatggaaatgtgatttgcacacaaatgtcctcaccagctcatggagactttattcttgctgatatcaattcattaatcaatacctgtaggatgtgggttgagcaacaggttttgaatcccaccaactgttcgggcatccacgccaaatccatctgggtcatgaggctttgtgagaaatctcagcaaattccctctactattcaaaaacacttgtgatatatctctaatatgtgggaattggactaaaaagtctagcccttccagctttaacaatttagaatcacatatgtatatctattctgcaatactgcggcacagatcttcatcgtgttccatgaattcattcattcatcatgttccatgaattcattcattcatcaaactagtatttagataccc

SEQ ID NO: 181595 - DNA, 688 bp, Homo sapiens
ctaccacggggagtggggagtgggaagtcacacagtcattttcacacatattgagaaaaggtcacgaaggtgaaaaaagccagttgcaaaacaatgcacgtagtatgatttcatgatgttcaaagaagaaacaattccgtatttctctgcgtacatataggtgtgcacatgggtaaaaatggatgggaagaatatatcccaaactgataattgtgggtttcctctggggcaaggggtaggggtgggaggtgatactaagggcacttatctccctctcttgttttattttgtaatgtgaatctcttctcttttttttggagaccgagtttcactcttctcacccaggctgaagtgaaattgcgtgatctcagctcactgcaaccttcacctcctgtgttcaagcgattctcctgcctcagctcatgagtagctgggattacaggcatgcaacaccacacccagctaattttttgtattttagtagagacagggttttgccatgttggcctggctggtctcgaactcctgacctcaggtgatcccccccacctcggcctcccaaagtgctgggattacaggcatgaactaccacgcccggccttcaaaacatttttgtaagtaaagaatcgaaaggaagaaagcactcagttcccagcagatgccaggtgctcagtaagctcagtaagca

SEQ ID NO: 181596 - DNA, 749 bp, Homo sapiens
tggggtggcttggcctcactttctctctgtgtagcctctctgtgatttttatttatgtggtccttccatatgatctctattatgatagccagacttcttacatggtagctaaggacttcaaatggtgcagaagtggaagccactaggcctcctgaaggttcaggcccagaactgtcacagcatcatctctgctaccttttattccttaaaacaagtcataggcttggtccagattcaagggcatgaataatgggaggctgggttcactggggggccacgctacacactcacctttcaagggcttttgtgtttttccatgccgcatgccatatgatcagatgactttcattatgagtcttgctagcattacatttaggcagtcctcaaacaatgaggaaaagtaaaacactgcctcagaattttcactccctgtgtcatgtcattttgatgatcaaagtagcttcactagtagaacacacttacggaaacaataatgtctgtaaagctttttacctctaatatttgagcatgaccagtcttggtcattttgttactaaaaagtgtggaaatatttatatttaacatactttttttgttcaattcagacatactgtcaaactagacaaggtaactagaggctgttaatgataagaaattttttttctgtactagcataaaagttaatttctgctggagaataaactttttattgttgacttttttccattttattattagatttctttacc

SEQ ID NO: 181597 - DNA, 576 bp, Homo sapiens
gtccccttccagttctaaaattccatgacatttgtgcaggacaaatactaaggagatcatagaatttatctgttttcactaattttttttagcattacagttggctttttcatttcagtgacattttaccatcaatttgcctttagattttcctcacagaatcattttcaacccccagaggttttcagcctccaaaaaaacagaacatctgtgtcactagcacgtactcttcatagctgcattaatggcaggtgccagaagaggtaacatgttaggtttgttggatgttaaaggaggcaaagagaaggaaattataaccctcttcttcctggctgaacccatggtggtggagagtcaagcgaaagcttcccctggccctctgaagattcactgaaaaatcaactcctaaaagtcagattaactggagaaaaggcacacaaatttatgtaatgtgtacactgggaaaaccacagagtgattacccactctacaacagggtgcagaagcttatacaccatcctagcaaaacaggttatagggttggggagaagaggaattctgttgagggaattacta

SEQ ID NO: 181598 - DNA, 127 bp, Homo sapiens
actgcagtggttcagagaagtcccctcttagagctttcatttcttttggagggatggtttgaacctagactggatctgccccatttttgccttagcaagtcttgatgagttcattggacagaggcaa

SEQ ID NO: 181599 - DNA, 536 bp, Homo sapiens
tttacgttgcatctttttcctttgtttagagttccagcccacaagcctcccctggtagacaacaatgttttcataactgcaagcaacaaggtagttcctagcccctctgctctctagttaaggcgttacgcactgcccagggagagggaaattctctctgtagctgtggcaacagctgtcaccaggaagctagggcatctctgcaacccctcctcagacggcactgaagaacatctgtaagtcaggcacttttaacttggggccttgtatttcaacattttttgtgggtacgtagtaggtatatacatttatggggcacatgagatgtgttgacacaggcatgcaatgtgaaataagcacaatatggagaatgcggaatctatccgctcaagcatttatccttagtgttaaaaacaatccaattacactctttaagttattttaaaatgtacaattaaattattgttgactacagtcatcctgttgtgctatcaaataggttttattcattcttgctattttttttttttgcaccc

SEQ ID NO: 181600 - DNA, 333 bp, Homo sapiens
catgagccactatgcccggcctaaagaatggtttttgaaatatggttcctcggaccagctcagcaggcagattctaagggttcacactacacttacaaaatcagaaactctggaggtaggggccaacaaactgggctttaacaggtcctctgggtaactctgatgcaatgctgaagtttaagagtcactggcataggacattagagatggaatcttcgtattttatagttgagcattccacagaggaagaacaaaaaccttgaaggagactggtatataaagcattgctactttaattaaatgaagttaaggaggtttgtttttgaagactga

SEQ ID NO: 181601 - DNA, 747 bp, Homo sapiens
atacacatgccttgtaacataggaaaacagatgggtttttaagacaggtatagaaagctctgtccaaaatggctaagtagtctttacattctgtattaagtataaaaagtgcatggcagagcaactcaaactttctgcacccctttctctcatttcttctttgaaaactgcataacaatgcataacaacaaaatttcaaagtcaaagcaatgcataacaacagaattgtgcattttaattttcaaattaaaatttaagaaacaattttgtaattacaaagaaaaaacacaaacaattgggcctaaacaaaatatatgttcagtaaactttatctctgagtgtatctgaaattttaactacacaagccaataaatttcaaagcagtaatattatcaaattgtgtaatgtcaaaaactccaaaaacaaagttacagatgttcatgacatcacattcactcaaaattatgctgctgttcagtctgaccatattaaaattaaagggatgcctatgtctgctaaagaataaaaatttattttggacctcaaacaatgaaaccgtcaccatttcttgtatggaacactcagctaatcaatttcctattaaaatagctttcaacaatacttggctttaaaattcatcagggccagtaaaaacgttttcccagtgcacaagaatgcagtcccaaccaccgatgataattactgttctaataattttattgccaaagtactttttcctgtgttcct

SEQ ID NO: 181602 - DNA, 555 bp, Homo sapiens
ggaagactgggtcctggcaaagatcagtacccagcatgaaatgcgcccacttacttgttaagtgcttaaaattttcacccctcctcctgccctgttctgccctgaagctgcagattcattagtatcaattggttttcagggtgtttctatctctgggccactggctcctggatatgattactgcctgatattttccatacagtgcttccattttcaatcatcttatccacagttggcctaatgtcactctttgaacattcacagaggaataatgtaaatgttagcttttgtcctgtgcataactggagaggaaaatgccttagactcatctgcactaaacatttctttgcagacacctcagagaggacagcctccatctctgcccacagcacacccattttctgaacaaaatcaaagagttgttcttggggatgtccttggggtgacgaaactttctgtaggcggtgcaacttgtgcctccaaggatttgaagagcatcctcgcctccccccactcacccatattttattgtcagttcttttgcaagggtgaagg

SEQ ID NO: 181603 - DNA, 507 bp, Homo sapiens
tggccaggctggtttcgaactcctggcctcaagtgatccgctggcctcagcctcctaaagtgctggattacaggcatgagccaccgtgccaggccttgttaatatttttaactctggcacttcaccctagaggctgctaggaatcaggtgtgccaagcaactggcaccactccatggaaagcgtctagggcagtgccttggttctgccaatcctgagaagccaggctgccccttgggctgggcagtggcctcagtaccgagccccaggccagcaagcccacaagcctcgagaaagactgcacttccggtggaggctgcagtttccttaaagggaaaatctgccccacccctgtcaagggcaggacacaagtcactggcattgaaggacccactccacacccagcagatcatcgacgcagactttttttttcccagatggagtctcactctgtcgtccaggctggactgcaatggtgtgatcttggctcactgtaacctccgcctccc

SEQ ID NO: 181604 - DNA, 1893 bp, Homo sapiens
gatcaagatgatggatatgccaattacccctatctgattactatacattatatgtattgaaacattattatgtaccccataaatatgtagagagcagtcaagggagctggcgagtacttttcccactggttattgtatatactgtgtctctaaaagctgactggtctctcccaccagctcactttctacttgagacataccatattgcagtgaggctagaatactgggaaggggaatgacagtcctttagaaaagagggtggaaccagtgtaaggaaatgtggaggaggcagaatttcactttggactcttcactcctccttttcttcattatttatcttcttccttagacaggtaattcttactcagctgtggtctaaggccctgtgtacactgagtttatagagcttctggactggtttgttattctccccatcccactccttgcttcaaatatcattccattaaaagcaggtcatctgattaaatcctgaattgtcttgttatttttttcttactcagtttagaaaagtagcaagcacaatctggtttgtcagaaaagagagggttgagagctaaagttaagtatcaggaaacgtgtgaaaaagtaagtttcatcctaggatttataaaggatgaagatcaagagctggttaggaagagttaacattgtaaacaatcatttgaagtcaattcaagcttctggtgcagaggagttattattaaatatagttgtgtaaaggaggcatggatattcacacctttagtgccatacggtataaatatacagtaggctttattaggggaaaatcctagctgagaaaaagctgatcctaactaactcttggaacttttattccacagagaggtatgcttaggtggggcatagctggattggatgcacgatggcctaccttccaatggacaggaatcctgctctgtaatagtctatatatagtatgggacaggagaacatctctaagactgtgtagtaatgggaggtctatgaatagggaataggccttgttagaaaaccgtgcctctagctcagtggctggtgtgtcagtctcttcttccattgagctaaatcacgtccatctgagctaccaaaaggagggaggaaaagaacctccagagtctgtgaatttgattctcatcaactattgagtgctaggagagcttggactaaaattaaagaacaactgtcaataatctttgaagaatcactgaagaaaaaggtcccagaaaaccaagaaaaggcagatattttttgagacataaaggtggaggaagcgtatatagtccataaatattagactggtaaacttgatgtaagtgttctgtcaatttctgcagtaggtgcttgaccacatggttgtgagcagttacaaagggaagggtaatgaccattggcaccatggatcacacagcacaagtcatacatggtcacctttagggaatgccagaagtccacgtctatcgtgatgtttgcaagagatttgatgaactgtatcataatgtctttcatagatagtaagacagggaagtgtttactgaaattgactatccaaaaaatgttgactaactggttttatttgactttgggggtaaattattcctagcaatctctgaattttgggttccaaagagccctggagacgagtggcagttgtgtgctcagtattataggttatttaaagtaaccgaaccaaaacttgcatatgcacagcacataacagtggttggcacgtagtgggttgtgtgtgcgtctgtagtcccagctacttgggaggctgaggcgggaggatcacttgagcctgggaggtggaggttgcaatgagccaggattgcaccactgcactctagcctgggcgacagattgacacccagtctc

SEQ ID NO: 181605 - DNA, 381 bp, Homo sapiens
tgggctgctcaattcagtccatcaggtcttagcaagttccatcaccacgcacagagtgtggcagatcacgtcttccaggatttctgatagacacaatccatttttaatgccttgtgtcaggcatccctgctgtcctctaaccattcttaataataagacaaaagtgatattttagggtaacagttaataaataatgtgacttatccaatcacacctttcactaaaatattattatcttttggcagattcattactgtagaggcatcaggatctgatgaaacattctctaattctaccactagtacattttccagagttgtctttcttttaatttaattctcccactctgaaagcatactgtccattgcaaactgaaatgag

SEQ ID NO: 181606 - DNA, 123 bp, Homo sapiens
tctttcaggggtgagtctgaggtatagtgagggtgggggaggctaattttcttttcttttaattttttttttttaagatggcatttcgttcatgttgcccaggctggagagcaatggcatgat

SEQ ID NO: 181607 - DNA, 852 bp, Homo sapiens
aggagccatgtggcattgctggcaagactcacatcacaccacctggcttctgggtgatgtgggtcatctatggctccacccagacagccatctgggtccctgaatgggaacaagatgcctctccagggctgagagtcttttgccacagcatgtccaggccagtgctccttgtttgcttttgagcttatgataccccaaatataagaagctccttctgttcaaactgggcaccccagcaggaggtgaaaagtatccccctcattccaacaatggacactgggatgtgtgcatgtgtttgttcatgtttgtgtttgagcctgtgctaacaaatcgaatacctgggcatcgagcagctcatacataaccagaggaccaaacagtctttctgtccatcactggtctgggttcagaatgcatagacctcccagcccacgttgcctcacatacaccacattgtggagttctctcggaggcagcattcagtgtgctttcaggcctttgacaaattaaacattcaaaagtaaaaattgctcactgctagggtagggggaaaattacaggggtagataaaacaggctagagcttatgaaaagaaaaccacagtctctctacgctaattactaatgcatctcagaaggagctcagaggttaaaggactaagtccttagctggattttcaccattcttagaaccaattgcagagaggcatagcatcttggaactgtgaaatgatacaattccaatgctggaggggggtcttcgaggctacacagttcaactatttctccaatatttgagtcttttttatggttagcatagtaagtttcacctatgattgaattcttccggtga

SEQ ID NO: 181608 - DNA, 551 bp, Homo sapiens
aatgactgcttgcctccccccaactgtctttctctttgcctctttctcccttctatttcccttccattttatatgcttttctaaaacataaatacattgaattcagaaggcagcgtgggatttggaaaccaggggtccaaagccctgcttgaccattttgcagctgtgaggtttcaggcaagtgactccagcaggctcgtcatcctccacactggtaattatggagagaataatccctactgtgcttggccattgaattacatcacctgttcagtggcacgcagtaggtgctcagtggttgcaactttcttctttcttctccttgatcacaaagcttcagaggctcaaaaaaatctaccagaactttttcagcctcttaagctcagaataggagcctcgccatattttccatctttcatctctggctttaacccactcaaccctcttccacattccaaacattccatgcactttccggccaccaggcctttgcacatgctgtgtgcccagcctgggttgccctttccccttttgcttgccttagcctgctt

SEQ ID NO: 181609 - DNA, 397 bp, Homo sapiens
tccaatattagcctttatttgttccaagaatcccacatgaatatatgtgacaaacagcataaactttgtcatgtagatccaaccatctctgtctacacagagatgtttctcacaaaagacagctacctttgtgttctgatttgcttagggacatccttggtaatttaggactgttatgaggtatgttggccaccctcaaatttaactccctcttccgttcattgtgtaccacaaataattgaatgagctaatatgtgaaacaattggattataaaggattaatgaagataattattgaaaaacccttagaatagcctgagtcattctgcatactcagtaaatgagagacatcattatttccattctattaggtacttttagtcacatccactgtttt

SEQ ID NO: 181610 - DNA, 267 bp, Homo sapiens
accttctgaaaggacagtgctggtctctgtcacagtgttgatctcctcagacgtcctggtgtcccttaatccaggaatcaaagaggatgttgattcagtctgaattctagtctcaaagaaggcaggagttgatgtagaaacacttgtatcccccatggcgaaggtgatacccattggagatgtggctttggatgtgtgtgaatcagctgggacagaagattgtgattcatgtccagaaatggaggtccccacgttggccactgcagt

SEQ ID NO: 181611 - DNA, 481 bp, Homo sapiens
acaacatcttgtgtgttctgagtataactctacttaagttcccaaagtacattactagtgcatgtgttctcatcattcttgtacttgtgaaagggagggtgatatagactttggttttaggatacccactacctttggtttcaggctacccactacctttggtttcaaaagccgctcctcttctgatgtctgttcttggtgtattaaggacaaatactggaaattatacacaaagaataagtatgtgctgatttatcatgagtcacatggatggtcttggcaggaagtgacagctttgtcattctttttcataattcaggaaacacaggaacaacatatgccttgggttgggcacagagtgagaactcaataaacacttcatccagtgaaatgatgacacagaaatctgtggcagtgctttagttgagtgataagggcttgaacccaatgtgtgaaagccagaatttatgaaacaaatgag

SEQ ID NO: 181612 - DNA, 430 bp, Homo sapiens
acacatgtttctctgattatttcctgaggtttaaatacctgctctgtcactgactagatgtgaaccttgagcaagctgtgcttccatgcctcagtttccttatctataaagtgggactaagaatagccccatctgattgaggtgttgtggggattaaatgagctaacacagacagagccctccaacagtgaccggaacactttaaagtctcaagtaacgttacaagtcagcttagtccatataggctgctataacaaaaataccttagagcaggtaatttacaaagaacagaaacgtattgctctattgggtgcaatggtgtgcatctctagtcccagctactcgggaaggtggggtggatcacttggagtccaggggtttgagaccagcctagggaatatagtgagacctcatggtgaatttttgaaaa

SEQ ID NO: 181613 - DNA, 434 bp, Homo sapiens
cgcttcagcctgggaaacagagcgagactctgtctcaaaacaacaaaacaaaacaaaacaaaagacacattattgaatgcctatatgagacagactaagaacaactgtcttagcccattttatggtgttgaaacaaaaacgttgagactaggtgacttataaaaaacagataatttctggaggcttggatgtccaatattaaggtgtcagcatctggtggggcccttttgctgcgtcagcccatagcagaaggcagaggtgcaaaagaaaaaggacagaaggggaccaaactcatccttttatcagcaacccactcctgtgataactaactcattctcacaatagccacattaatccatcaacgagggcagaacccttatgacctaatcacctcttaaggttccacctctctacaacattgcattgggaattaa

SEQ ID NO: 181614 - DNA, 342 bp, Homo sapiens
acgggttttcagtgtgttagccaggatggtctcgatctcctgacctcgtgatcctcccacctcggcctcccaaagtgctgggattaacaggcttgagccaccgcgcccggcctggaatcactgttgtagtcctccatgacccgatgtggtagagagcaggtgttctggttgaaaaggtctcccgagcgatgaagtatctctccatacaccatctatggatgacgaattcccagaggcttgtaatgaaatacattaagaaaaactgagagcagacctagtcgatgcttcctttgtttcagaggatgcttcgggatttctcagtgccttcatgtgatcacgtgt

SEQ ID NO: 181615 - DNA, 193 bp, Homo sapiens
cacaggtttcgtatgctgtgctgccattgccatttgcttcaagaaattgtttaatttcattcttaatttcttcactgacctgttggtcattcaggagcatattgtttaattcccatgtgttggtggagtttccaaaattcctcgttattgatttttagttatagtccattgtgatcagagaagatacttaaca

SEQ ID NO: 181616 - DNA, 134 bp, Homo sapiens
ggggagtagacggatgggcaaatgaatggatgaatgggggtgggctggtggtttggttggttgggaaggggatgcaaaagcaaacacaacattttaaaagtctattgagtagacttcctgaagtgtgaagtcat

SEQ ID NO: 181617 - DNA, 511 bp, Homo sapiens
gtatgagttcaaatgtaggaggagagggatataaaatttgagagttaagcattggacctgtgtaagtctattctcatgctgttaataaagacatatctgagactgggtaacttataaaggaaagaggtttaattgactcacagttcaggatggctagggaggcctcaggaaagttagaatcatggcagaaggggaagcaaccatgcccttcttcacatggtggcagcaaggagaagtgccaagcaaaaggagaaaaagccccttataaaaccatcagatttagtgagaactcattatcatgagaacagcatgagggtaactgacccccatgattaaattacctcccacagggtccctcctgagacatgggggttgtcagaactacagttcaagatgagatttgggtggggacacagccaaaccatatcagaccaaacatgaaagtctaagaagctttgacttttaagacaacattaggaagtgcttgaagggttgtaaacagtggcaccac

SEQ ID NO: 181618 - DNA, 515 bp, Homo sapiens
tttcctgcactgttctcatgatagtgaacgagtctcatgagatctgatggttttaaaaatgggaatttccctgcacaagctctctctttgcctgctaccatccacgtaagatgtgacttgctcctttttgccttctaccatgattgtgacacctccccagccacatggaactgtaagtctgttaaacctctttcttttgtaaattgcccaatcttaagtatgtctttatcagcaactgaaaacagactagtataaaatgtctttatgaccttgaggtaggaaacaatttcttagacaagatacaaaaagcacaactcatacgacaaaaagtttaataaatctaactaattcaaaacttacaacttctattctacaaaataattcataaacaaagtaaaacgacaagccacagactcaaaggaaatttagtaaggcacagactcaaaggaaatctagtatgtaacaaacaaaggtttggtatccagaatgtaaaaataactcatcacacttataag

SEQ ID NO: 181619 - DNA, 147 bp, Homo sapiens
accgtgaagccgtcacagactctggtatgaatttagccacagacttgatgttctgatgcctcgaggagcttctgggtccctcaagggcccaggtgacatgatctccagtgcagcctagagctttggaatccctcttcctcccccaga

SEQ ID NO: 181620 - DNA, 759 bp, Homo sapiens
cctctcaatgggttacatttttcaaattatgttccaaaacttaaccatgagatcgttggcatgagagctgtgcctgtgtcccacgccaggcttgaactcacagtgtagcagatgaatcaggaagaaggcatcatgggtttgcaccaaaaaaagaatcagataaagaagttcgtttgtatctttttaaaaagaacaaagaacccctcttcttccaaattaaaagtttagataacattgaagttatcaccctcttagaaatatcttgatttttgtatcatgcaatgtctaatagaaaggtgggaggaaaagagaactgtagagttcactgctgaagtccagtttgagtaactctcagaaatacgactagatccgctgcaatcattcacaggtagaatgcataaaaatgaatccgcagttcaagcttggtccatgtgtcatgtcctcaagatacatgggtcatggagagcaaagagacatcccagccatgggaggaacaaagtgggatacatcaggccagctgagccacagtccagctcctgagcctacgtccttttccttgggtacatcctcattctgggttcggatgaaaaatgttcctttctcccataatttcatttggaacaagtttttaaatggtgagtcagagaacttttgttcaccaggacatctaaatggacatttgacagggctccgatagatccagtagggggctcaatttctgacactttcccaaaagcttgactgcctaaaacagcaatg

SEQ ID NO: 181621 - DNA, 142 bp, Homo sapiens
gaaggacataaaagctaatctgaatctgctgctgccacagaaaaatacatgtacaacttacaactctaaggaaataagcttaaatattatagtgcgagtattgtctagtgttcagtttgctaatatgtttattcacagtcaa

SEQ ID NO: 181622 - DNA, 193 bp, Homo sapiens
aggatcccccaggtagacctaactgacacatactcaataaatgttgattggataaattgggaaagtcatcaatatttgtacatatctcagatataaaaatagaagcattttatttggtttcaggcaaactatatgactgcctccttgctcacttctccccactttggggacctatccctggttaggagtatga

SEQ ID NO: 181623 - DNA, 466 bp, Homo sapiens
ttttgagctcgcacccatagctacaccgtaccacccttcttattcttccacctcactgagggcctacatacccttactttcagaaatatacttctccaccatatgacaagttcccttcaagacaataacatcatcaagttttaaacacctgtaaacacatataaatacacacactttcttctgtcaggcaaaaaatgctataatcccttatatccataattactgtttgcttacagatcccttcaactaattccctcttttcctcagaagaaccctcccaactggtttctgtgtgcttagatttgggaaatcataaccccaagctaactgatttcatttgcattatctcaaccatcaaactggtgctgcctaaaacaaaataccattttagtactaacagactcactttctccactccctgacacttcacacctcctccgtacggtgtcgctatggggatcctcta

SEQ ID NO: 181624 - DNA, 596 bp, Homo sapiens
cacatatgatcatttcttcagagtatatatctagaatcagaactcctaggaggtaggatatgtgcatctttagttacactgcatattgctacatgcccacgaaactgattataccagtatatactcctaccagctgtacttgagaatttgtttccctatgtacttgccagttcttgatactgccagattctcattttccattcctcacaatggaatcttcttattttaatttgtactaatttatagtgagactgagctcatatattactggctggatgagtaggtcttctgtaattacttatacagatcttttgacgatttttctaatgaattgattttttatattgacctataggattttacatattctggagactgatcctttgtcaattatatgggttacatatatattctcctagtttgtgacttgtcttttaagtcttttgacacattttaagggagataagtttttcatttcaatgaggttaaatttagctatttttcctttatagtttctgcttgttgtatcatgcacaatccacccatattttatttttgcatagaatagacatggagactctatttattatgtaaaa

SEQ ID NO: 181625 - DNA, 418 bp, Homo sapiens
ccacctgaacttactgaaatttgaaataaaacactgctttatttttttctctgcttacattaaaaaaacttaccctgatttcagatgagaaagttttctatggtcaaattgctgtgaactttttaaatatgaagtatgttacttcagctcacctgtagagagtttcattttaataattagatgcacaaagtgcaaatcaccaatcagttgagagctatatgaatacatggcacctgaacacgtgtggtcttgtcttggatggaaacaggatgctggtgccatttcattcttaggacttccctttaaatggaagcccagtaaagagctatgggtttatattaatgttctcgagtattacataggctcaccagagctgaccccattttggtgaattcaacagaaccctggagattttttt

SEQ ID NO: 181626 - DNA, 448 bp, Homo sapiens
gtacacagctcccacgacagccactcacatgcgctttccgtgattccatcccagacaccacctgcccaaatttgtgtttgtcctcactcactccatctcattacctggctgaccctgctccaggctcatggaccaacctgctgttcctggagtgttccaagccactcctgcttcaggcttttgcactgtttgctccctctgcctgaaatactcttcctagtggtatgcgcatggctcattcccttgcttcctccctgtctctgctcaaatgccaccttagcaatggggctttcttcaactgctgtatataagtaacagtcccatcattccacctcagaaccccctactcccttatcctgctttacctttctccaaagcatgtattattgtcatatttaaaatatctatttgtggccgggcacagtggctcatgcctgtaatcccagca

SEQ ID NO: 181627 - DNA, 486 bp, Homo sapiens
atgtgatggtgatgttatccatgttgaataaactagaaatcagagttgagttgtgagggaaaaagagaaattgcaaatgtatgccttgggcatatggatcatatttggatactgaattgaaccactgaactataaaaacatgttatgaaacagggaaactgcactggctatgtgacggtattaaggaattactgctaacatttaaaaatgtgataagggtattgtggttatgtttagaaataaaaatagtccatatccattagagatacatactaaattgtttttgcatgaaatgatatgatgtctaggattttctataaaacaatccgaggcaggaatgagggacagtgggtgagaggacatatgaagtaagattggccatgtgtcgacacttgttgaagctggatgatggaggtccattattcaggcaaaccctgtgttattgtgctttgctttattgcacttcacagatattgcatgttttac

SEQ ID NO: 181628 - DNA, 391 bp, Homo sapiens
aaaatgtccttctgtcttcagccagtcctctctcccatgcatggatcctggcgaacaccaatctgctttctgtcactgtagttttgcctgtagaactatttcatataaatggaatcacacagtatgttaccttatgtagctaacatctttcacttagcgtagtattttgaaattcaccctgtgttgtattgtcagtaatgtgttctttgttactactgagtagtattccagagtatgggtatacttcagtgtgtcaatccattcccctgttgatgggcatttggattgtttccaaatttgggttattacgaataaagctgctatgaacattgaattatatgagtcctcgtgtgaatgcaagttttcatttccctcacgtaaatacttaagc

SEQ ID NO: 181629 - DNA, 912 bp, Homo sapiens
attaaagtaaacactcaaactatagcaaatgattcaaagaaacttcctataatcaaagtgcttccatctatctttttatagtacactaaaaattgaattcacagcactcaacctactccaattaagaaaaaaaaacttaaagcaacttacctaaacctaaaatatcttcaaagtactgcattaggaaacaaacacaagcacattttaaaacacaggcagttttttcaagcctccactatcttaagacctttcacatttcacacaaaacacatccatgagcgagaggggggttgggacagaggtgaaaagaacaaatgagaaagaaaataattttgaggtagagtaacatgactattactgccttataactggaattttacaaactaaaacaatgtgttgttctggttcaagtatttgacattctctccctggtatcatgagtgatcttgaactgcatatttggtgccaaccggtacctcctgcctacccttccagtttcactctttgcattaccaaatgactacagcagattggaatgtcacttagtaccaggcatgagaaaaacaaaaaggtaagctgtgtaaatcagcacacggacttctgaaaggaggtcaagctgtttaggaggattcttatcagtagtaacttacaaaaggaacctagaacctcgacaggaaaagtgacactaatgaaaccagctcactgttcaattaagttttcttaattaattctctttgcaaaacagaatcatggtgaaaagaaccaatcagtgaagtagattctcatttaattttatggaaacactctgttcactagaataatactcttaactcctgtttttgagaatcttctatactgttaaataaatatcctaggctaacacatacacatatagatttctaaaaagtacat

SEQ ID NO: 181630 - DNA, 570 bp, Homo sapiens
cctctttcaccttaaaacataaactggccatcaatcatttctaatggcatctacttaaaactggccttatgattggctcctaagtgtgtaaaatgtcaggtggaaatacataaacacatctttgagctggatagagtctcagtgatcctaaaaagtgaaatatagagctattttagagatgccatttaaaaatttatggagagagatttggtcttataatttctttcatgaatactaaaattttactacaaagaaaattcagaaatgagttatttgtgccatttaattattaaatcataaatccacagaccattagagctggaaggggccttctagattacctcctccaatgccaatattttgcagatgagaaagtaggaacagaaaatttattttctcagggttaggcatggtggctcacacctgtaatcccagcaatataggaggccaaagcgggcggatcacctgaggtcaggagtttgagaccagcctggccaacatggcgaaaccctgcctctactacaaatacaaaaattagccaggtgtggtggtgggtgcctgtaatcccag

SEQ ID NO: 181631 - DNA, 199 bp, Homo sapiens
ttgcctgggctggtcttaaactcctgggctcaagaaatcctcctgccttggcctcccgaagtgctgagattacagatgtgagctaccatctccagcctacattgggtttctatgaagacttcacttaaagaattaccttgctttgatctctgatctagttcaatcccatttgccacattttataaaggagacaactagg

SEQ ID NO: 181632 - DNA, 144 bp, Homo sapiens
caatacttaaagacttttctgatgagatcagtggattataacaaatgtgaattttgttatttattaaaaatgtgtaggactaggcaaggtggctcacacttgtaatcccagcactttgggatcactggaggccaggagttcaag

SEQ ID NO: 181633 - DNA, 296 bp, Homo sapiens
ccgtattgtttaagccacctgattcgaggttttctgataacataaattgaataccctcatacacatggcccataggtacttcagcagatcccaagtgaattcattatcatctctcaaaaatgcattcttctttttcaagtactctggtcaatgacaggaccagctccaaaaagctaaaacccccaaatgtccatgttctaatcccttgaatttgtgaatgatacctttatggctttgcagatgtgatgaaatatcttggaatggggagattatcccagattacccaggtgggccct

SEQ ID NO: 181634 - DNA, 359 bp, Homo sapiens
aggtagtctagaggtcccgatcatctgtggaaagatcacagcaggtgatacattaatgatgactattttcagagctcttatatgcaccacacaacacacacaaatatatctctatgtctcacctacacaagtgacccagttccctcagaacccctgttcaccttctgttttcatccaggacaaagccaggctcagcagctgcctgggcccctcgtgggctggatctttgtcacctcacttcagctgatcctattccaggctgactaattagtctggtcaagcaattccacccgagtgtaaaggatgccatttctacccaggccaggaagaggcagtggtgagaagatccacgatgatct

SEQ ID NO: 181635 - DNA, 514 bp, Homo sapiens
caggcgtgctattaggtgagaggctattattatatcctatatacagggaggacaaggaggtctcactaatactctgctagctgagtagacatgaagggaataaggcataacatattttgaggattagcattccaagcaaagtgtaaaactacaaaaatcctaaggtagaagcacagttgatatattcaaagagaaataaggaagacaacatggatagactagggagcatatttgatgctgaggtcagaaagttaaggggtagggatagggataggggctagagaaggtagggccttgcacatcattgaaagaacaggggatttcctttgaaagagatgcaaaaaatcagccgggcatggtggcgggcgcccgtagtcccagctacttgggaggctgaggcaggacaatcgcttgaacctgagaggcggaggttgcagtgagctgagatcgcgccattgcactccagcctgggcaacaagagcgaaactctgtctcagggggaataaaataaaat

SEQ ID NO: 181636 - DNA, 337 bp, Homo sapiens
agactgttttaaaattctagtgcaaatttagaagtacctaagaatccagaattagaagaatggtgatgcaaatattaatgtatacacaactgacacactatcatgcagttattaaaatatggtcatggccaggcacagtgggtcacgcctgtaatcccagcactttgggaggctgaggcaggtggatcacaaggtcaggatctcgaaaccatcctggctaacacggtgaaatcccgtctctactaaaaatacaaaaatcagccgggcatggtggcgggcgcccgtagtcccagctacttgggaggctgaggcaggacaatcgcttgaacctgagagg

SEQ ID NO: 181637 - DNA, 304 bp, Homo sapiens
aaaagaaacaaaaaattgaaacagtacactagaaagtatgtatttaacacaaaagaaggtattaatgaagacataaaggaacaaaaaagacatatagaaaacaaatagcaaaatggcagatgtaactccagtaatcacactaaatgtaaatggattaaataatctaataaagaaggtggaatggggaaaaacatgacctaattatatgctgtctgcaagagacacaatttagattcaaagacacaaataggttgaaagtaaagagatgaacaaagatacaccatgcaaacagtaactaaaaaga

SEQ ID NO: 181638 - DNA, 602 bp, Homo sapiens
agtcctgccaagttatcctaagttttcagtgataacctcaagcttgtttagctctgctaacaaaatacagggtcaaactgttgccaaccccattttaaaacaaggtccaaaatcaagacaaatggaaccaacaaacaaaaacatgtaacttctcattttaacattaggaaaacatcagctcactctatagtaataaagtttttctgctcaaaatttctataaatagcttttcttgtgagtttgtgaaaccctgtaatgagttttagaactatccacagcaaaaataatgtagcattgttttataaaaaactacataaactctaaaggcatatatatgttgtaagatttcttccatcagattctaaactttgattgagctatcaatcagtttttaaactgtgaattcactttaagaattaactttaagaattcagagtttaaaaacctgacatttacccacttatacctactgttccattatctacaactatctgatctttgacaaacctgagaaaaacaagcaatggggaaaggattccctatttaataaatggtgctgggaaaactggctagccatattgtaaaaagctgaaactggatcc

SEQ ID NO: 181639 - DNA, 740 bp, Homo sapiens
attttgtgtgcttgccttgattttgatttttgctaatgaaactgatattctttttgcaattcaggttttagatcagtttctaatcttatttcagagtattccacaaacatgtgtttacagcctggcaacagctatgactgagactaaccgaggaggttatggttactcttctgcctgctccttccctggtttctgtaaatgtttatcttaaccttagactctgcacattagtggttcctgttcatgcttttgagttgacatcagtggattcctcaaaactactaggttggtgcaaaagtaattgcggtttttgcctttgaaagtaattaaaagaaatgtctatatttatcgttaaccttgaatttgcatccaagatttatacttttttcattttcccaatttcttgactgaaatataaaaatctcccaaaatgcagagcaggaattttcacaggaaaacattaagcatgtatttggtcttgtttcttcatcgagtctgttcatctctggcttttaattggtgtgttagactattatatttattataattattaatgtggtatttcagtatttattttctatttctcccatctgttctttgcttcttttcctaccatcttttgaatcaatcgagtattttttagtattccattttatttttaccttaggcttatcaggtatacatttttcttccatttttcagcaattgcttatggcttgccatgtgtacctttacttctt

SEQ ID NO: 181640 - DNA, 142 bp, Homo sapiens
agttaacacataaaattagccatcacattgtccttcagtaatcgcatgtcatttcccctaacaagtgacactaattcagttattatgacaaatggactcaaccagtttctgctattccaataaaccagtcaaggatgagtgg

SEQ ID NO: 181641 - DNA, 573 bp, Homo sapiens
agaaaccccagccttttctgggatttaatggtaatacatatgtaatctagtaccttgttactttcccaggcatttagtctgggaaccctaatcttgagtctgtctacagtggatatttttctccaggacaggaaccaaatgggccagttactggtctaccctgtagctcaccacagacatagcctaggggcctttggcccatcttcactagttggcaactggctttttaggcgaaatgcctccttttgcataaaggagagatgcctgtccccacctgcaccgcccatctcctgctttaaggccagcaagatgtcccgagaggcctccttgtagatgagtgaaatccacacagggaaactcaagtaaaaatatggggtggggtctgggaagagctgtgtttattataaggatccagagggacctggggaatttaggatagggaaccactgtgggtgggataagaaccagagtggctccaggccctagttttttctcctctgtctctctgctttcttttcccactctcttctctccccttccttctccttattcttcttctactcctcttttttt

SEQ ID NO: 181642 - DNA, 351 bp, Homo sapiens
ttgttttatttctggatcatcaaatagaaatatatctacccagaagaagaaacatgttttccaaacaaaatcaagcattatgtgtaaaatcaagcatgaccctgcaggaaggtctggccagcacagtggcagcaccagtcaggctctataattatttacttgtgtgtgaatcctagtgccactttttaccccctcccacagacctgcaatgattaacaaactgtgatgattagaaaataaattacaggtccttccataaattatatctggaaacctgcctagattctttgtataagaaacacaaatttaatttctatcttcatacaagcatagaatttacttgggtgagga

SEQ ID NO: 181643 - DNA, 269 bp, Homo sapiens
atttccagcccttatcaaaataaatgtgcctgtaaagcaaattatacgcatctttacttatgggaagaacgtaaatgctttcaggacatgtattttaggtttagcgaaacctacttatttccgggttttatgggagatcatttttctaaacgtttctttactctaagaaattcattaattcatactaccctgcatatgaatttgttaaattagggcttctgaatacattgtatatgtctctctttttttttaaggaaccttgattaaac

SEQ ID NO: 181644 - DNA, 592 bp, Homo sapiens
gaggtggaagcttaggggtttccaccatcttggaggccttcagataaggtgtggccacccacttgtggatcacaatagggaccctggggagaggggcttggaaaggattaaagcagagttggaaggaggcccagggaagccaggaggcctagctgaggcaggctcaatgcccagtctgagctgtagaggagtagctgagctctgcactttgccagccatatgaccatgggccgatttacccttcctaagtcacaattttctcctctgtaaaacgaggataataatagtatgtatcacatagagttgttgagaaaatgaaacatgataatgtatctaaaagtgcttattgtgcagtctgatacgtgtgaaagatttagtatcatcttcaccgtcatcaccatcattctcatcatggttgcaacaggacttgaattctgaacatgtgacttctgggacctgggaagcaaagctctcaaataaaaatgaggttagctgaagcgtatattcactctgggaagcaggcacttctgagcagtatgacacactgtggccttgtcaagggttccgccatgagaaggaaccaagctgcctc

SEQ ID NO: 181645 - DNA, 209 bp, Homo sapiens
tttgttatcgtaacctgagcagattaaaaccctaggtgaagtctggaagttttgagctaggaggctcaaataacatgagccatttccttcctaggtggaagagaagcaaagatagaggaggaagagaggccctgggggctttcatgcccagcctctaggcaacccagaggctcagcagtgacagccatttgtccttgatgaatttctgt

SEQ ID NO: 181646 - DNA, 245 bp, Homo sapiens
gtagaacggagcttaatggaaagttcctgaataagtggatgagccagtacactgggtaggattttcacctgctacaggtctttaagaagccttgtgggccaggcacggtgtaataccagcactttgggaagcctcggcaggctgatggcttgagcccaggagttcgagcccagcctgggcaacataatgaaacctcatcttacactccatctggggtgacagagtgtaagaccttgtctcaaaaa

SEQ ID NO: 181647 - DNA, 201 bp, Homo sapiens
caataaatgctgaaaatgtgagacaggcctaacgctaaatgtattcaattgtagagaaggccaaactcttagaaaaacaaaattagcaaggtaattcctcaacatatgctgtctattgaaaacaactgctaatcaggatcaagaccagactccttaaaatgctgtcatgatgattatttaatactgttgtggaaaatctga

SEQ ID NO: 181648 - DNA, 512 bp, Homo sapiens
gggtgagctacttccccaagccctggagcggaatgggccatgggactaacttgaggatttagatccaaccagcatgaatacagtagtatctgtttatggagcacgcctgtccctatcaactatgtgttctcattgccatgtattcgacagagaagacaatgatgcggctagggacaaaatcagaacacgaacccagtacttgtcatggccagagtcattcatttttgtagcctgcaggaagagggaacagatgggatgccgccaacctcgactctgagcctggttctgtgtccagaaccatagcctctagaggcaggaggcagggcacgcaccacatctgtcccttcagggctttgggcccatcccgtcagcttctgggcctcactctctggacattgagttggggccgttcattgcctctcatcatgattgttttgaaggcaaaggattgagaggagacggcccctctggtgctgtggtctccatagatgtggtcaggctgggccttccct

SEQ ID NO: 181649 - DNA, 607 bp, Homo sapiens
catttattctggcaccctataattcaagaaaggaagtttaattcctacttggaaatgaaatatagaggagaaatttcaaagcaagccacattatctattgatcataatgggaattacacaaaaccttggtaggttttttaaagaaggtatttttttttctacggaggcaattgtgcactgacaattgaagttaataattttgttttaattttaacaaatgtgaggttggctgagtacctcttattctgagtttggacaaagagaagtataataacctctcacatgtatgctttacagactacttttacataggtattcccatttgatcctcacagcaacgctatgagaaggcaattattattttttccattttagagttaataaaagggaagcacaggttgtgaactctatgaggacagggtcaggtcagtcttattcgcccctctaattccagcacctaatatagcaactggcgtatgataagctctcaggaaccatttgatgcatgagattaattggaaagattttagcattaaatggctttttaatgctaagactttttcttcttcccaaggtcgctccacctgataaaacttttaatggtttt

SEQ ID NO: 181650 - DNA, 309 bp, Homo sapiens
aatgttcgaactagaggatccccttgaccattattattctaattccctctacatctgtgaacatctgtccattttagagttaataaaagggaagcacaggttgtgaactctatgaggacagggtcaggtcagtcttattcgcccctctaattccagcacctaatatagcaactggcgtatgataagctctcaggaaccatttgatgcatgagattaattggaaagattttagcattaaatggctttttaatgctaagactttttcttcttcccaaggtcgctccacctgataaaacttttaatggtttt

SEQ ID NO: 181651 - DNA, 752 bp, Homo sapiens
agaataaaatctcaggtgtgtttttttagtgccacagtcttggatgatgggcttctagatgttgagtcctagaagctctcaacatctcttcttaattggagaaagtgttaagccccaaagtagctggagcagtacatcttcaatttttgacaagaaagcaggaacttggttactttgagtgttattcattagtttctgctttcattgagaatgcagcaaaagccaacgaggctgctgctaactccttgctggacatcttctgccactatcacaggaactgtgatctcactggacaattaactagggagcctttcatcttgaatgactgctgcacaaatgatcttcaaagcattttagccaccagaggaattctcttcaaatacccaaaatccatcagtatcttgaatcatgctggattttgaagaattcttaacaagccatgtaaagggggctctctggccttgaaatagtgatgttttttatacagaaaggagaatgccgaatgttcagactaccatgcactgttaaatttgatttcaagaaattacaggaaaactttccaaagttccgtctcacagaatttatttttacaaagaattccaagataagtttagttttatggaagatttttatgtggtttttactcactcttcatctcagacatcaaccgatgattacatcacttatttagctagtaaatttattaatataaaactcagagacattccaatatccacattgcttacatcatc

SEQ ID NO: 181652 - DNA, 272 bp, Homo sapiens
aattaaagtaatggtgattcagttaaacatagagctggaaaagccattattttgaaatatcttctgagcctcattgaagagagagtgtcttacacaccttgggaaccaagttttgcatattatagtattaccacattgtattcgatcacaagaatggtgtgaatacttggtggttaaacaaattattgatgcttgttagcgcgtgctgtccagtacaatatttagagcacatgttttggacttggatagactttggaatgcttctccgcgat

SEQ ID NO: 181653 - DNA, 205 bp, Homo sapiens
ggtgcgatctcagctcactgcaacctctgcttcctgggttcaagcgattctcccgcagtagcctcctgagtaggcattcaccacaccctgctgttttgttacttgtttgttttttgagatggagtctcgattgatcgcccaggctggagtgcaataatagcaccatctcagctcactgcagcctccgcccccccagggttccaga

SEQ ID NO: 181654 - DNA, 464 bp, Homo sapiens
tacaatgcggtgtttctctgacctgctgagtgtcaaaacaaagtctcatatttagttggcattcaaaaatattatttgaatgaagcatatgactttgacatcaatgcaagggccatgaatagcataacatgagcaacttactggctattctgggagatgttgtaaggctgaacgcaagttccaacaagattcctgctgtcagagtagcatttaacccaacaatagccttcctctttgatgtctgtgttactgtaacccaatttcattccatttttattctccatttcagaaaatcagtcaagtgatacaattcatatatacatttctaatgaaacacttagaattatgaataaattacatagcattaagaatttcacattttcttgtgtagctctgtcagagcatgtgaccatgattaaaggctattttgtttgtttttgatacataaaactgtctctatatgg

SEQ ID NO: 181655 - DNA, 290 bp, Homo sapiens
ttcatctaggctttcacacagggacatgagaatgtgaacaacaagtggaacaaagcattatttggctgaacgttacacttctgtgccttcctcgctgcttttttgcaggcataacctgacttcctcgcctaccacctccccacaactgagcccacatcaaactttctgcttgttatctctgtgaaggagcaaggggtgaagaaacaacctagcaggattgaggaaaatcccatcatgtgcttttctccaacatctttaataggtgagtgacaatgaacttcaaggatggt

SEQ ID NO: 181656 - DNA, 701 bp, Homo sapiens
ggtctctttgaatatttccttataattagattcagggtaagcctttttgcaagaatactacataatactacaagaatactaaggatattgtataacatattcttcctatttgttgcattactttagtcatgtaatgttgctttatcccattattgataatactgtgtttattttattttttatttttatttttcttttgaggcggagtttcactctgtcgcccaggctggagtgcagtggcacggtttcggctcagtgcaacctctgcctcctgggttcaagcgattctcctgcttcagcctccctagtagctgggattacaggcatgcgccaccatgtccagctaatttttgtatttttagtagagacacggtttcgccatgttggctaggctggtcttgaacccctaacctcaggtgatctgcccgccttggcctcccaaagtgctaggattacaggcatgagccactgcacccagccgatactgagtttatttacttggttaagatggtatctgctagatctctctattgacaaggaactcttttccacgtgtaaaaataaataacttggatggtaagttgagaccatgcgaatatgcttttccccagcaatctatcagccattggccttagcattaataatccttgcctaatttatttatttcattgtgtttgtaatttttatttatttatttattt

SEQ ID NO: 181657 - DNA, 350 bp, Homo sapiens
aatgaagggtatatgagaaccctctgtactactcttgcaacttttctctaagtctaaaataagtggaaattaaaagttaaaacaaaaaaaaaggaaaattttatctatcccaagaccacaaagttatttttctgtttcttcctccagaatctttattgtttgttttcacacttagacctatgatccatcttgaatttatatctgtgtatgtagtgggatgaagttcaaaatcatttttttcatacagatatccaagtgcactggcaccgtttgttaaaaacactggccttctcttaagctgcagtcagacttttactgtaaagcatgggcccatatatgtgcaggagtct

SEQ ID NO: 181658 - DNA, 677 bp, Homo sapiens
agcctataagaaaggtaaatctgtctcctgaacttaaggggcctctgctctaaagtaagtttgacattggccaataatcaccctgacattcttgtggctttggctgctcttgaagctgctgaattgcaccaagagaagaggctgagtgagaaagcctggttatagcaatggcccatcctgtcagtgctgggagtgggtactatactcaaagcagtataaatacagatgctgcacattatgctctgctatgctggctgcctttgggatgattgttgggaaagttcttgaagccagtggtgttagaggggacagtgtgcttcttgaaacaaaagagttgatggtgagaatggtctttgaaaactgtactctttacaaaggtgaactctgcaaactgggcctactgaaagaaatagggattctattttcattactgttttatcatcaaaataccataaggcctggcccttagcaaatagtccttaaatatctgataccattagaagcttgcttctatgaagggtgatcacccatcccagtttgcgtgggacagtcttagtttacattattgtccttgcatcctgttcagctggtatatatccaagtctcttaatttttattcaagtattattattaatagttgtacaaaaataagtcagaataagtttggtagacctcta

SEQ ID NO: 181659 - DNA, 157 bp, Homo sapiens
ttctcacggttctggaggtgggaatccaagatcaattaaggcgctggtggattccccgcctggtgggggccccttccagcttcatggaaggtgccttttgctggtggaaggtgggaacgagctcccctgggccttttttttttttttttttgagaca

SEQ ID NO: 181660 - DNA, 363 bp, Homo sapiens
tattccctttccccattagcttgtctttcatctcacacaaactctaccttagatgggcccctgggtgtctcttattcctggctcctgtctttgttcccttgtcttatccactccaccccatcacttcccaccagagttccttgctccatctggaaggcgaaagtggaacctcacaacaggagatgaatttgccttttacagtcttcagtgtgaatcaactataagacagagcgtttgccttttagagtcttcagtgtgaatcaactataagacagagctttctcttgctaatactcacaagtgaggatgggatgaatgctaatactcacagggatgaagaggtacaggagaagagaacatcat

SEQ ID NO: 181661 - DNA, 138 bp, Homo sapiens
ttacaggcgttagccaccacgcccagcctcttactcctcttattttctgcctggatttaaatcagacacctcccctagcaaaaacaaaaaactccactttctcctggaaaccctattccctgtcctcagcaacagaag

SEQ ID NO: 181662 - DNA, 336 bp, Homo sapiens
attatgagaacttgaacttttattgttataaactgaggacatcaatgtatgttattctggattttcaactattttgatgtgagattttataaatgttatgagttatatatgttagcacatgtggaatggtgactgaagaatttgtttgcacaatttagaatgatcttgtccttttaaaataccagtttagtttacttggtataccaggctctcttttgacattaatgtaacttttgagacattaggttagacatagcttagctttaaattctgtccaaaagcaatttatggtatgcctgtattgtattaggtgctagagtaaatgaggttatacta

SEQ ID NO: 181663 - DNA, 187 bp, Homo sapiens
agaatcattccattcacatatctggagagagtggagaaaatgaatgcagtccctttatgatgaggatgtgctccatgaaggagaagatcctggctcgtggaggagcttcctgctctgtgaacatactgaaggcacaattggcccttcaaactctcatttgaagtcactgtgttgccatagagatatt

SEQ ID NO: 181664 - DNA, 549 bp, Homo sapiens
attctctagcctcagcctcctgagtagctgggattacgggcatgtgccaccacatctggctagtttttatatttttagtagagatagggtttcaccatacttgccaagctggtcttgaaatcctgacctcaagtaatccacccgtctcagcctcccaaagcgctaggattacaggcgtgagccaccacgcttggcctattcatgtactttcatatttcttgtattgtcaggtatatattatctgttatctgagggagtcatatcagccgttatctgtccaacgaatatcaagttgcaactgtgcgccgacaacataggcgagcttgccaacatcaacctcggcacaggcctaagggcactaccttccaatagaccctcagaacagccgcttctcaccattctgctgctactaccatggggcagcccacactcatctattccggcagccccctggattagtcagggttctttagagggacagaactaataggatcgataaatatatgaaggggagttgactcacacgatcacaaggcgaagtcccatcat

SEQ ID NO: 181665 - DNA, 382 bp, Homo sapiens
cactctgtcgcccaggctggagtgcagtggcacaatctcagctcactgcaaactccgcctcctgggttcacgccattctccttcctcagcctcccgagtagctgggactacaggcgcccaccaccacgcccggctaattttttgtatttcttagtaaagatagggtttcaccgtgttagccaggatggtctcgatctcccgacctcgtgatccacccaccttggcctcccaaagtgctgggattacaggcgtgagccaccacgcccggccctgtaatataatttttaaagtcaagaaagcactaatttagaaaatatctcagtcaattttcttatgatcagaaataacaataatcagaagagaggtaagatgcgttctacta

SEQ ID NO: 181666 - DNA, 258 bp, Homo sapiens
ttgaacccaggaggcagtgacccaagattacaccactgcactccaacctgggtgacagagcaagactccatctcaaaaaaaagatcggtggtgggagaaactgtccaaaggcccagctcacatggtactgcgtccctgaatctgttcctcatcttgttccctcccagctctcacaggctttgtttgtacatgtcctaccatcttctcttaatttgcctttctagtagagtaacttatatatccttcccccccatcctt

SEQ ID NO: 181667 - DNA, 270 bp, Homo sapiens
cacattacttttgggggttttaaaacttttaatatgtcaatgtgggaaaatacaattaagtcacctgaacatttaaaaatattttcacacagttaatggatgttattaatatttactataagactagatatagtttgtcactagcatcttaacttatttaagcttgttatttcatagggtttaatttgctgaacggtgttcagtttactctggtgaagattcacgctttttaaagtttaccatgacatttcagtatatagaaaaaaattt

SEQ ID NO: 181668 - DNA, 786 bp, Homo sapiens
ataataatgataagcaattcacttggaaaataaaagatttgaggttttcattgaacaagaattctatataaataagccaacaataaaatgtggcagttaaagtaatcacaatggatcttaaccagcagtagccagtaggtaaaataatcataattaatctgaatcagcagaaactgaagcagagagtggaactcacaagaaagagcagctattccatgttcttcactggacatagcatagctgtagtactaggatttatccttgagactacacacagtgaaagataccaggaaactgaggtccactcaaatgagggcaacccaagtaataagggtaatgaaaaccaatttcaaatcacatcttgacatatctgagggtatttaaactggaaaagagaaaatcagggaaaatgatagtgatccctaaacccttataaatcagtaagaaaacaaaaatagacttgctttgtgccatggaaactgcagttctcccacacatctcccagcggggatacacttctttttagtcatttggtaggtgaatcccaactgatgtgttactaaaaacaattaaagactacaagtctgtgattgagactcactggttataaattagagattccagtttactcccataacatcacttttattaattcattctttattgaaagagatcctggtaaatgtatatccactggaatgtcacataaactcagttaagctcaacagagtatttctcatatgtaaacctctttagaaggtagaactagtgtctgggatttacatg

SEQ ID NO: 181669 - DNA, 142 bp, Homo sapiens
tgaattgtcatcttgcaggctgggaaaatggctcaggtggggttgcggaaaacagcctggatcagggagaggttggaggaaagaaggctgaaggaggtgcccgctcaggccccaggctaggctgaggcaagtaagacatttg

SEQ ID NO: 181670 - DNA, 591 bp, Homo sapiens
gtgctctctgaaacatgtgctgtgtccactcagggttgaatggattaagggcggtgcaagatgtgctttgttaaacagatgcttgaaggcagcatgctccttaagagtcattaccactccctaatctcaagcacccagggacacaaacactgcggaaggccgcagggtcctctgcctaggaaaaccagagacctttgttcacttgtttatctgctgaccttccctccactactgtcctgtgaccctgccaaatcacacccaagaatgatcaattaaaaaataaataaataaataaataaaaaacaaaaaaaacaaaactactttcaaaactagcttaatgtgttttaaaaacaactcactgaaaatggaagcctggcgcggtggctcatgtctgtaatcccagcactttcggaggctgaggcgggcaaatcacctggggttaggtgttcaagacccagcctgaccaccatggagaaaccctgcctctactaaaaaaatacaaaaaaattagccgggggtggtggcgcatgcctgtaatcccagctactcggcaggctgaggcaggagaatcgcttgaacccggccggcggg

SEQ ID NO: 181671 - DNA, 288 bp, Homo sapiens
gtctatctctaaaagaacaaactctaggtaatcaaaaagctatattctaccccccaaccaaaaacaaattgcttattttagctaatacctagtcaaacataaatgccagggtagaaaaaataatgtattttctctttccttgctataataatatataccagttgaaaactcctgattttcctcagaccacctaaaaagctttgtccattgcttgtgctcatgtagtagctaaaggaggttatttacaaggcacaaaggagaaatacatagcccgtctatactgcatca

SEQ ID NO: 181672 - DNA, 394 bp, Homo sapiens
aacaatctcgatcgttatgtccagataatgtatttatgtatgtgagtatatactgtcagtttcttgtaatgttactatattggtaattatgtttacagttctatggagatgagtgaataaacatatgagcactgaacaaacatatacaacccatgtacttctgagaagattaagggattttaaaattacttatctagctttgggaggccaaggcgggcggatcacgaagtcaggagatcaagaccatcctggctagcacggtgaaactccaactctactaaaaatacaaaaaattagctgggtgtgctgacgggcacctgtagttccagctactcgggaggctgaggcaggagaatcgcttgaacccgggaggtggaggttgcagtaagctgag

SEQ ID NO: 181673 - DNA, 524 bp, Homo sapiens
cagaatatcccaaggatggaaaaacctccaaggaaaggaaacaagtatctttttgcttattgatgagcttcttataataagggttataagctctgttcactgaaaatacatgtaatactaatgggtttctttccaggacatacaacaaaactccagaatctacaaagatcagcagattatactccttcactgagccttcagaccttgaagtagaagacacaggggaagccctccatccccagatattccgagtctaactagagtacagccaccacaacacctggccaggttgaaacagaggattcctattccgaagaacttaatggggaatatatacctgttggcatgtggtgatgggatgtcacaaaggcatactttttctggttgatttgatgtcactccatctttttagctcacgggggacaaaagcagcaatgaagaaaggcatatggaactctcacagcagtcaattctaagaaaaaaaactgcaattaaattttcctttctcctaacatctagttttt

SEQ ID NO: 181674 - DNA, 496 bp, Homo sapiens
tagttttatacttcctattaagcttttcctgatagtttccttgttgaggcccttcaggcttttgctgatagcctcttaaaggccttgcaatttccacctgccacccagccccaaagccagtagcacagttctgggtttttgttgcagcatctcacttccaggtgccaaaatctgttccttagtcttgctgcctgaaaaatgacccccaaaagttagtgacttaaaataattccgtgatttctgtaggtcaggaatttaggaagagcttgattgggcaattgtggctcaggttcttgctttggctgcagtcagatggtagagctgaagagtagtgcacaggcaaggcagtgtgcacagctggagagggccgagctgagccgcctccacaaggtctctgtgtgaatttgtttgtgctgcttcttcagggcactcagactgcccacatagctttgtgtccaaatgtatgtcctgtgggaggatgagcagaatctgtatt

SEQ ID NO: 181675 - DNA, 257 bp, Homo sapiens
gggtcaggctgctcagctgcctagaggcctgggaatgcctagggggaagcccctgcttccggacacacaatcaattacatataacagtggggccttgtgtgtgtaggcgggacactgggaggggtcggctcacagctcatgttttaatgctttacaaggagagtgtgttcatgcattgcttctgcaacttataatcaatttaaaacattctacatcttgatctaggctggtggttacattgatatttacatattggg

SEQ ID NO: 181676 - DNA, 495 bp, Homo sapiens
aacttaacatctgttcatttttgctattagggtttgaatcaaggaaagagaattcatgagatggttgagaggattcatgagatagatgagcttggtagaataaataggccgtatgtggataaagccagggtgacccacaagtagtagtagaaggagggttaaaaaaagttagatgtatgttgggagaaggtttaatcttgtaagagtcaaggacagtttaaagataggaactagaaaagaagtaggaaactagcataaaaatatgagatgaattgggtcagtataggtgagaatgatgggactgagaagtaatgatacttggtggcaaggtttttgaattattaggcatagaccgaactagaagaagcagaaatttggttcgaaaattgggaagggagagataaatgacaatgcattgatctttaaaaagcttatactaagtcatatgggggtaaggagattcatcagaaaccatcagccttgtttctcctattt

SEQ ID NO: 181677 - DNA, 678 bp, Homo sapiens
aggcctcatacagtacgattccatttatatgaactattcaaaataaacaaatctataaagacagaaagattagtcattgacaggaaatgaacagaagaggaaattggaaggtacaaggcttccccttgggggtgaagaaaatattctggaattagataaggataatggttgtacaatattgtaaatataataaatatcacaaattgtatgttgcaaaatatttaaaatggtgaattttgttgctattttcaaaacatgtgtttccctggaaatcgtatcctaaaacttaatctccaatgcaacagtgttaagaggtggggtctttgggaagtgattaggccatgagggctccacctccatgaatgggattagtacccttacaaagaagcttgagggagcctgcaagctcctgctgccatgtgagtacacatagaagtcaccttctacaaggaactgaatctgctggtgcctcgatcttggacttccaagcctctagaactgtaagaattaaatttctgttgtttctaagttatcccacttaaagtcttctcctatagcaacccagatggactaagacatttgttaagtgaattttacctaaaaaaaaaatttctgtatcagagttgttaaagaatgatgaaactagcactcaatacctgaaataaaagagcaaacctg

SEQ ID NO: 181678 - DNA, 555 bp, Homo sapiens
  misc_feature (446)..(446): n is a, c, g, or t
  misc_feature (529)..(529): n is a, c, g, or t
tatctcgtcctgcactactaagccagaagaggaaatgatccagacaactcagattttaatgtaactgaaataagcacaaacttacacactagggctgatgtattacaatagagtacgatggacaataatactgggtcaaattcatccacttcatgtggacagcttgagtctccgaaagaatgcgacaatacattcaaagaacataaatgctggaatcagttcttgctagcaacacgagccagcaatgttattatgtgaaactgcatccaaaaaaaaaaaaaaaaaaaaaaagaattcagccaggcacagctgctcatctctgtaatgctggttgcttgggaggttgagatgggaaggtcctttgaagccaggagtttgagactagccttggaacatagcaagaccctgtgtctactaaaaaaaaaaaaaattttttttttgattanctgggtgtggtgggatgactgcttgagcccaggagtttgaggttaacagtgagctgtggttgtgccaccacactctaacctgngttgatagagtgagacccgtctgttt

SEQ ID NO: 181679 - DNA, 609 bp, Homo sapiens
  misc_feature (315)..(315): n is a, c, g, or t
  misc_feature (333)..(333): n is a, c, g, or t
  misc_feature (350)..(350): n is a, c, g, or t
  misc_feature (356)..(356): n is a, c, g, or t
  misc_feature (358)..(358): n is a, c, g, or t
  misc_feature (367)..(367): n is a, c, g, or t
  misc_feature (381)..(381): n is a, c, g, or t
  misc_feature (389)..(389): n is a, c, g, or t
  misc_feature (399)..(399): n is a, c, g, or t
  misc_feature (408)..(408): n is a, c, g, or t
  misc_feature (447)..(447): n is a, c, g, or t
  misc_feature (457)..(457): n is a, c, g, or t
  misc_feature (464)..(464): n is a, c, g, or t
  misc_feature (471)..(471): n is a, c, g, or t
  misc_feature (504)..(504): n is a, c, g, or t
  misc_feature (531)..(531): n is a, c, g, or t
  misc_feature (538)..(538): n is a, c, g, or t
  misc_feature (540)..(540): n is a, c, g, or t
tatctcgtcctgcactactaagccagaagaggaaatgatccagacaactcagattttaatgtaactgaaataagcacaaacttacacactagggctgatgtattacaatagagtacgatggacaataatactgggtcaaattcatccacttcatgtggacagcttgagtctccgaaagaatgcgacaatacattcaaagaacataaatgctggaatcagttcttgctagcaacacgagccagcaatgttattatgtgaaactgcatccaaaaaaaaaaaaaaaaaaacccattctagggtggtccacccataaanggaaatgagcaaagtaancaatatgtgggggtacntggtangnaatgagggntgtcccttcgggtnaggagtgnctggtgcaangctgacaanggtgatatgtgattgctagtaagtggaatacaagtgggncacagagaantgggctnctaagtncggcctaaagagaaccttctatgtttggcccgngtgggtaaagatacagctcagatgtanatgctcnangccatggtttaactcagggaatccatagggtggcccatccaaggggtggccgggggaccctcaaaagtc

SEQ ID NO: 181680 - DNA, 228 bp, Homo sapiens
aaccttaacaatggtattatctcagggtgaagataattatccatctccccttgaggtactaaatgttcctcttcacccattacaatttgttaaaaacaaagaattttttttgtaaaaatacaaagaaagaaatggaggcaaatatatgagccattccttaagtttttatgatgaccaatattccaattctatcttcaaaactatcaccaagtaagttgtacgcctgat

SEQ ID NO: 181681 - DNA, 529 bp, Homo sapiens
aagtcatatcatcatgggcatgaattctagttccctcacttattagctatgctaccttgggtcaattaacctctctgagactcagctttctcatctacaggataagaataataatcccttcctcataaggttgttgtgtgaatttaataatatattacttgtaaaacacttattggggtgggaaattaccttgatgcaatggtagcttccacgtacgagtcaggccatcccagagggtcatggaactcagatggctgagttcaaaaggctcagatcaaattgagatgcctgagtcacacagtttattaaatcaatttattttcattttaaataagtttattcaaacaagacatttgacttgaaaggaaaactaggatttttttttaagagtaatgtgtcattactgaaagattgccttacatgtaatagccacgtacaaagagttataaaattgtcttggctaggccggcacggtggctcacgcctgtaatcccagcactttgggaggccaaggcgggtggatcacctg

SEQ ID NO: 181682 - DNA, 409 bp, Homo sapiens
caagaggagttgaggggaggtgctatgcacttttaaacaaccagatcttgtgagaactcatcactatacagtaccaaggaggtatggtgctaaagcattcatgagaacttcgtccccgtgatccagtcacctcccaccatgccccatctccaacactggggattacaattgaacatgagatttgggcggggacacagatccaaaccatatcagcaggcatttcccaaaagaaaaattcaaatggccaataaacatgaaaaggcgctcaccctcattgcaatgagagaaatgaatagtaaaaccacgagagctctacaaactcacaggaattgctacattaaaaagactgacagtggcaataccaagtattggcaaggatatggaacaacaggaattctcacatgctgcc

SEQ ID NO: 181683 - DNA, 686 bp, Homo sapiens
taaatcagctcggtaccgattacgctcctagacgggaggtctggaacggagacatggggagaatggagggtcctagagtcaggctgcctgggttgagtcctggctcccctacttattagctgtgtggcttgaggtgggttacttaacttcttggagcctctgtttcctcttctgtaaaccgaggctcagagagacaaacagacttgtccaggctccccactgtcatgccaactggtctattcagaaggaaacccggctgggcgcggtggctcaagcctgtaatcccagcactttgggaggccgaggcggattgaattcctacaaccagcccatgatgtgagtattatccccatttcacagatgaggcaactgaggctcagttgcccaaggcctccttgctagccagcagcaggtccaggcttcctacctcagtctctgccacgccacagagccccgtttcgccatccccacccacgctattacgcacccactgagggaggcttagctaagagatgtggggtaacaaactgtgctgtgaaccaggaggcccaggggctaaccttacttccagggcacacttgctgtgtgaccttgagcaagtcacagactctctgtaagcttctgttgcctcgatgaagacagggagacggatggcctggtttgccccataataatttatctgtggt

SEQ ID NO: 181684 - DNA, 201 bp, Homo sapiens
tgcaagacttagagggtaaagggaaaggctgggcacagcacattggagctggcatgagaatggagacaaggatgacagggtccaggagtgaaacttgagttgctaggtttccatagttgcatctcttaaataaggcattctgggtctccctctccccacacatatacacacaaatcttttaatgcttctaccaaagttatt

SEQ ID NO: 181685 - DNA, 1280 bp, Homo sapiens
actgtatggcccctggcctggtctcagattggatcataagctccctcattcttgtatccccatgcccaaaactgtgcctggcacttaagggcccataatacatatttttggctttgttgaatagtttaactcattagtgatgcaaagtcccaactgcatatttagagatatttatgtgtgcactacattatggatcgtatgggtgagaaggaggaactcaaggagaataaatcatactttccctccccaaaatgtttataaagccaccaagaagacaggacatagacacatcaaatataaataaaatacaaaaggatgtaccctgacatgccaaatatgtgttcacagcaaacaaagttcctcttgccaaattcctgttgtctaaagcagtttttcctaaaacatattcttcagaataccagtttctcagagtgccaatgtgaggaaaagctttggtggtcagatgagtgcagggctgggttaggctgacttctttaccagagggcttcctgaagacttaaagaaatctgtattgagatataatttgtatagcataaagttcacccactttaagtaaacaactcattggcttttagtatagagttgtgtatccatcaccacaatgtcactgcagaatgtttccatcaccacccaaaacacctcatgctgtttgcagccatttcccatccacttccttcctagcccctgacaaccactaatttaccttctgcctctatagatttgcctattctggacatttcatacagatggactcatttactgtgtgatcttttgcgaccagcttctttcatttaacttaatgttttcaaggttcatccacattgttgcatgtatgcactgatggacatttgggttgtttccactttttggctatcataaataacgtcattataaacattcatgagcaagttgtatttgaccatatgttttcagttctcttgggtctatacagaggagtggaattgctgggtcatatggtaattctacattgagcttttagaggaactcccagactcttttccaaagcaggtgcactattttgcattcccaccagcagtgtacacgagttccagtttccctacattctcaccaacacttattattgtctgtccttttttattatagccatcccagtgggtatgaagtagtacctaattgtgattgtgattttgatttttgtttccctaatgactaattgttttgagcatttttcatgggttcagggcctttgatatgttgattttttcacaaatcttcaa

SEQ ID NO: 181686 - DNA, 1352 bp, Homo sapiens
gagggatcttgcagccgtcagaagctcagatttaagaagtctctgcaggatacggagcaggcagcaggagttgtcagcgcacggaatacagagtggttcccgggtcacgatggggtgtggaggcgggggtggggggagatggtccagagaaagatggtccagagaaagaggggcagatttggagaagtctttggagaggatcactggccaagtggaagaggcggatgaagagctccctgggtgtgctgctgaccaaggcagatctggaggcagagtcaaagcaacagtcggcaatcgggcaatttatgaagacgttgaaggaaggagttgacacacggattcagtcagaaatttcaaagagagtagagtgaaaagaagggtttggtgaaaagattcaggcattcctggtggaggtgacatagtggagcaggacatctaccagaagtcccggggctatggtccatgagcttggccctggcggagtgaggccagtgcagcctggctccgctgcaggagatgccaagacaaggctgccctctctggaacaaaagtgacctcatttctcaggtactgctggggactgccggccaattgccaattttgcctctccttcactcaatgaagaagtgtttgtctttgcaaatacaggaagcgctcttttttgttttctccttgtgttgttgaggctttgctgtccaggagtggtttctggggagggccaccccatccaatgtccccaccttttttgacctttgggtgctttatttgggctggtgagaactctcttttgtcctgggggcagttctgagcttataggccactgaggtcttcatatacaacagggcctattccttttgtgattgggtagtcccaccaactgtaacaccagaatcatcaggaggtagagcccaatcaggagagctgggaatgaatggctcagaaccggtgtttggcacacatgtaggacaagcattcttcatgtgtcttattttgaacagctgtctggattgttgtctcacaggttttggcattatgtgacccccacatccccaattctgtcctgctacaggccgtaagatttcagggggaccattcccagggtggtacctgtggttgatatatgaacttccttgtcccccacaaatctccacagggttcaaacccagtgttgaatgagtctctgtttgaaattagattagaaccaccacttgggaagggcaaagagcagacagcctcaacagtggtggagccaaccatgaacttctcaggagtgacctgtgcttccttcaaggcagtttctgttatgtgtatccttctaagacctgcatttctttcaagactgatcctgtcca

SEQ ID NO: 181687 - DNA, 359 bp, Homo sapiens
ctgaatttcaggacaccctgagccaggctgcctccataggtccaagcacgtttgcaagtattgattttggaaactcctcctagaaacaataagggaaggtcagagaatgaaaaaagatgcgtctgtgaataaaataactgacttaaattaatttcaaatgccaataataataataatttcaaaggccaaagccctgcaagtgaatcacgcagggaggaagatgtggaaactctgcttctgaggttggttcccagcagaggtcatgcaggaaacttggggcataatacaacagggtttaaaaatacactacgaggggaagggtgatgaaatgatcctctcgctcgcagaacggtgctagg

SEQ ID NO: 181688 - DNA, 276 bp, Homo sapiens
tagataccaaggttaaagtagcgaataagatgtgagctcatggggtttacattctaatgaagggagacaataagagaggatgatgcagtaaagcaactaagtggctactttagatcggttggtcatgaaaggcccctgaagaggcaaaattgaagccgagatctgaatgacaagtcaagtcaaccatgcaaagattggggaaagcatttcaggccaaggaacagctagcacaaaggctctaaggtagaaacatgcacaacatgttgaagaatagga

SEQ ID NO: 181689 - DNA, 495 bp, Homo sapiens
gtttgatcttaatttcaaaattcagaacagaagccacatgtggctcaacttgactcaggcttccttccctagtccagtcagctgtggatggggtgtgaattgtgcagtataaatgtggctggccaggactggggataaggggggttgttctaagggaaagacaatagtttcttttgaactaggctgccacaccaaaaggcatacctttttctactatctgttctggtggtttttttgcttttactgtttcttcatgtttctctcaattcctaaagtatcattgcatcctaggtgcggttttgaatgacagtctgttgtttgtcagaaaaccatgattttacttggaatatgatttcatttcggcggaagccctacttgtttatcatgtaggaattaacttttctattaccaaatttagtcactcctcacattcccacatttccgtctttgtaattcaagctgttttcagtaggtgtatattcctgattctctcat

SEQ ID NO: 181690 - DNA, 156 bp, Homo sapiens
tgccaaaaaagtacatttccatttgtgtcaacaagatgtgaattaaagaataaagaaaaatgcagaaaaaattacatgtgttctcaacttaaaccaaaggtgcaacattttagagtatcagagtagtcattgagactgtaaagttcagttgaatct

SEQ ID NO: 181691 - DNA, 377 bp, Homo sapiens
tctgcctcctgggttcaaatgattctcgtgcctcaccctcccaagtaatcctcaactgggattacaagtgcccaccaccacgcccaggtaatttttgtatttttttttttttttttagtagagaggggtttcaccatgtcggccaggctggtctcgaactgctagcctcaagtgatccatccacctcagcctcacaatgtgctgggattacaggtgtgagttaccatacctgccattggaagtctattatctgaagagagtagactagaggatgtgatgggggctggcccagcacaggtgaggacctagatagtttaccagtaacaggggcatgaaatgactataactttcatgaatgctaaatactgagagccaac

SEQ ID NO: 181692 - DNA, 288 bp, Homo sapiens
tcatttgactcacaatctggggcttttagaaccctctcctgaatcattgatgagttaggctccgtgcccagtcacgtaagggctttgaatcctatgtagtattaacccccaggtttaacacaggcaaagtaatacctttgtggcaatgtcaggacaattacagctctcgtttagtaccagtctgcctatttctatggactatccagttttattttggtcactgctctatttataaataaaatagcattttattttagtatattcctaacagttatttgaagttttcat

SEQ ID NO: 181693 - DNA, 296 bp, Homo sapiens
tacacatgtatgttcttttacactgtgtcattgtttgtaaaatatacagtatttatgtacagtttcagagacattcaatattgaaaaccacttcagttagcctcctagtgaatactattaatttttcatggattacatattaccatatgaccccataaatacattttattagttactttggtatcttcaaattggtaagaaaaaaacataaaacaaaaatgttcttattttctgcaatttttttttctagccattccttcctcccaaatagaagtgagggcaattgtagagagagg

SEQ ID NO: 181694 - DNA, 358 bp, Homo sapiens
tcattttcatgtataaggtatacatcgcttttctaaaacaccaacaatgctagattatttttgctttgatttgctttgtttttttcatattcctttgaatgatttagttattacttctctttgtttaatattttttaaagggataactatttatcctaactttctctatactggaaaaacaccccctttccttcccccatttacaggattgtgcaacctttcagttaaacaaaaccaaaattgttcacttgctcagtgttccacccccttgaaataagccacatagctctctatgggtgtggcccagcgtctttggctgccacagttacttgatccccttatctcatgtcacccttgg

SEQ ID NO: 181695 - DNA, 160 bp, Homo sapiens
agtccaaaccaatgtatacgtttcatgtatacattagtatttgtattttacttttactatatatttatggcactatatcttgacttacaattttgttccattgatttatgtctttgcctgcaactcctgtctccctgaaatgtgtaaaaccaaactgtaa

SEQ ID NO: 181696 - DNA, 1074 bp, Homo sapiens
cggaggcttgccctccttccctgcctgccgggtgcgtgtgagcggctgccctgcggatgctgtcctggacctgttggcaccacagacagttgctctgctgtgcctgtggcctcggggcaaagagaaagtggcgatttctacactcagtgctcgggaaccagtgggcactgagaatggtttatggcctgacattacttgcaaccaaagccaggcagcatttggattttcgcttttggaaaccaccttacctggtttgctccatgagggaggggcagcaacatcgctgggaaccctgaggtgtagatatgtataaatgagctgtgtgtgtatctgaagctcgggcacttgtggggttaccaggagtgtgcgtctcactcccaggcctcgttctggaaacgattctgtaggtctgtctgggaggccttaggcaagtttgattaagaacagtcgagctggataaacaggctgttccttgtccagcactagtcatcccaggggggcgggggcggggctgcaactcctgtgcacaaaggaagggccctgggtaggggtcaggagctgccttgcccagagatgtgtctgggtcactttggaaacaggaatcctctccccaaaatgggtagcaatgggggtacagaggccaaagacgcagctgcatgtcctgcagtgcctgggacgccccgtagtgaagagtgatgtggcccaaatgtcagcagtgccagtgtcagactcctgctaagagacagtatcaagaaagataacttcaaaatacactttctggaggcctggcgcggtggctcaggcctgtaatcccagcactctgggaggccaatgcatgtggatcacctgaggtcaggagttcgagaccagcctggccaactgcctgaaaccccatctctactaaaaatacaaaaattagccaggtgtggtggcgcaagcctgtaatcccagctatttgggaggctgaggcaggagaatcgcttgaacccgggaggcagaggttgcagtgagccgagatcgcaccactgcactccagcctggacaacagagtgggactctgtctcaaaaaaaaaa

SEQ ID NO: 181697 - DNA, 222 bp, Homo sapiens
gcccaaggagagatatccagaatatatggctttctgggggctgggtggacaagaatctaggatttggaacaaacagagattaagccacaagcaaaggccaccctaacatcataaattaggagatgttgctattacaaaacaggaatttctgcagaggaactttccggagtttggaaaatataccagaatccgagaaccgtcagacccattatgctccataaa

SEQ ID NO: 181698 - DNA, 758 bp, Homo sapiens
atcatgtcgtggctcgtacaggctgtgtgccatctctttggtccatttgtatctgtattcttagctcttagtatcaggatttgcccggaggtgttgaagctggcaatcatccttccattccaacaagaataaatataatttatcacatatatgtatgaaataaatgtatttaatatgtatagtaaatgttgaaggtttttaaagaagtgatggaatttgtaactaattcatggaatttataacagttcaattcattatatgctattgaagtagcagtctcatttttaatctcagaaactgtttctttcataattcatgttaaattaagaagtcatttgggaatttaaaaagcatctggactttcctccctgccccccttccacaactgtctgtgaataaattgaaagaggaaaatagtgcttacataatcttaaaccttttcttttgacatgtcttggaatatttaatttctattattgtgataatacaagtaaaacaaaattatactacaggatttatagatgtttactttttttgaggaaaatcactcaaaacaataagcttttaaacccaaactcaacaatcattgctttttgttcttagtgatagtgcttgtgctgatacaatatgatcaaaatatttggccagtattaggaaatgtcctagagatgattataatagtaagagccagtcttaattggtaagtgccagatatggtgctaagctctttaattctcatgactaccttaggagatagg

SEQ ID NO: 181699 - DNA, 266 bp, Homo sapiens
tttcccatcttactgtttgttttctattcattctacctcgtttatgtttgtcccttctttcttgctttttaaaaatgaatcatgtgttttgttttattctgcccctatatcatctactgttatcctctcacatccactagtgtttagttgtttctattttattcttttgggggttaaaatagacctcacagtgtgcacctttgacttactgctaagagaaatcattgctttggccacttccctgataattctaagacatcaaacca

SEQ ID NO: 181700 - DNA, 356 bp, Homo sapiens
aattcgaggatggctgctgcacattcctacctgggaattcctacctgggaactcctacgtgggaagcttgttaaagtacagattcctggaccttggcagcacagattctggtttagtgggcaggcctaagaatcaacattttccaaacgcttcccaggtgatgatgatgacaccaaaattggaaccacaccccagactatagttagtacctgcctcaactgaaagagaaaatagtctgggctcggtgaaaccctatccctactaaaaatacaaaaattagccgggcatggtggcaggcgcctgtaatcccagctactcaggaggctgaggcaggagaattgcttgaacccaggagg

SEQ ID NO: 181701 - DNA, 278 bp, Homo sapiens
aattcgaggatggctgctgcacattcctacctgggaattcctacctgggaactcctacgtgggaagcttgttaaagtacagattcctggaccttggcagcacagattctggtttagtgggcaggcctaagaatcaacattttccaaacgcttcccaggtgatgatgatgacaccaaaattggaaccacaccccagactatagttagtacctgcctcaactgaaagagaaaatagtctgggctcggtggctcatgactgggaccccagcactttgggag

SEQ ID NO: 181702 - DNA, 228 bp, Homo sapiens
aattcgaggatggctgctgcacattcctacctgggaattcctacctgggaactcctacgtgggaagcttgttaaagtacagattcctggaccttggcagcacagattctggtttagtgggcaggcctaagaatcaacatttctctaaagaatatacatgaatgtccaacaagtacatgaaaagatgctcaagatcattagtcattaggaaaatgcaacctaataccac

SEQ ID NO: 181703 - DNA, 574 bp, Homo sapiens
tgggatatagtagtcagagcttcccttatcatagcttcatactgtgcattttgcttgcttctcaccttcactaggacctgctctctgtaagggtggaacacaatcctacatttctcactgtcagcgcagtgtctgcatctgtacatgttcactgaatgctgaccaaattttcttgactttagagctaagtatgtgagaattaaatgggattttctttaattgatccagaaactgcttagccggcacttgtattatgtttaacatttgcttccattggaaaaagaaggcaattactgggcatcagtcatgtgtgccttgacaccttttaaatgtttcatttaattatctcaataactctgcaaagtaggtgtattatccccgtttttaccaatgaagtacttgagatttgaaagttatgtaacttgccccaggctggtgaaatgcctgcgccacaactgcaatttatctgatgttaaagttttttgaaatatgacaggctcacgtttgaggactgccttatgtatagttaagagaccacatgttgacttatttggactttgctgtgtctttagaa

SEQ ID NO: 181704 - DNA, 494 bp, Homo sapiens
ccagccaagatgtagatgtagatgtgtgtgtgtatatatatatgtgtgtgtgtgtgtgtgtgtgtatatatatgtatatatattttttaatccaagtgccataagaggtgatttaagtctaattcctactttgttgtaaattgctttgggcagacaatttaagcctagacccaacagtgctattcaggttaggggctgtcagtgtttggtagaaaagggcaaatttaggccaggcatggtggtcatgcctgtaatctaacccttggggaggctgaggtggacagagggcttgagttcacaagttcaagagcagcctgggcaacatagcaagacaccccaccccaacaaaaaaaatttaaaaattagctgggtatggtggtgtgtgcctgtgggcccaactactcaggagactaaggcagaaggatgacttgagcctgggaggcagaggctccagtgagctgaggtcgcactactgcattccagcctggacaaca

SEQ ID NO: 181705 - DNA, 367 bp, Homo sapiens
actctgcatttgtcaaattcgtagaactgtacatcacagagtgactttatataaatttgtaaaactcaaccaggatgtgtatgggagggggcacgtgtcgggcacagggaggaagacagaatgcagactgagatgaatgaagacagcagaactcttacaaatgatttccataaccacactgcaaggggatagaagaagaaaggaaccgacttaagtagctgggaaacattggttcaaccgatcttataagacagaaaccaagaagagtcgtatataaacactgtacttcagctgggaatttttctccctcctcaaaagtatatgggttaggggccaggtgtggtggctcacgtctgtaatcccagca

SEQ ID NO: 181706 - DNA, 480 bp, Homo sapiens
ggaagagcaatggattgaggtccgaacctggaggatctgctatacgcagagctgggaggagggacagagtcagtaccagagtcggaaaaaagcagggtgggaaggggaacctgagtcaggagacttgcctggcaggcgctgccctgccagcagaggcctgacagtggtttccatgaactgcatccctgctgtgggctgggacagggccactgacacagtatcggagcacagagggggaaaggagcaggagggattccaactctgccagttagcagctgtgtggctttgggcatgttacttaacctctctgagcctcatttatttcatccataaaatggaaataaaaataatacttttgtcaaaggcgcattgtgaatatttagatcctcagaataatgcctggcttgtagcaaatggtagctggaggaaaaggaagagaaaaccaaagtcagcagctgaaggattttcatattagaactg

SEQ ID NO: 181707 - DNA, 184 bp, Homo sapiens
ttgagagtatctattcgtagatttcattaatgtttaccactaaggatgtctcattctttctgcaattctaagtaaagcttgcatacaggataatcttcaaagaagtagaatgactgggtcagagttgtaatgagaagactgtaacctccacgatggcaggggtgtccccaaaatctagagccca

SEQ ID NO: 181708 - DNA, 398 bp, Homo sapiens
tggccaagggcattcctttctaaggaatccttagcaaataaactggtcctctacagaagaaagcataaaaaagggacacttggaagaaattcaaaagaaaagaacctgctgagcagtcaaattccagaaggccattactggtgcatctcttgctaatatagtggccaagaggaatgagaaacatgaagttaaaaaggctcaatgaaaacaagctagcagggctgctaaggaagcaaaaaaggctaagctagcatctgaaaagaccgcaatggctgctgctaaggcagcatctacacaaaagatggtgaagcctgtgaaagtgtcagctccccgaggtggttcaaaacaccaagttggcagatcagattcttaaagattggactgtagaaaaatataaa

SEQ ID NO: 181709 - DNA, 332 bp, Homo sapiens
aacaagtatctattgagtgaatgaatcaatgaatgaaaaatatactatttaatggaatgcaattcaaaaaatgtttatctattacccactgcatggttggcactgagctgagctccaggaaatctaataaatgaacaatcttgtgcgggtgttgcccgaggcattaacctcagtccccttctcagatcttcactctctctgggcaagcacattcttcacagtggctttaatcaccacctttgtatgtaaggatacaaaaacctgatctctgatcacaaagacacttctccctagataatagccactttactaacccagaatcagaccaatag

SEQ ID NO: 181710 - DNA, 193 bp, Homo sapiens
atcgcgccactgcactccagcctgggcgagagagtgagactcggtctcaaaacaaaccaacaaaaaaggacatggaagtgcagaagggccccccgctggctggatccggggtggtgtgtgaagagaatgctatctcctcgtctccacctccccggcccccactcttaccacggcccccctgcacagccttccc

SEQ ID NO: 181711 - DNA, 351 bp, Homo sapiens
gtagcacatgccattctcctgcctcagcctcccaagtagcggggactacaggcgcccaccaccatgtccggctaattttttgtatttttagtagagacggggtttcaccgtgttagccaggatggtcttgatctcctgacctcatgatctgcccacctcggcctcccaacgtgctgggcaaactccaagttttaaaagtcctgaagaaaacaacatcaatgcacatcataatcaaatttcttgaagcaagtgataaagacaaaatcttgaaagtgaccagagataaaagcacattacatagataggaccaaagataagaatgacagccaacttttaggcaatacaaaccag

SEQ ID NO: 181712 - DNA, 221 bp, Homo sapiens
ctgctggataagagtcactgtgagtcagaaacttggattcgagctggctctggcactcacaggctatgagaccaactcatatcccatatcccagcatttctctgaggctgttttctcatctgtaaagtgaggaagttgcattcccatcattttcacaaatgaccccaagttgaacaatgcccggtgttaagggcatcagtgggactcacaacatctccctg

SEQ ID NO: 181713 - DNA, 119 bp, Homo sapiens
atacccggaccgtaaaatgtcacaggcggactgtgtaggaagaacacctgaattctggggaaaagcatcattcatcacttttttgctttaaatactcagaaatattttttctatcatct

SEQ ID NO: 181714 - DNA, 565 bp, Homo sapiens
tgaggatgagtcttgctctgttgcccaggcttgagtgcagtagcttgatcacagctcactgcagcctctatttcccaggatcaaataatactcccacctcagcctcccaagtagctgggactatagctgtgtgtcactacacctggctatattttgtattttttgtagagatggggttttgccatcctgctcaagctgctcttgaattcctagattcaagcaatccacttacctcagcctcccaaagtgctgggattatatgtgggaaccacatatgtccgaccccctctgattttctgcctcatctgcaactagggacagtttaaaaaattattttccaatctacgtgccttgtttccttttcacaaataggatattgacattgatgaagttaagatacataactttctgattaccacaggatcctttactttatcctttcgtagtcacacctcactccaatatgtggctacaatttctagtggtatgttaaatacagttgacatccttgatcttagaagtaaacattcagttttttactcttaagtttagcattaataaaaga

SEQ ID NO: 181715 - DNA, 726 bp, Homo sapiens
gaagcaaaatgaagcctaagtaatactgggcaaggacataggagatgaagctctagtaccaactctgatacttactgtgaaacttaaagcaagtctttatcggcctcgattttctccactacaaaatgggaacgatgataccttcacattcttttccaaagacagtaagaattagatcaactgagaccatgaaagtgaaggtacgttatgacatcaaccaaaaaaatactgtgcctaaataagagctagttaatcataggcagtgttcctccctttgggctgttcttctgggtacagaagagaaaaagcttccctctccagcttcctgtaatgtttgctccaaaccctagctccctcatggccactggcaaccatactattgctgatcactttccaggaaatcgagaggagttagggcactcctattagatttgcttcaagacgctggagagcagacaaagggaaccattctgtcaccctgtattctcttccccttccttcctaggtacaaagagaagggattttccacttgcaggctctgggcaggctgagtgaatttgggaagttgtttctcttcactgagcctctattccccattatgtataatgaaaaggtgaaacagaatggtatttaagtttaggggtggccacgaaatttactgtcaaaacagggacacttttaagaatgaaaatatgaggccaggagcggtggctcacacctgtaatc

SEQ ID NO: 181716 - DNA, 377 bp, Homo sapiens
taatcgagctggtccgatttgctcctagacggggtttcaccatgttgaccagactggtcttgaactcttgacctcaggtgatccacctgcctcggcctcccaaagtgctgggattacaggcgtgagccaccgcgcccggccataggcaagtcctttatctccattagccttcagggggtggggaggattagactttattttcctccattttactgatgaggaaacagagactaagagatatgaaatggcttacacaagagtttcctgctcaagggtgtggtatgagacagcttctaaatcttggtcaagatgacagaaaaagaagaaactcacttctgagcaagcctcaggcatgagtttggcactaaaatcgtctg

SEQ ID NO: 181717 - DNA, 426 bp, Homo sapiens
agtgtgatgttcacaaaacaatgaaatggcctaacgacacatttctcagaacatatccatattgttataccatgcatgactgcatatgaaatgcttcatacaaagcttggcattcataattttaataagttgttggccaggtgcggtgccatgcctgtaattccaactctttgggaggccaagttgggaggactgcttgaggccaggagctcgagaccatcctgggcaacacagtgagacctgtctctacaaaaaattatctgggcatggcagtgcatgtagctgggcaaggtggtacatgcctgtagtcaaagctacttgggaggctggggcgggaggattgcttgagttcaagagttcgaggctgcagtgagctaactatgccactgcacttcagactaggtaacagagtgaggccctgtcacc

SEQ ID NO: 181718 - DNA, 581 bp, Homo sapiens
tgattagataaatatataaatttcattgaagcactacaggatttttcctccctttaatgtgtaaagtatttttttgtgcattaaataagaacaaaactatgctcaaaaagcaaaataggcccatttaacttttacaaaatttactgctgatgtttagcagataaactagtttgattctgctttggttagaagtgttcaaaatttaaaaattttttgtaggataactattaggttcatagaataatttcaggttcttttgatcttcttgtgttattaatcctaataaaacattatttgaaagtacatagacaatgtctagagtttatcttttgaaaaaattattgtgatttttttttttttgagacagagttttgctcttgttgcccaggctggagtgcaatggctccatctcagctcactgcaacttctgcctctcgggttgaagcgattctcctgcctcagcctccagagtagctgggattacaggcatgtgccaccacacccaactaattttgtatttttaatagagacagggttttgccatgttggtctggctggtctcgagctcctgacctcaggtg

SEQ ID NO: 181719 - DNA, 432 bp, Homo sapiens
gaaatggggcataaataacagaaaatagcttgcctctgtatcgccccgggaaatattggaaaatgccatgctaagcccaataacagcagggagtatgccacttttgtctaatactggacatgctgtgctggcacatagtaggttattgagtttaatatttcggtgaatgaaggtcttgccaaattctttgagcaatggattttgcatttacactagctggagaaagggagttacattcagagcagcccaactgtgtatttttagtggaagaagaaggctctttcttaggtaagaatataaaaagaatcgtagatatagaggtggaagggacaaaagaagaagcaatagcatggtctccatactaatcccactttaaaggtgagggcgtggagaaaccatagctggacagttagcaacggaagacagctatga

SEQ ID NO: 181720 - DNA, 194 bp, Homo sapiens
cattacacagcataactattgcgcaatatgactgaaagatagtcatgtcttgaatctcaaatcttcagaatgataaaccacaaaactctactttgacacctaatgtatacagatgaatgtctgtctacttcctactggaatcgtgatagttgaattaagatttttttttttttcactcaaaatagtttatgcgg

SEQ ID NO: 181721 - DNA, 202 bp, Homo sapiens
attcacccacatccatccccaggcctgaatgtaagggctcaaacagacctgcaaatacactcggcacctgcgagtgggcagctgctgtgcagaccaccccatcccattttctggtccgttaaactcatgcataatggtcgtagcaatggccaagttgtcattgctgggcagaaagttccgtttaagacaggaataataaggc

SEQ ID NO: 181722 - DNA, 1113 bp, Homo sapiens
cacttgattttccacatccctttagcaattatgtatagtttgcacttcattaacctacccttatttatgttacttctcacatacacccatatctcttctgtattttcaatcaaaagataatgcctcaaatgttatatatattgtatgtgccactcaacagtgcctcatatgctgcaaaaaaaaaagacagtaaacaatcggggtacctttttgtcttttaagccatattttctgggtcagtgtggtctttcaagggagtttagacaggctctattttttgttacttcactcctatagtatgtgactgtaaattgttccttcagtgttcaatttaagtacaaactaaagagaaacagtttcctaaagaaaaacattttaaagttacagagacacctatgtgttcgtaacatttctccagaaatatttgaagtaacgtaaaacttctggactggtcagtttaaatattttcttggaatttctatagaaatttctgtggaatggtgttatattggaaatattaattaactataagaagactcctacttcttcacagagaacaagcagggatatcctggattttcacagtatttaggccactccttagttgtctcatgaaggaattaaggtagtggaacacattcaagaattgcttaggtgtcaaaataagacaaagtgtaacagtttttttctgtagtagatttttaaaatagttaaaagactctgccctctttatctatactgtattctggcaataataaagttgggcagcctatacataaaagcaatttctaacaatgccaaattaacagcagtttcttggccctttcctttccctccatgaaagttacaatattaggttatttcacaggtttcctccatgccccccatacccaacctaaaactgtgttaggctgtcaaagaaaacaaatcaggtaagattagtgtttgcctttacgcagtcattctaagtacacataaaatcatacataatatgaaaatacagcaggaagagaaacatcaaaccatagaactgagttttagttttactgacatttatatggcatacttcctgtttttgatttcagaagtgcaaccatgcagtgcttctatgaa

SEQ ID NO: 181723 - DNA, 653 bp, Homo sapiens
ttctttgcctgactcctcttcttctgcctttcaaatgccccttggaggtttccttctggggaggccatctctgaatgccccttagcctgagctgaactggacatttcccagcagcatagtgtaactccccatcctctctctcctcgggtctttcccatgctgtgaacttcaggcctaacagtggtgggaccagggatccattggtgaagtggatggacagatgggtggatgcatgaagccgaaaatgcagtaggagagtgaggcttagagagggacgggagccttatggggtcacagagcagggcaggggctccaaccctgggctccagactccctgtccagtgactcaccaggctcacctccctctctctggagcccccactctgaattcttagcaaaccagatccaaaagggctctcagccgagggaggggagccgggggcttcctggaggagcatctgggatcatgtccacctcacctgagatgccaggccccaccctggggagctggtggtaatttctcctggcgctccaagccccgctcacagggtccagcaatgcggccagctggcaagtcacactcggcttgttggggatggggaccatgtcctaggccagggcttggagggtgggggtgaggggcaccatttaca

SEQ ID NO: 181724 - DNA, 536 bp, Homo sapiens
gtctggccaaaactcctggttatcccggaggtgggacagcattgtctcatctcataccggctctgccagacacaagctcttggtattgtggagacgactctcatgacaactttgtggctggctaaccagagctgtagctttgcaatgacttaagagcagttttttgtgctcttccgaatggggttccacccccaaatccacaaattcttgcgagatgcagtgaggtaccggctcgaactggagcaggccaccgccaggccgagaagttctttcttagtgtccattatgtgattcctaattattcattgagtgatacagtgaatattctacaaatttaaaagttctgtgagtttaaatacaacctaatgcatttgttctgggagtgatcaaagcccatgattttcactgtctttttttttttttttttgagacagagtcttgctctgctgcccaggctagagtgcagtggtgccatctcggctcactgcaaccttcgtctcccaggttcaagcgattcttctgcctcagcctcccaa

SEQ ID NO: 181725 - DNA, 346 bp, Homo sapiens
aaactgggggaacaaagaaagagggctgtatgtctgtttatgccccgtaattatgtataaaaggggttatatatataatcacagaaaaatgactagaacacagaaaaatgttaatagaggtaagatatggagtctgagtttacatgagacttaggttcatttttgtgtatttctaaactctacaatgaacatacattgtatctccctcatcccaaaaagtcacgtcaaaagttatgttttttaaggaaactactgaagtagtagtttctattccagagtaaccagcttaaatctattgtgaaattaaacaggatctaaataaacaaaatatgaaaaaacttctacg

SEQ ID NO: 181726 - DNA, 815 bp, Homo sapiens
cggctaatttttttgtatgtttagtagagacggggtttcaccgttttagccgggatggtctcgatctcctgacctcgtgatccgcccgcctcggcctcccaaagtgctgggattacaggcgtgagccaccgcgcccggcccacctgactattttttattgtttttttttttttttggtggagacaggtctcattttgtttcccaggctggtctcaaaaactcctggaagattttaatttttaggaatgtctttctaataacagtatggaaatggtgtagaggaaatgagattggaagtaggagattaataaaggagatattaaaatccaagaaagaataacgacctggcttggacaaaggtaatgctatgagattagagattaggaggtaaaattaggagcatctcaggatggatgtgataaggtggacaagaacacagatttggcatgattgctggtttctagcttctgggatagggatagatattggggaatgaatgaagggagcagattatagtttgagggtgggaaaaagaatattttaaacatcttggaggtattcaaggaacattcaagtataagatgttttattaagtatctgagtactatttgaaaatcattaggtttgggcatatagggatgaacaaaacatgtcccctgccctcttagatattatagatcattgagggaagaaacaaagtaaatggcacttttcacagtaaggatcgatgaaggaaaagaagagcgtggatgagaagatggcaagggaaccaaaattagaacatggaatttgggggatgctgccagggaagctta

SEQ ID NO: 181727 - DNA, 870 bp, Homo sapiens
atggtaataataataattgtcatttgttgctcacttgcagcctcagcacagttagaagaaaccttaggcaagttactgaactttatgctttacctgcaaaatatgcatagtaatacctaccgtacatagtcattataggaaatacaagataatgtacataatgtgcttagcataatgcctgccacatagtactcaagaaattgtagcatttattttactgtatcatgcaggctggctgagggtgttactagaagacatcactagaatgagatcccttttttctcctacagctttatgttactcccacaggtcttttttatttttatttttttaaacttattttattttattttttgtgactccagaaatatgcttatccatcccacgggtctttggcatgcttttgccttcaagtttatcatttctaagcaggtgcatgtctctggccatatgtagagtacttctctacctctgtaatcagcaggcctgttgtttttgaatgaacaatgcaccttttggctgtatttcattgcagattccatctcttcaaactgaagtgatgttcttaactacagtgctgtctccaattaattcagatggggttgggaagaggaatggaaagcacaagcatgtgaagtaacttttctatttaaagggttcttcccttcaggttttgagtaaacaactatttgaatagaaataaactattttgacagatgccagctccaaagataattggttacaaaagacattttctgggatgatgcatcataagatatgaaagcacttaggaatgtgatgcggtttggctgtgtgtctccattcaaatctcatctcgaattgtaatccccatgtatcaagagagggacc

SEQ ID NO: 181728 - DNA, 302 bp, Homo sapiens
attatttgatatggatgagttaagactgacaatgaatgaacatttatgtgaattattaatagtcattaaaaataactcatctcattgagaggaggacatgtcatatatgtttgcccaaaaaatgattctaattttttgaagtattttcatatatatttctcagaagacattcacatatttgattattgttaaacaattccaataaagaggtaggatgagtgtaaatattcttatcatttcacagctgagcaaactaatgttcagaaaagttaattgaatctactcagcttgtttagctagta

SEQ ID NO: 181729 - DNA, 175 bp, Homo sapiens
aatgttataaaattaaaactgtacattttaaatgggtgaattttatggtatgtgaaatatatctcaataaagtcattaaaaaaagagttgcaagatacagtagggagtaaatataaaggagagagagcattgctggaattatatttatggtatatctctacaactcctttttttt

SEQ ID NO: 181730 - DNA, 742 bp, Homo sapiens
gggcagccccatgcggccaccaggctagtgtacatctgtccctggctctagctggcctggaggtggccccaccccaagggagagagtagtatacagccagtgggcctgtgtgaacttgctcccagcttgaatagctggcccagaggttgtctgcctgtaccactggaggattgtgcacagctgccgggccacaatttcctgcctttagtccaatagctggtttggaggcactctttccgcagctcaaccctacatcaccagagtcatgcacagcctccagacctgtgtgcatccacccctggcctgatagccagcccagcagtaaccctgctgccattcaggagagacagtcgtacaacctttctggcctgctgcatcagcatgtgcctgaccagcaaccagcttggtgccaactccagaaaaaccatgccaccacagtcatgggcttctgcatactaagtcactgagataatcacggacatcgcaggtgaggattccagctgaataatctgtttggacaccacaatactgagtccaccctgaaccaaagccaccacacgccatttccaatcagcaccctaggacccatcaacaggaaaaaacctcttcctatgaaagctgctcgttaaaattggaaaaagcaattgtccattacatgcacaggtaccaacatagagacagaagaatcatgaaaaagcaaggaaacgtgtcacccccaaacctggcaccacaatgcatcttt

SEQ ID NO: 181731 - DNA, 197 bp, Homo sapiens
ccaagcaataccacttctgggaatctacagaaattctaccagaagaccacaaagatacataagccctgagcactgaagcactgtctgatgtgaaaacctgaaaatatcctttgtgtttcccataagcaaacattgatgcatttatgccgtgaaaagggctgttagagcaaggccgatctgagggatgaatattgacg

SEQ ID NO: 181732 - DNA, 365 bp, Homo sapiens
tataacataacttggttccagatcttacgcttttaacttcttggttattttgcatccctcattagtcagatacagacattcaaaagcgaagcacatctgaaaaatctaggaccataatctttataaattaaaaaagctaagagcatacatatccacagaatttaccacttgtgggtgtttagctgtttggcttcaaacacacagaaatctcaaccacattttcccaccacctaccacacaaatcccttttcccccacttaccagtagaaacttttggtgaggtctctggacaaaagtccaaaaaggcaaagcctactcaattgctcatcggtagctgagctgaagaggaaccaagttatgttata

SEQ ID NO: 181733 - DNA, 491 bp, Homo sapiens
gacgaagggcgactcctaggctgacagtggccggggccctcaaggagacggcagcgtgactcgggatggaagcagactgccgccggacagaggcagcgacacaggcaccgaggccacacggaggcagagcagaggggacgccctcctcttgacagggggcccctgcgtgtccccgcaatgctcacacgccactctccactggcccgggtcccgagatccccgctttagcctctcaggcacagaagggacctcgttgcaggcctggctccctcgtgcgtgaagacgaggcctgacctgccaccatgcgcccaggtcagcatcaggagccggagcaggaccccgggcctctccagggtccacgcaagggcagggacttgccgcggttctgccgtgcgtcttggggacaccctcagcacctcatcgtgagacgcccacttctccaaatgggccttctgtggaacactcggccaccggccactgcaggtggatat

SEQ ID NO: 181734 - DNA, 442 bp, Homo sapiens
cattggtccgagagaaattagacatggtggacaagtgaccaaaaaggcctacgtgtttactgaacacttaagaacacacattatgtctttaggatctagcctattctataatgtgtagtacagtcttaattaaataaatcaccaaaatgaaccgatcactttacacactgccaggaacaatcagattcaagtggagaaagaagacttaaggtctacaatccgaagactccagtatctgtgaacccaaactgttatttttaaagacttgtatatcttagatattatagattttacttagctttgtttagagtccactaattacacatctagatgtaaattccaaatgtgtacaaccttctcagcaactctccatatagaaatctgtatggttttaatctactggttaaaagaaaatgctaatttctctcgaccaatgggcaga

SEQ ID NO: 181735 - DNA, 517 bp, Homo sapiens
catggcttgctcaacagtagatctactgaatgtatacaaatactaaacagtattataagagctaaaaacttaatatattcactcttggttcatcagaagctgagagatagcatttagcaccacaaatagtatcactgatactaacagaaattagctacttattcagtttacaagttccctaatgattatcaatgtattaggaaagtaactggaacagtctgatgcagttccacctatcagaaagataatggctcagacacgggtctcatttagttagtaatagccacatcaacaacaaatcacgaaaacaattttgaaaaaccaacaaatgatttagaaaatatggcctggcacggtggctcatgcctgtaaccccaacactttgggaggccgaggcaggcagatcacctgaggtcaggagttcgagagcagcctgcccaatgtggtgaaaccctgtctctactaaaaatgcaaaaatcagctgggcgtggtggtgggcacctgtaatcccagctac

SEQ ID NO: 181736 - DNA, 212 bp, Homo sapiens
tacttggaaacggcacctagctggccttgacttctgctacctaaggttatgctgggggagtctgacggaatgctatttctgtggctttgtagaccacttcatttattcatttgttaattaattcattcactcatttatttattttaccctaaaataatcacatgaaaaacgttttgtgtgtatgtgtttgcttgtgtgcacaactgcttatg

SEQ ID NO: 181737 - DNA, 500 bp, Homo sapiens
gttttctgtgagtgaatattacttgcatcgttaatgtaaatcaaaggcatcaaagtattttactctttttgaaaaaaatttagaggagaaatttattatattaatattctacccatatatgagtttaatttgtaaattgtagcaaagcatgatgtgctttactaaattcctttataattagaataagcttttataagggtgaaattatgtctttgctacagcactaaaccaaaatggcaaaattgttttagtcggtaagctttgcttttttaaaatatgaaataaacaggtttttaaaatgttattttaatagtcttctctgttataaacaaagaaaattggtgtttctctagagcttattaaaagtagtgattattgtcctaaaagaggagtagcagttttagatgctaatgcttttccctgactgagttctatttgccatttagttataactgcctagtgcaaaaattctaataaaatgtaatgatgaggatcctgtc

SEQ ID NO: 181738 - DNA, 351 bp, Homo sapiens
actcatgtttgtaacacttgctattataaccccttttttaaaaaaaaacaaacaaactccagtttcatcccatggagtttacattccagtttctctcctgcaaatacactttatttaaccagaggtattactaaagaagtaaggtacttctttttttctgaaattcctaaaagaatcagtgtaagcctaacagccttcagattgtatttcacatatccatgatcaggagagtcctaaaattgtcatgggaatatggtagttgcaaaaaaaaaagacaatttaaataattatttttcatctaaatcaaataatacaaggtcctttcctagattgttgttttctcctttcaat

SEQ ID NO: 181739 - DNA, 460 bp, Homo sapiens
agacaaacccatggctcatcctttctattgtgttaatacagtaaataacatccatcgattttcaaacttaaaccaacgaaatccacttggtcatgatgtattaccctttttatacactgctggattccaactgctaaaatcttgctaagaatttaacattggccaggcacatggttttaaacaatttgattacagtaagccttggtgtagttttcatgtttcctatgctcaaatgttgttaaatttcttgaatctgtgggtttacagttttcattaaatttggaaaattttaagccatttttcaaagaagtatgaggatatttagtctggtttttattggatatgtttgcttagagagtctctgtaatttacctgttgattttctttcttttcctcacccccgagcctaggttgctgcctcctttccagcactaaatggcaccataagcccaggtttgcc

SEQ ID NO: 181740 - DNA, 291 bp, Homo sapiens
tggcaggggttagctcaaaggagtgggggcttcccaaggcaggaactggaaatttttcagagaaggaagaggccggagccccagcaccaggtgtgccttgctgcctccagctgtttggtggctgttttttcccctccaccagcccagagcacgttgttcccatgactctgcccaggagtcaccctctgtcttctcccaattttccagacccagaatccaggctgggggatgcacagggacaacaacaagggcagtgacaaggcaggcaccctgcaggcccctggctcccca

SEQ ID NO: 181741 - DNA, 442 bp, Homo sapiens
cagcaaacaaatgaaaaaaatgctgtgtctgtatcccctatttagatggatctaggcactgatcatcaatagtgactaatagctcaagaagagacaagtacacattatgtgccacctgatggaataccaccacctataaatactgtccccatccaacaaaacaactatctgaatctgattacgtctgtggatctgaaacaaatttataggaaacataaaggccacagaaattcgttaaatgatatgaaagggatgcaactgcagtatctgggaaactacatggcaaaaaagttattttcttcatacattgcaatgaaaaaattagtaagagtcggactcttcattaatatatgaacttccattggatcttgactcaaactgtttacaaaaactaaatatttgaatatcaggaaattataaattttttgatgtgataatggta

SEQ ID NO: 181742 - DNA, 433 bp, Homo sapiens
tcccagagtcctggagaagcccagcgcccgggcgagtatctctgttctacaggctgggactctgatgctcagagagttaaacccaccgtccagggccaatgatggggcaggggccgttcctaagagcaagaaagaggacccggggtggagaaaccgagaggaacgaggagctccccataggagcaggaacagccaagtaaagatgggtctgcagctcagaagaagcgtgggactgggcaaaggaacaggacaaaaccttcaggaatggcccgaggccacttcagcagctgcaggatggagagggagatgtaccgtggacgcgtctgtgaccacctgcgcacgcaggttccgcgaccccgacccgttcgtccgaatgagtcagaatccggagcaccacggcggacgtaagagagatggcatccttggcaagttg

SEQ ID NO: 181743 - DNA, 357 bp, Homo sapiens
tagtgtgtatagcaacatgccttttaatttgctgggggagtgccatttgcccattggagctctggccctattatttaacagtgaggaggacagatagctgcagggcacacctgcagagcctgcccccagcagcagcttgtgtgtcttgcagacacacaccctcctcctgccacgagatggcactcttcttctccagtgcgatggcgcgctctttgctggtgtgaagagcaccgtgtttcttgcaccgtcatcatcagggatgcccccgccgggatcattgagccctgcaggagctagtggggagaggtttacaaggggaaggtggtgggcgaggtcatccaacatggctgaccatgc

SEQ ID NO: 181744 - DNA, 282 bp, Homo sapiens
tagttttctgaggaacccccattatggctgtactaatttacattcttaccaacagtgtacaagggttcccttttctcacatcctcaccaacacttatcttttgtctttttttattatatccattcttacaggtgtcaggtgacactttgtggtgcagaagatttttattttgatgtaatcccatttgtctatttttgattttgttgtttgtgatttgacttttggggtcaaatttagaaaaaaaaaaacaacattgcccagaccaatgttatatagttttaa

SEQ ID NO: 181745 - DNA, 198 bp, Homo sapiens
accctgtctcaaaaataaagtgataatgatattggggttgcaaatgtttagaattattatgttttagggctctctctgagatctgaatgggcaggatgatggagcctgagattggcttcacattaatccagtgaggagggtgaagaggggagcagatgagccgggtacccgtacctcacgaatcccacgtacagggat

SEQ ID NO: 181746 - DNA, 490 bp, Homo sapiens
ggaaaacagagctgggcaagcagagggagagaggggaggacagagggaagggaaagagtgatagaaaaggaagggaagaagaaaggaaatgtggagggggatggaaaggagagactaaaatcaggagacacaaaaaaccatttatcttcatggaaagtagctcattgcataattttttagtggaaagtctttaagtgccataatcatttaaaatatctgataagaataggttaagttagagttttgtgatttaggaggaaaggtagtcctaataaaagctaccatttattgtgtgcttactgtgtgtcaggaaagggcagtgtccttacatgtctcatctcactggggaggcaggacaagacagtgatggctgagagggtggactgaatttgaagcccagctccatcacttactacctgtgattttcagaatgtgttttttttttttttatgtgtcctgaaactctaaacccaagtgtcccaatctcaaa

SEQ ID NO: 181747 - DNA, 519 bp, Homo sapiens
ggttttgggacattgtgccttaagtcctgccattgtttttgatagctgatgacaaatgtttcttagatttacatagactaactaggaaaaggactatttctgtctcttttaaatgggtagtgctgtttttattgacattttgaaatgagttttattttgaagtactgaaaatcaggactttggtaggcggataattacattggccattttgtgttttggtaacttagatggtaaaacagttgaaaaatgtgtacaacttttaattatgccaaaaaaattagtgcaaaagactattgaaaaaaagttttatattgccttgtagtctgggttgttgcagatgaatcttggctttttggcaaggagctgttaaccttttctattagtgcagaataagttgtatactgaaaagcagtgtttttcagtagggcaattaagttcaaacggcatttattccagagatgcagcaagagctgggacagccataaagcttgtgagccttcctttctgtggaaggaatgc

SEQ ID NO: 181748 - DNA, 564 bp, Homo sapiens
cggcctaacggctaggtccttgggacactcccttctgattttttccccctacagaggtgaggttgagcagccttgaatctgagggaaatgcccattgtcactcccaaatccatggtacaaagcctcggaagcccggcggggttgcccaccagttgcgaaagccccctttcctcagggagcacgcgggacctcggaggagaaagctaacagaaaattcgttacctgaggtcctgcctgcagtttcaaatagcttccagcagttttacaaaacacatcctttccatttcttccttttaaatgtttccctaagaacgatccatttaggtgctataagtcctcagccagggagtctctgggacactggcattcaaaattttaaacttccgccccaaaaccaggaacattccaagacagaactcttttagggggccatttcctgggggtgggggagagggcttggaatcaatgctagattgaaaacgttgtaatagctttgccccagacttaacaccggttgggcaggaggagggtaatttttatttagccgtttctccgatcatgtgg

SEQ ID NO: 181749 - DNA, 549 bp, Homo sapiens
aatgcagaaagggtgactgaaaattttgcaaatgaacatgacttcccatgaagtctaatgttccattcgctgccatggtccaggggactcccaccagcttccaccggcttcaacaggatctccactagagagcccagacttatctagtcctgtcggggaaaagggagaagaggccttgcaggagaaagctaacagaaaattcgttacctgaggtcctgcctgcagtttcaaatagcttccagcagttttacaaaacacatcctttccatttcttccttttaaatgtttccctaagaacgatccatttaggtgctataagtcctcagccagggagtctctgggacactggcattcaaaattttaaacttccgccccaaaaccaggaacattccaagacagaactcttttagggggccatttcctgggggtgggggagagggcttggaatcaatgctagattgaaaacgttgtaatagctttgccccagacttaacaccggttgggcaggaggagggtaatttttatttagccgtttctccgatcatgtgg

SEQ ID NO: 181750 - DNA, 240 bp, Homo sapiens
cacctttagtctggattttcccggagccccatttgtgttagtgtcctcgggctactgtaacaagttctcaaaaatgtggtagcttcaaacaacaggaatggaatctctcatagttcagaagtccagatcagtttcactgggctaagatcttggagtcatcagttctggctccttctgaagctctagggagcagtctgatttagctcttccagcttctggtggcttctctctcccgggatg

SEQ ID NO: 181751 - DNA, 102 bp, Homo sapiens
gtggcattgctctgtgatagctaatacacatgcatacattactgctgacatttaaaaacattcctaacagtttgtgtgggtacatggtaaacagatgctatg

SEQ ID NO: 181752 - DNA, 380 bp, Homo sapiens
cacaaaaaagaaaacttcagaccaatatccttgataaactttgatgcaaaaattgtcaacaaaatactggcaaactaaatccagcagcgcatcaaaaagcttatccaccacaatcaagtaggctaccccaggtagacctaactggagtggtttcaagagagaatggaagcaaggaattggaggtagtaggtacgtacaatacattcaagaagttttactgcaaattagggcagagcttggggagagcagctggagggggttgcaagaaggggaaactgatgtgaaaaatgatggttaggttacctgggttaggtctacctggccaggtagacctaacgcggaaccgcctactatttcctctaggcacacagtattcacca

SEQ ID NO: 181753 - DNA, 621 bp, Homo sapiens
cacaaaaaagaaaacttcagaccaatatccttgataaactttgatgcaaaaattgtcaacaaaatactggcaaactaaatccagcagcgcatcaaaaagcttatccaccacaatcaagtaggctaccccaggtagacctaactggagtggtttcaagagagaatggaagcaaggaattggaggtagtaggtacgtacaatacattcaagaagttttactgcaaattagggcagagcttggggagagcagctggagggggttgcaagaaggggaaactgatgtgaaaaatgatgctgcaggagacagaaaagcataattttaaaagaattcctagctgaatatgtcacttttcacatcattcttatcttctgcatgtcacccttggttaaaatttactcccctgttctggaatgttttccacattattccttcatttcaccaccttaatgcttaatatcacaaattaacccacttcttactccacccgcttctctctaacctatgggagttccctgggctgctctccatcatccagggagcggtgaagcaaggacctaggtctctcgggtgtgggcagatcccgattccgccagacatcctacacacagcatggctgctcca

SEQ ID NO: 181754 - DNA, 426 bp, Homo sapiens
tgttgggatgacaggcatgagccactgtgcccagccttaactgagaccatcttaactggatctgagagggtcagctcagctcagccttctggtctcaggcccactcactgcctgcacttgcccaggatctcctggaggagcatgactggcggagaccatggcctcggttttcctcctgagtctgtgttcttggcttctcagcctccctgctcagcctcagtaactctgtccatctctgagtctcgggacctcccacccttcgtctgagttgtgctctggcgtttgtccctctgtccaggtctgtctctgtgtccacccatcccccacccaggctttgccctgtgtctgggacacgggggcctggctcttctctcatgctcctttccatcccctggcagtgcccacaggatcagacatgaaagcaaa

SEQ ID NO: 181755 - DNA, 690 bp, Homo sapiens
tctgcccgcctcagcctcccaaagtgctgggattacacgtgacctgtagaattttaaagttacaaatgttgttcagcatcttcagctctgatgaatgcggtgtcagtacaaaatgatgagctagagccagggcatggtggctcatgccaataatcccagtgctttgggaggctgaggcaggagaatctcctgaggccaggagtttgagaccagtctggacaacatagtgagaccccacctctagaaaaaatttttaaaaatagcttggcctctagtcccagctactttggaggctaaggtgggagaattgcttgagctcaggaatttgaggctgcagtgagttatgatcatgccactgcactctggcctgggcaacagagggagaccctgtctctaaaaaataataaaatgatgagctaagttcgagaccagcctggccaacacagtgaaacgctgtctctattaaaaatacaaaaattagccaggcatggtggcatgtgcctatagtcccagctactcaggagactgaggcacgagaatcacctgaacccggaaggcagaggttgcagtgagccgagaccacaccactgcactccagcctgggtgacagagcgaaattccatattaaaaaaaattgatgagctagtcattaaaagtgctcattatggctgggcatggtgactcgcctgt

SEQ ID NO: 181756 - DNA, 163 bp, Homo sapiens
cctatgggacctctcctactgtatctaggatatggttgtgaattggatggcaaggtaagaaagggaggtgttggaataattccttggtttctctctcaaacaactaaaggtacctagttcatgtgttgaacttagggaagagatcagaatttccatcttgaat

SEQ ID NO: 181757 - DNA, 671 bp, Homo sapiens
aatttttaaaagaatgtgttctacagattttctaggaaattacatgactgtctccattctctattttctatactccttgagaagcaagatttatttttccatgtcatccttctgtcatagtcagtgatcatatctgtacttcatcagaaaattctgggttataatttgtctaggactgaggagttataattattcatgtaagacagacatgtacactttctttccatctatcttaggcttcagttggctcttagctatgtttactataccttttccagtttaaggatcattctccttgatagaactaaataggaattgagtagttccactttctctgtcatttggttctattcattcagcaagcatttattgaacagctaagtttatggcactgccatgagtgcttgaagaaagatggccctgggaacagtacttgtcttcagaaagtaccaatatgagtgtgagtgtatgtgtgttggtgacagtgtgtagggggaattggtgagtgtcaacaaaagagggagggatcacaaaattccatttacaacatttccctttgttttaaaataccaagatcactttgtgtctttgctttactatgttatttcatcaagtgtgaggacaaaattattgctctcaaatttgtttcctgattaattactattactgta

SEQ ID NO: 181758 - DNA, 264 bp, Homo sapiens
agacacaccgccacactgtcacatggacacacctccacactgtcagacaccaccacacagacactgccatgtggacacaaggacacacagacattgtcacatggatacacacactgtcacacggagacatcaccatgcagatacatgaacacaccaccacatggacatagcaccacacagacactctgccacacggacacaccaccacacagacacaccaccacgctgccacacagagacaccaccacatcgttgccacatttt

SEQ ID NO: 181759 - DNA, 342 bp, Homo sapiens
tgtggcaggcccacgggagtgactggccaggcagcgggcctggcacgtctaaagcttcctaggctcccacagcacgccgcctggggcggcgcacccaggacggtggcagagctgacctgactcgagtgaccggcagcgtctgcagggaggatggggacgaggaaaaggctcccactgcgccgggcctcacctttgagtgaggatccagcctccccattctgctccctgagggggcacctgggtctcctggtgactctgtgggcatgaaaggtgctgagctcacagtgcgggggctcccatctggccacccactgcacgggccgtgagagcagcacccagtcc

SEQ ID NO: 181760 - DNA, 795 bp, Homo sapiens
agatatttttagtagtcagctcataaaaacaaagtacaatggtgtttgtcaagaggtgggggagagtgaaaatgttaccaggaagtgcaaagtccttagttcttgttttcttgagagaaacaattcagcccagacacaaagaacacaccaaaagaggagtaggttggcccagctggaaacagtcttgagagttacatgttgcagtttttattatcatagacttaaaaaaaatttcccacctctgtcttaagtgtctgcctttgtttagtatcctgcttcctggtaaatctcttcttttatcctcatcgagtttctgcccaggtctgtgagatgcttccttactgtcagctgatatacatgtgtgagttccagtgatcaatgaatcttaatggcagcactgcttattaccgccatcttaggaaaataatatagcagtcaaatgtgtacttactatgcctacgtatctcttaggaattttcctttagccctttttccctttttatcagcatgtagctagctacattctgacagtttaatcacagtatgagcaattactgggtgtcctaagtggtgtttcagggtgttcttcataggtatttctgctcctctctgctcaaatttagcatacatgttttgggttgtctttggagcatgaggctttttcctctggggctctttttttctgttcatgtctaactgcctactcgaacattccctcaatagattgtgactctaaaaatctttgagacagtgcactgtgggtcttctgtaactacttcctggtgacataagata

SEQ ID NO: 181761 - DNA, 393 bp, Homo sapiens
gcagttgccagcagtcatcctctgggctctgccagcaagttggcagcagggtaggattcacaccccttggcttctacctcacagttaccaccaaaggcctttccaatttaaaaaagcaattttagaaattgaaccagaggaataaccaccatgtacaaatcaaaaagcatagaggggcttataatgagaagttgtgctcctctgtcctaccttaactccctctgaaatccaggctccctatgatcaatccccttgacctttcagttctctgggtagatttcttttcttttcttttctttctttctttctttttttttttttgagacagagtcttgctgttgcccaggttggagtgcagtggtgggatctcagctcactgcaacctcctcctcc

SEQ ID NO: 181762 - DNA, 653 bp, Homo sapiens
aaaaacaggaaagagatcaatatcatccacctcaatgggtatatagattcaagaagataatcacatggaggttctttgaagagtgttatccacaggtaaacgtgggaactattattactccttgcgtgcagaggaaggcaaagcatgcggaatgaagcaactgaagactgatcacagttttatccctggggcttaagaaaagctgtatccatttcttcaggcactgggggctccaatctatcaatactctacactctctgagtgatatagtctatagctctggagtgagttttgagacggagtcaagctctgtcgccaagctagagtgcagtggctcaatctcggctcactgcaacctccacctccttggttcaagtgattctcctgcctcagcctcccaagtagttgaaactacaggcgtgcaccaccaaactgggctaattttttgtattttagtagagacagggtttcaccatgttggccagcatagtctcgatctcctggccttgtgatccacccgcctcggcctcccaaactgctgggatgacaggcatgagccactgctcacagcctaggggaagtcttatttatttatttatttattgagacggagtcgcgctgtgtcaccaggctggaatgcagtggcgcgatct

SEQ ID NO: 181763 - DNA, 438 bp, Homo sapiens
ctcagcctgccgagtagctgggactacaagcgcccgccactatgcccggctattttgtatttttagtagagacggggtttcaccgtgttagccaggatggtttcgatctcctgacctcgtgatccacccacctcggcctcccaaagtgctgggattacaggcgtgagccactgcgcccggcctcatttttgctattttaaagtgtacagttctgtggcatgaagtacattcccattgtgcaaccatcaccaccgtgtccagaactttttcatcttccccaactgaaattctatacatattaaataataactccctattcctcttttttttctcagcctactcagcttcttgaatttgcaagcttatatctttttacaaacttggaaacttttcagcattatttcttcaagtaccttttttttgagacggagtcttgct

SEQ ID NO: 181764 - DNA, 496 bp, Homo sapiens
atggatggatggatggatggatggatatcagttcacaccactctcaaaaggctctgcaaaccagtctataatataataattgaaggtcttctggtagaaaatgttaattttctgatttaaaatattatcttccccaacaatgcatgctctttcacctcattttcctcccaaacctccaaattatgaagcctaactgtatcaattaagaatcttctggcttgaattaacagaagagccaaccatatgcaacttaaccaaaaggggctcatcaataaatatcatccccaaaataataaagtctgaaagaaggaggtatgagtgtctcaagaatgacagtgctctcagtcagtgttgctacaaatctaggcacctgttcatagtcataatgtggctgccatagctccaacaattatgtcctcacctaacagcctccagagcaggaagaaaggatgaaaagaaagagtctttcctacatgacccaaactgggtccagtgc

SEQ ID NO: 181765 - DNA, 387 bp, Homo sapiens
ggtgtctcacatgttaagcctatttattgcagtctttgagttaagttaatcaccagccctgaattacttgggtgtagtcagatgagcagaataatgtggtttaggtgataataaccttatgtagaaagaactccctgtggctgctaactcacacgtccacagagctgcatacagacgtgtcaggctctaagagttctacagattgtccaatacagtgcttgctttttttttgtttgtttgttttttgagggcttttgaggctgtttttagaatatattactgggagttattaccttcctcctggaatttgcctagtattggtgagctctcagttgttcaccacttgaagaaaagttctacctcctcctttcctgcttcccaagataa

SEQ ID NO: 181766 - DNA, 724 bp, Homo sapiens
ggtgggcatcagttgcctgcttggcccacctacagagtcggcgccagccaagcagggcagaattcggccagtcctgtgggaggtttggctgtgagttgggggtggtggtgcaacttgttattttcgttgacttgtgtttttaaaacagagggttgagtgatgccgcctttggaacagttgcattccagggcagtggtttgtaaggcagttgattggaaccaagacagccatcatctgcccttagaaaatgtccccagttgcaataactggtcatcggtccagcccgcagaagctactcaggtccttattggagctgaagtggaattatcttagaaacaccggctttgaggtttagaagaagggggtgccgttttgaccaggagctctgggagccaagtggatgaaggtggggacactggttatgaagctggtgacaggctccacatgtcatgcctaggcgagcgggtgagacctgctgctgctgaactttgtttggaagggacatgtgtggcgtgatttgctaacatcctctgggagctccccagcctctgccagatgccattgtccctgacagtggccattgctggttggtggcggtacgtcccccaccagcctggatatttcctgtcctttcatcctgttgtggtttgtctggaccctgtcacaccaccatcgggagaggctttctctgagattggcatgggacgggacagggccccacagc

SEQ ID NO: 181767 - DNA, 490 bp, Homo sapiens
atttgataaaattttccattatatagggtgtcttagcacaactctgctgctataacaagatacctaagctggtaatttataataaacaggaatttattttctcacagttcagaagactgggaagtccaagattaatgcaccggcagttttgttttttgtttgtttgtttgtttgtttgtgtccagagaggggtgctcttgctgctcccttaatgaggtcttgttgctacatccccagagggaagaaatgttgttttttatgtggcagaagaaatagaagggcaaaaatgaatgaacttcctccatcatgccctattttaacgacaccgaatcctagtcatgagggactcaatcaccttctaatggccacacctcctaatactgttctattgggaattaagtttcaacatgaattctgaaagagacaaaaatattcaagccatagcatagaaattacatgaaaataataacaaataaaagagacaaaaaca

SEQ ID NO: 181768 - DNA, 434 bp, Homo sapiens
ataatagagcattcgtttcgtcatctggaagcagagatggaagaagctggggggaaatgagagacatcactgttgctttcgtggagggaagctttgtagcatgttatcagacagcagtgcatattgaagaaaatatctgttaggaatgcatgtcaccagatgtattttgctttcaagaatggtagacacatcaaacaagaatcagataaaagcctgagaaaaagatgttcagaagaatactggagttattctttatgcttcactgccctttacctctcttggtaccttccagagaaacaagtatagatgtatttttagcttgccgtttccagcatcaatatgacaacatgattttgtctttatatcagtaagcagcttctactatgttttcctattttctgctagctacagtttacaaaggatgtcacagcact

SEQ ID NO: 181769 - DNA, 293 bp, Homo sapiens
ggaagacagcagccatgtcattctaacttctagcggacacatgagaatagctgccactgtaccagcatattcctctggttcattctcctgcatgtcctccaggcactgaggcaggttgcagatccaaccacacacttccaacaccacttttatttttattttttaaaactgtggtaaaatacaagatttaccgtgctcaccattttcaagtgtacagttcagtagtgttaagtacattcacactgttgtacaaccatcatcaccgtccatctccggaactcttttcatcttga

SEQ ID NO: 181770 - DNA, 1064 bp, Homo sapiens
actaaaaatatgacatttttaaagaaataaaataatcacaaaataaacaaaaaatcacaaatcaccagacaaatgtgaaaaataactaaataaaacttctactaatgaaaaattgttgaaatcaaaatctcagggttagtttgaattagtaaataggaagccggatattttttaaaaactctccaaaggccgggctggtggctcatgcttgtaattccagcactttgggaggctgaggcaggcggatcacctgaggtcaggagttcaggaccagcctggccaacatgataaaaccccatctccacaaaaaaattagccgggcgtggtgaggtgcacctgtggtcccagctacttgggaggctgaggcaggagaattgcttgaacctgggagacggaggttgcggtgagccgagattgtgccattgcactccagcctgggtgacaggtgagactccatctcagaaacaaacaaacaaacaaaaactctccagaaagcaatacagagaacaagcaaatggaaaatataaaaggttaaaagacggggttaaaataaagactgaagtcctagaaggaaagaaaaaagaaaataaaggagagccaaagtgcttagagacctaagagctgagaatttttgaagctaagaaatgaaaccacagttatgggaagcacaacatataccaaacagaataaataaattcatgcacagtcatgttatagtaaaactgcaaaacaccaaaagagaagatcttaaaggaccaaagaaaagatacaccacctacaaaaaaaccacaatcaataagaaagatagatttctcactgctatattagaagctggaagaagagggcatactatcttcaatgtgataacctggaatgatcaacctggaattttatgtccagagaaactatctttcaaggatgatggtgaaatacaaagacatttcagataagcaaaatagaaactgcctccaacagactttcacttaaggaaattctactttaggaagaagaaaaatggtgccagaaaggaagtctgagatacaggaaggaacggtgagcaaaga

SEQ ID NO: 181771 - DNA, 194 bp, Homo sapiens
tgtgatgatggaagaagttccgaaaagaaaatgaaacatgcaaagcctaggctcataagaaacttattgtcatttcgtgtcaatggccaaaccaagccatatctccaaacccaaagttaaggggtgagaaaaatatatttctccttataggaggatttaaatgtcataaaacaagagtaagaatatagggaggg

SEQ ID NO: 181772 - DNA, 467 bp, Homo sapiens
gctggaaaaagaaacagcaaatgatacaaaggactggacgcaatggcttatgcctgtagtcccagcacttggggaggctgaggcgggaggattgcttgatcccaggagttcaagaccagcccagacaactagtgggaccctatctctactaaaaaaaagttaaaaaataaaccaaagaaagcagaagaaacagtgcaagaagagaaatcactgaggccgagcatgagctactgtgcctggccggctgcattcctttctataggttctaagggagaatccatttccttactcagttgttgacatacttcaattccttgtggttgtaggaatgaagtccatatttacttgtagactataaactgaagatgttcccagcttttagaggctaacagattccttggcttgtgtctcgcttccttcatcttcaaagtcagcaatggcagattaaatccttgtcatgctgcaac

SEQ ID NO: 181773 - DNA, 274 bp, Homo sapiens
gagcacagagtgattagtttaggagtatatgacccagacagagtattttctggaactaggaaatggatactatggggtgggggtggtattttgcagctaaatttaaaacatagaagccaggagcagcccaggtgcaaactggataaactcatttgctcctcataaaagcactacatttatcatctccatttcacaaataggaaaactggggcccagaagggttagggtcacacagttaccaagtggtggggctaggatctaaactactcaggca

SEQ ID NO: 181774 - DNA, 363 bp, Homo sapiens
ggaaacgcatgaggcgtgtgctctggaaccttccctccagctgtggtgtaaggcagagcttcctgcgtttgcccggggctcttaaagggtcctggagacatcgtttggcctccctgtgttttacctgcatctgtccttctgggcttactcagcagccatcttttgtgtgatagattagttgataaggaaaacttaattattggagttgcacaatctcagggattggttctgttcactaaacgggcgtaaactgtcttgatgtaggtaagagttattggccttgacagactttgtcagattagcgattggggagatttgttccaagtgctgtcctctttcgttgtaattgaattttgcatgttt

SEQ ID NO: 181775 - DNA, 408 bp, Homo sapiens
tcttctcctaatagggagcatgggaggaacaacccactatatttttcaaggcagctccaggaattagacccataaatcatgttttaaaatagcatgcattgtgcagagagcatgcagaggaccgctttttgaacacatcccctttgttttagaaaaagtggaaattgttcatgccagacaattgttgagtctaaaagttaagtgtactgatgggcctaattatcttaataaacaaagagcatgatttataggtagctgcagtgccctactttgaaggatagaaatctttaacctttctttctcagctgttcccgagagattccttttaagcagagctatggattatcatcattgatgtttaatacctgagttggttaaacttgtaaaaggaatagtactttgaagtac

SEQ ID NO: 181776 - DNA, 542 bp, Homo sapiens
cccatttttcttttaaatacaatcttattttaagtctctaagggcagctggctgaaagtgtcatatgggtaatcctcttctaaaacaaataaacccctgttgtgttttcaggtctaaatctgaatcgtcacctattcacctcctgtcttgcctagagcagagacatgtttattagcactggtgatgataccacttggaggccaccaggtcactgggtgctgagaggcattttaagaatactacttttttccctccaggagacactgcccccttttttttttggtcaggatgtacaattttctatgatgctaacctgaaattgggagaaaactttaaccagggggagatgcattggagtttccctccttggggacccagctctctggccttgagccctttcctcggggacatatgaccctgaattgggggtctgaggctttccggacaggagaaaacgaagtggtgctgggagactgatggggggccagggaggggtgctggcaggaaataggatgtaggcaaggatagaaggagggtacaag

SEQ ID NO: 181777 - DNA, 866 bp, Homo sapiens
aggcagaggttccagtgagctgagattgtgccactgcactccagtctgggtgacagagggagactctgtctcaataaataaataaatagagtgtgaatttaatttaaaaataaggcattgtaagatttttaagcagcggagtaacatggttcaggaggctattgctgaggtccagaaaagagatgatagtggcttcaactggggtgatggcagtgaagatgatgagtaatgggtatatttaagatatttttaggcttggcattgtggatcacacttgtaatcccagcattttgggaggcctagccaggcaggtcccttgagcccaggagtttgagaccagcctgggcaacgtggtgaaactctgtctctgcaaaatatataaaaattattcagtcctggtggtgtgtgcctgtggtcccacctacttgagaggctgaggtgggaggatcacctgggaccaggaggttgaggttgcagtgagctgtgatttcaccactgcactccagtctgggcaaccgagtgagaccctgtctcaaaaataattttaaaataggccgggcctggtggctcatgcctgtattcccagcactttgggagcccaaggcgggtggatcacctgaggtcaggggttcaagaccagcctggccaacatggtgaaaccccgtctctactgaaaatacaaaaaattagccaggcgggtggcgggcgcctataaaaccagctactcaggaggctgaggcaggagaatcacttgaacctgggaggcagaggttgcagtgagccgagattgcgccactgcactccagcctgggtgacagagcgaaactctgtatcaaaaaaaaaaaaaaaaaaaaaaagaccatgga

SEQ ID NO: 181778 - DNA, 480 bp, Homo sapiens
cagcaatgacacgagcctgaatcagatgccaagtgagtgagccaagctggaagcaatgcgagaacatctgactccattgacagaagctccagagcaggcagctaatccacagtgagacttagaggcacaggatgctccagagcaggcagctaatccacagtgacagactcagagccacaggatgctccagaacaggcagctaatccacagtgagagactcagagctggggctgcctctggggatggaggcctctaccgggaagaggacagagaagggcaatggcaacgttctttatctcgacgaggtatgcgttgcgcaggtgcatgcgttttggggtttctgttgttgtttttgagacagagtctcactttttcacccaggctggagtgcagtgtcagtcagggctcattgtaacctcgacctcctgggctcaagcgatcctcctgactcagcctcctgagtagctggggtacaggtgc

SEQ ID NO: 181779 - DNA, 238 bp, Homo sapiens
aaaattgaaagctaataaaaattacaaaaatgttcttaacattattatggaatatttcaaacatatagaaaaatatagagaataagcctggccacttttacaggtggctcaaaggtactgttggcaccagacagaggaatgaagttcctgtaggagttaagcattgagctctgctgtctcgctttctgtgtccagaggtggctcctggtagttgaattagaccattacattttgggca

SEQ ID NO: 181780 - DNA, 520 bp, Homo sapiens
ctccctagtaatctcatcaaacaaccaggaaatatcaaccactagagaatagattgacagtcactatgacctgacagacttttcatctgttcttctgagggcagccccaagggattacctggaggactttctctgcataataagacaatctttgttcctgtgcagctctacacctcaccttcccattaatgtctgccttccacctccaaggtccatttgttctccctaatgacttgctgtcactcaaaagaatttctacattctccatctcccccttcccttatgaaaaagggtatataagtttctttaccacactaaataataggtaatcactctggattattcacacacacacgttaatttaaaaagtttggtgtttctgaaacaggatctcactctgccacccagactagagtacagtggcactatcacagctcactgaagcctaaaagtcctgggctcaagcgatccgcctcagcttcccaagtagctgggactacaggcacacaccaccatgccc

SEQ ID NO: 181781 - DNA, 308 bp, Homo sapiens
ttgatgttgttttgaatctgtggctgttaaccaggatagagaatctagaaagaagaatctgctgacgcgtggggattaaatggtttagttttgcaaggaattggttttgagatgaccataggacgcatatagtagagccctgctgtgtattctcataacaccctttacacacctctgttataacaagcactatattataattacctgtttactggtctgttttctctaccactgtaagcctgtcaaaggtaaggagtgtcttttattcctcaccataattctatacctggtgtctggcacatatcaga

SEQ ID NO: 181782 - DNA, 648 bp, Homo sapiens
cctgccctccccctaattgagaatgaccttcctggtcttctctctgtgactaaatcctacccatttttgaagactcagccaaataataccaccatctgaccactctagttcaaaatgcccccctttccttgctgaagtcctgcaattctgccccatttattcactatatgttacactttgtgaagaaaccattcacataacttctttcttccaaatgtgtgttgaattatttagagggcaaaggtgctaagcctctttaagaggcttggaaggaattaggcaccaggaaagtgaaagctttatttatttatttatctttttttttctttttgagacggagtctcgctgttgcccaggctggagtgcagtgtacaatctcagctgactgcaacctccgcctccgcctcccaaagtgctgggattacaggtgtgagccaccatgtctggccaagagttgttggtggtacacacgtctaaagccactatggacagaccctaaatgacctgtaagagggatttcctatatgtcgtcttgggaaagatatttgacctctgtgtgtctcagtttcttcatctgtgacatgcaggagattaggggaccatgatgccttaaggctcttttgttttgactattctacgcatctggcc

SEQ ID NO: 181783 - DNA, 636 bp, Homo sapiens
ggaggggtggatgaaaacgggaatctctgctgtttcctagggccactcctgctccaactctacctcctatctgcatctacagtccctgactttgtcctcccttcggctgaccacgctgcaggctgataaaggctcttaatgcccagacctgtgcctaccaagacctaagatacctgccttttctctccaccgatactgacatcttagaaaattccacctgttgccttccacatccctcctgtctaatcagactttgggtcttgatcccccacagccagtcctgtgctttcatattccataatgaagagaaaacttgggaggctacacaaagactcagataatggataagggtcagctttcttcagaggggcagaatccaagcccttgtttctattcaccttcattaagaagaaagggcagttctaatcctctgtgtaataccgtgagcattcatctctggtgtactcaacaggaaagcctataaaattcaaaccagagtgaatcctcttcaaaacttgtcacagcagatggtgatacaggtttcttgctatgatgtgtgctttgtacaatgccaaacatgctcctgcttaaaaataaagatgtaaccggtaggtatgatgaaggacggggtaccga

SEQ ID NO: 181784 - DNA, 179 bp, Homo sapiens
cctgcactctctcccatctcatttaccagcaccttcagccttccagttgtcagaccaaaaatctatgtatcatagctgactcctttcatactctacatctaacccaaaagcaaatcctgtcagttcagacagttcagaatatatcaacaatgagcttgcttctcctcacctccactgtt

SEQ ID NO: 181785 - DNA, 400 bp, Homo sapiens
ttttcaggaaaaagaagagttttacagcttatcttaaaattaaaacaaaacaaaacaaaaatgaatactcaagaggcattggatttaggaatccggtaaaacaactaattccagacagccgtaaagaaacctgcaaccaggaaatgatttaaaatggagatcttcaaagtcaggattgtagttttttcaggtagctttttgtagaccttgaaaatataggccgagaccacatgtagaaattaaacgttctcatccgaagccggaccatttggtttggcgacttaagggaagagaaaaatgaagtttgctaagtaagaattaatgatttctcaggaatttttaggatgttgaacagcttaattgcatagtttgggtggatatgtgttgaagaaagtaattt

SEQ ID NO: 181786 - DNA, 278 bp, Homo sapiens
atcatcttaactaatgacatatgcaggatcccgtttctaaataaggtctgaggttccgggttgatgtgaactttgagggacaccattcaacccagtacagggctcttggctgagagctgcgggcacctccaggtgtggcggagggcccacctctttctcagcaaccccagagggatcaggctgccgcccccccgtcacaccaggctgtggtgggcaccccccagtgtctttccagtccccctgggagtccccagtcacttcgagatgctgcctccacg

SEQ ID NO: 181787 - DNA, 449 bp, Homo sapiens
gttgaactagcctggactgctgaccagctcctgaaactcaatcctggaagaactgtagaagcgagaagaaaacatggcttacgggaactgtaaaaaaatggtaaacctcctgtagagaccaaggcagtattgacccggtgtgtgtggaaggttaatgttcaccgacagcagagagaaaacaagatggagaaaagtattttcggttctgctcttgcgtctctctccatggctctgggccagctgcgcttcttaccccttcccgaaagagatttgtcagcggctcttaaccctccaatgcggtagctgcgatgtgacatcgggaacccatataggcttcgctgaggaaaagagtagatgaaaacaggggtgaaaccggatgatcgcggggctttcctcttcagagtgtcctcctcaggcctccagagctaatgattgccatggcctcccca

SEQ ID NO: 181788 - DNA, 539 bp, Homo sapiens
aaatggagctttccctgggctttcactcatcagcagcaaggccctcatcagaagggtattaaactgttaactcttaggcagcagtttagagcaaaaagcagaactaaaataataaactgcaaagagagaagacactgactaaagaggcaacccttaaaataagattttctggggcagccaactaaactgtctctaaaagcaattccaaaggaaaaggacaaaaaaaattataaacaatggcaacatcatttgatccatttcaagggggcctactttgaacaatactcctcatttcagcagatatatctcagttctgatatgtctagttcaaaatcagttttatacttgtgaaattgtaactttaaaacctttaaaggaaggtaacaaaaataaaatgattgctgcaatcaactaacaaaatggaaaatttctagctaaaatttttaaaaattgattttgtttattcggcctgaagctcactacttttaatccttgaactcaaaaaacactcaagttacaagattgagattgtttcccac

SEQ ID NO: 181789 - DNA, 421 bp, Homo sapiens
actagtaatgtcaatatgaaaatgaaattaagaacacaattccatttacaacagcattcaaaagaaaaaactactttagaaataaattttatttaaaaagtgtgatattcatgagctaaaactacataagaatcttgaaaagttaaataaaatttaaataattgaaaacccaccccatgatcatgaagcaaaagaattaatattgttaaaatgacaatattctctgtcttatttcgttctgtgctgctttaatagaatatcatatactgggtaatttataatgaatagaaatttatttaccttgtggttctagaggctgggaagttcaacatcaagtggccgcatctggtgaaggctttcttgttgggtcataacgtggtaaaatgggtaaagcttattaaacataaattgtaaccccata

SEQ ID NO: 181790 - DNA, 632 bp, Homo sapiens
agaacacatactgaggctgagtttatatttgaatgtatctgtttttttgttgtatgtttgaatgaagacctagagaaaacatggcaacattcactttcaagagtgagagaatgaagtggagcaggaatagaatcagtacataaatcctgtcaacatttattagcatttgcaaatctgactcacaaaacctcagcctaatcagactggatttttgcatgtcatgacaacagcatacaacattgtttctggagggatcagctgcggcagcctcctactgtcctttggtgacaaggctttaatgactccataaatgtatgctgcccagctgctgcccgcttaattagacgatgatttccacttgattgaacctgcccagcagccagttgtcacctaacattcacaggagaccacactggtctctttcagaactaccaggatcaaacagtcacacgagttctatggttcctacaacatggcagtatactgtttgatttaggacttgaatcatatttctccctttttaagaatatacccttctctgccagaaggttgttacttctcagattaaagatgtgaaaggaaaccttcccaggctcatcttaattggacatatacatcatcactttagtata

SEQ ID NO: 181791 - DNA, 1214 bp, Homo sapiens
cttttactaccatgacggcattgatagggtttttctcctatatggattctctgatgtataataagatctgagctctgactgaaggctttcccacactcatcacatttataaggtttctcaccagcattttttattttttgactttttaataatcattctgactggtgtgagatggtttttcatggtggttttgatttgcatttctctaatgatcagtgatgttgagctttggatcagtttgatcaattgatcagtttgggattgattttgattcaatccttattcttattgtgcattatttttttttgcctctgcatgcctggtaatttttgactagattctatgtgctggatatttttttatccctagaaatcttcttgaactttgcttagggttacagttaagttacttggaaataatttgacctgtttcttgttttgcttttaggattttttaggtgaatctggtgcattgctcagtgaggcaagatcttcctgagtactctactaaatgtcctgtgaattatgaatttttcttgtctggctggtatgaacatccactgttcccagtaggctctttgtaagcaccaggcagtgttcccaccagtcctttcatgtggttctttccattgtctcagttagtttcttcacgtgcaagtgctgctcagtactctgcttaatactcaagggagatcctttgcagatctctggggttctctttctttgcacatttgttctctctggtatactatcctataaactgtagcttccccagtctttccagactcagccttatttctgaaacttagagagtccataggtctgtgccttaattttttctctctgtgcctttgcctgaaaattttcttgatgcagtaatttacaggcaataatgggactcaccttgtttgttttccatcatttagcgattactatcctctgttgtctgatgttcattgtcttgaaaaccagtgtttcatgtattttgtccaaagtttttggttgttttaggtttcaggctaagctcaagtacccattactctattttagccagaagcacttttttaaaaaaaaagtcaattcctattatgttatttttcctcctatttactgggcattcttaaaatatcctaccccatgctgcctcatttttttactcatttgagtatttgcatatatgtatatttccatctttttctaacagttgcccttgaa

SEQ ID NO: 181792 - DNA, 390 bp, Homo sapiens
tacagtagttccccccatctgcagtttcagtttctgtgacttcagttgctagcagtcatctggggtctgaaaataggtgagtatggtgcaagaagatgttctgagagagagggtgagaacattcacctgactttcattacagggtcttgttatcattgattttattagtcattgttgttaatctctcactgtgcctaatttataaattgaactttatcatacatatgtatgtgcaggaaaaagcatagtacatatagggttcggcactatctgcagtttcaagcatgttgagcagataacttgtcttttagttgattagcacaaggaaccagacacattcaaacctggtgggaaactggcacagtcctgcccgatcccggtacatgcaag

SEQ ID NO: 181793 - DNA, 662 bp, Homo sapiens
atgaaagacacttctggagggacttgaagaaagactcaggtctttcacatccattcccttctttcccctgtttcagcataactcccacttcatattgtgtgattagccggttctgtgatgtgtctgaatgctgtctcctacaggtaaagtttaagcattactgactataggcaaacaatggcctctcagctgtccatcagaagaagctacagaaaagtaagttttctttattcagtcaacaaatatttactgagttcccactataggccaggcatactctgctgggcgccgggaagagaaaacacctgctctcaggagggagagcgacaggggttactggctcaaatctgtgtgtgagattgaagttctaaggaaggctttgacctaatgtagtgagaagaataaaacacaaataatttatagtaaatgaggatgagagagaccacaaaatttaatgttattaaattcttcctcataaggaggaagaaacaaggcctttaagaaaaacgttgtaagttgtcattgttttttgttttttgtttttttttttgagacggagtctcgttctgttgcccaggctggagtgcagtggcatgatcttggctcacttcaagctccacctcccgggttcacaccattctcctgcctcagcctcccgagta

SEQ ID NO: 181794 - DNA, 399 bp, Homo sapiens
tgatttaattgaagcaataatttaactattgatccagaatgattgctatgtatttttaaagacacaaattacatttgcttgctagacttttttttttcatattggtcaggtttctactgttattttgaaaagaactcaccatatcttgatgttgacacattccttaaatagaataataaaatacatcaggtacaatctaagcaaacagctgaaatcaaagtgtaaatagcaaattacattctggatcacacaagttatgactatggttatatatgagacagaaaaaatataaaaggataccgtttctttaatattctttaattgccaattttgagtcatcaaatttatcaggaaaaatactttaaattattgtaagcaaaggtaaaacaacttaataaa

SEQ ID NO: 181795 - DNA, 470 bp, Homo sapiens
atagctatttattctcaaagagtggaagctctttgagagtcagtatggaataactgtaaaatatattacggaatgacaaaagcagttttcatggtatgttgatacatcctttgtgtaaaaagagggaaaggctgggtgtggtgcctcacggctatagccccagcactgtgggaggcagaggtggctggatcacgaggtcaagagatcgagaccatcctggccaacatggtgaaaccccgtttctactaaaaatacaaaaattagctgggcatggtggtgcgcgcctgtagtcccagctactcaggaggctgaggcaggagaatcgcttgaacttgggaggcggaggttgcagtggcgcaatctcagctcaatgcaaccccgcctcccgggttcaagcaattcgctgcctcagcctcccgagtagcctccattgaaggaagtgccatagtgtgggaggatctttttatttt

SEQ ID NO: 181796 - DNA, 642 bp, Homo sapiens
gaagaccaagatcagtaagatatagtttctgctcttaaagagttgtagccttgtcgaggaaatcagaagtgaccataatcataacacagtgatgggtgccccagagaggcccagcagaatattctgggagtttaaaggatggagaaacactgatttccccaatgaatagagggagtgaaggcttcatgtgggaggtagtatttaagcagtgtcttactagatgggacttgaacctatgaagagtttttcagattgaggcatgtgttgaggataacaacttcagattgctacattgtctagtgaggaaaataaatgataataatgctagtgtttattgaatgtttaacttgtgctgttttaagtgttcttatcatttcctcataacaataacatagtaaccctatgagataggtattattgtcattccattttacagatgaagaaattgaggttaagaaacttgaaactcttaacccacactggtcctggagagttcactcttacttgctatgttatactttgggaaatgtagcaaagctggatggggttccatttatgtagagtctcaaatgcccagatgaataatttaatatattggaagatatttttaaaatggttctgtgtgaaggttttaagcacatc

SEQ ID NO: 181797 - DNA, 241 bp, Homo sapiens
cctcactaccgttcccccatgacagtgtcttatttacgtttatggttttactgtcacatgccaggcatgatttcagcccaaaattagctcttcctttgttttatcagaaagaattatttaagacaatttctctaaaacccaaatcttcacctttgggaaaggagcagcaagcagtcctgtcaatggaaaattaggaaccgatgggcagaaatcccattcttcagtaatcatcaggaaaaaa

SEQ ID NO: 181798 - DNA, 1068 bp, Homo sapiens
tggctggaacactggtcatgacagaggcagtgactctgactgaggtcaaggccaaagccagggaagtggccatgaaagaagcagtgacccaaactgatgctgaggctggcaaaatagttaagaaagaagcagtgacacagaccaaggctaaagcttgggcgctggttgccaagacagaggccaagagagaagcaatgacccagaccaaagctgaaactcatatattggctgaaaaagagacagagattaacagagtaatggttacacagagtgagaccttggcagtacccagggaagtggccaagatgggggccacgaacaagactggaattgtggatgaaaccaagacaagagctctggaagagactgtgagtgtggctaagactcagtctgaggccaggcctggtgccacagttgatgctaggggaaatcccaatggcatgtccagggaggtggctggagtggacatgaagtcctgtgcacagtctcaggctgtgaccaagatccagggtgatgacatgcctggtactggggttgaggacatggggaattgtaaaaccatgtctagggcagagtctggggcagacacgagggcttctgctcagcctcaaatttttgccaaaacccagactgaggccattcctggggcaaagattgatgccgggggtaacaccaatgccatgtgtaaggtgggggcaggggcagatgtgagagcttgtatacaacctcagactgtggccaagaaacaggctgaggtgacgtctggtgccagggttgatggtaggggaaataccaatgtcatatctaaggcaataactggagctgacatgagagctgctgctcagcctcaagctgttgccagtactcacgctgaggccatgtctgatgctaaggttaagaacagaggcaatcccaatgccatgactaaagcaggggccaaggcaaacttgagggccaattcccaggttgaggccttgcctgatgccagggataagagcagaggcaatcccaatgttatggctaaggtgggggatgggacagacatgttgtcctgtacacagcctcagc

SEQ ID NO: 181799 - DNA, 181 bp, Homo sapiens
aaattaatgagttttgaaaatgcatacatgtgggtaatctgtgcatcccccaccccaccaacaagatatagaatatttccatcaccacataaaaaggttcctgcagtacctacccaataagtccctcccccaactcaggaaactgctgagcactattctgattttttcatcatggattagt

SEQ ID NO: 181800 - DNA, 493 bp, Homo sapiens
agctcctacaactcagtgagaaaaagatgaacaatggaaaaaacaggggtaactgacttgaataggcccttcacaaaagaggaaatagaaatgaccaataaacatataacatgatgcctagtatatcattagaaatacaggaaatacaaattaaagtcaattttactttttttcattttaaccaaatttatttaaaccccaagactttgtagacacagtggctcacgcctgtaatctaagcactttgggaggccaaggtgggaggatcgcttgagcccagaaggttgaggctgcagtgagccatgatttggtttatttttaagtaatttatccctacttaaagacagattaccctacatgtgaaagctatgtacaaaaatcatccactgattagaaggatttttttaagttatacaattgtccttggtttttacaatgataaatgaaaaacattaaaattcttcagttgaataaagtatggaaggatttttat

SEQ ID NO: 181801 - DNA, 441 bp, Homo sapiens
caaacaattgtagaatatcgatgggatactatcagcaatacaaaggaattaactattgatacatgcaacaacatggatgaatctcaaaatatgctgaaagaagccaaacaaaaaattagtatatatcatacaattccacttacagttgaccttccataaattccacatccatggattgaaccaactgcaaatcaaaaatattccgtaaaaagaaaaaaacacaactataaaaaatgtagaatacaaattttaaaaaacaatacagtatggccgggtgcagtggctcaatcctgtaatcccagcaaatcccaaatttgggaggctgaggcagacggattgcctgagctcaggagttcgagatcagcctgggaaacatggtgaaaccccatctctactaaaaatacaaaaaattagccaggcatagtagtgtgtgccttaatc

SEQ ID NO: 181802 - DNA, 305 bp, Homo sapiens
gaaagggcctgtttaataataatgtgaagaaagggcctctttaataataatgttaagaaggggcctgtttaataataatgttaagaaggggcccgtttaataatcttaagaagggtcccatttaataataatgttaagaaggggcctgtttaataataatgttaagaaggggcccgtttaataataacttaagaaagggcctctttaataataatgttaagaaggggcctgtttaataataatgttaagaaagggcccgtttaataatcttaagaagggtcccgtttaataataatgttaagaag

SEQ ID NO: 181803 - DNA, 701 bp, Homo sapiens
gtagcagcagacagtgctatgcaaggagaatggctgtttcagaagtccagctcctcacatgaatttaatgtgttgccttttcccccatacattttgtttaaatccatggtcatcttgccatttagtggtgtggtttaattgcatatttgggttagtctgtatgtaatgtttaacataggtgtctctgtgttaaacaggaatcctcttcattttctttaccaatatggtttgtggactatgatgagccaaatctgacatcagttctggaatgtctagaagatgctaagaaaaacaattcagtgaggaaagaagccaagctattttctcttttcctcatgaacattatatttagaaattaaatattaagatatgataaaaacaaaagcatgattaatgactataatattagaggaattaaagtctgggtattttaagtccttccaatcttacttactacctggattctctttattatttcccacatgtataaccttagtttagattaggaattcaggatctctttttccctgaattctaaccattaagccaagcaagcattttgggtagtgaccactagccaaggtgggaagtagaaaaaagaccaaggtggaagtgaaaggagagaaggggagaatgacaccagaactagtgggaggggattgccttttctttcaagggtctgtaagtctgcagtaaaagtc

SEQ ID NO: 181804 - DNA, 299 bp, Homo sapiens
  misc_feature (4)..(4): n is a, c, g, or t
  misc_feature (19)..(19): n is a, c, g, or t
aagnctaaaaaaaaaaaanaaaaggagatagagcaggaacgtaagaaatagttgggtgcagtggctatgtggtggcactataggaggctgaggcgggcagatcacctgaggccaggagtttgagaccagcctgggcaacatagtgagaccccgtgtctacaaaaagtaacctttatatattttttttaacagtggaggcagttcaatatagagtcttttttgaacaaacgtgaaatagatgtcttttaattttctggaggaaaaagcaaagcaaaagaagcagtggatattttaagact

SEQ ID NO: 181805 - DNA, 853 bp, Homo sapiens
cgcccagtaacttaggctaggtacgaggctgggtggtggaatgaatggagatgacgcctcagagattctttcttttgagatgaggtctcattctgtcacccagactagagggcagtggtgcaatcacagctcaccacagcctcaacctcctgggcctcccaggtagctgcgatcacgggtgtgcaccaacatgcccagctaatttttttttaatttttaatttgtacagacagggtcttgctgtgttgcccaggctggtctcgaactcctgggctcaggtggtcctcccacctaagcttccccaaatactgggattataggtgtgagccactgtgcccaggcttgcctcagatatttgaaggctgggaaggattttgcaaagctgggaaaaggaaaaggcattcccagcagaggggatagcaggtggaaatacataattaaaaaaaaaaaacgtggagcagatccagcgcaggggctcatgcctgtaatcccagcacttggggaggcagagcagggaggattgcttgaggctaggagttcaagaccagcctgggtaacatggaaagaccctgtctctacaaaaacacaaaaaattagccaggcgtggtggtgcatgcctgtagtaccagctacttgagaagctgaggcaggaggactgcttgaagccaggagtttgagaccagcctgggcaacatagtgagaccccgtgtctacaaaaagtaacctttatatattttttttaacagtggaggcagttcaatatagagtcttttttgaacaaacgtgaaatagatgtcttttaattttctggaggaaaaagcaaagcaaaagaagcagtggatattttaagact

SEQ ID NO: 181806 - DNA, 1239 bp, Homo sapiens
gttctcccatgcatgtgtactgtggcaagggagactttgaggaagagattccagtggctgagcagaagggctcgcattgccctggcgaaaggttggaaggcttcacctgagagtgtgtcgtggcctttgtcatatccactgcttgattcctttctttaaaaattatttttattgttttctacatatgagaaccaccacacctggctaatttttgtattttttgtagagatggggtttcaccatgttgtcccggctggtctcaaactcccgggcacaagagatccacctgcctcagcctcccaaaatgctgggactataggcatgagccactgcacccagccactgcttcattcctggtggctgctgtgcctggcatgttgcagatcctccatgaatatgcatttgaatgaatgaatgaatgaatgaatgaatggagatgacgcctcagagattctttcttttgagatgaggtctcattctgtcacccagactagagggcagtggtgcaatcacagctcaccacagcctcaacctcctgggcctcccaggtagctgcgatcacgggtgtgcaccaacatgcccagctaatttttttttaatttttaatttgtacagacagggtcttgctgtgttgcccaggctggtctcgaactcctgggctcaggtggtcctcccacctaagcttccccaaatactgggattataggtgtgagccactgtgcccaggcttgcctcagatatttgaaggctgggaaggattttgcaaagctgggaaaaggaaaaggcattcccagcagaggggatagcaggtggaaatacataattaaaaaaaaaaaacgtggagcagatccagcgcaggggctcatgcctgtaatcccagcacttggggaggcagagcagggaggattgcttgaggctaggagttcaagaccagcctgggtaacatggaaagaccctgtctctacaaaaacacaaaaaattagccaggcgtggtggtgcatgcctgtagtaccagctacttgagaagctgaggcaggaggactgcttgaagccaggagtttgagaccagcctgggcaacatagtgagaccccgtgtctacaaaaagtaacctttatatattttttttaacagtggaggcagttcaatatagagtcttttttgaacaaacgtgaaatagatgtcttttaattttctggaggaaaaagcaaagcaaaagaagcagtggatattttaagact

SEQ ID NO: 181807 - DNA, 488 bp, Homo sapiens
ctcagcctcccgagtagctgggactacaggcacccgccaccacatccagctaatttttaaattttttgtaaagatgatgtctcccaggctgaagcgattctcatgtctcagcctcctgagtagctgggattacaggctcccatcaccacacctggctaatttttgtatttttagtagagatggggtttcactatgttggccaggctggtcttgagctcctgacctcaagtgatctgcctgccttggcctcccaaagtgttgggattacagatgtgagccacctgcccggacccctatttaatgtatagtttttgttaaagttatatcagaattctagctgaatgatatttagagtccttgttcctgctttgtacctgggacactgccttgttactgatatggctttgaggagtagaggaacaccaggttttttgttttgagttgaattagataaaacgacacggacacacgtggagtggttttaagga

SEQ ID NO: 181808 - DNA, 129 bp, Homo sapiens
ttgaataactacactcctaagcaggtagactcttaaaatttaaagaaactctaacacctggtcaggacaacatggcgtttgagcctaaacctagaatctatagttaaagaaaaggtttatcaggctcac

SEQ ID NO: 181809 - DNA, 231 bp, Homo sapiens
agctaattttcgtctttttagtagagatgggatttcaccatgttggtcaggctggtctcccactcctgacctcaagtgatctgcccgcctgggcctcccacagtgttgggattatacgcatgagctaccatgcccgtgccagtgatgaatcttgccaaggaaagattccttaacttaaattttataaagtattattacattttaaaaatgtcaaaatgcaatgcaagtaat

SEQ ID NO: 181810 - DNA, 189 bp, Homo sapiens
caaagtgctgggattacaggtgtgagccaccgcgcccggccatggtttggcttttttaacttgggagtcttatttgcagtgagaatggacctgaaggcatgtgggtgtgtggggtcttcattccaggtgatgtgaggtgttcttttgtcctcagcagctcatgtgaggagcctttatgtatgtgtatgt

SEQ ID NO: 181811 - DNA, 482 bp, Homo sapiens
gcagttcctaacgaacttctttgattattaacctatgctgggcccagggaaattactcacttgttttctggccaagagaaaatctcctggaaacttctatatataaatctttttgacaattccgcattcaagagagttccctggcagttcttctatttgtagggtggggagaaaaacccatgtaatttcccccaaactgtggattttgttcctatagaacatgcttgtgagattcagtgtgcgtatttgtgtgagtgtgtgtgaatgtgtgtgtgaatgtatgagtgtggatgtgtgtgaatgtgtgtgtgtatgtggatgtgtgtgaatgtgtgtgtgaatgtgagtgtgaatgagtatgtggatgtgtgtgaatgtgtgaatgtgtatgtgtgggtgtgaatgtgtgtgtaaaggtgattgtgagtgtgtgaatgcgtgtgtgaatgcgtgagtgtgtgactgtgtgaatgtgtgaggtg

SEQ ID NO: 181812 - DNA, 410 bp, Homo sapiens
tctttacttttctctccttgtgtcttctttctcagtctgtctaccttatcacctcctggatttccttatcacctcctgggtgcatccttattgccacaccagactgatcaaacatgttaggtacaatcttcatcccagatgtgttcatttgttgatgggtgctcaaagactacttcttcactgcccctctaaaaagagaaagtttcaggctgggcgcggtggctcacgcctgtaatcccagcattttgggaggccaaggcagggggatcatgaggtcaggagttcaagaccagcctggccaagatggtgaaaccctgtctctactaaaaatagaaaaattagccaggcgcggtggcaggcccctgcagtctcagctactcgggaggctaaggcaggagaatcgcttgaac

SEQ ID NO: 181813 - DNA, 1680 bp, Homo sapiens
gagctagcatcaccctgagaaagcaggctggccccaggactcacgggcgtccatgcagctgatggaggggagctggaccggacgactgtgctctcttagctctagcatcaccctgagaaagcagcctgtctccgggactcacgggcatccatgcggctgatggagggagctgggccggacgactgtgcttctcgtgcttcatgtagaacccttaggtttgcccctgaagtctgtctgctccatgtactatttagttgcttttcagcatagagcttggttttccctttttttaattgtaagaatgatgtgctctggcatgtcacactgtgaaaggggaccagatgatggagcctggactgaaagggtgaatggggccgctcacctcagaactctccctgctttgctttgctgggagcagggagcagggcagcctgggagaggctggagttcctcaaagggcagagaagaatggccttcaggggaccacagggaggaaccatgccatgatagactcaaaaagctagattatgctaataaaaaggggaagacatctgtgacacacaggaaacagtgttcgtggccttgccatagaaggcgcagtaaaggaggaaaactccggagactccctgtgaattcttggctaagaatgcacgttatctgcagtgatctaaaaacacaaacgagaacagaagtgagtggccctacctgtgagatgcacagtgctgagcggcacccagcgctggctgcaggatgggaggctggctgccgtatgattgttcgtgggaagaaattttgtagaagttatcaagctccttaaaatgttcgtgctgtgtctgcctggacagttgcaattctgagaagcgatccttgaaaatgattctgggtatagaaaaaggtacagcacagtggtgttcttagtatggctgtttacagtcgcagaaaatgagatgctaaactgctgccctaggggattggttaagcaaactggtgcttccactccatgagataggatgcagccatttgaaatatttatgaaggttttggacagtcatttggaataatggttttgttggggctcttaacttgcaagccaatagaaaagaaatctggctaatataatcctataaattatttccctacagcccatttttaaggttcccagtaactttcagaatcaaaggagacatcggatggccaggcctcagtagtggcaaggcccaggcagttccagatccctgcagcctgccactaccccgagtctctccaggtcaccagccaggcttgggggtgatggaggaggactcggtaagggacagttcacttggcaaatgtttagggagcacctgctgtggccaggcattgccctagaggcagggaatatgatagaaattgcggcagtacaggaaggtaaggtccctgtaccgcagagctcacagtctcatgggaaggagttcttacacaggtgaggtaagtgttagggagaaactaaagccaggtaatgagagagggcagtggggctgcagaggctggggtgagccacagactactgtagacacggtagcaacgtaggtctcttaagaaagtgacacacaacgtaggcctaatcacagcactttgggaggccaaggtgggaggatcactgagaccagcctgggcaacatagagagaccctgtctctgt

SEQ ID NO: 181814 - DNA, 553 bp, Homo sapiens
ctggaagattgggtagatgaaaacacaaatcaaaaatcagataatgtcagataacaagagatgctaagaaaaataaaacagggtgaggagatggagtgacatggatgggaacttggtcagggaagcctcctttgaaaagataccattttataacagtcctgaatgaagagaacagatcagtcaagtgaagatgtcaggcaaaagtattccagacagagaaaatagctcagacaacgcccaagacagaagtatatttgggatgtttcagaataaaaggaatctcattggggttaaaaattatccaagcagagaagaaggcagaagccaagattatgtaggccttgtagactatacaagcaattaaggttgtattcttttgggatggactccagtggaggatcttaaatggaaaagtgacattactacttttatgaacgagcactctaacttttcttctagatggaggataaagtagggatacaagaatggaagcagtgaaaccatttagaaggtcatttctttggaccacgtaagagatacatgatggcatgaa

SEQ ID NO: 181815 - DNA, 536 bp, Homo sapiens
aagcgatcctcctgcctcagcctcctgagtagctaggactgcaggcaaacaccactgtactcagctaatttttaatttttttgtagaatcagggtctccctgtgttgtccaggctggtctcaaactcctgggcccaagtgatcccccctacttagcctcccaactgtctacagtttatgaagttaacatttgtgatttgctcctcttttgtgagttgcacttgaggggagagattattgcccttgttaccaaaggaatatgaactaagattgagttgaaagggcaattaaagtgatttttggacctatttccctatttcttgagagatagcagaacatagatcctatagtatcaggctcaaagggcatcagtgccccattagaaagtcatctttgggctctgacccatttgttcctggctagcattgagagcagctgtttcctttcctccctgaggaatcactgagcgtggtctattctttggcttcctaacctctctcatagcacataccttagatgaattatctgcattcccac

SEQ ID NO: 181816 - DNA, 769 bp, Homo sapiens
ttgcgcaggctggagtgcaatggcacaatctcggctcactacaacctccacctcttgggttcaagcaattctcctgcctcagcctcccctgtagctgggattacaggcatgcgccaccatgcccagctaattctgtagagacagagttcttcagcagagacagggtttctccatgtttgtcaggctggtctcgaatcccagcctcaggtgatccacccaccttggcctcccaaaatgctgggattacaagcatgagccaccgcgcccggccaagaatttttatacatacataatccagcaggtatcagccttttttcctgcccaaacacaagaaagaacaacttgacagacacaacaacttcctctattaaaaccagttttattccaaaaggggggcaaaatgctgcattatacaaagagactctattacagataaaataagtgctgtgggttccctacatgagaggagggaaactgaattcagttacagcaacaattaagcatgcgggaaaatgctctcctcaaaggaaaacggaagaggtgcgtcatgaaaaccatgcagtctccgggagcttgaatcaataggcaataattatttttacaagttatccaataatcaatttgagagatcaataggaaacataaaaaaaatttcttggtcaaatcttttctgcctacaaactatctagatgggagatagatgaggtaatactgacaaaaggcagatgtggaaataaaatggtcacccatatttcagtcataaaaatgg

SEQ ID NO: 181817 - DNA, 659 bp, Homo sapiens
tgggaagtaatttcccatgctgttgttgtgatactgaatctcacaagatctgatggttttacaaaaggacagttcccctgcacacactctcttgtctgctgccatgtaagacataactttgcttctcatttgccttacaccatggttgttaggcctccccaggcaggtgtaactgtgagtccattagacctcttttataaattacctagtctcagatatgtctttattagcagcgtgagaacagtctaatacagagaataacaccttaaatgaaataacctttttggactctacatttcttcctgtaatttgccatttaatttccttttttatatacaagaaactagcattgcaatttcttagtacttaaatctcattacaactaacattgatgagctggtgtcctacgaagcattttcagatatccttggaagaccttgttcctttttttccccctgagaagttaaatatctaattcaaaggattttttaacctggacaaatttgttcttgaacaggtttatccatacctaactggtcagcatctttgccagaagatgaaatatgtaataagcaccaattgccttgttgtagcatgttagaaagccagttaggaattcagcaacttatggcctatcaaaacctgtagctgcttttcga

SEQ ID NO: 181818 - DNA, 126 bp, Homo sapiens
atcccgacagctacggcagcagctgaggctgccgatctgccctcgcggctcggctgcggcctccgcacccggtcccagcgcctgcgggagggctgacttgcccgctctgcgcttcccccgggcagg

SEQ ID NO: 181819 - DNA, 230 bp, Homo sapiens
attaatctgcacacccctgaaatcactattccaacttctatcactatttgttagttttgcttctgtgttcttcgacttcatataaatggaatcatacagtatatattcttttttgtttgacttcttttgctcaatataaggttagccttaccacaacttagtcaaatggaagaaatacagatgataggctatagttgccaagggctctgtctacataattcttataaaat

SEQ ID NO: 181820 - DNA, 490 bp, Homo sapiens
atcccagttctggaattcaataaagctgtatcttttaattaattgttatttctatgaataactattcaaagtgtcagcgattatgtaaaattattaacactttaaagctgtgtgtgtgtgtgtgtgtgcgtgtgcgtgtgtgtgtgtgtgtgtgtgtgtgtgtgtgtaagtattagctcttccccaagttggagtactgtttatttgcctgtttcatacaggatttatgctttttaattatgaaagccaaattattccaatcctctaaaaatctatgcaagatcaataagaacagaacagataaaatcataaaactccatgtttttggcatgagaggaagacagagaacactacaaattttaaactctccataagtagaaaggtaaacactaacttctggaaaagagatttctcaagtttccttctcaagtctttgtggagagctgagtttttagaaaaattgcatggaaaagagaagatgtaattgagc

SEQ ID NO: 181821 - DNA, 304 bp, Homo sapiens
ccctgctgtggccacctgccctaaagcagcccagggttctcctctcctaagctcgcagctgctacttcataccaagctccagggtgagggctttggtaattggcatcggtgtctgaggcggatgtaggcaggaacagattgaatctgcatgagctatttcggtgtgacaagggagctggaatagttgcagcagaatgcagtgtaaccaggagccagataatcctttctggctccaaagacaggggtttctgtgttgtcctgagacatgggtctcctttctttgccttcttgagtgcacaggcat

SEQ ID NO: 181822 - DNA, 186 bp, Homo sapiens
gatgttccccttcctgtgtccatgtgatctcattgttcagttcccacctatgaatgagaatatgtggtgtttggttttttgttcttgcgatagtttactgagaatgaaattttttcagttttatacgtttatgtaagtggcaccatacagtacatattattttgcaacttgccttttttttttttg

SEQ ID NO: 181823 - DNA, 323 bp, Homo sapiens
acaaaagagtaaggagtgtccacctgagaaggatgaagaagtggtaacctcaggaataagttgaattcagttatgccaaatggggaaaatgaatattgaggaataaatgagttaattatcatagaattggggtttctgatagcacaataaatgagtgctgcttcaataaagaagtgagcaataaaagaaagcatgaatctaaaatctttacataacaggatggttgtgttgaaaagaccagataattagattggcctataatttagattatggacaaaattatgaagacgggaaagtcagttagctcacatggccactcaata

SEQ ID NO: 181824 - DNA, 507 bp, Homo sapiens
acttgttagttttcgttattatttatttatttttattgatcattcttgaggtgtttctcgcagagtggggattcgtcagtgatcatatggtcacactactgtgatggaaggtcagcagataaacaagtgaacaaaggtctctggttttcctaggcagaggaccctgcggccttccgcagcgtttgtgtccctgggtacttgagattagggagtggtgatgactcttaaggagcatgctgccttcaagcatctgtttaacaaagcacatcttgcaccgcccttaatccatctaaccctgagtggacacagcacatgtttcagagagcacggggttgggtactacgctttggctgccaaagcgtagtacccaatagctaggactacaggtatgcaccaccacacctggctaatttttgtatttttagcagagatggggttttgccatgttggccatgctggtcttgaacccctggcatcaggtgatccacccgccttggcctcccagag

SEQ ID NO: 181825 - DNA, 395 bp, Homo sapiens
ataaggaatcaacacttcaggtgggttcatgaggacgccattccaaacaactagaactctacccatggtggaaccccttcctcctcccttcggaagcagtcatcattgtctggatgtaaatccccagatgtaaccctgattgatctcattttctcttttctggcactcagtggatatgtggattctagcttgtctgtgatagctttctttccctagcatgaatgatctgtttctttaccataagttttttttcaaagccttacagatatgaaaatgacccacactccagtcttttctaaaaagtatggatggtgtcatcagacactttcccccccgcaaaaaaaaagagagaatatttgcttctttccaaataccatcaaaatactctgtgtgct

SEQ ID NO: 181826 - DNA, 327 bp, Homo sapiens
agataataaagctaaggttcagagaaatttttaaaaaatctttcttgaggtcacataactaagtgatgaagccagaatgaaatacaggtcaagtacaggtaagcctgtgatctttccaacacaccatgcttgcaatagcagttataaaattatccaagaccaacaattaacccaattaaaaactgagctaggggtttgaacagaaatttctccaaagaagatacacaaatggcaaataaactcctaaaaagttgctcaacatcattagtcactagggaaatgcaaatcaaaatcacagtgagataccacttcacgcccaccagaatg

SEQ ID NO: 181827 - DNA, 255 bp, Homo sapiens
gttcgggctagtcacttaccttctctgatcaccagttgtctcttgtaaagcgagatgtaaaactaggtggctcttcaaactctgacattggtttttttctttatttactatacataccaatgccaaataaggtgccgtaagaaaaaagaaaggtggattgcacactgaaattgggctcgttttcatagactgaacctacatggacatttactggcctaaagtaactttatctctttcttttcttttcttttcttt

SEQ ID NO: 181828 - DNA, 477 bp, Homo sapiens
ggacaggtgatgccaaagagacagagggccattacaggacacagccaaagagaagtgggaaaggaattcttatcccccacaagaatgtaagctcttgagagcagggactgttttgtaatctgctacatacctagtgcctaaaaccgtgcctggaacataaaaagcactcaatactggtggaacgaatagacaaatatgaatgaatcatttgtttaggtaccaggctctgcacaaggttgtccacacaccagcccagtgagataggtgcttatgccattttacagatgaccaaattgaggctcagagtggtaaagtgaaacggcaaggatccgaaccaggtgcagcagactccaaagtctatgctctttctttttttttttttttttttgagacagagtctcgctctgtcgtccaggctggagtgcagtggcgcgatctcagctcactgcaagcttcgcctcctgggttcacgccatt

SEQ ID NO: 181829 - DNA, 748 bp, Homo sapiens
ctggctgaccacatttcaagtgcgcattagccacatgtggctagtggttactgtattggacagcgctggtttagagagttaacgtttcttgcaacttttcagtattagacaaaaagacactttgggaggccaaggcgggtggatcacctgaggtcaggagttcaagaccagtctggccaacatggtgaagccccttctctactaaaaatacaagggttagctgggcgtggtggcgctcgcctgtagtcccggctactcgggaggctgaggcgggagaattgcttgaaccctggaggtggaggttgcagtgagccgagatcacgccactgcactccaggctggagacagagcgagactccgtctcaaaacagcaacaacaacaacaacaacaaaaaaaaaacccttgagttgctcatgtatgtaactcttcccatcctccatgagaatgaagctttttcagtagcttcatttttgagactaagtacctgaatgttagtaagacatttcccccaaactgtgagtatatctctgtgtatctcttatagtataagatgtcgtttgcattaacaaaagcttatccagcctgggcaacagagcaagaacccatctcttaaataaaaaactaaagaaagcccaaaaacaaaaaacacaactttcccacataccaaactctatatggaatacgttttttccctcctacttaagaaggggattcaggggacaacatgaattgataaggaagccacgt

SEQ ID NO: 181830 - DNA, 425 bp, Homo sapiens
ctaaatcaagtgttagcaagggtaccttcctttctggaggctctggggaagaatccatttccttgtcttttccaggatctagaggctgctcatatcccttggttcatggtccccctcttccatcttcaataagcaatcttcagctgagtctttctcatattgaatcctactctgcttccctctttcacttttaaggaccacgtgattatattgtgtcccagataatacaggataatctcatctctagaaccttaattttttccagctataaaatcccttttgccatgtaaggtaacatattcacagattcaacccagtatccaaccctgttaggttgtggacatcttttggcagaggagggagggaataggcaggcattatcattttgtatgcaacattatagaaaagacagatagtactcatta

SEQ ID NO: 181831 - DNA, 440 bp, Homo sapiens
cacagaacatgacccagtccacccaagggaatgccaaacccagcagagaaaaggtcaagcccagcaaaggaacacgagagagaaaacgtcaatccaagcaggaaacgtcaatccaagctaccaacgccaagccaagccaagaacgcaaagccaagccaagccgctacaggccagccaagccgttaaagcgcgtgcagcatgcgcgtgcaagccattacaggccagccaagccgttacgcgcgtgcggcgtgcgcgtgcaagccgttacaggccggccaaaccgttatgcgcgtgcggcgtgcgcgtgcaagccgttacaagccagccaagctgctgccgggcgtgtgcgcgcggcgtgcgcgtgcgcgtgcggcgtgcttatctcaggtggcgtcagggcacgtggcacagacactggccgatgcatgcaacgcgcctgc

SEQ ID NO: 181832 - DNA, 640 bp, Homo sapiens
taagccttcaagtatcaagttcaatgccacctcctcagggaagcctttcttgccaccccaggctagggctgtcagacaccctcacagtagcagcctttactcttgcagcaccagtcacaatggcaattaaagaattattgagaaatttacaagtgtcatgagggcatcatcagctttgttcactcatggatttccagaacttgcacattgtaggtgctcaaatatttatactgatattcagttttcccctctaactctcccaactcctactcaattaactcagaaaagtcctatttttattttttattcatgtttgaccccaaacaaaataaaccatagcaccctaccccaccaccacccaacatgacagattaatattagaatgatgctattttagatctgtaccaaagaaaatgatgtgaaagaatgaagaatgaaggactacatgtatctctaaatctgagtttataaaatggcagtttacattgaattcaggtaccacgtgtgatttacttaacttgtgctgcttaggaaaatgaaatgtaggtttgtgaatccattgagaaaccaaaagatctggcaacatagatgatggattcccgcatggtgactacagactgggagtgagtagccgtggtgc

SEQ ID NO: 181833 - DNA, 1349 bp, Homo sapiens
ctgtagcaggcagagcttaccaagtctctccgaactcaaatggaagaaataccttatgaatgtaagaatgtagggggtcatggcttgtaatttacacagtgtaaatgaaaccatcctagaggattatgaggaatcctttctatgtgattttcaatcatagcaagcaagaaaggctccagtgtcaaggtagttcagctcttacaggatataaaacagtccatacttgagagaaaaaacttagatctgagtgatggaatgtgaagcaaatctttcaaaatcagtagacatttcttggacataaaacacagatgaggaaagggcttcaaattagaagttacgtaatcaccatcagaaagttcatgtttggtaaattctgttactagaaatgtaggaaattcaggtatagctttgaatcccaattacacattggtcagtgggaaaactaagggcctccaacaggcaaattcagggaggataggtttcagggaatgccctggattctggaagacctcaccatgggacgcccccgacctcgtgcggccaagacgtggatgttcctgctcttgctggggggagcctgggcaggacactccagggcacaggaggacaaggtgctggggggtcatgagtgccaaccccattcgcagccttggcaggcggccttgttccagggccagcaactactctgtggcggtgtccttgtaggtggcaactgggtccttacagctgcccactgtaaaaaaccgaaatacacagtacgcctgggagaccacagcctacagaataaagatggcccagagcaagaaatacctgtggttcagtccatcccacacccctgctacaacagcagcgatgtggaggaccacaaccatgatctgatgcttcttcaactgcgtgaccaggcatccctggggtccaaagtgaagcccatcagcctggcagatcattgcacccagcctggccagaagtgcaccgtctcaggctggggcactgtcaccagtccccgagagaattttcctgacactctcaactgtgcagaagtaaaaatctttccccagaagaagtgtgaggatgcttacccggggcagatcacagatggcatggtctgtgcaggcagcagcaaaggggctgacacgtgccagggcgattctggaggccccctggtgtgtgatggtgcactccagggcatcacatcctggggctcagacccctgtgggaggtccgacaaacctggcgtctataccaacatctgccgctacctggactggatcaagaagatcataggcagcaagggctgattctaggataagcactagatctcccttaataaactcacaactctctggttc

SEQ ID NO: 181834 - DNA, 626 bp, Homo sapiens
agcctcccgagtagctgtgattacaggtgtgcaccaccacacccagctagtttttgtatttttagtagagacagggattcaccatgttggccaggctggtctggaacgcctgacttcaagtgatctaccgcctcggcctcccaaagtgccgggattgcaggtgtgagccaccaagcctgtctgggatttcattctttcccctcttctgtcagtgttttgaccactacccttagacaccatgtctgtctgtacatggaagccccaagccctgtcctgactggtctcaggggacaatgcttttacccccattggctacaggggaccaatcatgccaaagaactggtaaaacgctgggacagcaggaaaagggacgttgtggacatctcagatgcaaggctgttctcattctccctgtctagggcgattctggaggccccctggtgtgtgatggtgcactccagggcatcacatcctggggctcagacccctgtgggaggtccgacaaacctggcgtctataccaacatctgccgctacctggactggatcaagaagatcataggcagcaagggctgattctaggataagcactagatctcccttaataaactcacaactctctggttc

SEQ ID NO: 181835 - DNA, 575 bp, Homo sapiens
ggaaagaaagggggttagatccagacagggatggaggcaaagggctgctctctcagggaaccttacaacctcttccccctcagagaattttcctgacactctcaactgtgcagaagtaaaaatctttccccagaagaagtgtgaggatgcttacccggggcagatcacagatggcatggtctgtgcaggcagcagcaaaggggctgacacgtgccagggcgattctggaggccccctggtgtgtgatggtgcactccagggcatcacatcctggggctcagacccctgtgggaggtccgacaaacctggcgtctataccaacatctgccgctacctggactggatcaagaagatcataggcagcaagggctgattctaggataagcactagatctcccttaataaactcacaactctctggttcaaaacatgtctctgttttggccctgtggggagggctggatggggatccgggattgttcctgctggcagactaggtggggatgtgcagaaaccaagttctcatggtcactttggccatcaccactgcctaaagtgatccctcgttttctgga

SEQ ID NO: 181836 - DNA, 777 bp, Homo sapiens
agcctcccgagtagctgtgattacaggtgtgcaccaccacacccagctagtttttgtatttttagtagagacagggattcaccatgttggccaggctggtctggaacgcctgacttcaagtgatctaccgcctcggcctcccaaagtgccgggattgcaggtgtgagccaccaagcctgtctgggatttcattctttcccctcttctgtcagtgttttgaccactacccttagacaccatgtctgtctgtacatggaagccccaagccctgtcctgactggtctcaggggacaatgcttttacccccattggctacaggggaccaatcatgccaaagaactggtaaaacgctgggacagcaggaaaagggacgttgtggacatctcagatgcaaggctgttctcattctccctgtctagggcgattctggaggccccctggtgtgtgatggtgcactccagggcatcacatcctggggctcagacccctgtgggaggtccgacaaacctggcgtctataccaacatctgccgctacctggactggatcaagaagatcataggcagcaagggctgattctaggataagcactagatctcccttaataaactcacaactctctggttcaaaacatgtctctgttttggccctgtggggagggctggatggggatccgggattgttcctgctggcagactaggtggggatgtgcagaaaccaagttctcatggtcactttggccatcaccactgcctaaagtgatccctcgttttctgga

SEQ ID NO: 181837 - DNA, 792 bp, Homo sapiens
ctgtagcaggcagagcttaccaagtctctccgaactcaaatggaagaaataccttatgaatgtaagaatgtagggggtcatggcttgtaatttacacagtgtaaatgaaaccatcctagaggattatgaggaatcctttctatgtgattttcaatcatagcaagcaagaaaggctccagtgtcaaggtagttcagctcttacaggatataaaacagtccatacttgagagaaaaaacttagatctgagtgatggaatgtgaagcaaatctttcaaaatcagtagacatttcttggacataaaacacagatgaggaaagggcttcaaattagaagttacgtaatcaccatcagaaagttcatgtttggtaaattctgttactagaaatgtaggaaattcaggtatagctttgaatcccaattacacattggtcagtgggaaaactaagggcctccaacaggcaaattcagggaggataggtttcagggaatgccctggattctggaagacctcaccatgggacgcccccgacctcgtgcggccaagacgtggatgttcctgctcttgctggggggagcctgggcagggcgattctggaggccccctggtgtgtgatggtgcactccagggcatcacatcctggggctcagacccctgtgggaggtccgacaaacctggcgtctataccaacatctgccgctacctggactggatcaagaagatcataggcagcaagggctgattctaggataagcactagatctcccttaataaactcacaactctctggttc

SEQ ID NO: 181838 - DNA, 1077 bp, Homo sapiens
ctgtagcaggcagagcttaccaagtctctccgaactcaaatggaagaaataccttatgaatgtaagaatgtagggggtcatggcttgtaatttacacagtgtaaatgaaaccatcctagaggattatgaggaatcctttctatgtgattttcaatcatagcaagcaagaaaggctccagtgtcaaggtagttcagctcttacaggatataaaacagtccatacttgagagaaaaaacttagatctgagtgatggaatgtgaagcaaatctttcaaaatcagtagacatttcttggacataaaacacagatgaggaaagggcttcaaattagaagttacgtaatcaccatcagaaagttcatgtttggtaaattctgttactagaaatgtaggaaattcaggtatagctttgaatcccaattacacattggtcagtgggaaaactaagggcctccaacaggcaaattcagggaggataggtttcagggaatgccctggattctggaagacctcaccatgggacgcccccgacctcgtgcggccaagacgtggatgttcctgctcttgctggggggagcctgggcagagaattttcctgacactctcaactgtgcagaagtaaaaatctttccccagaagaagtgtgaggatgcttacccggggcagatcacagatggcatggtctgtgcaggcagcagcaaaggggctgacacgtgccagggcgattctggaggccccctggtgtgtgatggtgcactccagggcatcacatcctggggctcagacccctgtgggaggtccgacaaacctggcgtctataccaacatctgccgctacctggactggatcaagaagatcataggcagcaagggctgattctaggataagcactagatctcccttaataaactcacaactctctggttcaaaacatgtctctgttttggccctgtggggagggctggatggggatccgggattgttcctgctggcagactaggtggggatgtgcagaaaccaagttctcatggtcactttggccatcaccactgcctaaagtgatccctcgttttctgga

SEQ ID NO: 181839 - DNA, 1013 bp, Homo sapiens
gttcccagaagctccccaggctctagtgcaggaggagaaggaggaggagcaggaggtggagattcccagttaaaaggctccagaatcgtgtaccaggcagagaactgaagtactggggcctcctccactgggtccgaatcagtaggtgaccccgcccctggattctggaagacctcaccatgggacgcccccgacctcgtgcggccaagacgtggatgttcctgctcttgctggggggagcctgggcaggacactccagggcacaggaggacaaggtgctggggggtcatgagtgccaaccccattcgcagccttggcaggcggccttgttccagggccagcaactactctgtggcggtgtccttgtaggtggcaactgggtccttacagctgcccactgtaaaaaaccgaaatacacagtacgcctgggagaccacagcctacagaataaagatggcccagagcaagaaatacctgtggttcagtccatcccacacccctgctacaacagcagcgatgtggaggaccacaaccatgatctgatgcttcttcaactgcgtgaccaggcatccctggggtccaaagtgaagcccatcagcctggcagatcattgcacccagcctggccagaagtgcaccgtctcaggctggggcactgtcaccagtccccgagagaattttcctgacactctcaactgtgcagaagtaaaaatctttccccagaagaagtgtgaggatgcttacccggggcagatcacagatggcatggtctgtgcaggcagcagcaaaggggctgacacgtgccagggcgattctggaggccccctggtgtgtgatggtgcactccagggcatcacatcctggggctcagacccctgtgggaggtccgacaaacctggcgtctataccaacatctgccgctacctggactggatcaagaagatcataggcagcaagggctgattctaggataagcactagatctcccttaataaactcacaactctctggttc

SEQ ID NO: 181840 - DNA, 590 bp, Homo sapiens
gttcccagaagctccccaggctctagtgcaggaggagaaggaggaggagcaggaggtggagattcccagttaaaaggctccagaatcgtgtaccaggcagagaactgaagtactggggcctcctccactgggtccgaatcagtaggtgaccccgcccctggattctggaagacctcaccatgggacgcccccgacctcgtgcggccaagacgtggatgttcctgctcttgctggggggagcctgggcagagaattttcctgacactctcaactgtgcagaagtaaaaatctttccccagaagaagtgtgaggatgcttacccggggcagatcacagatggcatggtctgtgcaggcagcagcaaaggggctgacacgtgccagggcgattctggaggccccctggtgtgtgatggtgcactccagggcatcacatcctggggctcagacccctgtgggaggtccgacaaacctggcgtctataccaacatctgccgctacctggactggatcaagaagatcataggcagcaagggctgattctaggataagcactagatctcccttaataaactcacaactctctggttc

SEQ ID NO: 181841 - DNA, 1635 bp, Homo sapiens
ctgtagcaggcagagcttaccaagtctctccgaactcaaatggaagaaataccttatgaatgtaagaatgtagggggtcatggcttgtaatttacacagtgtaaatgaaaccatcctagaggattatgaggaatcctttctatgtgattttcaatcatagcaagcaagaaaggctccagtgtcaaggtagttcagctcttacaggatataaaacagtccatacttgagagaaaaaacttagatctgagtgatggaatgtgaagcaaatctttcaaaatcagtagacatttcttggacataaaacacagatgaggaaagggcttcaaattagaagttacgtaatcaccatcagaaagttcatgtttggtaaattctgttactagaaatgtaggaaattcaggtatagctttgaatcccaattacacattggtcagtgggaaaactaagggcctccaacaggcaaattcagggaggataggtttcagggaatgccctggattctggaagacctcaccatgggacgcccccgacctcgtgcggccaagacgtggatgttcctgctcttgctggggggagcctgggcagcgtgtggaagcctggacctcctcactaagttgtatgcggagaacttgccgtgtgtccatttgaacccacagtggccttcccagccctcgcactgccccagagggtggcgatccaaccctctccctcctgctgcaggacactccagggcacaggaggacaaggtgctggggggtcatgagtgccaaccccattcgcagccttggcaggcggccttgttccagggccagcaactactctgtggcggtgtccttgtaggtggcaactgggtccttacagctgcccactgtaaaaaaccgaaatacacagtacgcctgggagaccacagcctacagaataaagatggcccagagcaagaaatacctgtggttcagtccatcccacacccctgctacaacagcagcgatgtggaggaccacaaccatgatctgatgcttcttcaactgcgtgaccaggcatccctggggtccaaagtgaagcccatcagcctggcagatcattgcacccagcctggccagaagtgcaccgtctcaggctggggcactgtcaccagtccccgagagaattttcctgacactctcaactgtgcagaagtaaaaatctttccccagaagaagtgtgaggatgcttacccggggcagatcacagatggcatggtctgtgcaggcagcagcaaaggggctgacacgtgccagggcgattctggaggccccctggtgtgtgatggtgcactccagggcatcacatcctggggctcagacccctgtgggaggtccgacaaacctggcgtctataccaacatctgccgctacctggactggatcaagaagatcataggcagcaagggctgattctaggataagcactagatctcccttaataaactcacaactctctggttcaaaacatgtctctgttttggccctgtggggagggctggatggggatccgggattgttcctgctggcagactaggtggggatgtgcagaaaccaagttctcatggtcactttggccatcaccactgcctaaagtgatccctcgttttctgga

SEQ ID NO: 181842 - DNA, 501 bp, Homo sapiens
ggacccccaggccttttcccctaaatttgcaacatgtatttttctaggacagtgattttatctttacaaatgaatttagttgcatggcgtgaggtgtctcagcacctgtttgccttctattccctttagaaggtaagtaaaagtaatgggggaaaggattaggtggagcctgtctaaacattctagtgtgtcttggcaaacatagcctgaaatgattcttaaagaactggcattgtttaatcaaatatttttaagggagattcctattttgtcccattaattaatttgtctatttttacatcaatattacaatatcctgatgactggacttgcaaccagctagcattggtactgtacctctgttcttttttaaggttgtttgggctattttaggtcttttgtatttcaacataaattttagattcagtctgtcaatttctacacatgatcttacttaagttttgattgggattgcattgattctatccataagtttggggg

SEQ ID NO: 181843 - DNA, 143 bp, Homo sapiens
attctgtacccttcacacttgttctataaagaactgcccaagactgagtaatttaaaaaggaaagaggtttaattgactcacaattcaacatggctgaggaggcttcaggaaacttacaatcaagtggaaggtgaaggagaag

SEQ ID NO: 181844 - DNA, 380 bp, Homo sapiens
tctgtgccgtaagtgccaattctatgctcaattatgtaccccagcataaaatgcatctccatattgctaaataaagattcacaattagccaggagcagtggctcatgcctattatcccaaaaacttgagaggctgaggtgggagggtcgcttgaggccaagatttcaagaccagcctgggcaatatagttacatcccatctctaaaataagatatttaaaaattagtcaagtgtggtggtgtgtgcctgtagtgccagctacttgggaggctgagccagaggactgcttgagtccaggggttctaggctgcagtgaactatgatggagacactgcgctccagcctaagtgacagagtgagaccccatctcaaaaaaaaaa

SEQ ID NO: 181845 - DNA, 282 bp, Homo sapiens
aattgactcccaacgtaattaggccagggctaccaggcaaaaaattcctcaaattattcagaaccccagagctattcttttgcaatcactcaagtaactgagaaaagagtcaacttttaaatataaatttgttatcagcatcatcattgtccaagcaattcccagcactccacctgcccaagaatatagactcatgagctgagctgagttgagaaccaaatacaggaatacttctctccagccagccaaaatcttttcttccactgggacctggaggcaatc

SEQ ID NO: 181846 - DNA, 196 bp, Homo sapiens
aaaatgcaagtggcctattaataaaggattggggaacatgaattaaaacctagaatggtataaagaggttgcctcatctagaatttatgccctcatccttcaaacagttcatgagaggtactcacagctgctataatcagcaaagctgaattccttgagatctattcatccttccttgctagaagacctgatacat

SEQ ID NO: 181847 - DNA, 365 bp, Homo sapiens
ccaaacccaacttcacacaggttttttcctgctgtcttcttttatagctctgtgttttacatttaggtctatgatccatttgatggtttctgtgaaaggtgttagatgtgtcttgattcactttttgcatatggatgtccagtagttccagcagtatttgttgaaaagactgtcctttctccattgaattgcctttgctccttgatcaaaaatcaattgatctttgactaagatcaatttgtatttgtgtgagtcacacaagtgtgtttgcgtgggtctatttctggtctctttattttgttccatcaatctagttgtctgttcttttgccaataccacattgtcttggttactgtagctttaca

SEQ ID NO: 181848 - DNA, 616 bp, Homo sapiens
gtgtggctgctcacagggcatactgaaaagttaaatatgtctggattgtagggtgcatagaggaatgatgagaacctgaagctagaaaaatagaaagtggagccagttgaaagattttatagtgctgtaggtttgttttatctaatgaagtttgaaagcagggggagtatcatgattaggccattgggcacaattaacactcgtagtttacatggatggcaaccttctctagtggtgcagacttcaggctgtatgcagcaaccctgatcaggattcagttcttaaggaggagagtgtgatagcaggagaataagttaggattcttttaaaatataactgatagaagatgcctatgttgaaaacatggcattggtgagggagaagaaaagttagatttgattgagatttctaagctagaactgatagaattgacctgggtacatagtgatgtctttaaccagtattaaagatgaaaagaacaagttttaggaaatgataatgagttcctttcaggcctgttaaatttgagtggctacaggattttcatctggatagaagtataaagcgttgagctcaacgctttatacttccaaaatcagcagtctcctggaggagc

SEQ ID NO: 181849 - DNA, 875 bp, Homo sapiens
ctagcctccttatgcaaaattcataagtgcaagtcatattcatctttgttgcttggttatgtcctcccctaaagaatctttgtgtatctaatacaaacccagaagaataaaaaggcttttcaaacaaaaaaataatttacctcttaaaaaattcctgaaaactaaaacatgacctcttaaacctaaaatatttctaagtcttaagtagctggatataaggacttgtctcctccccctattttttggaagaattgcttaccgaacaaagatatttgtaatggaaatttgtttccctccctctccatcatctaatgataggttcccacataatggatttatattagtaatgcagagagaaaagcaggcctcaaagtctgatagattttcttttatatgaccagcttttagattattatatacaagatgtagcttaagtgttctggaaatgagtaaaagtgaatcttatgtctcagatagaatgtaggagtacttttgcatgacaggaacttggcagcttgcatttcttgtgtcaatataatttaaagtattctaattttctgcctaaaacttatttttatagtttggttgcatgtactacctaaccgttaagaaagaaataggatcattgggcatgtgggctttatgaattaatacaggtagaatggttctatgaataattattagtccgcagagtgttattaaatttcaatccgtttggtctcaaggtctcaaacgcttcggtggttcacgcactcaggtggttcaagggctttgcaacatacacatgatggggcacgaaactggtaatctagcgcaaatggacaaggacatgtgtgtcttgcacacgtgtctgttcattcggttgtttttatcct

SEQ ID NO: 181850 - DNA, 363 bp, Homo sapiens
aatttgaaatcttgtgtcctttaatttgaaatcttttcaaatttgtgttcatattttaagacattaaattttttcagtaaataatttaaaacagtgtcctttaatttgaaatcttttcaaatttgtgttcatattttaagacattaaattttttcagtaaataatttaaaacagtactctttgtatttgagatgaataaacatgagaattaaattgtagagtttatcctaaaaacttgatttaatttatgataataggtaataaatagactgctcctttccttacgtatttttctaaaatattcaccctcttttacacttgttcgttatacattaaaactaaaataatctgtttacttgatct

SEQ ID NO: 181851 - DNA, 626 bp, Homo sapiens
  misc_feature (85)..(85): n is a, c, g, or t
tcgaatcgacggtttctcttccactatgttaggaggtgatctcagagctttgtcagcacacgctctaacaactgagctaaacganctgctgatctcagaggctttgtaattggaccatagtttgaggcatcttgtgtgagttccttaaaaaacttttttcctcagtgcgtaatagtataatatatattacgtcttatttctttcctttctttcgtcctggaggcttgggagaaacctggtttcttaaattctttctgaaagcttcatcattccccttctactttgggaaccttgatttccctggtttttgctgggagagaagtagaagagagaagctaagtccaagagaggagagggatttcaccgcctcctttagccttcttgctcctttcatggctctgccccatattctcattttccaaacattccaatcacctagagagggttgtttttttgtcttcgggtttttggttgtttttataaaatagagttcttggggcccacttttagttattatacttaaggaagtctggggcttcagtcctgagaatctgtgtatttcttgagttatgcaggtaattttgatgcccagttagatttgagaactgtaggatatgtttcccacc

SEQ ID NO: 181852 - DNA, 467 bp, Homo sapiens
ctccagcaagatttttgagtgtgactttttcgtccttctgcgatctgttttgcattccaaggtggtttttttttttcatatttttacccaaaatagaaactgagtctaactagaagtcaaatacaattcataaatcaaattgctttgtgatatttttaatagtataaatactggtaaagtgacatttatcttttgctgtaacagctagtattttgcacttaattagaactctaaaagtaggaaaacacacaacacaataaaattgttgcaagatcttctagttccttgatcccaaatttttgacattgggaatttaagatccgtctaccttaaaatatttcatgaaactaaaacatttagggataataggtcttaagggaattactctggttgaggaggttaaaaaaactaatctgatagctattattgaattttcaatgttttactttttaaaaaatttattaaaa

SEQ ID NO: 181853 - DNA, 126 bp, Homo sapiens
aacaaataatacaccctagtcaatgacatccattctgaagtgattaagagtaccattaatcatttaattcactttgaaaagcattaaaaacttagataaaataatggctggctaaacagatgtgat

SEQ ID NO: 181854 - DNA, 502 bp, Homo sapiens
aaataccagcttctccacttaagagcctagtgaccttgggcaaggtacttaagcattttaaggttctctttcctcatttataaaatgagaataacaatcatattgacatacttaataaagttagctgttattattaaagctttatcctatttttaaaatctccaccgcacacagtgtgaagcaaaaagaaactaagctaaaatttgtatagtaaatctaaaaagctgtccagaatatcataaatcaggctttctactgttccttcattattctgtataaagtgaatgaacacccagaatactggatatattcatgcattcatatcattttagaattaccaaaattcaccccaaagcaaaatataaaatacaggattttttttttgtattttgattttttttattatttggtggtttttccctttgagcaaatagccatgttatgtctgcattgaaattttgtccctttaagaattgtgaataactttttataatggataagt

SEQ ID NO: 181855 - DNA, 371 bp, Homo sapiens
cccaataaatatatagaacattttcccccaaaagttcccttttgccattttgcagtaaattctcctaccctcttgcactccccactcccgatagtcattactttgatttctatcatcataagttgattttgcttgttctggaacttcatataaatgaaatcatataatatccactctatgtgcctagtttcctctgctcagcaagtttttgaaattcatccctattgtgtgtatcattaatttgttcctttttaatgtgaagtagtattcattgtatggaagtgccacaatttgtttaaccattcagctacttatgaattgtttccagcttgtagctgttataaataaagcttctataaacatttatgtac

SEQ ID NO: 181856 - DNA, 567 bp, Homo sapiens
tgatgtggcttaggcaaacagctaggcatgatggacatcagatgggtcactttgaaatctcaggtactccattataaagtgggttgttaaacatagagtctatttttttataggaccaatgggatagattaaatactacaccctcgattaaagacttagcgccatggaaatcaaatgataaaagccataccacaaaaaccaacaaaaaattaaaacaccaatgccaatccacaaaaaaatctgtaatttatatcacatatagtacatatttcacattctaataaaatttcatgaatatgctgtataaatttgcaaaagaatgtttctccataaaatttttaagtagagagaaaatgatatttttatatcactgatataaccacacacatatattcagtagcaagtatcatgcttaatgaacatccagtaagaaaaggaaacagaatttctcagacttagcaagtttgaacaaagaggaaaaaatatataaaacgttgatctcagaagagagttgggatagtcacatgattattactatgtggaaggcactgttctgtgtacactaca

SEQ ID NO: 181857 - DNA, 554 bp, Homo sapiens
gatttcatcagtttttcattaatatcctctttttgttttaggatctcatccaggacgacaatgcatttaattgtcgtatctccccagtctcaaaggctgtttttcacttacactcaggagatacttgtttaagcacggtcatttgtataaatttaaccaaaacatttaacttctctgattctcaggtctgtttgctgtagaatgaggaaataccgctatctgagaatatctaataagataataatatgaaaaggccctataaactgttttcatactgggagtgtatatttgcttaatacatattattcacaagctagtcaaggatctaaaatgtcttctcttataaaatgtccagagagaattaaaattctcttccccaccccaacccgccaaatatgtaacttcatctttataactacatggagaacccaaagactcgacatgttcataaaggacttacatataatgtttgagaagccccaaggaaaaaaatcacaatgtaagtctaaagaagtgataatataaaatgtatttaatgttctaatcttactaat

SEQ ID NO: 181858 - DNA, 323 bp, Homo sapiens
cacagaatacccagtcctggcacataatatcaatacacgtgttttggatttggatgaatgaatgaatgaaggaatattccttccactttagtcagcatcccttagctacctaatctctgagaaaacaaaatgcctcctgtaagataaagctgtaagataaagcctatgcttttggatttggtattcattcactcattcattcagcaaatctttatttaatacagtcatctgattcctgtttatctctagcttccttttgttaacatctctcagatctgcatgacttttctaggtctgcaccttctggccagtcttctgtcaat

SEQ ID NO: 181859 - DNA, 448 bp, Homo sapiens
aaggtgccaagatcccacaatggggaaaggacagcttcttcaatgaatggtgttggaaaattggatattcacattcagaagactaaaattagacccttatctctcatcatatataaaatgcaacttaaaatagattacagacttaaatgtaaaatctgagactataaaacaactagaaaaaaataggagaaagctttataacattggtctggggaggattatttggataagacctcaaaaacatagacaccaaaagcacaaatatacatataggattacatcagattaaaaagcttctacacagcaaataaaacaatccacaaagagacaatctacagaatagaagaacatttacaaattatttaactgataaaatgttaatatccaaaaccaaaagtcctccagcaactcaacagtaacaaaaaaacaccaagaacctgatttaaaa

SEQ ID NO: 181860 - DNA, 542 bp, Homo sapiens
aacatttgccaaaaatttataaagaagacagtttctgggctgggggtagagggaggggcaggtggaaaaggggatcaactctctccttccttctttccttaaatttatgaaataagtgcatggccaaaacacttgatgttagccccaggatagttcaggacctagaaaatttgggaggtgccaagatgaacatggcaagcctatctacacagtgattttcagacttctgaggaagtttttcaacatacatagaaaagaagtgcacgtgatttacccctctactattgtggcagcaggagcttgaaaaggattcgtagcacaagccaggttcatggtgaggtggcataactagacatccaaacaaggatctgctcagagtcaaagggagtgccagtaataactgtggagggaaaacaggcataaaccaggacacatggccttcctaccaatgccctaacctggcacactcatggctcaataaatgttttaaagagtagcagacaggacctgaaataattgctccaatggaagaataaaaggtc

SEQ ID NO: 181861 - DNA, 447 bp, Homo sapiens
caggtttagagagtacaacatagctacacatgcttcccacatacctcaaatttatgggaaatccatggatgtttggatacatgagtcacatcagagaaggctcttctcaaaggctagcctccagtgccgtcataccaagttaaaacaaactaacaagcaaaaacacattcacagcatatataaggcctttcttctttgggaaatcttgtgttagattcgtagcacaagccaggttcatggtgaggtggcataactagacatccaaacaaggatctgctcagagtcaaagggagtgccagtaataactgtggagggaaaacaggcataaaccaggacacatggccttcctaccaatgccctaacctggcacactcatggctcaataaatgttttaaagagtagcagacaggacctgaaataattgctccaatggaagaataaaaggtc

SEQ ID NO: 181862 - DNA, 521 bp, Homo sapiens
agtatgtaatatggaaatcgaggagaaatctgcttctcagtgctatccatattccaggaacattgagctgtttctgataaagattaaaggaaagctcaaggtgatgatctactttcagcccaatttgagagagcagtgtctccgggagtaaaatggctaataacagaatcttcctcatcctaacccctcagaattgtcacacatgaaatgggctatgaagcagtcaaaggttatactgcttgaactcttccactcatttcagttcctgtttataagtaggtgacctaaatttattttgtaagttaatgagactatgttttcttttgatttcagtttgggcggaaaagtaccttagtttttgagatcacgtgcctttactttagggatgttgaggttgagtttttcagctactagcttttgagataaattcagttaatcatttcattgggaaaaaatacatatatatttaagtaatttttgttttgttttatcttagagacaaggtttcactgtgttgccca

SEQ ID NO: 181863 - DNA, 601 bp, Homo sapiens
cctttattcttttcctttttttttttttgagttgtgttgtgatttgtttacctaggaactcaagctgttagagttgtctcagcctaatggactcccaattaattattttaacacatgttaaattaataatggagaaattaaattaagaccacaatgaaataccattttatacttgctggattgctgaaaattaagaagtcttggtaagtctataaagcaataggtgctctcatatcctgctgtgtaacataaattagtataaccactttggaaaacaaatgatcattatgtgtaaggctgaatgtgctcataccatgtagaccagcagttccactcttaagaatgttattaaggaaactgttatacacatgcctcagtacaaatgtgtagaatgttcagagcacatggttgatcatacaaaaaactgtggccgggtgtggtggctcatacctgtaatccaagcactttgggaggccaaggcaggaagatcacttgagcctgggaggttgaggctgtagtgagctgagattgcaccactgcactccagcctgggtgacagagaccctgtctcacacacacacacggaaggaaacaacccaaa

SEQ ID NO: 181864 - DNA, 260 bp, Homo sapiens
gcttttttcagaatctcattgtggtgctaaaatttctgaaggattcaatgaaagcagatgacaacacaactaccttcagcacacttaatgtctgcttggaaaaagcaaatcaaaacatgaaagagatgatatataaaatacagtcctgaatgcattcacatgtaatttacagagagttgagatcatgaaggaaggaagtagacacactgtcggaaatatctaagtttacagaggatacttgtacagccagggttttgtga

SEQ ID NO: 181865 - DNA, 431 bp, Homo sapiens
ccggcttccgggagacactcccgccccagcctgcgctccggccgcgaacccccactggggcccccagggccaggggcgcgtctccctccgggggcctggcgcgaggctcttttgaggctcttccccattcgagccggggcaagaaaccaagaactccagcccgggtggcgttcctcgttcctgctccctcccggacctgctaaccacctggctgcagtactgtcgggagatggggcaggagggctggcgccaccagcttcgtgggtgccatcccagactctcgctgtaaacgagggagcggggaggagccggccagccccgaggccaggcttggactgggcgtcagaaatgtttctacaggcgtgacagcccttgagctccccgcatccccgtctgtgcctttgcctcctaagtatcagctgaggctaaat

SEQ ID NO: 181866 - DNA, 611 bp, Homo sapiens
ccaggatagtcctggaaatgatcttgatgctatctgttcctcgttacagcagacctgctcaacttcagcagctagaaggaggattgtctttcaccagctgcaggagcctgttcccactacaagcctggtggagtcttcggagcagatgtgactgtcctacttgtatagagaagagaaactgaggctcagaagagatgcctggctgagtttaataggactgcaacaacaattttgcctttctactttctgctcaccgaagaagacaggaaaacttgtcagatggggaaggatgtgtcaagagcatgcacacagatttactcttcagctagaagctccaattcctagatgatctgaatccaactcagagtgcttgcacctgtttcctgccacacagctagagctgtgtccctctaggttctctgattggctgaagctactctaagccaagagatcaaagaagctgataatgtagaatgtaagtttgtctcctgggccacaatggaaagcagagactgtagctggaggagtgaatagaggatatgcagctctggtaattctcagtacaattcccagtggtccactctgcagaatgaaccaagttccattttgcc

SEQ ID NO: 181867 - DNA, 309 bp, Homo sapiens
gtgagatattttgtttcatatggtcttgttggtctgactgagcaaacaaccttgacgttgattttccagtatttaaaagcattagggaatgaagggatcctgattgtcatggcctgtctctggtaaaatatcagtggatttagaactgctatgttaatcagatcaaggggcttttgccctgatgttatgtatttctctcactgttccatgagtgtccctgtgggcatatcacagtatctagcattttctctgtctgcttgaagactgaaaatgtctaattccagttcaatgtttctccttggaaactaa

SEQ ID NO: 181868 - DNA, 368 bp, Homo sapiens
cacacctgccctcatttatgttgttccctattaaccccaccttttaagctgaagtttataaacaactaaaatctggtgacttgtacttgcaaaatcagcaatctcattgggttggtaaaaagacacatgcaaagcatggttttctctttcaaaccattgaaacccaccatccctccaaaggaaaggcacctttctcccagatttacagaacctcccctgacctcagcgatgcaggactcccatgaatttcttccagctgcctcagctaggctttcaaactgtccacatgcgcaggtcttcacacctcctccaggtcaccttatactcaatgctgctaaaggcatcaccccagagttggaggcctgagt

SEQ ID NO: 181869 - DNA, 382 bp, Homo sapiens
gtcgacctttccactcttgctttcctttctttctttccatctttctttcttccctctttctttcccctttctttctttccttccttcttctttctttctttcctttcttcctcccttcctccctccctccttccttcctttctctctttctttctctctctctatctctttctttctttctttcttttctttccttccttccttctttctttctttctttctcagagcctgactctgtcatccacatgggaaagcagtggtgcaatcatagcttactgcagcctcaaactcctggcctcaagcgatctcccacttcagccccccaagtagctgggactacagatgtgcaccactacacccagctgatttttttatttttatt

SEQ ID NO: 181870 - DNA, 547 bp, Homo sapiens
tttactttctacatatcagagaaggaagaatgacccatttctgggggcggaggtagggtgcggttaaaagcttgctgatccagtgttttagatgtcaacttacaatttggtgccagattttcatcttaggagacacttattcatatttgcctaacaatgagtacaataatagttgcagtataaattctagactgaaacactactaaattattactgttgaactagattaaaattcataggcattcctgtttaataaacccaatataaaaaactgattaggctgggtgcagtgggaaagggtattggcaatgcagtgctcgttttaaaaaataaatgcaggccaagtgcagtggatgctaacaacatttttaaattaaaaaggacacaaacacttctttaaactttctataatgaataaattaatttttttttctttttggaaatattggctcactctgtcttcccagtctggagtacagtggcacaatgatggctcactgcaccctccacctcctgggctaatgcgatcctcccacctcagtcttcc

SEQ ID NO: 181871 - DNA, 486 bp, Homo sapiens
ggagtctcttcagcacttaagtatagattgaaattggtaacaagatgcctcttgaaggagaaagaacagaagaaagtgctccctcaagagagaaagcactctgctggatttccagccccattaaaccttcacaactctaaagcagtcctgatacttatgcagggacagaaggggaggccctgggcacacgaggtataaagttggtactgagattcttccagaaaaccagggctgtcttcaaaggtctatcctcatagttaaaaaatggtgtcggggaggagaaattcactcatagtcatattaagacttaagagagcttgtctctgagaatctgggtgaagaggacaggggaaatgctataaatgctataagaaattaaaatcctaaacctatgacacaacagttttgaaatgtgaatcttatttgtatgagaatctcctaggtaaaaaaattaagaatctccaatctaaggaattagatcctggg

SEQ ID NO: 181872 - DNA, 657 bp, Homo sapiens
  misc_feature (503)..(503): n is a, c, g, or t
ttgaggtaggtctacttgttagatctcattgaagtatagattggtcctgcctatacttattagaagaaaagccacagagttttgtgtaatgcaaaaaatatgtaaagggagtcctaaagtttgtctccatctcaaccgtaagcatataaaaatcaatcttaaaaatccctgttttttcagaaagaagcattataccggtgttttctctcttacaacctgagttagtcaaatcaaagtcaggtgatttatgtacatcaaaataaagtacataaaaacaactgaaagaatttacaatgaaattattatatgcacaactacctaagatgataaaattaggctgggcgagatggctcacacctgttatcccagcactttaggaggccgaggcaggagaattgcttgaactcgggaggtggaggttgcagtgagccaagattgcgccattgcattctgtcctggacaacaagagcgaaactccatctcaaaaaaaaatatattgattntgttgttataaatgcactccagtctgggcaacaaagcacgagtctgtctcaaaacaaaatttttttttaattgtggaaaaatacacaacataaaattagtcatcttaaccattttcgaagatacagttcagtcatcgcctcaacattttatatt

SEQ ID NO: 181873 - DNA, 231 bp, Homo sapiens
ccttaggcagattgttgtgcattcttgagttaatttttgccatctcactggcttgaccaaattgtaatgttcagagaactaaagcctaaacttagtgtgtttcaagcacttgattggaacttttcattaagcacatattcttatggggcatacatactacaggctacagatactgaaacattttaatactactctaatcacataaccccagaaacaaagaacaaatcccta

SEQ ID NO: 181874 - DNA, 314 bp, Homo sapiens
caaaactttgctgatgactccttggatgaagaaacttctcatacagtggtgtgagccctggagtcagaatggttggcttgagccccaatttcattactgcctggccaggtgaaggagattctgttcatcagtggcagccagggatgtctctccttcctaccctgactctcctctttctgctgggtcccctcccggatacagggctcacacctgtggacctcagagccagcgtcaagaccaagaggaaagaaatcaccaaaagccagacccttgtatagagggaaggggaaggaagggagggaagacagactcct

SEQ ID NO: 181875 - DNA, 410 bp, Homo sapiens
tttaattttaaaataaatgataaaaaggtaggctggaatattttacacatctgttataaaacccacagaagctgtctgtaaaacaagactcaaatccaaagcaggtggacaagacatactgtctgtttgaagagctggaactccctcgaaagttcacaaaccaaggaaaaagtcaaactgtcagaaaacagcaattaatgactataaacactgtgcttcctgcccttatgataaagcttctgtggagacagtcatgaagagaacaagttcaaattctcaattctctacctaactccgaagctccataaggcatttcaggttattatctcatttgtttaaccacacaactgttagaagttcaactgtccctcccaacccccaccacattcctatgctgaagtcttaatccc

SEQ ID NO: 181876 - DNA, 135 bp, Homo sapiens
agaagtcagaattttgaaatggctttcactgggctaaaatcaaggcttttgaagagcttagttccttctggaggttctagggaaaaatctattcccttgccttttctcgcttttagttgctacctgcatcccttg

SEQ ID NO: 181877 - DNA, 685 bp, Homo sapiens
catgaatgagtcttcttaatttaaactgactactggatggcttcctgttatgttaagaggtagcaacttaaacatagagcattttaaaattgagctttaacgtacatcagagcctaagatttgactctgattttgataccctgagtaaacttaagcacttttctccttcattcactttggtaaatgagctgtgcagccatgctcttctcgtaaacttttacctgctgtgctaggctgtgagccacgaagtgcctgcactgccctgtgccagtgtctggaacattctccaagtaattggccagtgcctgcgcagatagaatgcaggtagaatgccagttctccccaacccttgccattgatctgcatcttgggaggctgtgcaaggagttggaggatctggggttttcccagtgtctggtcactgaaagaaattttttctttttagtgactccaggttagtgtctgagaaaagttggccatcaaaacaggaccagcccgagcaggtttgaagataaaaatcaatcattccgttcatagtactttcttatttcatgttcctttgcttccaactcccataaggaatttgctaaagatacaacctcagagatagcttaaggtggagagaaattttcgaccataagttccttggagaatacgaattcaagtagggtgagtgggaagaggt

SEQ ID NO: 181878 - DNA, 351 bp, Homo sapiens
ctccaggactacgggggttagaggagaccaaatgagtttacctgtggggtccagtgcctgaccagggcaggtgctaagcaaatggagatcctatcccctctctcccagggactgtcaaacagtgccctctgccctagaggctgacccccggcaggttgaaggaacctgaagaactattttcagcagtaagttctgctgaatacattaatactacagcaataatgattataacacaactacacttcttgagcatcttttatgtgaaaggctcgtagaggaagcaatggtatttctctcatatgctggatgtttctcccactctcaatttctatatcactgcctatgtaccca

SEQ ID NO: 181879 - DNA, 156 bp, Homo sapiens
aattaaagagtaataggcaccctctagtcccttgctactcaaattgtggtccatgaccagcgtcattgccaatacttggggcttgttagaactgcaaaatctcagcccctcccaggcctacagaaccaggtcctgtagtctaacaagatctgcagg

SEQ ID NO: 181880 - DNA, 616 bp, Homo sapiens
acacaagtgtaatcagaatttttattccaaaaacagaagaaatgcagccaactgttgaagctaatcaggcagcaaaagaagacactgtggttttgaagattggctctgttgccatggctccccaggctgacaatccccttggcagatctgtccttaggaaagatatttaccacatacggcggcatcaagaaaggagagcaattttgacccccgttttgacagatttttctgtccgaataactggagcacctgctgtcattttcaccaaagtagtttctccagaaaatttgcatactgaggagattttagtgtgtggccattccttagaagtgaatataaccacaaacctggacttcttcctaagtgtggctcaagttcaactcttacatcagttaatagtagcaaatatgactggactggaaccatcaaacaaggctgcagagatctctaaacaagaacagaaaaaagtggatatatttgatggaggcatggctgaaacctcatctcgctacagtggtgctcaggatagtggaattggcagtgacagtgttaaaatcagaatagtgcaaatagagcagcacagtggtgccagtcagcatcgcattgcccgtccctc

SEQ ID NO: 181881 - DNA, 308 bp, Homo sapiens
acacaagtgtaatcagaatttttattccaaaaacagaagaaatgcagccaactgttgaagctaatcaggcagcaaaagaagacactgtggttttgaagattggctctgttgccatggctccccaggctgacaatccccttggcagatctgtccttaggaaagatatttaccagagagccttgaacttaggaattcttcgagatcctggatcagaaatcgaagacagacaataccaaatagatctgcagtccatcaatattggtactgcacagtggcatcaactaaaaccagagaaggaaagtgtctca

SEQ ID NO: 181882 - DNA, 706 bp, Homo sapiens
ttagctgggggaacacaggagacatcaccgtgccaagtatcaggaggaacaattgcacagactgtagaaagacaatggcaaattggaggaagtgacagaaagctgaagggctggggtacgctaggtgaggggagtaaggcagagagtaacagcagctgggtagggagaggttggcaagggagaaaatggagaaagggatggaggctggtcaagcggaagctcgtaacagcagggctagggaagctcaaccaataggctggaggggtctgaacactgccacaagcagagctgcacttcaggaaggtgggactggagacacatgtgaagcgctttgaggggaagcagcactggtggtgtggaaacaatgaccacatccaggtagaggtaatgactatgacaggagcgagcagcaaggaaaaatagaggtgagaaggaattcaagagagatagcagagagaggtgggtcagaaccccaggaatgcctaggggtcaagggagaaagctgagtcccagctggggactggggacatggagctatttaaaaaccagcaaaatggcggggcagagcggctcacgcctgtaatcccagcactttgggaggctgaggcgggtggatcacctgaggtcgggagttcgagaccagcctgaccaatatggagaaaccctgtctctactaaaaaatacaaaattagccgggcgtggtggc

SEQ ID NO: 181883 - DNA, 704 bp, Homo sapiens
gaggagccttggtctgactagtatttacttaaccccacgagaataagaacatcgtatagtttaacatcactgtcctcccagcacccagccctgccacatagtagttgcttaataaataattgttgaatagattaatgaataaatatttcagcaagaaacctaactcatggggaaacgtgtgattagaaattgaggttagtaattgaagctcagtgtgcactaagtaaaacatcccaatataaccacttttagaccatattgtaatattcaagtgtgttttgtagggcttagtgaggaaactcttttaagaggcttggtaggaattattgcttgctaaaagtagatagagataattgttagcatcttctgcaagtgacctgtatgcaaatggccacttcaaaggcaaggaactgagggacctgccagcttagatgtcacagaagaatcctgccctagcaaaggcaactcctgggctttgtgcaatcaagaggatgccaataatattcctcctccatctgtccaggaggccagggtccccatgtgcagcacaacaagagcaaaatagtttagagacactgagcagatatttatacaaatgaaccgtgggggaagactgaatgaaaataggaagacatgcaatactttctgtttaggaactagcagctaaaattatgaataggtccaaagccccagaggtaagttaa

SEQ ID NO: 181884 - DNA, 298 bp, Homo sapiens
ttaagcatcaacaaattagttcaaaacttagtgactacccaccactgtagaggaaggaaggaaaggagaggaaggaagagagggagggaggaaaggagggggagaaaagtaaataactctgaaaggaagtgtcctcagtacaggaaaagcacagatccttaactaaggtcttagcagatctcaggaagaagcctttcttttccagcacaaattcagctaccatcctgacatatttatcatcaggactttactgtttaatgaaaagatgattctgttctctctgctaacgctttccttt

SEQ ID NO: 181885 - DNA, 711 bp, Homo sapiens
gctttcccagactgactgggaatgtagcagaaggcctgagaaccaggaagtgacacagacctgtttataccatcccactcccaggcctttggaaaacgatccacagagatggtaaaaagtaaacataactgcatcagccagctctctagggtttgctatttttgacctggaggaggtgtttcctgcatagctgtaagtactcggaataccaaaatttagctcctaaacattctttgagtgaaggtatatagacagacagacattttttgttaccagacagcagcattcagtgactgtaggcagacaaaattaagttttttttccctcctctctctgccatccttttggtgagttgttcttccatttctttatctttctttgtaagtagcactgtgcatgcaaaacactgtcctgggagctctaaatttgtgcatgggttcaaggtccaactcaaagctttctctttcacttctccctactcccatcagaagtctttgttcctgtgtcctctgtgttctcatagcactttttaaaaaaccttctttggggccctagtaacaatttgacagtgttatatagataaacataattcctctcacgtaagttgtgaattccttgagagtaagaattgaactgtgccccaattcatctctatgatcacccaagccttgcatagaagacagccagtaaatattagctgaattgcagtat

SEQ ID NO: 181886 - DNA, 892 bp, Homo sapiens
gaaggcttaatgccctgctaagaaaactatacttagggccgggcacggtggctcacgcctgtaatcccagcactttgggaggctgaggcgggaggatcacttgaggccaggagtttgagaccagcctggccatggcgaaaccccgtctctactaaaaatacaaaaattacccaggcgtggtggcgcgcacctgtagtcccagttacttcggaggctaaggcaagagaatcgcttgaatccaggaggcgaaggatgcagtgagctgagattgcaccactgcactccaacctgggtgacagagcgagattctgtctcaaaaagagaggttataggtcttaattggacagagggatgctttagttcaattctacagctatgttttgagtgcagattacgtgcaagcctgggaataccatcatgaggttttccaaggtataaacttcaaagtagtatgtgctacaaagtgaatggtctcatgaaagtcccaaatagttctgcccttttgtgggaaacagttttacaaagtgtgctacaattgcaggaggtttgagcatgctgatggctccccagcataagacttcactctgcccaggccaggtgcggtggctcacacctgcaatcccagcacttcgggaggctaaggtgggcagatcatttgaggtcaggagttcaagaccaacctggccaatatggtgaaatcccatctctactaaaaatacaaaaattagctgggcatagtggtacacacctgtaatcccagctactcaggaggctgagacaggagaattgcttgaactcaggaggcggaggttgcagtgagccgagatcgcagcactgcactacagcctaggtgacagagtgagactctgtctcaaaaaatttaaaaaaaaaa

SEQ ID NO: 181887 - DNA, 282 bp, Homo sapiens
tgttttagtctcatgatccctttatattcttgaaaggtaatgagaaacctaaagaatttttgttgtagccactggtatttaccattttataaattaaaatataaaattgtaaatatttatgtaatttatttaaaaatcaatgattgtaaacccattacatgttaacataaatagttatctttttatgaaaactacttttaagaaataaaaataatttagtgacaaagtggcattgttttacacttttgccaatctggttaatgactgctttaacagaaggca

SEQ ID NO: 181888 - DNA, 232 bp, Homo sapiens
ctgagtagttgcaacagagatgctatggcctgcaaagcctaaaatatttactatctggctatttacagaaaaagtttgctgacctctgctctgacttaaaacaatgtttttcaaactgctgtttttaccatcagtgtgtaaaagctcattgtttcaattttgtcttattttgtttattatgctctctatcatatggactggatcacgccaagtttcttgtatctctgttcct

SEQ ID NO: 181889 - DNA, 357 bp, Homo sapiens
cagttaaattctgggacactatcttgagctataactaagataagtcatttttttcttccatttctaaaaatatttgtagattaaacccatttttttcttttttgtaccataccaccaggatagctttccaccttccatcactcatctgtgtgacttcttaagttccttcaaatgtaactctgtaattataattatatattcacacaatcattgtgattctttaattgcaattgatttaatctaccttatcatccaatcggtgctgacagtggatttcattcctttttttttctaacagtaggaatagaatgcagtgcgcttgccaggactgaggaaagagggaggggttgtttccgc

SEQ ID NO: 181890 - DNA, 398 bp, Homo sapiens
ccatatcaagagcatctcctatgctggctgcctgctccagttcttctacttctccatgtgtgctgcagaaggctactttctgtctgtgatgtcctttgatcggttccttaccatctgtcgacctttgcattatcccacagtcatgactcaccacctgtgtgtccgattagtggccttctgcagggcaggtggttttctatccatactgatgcctgcagtgcttatgtcccgagtgcctttctgtggccctaacatcactgaccattttttctgtaacctgggaccattgctggcactgtcctgtgccccagttcccaaaactactctgacttgtgctacagtaagctctctcatcatcttcatcaccttcctctacattcttgggtcccatatcttag

SEQ ID NO: 181891 - DNA, 223 bp, Homo sapiens
ctacattttcagattcctatttcttcatccaactggaaaacctgtagcaaaggtagaacagtcaaaaacctgtttcttcttttactttgccacctacttatttggtgacctagtgagtaagctaggtctcactgtcgctccactcatcctataagcatgctgcataatcagaatgtctgtctcattctgtaaacataaaatggctgtatgtatacagatattt

SEQ ID NO: 181892 - DNA, 661 bp, Homo sapiens
tgtcctgctcacaaataacttattttcttgtacatcaagccttttctgaataaggtactatatttaccactgtcatttattttattttattttattttagagacagagtctcactatatcacccaggtaggagtgcagtggctcaatcacacctcacggcagccttgacctcctggactcctgcaaccctccgaagtagttgggactacaggtgtgcaaccaccacacttggataattttttattttttgtagaggcaggatctccctaagttgcccaggctaggcaaactcctgacctcgtgatctgcccacctcggcctcccaaagtgctgggattagaggcgtgagccaccgcgccctgccacatcctgttttttttacaacagggtgtcactctgtctctcacccaagttagagaggagtgacacagtcttagctcactgcattctcccaggcccaagcaatcctcctatctcagcctcccaagtagctgggactttaggtatgtgtcaccacagttgactaatgttttaatttttgtagagatggggcctccacatgttgcccaggttggccttcctgggctcgatcctcctgcctcagcctcccaaggtggtgcatgcctacagtctcagtagattagaatcaccctaaccctca

SEQ ID NO: 181893 - DNA, 355 bp, Homo sapiens
atatattaaaaatagaactaccacacaatccagcagttctatttctgggtatatatccaggggaaattaaatcagcatgtggaagagatatctgcaatctcaagttaatttcagcattattcatggtagccaagacatggaatcaatgtaagtgtccatccattgatgaataaattttaaaacaggttatatatacaccacggaatatgtttttacctgacagtaaatcaatcctgtcaggtgagataacatctatgtacctgaaagacaccatgctaactgaaataaaccaggcacagaaaagacagatactgcatgatctcacttatatgggatatctaaaaacatttaactc

SEQ ID NO: 181894 - DNA, 227 bp, Homo sapiens
cataagtcttcatacaaatgtccccaaatacaataaaatcaaaatctgtcccaactcactaatactgcctgggctcaaatacaaagctccagctgtcaaactgtgtgacagcaaccaagtgatctccaacccccccatcttttgtgtctaaaacagaggtcgtcatggggcctcactatgaaaatgaggattcacagccaaggcaagggagacacagtctgtgtgtg

SEQ ID NO: 181895 - DNA, 248 bp, Homo sapiens
  misc_feature (195)..(195): n is a, c, g, or t
cagatccaaaagtcagaggccctgattcagggtctgagcatggcaaaaagtcaggttgctgccaagctgcaggagacagagcaggcgctacaggagcaggaggtggtgctgaaggccgtgaccctggaacgagaccaggccgtgcaggccctgaggatgcatgggctccccagaccaggggcacagatgcttctnaggcagcatgaagaagaaataagtaaagactttccatccagtgagatccagcg

SEQ ID NO: 181896 - DNA, 585 bp, Homo sapiens
cagcgtctgtgtggggtgtgcagcagccctgagccaaggattaattacgtaacaagcccagatcccatccctgcctgagcaggccatgtgccagcaaggggggccccgaagtgccgctaggtgcctcacgattagcataaggcccgtttatccaggaagccagaaccagtgcacatctgttaagcgcatgcaccaagcggcgattccatagttgtatagtgattgtctttatggaactccagaatagcttcttagatatcactcttcaggccctgaaatggagccctgtgcaaagaaatgaagaaaagctatcggggcatctgcagccactattataccatctggcagctcagaaatattttataatcaaatgagtaagacgggcgtcccacactccacagtactctgctcccccttcccttcctcccaggacttgctctgtctctgtctctttctctgtgtctgtctgtctgtctctatgtgtctgtttctctctccctctttctgtgtgtgtctctctctgtgcctgactttctgtctctttctgcttctctctctgtgtctgtctctgtctctctctttctg

SEQ ID NO: 181897 - DNA, 363 bp, Homo sapiens
atcgcagcggccacttctttattatcgttgttattattgagacatggtctctctctgtcacccgagttggagtgcagtgacacgatcttggctcactgcaactgctgcctcccaggctaagatgattctcccgcctcagcctccccacgagccgggacgacagttgcgtgccaccacgcccagctaatttttaaaattttttgtagagacgggatttcgccatgttgcctaggctggcctcgaactgctgagctcaagtgatcctcctgcctgggcctcccagagtgctgggattacaggcgtcagccaccgtgcctcaccttttgttgaggcctgcgggcttttaagaacacgatgggctcc

SEQ ID NO: 181898 - DNA, 354 bp, Homo sapiens
acttatcagtttacacgtttccctttttagacctagtaagctccctgaggacaagtatcagcccttccagattttgacctcaacatttattcaatacatgtttgttgaatgaaagaagaaatgaagctcctccagagcttcgactataactgcttctgtttcatttcttgaattcttaggtagagctctgagtactgagtatacttctgcctaacacatttggtctgacctgtaaatcttactgctggatttattatgagacaatatatttcagtaatgttttaaaggacaaaaacaacctgaataatcagccaagggaggaaaagattatttcaaaaattaaaatatcactct

SEQ ID NO: 181899 - DNA, 614 bp, Homo sapiens
atgcagctttgatctcccaggctaggctcaagcaatcctcccacctcagcctcccaagttgctgggactgcaagcatgcaccaccacacctgcctaaatttttttattattttgtagagacaggcctcactttgttacccaggctggtctcgaattcctggcctcacatagtcctcctgcctcggcctcctgaagtgctgggattacaggtgtgagccaccacacccagccaattcccattttaaaatgaggaaaccaaggcttgggttcggtgatttgctgtgactgaaaatccttccctccccacaaatagggacaccactatcagatatcacatagatcatttcccaggagccaagggcaaagggcagacccgtctttggccaaagccaaattctttcctacacagtaaatatgggaaaaagagagacttcaagcttcacccaagagttgagacattttgaagaaagactgacacaattaggggagtcgctggatataggagtgaagtgcgagagaggtatcaaatatcaggctctggcctatgcttggagaaatggtgcaaaaccgttagcagaaatatggaaccggagtgcatgctgatttgagagggg

SEQ ID NO: 181900 - DNA, 314 bp, Homo sapiens
tgtataatttggtaacattatcacctaagccttctcaccttcatcctagggaaacatgaaattgacaacctatatacagtgctttgaacttttaagaaaactctgttatgcatttgggctactaggagtaaacatgaccattaacaaacagaactccaaccactgacagtcgatgtgattagctttctgtaataagctttctgttatttataaatgctgctaatgcttgtggaagaagcaatttcatcttccactcccttagttatcactaagctactatgtcaagattaagtctaatgtttgaagatgttgtt

SEQ ID NO: 181901 - DNA, 487 bp, Homo sapiens
atactgtagtggactgaggaggggagattagtgagagagtctgaggtcttttaattccatagagctttttgtgtgtcattggacaggtggatggggttacaatagtttcttctatgataaactccgtaccaagggttatgatggggtgaaaaggtggaccaaaaacgtgagtttagaattcacatccacttgtgtaatgccttgcctctaaagaatgagagtcttgtactctctgagccctttccctgcacgcggtcattcagtctttcaaagattacacgtctcttgtgtgtgtcaggcactaaggatacagtgttaaataaggaaaacttgcccttaaagttaacatggcagctagtgcatcaagtgctgtgggcagcatcaacaccaagtgctgggattacaggcttgagccacagcgcttggccaagatctcaatactaatcttggtgttgatctgggtgaatccagtgcaaccttccttttc

SEQ ID NO: 181902 - DNA, 642 bp, Homo sapiens
gtgctcaggatccagggagagaggcagactcaacatgcaaacaactcttctatgagggtaagtgtaattgagggccctaggagaactttagtagtggagggtttcttgtgtttctccctttggactgcctaactcaagcagtgttcttgacccatataagctatgtagtgtttcccctctcttatctactgtactaatttctgtgtctctcttggaaattactgccctgatctcgaaacttaacttcacccattgcttggtgagtggtgtggaaaacttctctcgggtctatgtcttatccctgaaaaatcttgccacagctgctcaggaagagtgtacaaactcatttccccaacatgaaagtcacaaaaattttgaaaaagttttccctaaaattgctgtgagaaggtcttgctgattatttttgttctcaattatatattctttggggggaaagcctgtagcttgctcactcatgggacagatctttcgtgggttacatgaagagcagatctgtgaatgttgtcatcccctgcttgttcctgctttcttgtggttaccatctttgtctttaacctttagtttttggctgagtgaaaaatttccagactcctgaaatcaccacaatcagatacaggagac

SEQ ID NO: 181903 - DNA, 458 bp, Homo sapiens
gctgagataagacgctgaggaaaatgggcagtaaattctagctgaaatgggaacaaaggagagtcttggtctagtttcaggttaacctaggaccgtgctctcactagcaggcagatggcaccctgtcagtgattatggaggtggtggaaagatcactgctctcagtggcatcatttagttctttgacctacaacctaagaaatcagatccctcacgtggaaaagtgaaagtcacaatacaagaccttacagctgttgaggtcaaatgagatcacatgtaagtgccagtgcttagtaaactgtataggaccataacgcccttgaagtaggtggacagaggcctccatggcaggcactgggctgtcataacctcttatcaagtaccaggcctggagctactcaggcttcacatgcacttagctataaggaaatcctgatacacactgcaggcccttacct

SEQ ID NO: 181904 - DNA, 504 bp, Homo sapiens
caggcaaataccaccatgcctggctaatttttctttaactttatgtggtgatgtagttgcccaggctggtcttgaactcctaggctcaagtgatcttcccacctcagcctcgctacgtgctgggattagagatgtgagccaccacacctggcctcccatatttatgtaatatttgttaaatacatgtagtttctatatgattaataaaacatatatccatttaagtaatgcagaattaacagtagtttattagtaatcatgtattttataaatctacagatacttatagttattatgtgggaatccataacctgaaagggttagttttaaactcatgatgagtaacggtgaacagaagtaaaatgtcaaattgtaactaaaagtatggcaggactacattagcaacagaagaatatgaacctgaatggaaggccttgcatgtgtatttgtctgtgtgccaatacactgtcagtgatctcaagctacagaatccttactccccta

SEQ ID NO: 181905 - DNA, 381 bp, Homo sapiens
aacttggtctttctcctgatggctttctaaaaacctcactgtctaccaccctttttccatcctagactggttgagtttaatctgtttttgatgtctcaggatcatcatccagaacatcaactactgaatagtatgacacgttctacggagagtggtgtcaggcttttcatttgcttccctaggtggcgaggattttaaattctactcttttaatagttttcctattacttccttagttggcctctactagactgccagatgccagcccttccctagaagtgctgctcatctgctgcttcttttctggtatggtctagagaaacagataagctggttataactataccttaaatgagagcataagggtataggaaggtatgg

SEQ ID NO: 181906 - DNA, 396 bp, Homo sapiens
aatggctcatatcagaagtgtccaaataaaagttctgggaaactaggtatttgcttcccagagcaatgggaatagctccaaaggtcagagtaaggtaatgagaatctcccggtcaattccagtgccaggcttcctgaaagaagtcaaagcttggatcctcattttaaagggcgcatccatgactcatctagcagcccctctctatttttcccttcacttgatggtaaatccattctatatgtccatttactagctggacatagagaacttgagctcacctctgggagttaaatattccaccccaactatcccatattgatagcaactggactcagaggtccccctcctgtttgaaagtgaacacattgccaatgttttgagaatggcaaaagcaat

SEQ ID NO: 181907 - DNA, 333 bp, Homo sapiens
ctattcatgggtaggtaaacatagggaaaaaatgctgaaacagaatagtaagtggaatgttcaaggggaaaatcattagactaagtttttatcaactattaataccaggactcttaaatgctcagctgaggattgcttgagcttgggagttggagaccagcctgggcaacaaagcaagaccctatcctacaaaatatttaaaaattagccaggtgtgtggcagacatctgtagttccagctacttgggaggctgaggtgggagaatcgcttgatcccaggaggttgaggctgcaatgagctatgataatgtgactgtactccagcctgggtaa

SEQ ID NO: 181908 - DNA, 384 bp, Homo sapiens
caagaaggagaggagaaagagcctgggtctgaaaaagtactggaaatacttgaagaaagtgctgaaaacttcctaaatttggtgagagacataaagctgtagattcaaaaaggtcggtgaaacccaaacaggataaatcaaaagaactgtcaactcagaatctgttttttgtttgtttattttgtctgtttgttttgaggtggagtctcactctgtcattcaggctggagtgcagtggcatgatctcggctcattgcaacctccaccacctcctgagttcaagtgattcttgtgcctcagcctcccgacgaagctgggattacagtcatgcgccaccacacccagctaattttttttgtaattttggtagagacagggtttcaa

SEQ ID NO: 181909 - DNA, 214 bp, Homo sapiens
tcctaagaatatcaccaagcttcttctccagcctttagatggtctattgtatgtctccatccagaattttttgcctcaggcatccattggtttatgttcctcttgtagcttttacaaacagtggtcaccatttttactgcccgtgttcagagatacgtgggacagagatgagttagtccttcatgttacaacagatgtacacaattatatgcaa

SEQ ID NO: 181910 - DNA, 213 bp, Homo sapiens
ttgctcagggaggtgatgttcagaccttcccattttaattataatgaagtattaacatgaacagtgtagggggaaaaggtggtcatgggagcacactgggtagtgagatcccagagaggctcccagaggaagtggcctctatgctgagatctgaaggatgaggatgtgggagtcaaaggaatgttccaggtggagggagcagcttttgcagaa

SEQ ID NO: 181911 - DNA, 623 bp, Homo sapiens
agagggagaagtaacacttgttgagcaatgaattaaaatgccagattcattttcaagtctgtgcaattttattccctttaccttttttaatactcacaataaatctgtgagaaaaatatttctatgcccagtttataagaaagaaaaccaagttcaagagctgtagcccaaggttttaattgtcagggctggaattagaagcactgtctgtccaactcccaaaattatgttatttctgttatgccctataaaccaagaacagtttttttgtaaaaagaacttgaggactgtgtaatatatttacctagatttaactgttaggtgttcaaattagcatattattatcagacacacccattagattccaaacttattgctgagaccaaattaataagaaacacgagaataataataaacataaaaagtttcaacacaaagcaatttcagttatggggtcaatgataacaacattcattagttgggatatttagagcatgacactaaataaggtaaagtcacaggaacggtccccacctgagcaaggaagcattactcccggttatgaccacagactgcttcttgggcaggtcctgccatctcacatgtgtaaactttcatctacc

SEQ ID NO: 181912 - DNA, 484 bp, Homo sapiens
ccgtctcccaggttcaagtgatcctcccgccttggcctcctaagtgtgtgccaccacactcggctaatttttgtatttttactagacactgggtttccccatgttggccaggctggtcttgaactcctgacctcaattgatccgcccggctcagcctccctaagtgatgggattacagatgtgagccaccatgcctggcctatgggaaggtttgatagtaatgaaaattgagaaagccagtctactgaattgcctgacaattttgagggcttatttgatcattatggttgcaaatttaaagtcatactagtcagcttgcttgtgtggtgtttcctccatgacattcagctgttttgatataggtataagatttctcaggcaagtacatggaggaaggaagggacacgggagttagtgtttgctaaggtatgattatgggccatggaatctaagctgagaagggagcagagagaaagcatggcag

SEQ ID NO: 181913 - DNA, 443 bp, Homo sapiens
catgatgcgaacaatatgaatgtcatgaaggccgctgagctgtacaattaaaaatgcctcagataggccaggtgcagtagttcacacctgtaatccccgctcttttggaggccgaagtgaaaggattccttgagcccaggagttcaagaccagcctgggcaacatggggagaacccagctctacaaaaaataaaaaattagctgggtgtagtggtacatgccagtagtcccagctattcggaaggctgaggtgggaggatcactggggcctgggaggttgagctgcagtgagctgtgactgcaccgctgcactccagcctgggcaagagtgagactgtctcacaacaacaacgacaggctaaaattataactttcatgtgctgcctattttaccacagtaagaaaacaatcattaaagcgttgtgttggtcagggttctccag

SEQ ID NO: 181914 - DNA, 335 bp, Homo sapiens
ctcaggtgctttcttcaagcaatttcaagtaaaatacctataaacagctactaaaatttagctgaaatataactggcctctccccttgaagggaacctagggttttcatgttttcaccaattcagagaagagatctgaaattgtgactcatgagtagaatcctctgaagatttattagcaagagatctggattataatcttcactatcactagcctgtgatttaactttctttgtaaaatgaagatgataatccttgtctgtcttacctgtcaaaactgcagtgaagattaaataattaaatgtgggaaagtcggccgggcacggtggctcatgc

SEQ ID NO: 181915 - DNA, 578 bp, Homo sapiens
aatgattagtttcttaatgaaattttacaagctcagttgaacacagaaaacatttgcttctctaaaagcaaacaggtctgtttctattataatcagacatctgaaccacagaagacccccagcccttaggagtacagaggtgaatctgttcaggaacttccgagttttctttgaagatgatagtggccaaagagtgatgggagaaggaagctggcgatcaacaagatttgaaactgcaggatctaatgccacagaccctgacataaactttgggcagttgtgctaaacacagcagctctcaagtagagggacagatgatcaaaggagctaatatagtcagtggttatgctagaatgtctgtttgggagggctttggagtgacagtctaactggaactacttttacatttctggcaggctgttcttacttaggttatatgagaaaattaaataaaatgaaatttaaaattcagtgaaacaggagaaggaaggatgattagggagaacaaaagggatttttagatcagtgaaactattctgtatgatattataatggtggatgtaagatatgcacttgtc

SEQ ID NO: 181916 - DNA, 328 bp, Homo sapiens
atgaatattgacaaatatatacaaatatatataaatgtttgatatatataaaatatgtattgaagaaaagtactataagaaaaattacaaaatattttgatggaatgataactgatacaaaataccaaaatttgtagaatgctgctaaaaagtatttagaaggaaatttatagttttaaatgtttatactagaaaggattagaaaggaaaaaaggtttaaaattaaaaactcatgtgttcaatttaagtagataagccaattaagattatctcaaaataattgtgcctaaaattacaattttattaaaaatattaattttaaaagaag

SEQ ID NO: 181917 - DNA, 116 bp, Homo sapiens
aagagaatcaaaagatgacaaattgcttctggttttaaaggagctgttcaggctgggtgtacacccagggggaaccagcttccgtgccaggagccatcacttcatcccagtctaag

SEQ ID NO: 181918 - DNA, 212 bp, Homo sapiens
caatattatgaagtgactggttatcaactctgaattgagtccagaaacatcctcattccctttgctcagttgttcttctgtcccatcagaatttcctcttcatatatataaatactataagtataggaaaaataaaaggaaagacaaggtccctgccctcatgagactagagttcctttaagatttgttctcctaatatcttgaatacagaa

SEQ ID NO: 181919 - DNA, 418 bp, Homo sapiens
gatcagggattctctgggggtggggtggctcccaggcctcagccaattgtcctattggtttcagccataaagacagctcaggctgctaccacgcactgataggagatttgtcaaagatcgaggcatcttcactcagaatccctctgtgattaccaattgtgaacacaaaatatctgatatgggtctcagtcaatttagaaagtttattttgccaaggttaaggacacatccatgacatagcctcaggaggttctgttgacgtgtgcaaggtggttggggcacagcttggttttacacattttagggagacatgagatatcaatcaatatatgttaagacatatatcaggtggtccaaaaaggtgggatgactggaaacagggagggggcttccaggtgataggtagataagagaaaaa

SEQ ID NO: 181920 - DNA, 835 bp, Homo sapiens
ccttgatgtacttgatgaatagtgactattattatcacacatagtaggccttcaaaaatacttctctcttactgcacacatctctgtgttaaagtagtcacattagtgctttgtaactatttatttgactgcctttctttccagaccagtgtttccagatcttctttttttattattattattgctccctaaggagactttttagacagttttttcctaattgcacccctgctgtgaaattgtaatgccacagacatactacgcctctgcttccgtaccatatgtacatttgtgcttttacatagaaagaataagaatttttgccaccgcccccaccccccaccagcgccaaaacaaattttcactcctttggggggcaatatcagccccaattactagaatgcacgttctagaatggagcttcttaagggtaaagtggcaatgtattcatgtttatgaatgaatggggatcatgccttcttcaaatggaagacattttggattacccagttctgccgtctctgtctgtgcatttccattgaggaatctgtgtcagttggagtctgtgcaatcagacctgaactgcacatgttttcatactgtttggttggagtcaccagagggttcatctttgctattggtcaggtcactgaagtcgcaaattgaaatcagtgattggggctcagagtttggggctgcgccggaaccctctgggcagcctagctgaatgcaggatccccctcgccccagagaactccttttccaggagaccaaggtgggtcccagaatctgcaagttcagtaatagccccaggtgattctcatgcaggcaggtg

SEQ ID NO: 181921 - DNA, 124 bp, Homo sapiens
tttccgttcccaggaaagacatatttcatacttgagaatcttcatatctgaataactatacagaaaaggaccgggcacggtggctcacgcctgtaatcctagcactttgggaggccaaggcagg

SEQ ID NO: 181922 - DNA, 557 bp, Homo sapiens
ctgccacagccacaccatgtgctgactgcaagacctggggaccttacttactatctgggggctgcagctttctcttctgaagcagagtcaccagagcccacatctgactgtgctgttgtgagggttacgtgaggcagtgaacatttagacagcactaggggcatgatgctctctcaagctgacgcgaccaatgtaggccactgccaaggtggagccttcatgtggaggaggatttgcattgctcagtaggttgttacaagtaactaacagagaaaagcaggctatgcatgaccaatgcgtgtgacacacaccaaggattgaacacaatccaattctctgtcctgggggcctaagaacctgacaagcctctcacctgccagctcagaacttacatctagacaatttctgctccaacagtttcaaacgtggttcctcccaccttctggccaagtgctcttacccatctaggggggccagtggaacgccctttccctcttgctgagcacgtaggaggggctgtttcaggaaagttctcaccaccaaagccctactgctca

SEQ ID NO: 181923 - DNA, 861 bp, Homo sapiens
attaaaaattgaattaccatttgattctgcaattctacttctgggtatataccacccaaaattgaaagcagtgtctcaaagaggtatctgtatacccatactcatagcagcattgttcacaatggctgaaatgtagacacaaccaaagtgtctatcaacagataactggataagcaaaatacatggggaggcacatgtgtacacatacataaatacatgttagtattatccagctttaaaaaggaaggaaattctgatatttgctacagcatggatgaaccttgaggacattattatacaaagtgaagtaaaccagatgcaaaaggacaaatactgtactgtatgattccacttatttgaggtacttagactcatcagaattatagaccgaagtagaatgattgttgccagtggctagcatggaaggagggatgggaagttagtgtttaataggtatagaatttcagttttataggatggatagcactgatgtttgcacaacattatgaatgtatttaatatcactgaaccatacactttaaaatggttaagatagtaaattttatgttatgtgtattttaccacaataaaaaaatgagggggaagtatacatcaaatgtcatcactccctccactagtgttctatcccagtgggaataaagtccttgccatgacttataagagctgtgtgatctgacctccaccagttcatccatgcttatttcctatcactgtctccctggttcactatgctctaactggtctgctgaccttttcattttggaacacactcaacccacttctagctggtggctttttcctttgctgtttcccgtcttgaaaggctcttctcttatgtcc

SEQ ID NO: 181924 - DNA, 373 bp, Homo sapiens
tgatattttcttgattatccagaaaatcatcttgtctgacttctgctgattccacagatgtaattgcaagaatgcaggatatctccctatttgttttcgcaaaggtctggctcttctcttctggtcataatgacctacacagattagaaacttaacgtgttttgaatttataaaaggaatcatggtataaaaaagccaatagcatttgacttcgcatttgttgtgtaccttgactgttcagatagttactttaatctgtgagtttataatatagttgttgctttcagaatagttgtcgtgcaacttctgagttaccgtgacacataaatgaaatttgccgaaggaagtataaagtgagggggatcctctagga

SEQ ID NO: 181925 - DNA, 712 bp, Homo sapiens
gtctgagaagtttgctgaggtccattgggggctagagcctggggtgctggagaaactcagtacagagcaggccccactgggcacacgccactggcagctgtgccttcagaggaaaaagagaccctggaaccaggaagagaagctgctacctcagcaaggcctggcagctccccacagtgttgtcccctgtggatagagcctgacatgactgtatttggccaaggagaaagactcataaggcctcggtccagtatcacggagcggggcctggcaggatgtatgcagagttaagaggcaatacatgggtaactggcatatttttccagattctttgttttttttgttgttttgttttgttttgttttgttttgtgacagagcaagactccgtctcaaaaacaaaaacaaaaacaaaaacaaaaacaaaaacatccgaaatgtcttccctaaagtttctggagccagaaatcccagaccgaggtgtctgaaggttcattcctcctgggggttccgagggagactgtcccatgcctttctccgagctctgcggcggccagcaacccctggtattcctcggcttgcagctcggcctaccccccacctggccttcaccctgtgtctcttcttgtgtctctgtccaaactgccctctctgttgtctttttaatttatttttagggacaggttctcattctgtcctccaggctggagtgc

SEQ ID NO: 181926 - DNA, 145 bp, Homo sapiens
acagggaaaggtcaaggggaagcaggtgggatatcttggggcacagggacagtatcagagagactccctagaggaagtgatctttaagatccctgagacctgaaggagaaacacgggctaatggggaagagcattccaggcagaa

SEQ ID NO: 181927 - DNA, 542 bp, Homo sapiens
ctcaaggttgggacggcgaggatggggacagcaggtgatgggggcatggaatcgagtgcgtggaatcaagtgccacttgtgttgagatgcccactaggtggcctggtggagagggttagctacccaggtctggctcagggcagtggttggggccgacgcagcagataaaggagggtgttcaggagaccagatgtgagccccagagcaagaattgggccaaaaatagaacctgggcagagggaactgttcctacctcattgggctgagcaagaatcaatggagagtcatggaaagcactcagcccagtgccaggcaaggagtggacacccatgactgtcgcctggtgttccgctatactgctgaggagctggacccaagatccagagagggccagcagctgacccagggtcacacagctggacgagggtctgaacccagtttgtttttgttttttgagatgcagtctcgctctgtcacccaggctggagtgcagtggcatgatcttggctcatagcacctctgcctcccaggttcaagtgatt

SEQ ID NO: 181928 - DNA, 613 bp, Homo sapiens
ctcaaggttgggacggcgaggatggggacagcaggtgatgggggcatggaatcgagtgcgtggaatcaagtgccacttgtgttgagatgcccactaggtggcctggtggagagggttagctacccaggtctggctcagggcagtggttggggccgacgcagcagataaaggagggtgttcaggagaccagatgtgagccccagagcaagaattgggccaaaaatagaacctgggcagagggaactgttcctacctcattgggctgagcaagaatcaatggagagtcatggaaagcactcagcccagtgccaggcaaggagtggacacccatgactgtcgcctggtgttccgctatactgctgaggagctggacccaagatccagagagggccagcagctgacccagggtcacacagctggacgagggtctgaacccagtttgtttttgttttttgagatgcagtctcgctctgtcacccaggctggtcttgaacccctggccttaagtgatcttcccacctcagcctcccaaaatgctgagattgcaggcgtgagccaacgtgcccggccaaatttttatatttaatcagagtacctcctatatttgctttgg

SEQ ID NO: 181929 - DNA, 318 bp, Homo sapiens
  misc_feature (11)..(11): n is a, c, g, or t
  misc_feature (28)..(28): n is a, c, g, or t
ccgagtcctantcccttccacaaaagcnttcccctattgcagttaatctcatccttctttgttgtagcttctctcacattctatctgcagtatagttgtttcttttcctggtctagaaggtaaactctttttgaggacaggaaactgttcactgttgcatctgcatttatatacacatagtgaaaccacaggtacttgaaatatgttggttgggtcaagttcaattttggagattgtttattttcatgggacctgcacaaatattagcagaaaaaaaaagaatttcccatcatgccaagtatcaggcagagtgttggg

SEQ ID NO: 181930 - DNA, 1502 bp, Homo sapiens
  misc_feature (809)..(809): n is a, c, g, or t
  misc_feature (1230)..(1230): n is a, c, g, or t
  misc_feature (1249)..(1249): n is a, c, g, or t
  misc_feature (1266)..(1266): n is a, c, g, or t
  misc_feature (1276)..(1276): n is a, c, g, or t
  misc_feature (1310)..(1310): n is a, c, g, or t
  misc_feature (1396)..(1397): n is a, c, g, or t
  misc_feature (1402)..(1402): n is a, c, g, or t
  misc_feature (1419)..(1419): n is a, c, g, or t
  misc_feature (1422)..(1422): n is a, c, g, or t
  misc_feature (1429)..(1429): n is a, c, g, or t
  misc_feature (1433)..(1433): n is a, c, g, or t
  misc_feature (1437)..(1437): n is a, c, g, or t
  misc_feature (1441)..(1441): n is a, c, g, or t
  misc_feature (1452)..(1452): n is a, c, g, or t
  misc_feature (1457)..(1457): n is a, c, g, or t
  misc_feature (1461)..(1462): n is a, c, g, or t
  misc_feature (1469)..(1469): n is a, c, g, or t
  misc_feature (1483)..(1483): n is a, c, g, or t
  misc_feature (1491)..(1492): n is a, c, g, or t
  misc_feature (1501)..(1502): n is a, c, g, or t
tttttttttttggtggaggtggggtttcgccacgttggccaggttggttttggactgctgacctcaggtggtccacccacctctgcctcccgaagtgctgggattacaggcgtgagccaccacaaccagcctcccttttgtcagcttatcaccccacccttatgaccttatttaaccttaattacctcccaaaggccctgtctccaaatacagtccctgttggaggtcagagcttcagcatatgaatttagtcatgggtaggtgacacaattcagtccataacagatggtcaaagtctgacccatagtgttcaacagctgctgttagttactctccttggctagtagtatgccttgaggcattaaagaacaaacacacaaagctagtgtggtgtaggaggcaccctgagaagttctgtgatgggctctgtctcctggtgctgcagaggaaggcatttgtgtgtaagtgactggtggcctcaaccatgggagggtctcagatttcaacatcctcctaaatcccttgggggtgtttttgtggaattcagattctgcctaacaggctggggaggtacaggctaagggcctacatttcttttctttttcttttttgagacacagtctcactttgtcacccaggtgaggcgatcatggctcaatgtagcctcaacctcccccaggctcaagcgatcctcccacctcagcctcctgggactacaggcacataccaccacagctggctaatgtatttttttgtagagacgaggtttcactatgttgcccaggctggtcttgaactcctgggctcangtgatcctcctgccttggcctcccaaggtgctggggttataggtgtgagccaccacacctgatcaaggacctatgttcctaaggagctccctggtaatgctaatactgctggtccacggaccacacttttgagtagtgagggcctgtgttcagcagcacagtagccaggagccacgtgtggctgtttcagtctccgtcttagttaaataaaactagaaaatccagtgcctcagtgactgtaattgcattgcatggaggaaagttctaattgggcagtgccacatcttaaaggaccgaatgatccactttttctttacttttaaattttctttctttatatttttagagacagggtcttgctctgtagctgaagctggagtgcagtggcactatcttagctcactgcagcctaaacctcctnagctcaagctgtcctcccncatcagcctcctgagtngctgggactncaggcacatgctaccacacccagctatttttttnttttttttgtagagatggggtctcactatgttgcccaggctggtcttgaactcccaggctcaagcagtcctcccacctcagctacnngggangctgaggcaggagaatngcntgaaccngggnggcngagnttgcagtgagncgagntcannccactgnactccagcctgggngacagagnnagactctcnn

SEQ ID NO: 181931 - DNA, 555 bp, Homo sapiens
taaattaaaggaaaaatgaaatgtctccttaagtggaagagaacgacttcaaattgggactttgggagttgagtagaaaacatcaaactggccattgcagacaaatcgtttccagttggtgaataagaataggctgtggacctcagagcttaaacataaaaggcagcaggaaaacttgtgtttctttcagtactgaagtaaaaaggaaacatttatcttgctgcatccatccttacagtaatgaaagttgactagaaaaaccagacaagagctatttaatttgtttatttgcaaaccttcagatgtggcagaataatctggaaagccagagttcattatgtcttcctcattctgggacagcaggggcattttcatttatatattttatcccacaaacagcaaaagacaaatcagttagcacttcttcctcactgtccaaaattatgaggcattggcaatagcactaattgttttctttgtgttttgttaggacggcttttgcatcatataaggattgtgtctaagttgggtttgcaatgtaccctggcaaggtta

SEQ ID NO: 181932 - DNA, 441 bp, Homo sapiens
agccgactcctgaggataaaccgacccccggggaagacatcaggactactggtcagccccagagacctgaattgtgaggaccagcgaagatgagggggagggtgtctctagtcagtcctcccccactgctgacctgtgccctgcccaccaggacagcataggacttaggattgcatctttctttacttcataggagcagaagtcagaagaggaaagagggctttttaaatgaggtagtggcagaactgacaagggggtatcagaatgagagtgcacacaagtaagtgggagtatgtattgattagtcagtacagcaaagagactgaaacctgtggtcgctacactcctctggatgcagaggactggtcaaaaaattgcagaatcatccttttataagatagtatgttctcataacagctctttgaggatcagggaggtagg

SEQ ID NO: 181933 - DNA, 259 bp, Homo sapiens
tacaaccaccatatcagaggtgccttcaaaaatatcagtatttgtgagatatagaggggcagaagtctggttggtgtgtttattttcttgaaaattctgtttctacctccttttggaacaagctcagcttcatgaagaagaaataaaaagtcttcctaaaagaggttttcctcagctattggaaatattaaatagaagtattttaaaatgctatatttagttgaatgcataggtttttccccctaatagtttatgctgt

SEQ ID NO: 181934 - DNA, 236 bp, Homo sapiens
gcagtgtgtgagggaatgtgagtgtgtggtatatagtaagacagaaacacatagccagtctttgtacccaatcctggcacagagcttcaaaaacccatggaatttcctgagagatgagagtgtcttttattattcataatgagccccttttgatcttacctgagtttctgctactaaacagggactcctggtgggaccttagattcaagggaggtgctggccacagaaagactaag

SEQ ID NO: 181935 - DNA, 388 bp, Homo sapiens
taattttactgatctctctgtgcattactgaatctagaaatctcttcgtgcttgacaccaaagcttttcattataaccctttcctgatctattcctcatcttcccaagttcaatcaactgcctctgcctgatgcctgtttccttccttttcttcccactaagttccagtagccatttttttcaactcctacagcggctaatatgaaatgaaattctccccaaacttaagtgtaacttctttaagaaaaaattggaaaaaaaaatccagtagatgccagtcttctattgaaaaagacacgtgggtataatatagctgatgcctaacaaaagctacttcctagtcactccttcagaagagggttatcctcattccatcttccccaccact

SEQ ID NO: 181936 - DNA, 765 bp, Homo sapiens
ggccaaaaagtaaaacttgtactccctatcaataaaactgatcataaatcactttttctaacataaaacagccttttcatactaactagatgtaataagaatttgcagattacatgcagttccatataaattcctcactgagattattttaatttcctttactttcaaaacttgaaagtaagccaggtgtagtggggttcacactttgcgaggccaaaaggggtaggactgcttgagcctgggagctcaagaccaacctgggtgctgagtgtgatggctcatgcctgtaatcacagcactttcggaggccaaggcaggaggatcacctgatgtcaggagtttgaatccagcctggccaacatggcgaaatcccatctctaataaaaatacaaaaattagccggacatggtggcgcatgcctgataaaatacctctctcattctttataaccagctactcaggaggctgagacaggagaatcacttgaacccaggaggcggaggtggcagtgagtggagattgcgccattgcactccagcctgggtgacagagcaagactctgtctaacaagaaaagaagagaagagaaaagagaagagaccagcccagactcggaaacatattgaggctctgtctctacaaaaaaaaaattaagttagccaggcatggtggcatgcacctgtagtcccagctaatcaggaggctggggtgggaggattaattgaatccaggaggtcaatcctgtagtgagccgcgatcatgctac

SEQ ID NO: 181937 - DNA, 360 bp, Homo sapiens
gcttgcagtgagccgagatcacgccaccgcactccagcctgggagacagagcgagactccgtttcaaaaaaaaaaaattgtggtaaaatatagcaagattaccattttaaccacttaaaaatgtttttgactagaaagaagggaggaaaattttaaccgtttgtaattgtatggttcagtggcatcgcctccgttcacactgctgtgcatccgtcaccaccgtccatctccagaactttttaatcctcccaaactgaatttccacacccttgaggctcaccgttcctccctcctactatcccctggcaaccaccgttctcctttccatttctgtgaacccgactgcttctaggtacctcc

SEQ ID NO: 181938 - DNA, 347 bp, Homo sapiens
cagcaggaagaagaaaaatgagcaaaagatggaaaagcctcttataaaaccattagatcttgtgaaaactcactcactatcatgagaacagcataaaggtaaccacccccatgattcaattacctcccacagggttcctcccatgatgtggggattataggagctacaattcaagatgaaatttgggtggggacacagccaaaccatatcaaaagtcctctgccatgtctggtcttttaattcctttgttccccaaccttccacccctgattgtctcctgccctgtcccccttttgtttctcttcctcaataagccttaatttccatggccaatcacttataaacct

SEQ ID NO: 181939 - DNA, 572 bp, Homo sapiens
cagtataaaagaaattgaaactggaaattctatcgcatagtttatataagaaagatgatacagactccatcagtgggcccatactcacagaataggctttgacccaatatcctaagattgttgaatagatataaatttatgttttaaattaaaataaaatgtttgagttacatatattatcactacttgatttccctcacttcgtcaatcagttaatgatccaggtcatgttgcataagcagttttttcctgttcttatcgaaaaatggtgtggagttcacagagtaaataaaagaacaaatgtttgcatgttgagggaaaaaccaccaccatcaccaccaccaccaccaacagatgctgtaagaatgaggaactacccgctaccataatgaaaagctactatgggttttttttttctttgagacggagtttctctctgttgcccaagctggtctcaagctcctggcctcaggcagcctcccagcttggctcccaaggtgctgggattacaggcatgagccaccatgcccagcccttccagagaatttttatgcttataaaaagcaatacca

SEQ ID NO: 181940 - DNA, 116 bp, Homo sapiens
tgcctctaggaaaagaaaccttcagttttattctagcttaattatgttttcacatacttgggttaataagcctttaacatatttctttatgcattcattgtagaaatttagaaaag

SEQ ID NO: 181941 - DNA, 308 bp, Homo sapiens
tgttgggctccagccactcctcctaccagacccattcaagaaaagacaaaggagcccattttgaagcagctctcctggagccagcaaagacacaataaaacaacaagttaattgtccacagcagtaccaggaagtcacacaggtgcaatcaaggcagaccatttcctgctgttactaccctgaggtccaaaggcctgcccaggcctcaccatccttggtgacccccatttttaccctgtgacgcctcagtaaaactctggaagacttctgttggaggtattaaaaaataccgtgacagccaggagcag

SEQ ID NO: 181942 - DNA, 393 bp, Homo sapiens
agcctaggtctcctcctctgtaaaaaagatgatactgacatctgtcttggaggtgtgttttaatgaaagaaatgagattaatgtacattaagtaactggcgtactgcctaaccacaataaagcacttgataaacagaagctagttaagattaaacccacagttccagaagaggctaatcaaatgagaacaatttatgctaataatctatgtgatatcaaatatatctcaagtacatgttttatctgttttcaacttgagacaaatccacaacatttttaagatgaaagggagcctctaaaccagtgcttcgcaaactttaatttcttacaaatcagagggtcacgttaaaatccaggttctgatgtggtaggtttgaggggactgagagtctg

SEQ ID NO: 181943 - DNA, 408 bp, Homo sapiens
ctctgcagactcttgaagtttttctccagaagcagacagcatcttacatatgtacagctctcctaagaccatgggccaagacttacctccatcctgaaagccgtatccttttactttttttcccctaattttcttctgccccaattatttccttttccttacaggaaaatccatgggaccataatctgtggatagctttacctaaggcttattctgtagcaaaaaacttgagtaatccttgggcttgtgggttaatgccaaaaactcaagaagcaatttcacaaatgccaatgcctccctgtgttcccaattcaccctgacgctccaaaggaagaacagaaagctatcttgatattctagacatcactaccacttgttttcctacacttgctggaaacaatatcctaa

SEQ ID NO: 181944 - DNA, 258 bp, Homo sapiens
ttattgagggctggagccaactatttgtgacttttccaactatttttgtgaggtgtgtattctttgcagtatggggtcagtgaagtttcagtttgtatcctgtggtctgtaccagagggtttaaagcaagggagtgccatgttctagttcattttttaggaagataattcttgctgtcatgtgaagcacagcctgcagggagggaaatcagttaagcagctgtggcagttgtccagataagaggtgagaacaacttga

SEQ ID NO: 181945 - DNA, 290 bp, Homo sapiens
agaaccagcctttgttttctacaagctatctgttcggtctactcaggaatagagataaactgccttaatagtaataaaagcaagcaccgctgagtgagtgctggcctcatgccaggaactgctcttggcactctgtgcacaagggagatactgacattctttctgttgtgcagatgagaaaacaggctcagagaaggtgagtaacttaccatggtcacacagcagcagagctaggtcagtataatccacaagtcattctcttaaccgctccgccgtaccgcccagaatgt

SEQ ID NO: 181946 - DNA, 289 bp, Homo sapiens
tagaggatccacacacgccacgccttcatgatattatactcatcataggcaatactgccagagctatcaatgacaaacacaacgtctaaaacttcaatccgcttgcattcttcacgggggctgcatattccaaaaacaagatcatcttcaatgcgctgcagaatgtcaaaattctcaacataaaaaaccatctcgggcctcccactgatctcctcaagctgggtgacattggagccaaacactcccacagaatagatgattacaccttcttgccgaagcactactgctg

SEQ ID NO: 181947 - DNA, 439 bp, Homo sapiens
ggacctactattcttgctttccccacaatgaggagacttagccaaagtgatccctcttggtgtgaggtctgatgttacccacaagcagctgcagcagcactggattccaggagcaggtgctcagaatgacaatgggaccatgtcctaggctcagagtctcacaaatgtatttgtggcacctgtggcaaagtgggatatgttacccacatggtcaggatctgtgactgtcaggtacccactggtagcttggacctaagagtctactttgtagctgtgattctatccctgggaattagggcataacactggcctgactaggtagaaggggcattctggaagtttgggtcaagggtctggctgcaattcaggaacatgagtcagcagggctcagtggcaacttaggtcccatggaatgaagcaccatacagtattgactata

SEQ ID NO: 181948 - DNA, 309 bp, Homo sapiens
aaaggaaacattgactcgaagccccgtgagacatggaggtggagcatcaggaggccaccgtggggctgggcaacccctgcgccccggggcctctgcagcacattctgtggggccagcccgctccctttgcctccaggagcaggagacctggcacgagctgcggggcggggtcttgttgagagcactcatgcccctgttctgtgtttagttccacacgggcccagtgctgcccctgctgctgcaggagcccccaggcgaggttcggccttcctctcgcccctgtgcacccggagatgcccacagcaccag

SEQ ID NO: 181949 - DNA, 378 bp, Homo sapiens
tccccctctgctctcaaccccccagccccaacctctgggtccctacaaagcagggaagggacccccggggcgtggtgaggctgcagctctccaggagttccacacgggcccagtgctgcccctgctgctgcaggagcccccaggcgaggttcggccttcctctcgcccctgtgcacccggagatgcccacagcaccagcacctgagctcacctccgaacccgcctcctgaacccgcctcctgaacctgcctccttacctcccacttcctgagccctgagtggaagcctttctgtgccttgccctttgcccactcccctggtgggactgccaagaccctcaatgcccattaaatactcttgcctgcctcttaaaaaagt

SEQ ID NO: 181950 - DNA, 367 bp, Homo sapiens
agaaaaactgtttgaagatgacataatgctattctatacacagagaaaatcctaaagaacctatagaaaaactatcagagctattaagttcagcaaagttgcagaatacaaaatcaacatagaaaaatcagttgaatttctatacaacagcaatgagcaacctgaaaatgaaataaagaaaacatttccatctataatagcatcaaaaagaataagattattaggaatacatttaacaaaagaagtgcacactgaaactacaaaatattgtggaaagcaacgaaggaagacttaaataaatgtaaagccaatccacgtccatgggctggaagacttctttgtttgaaacagggactgagtctgtcac

SEQ ID NO: 181951 - DNA, 463 bp, Homo sapiens
tcgattctctgtttctccctcctccctctgcccttaaactaaagtcaaccatcttgaggccatgtgaaaaaataggcttggatggaaaggtgcacccttaatctaatctttgccatggattggccccctcgtttggtggggaactcttcatgggacatgttgaaaaagacctcacatctttatcattttttaattcatgtttcttaccatattgaattggtttttgccacttgtaacaaaaggattcctgatgaatgcctcctgtgtttggagtcttattttattcttcctctctgtagctgcagggtctaatatatacctaatttataatctgtgtaggtgccaattacatatgtaattgtgtgagcatatgtatataaaaacttagaagcagatatgcccctgagagcaaaataaagaataaagttcctaaaacatacagagaaaaagataatgtaggaga

SEQ ID NO: 181952 - DNA, 297 bp, Homo sapiens
tgtgctagctcaggacagaaaggcagcagctggagctcttagagtggtaagaggtgagggcaggaagggagcaggggccaggtcatgacttgcatttttatcctgcatgaaatggagggctcacagaaagttgtgagtagagaattgacaggaagacttatgttatacagatactgtaggggcttggtgtgtgtctcaagcaatcctcctgccttggccttccaaattgttgtaattacagatgtgagccattgcacctggccttgaaaattattttgatatcaaaaactaaagttg

SEQ ID NO: 181953 - DNA, 435 bp, Homo sapiens
tgtgctagctcaggacagaaaggcagcagctggagctcttagagtggtaagaggtgagggcaggaagggagcaggggccaggtcatgacttgcatttttatcctgcatgaaatggagggctcacagaaagttgtgagtagagaattgacaggaagacttatgttatacagatactgtaggggcttggtgtgtgtctcacgcctgttatcctggcactttgggaggccaaggtaggaggaattgcttgagcccagggatttgagaccagcctgggcaacatggtgtgagaccctgtccctattttttaaaatagtgtgtgtatataaactgcagggctaagattggaagctgggagcccatttggaagcttatgtgataatccaggtgagagatgatggtggcttgggaaagagtgaagttctgaaaagttcagtg

SEQ ID NO: 181954 - DNA, 160 bp, Homo sapiens
caatgatgccatctaacagagatgaaattagggattttttttcattacttttgtccttttgggaatagaaacacacccaaacctcttaatgcaaaagctcattaagtgactttcacacattcaacattaacacctctgaagaaaccatcaggccgggtac

SEQ ID NO: 181955 - DNA, 340 bp, Homo sapiens
tgaaaagactcatgagttcacattgaatctcatcaaaaccccttccaaaaccatagcctaaatctgaaaagttgctacagaaacattctcagcattgggaaatacatcttagaacaaacatatccaaggagaatatgtgattccttaaactttttcttgttctattcttacgttataaacctctacactttccagctaaccagcctactgggcagcccaggaggcaggagccagctagagaccatcagatcattcagcctcctaagaaaataaaaatgaaatcctttcaggcagtgcttcccaaaaagtgaaagcattttcatgaatacaataaaaacta

SEQ ID NO: 181956 - DNA, 176 bp, Homo sapiens
accctctagggaggagaaccagaagcaaggcatcccttgagtgtgatctccaaaagggatgtcttctgtccatttcttatgtgttgccttgatggtggttgaggctggatgggaaggccacagtgtggagaagactgtgctcacccctcaaagtctcggcccagtgacttgcccca

SEQ ID NO: 181957 - DNA, 973 bp, Homo sapiens
tttatggctaagggggtacgttgtatggtttgttttttttttaaccaagatttaaattaaaaaaaatttgagaacacataatagaagaaaattgtgagaatggggtggtcaatatgtgaggggcatacacacaccaaggtcagatttggcattaggggtttatgggtagtttcggagagagccatttgagcagaaaggtggggaaagaagctagacctcaggggattggagagagctcaggcgacactggagggaggtgggggcagccagaatggactcactcccatgtttggtggtaccaggaaagagagactgagtgggggtgacgtgaatggatagagtttgtggtaagattagtgttctgttgtttttttatctagagaacgcctgaacacacctgtaggtgggagaggagagatgaaagatgaggaagtgggtaaagcgagtggggatgctggaggtcagatgattagagaacagatccctggcagtgatggggggagagatgtgctggttagtcttggtggaagagggacctgtgcctttgtgacagagggtagaggaggaaggtggtgtggaggtgtggacagagcattatcagatactgagagagatgtggccaggatgggggtggatgcacagtctttctataaatttgtctaccaacagttgaagccaactgctgcagtggggaagcagggctgaattggagtcacgagaagtgtgggagaggtgtggacagcaactgtgggggccgcagcaggggagttagtgatggatgaggtatcgcctgtctagcagaaggatacaagctgagcctggtcaacaccaacctgtggttggcccaaaaggcaaaagtttgcagcaccctctagcaatgctcagagtggaggaaagtgctgtgggctggttctgggtgggctggttctgggtggggagctggcagggcagaggaggtagtctggagttggag

SEQ ID NO: 181958 - DNA, 917 bp, Homo sapiens
tttatggctaagggggtacgttgtatggtttgttttttttttaaccaagatttaaattaaaaaaaatttgagaacacataatagaagaaaattgtgagaatggggtggtcaatatgtgaggggcatacacacaccaaggtcagatttggcattaggggtttatgggtagtttcggagagagccatttgagcagaaaggtggggaaagaagctagacctcaggggattggagagagctcaggcgacactggagggaggtgggggcagccagaatggactcactcccatgtttggtggtaccaggaaagagagactgattatctagagaacgcctgaacacacctgtaggtgggagaggagagatgaaagatgaggaagtgggtaaagcgagtggggatgctggaggtcagatgattagagaacagatccctggcagtgatggggggagagatgtgctggttagtcttggtggaagagggacctgtgcctttgtgacagagggtagaggaggaaggtggtgtggaggtgtggacagagcattatcagatactgagagagatgtggccaggatgggggtggatgcacagtctttctataaatttgtctaccaacagttgaagccaactgctgcagtggggaagcagggctgaattggagtcacgagaagtgtgggagaggtgtggacagcaactgtgggggccgcagcaggggagttagtgatggatgaggtatcgcctgtctagcagaaggatacaagctgagcctggtcaacaccaacctgtggttggcccaaaaggcaaaagtttgcagcaccctctagcaatgctcagagtggaggaaagtgctgtgggctggttctgggtgggctggttctgggtggggagctggcagggcagaggaggtagtctggagttggag

SEQ ID NO: 181959 - DNA, 394 bp, Homo sapiens
catcttgcctgctttagaatcttaatacaggaaaatattaccttattgtaatattacatcaccataaatttatcattacatccattatacacaccattataaaaaccaacatgaattcagcactgacaatgcccaaactctgttcctaagcactgcccacatattaccctatactcaaaacaaacctagggaggtagtatttttagccccattttacaaatgagcaaacaggctcagacaggtaaactgacttgtcaggtcattcagcattgaagcggcagagtagggattggagcccaggcaggccaattccatggcttcagtgcttaaaccctgggctttatggcctttgcaattctgacttcatctggaagttctaaccccgccaagattg

SEQ ID NO: 181960 - DNA, 319 bp, Homo sapiens
accttctcaaatagaatatgcagggagggaagtaggcaaaccatttacaagttgggtttttgttttgattaacctgttaagagacacttttgtaatctctagtgtttacattcctttatactagctatctataaagagaatccagaaggctaaattaatcagaaataattatatttctatgtcagggtattggctatatgtagcatgaacaattctccattttctgcaaatgggtttttcaggacagttttataattctgagtttgctttttcttattccctagacagtttgtactcagggaatacaaattgattttta

SEQ ID NO: 181961 - DNA, 240 bp, Homo sapiens
gaagtggaggctgcagtgaggcgagattgcgccattgcactccagcctgtgtgacagagtgagactatttcaaaaaaaaagagagtgatcaacatcaggtgagtttcaggtgtgcaagaccagttgcagcatctgaaagacgtggccctcttggaggaaaacaagagggtggacagtcaggggaggagaatgtcaactacagaggaagacgcatgcgtctaatatgtttgacgcttctag

SEQ ID NO: 181962 - DNA, 502 bp, Homo sapiens
  misc_feature (474)..(474): n is a, c, g, or t
ctcagccggaccggatgtatcccaacactcgagtctagctgagtcatactcgtcataatataaacatcattttctcagtgaagcttctggtatgcccaaatttgaataagctgttctatgtgcttccatagcatcctgaattcctttatgaaaggatctaccatactgtgttgggcgataatcattatcgcccaacacgcaaaaggttctgaagggcatggaatgagaatccctgtgctctcggccggctcagtgcctgtgtcctggccgccagtcctccccatgaccccctagcggaaactgacgctatcagattctcagccttcgtttttcatgatggcctctttctcatccccataaaatgcagcatgtaaaaaacatcagaggaccctcagtttcttgtggatttatcttgtttatgtttccgtttgccgtcatgtgtttaaaatttcttcctgttgagtacatggtgtngggcgataacatcacggggatcctctag

SEQ ID NO: 181963 - DNA, 543 bp, Homo sapiens
ctcagccggaccggatgtatcccaacactcgagtctagctgagtcatactcgtcataatataaacatcattttctcagtgaagcttctggtatgcccaaatttgaataagctgttctatgtgcttccatagcatcctgaattcctttatgaaaggatctaccatactgtgttgggcgataatcattatcgcccaacacgcaaaaggttctgaagggcatggaatgagaatccctgtgctctcggccggctcagtgcctgtgtcctggccgccagtcctccccatgaccccctagcggaaactgacgctatcagattctcagccttcgtttttcatgatggcctctttctcatccccataaaatgcagcatgtaaaaaacatcagaggaccctcagtttcttgtggatttatcttgtttatgtttccgtttgccgtcatgtgtttaaaatttcttcctgttgagcttcatttgcacattaatgtgcatcacatggtggcaccgatacacaaataacgtgtgatctgtgtcgtggataactatga

SEQ ID NO: 181964 - DNA, 162 bp, Homo sapiens
tgtatccttaaaagtgagatgtatctttgtatacagtatatagctaagtcttgttttttaatccattcagtaactgtctttttattagagcatttaatccatttataagcaaggtaattattgatatgtaggatgtactattgccatttcctttttcttttt

SEQ ID NO: 181965 - DNA, 497 bp, Homo sapiens
tgcagaaccatgattcagtccagctctggagcttgtttattgctcatgggaccaggcgaggccacctccaccagctcaactggggtcgactcattgattaaatgagtgacctgaattcctttgattcttaatttactggtctttaagtcaagatgaaaccccctccctctccagtggtttgtggaaggagtatacagagcttgtaaatgggctgagtcaatgcctgcccgcagatgggtggtcagctggaatgaaatgcacagtgaagaccatccatgactgtcccaggcacacctgggtggagggtcctgaaagcccccatcctagcaggcaggattcagtgaaatgggagcaaggcatggtgggctgtgtgcccacctgcgcctgtgccggctacacctctcggtttcctggattgtcagcttctcctagaaactcactcagacccctcctgagtcagacagagcatccctggaccaggactgggtctgttctgt

SEQ ID NO: 181966 - DNA, 406 bp, Homo sapiens
gttgggacaccttgcagaaggactcttttatgagcacaaaagacctgtagtctacaatttgatgaagaaccccagtgccctagactagttggtgaccaaccaccattactttaaactgggccttcttgatagtagaatatttccccttttctgcaagactgcttatgcctctcataaatgtgcagaacatataatggctcagggcttaggtttaagctcctcagagtggcatttatggatcattcattaattcatcaaatgtttattgagcccttactttgttccaggatgttttctaagtactgggctacattgttgggacaaaacagacaaggcctcttccctaattaagctttattctgtatgtatgggaatgaggaatatacaacaaacaagcaaataggat

SEQ ID NO: 181967 - DNA, 384 bp, Homo sapiens
gtgagtctatttctgggctctgtattctgtttcattgatctatttgtctattcttttgccaataccacactctcttaattactgtaactttatagtaagtcttgaagtcaagtagtttcagtccttcagttttgttcttcttctacaatattttgttggctaattggatcttttgcctctccatataaattttagactcagtttgttgacatccacaaaatagcttgctgggattttgactaggattgcattgagtgtatagatgaagttgggaagaactggcatttgataatagagtcttcctgttcatgaacatggaatatctctccatttaaagatgctccttggtttacaatggagttacatttggataaacccattata

SEQ ID NO: 181968 - DNA, 426 bp, Homo sapiens
acctcacttgcccatcaccccaacacaggccccaagtacacagtcaggcctctgagactctgataacattgttccctctgcccagaacatcctttcctcgcctctctctggacctaaatcctacccagattttaacgaatgcttcaacatctacttctctaagatgctctcctccatgtttagaaggaatacacattgaggccccgggaaatcaagtgattttctcaaggtcacttagatcaggaggggcaaagttacaacttaaaattttggcttgtgactcgctgtgttactacttaccaatattttgttttcccctggaaatggacagatttgtcttcagcttcagaatcatttcatctgacaccttttatagataagacactagtctcaaacttggctgcatgttggaatcacctggaagct

SEQ ID NO: 181969 - DNA, 513 bp, Homo sapiens
aataccacgagcagccattaggggcagtctcacctcagggccaggcagggagggtcccacagacactgggcaaccaagaagcaactgcggaggtagtgctgggccttgcacaggcctgggcagggtccacctaccagcagtgccctccctcccacttctgttgatgaatctataagacccagggagggcaacacaggaatgaggtggccgctgagaacaagactcctgaaaataagcagtaggcaggccccaggccctttagccaactcctgtggactggcagacaaccccaggagcctatggtctgacagcatctacgctgccctcccaagagcaagcagtggcctcaggtcaggtccatggtcaaggtctagcagagtctgcttcctatttgctctccctcctactgcttaccctcctgaggtcaggagttcaagaccagcctggcaaacatggtgaaatcccatctctactaaaaacatacaaattagctgggcatggtggagcacacct

SEQ ID NO: 181970 - DNA, 443 bp, Homo sapiens
tcaaccgtgagtgcatctcactggatgtgtatatcatcacgaacacctgtgtacgaccttgctaccaaccacacctccctcccacttctgttgatgaatctataagacccagggagggcaacacaggaatgaggtggccgctgagaacaagactcctgaaaataagcagtaggcaggccccaggccctttagccaactcctgtggactggcagacaaccccaggagcctatggtctgacagcatctacgctgccctcccaagagcaagcagtggcctcaggtcaggtccatggtcaaggtctagcagagtctgcttcctatttgctctccctcctactgcttaccctcctgaggtcaggagttcaagaccagcctggcaaacatggtgaaatcccatctctactaaaaacatacaaattagctgggcatggtggagcacacct

SEQ ID NO: 181971 - DNA, 1531 bp, Homo sapiens
caagttttatcttgtatacatataatgtggaatgatgaagaggatctaaaattgtacaactgggatgcatcttcacatactaattgatgaaagcaactcacaggtatcagcatgtgtctatgctgggctaacaatggtaacctaattatagtacagaccatcaactcaaaggtattgtttgatttggccttttcaataataagagcactacgatcaatgatactcaattttcaaattgaactgtgtcttttcaatgccatgcaaaagccactgctgccccattaatttttaatctcactcttcatgtatcttcaggaacactacaaccctttggttttcaccagtaactctagccacaatctcctttaatgggtcttcctcattttctcaatatctaaatgctagagcatccaaagcatggtctcagacacatatgttcctactcccacatacactctatctctagatctcatcctttcccacagcgattaagtattatctctacctccaaattccccccagctcaagcttcctatttacactttaaaaaccaaaaccttaatctgtgggtttaatatggatctaaaactggcaaaatagcatttttataaaaaatcatgcactcagagaaaaccaaccctccctagcagttgttgaggtctaaatcataagtcctgtttccgtcctcttctcctctcacatgataccattcaatactttatcaagtagaactggcaaggatttcaaaatacaccccaaatcccatactttgtaatactttcatgtaagacaacctaatgtaacacctatgtacaacttatataatacaacttatttctacttttgctattagtatttatatcatccagtgatcttcatcctacctaacttgttttaatatacataaaatatagaaagttaagtactgcagaaataaaaattgtaaatctaaaaaaacccaaagcagttggaatgctaattatgagtaaaatacagccattgaacaaggcattcttatccaaggcattagggagaacactcgctaaatcttggaaatgactgaatgagacatgagatgacatttttaaaatctctaattcctgaagataaacaatgaatcgattttagaatcaaattatcttgtggaaaaaatcaagataacatgattgtcatatattccaaggtgacaaacgagatacaacaatgtaacagaatatttcaaaccatcaaataaacatgagactggtatttttaaccaactgtacttttgtcttggaattaactttactagataaatcaaataccagaagagtcagaggcctgaatttttttgtgcaaatcgtttatcagtcagcagtgaacctcaacaaatataaggagaaataaaaggctacaatcttctcctcggctttccttggtctatgtcactctgctcccactggaaggaagaggctctaatttgatcggtggaatgataacagtacttactcggctattctttagagggcaatcactgtgttccaaggtcaat

SEQ ID NO: 181972 - DNA, 803 bp, Homo sapiens
  misc_feature (138)..(138): n is a, c, g, or t
cccatccccctttgttaaccgccggcaaatgattttaatcccctccattaaggccaattggccaagtgagcctaattgcggccgaatgcataactttctcgagttaaaattcgactggcccaaggcggccaacatggnttttattttatttatttatttttttgagagggagttgcactctgtcgcccaggctggagtgcagtagcgcaatcttggctcactgcaacctccatctcccaggttcaagcgattctcctgccttggcttcccaagtagctgggattacaggctcatgccatcacacccagctaatttttgtaattttagtagagacggggtttcacaatgttggccaagctggtcttaaactcctgacttcaagtgatcctcccgcctcagcctcccaaagtgttgggattacaggcgtgagccaccacaccctgccaaaacaatgtcttatataataaaaatagtagttttttttccttttttgagacagggtttcactctgtcgcacaggctggagtatggtggtgtgagcacggctcactgcagcctcaacatgctgggctcaagcctgcatcagcctccccagtagctgggaccaaaggcgtgcaacaccatgcttggctagtgcattattatacattcagtacataaactttttgatccccatccataagtttctagaaattgcccacaagtatcaaaaaatgttcaatcttactactcatcaggaaaatgtaaactaaaaccacaatgagttatcacctaacgcctgttagggtggttattatcaaaga

SEQ ID NO: 181973 - DNA, 1016 bp, Homo sapiens
tttatgggggaattggtagagactcaaaatccacaccactattactttccaaaattcatgaatgataaattttccccttctaattcaaaccacaacaaactcagagcaaaccaatttcaacagttcctccaatcatgaaagatttcttctgtttctttctccttttcttccttgcttccttccttccctccttctccaataaggaaaaatctttcacataagaagcactagaggccaggcgtggtgactcacacctgtaatcccactttgggaggccgagacaggcagatcacttgagcgcaggagtttgagaccagcctgggcaacatggtgaaaccttgtctctacagaaaatacaaaaattagctaagcgcagtggcgcatgcctgtagttccagctactcaagaggctggggtaggaggactgattgagccctagaggtgaaagctgcagttcaagcgattctcctgccttggcttcccaagtagctgggattacaggctcatgccatcacacccagctaatttttgtaattttagtagagacggggtttcacaatgttggccaagctggtcttaaactcctgacttcaagtgatcctcccgcctcagcctcccaaagtgttgggattacaggcgtgagccaccacaccctgccaaaacaatgtcttatataataaaaatagtagttttttttccttttttgagacagggtttcactctgtcgcacaggctggagtatggtggtgtgagcacggctcactgcagcctcaacatgctgggctcaagcctgcatcagcctccccagtagctgggaccaaaggcgtgcaacaccatgcttggctagtgcattattatacattcagtacataaactttttgatccccatccataagtttctagaaattgcccacaagtatcaaaaaatgttcaatcttactactcatcaggaaaatgtaaactaaaaccacaatgagttatcacctaacgcctgttagggtggttattatcaaaga

SEQ ID NO: 181974 - DNA, 272 bp, Homo sapiens
ttgttgcctgtcttggatgtctcatagaagtggaatcacaacacctggccttctgtgactggctgtcctgttaaatctagattttgtccttgcacactcaagtttcccatgctttctttttggttttataaattcattccttttaagaacttactgtacatctgttataaaccaccctttgtgttggaattctagaaatgaaaccctcagttagctaggattcctccatgaaagaattccgattaaggtaagctgacaaccacatggccact

SEQ ID NO: 181975 - DNA, 363 bp, Homo sapiens
tttattactgtatatcccagtggctagcagagtgcctggcatgtaagcagtattaaatactttgctgaatggaaattaaacaacaacaacaacaaaaagcctgctaagatttgttttaggaaaatccctgacaaataagaatgggcaatgtggagggtgaactcatggagacagcctttaaaacaatatttccaatagccgagccatagaagggagctaacaaattggcagtgggattaggagaaatagggtagttcgggatgtggaagtaagagaaagaaagggctgtcaagaatgcagcagatttttagctttggcagctgaggggatggtgacaccattccttgagaggatcagctaaga

SEQ ID NO: 181976 - DNA, 728 bp, Homo sapiens
ccgggaggatgcgcccccggcgtgggaagccgaggaaccggcgcgcggcgcgcggcgcgtggcgcgtggcgagtcggggagagactggtcttgctcgctcaggagaccctcatcgcccacagagcgcccgcggcgacccggtcacggcccttccatttcctgaccctgcttaatgacagcgaggtgaaaacatctaccaaacgaagggtaaaaggctggagtccgccaaaagccaatttaaggcttaacattgcagaccgtttgtctttacaaaagcttcaaagacggggctgcagctcccggttatccccactttgtcaagccatgaatctgaatgttcgtggggttgtgtgcatcgaatcagcaagagcaaggcaagaattcaagaaatagttcttttttatccccccttccaagtcacaggttcagaggatcatcatctttctcccacattagcaaaacatatttgcatttttcagtgaagttctttaccgcacgagtgccctaaaatagcaaacagttccctgttcaaaagcaatagtaaagaaattcgccgaagagtttaattgcctggggacagctgcagtagtcgcatcatcgtctcttattaaactgttgcagaaatattcggtctagtccatgtattttcaactaaatagcactgcttacgcagttggtgatatggtgatatcacggaagtagcaataaaccttggttatctttttttt

SEQ ID NO: 181977 - DNA, 542 bp, Homo sapiens
  misc_feature (520)..(520): n is a, c, g, or t
gctggtggacaggggagtgcatggatcagatacgccctggtcctgtgggaaagacagccctgctctctccaggtctggcagtcaacaaaggttagagcctcttagaggaatatggagagccttgggggataggtgcctatggttgtgttttgttgcagctgttcccatgcaaaaccccatgggctctgtgtagcctcgagctctgtctctgccagctctccaagcagttttccctgccaactcaaacgtccatggtggctgtgggatctcttgcagctagaatcccagatgtccacagtgacagtggcctgctctgcagttacttctttcaccccttccttaggagccattcagagcccatgcagggttctcagtttcctccctcttcagcctcagtgactgcatcatctctccactgactctcagtgctttctcttaaaaggtctgttcaaagtatgctggtttactcaatattttggtttctcttggtaggaaagagaagccaaaatattgagtaaancagcatcaccctacccagggat

SEQ ID NO: 181978 - DNA, 397 bp, Homo sapiens
tgtggtgaagctcagtcttgctaaaattaatatttctggtgcggtcacagctgtttccacttgttataagttgctgtatctaatgcacacacacgtatgtgcgctgggggctcagtcctaaagtcaaatatgcacacgcagagaagacagctgttgctttgttttagagaatacttttttcttcccgcagctcaagctgacacttttggaattgctagtggagatgctgttgttagatactggctagaacttgtcaaggtcgaccatgaggctctcttcatgtgctgacctgtgcctatctttccaacttcatctctgcaacattctcccttcagtgttcactgtagcaaacaccttgcagttcccagaaagtgcgctgtgtcctgctttcctctta

SEQ ID NO: 181979 - DNA, 588 bp, Homo sapiens
aagtaaattaatgtctgcaatttacactttaaaatacataaaaaataagatagcttgatggatgaacagagattgttagatggacagaaatgtgataaaacaaatttagcaaaatgctaactatagaatgtaggtcttgggtgtatgggtgttcaccgtgatattcaacttttgtgtatatttgagtattttcaaaataatacgttgatataaatagagagggaagaagaggatgagactagtgttaacaaattggctatatccttttctcttaaaatgtaaagtcaacagatattatctagtcaataaatcaggagactactgtgcttcattacaagccgaggttgatttttaaaaccctgtacagattgaaaccacagtagtagctattgggtactatgtttattacctgggtgacaaaacaatctgtacaccaaacccccatgacataaaaatcaaaacacacagcaccacacacacaccacggtttttttccccctcggacaccaccgtccgccacggcttcccagctccaacacgcgggtccaattctccagggccctttttcggaccaacttacccctacat

SEQ ID NO: 181980 - DNA, 241 bp, Homo sapiens
gggcgaaagggaaagacggggatggtccatttcagcagaagcaaaggtttccagtccattaattttaacgtaatgcaaatcggtttatggaagtgctgacatgccgttatttaaaaagcatgagtagcatgataattaaatctccatctatattttattctagcacatttatagtgtatccttgcccagctggggagatagatttccagccttataataattatataaactgcaaattact

SEQ ID NO: 181981 - DNA, 181 bp, Homo sapiens
gtacatggtaggagcagcagcgagacaagagcttaagccctgcttaaaaggccaagaaggctggcagctagcgttctggctcttccattttactgtctgggggaatgtggggaaattacttcacgtttctgaaagtaaaagttgtagtgtaaagctttaagtacaggatgttcatgatata

SEQ ID NO: 181982 - DNA, 240 bp, Homo sapiens
cgtgagtgggccccatagagtgtagctgctgctgttgcggctgtttccctctctgtgttctcctaatcacactgggtggttgtcattttttatttcactgggaaaaaaaaatttaagtcagctgtactttgggaaaagagatgttaaaaaatgttttccaatacattaaaaatattagcactgttgattcttttagaatcatgctgtctaactcttactttgaaactatactctgttaca

SEQ ID NO: 181983 - DNA, 325 bp, Homo sapiens
gctaagttagagtttattagtgttaatgtttgagaaatagataaatgggttggaagatataatttgtggtaaaatgaaataagtatgtaatatataccacaaccagtaagtaactggccaaagacagcaaagaaaaataacaattatatacattagtgtattataataaaattgtcagttaactacattggaaaaaaagtctgtaagcctcaattaaagaagatcagtgacagaacttcataatcggttgccaaaaaagcaatacttaaaatgataagatataaagacactaaaaggttaaggtttttcatgcacatgtaagtaa

SEQ ID NO: 181984 - DNA, 333 bp, Homo sapiens
atcactaagtcttttcccatcaaacattgctgtccatttttgttgctttctatcatgttatgcatataggaactgctcaatagtggtattatgcctgtaggaactgctcaacaagtgtaagtgtcagattaagggtaatgacagtggctgtgctgcagacacatgcatttaaagataaaggtggttgaagaattgcatgtggtttctgcaaagagcaaagcgataattattgtgtgtgttttttcctatcttgcagatctttgggcagactgacaatattctgttgatgccaagaaactattttagggggaatctctttcagggaaatcttag

SEQ ID NO: 181985 - DNA, 447 bp, Homo sapiens
taactacaatgtaaaactcgaagcactcttcctaactcagatttcatttcaaccccaggggatttttctaatgagaatttttatttctaactagctgcttattcaggagaatcattatccatttataaattaatttcttcttgtacacactgcaagctacttaagagtttccatgtgaaagaaagactaaatttcgatcagctcctgaaattgcatttatttgtccttgaaactttcaatttgggtcttgtattttaaacttttgtgcccatggtattttaaaatgtatgacagctttctcgcaattggctgtcagttgacccctcactgatcctgttacagttgctctgaaggggtttttaacctgtctttgagctgctgccagaatcctgcaaagaaaattcacataaatcccactgcctatattttatcacagcatcccagatc

SEQ ID NO: 181986 - DNA, 519 bp, Homo sapiens
tggcttctagtgcaggagcttagagaaagaaattgctttcggcttttaaccataaagtaccaggaaaggatcccttgaaagggaccttggggactacaccttcaagttttgttttgtgtttttgagacagtcttgctcttgtcacccaggctggagtgcaatggcatgatctcggctcactgcaacctccacctcccaggttcaagcaattctcgtgcctcagcctcctgagtagctgggactacaggggcccaccaccacgcccagctaatttttgtatttttagtagagatggggcttcaccatgttggccaggctggtctccaactcctgatttcaggtgatctgcccacctcaacctcccaaagtgctgggattacacgcgtgagccaccacaccctgccacatgcatttgttttctgctactctgtagtgaattagtgtaactcagctactgaaaacacctgttcattagcttacggttctgtagggcagaattctgagcatggcatgactggg

SEQ ID NO: 181987 - DNA, 275 bp, Homo sapiens
gtggaataagatagggctggagaggtgtatcgggccagaccatcgacatcttgtcagctgtgctaaggagtttgaacatttcttctacaggcaatgaggcaacaactagaagagtttgatggagaagtgatgaggtcatattttgtttcataatggcaacatgagcaatagtttaggggatgaattagaagggtaagagactggagatagggagactaatcacagaagagatgaaaaggacctgaagtaatgtagtgtggatagggaagagtgag

SEQ ID NO: 181988 - DNA, 328 bp, Homo sapiens
tgaggctaaagatgagcaaagatgagagtgaaagagtgatgatggaggtagggagagggattcctgaaggaccagtgaagtcccccaaggaaactgacattcctgtggctggagggtagggatttggggaggctggtgcaggataaaactgggaaggtgagcagaggccagctcttaccaggccctgtggccaaattagtttggactttgtcttaaaggcaatgggcagtcaccagcaggttttaatcaagaactattttgatccaaatttgccttttaggagaattcctctggcttcagtgaacaggccgaagtgagcaagcctaat

SEQ ID NO: 181989 - DNA, 267 bp, Homo sapiens
ataaatcttcagctttgatttttctcgccgttcagctctgcttggactcagggtgatggtcccaaccgtgagaagccagctagagcagccaccttggatcccagcagaacgggccgctgtgtgtctttagttgccaaagcgactcggcaggaaaacaggccttttggtggcgacagcagtgtgtccttgggcgcctgctgtcagcctggaacaccattctggggccatctgctgcaggcttgttggaaacagatcctcttggcagct

SEQ ID NO: 181990 - DNA, 339 bp, Homo sapiens
tcccagtagtgatgaggaacatgtcctaggaaaggcagagtggtagaatcagaaagccaagtgtcagcatattctgcccatccctatatccccaaactatgaataatgagtaaaggcccccagtgaggatgcaatgagacactatctaacacctgagtatcaactatgtgctagacatttagttagcaacagatctgaagaaatgacaaatctacatgacccagaaaaatcaaactgagtagagaaggagaaaaaaatgcagaaaacaatgaaaaagtattttacagcagaactacaggcgtccatcatgtgggctatccagaaccagcaggacagcag

SEQ ID NO: 181991 - DNA, 282 bp, Homo sapiens
cactgctaggaaaaaaaattgctttgcttggaaatcaattcattgtaagctttaatctgcctagttcggtttctcagaatgaatatttcaaatattaaatattttcttgagtagaatgtatagtacatattttatactaatatctatgtgtgtgttagacaattaagaagactggagtgttttccaaaaacttgaaaagttttcggtgactcgtaatacagaagtgacatttttatttgagaacaatttaccagattatgtcaagttcattattggtatgat

SEQ ID NO: 181992 - DNA, 423 bp, Homo sapiens
taacaacttaggttccagattgagtaatcaatcatgtatccctttagcatgttccctaagtgtttaaatcagaggtgagtgagattaagaggatgaaggaggtaaactagaacgagtaactttttagtccttgcattgattagagttgttatgagtgcactgtgtgatttaagttactaatctatcaaagtgttccttcataacaaaaaaaaaaagaaaaaaaaaatttactaacctagtgaaggaaatggaaaggccacaattccatttacaacatagattttcttttaagaagtgcaacattctaatttcagaaaaaaacaaaaaactaaatagtttatgctgtacagcataaactatggaagtccagaaggtttccatagttaatgctgtaatagtttatgctgtaatagtttatgctgt

SEQ ID NO: 181993 - DNA, 471 bp, Homo sapiens
aaatgtctattacgagcctttgcctattttttaattgggctgttttttgcaaatatttactcctgttttgtgggttatctttttactttctttacggtgtgctttaaagcacaaacattttgaattctgatgaggtccaatttatatattttttctttggctccttctgtttttggtgttacatctcagaaaccattgcctaaactcaaggtaacaaagagttacttctagctttgctttaaagaactttatagctttagctttcacatttaagcctatggtctgttttaagttaatttttgcatatgatatgagtcaggggtccaagttcattttttttaatgttgtcccagcaccatttgataaaaacactactctatccccaatgaatggtttgataaaagtatcaaaccattacttttgtcaaaatgaacgtaaatgtaagcgttggcattttttaaatttcacttt

SEQ ID NO: 181994 - DNA, 163 bp, Homo sapiens
taaagctcccccactcctctctctgcagcatttgacgttgctgaacactccctgactctgcaaagtcctattctagtttgctgaaaatgcaagatccgaattctccttctccctgaccactgtttcttagcctttgccagttcttctgtctcttacagatctt

SEQ ID NO: 181995 - DNA, 106 bp, Homo sapiens
gttttcccctcctctccgttgttttcacagcagccatcacagagccttctctacctcccagtgctgagcccacctggaggcacccgagagcctcctcccaccaacg

SEQ ID NO: 181996 - DNA, 180 bp, Homo sapiens
tcacttgtcttgtacttcttttcccatttaatctttctccaccatttccacctgaacgtaaccttgaagatttatttttagttgtcatttcttaatattatattcacctctccaaacacaaaaatactttctgttatctttagcttaagaagaataatagcagtcactgaacctgaacac

SEQ ID NO: 181997 - DNA, 576 bp, Homo sapiens
ttttgggttttctttaaatgtatgcatccaatgtctttttcatttcattaaggtcaaataaatatttgtcctgggtttccaataaggtatttgagattttcctgtgccataatgactgtatttggtacaggcaaggcaatatactaaggtctctctacagatcttgaaaatcagatcagccttggaggatgaaattagtaacaactaatacaccctggaggacaccagcccttgggaaggcattcatgggaagagactagaaaagcagttgaggttgggagtttctcatttcaggcaaagtgacaagggagtggtatcagaaaatacgatcttaactaagaaagctagaacctatatcactctagaagactgttcacaaacggtagcagggcccatgtgcagcttggaaagaggaagcttaatgtgcaaaaatttaatatccctgcaactctctggaaattggcaagatggtccctcagaagagcagatctgtgtggtgagtgagatatcacagctccatgaggtgaacaccaaaccttccaatcatcagttgtctcccatgtacttatggagaat

SEQ ID NO: 181998 - DNA, 286 bp, Homo sapiens
ttgatttcttcaaggtagatttttagatggcaaagaattgtactgtatgcatactgtatatttttttttaggtctcactatgttgtccaggctagtcttaaacttggggactcaagcagacctctgtcttggcctcccaggaagccaggattacaggcgtgagccaccgtgcccagcccacaaatatatctttaaaacatgttagtgcaagtgcatattgcatttttaaaaagagaacaagatcacaataccatgtagatcaattaagaatatatagtacaccaca

SEQ ID NO: 181999 - DNA, 404 bp, Homo sapiens
gccacttgcacacacacaggcacagagctacttgcttgtagccttgactgccagcagccctgaacaccgtagctggtggtgccaggccttgtgtgtgtttaggacttgccagttcagtcctgggagctgaactctggacatcctgctgtgtgtctctttatcccatcgctggtgtaatttatgccactacttcctgtttgcatttgctcagtctctcctttggtttgcttctctctgctgaagccggtccccatagctgtgcacatggctagctatggggactaggcatctagatattctagacatctgcagttgtttcttagtgggaatggttgctttatgtctctctacagaattttagttgaacttgagtgtatgatttaatttacttgcttgttccgctg

SEQ ID NO: 182000 - DNA, 237 bp, Homo sapiens
tggctaattggaatatgatttcttttaattacaacattccatttgctagtattttattgagaaattttgtatctgaaatcatgagtattccatctggccaaatatgtggctggaatttcatcaaaagtggcagaggggttcccagaagggactgtttcaaataatagtttatgctgtaatagtttatgctgtactagtttatgctgtactagtttatgctgtaatagtttatgctgt

SEQ ID NO: 182001 - DNA, 272 bp, Homo sapiens
tgttaatttacgttttaaaaaaaatcaattccagaatttaattcccaattactttagtaacttgaattaatttagtaacttcagtaatctggatttgtactgtattgttccccttatatcattgcagtacacacataaaagcagataacatggtgaaatactgcactgaaaataatcctttaactctggatatataataaaattttgttaatgtgcaatacatttttttttcacatgaaacatccatcagaagtttttaaatgttcatgagg

SEQ ID NO: 182002 - DNA, 559 bp, Homo sapiens
gctggacacagatgcaaacccacacaacgctggcaggtccaagcactcagtggccactcaaggggcagggttgtctctctgtaacaaaatctccttgaaaaacaaaggtctacactgcttcctggccaggggctttcagtgtccgggatttgggggtgattctagactccttttgaaaacagaatacaagtttgtggaaattgtcacacccgtggctctgggcagctagagtgagaattcctgaatttgtccaggaattaatcctaagcacctgccgggttagaacagagttgcgtcctctctctccattcacaagtgcttcatccccgagtctggtgacaggacaggggtgcagtggacaggggggtgcccaggtgtgggggcacaggcaaggcttgaaatgcccctagccactggcccaggcccctcgaagcccagccaccttctggttctggtactggttctctcctgtcttagacttggcttccccttgtccccatcatctcttctccctcctcctctcgctctcggcctctctctgtctctgcgtctgtctcta

SEQ ID NO: 182003 - DNA, 451 bp, Homo sapiens
gttgatctgtgaccttacccccaaccctgtgctctctgaaacatgtgctgtgtccactcagggttaaatggattaagggcggtgcaagatgtgctttgttaaacagatgcttgaaggcagcatgctcgttaagagtcatcaccactccctaatctcaagtacccagggacacaaacactgcggaaggccgcagggtcctctgcctaggaaaaccagagacctttgtttacttgtttatctgctgaccttccctccactattgtcctatgaccctgccaaatccccctctgcgagaaacacccaagaatgaacaattaaaaaaaaaaaaagaaaaaagaaaaaaaaaaccacttgttgaaatattgagttagatatggaagggggcagtatggcataatgacttaaggtccagtttctgtatacaagtcttagctccatcacttcttagcta

SEQ ID NO: 182004 - DNA, 152 bp, Homo sapiens
tgatagtcatgttttctggtagattatccagaattttttaaaaattattcttagataagttacataagaacaacaactctttatgaaaatctagcatgcgttttaggatcctgttggccacatgacatacacagttttcttgcttctcaggg

SEQ ID NO: 182005 - DNA, 289 bp, Homo sapiens
ggggtggggttatctactttatttataggaaacttcatgaaatattattcaatacagtttttttcatctgaagtgacaggaatagaacaatataattttaacatgtttattattctattatagtaccttaatttacttaatttctcccttactgttcattcattcaacagtactttagtgcctaccatgtgccaggcactgttttatgaagtaggggtaccacagtggaaagacaaagtctgatcttaatagaacttatattcaagtgtgtgagagctttgggatatta

SEQ ID NO: 182006 - DNA, 296 bp, Homo sapiens
caagacgaagagttctgtggatgaatggtgttaacagttgccaacaatgtgaatgtacttaatgccactaactatacacttaaatatggttaaaatgttaacttgagttatgtgtatttcaccacaatttaaaataacaattttaaaaacaacattaacataatttcatgttgtaattttcccttgggggatgggcatgttttttccacttctctgtatactccctcttttaaaaaataaacctggccaggtctggtggctcactcctgtaatcccagcactttgggaggccaagg

SEQ ID NO: 182007 - DNA, 563 bp, Homo sapiens
atgtctgaggcagctaggggatgctgagggggctggctcagctctggcctctcccctcctggcctgccctctgtcccacagtgaagatccatcctgcttctctttcacttcctccctcataacgattgtctggcatctatcttcaggtacaggaagggaggttgggtgcaggggacaagacccttcgggtcccttctatgacttgagaagatgagatttgggcagcagcctgcacttgtctcaatttgtccattaaggaaaacctgtcggcgaaagcccttgaaaactcagagatgagtgagtaaatatcctctgaatgtgaagttagaggcatttaccgtatttaagtgtgcttataaaggagcactgtctgaggtctgtgtcaggagtggtgggttggagcctctgtctctgggcacctctgccgtgcacatttgtgcagtgtgcacagatgtaggtgtgagctgttggctcccttcctgaaggacctctgtgggggtcctcactgagtcctcagaatcagtgggctcaggacttgccccatggggcagggggcgggtaag

SEQ ID NO: 182008 - DNA, 367 bp, Homo sapiens
tgattaagcatgagaggatacttcctgctctcagataaattatttattatattctgtattatccttgtaatttttctggatatgaataaataacaatgtatctcagaaaaacacattttgaaaagccttataaagttaaaactttaaatgcttttcatcaaaatgttatgaccaataaaaatgccattcatgtatctcatcacactttctatacattttgtagtgatatgtatttatacatactgcagttggaaatagggaatgcttttttggtttcccacggtaggctgcaggttttaaaagcagaagtcctgaacctctgaaggcaacataagaaaagtattcatttgaaacctgtagtgttaaa

SEQ ID NO: 182009 - DNA, 308 bp, Homo sapiens
cctttccatccacataataggcttactctgctgtaaacctaccatcttaaatcatttcttttaacatttcacagtgtaggtctgccatatcatagcagccttattgctcatattttgagaatggtcagaaccttcaaattacctattgccacaaactccaaatcacaatcactgggcttttccctttacagcaatgtatctcagagtgtattccatggaaccatggcatttctgggcagcttctagagaggttcacaggcaggacggccattttggggagagagaagcatagggggaagggagaaagg

SEQ ID NO: 182010 - DNA, 525 bp, Homo sapiens
actctgacttggaaagctcaatgaaccaactgggctatttcaacatcttctatattttgtttataactctgcctcattccagggtggatttgaggtggtttggtttgattcgtgaacatttcccatgccaattagaagacattatgttagggggggtccccaattcagcctcatctccctcatcaactaggaaatgttatagtaatacccaaatatactttcatctatgttttgtaatagaccccactcatagaaatggtagggataatatcttttcctttttagcattacaggagaaattgtgactttgaaatgaaccaagaaggttacagttgtcttcaaaggaaaaagagtcagtctagcatgccattccagatgtgactctatggtgtatcctgtgcctttcttgactttaagctattttacaactctgtaagttgtgcataactgatagcaatgcaaataatagtaacatttgtctataaacatgcaaataaattttatcctgtgaaagtaaagttgacc

SEQ ID NO: 182011 - DNA, 286 bp, Homo sapiens
aggatggatgcagttgttaaaggaacagcagatacatatgtatagacatgtaagatagctttcatacttttttttttgagatggaatttcgttcttgtcacccaggctgaggcaggaggatagcttaaacccaggagacgaaggttgcagtgagccaagattacaccattgcactccagcctgagcaacaaaagcgaaactccatctcaaaaaaacaaaaactaaaactaaacaaaacaaaaaaaccatgtgtaaaactgttaatcacaacactgatttcaatagc

SEQ ID NO: 182012 - DNA, 499 bp, Homo sapiens
tgtgagttatttgaagccaaggtcccagctgcagcctttggttggggggaaccacagacagatctagtctggaattttggctctgctgggtgcctctgggccattgtcttcctctctgagctttggtttcctcatctgtaaaatccctacttaaaagaaggtcaaggtgatgtagtggagtcatgtctctggcgcatagtaggtgcccagaaggtgtctgtttctatgttcgcgtcacccgaaccctgtaaactcaagagggtaatgacaacaattgcataatagctgttgctgataagaaacaacctgaaaactcattggtttaaaccaataaaggtttatgaatcctgataagtctgtgggacagttcgtggattcttctggatgtggatggaagggatcagtcatggtacatgagcagcctggggtcaggtaggcagccttgctggtgttggctgagttctctcacatgtttgggttttggctggcttcagaccga

SEQ ID NO: 182013 - DNA, 281 bp, Homo sapiens
caggcactatcaaaagatgaagaccacccctcccccagatcacttcacatgcacaggtggcttgagtctaaatcccaggtaaacacaagttatggcagcaggattcatgcccacacttcttcaaatccctcagagtgttggggacactcagggctcaatacaggccttgaatcactcacctatttaccctaaaacaggtaacttctgggagaggcaacaactcagtgcttcccttcaggagaaacattctgcctggaattttcatggttaggtctacctgg

SEQ ID NO: 182014 - DNA, 426 bp, Homo sapiens
gtaacaaacctgtgcatcctgcacatgtactcctgaacttaaaagttaaaggaaaaaaaagagaaagagatggcataaatgaaaaaaccatgcactttggagtcatgcaagttgcatctgtcccctatctttgccttttactccctggtaacttttctttgaccattttgaacttcaactttcctgtagatagaatgaggaatcataaaatatggcatgatcatttaataattaaatgaggatcatttatatataatacttgggatggcaccaaacacaaattatggacttagtaaagaatatacattatcattactattctgtttacaaattgtcattgtgaaatttccagaaacatttaatgactaagcttaatgatgtaagtcatgaaagcataaaaaataaattatttggatttaaataaca

SEQ ID NO: 182015 - DNA, 387 bp, Homo sapiens
taatgtaagtatttcaacatatgtatgtcaaaatgaaaagtaacgcaaggtatgtcaaaatgatgagatcaaagaaaaggatataaataatgtaagtgtttcagatgttactttttcataaatacctctagaagaatctgtcaacgagtatttgataaataccacttctgtgctagttagttgtacataaaaaaattaaaattcctatttttcagtgcattcctcaagaaatgaaaggcaaagcctttaaaattctctaggcaaaggctccatttgtcttctaaaagctggttcaagaggtattcctctagcaaaagacatcaagcattattgtacctggaggctaaacaacccagtagtctataagatgttttaagtaagactaaa

SEQ ID NO: 182016 - DNA, 553 bp, Homo sapiens
ctattatgataggtaggaacaagtgtaacctccctagctaacttcttacccatgccaaagtagaataccaagattaaatttgatctccagggaaattacagagattagtgccaccattaaagatatgaaagatacaagtcttttccttttaactcctcttggcttgtgcaatagccaaattagttttggagaatgtggattattaaaaatttaatcaaatgttgatgctagtcatagttgtggttccacatatgggggatctttactagagcaaatcagaacagctcttggcacctagaaggtagctattgacttgaaaactagaaagtagctttcttttcaattcccgtcagcaaaaataatcagaagcagtttgctttcacatgattgcaacagcactgtcattgtactacctcagggatatttaaagacttctgttctatgatagagtatcattccagagggacctttgtttccttgatatccagtagaatatcatggtagtcttttatcttgataacattatgcaaattgcaccttgtgagcaggaagt

SEQ ID NO: 182017 - DNA, 251 bp, Homo sapiens
taaattgtaattattattttttatagagacagcgtctccctatgtttcccaggctggtctcaaactgctgggctcaaggaatcctacctcctcagcctcccagagggctgggattacaggcatgagccacccaccatacctggcccaccaattgttaatattttgccacatttgtgttctctctttcatatacaggcacagacacatatatacatatttttttttctgaactatttgaaagttagttgcaa

SEQ ID NO: 182018 - DNA, 142 bp, Homo sapiens
agggatgtccatgtgactggaacctgcttagttgaatggagatagtcaggaagttcttttaaagggtcagcacatggagggggcttataggccatggagaaggctttggattttattcaaagtgtaatgagaaggtgttgga

SEQ ID NO: 182019 - DNA, 214 bp, Homo sapiens
tgcaagttacatgttgttcatttcttggcattctagaaagtctttttccatttcaagattccatgatcccttaaagataattttttcttaaagaaaaagtaggatgcataattatttctaagactagaaatagggccgggcgcggtggctcatgcctgtaatcccagcactttgggaggccgaggcaggcggatcacgaggtcaggagatcgag

SEQ ID NO: 182020 - DNA, 436 bp, Homo sapiens
ccagcacctgttgtttcctgactttctaatgattgccggaatggctgggttttatggtatgtatggtatatgtttaactttgtaagaaactgccagactgttctctaaagtgattgtaccattttacatcccccagcagtgtatgagagtttcagttgcttcacatccttactaacgcttggtatgattagtctttttaaatttagccattccaatggctatgtaatagtatcttattgtgatttcaatttgcattcccctaatgattgctgatgttgaatttttttcatgtgtttattgaccatttgtatatattttttgggacatgttcaaatcttttgtacagtttttagttgaattggatacctttttattaaattgcaataattctgtatataacctatacaaatacatttaataaatacatatatttaac

SEQ ID NO: 182021 - DNA, 308 bp, Homo sapiens
cgcccacctcagcctcccaaagtgccaggattacaggagtgagccactgcacctggccagaagccatattctataataaatagtggttggattaataggacatgggagagactgcagtagagtggatgagtcccctctaaaggagcactcacaaatgccctggtagctatggctgtgtggggtggggtattacaggaattccaaagacctaaggagctgtgtacctcctgtagccaaggtcaatgtcagaacaactaaatcaatgattttatgaattcctgtagcctccctggactataaatttcaaa

SEQ ID NO: 182022 - DNA, 262 bp, Homo sapiens
ccttttcaattgagcccagaaagagcttcagaatcattttcagcataatactctagatagccatagccagccagccatgattagcacgtgagatgaaacttctttaggcccaactttgttgtttaattatttcatgtgtgtgtcttaattgctttgccatgtgggaccttcctaaacagcaaaaacaatgtcttcgaattctttcacgtaactgttagctgcaagtatagttctttgccctaataagtgctcaataattgtt

SEQ ID NO: 182023 - DNA, 197 bp, Homo sapiens
ggaccaacctcccgtctttagagcaatctaagcatttgttctctacaattagattaaatgggattaaacacaggcactgcttcacatatgaaattgctgtgcaaatacacacggctgaaaaatacgagaggtcaatggacagcattagcatgtccacttcatgaaaaaatgacacacttctccgtgttggtttagtg

SEQ ID NO: 182024 - DNA, 488 bp, Homo sapiens
cacatgcaagctggggatttctaagaccagatttggtcattctctaggagaactcacaggattctgtatatagtcatactcatggctatgatttattttatagtgaaagaatacaaagcaaaaccagcaaagagaaaagtgcatggggtgaaggccataggaaaccagatgttaacttccaagggtcttctcctagagtagatgtgcttaaccccttccaggaccaaattgtgacaacatatatgaaatgttgtctaccagggaagctagttagagcctcagtgcccagggttttaatggggggggctggttatatctaggagtccactgcctaacacataccaaaattccaaactcccagaaggaaattaggtgttcagctgtggttcagccttaaaccatatctatcacaaataagtttaggcagagtgagtgagccactcttacaagttaaggcagtgggaccccttccaaaacccaagttcgca

SEQ ID NO: 182025 - DNA, 373 bp, Homo sapiens
atacaaaggctccttataaaggagaagtaactatctgggatggaaaagaaaatgatgccgattcaaagctgactttagctttttaacttctgaaatgcctagagggtggagactggactcctaatggattgtcttccctagaactgctgtgagctctgggaagcagtcactgtcacccccacctcaaggagacttcctttctcttcccttcctttggatggcactgccactctcccaacagcaggatggaatccttagggagtcatcttccaatttttccttctgattgcctcttctgttggttctttccttggaatcactctcacgtgaggtttgtcctttcagctcctttccttgagaaaaaaagtacatc

SEQ ID NO: 182026 - DNA, 216 bp, Homo sapiens
tataacaaggggctaagaaaaaaataggaatatgccatctgtgtgccagctggaaaaacaggttccagttgcagggactttatagattgggaaagtctacaactagggaagctggaaaagaagatagctgcagtagtttaagtcaggtatggatattggtgagggtttatttgcaaaaaactaaatccattcttagtaaaggcagaagaggattta

SEQ ID NO: 182027 - DNA, 263 bp, Homo sapiens
aaacccaccagacatcattctcccaagacagatgcaatttactgacagggataattctgaccataagtaatgttgttaagtgatacatgtcttactaggttgccagaggaacagagctagaaatttaactgaggttaagctgtcaaggggaaggaataaagttttgtttacctttctcccacaataatcaatctaaaagaaatacagaaaaaaagaaaataaatacagaagagtcaaatagaagcattaacaagatgcctgat

SEQ ID NO: 182028 - DNA, 439 bp, Homo sapiens
ggagccattgtggctccggccggttgcgcgggccctcggaccctcagagaggcgagggttcgagggcacgagttcgaggccaacctggtccacatgggttgaaaaaaaaaaaaaaaaaaacaaaaaaaaaatttggggcggcctttgggccttaggaaagagcttttcaagaccccttcggtgtggggggcgcgcgcggcgcacgattggggttagagttaacacgtgtggcccagaagcgggttgccaaaggaaaaactcgtggcaaagaaacaaggctgcgggggattccctcacccaaacttaaaaaggcgcgcggggggaaaccgagagtgttcgtgaaacaaactccagaggggggtccggagaggacacaccgggagctctacccacgagggagcaccaggggaagcggaaattaaattaggcccgggctgga

SEQ ID NO: 182029 - DNA, 247 bp, Homo sapiens
tatatttgatcaaatctgtcacattctgtatcaaaaaaccttatccattgatttaaaaatattctgcagtattacacatcaactttcaggatacacagtggcttttcccaactcccaatgttcattttttaaattaaaatgtagcaactttacagtatgtaaagtttttaatttaaaaacttacatttttaaaattaaaatgtagcagctttacagccatgaatgattcactggagaaaaaacactg

SEQ ID NO: 182030 - DNA, 690 bp, Homo sapiens
catcatccagtcacatgggccaggatgtctcaatatattgatatatcccaacactgcatctacagcctgaccgtctccccttgtatctgtcaagtatgcttaggctatgctgcagtaataaataaaccctaaaatcccagtgcctaactctccatgtcatagtctgatatatagaactacatcgtccggacatggtctctcctggtttgccgccgtgtctgggaaaaagactggaggattgtatgggatgttttaaaggcttagaactagaggtggtttcgacccacatcccattatccagaacctattgccatggctcaaatctaactgcaaggtggtgtataaaatgtaatcagatacagttcctgaaccccagactgacacctccactgagatgctaaatacatatatcacttttgcacttagatgtcaatagatatatcaaacgtaacctgtccaaaactgaactcctgatcttcccctcaaaacctgctccaccagtagccttccccattttaagtggtagcaactccatccttgctcatctggccaaaactttggaatctccctgactcctctctctctcatacaccctacatcaaatccattaacaaagcctattgggtctatctatttgtcaatgcctgctattacagacccaagtcatcaccactgacccggattattaca

SEQ ID NO: 182031 - DNA, 197 bp, Homo sapiens
actagaggatctgagaatgctttgtcggggaagaagatactcaaataagaagggaggaagaggtcaggagcgatgcctcatgtctgtaatcccatcaatttaggaggccaacgtgggaagactacttgaggccagaagtttgagaccagcctgggcaatatcacaaggccccatctctacaaaaactcaaaaattag

SEQ ID NO: 182032 - DNA, 235 bp, Homo sapiens
aatttttaaattttctgtagagatggtgtcttgctctaattggtactacaccagaaatggactggccttttctatctgcagtacctccgccagcaccatcattcaagggcttgtaaaatgcatctgacttgtggggaagggatctcctatgtcatctcttcagaccaaggggtcatttagggcaaagaagatgcagcatggccaggtgcggtggcacatgcctataatcccaacg

SEQ ID NO: 182033 - DNA, 680 bp, Homo sapiens
cctcaggtgatctgcctacctcagcctccgaaagtgctgggattacaggcatgagccaccgtgcctggcctagcctcttgatttttctatgccagctgtcaacctgggtgatcctcccaccacagtaatttcttatcctcagtaattctttatccctagtagttatggaagtttggttggttgattggttggttttatattatttctctttgaatgaagcagttctgaataccttcatcctgccatcttagcagaattactgcaatgaaataaaaaagattttgagtatagaaccaaagtcaatacacgataaggaaggatcttgattttattttacatccttgtctcgaaggtgcttttctacttgttaaattatctatcttattaggacattctttgtacgtttgatgtctctgcttcccattctgttttccttctaggaatctatatccttgtggagacttttctcatctaccaacatttttatgtcccctcaagtactgaagcctttgcagctatcattggacagctcaagttgtttatagattttacccgaaggccaatctaaaggaaagtatcttagaagaaagatgccttttccttttggtggttattttctctttaaataaaaatcttatacagccttataatattgtaataaaactataacccagcacttg

SEQ ID NO: 182034 - DNA, 734 bp, Homo sapiens
acatagtgtactgtatgctgactcttagtgccctgagttatttaggtaagtatgtaagttaatgtagaaaggaaatgtcaaagttcttctgattgtgtaatggtcctgggcaatactgcatataggaaagtccactggaaatttaaggaatagtgattccatgactgcagactttcatgactgttgtctccttaaataatgcaggaactttaagtgagcagttgaaagtgaaccttaagatggaactgtttatttctcagagctgattttccaaaagtagttatacgttgatttatgtaattttccatactttgttagcatattgaacagcactgaaattttggaatttttttcacatttatttgcatagatcctttttaaatttcagtgtacagcttcattttatttttttctctaacctggtcattatatttctgaatgttgtatcttgtcagggatctgattttttttgttcctgatggattaccacttattgaactaataatgtgtgatagtgggaaactgactgactgttctgtactctagaatttgttgcctttaacatttgggaagaatggatttcttggtaattggcatggaattactttgttattattaggtataaacttatatttcattctttttaatctagaatacttattaatactgataaagcatctatagtaatatagatccatactctcttatcttaaattctgaaatatgaaagttct

SEQ ID NO: 182035 - DNA, 637 bp, Homo sapiens
gtgtaagtccttgtgcacattttcttaaggacatacttacatgtcgggccattgtagagcaacaaagggcagggtgtgtgtgcatctcactgtatgtctatatcaccaagagcagctgtctccaaccttgttcggcaccacagactggggttggtgggatggtttcatgatgattcaagtgcattacatttgtcgtgcactttatttctactattattacattgtaatagataatgagataattatacaactcactataatgtggaatcagtgggagccctgagcttgttttcctgcaactagctggtcccatctggtggtgatgggagtgacaaatcattaagcattagattcttacaaggagcgcgcaacctagatccctcacatacaagttcacagtagggtttgcccactcttatgagaatctcatgctgccctgatctgacaggagatggagctccggtggtaatttgagcaatggggagtggctgtaaacagatgaagctttgcctgctcacctaccactcacctccctctgtgctgcccatggacgcgtaccagtccatggccctggcgttgggcacccttgctatagagtcattcctccaacccttatttgcgggggatgctttccaag

SEQ ID NO: 182036 - DNA, 465 bp, Homo sapiens
tggccatgtgatctctgtactgtgactcccttttgctttctgccataagtggaagcttcctgaggcttttgtcagatgcccagtcttccagccaggaaaactgtgagtcaagtaaacctcttttcttcataaattatccagccttaggtattcctttatagcagctctaaagggactaagacaaggagacttagaatttcattttgggaagtttgtcaaaaagattcaaacacttgatcaaaaataggatcacatttttgatcaagtgtttgaatataatactcatttagccacaatgataattaaaatacttcaaaagaagttacatagctgtagaaaatcttaactcttataataaagaggagactcagttttcctaagtaattaatgacctaagaaagaaaacatgaagcacagaaattattttgacaaaatacagaatctttcttttctaggccacatacc

SEQ ID NO: 182037 - DNA, 184 bp, Homo sapiens
acctccagggtagccctgccctacaggagcagtcacagggctgtaacgctgcctcttcaataaagctgttttcttctatacctccagcttgcccttgaattctttcctgggcaaaggcaagaaccctcatgtgctattgagaggtgacagcgttctggcagccctggagctcactctcagtgtc

SEQ ID NO: 182038 - DNA, 230 bp, Homo sapiens
tctcgctctgtctcccagactggagtgcagtggcgcgatctcggctcactgcaacgtccgcctcccaggagaatcggttgaacctgggaggtggaggttgcggtgagccaagattgcgccactggatggcagcctgagcaacagagcaagactgtctcaaaaaaaataaagtgtgctctattgaactcctgaattttttaataaattattttgcccccacatatcatgaa

SEQ ID NO: 182039 - DNA, 407 bp, Homo sapiens
tgagacagacttttgttcttgttgcccagactggagtgcaatggtgccatctcggctcactgcaacgtctcgaactcctgacctcaggcgatccaccctcatccgcctcccaaagtgctgggattacagacatgagccaccacacctggccctgtttgatgatttttgttctataggagcggcacaaagagaagaggacagaacaaaagtaaccaaatctattctctctgaggaagatcatatgtagagagcagaggtctgtgtgtgtgaaagaaaacggggaagaggatgaaaatgtccagagtggtgagctctgctaggccctggaatgaagctgagatgctggaagcgctaagttctctctagtgggagaaaacccactgtggaaagctaatcatttgatgtag

SEQ ID NO: 182040 - DNA, 423 bp, Homo sapiens
agagctgctatctcttcagttacccccgagatcaagcgaatcgagcgtacttcctctggacctaacagtctcatggcacacccccagctctccacctgggccacactggacacggcagttacttctcgtttcatcctagctgtgctcctgcgcatgaaaacttcatctgctccctgcagcttccttgattttgccaggcctgacttttaacgcttactgtataagcaattaacaggatttgaaaagtcaatgggaaacagatcttcaagagcattctctgaataccagcaccccgtgaagcggttttaaaatgtgcagcatcgccctagagatactctgaccccagtcaattattagggggattatgagagtccaaacagcatttatcaaactgacagaaaaaaacaaaatcccaaactagta

SEQ ID NO: 182041 - DNA, 708 bp, Homo sapiens
tctaattttctgttcaatccatactgcacagatacaaggatgaaccaccattttggttcccaagttttattcaagaattcgtataaaatattccacataagtgaattttaatcctcgtcttcctcctcttgtttgttctggttaatttggaagtaacgtaattcataaccccttttgctgttagcagttacgcacgtccaatcacgtagattgttcttcttcaaatatttcttatttcaaataccttttgggaagaggcatctcggaagtcatggtgatcttgcccttgctccttttgatcacaacccctccaatgacattcctagcttttctgctcactttgatcctctcttgcaaaaactgctcaaaattggcagcatccatgatccgtcttctatggggtgggtgcaatcaagagtgaacttcagaacctgcttcttttttttttgcccccctttaccacaaggtttttcatggatgccatggtggcagtgaaggcagaaagggcattttttttttttcagcctgggtgatagattgagactctgtcaaaccaacaaagacatacctacattcatgcatgcatatatgatgaaaactcaggtgaaactcctataaaaactctgtttatggtttgctcttacataattaattatttgagaagtcacttgttaaatgtgtctctcttgctgggctgtaacctaatta

SEQ ID NO: 182042 - DNA, 133 bp, Homo sapiens
ataaagcacaaaatcatcaaattttacaagagagcatatgtaatttgttgttctggacaccaagacaaatcataattgatctttccagtcaagccctactattacatcaccaggtatctatcacaaataaaat

SEQ ID NO: 182043 - DNA, 148 bp, Homo sapiens
gtcacttaccacactgagttgaagtaatctttagatagatatctttcctactgagtataaaatccttgaggacaaggaagatctatattttcttcatcttcgcatccctggtgtttagcagaatcgggtgtatttttgatatctatgt

SEQ ID NO: 182044 - DNA, 218 bp, Homo sapiens
tcttgtatgtttggtagttgttggtgaatggttatcatttcttcttatctgttcctcagattttatacttgcctctccaactgtcctcttcagagtcatctccaattttgagagagaaaactgcttatgtgtttcccccatattattctatattatcagattttttagaaaatcccaggtattgtggttaacacttcatgtataaatttgttctcata

SEQ ID NO: 182045 - DNA, 634 bp, Homo sapiens
aaagctgactgacttaatggtacccacgaccaccaccattcagagagtcacagggacaaagagcatgatcacatgcttggccccatatttcaatggtcagctcctcatcttctgtcctcatcttgctccaccacctgccgggagttaccctggggtcgtccattagataatggctcagggttgccaaggctccgtcttctgttgtctgcagcagacaacagcacacacacgcacacacacgcggcacacacgcacacacacggcacacacacgcacacacacgacgcacacacgcacaccctggaccacagcctgggccaccacaggagtgacagccacagcaggaagtcctgcctgggtccacgttcctgcgtcatttaacgcctgttcgctgggcaccagctctgtgccaggcttgcactgggcacaaggacactgtggggagcagaggcagggccctggacagcgtggtccgtgggacagcacgtgggtggcagctctgcctggaacacaactcccctacccgtctacctgctgtggtccaagctaccgcccctcttgcctagtgaaagcccaggcctcgggccgcccactctgcttgtctcccctccatgtcccatccccgtagccccag

SEQ ID NO: 182046 - DNA, 126 bp, Homo sapiens
ccgagatcgtgccactgcactccaggctggggacgacagagcaagtctcaaacaaaacaaaaaaaaaaggactaagagcagagaagggagttacagtttgtgtgcgtgtgtgtgtatgtaatatag

SEQ ID NO: 182047 - DNA, 222 bp, Homo sapiens
  misc_feature (16)..(16): n is a, c, g, or t
gaactagaggttacgngcgcctagcaacttccgttgaggtatagagtcaagaagagtgtgagaacagtaatttcccaagactgccctctgtgttgactgtatttcagaaaacacactggtggggctacctctcaattcacatgtactgccctagcctctccccatccccggctgacgctcatccataactgcactgttccataacagcagtagaatgttgca

SEQ ID NO: 182048 - DNA, 394 bp, Homo sapiens
  misc_feature (229)..(229): n is a, c, g, or t
ctcagcctcccgagtagctgggattatggatgtctgccaccacgcccgtctaatttttgtgtttttagtaaagacaaggtttccccatgttggccaggctggtcttgaacccttgacttcgggtgatccacccgccttggcctccctaacctcaaaaagtgttgagattacaggcgtgcgccaccgtgtctggcctgaagtcagttttttttttttttttttttttttngagacagagtttcgctcttgttgcccaggctggagtgcaatggcacgatcttggctcaccataatctctgcctgccgggttcaagtgattctactacctcggcctcccgagtagctgggattacaggcatgcgccaccacacctggctaattttgtatttttagt

SEQ ID NO: 182049 - DNA, 598 bp, Homo sapiens
catgtcgtggcttatagcaaatatgcaataaacatctgctatttataataataatggatattcagaattactttaattcagaattcatgaccgtttttctaaactagactgaaatttatttcacattattaggaccagttagcaacaatgtaaaaaattattacggcaatgtttaacaaacttaagaaaacagacctttaagcaaaccaattcttttttataatttcctgggaaaaaactaaatgcagtcattacacaggtgaacttatctcccattcaaggaggccttgctcagctcttcccatagttacctggagaggctaatactgcaattagttataagcggtttttccttccaatttctccctacggctgcctctctgagcgtgaatttggaaggtgattcttaatgtttacattacccctcagttctgagaagccaaacatttgtttgaaaaaaagaaatagaatttctgaatcagaagaaagagtttttgtgtgtgtgtttatgtgttgttgtttttttttgttttttggggtttttttttaattgagacaaagagtctggctctgttgcccaggctgctggcatgggtgc

SEQ ID NO: 182050 - DNA, 157 bp, Homo sapiens
taaagtttacattgttttttattttctgctcatacacttgtctcatattttttgtcttcaaaaacattctcagagacaagtacatttagagatgatcccagaattgtttgtatagaaatagaaagtgagaatctcattatcaagaggatttgccata

SEQ ID NO: 182051 - DNA, 182 bp, Homo sapiens
acaagaggagaatgaaggcaggtttcaaggtgtttgatctgatccacccaaggaattgtaccatctactgagaatgggtccaatgagaacagtaggttgaatggggaattaaaaagttgttagtggacacattaaatttgagatgtcattaaataaatatccaagtagatatgtcaggtaag

SEQ ID NO: 182052 - DNA, 381 bp, Homo sapiens
gaaaattttaaaacaccctgaatcacctgtttcccattcccagcttgacatatggctgccctgtaggaattcttggcccctgggtcaaagggctgatgagacagacacaaggctccatggggactgggcccaaggccaagtatgtctgcagtacggctgccatttccaaaaggggatgctgatttctgcaaatatgggacttaaccggctctctgctttgaaggctgtttgtggcatgagagctgatgaaattcagtggctactggccaacagcatggactgatttcctctctccaaggctctgccaaaccactgctgtccctgacccacagctgccacacccctcagtcctctcttctgtcctcttgaacttccatggaa

SEQ ID NO: 182053 - DNA, 222 bp, Homo sapiens
caaaaatctgtatttctatacaccaataacatttaagctgatagccaaatcaagaacacaatcccatttacaacagccacacacacacatacaaaatacctagagatacacctaaccatgcaggtaaaagatctctaaggaggactacaaaacattgctgaaataatcatagatgacacaaagaaatggaaaaccattccacactcctgggttggaagaacc

SEQ ID NO: 182054 - DNA, 278 bp, Homo sapiens
tagcgaactcaatgttgaaagagaaggacaaagttggagggctcacaatacccaacttcaagatttactactaatctacagtaatgaagacagtgtggtattggatcaatggaacaggatacaaagcccagaaatacactcaactgatttttgacaaagtagcaaaagcaatataatagagaaaagatagtgttttcaacaagagatgccataattcgacacttacatgcaagaaaatgtatctagacacaataaaataaagaccttacagtcttcac

SEQ ID NO: 182055 - DNA, 585 bp, Homo sapiens
atagatatatgtctagataggtaagtagattagatagagttggtaggatggaggattataaagtaaatatggtaaaatgttaacattcgaggactctgggtaaaggatatacaggaattctctgtattattctttcaatttttatataattttgaaattgtcaaaattcaaagttaacaaaacttaatgtctcaggaaaagagcgaattacttaaaggaaaatcagggcaggtgtggctactgagaaagcttgggtcagggagggggaaggaggaatatcaagaaaggaattactaacatccacccattatagacataattttaaatgatgttatagaactatgttatggacatgtaaaatatgacataacaataggaaaaaaattagtttaccattatacatacaatttgctaagtaggcttctggcaataagtgacttttatctttattctcttacatgttattttttctttttttttttttttacaataagctatcagtaaatttataatcggcaggaaatcagtaaaacattttaaaaggaagaaaattctcatttagatcaggggtcagcaaacattttc

SEQ ID NO: 182056 - DNA, 304 bp, Homo sapiens
  misc_feature (11)..(11): n is a, c, g, or t
ctagaggaccnactaacctaatcgcccagagtacactgcgggatacaaataaaaaaactactcaaaatatagcagctatattacagtcataagacgacactccagggcatgttttatttggttaattaatgtgtgccttaggaagtaaaattatgattctatattcacccaaggtgtaccttaatgacctaataaaacatgtctcgtcacctttaaatgctatttaacagtacccagtgtacaaaattttagaatcacctatactattaaactgcttattattataatcgcgattagggttagt

SEQ ID NO: 182057 - DNA, 189 bp, Homo sapiens
cagttaatcacaggtggctataaggcaaactccaagctttaaccagtccagctttctctgtacctcacttctgttttctgtatctcactcccctttttgtgtccataaatattattcagccatgtagcagccctggtctttctgaacctgttctggttccaagggctactccatttgtgaatcattcaa

SEQ ID NO: 182058 - DNA, 341 bp, Homo sapiens
tgctgggattacaggagtgagccaatgtgcccggcctgaggtgtttttttagtcaggtaattgaggtgtttccaccaggacgaagcctctcggtggctgagagggaccccactgaactctctgctgaccgatgggggagcatgctaagtgcttaggaacattagcacataccttgtgaaactgatgtttttatggtcaaaaagggttggatatcagcacttccataagatacagtggacattgggacgcacatttactcccagtgaccccccactctgttccttggtgctctgtgtccccacctcagctgctctgggctgtggctttctgctcagcagttc

SEQ ID NO: 182059 - DNA, 373 bp, Homo sapiens
tatatatgagtatttagatgttacataaggaaaacaaaaaaagctaatggtttacataaacaaaaaaatgtaatcatttatacaagaaaattactttaaacatgtattttcatattctgtcttataactatcctgattacttccaaaggattctactaggattactacacaaagctttagtcttcttttaattattatctatgttattaagcagtatattatgtcctaacaattgagtacaaaggagaattcttgatttatagtgcactctatttttggcatttatagtcactgcatttaagaatacaaatgtacattttaagccactcaaaataaaactatattcatgaaattagatgtgattccttaatgt

SEQ ID NO: 182060 - DNA, 560 bp, Homo sapiens
ggggggtcaggaatttaggagctgcttagctcgtagttattgcacaaggtttctcatgatgttgcaggcaagatgtcatcaggggctacatcatctgaaggcttgactggggctggaggagacacttccaagatggcttactcacatggctagttggttagtgctggctcttggcagtagacttcaacttcttagcatgtggagcccccattgggtatctgagtgtctttgtaatgctgtgactgtcttcccccggaagaagtgatctaagagagagcaaggcagaagcctacagtgtctcttatgactagccttggaaatcacacactgtcatttctgcaattatcttattagttacagaagtcttccctattcaatatgagagggaattacatgaggatgtgaataccaggagacaagaatcactgggtaccatcttggaggcaggctaccacaaaaagtaagggaaagaatgaatttgcataagatgttcagctaaaataatttccattttttaaattggaaacttgaactcagtcccatgagcgtaatatttgtag

SEQ ID NO: 182061 - DNA, 999 bp, Homo sapiens
gtactagctcaagttcacctgttatctgatttcatttttaaaaaaaattttttaaaagtggtgttcgggaggtaaggaacaaggaagagacctttagaaaaaagtttcagtgttttatattggatatgaaaatatcagtggaatgtgtcctgaaaaacactggatgacagttactggacaaaaagacaaattattcccttttaccatgcaactgaacacagatttattgaatgtttttctcctgagtttaggttgcctctgggcaagagtataattctggcttgataacaccttgaagcgtgtttgtttaagtttgtggatagtttcatctattagtggaattaggcatctgcttctctttatgaacactgggtaccataatcttcctcttactttttgttttttctactcaactccaaaaaccattgctgagttgaagtagaataataaggggaaagaaacaaaagactaagtttgaatcccagtgctgacacttactggctttacgatattgtttaactcacttaccctttttaacctgaccttcttcttcactaaaaatgaaaaattgagtgaatttccctgggactctgttagataaggcaaaactaagatgggaacacatttcctaaggcgtagaaaaagacagtgaatgggacctttcttgttgtatcaggagttatggtaagaggtactaacaataaaaattaggctttcagccaggcatggtagctcacgtctgtaaccctaggactttgggaggccaaagcaggtggattgcctgagcttgggagtttgagatcagcctgggcaatatagcaaaaccccatctctactaaaaatagaaaaaattagccaggcatggtggcacgcacctgtagtcccagctacctgggaggctgaggcatgagaattgcttgaacccaggaggcggaggttgcagtgagccaagatcacaccactgcactccggcatggggaatagagcaagacttcttta

SEQ ID NO: 182062 - DNA, 1020 bp, Homo sapiens
ttccctcttgctcctcaaaagtgattattaaattgatgataaacctttgaattaatgacatttaagcagtgcaggaactgggcctacacccaatatctcagtaaaaggtatactgcacattcctaaacaaagaaaaacccttagacagatactgcagtgtctccataaggacaaagggctagatctagtcagctgggcatcagaacacctgaaacacatctgagttgacgtcatatcaccactggacactagtcaagtttcatatgcttatacaacatgtactgcatgctactgtgtgccagataatatgccacctgaaaatgttactgatctgggtgagggaactggcaagatccccagaggggagggtgtagagatgctggatgagaagccagggagtgtggactaacaaggaacctgagtgttcttaagagacacagaaaacaaagctggagagaaaacaggaccaactgaatgactccagaagagttgaggttgcgtgggaagtgtaattcatcaacttgttagaaaccatatttatttataacacagagtacaggtagccttgggaattttcaattataagaataaagggactctacgagaagccaaaggggtagatgtaggctcagataaaattctgaccacgggagcagagaaagcaagcataacctgatgtgggctctgcattgagtgaacattacaaaaaattctcaggaaaatcccatatatggggcctaacattcttatatttcatggaaagaatgagataaacagatcttgatgattgcctagtggtatttaacaacagcccccaaagtctgggtgccccttcccagagatgggctgtggggttagaacgcataatatttgtacagctctcgcttaaaaacgcctttgctcagacagcatacttgcgtgccatatatcatgtattttaaaatggggaaacttgtcccttggtggtccaaaggagacaagaaaattatgatcagataccaacagagacccaagtctgaa

SEQ ID NO: 182063 - DNA, 222 bp, Homo sapiens
tcctatttatacatcagtccatgttccagacagttgagtatctaatctttatttcaggttatagtgagctaatgacttttcctggaagtattttcagttttcagatagacccttattgttaaaaaatttcttcttttggtgaatcgaaatcagcctgtatgtagtcttatagagtaagagaataggtttgctctgtagtcttatagaataagataatagggt

SEQ ID NO: 182064 - DNA, 590 bp, Homo sapiens
ctccaatagcttttccaagttgctttttcccattctacaactgcttccttttgcagaaaggaagtgtctctgaccttgtatcaggagcgttaccaaaatcagctttcctgcagcattatccaagttgcacactgtacttccttattagaacatatgcatcacctaagatgttccgtaaaacaaatgtgaacttttcccccacccattggttttcaacgtgaagccagatcagtgcttctcagttttccccagagggctgagagccttgctgtcactggtgaaggctttgacggctgccaacccagtgctctcttacttcctacccactcaaaagcaccttgaattccagctccaggagtgcattgccaccagcgatccccatctgcaaacttaggacaataggaatttttcgtaggctggaaacgacctcttcataatgtggattcttagaactttgccctccttcttttgatgaaattctgggctttaatttcaggcttgaacaagaaggacttcctctgactcatggtggccagctttgacatcttaagcctgatatgacagcatacttactgagcactttccaggag

SEQ ID NO: 182065 - DNA, 365 bp, Homo sapiens
agctgcaacatagtgagcccaggagtcccggtccagcagctagtattaaattctctgttgctagcttggacctctctcgatatctaggaattgtctgcagtgtggggtggcacagtaacaaccatttgtttctcaacaagaatctgataatgttgcttgaacctcctgaaccagtgctgcatgctctgcttcttcatatgtttgtccttagatttgaccaaaaacaataactgataatgtaatacagattccccagctccctgtgagctgggttgagcccaggaagtctgtacaagagagcatgtctactgggatttaaatagcccagaaacaggcagccggaatttcttatactcttgtgctct

SEQ ID NO: 182066 - DNA, 450 bp, Homo sapiens
cacactggtagtagatgaaagcacagacggtgggttcaaagttacacatggttaaataatttgtttaaagttgcactgctgatactcaacagcagtgtagttcaacagggctgctgcataccagcagtataactaaacaaatgatttaaccacctatgaccttgatttcttcttgcataaagttattatgtctgtttcatgggttctgatatatataataaacctgttagatgcaatttcattattattttatatctttacatcatattctccctgagcctgtaatagaaagttggaaaattggagcattcaagggtggcagggtgggggatgagggtggcagtgctcaaagccccaagctgcaaacctgccatgaaaagatgaaaagagataagggaacaagaaaatgactttgtttatccgtccaaggagcttctggggctccctgat

SEQ ID NO: 182067 - DNA, 193 bp, Homo sapiens
aactccaacctatttctttgaaatgaaatttaagaaaaaaaggaaaagaaaaggaaggcacaaacacagggaaggaaacaaaaatttaaaaaggtagggcaagataaacatacatgtaagtagaagcagaataatttttcaaaagagaatgatttattgaattgaaggaaaagactcccttccttccttcctt

SEQ ID NO: 182068 - DNA, 318 bp, Homo sapiens
acctatcatgcactttcaccttcccccaaagaggaaaaagcctcattcactgaaatttgctagtgtagctcctttgcttattttgatatcaacttttcaatcaatattctcaggaaaagatatgactattttaagttgaaagcaaaccacagacgaactcagttccctggtcaattatcctcccagtaggtggtgacagttaaaagcagctccttaagggccaaaagcagctccttaagggcccaaaacagctccttaagggccaaaccctgcagtgaggcctgtaaataacttagattcttcaggtgctcagcgttt

SEQ ID NO: 182069 - DNA, 362 bp, Homo sapiens
gggcacccacttccccaggtcagaggggaaggaaataggaatgcctctgaagaagagtgggcggtctgatgtgcgtggaacagatagtgtgtgtggcggagtgtgagctgggaggtgactcagaaagtcacctagtgtttgggtttttgatggagctctggaatccaccagacgtaggctatagtcacagcaatgcattgtattagccacgtggccttgggcacatcactcagctggcccaaacctcagtttcctcattcgtaaaatgcagataaacatgcctgtctcacagggaccatgttgtggttgttatataaagcacctagtgtaatgctaacacattgcaggaactcagtaaacat

SEQ ID NO: 182070 - DNA, 393 bp, Homo sapiens
ccttccttccttcctttcctttcctttaatttcccctttccttgttcttttcctttcctttctttcttctttctttcttttttattgagacagggtctcactctgtcacccaggctggagtgcagtgacacgttctcggctcactgcggcctcgaccacctggactcaggcgatcctcctgcctcagcctccgaatcgctgggaccacaggcatgcatcctaatttttttgtattttttatacagatgggttttcgctatgttgcccaggctgatgcacccaccttggcctcccaaagtgctaggattacaggcgcaagccaccgtgcctggcctagattttgttaaactgacttagctggtcatttgctcaaactggattctacaaagatag

SEQ ID NO: 182071 - DNA, 229 bp, Homo sapiens
atgttcacagcagcagcattcgtaacagccaatgtgtgaaaaagtctccagtgtccgtcagaggataaaatgtggtctatccttgcaatgaaatcttattcacccataagaaggaatgaaggccgggcgctgtggctcatgcctgtaatcccagcactttgggaggcgtaggcaggtggatcacttgagcccaggagttgccagcctgggaaacatgatgagagctcgt

SEQ ID NO: 182072 - DNA, 145 bp, Homo sapiens
agacacacacacacacaccacacacacacacacacacacacacatgtgagaggagggccaccctgggaggaaaccctgaattctcccctcttagcacactccttctatctactccttctatctcctggtagagggagaagctgtg

SEQ ID NO: 182073 - DNA, 549 bp, Homo sapiens
tggatggatagttgggtggttacgcggaatgatggatggatggatgggtgggtgggtggatgggcggatgatggatatatggatggatggttggatggatggatgggcagatagatggacgagcaaatatggatccgcctccttgattggttctgactaactcttcttctctccttttgtcctcacatccctcagatgctggggatcacagtgtcctctcctttccactcttcatctcagcttccttgactcatagtttttcctttccttgcagtctggctgttgagcagtgttagctatgcccccgtgtggtgcctcagagactcagccactccccctggactttccaggcggcagcagggaaaggcttaggagaatgtcagaaactgttggatggtaaagtgtgtggaggagaaatgaagaggaggacacccaggcccttagccctggatcctaaaggagcgggcagtggagagaacctgagtgctgtcagctcagttccaggacctttagtgaatgtcagtgggtgagagaaggactaaacatggg

SEQ ID NO: 182074 - DNA, 538 bp, Homo sapiens
taccccaacctgatcttttccctcataacatgtaccataaattgaaattgtttactgactggtttgtttccttgtgtattgccagtctcttccattgaactaaaagtttcatgagggcaggagccatcttcatatgccactgtctaacacagtgtctgacagagtagcccctcagtaaatattttaggaatgaatgaaagaatgagtaagccatggtaaaaagtcttgactttttcctcaggagcgatttgataagatgaaagggataagacaagactgagtgaggaaaggagtatgtgagagcttagagggaagaaatactttaccaaggtcctgtcatgttctgggcagtgtaccaaacagtttcacacacatcgtatcatttcactttcctagtcatcctttttcatagatatataaatggagctcaagggcttatgtaactgctccaagttgacacagctgggaagtagaagagcaagcattcctattcatgtctgtagctaccaagccctttctcgggtgtttacagtgaaag

SEQ ID NO: 182075 - DNA, 441 bp, Homo sapiens
atatttatctcagtggcttaacaaaataaaaatttatttctcattcatacaaagtccaatgtggatatgcatagtcaataggcagccgtctatgtggtcattcagagatgcaggcttcttgcatcctatggctctgttttcctgtatggccttggagtcctctgttcaagcctctgtgtctaacagatagtaggtatgggaagagagagaaggtgtggaggatcatatcaaggggtggacatcatatccacccacattctttctgtgataattcagtcacgtgaccaagcctaactgtaagagaggttgtaaagtgagttctgatgaacatatagcatttctgccctacccacttaaatgaagcaacagtaccagggagtagttggaggtaaagaagacatgctgctttatatactaggagaaagtccagtatcataggca

SEQ ID NO: 182076 - DNA, 112 bp, Homo sapiens
aagttatatggagctccttggttctgtgtcctcaacatgctgttctatgttttttacattctgtttgctccttcctgcttggaatgtccttcccctccccgtctttcttaat

SEQ ID NO: 182077 - DNA, 343 bp, Homo sapiens
tttgctacctatataattttaggcaagtcatttaagccatttttctgagtgtacaaactggggttatttaaagctgtctaataggctggacggaagggagtaaaagaaagaatgtaaagtatttaatatggaccttggtacattctaattatttaataaaatggttgctgtgcgaaaacaaaacgaaacaaaaccaaaaaacaaagagaaagccagagttgtagaagagaggacagagaagtagagaaagggttacagaggaaggcagggccttgtccatgtggggctttacagacaaagttgaattttatatgaaatctctagatggctttaatcagaggag

SEQ ID NO: 182078 - DNA, 357 bp, Homo sapiens
cttacgacgacgcaaattcgtaggctatggtcatggactagtagccatgtgtggaaagagaagattgatagttacctggcatcatgataatcaagacattattattagaaataaatatacatatgtatcctgatatatttatttacaagtccaaactgaaattaatcttaataagaatgtaaaataaagcaaaagtattagaaaaaggggaactctagttctgggtttcttcacaaactgtagcaaaattttaacttcaaattttaaatttaatggctagtactagtactatttatacatttgttgaaaaatgaaacattctttttaatttggaactaaaatttgtctttaaaagat

SEQ ID NO: 182079 - DNA, 154 bp, Homo sapiens
tgctgggattacaagcatgagccaccatgcccagccaggacattcctttaaaaaactaaatttcccttaaaaccatttatctttttctgctatgcctttctaattggaaaataaacaacttaaagtacacatctgcacaccttaaccaccacat

SEQ ID NO: 182080 - DNA, 378 bp, Homo sapiens
  misc_feature (45)..(45): n is a, c, g, or t
tttgctggggtgactctagagtatccctttctctgatcgctccangatgagatttgggtgggcacccagccaaaccatatcatattccctgctctagattccagataagggagaggagggaggcggtgctcagccccagccatttatgctgagtagaggaggtgagaagtagttggtagtgacttcctcagtctcttccttcagcgagcagttggagtgcactgttctagtcacatctattcctaggcccagactctgacctgttttcaaagtctcatatgcctaagccctggcttgctctctctccctttctttattagcaaagaaatcgattatcttcaggaaaggtattatgagcacactgaaggtatcagtcac

SEQ ID NO: 182081 - DNA, 271 bp, Homo sapiens
cccccaggtagactaaccaggtagtacttaagccaatcaacctaaccccccttgtcccatcatgagtcttttaaacaaatgtgagttactcaagtctgcaatcaaatgaacgcttttatcaaacaatttaaatcacaattactaggcttttcacagcgcgaaattcttttaaagaaaaatgcacatgttaattgaatcaaggcagtttgggcagttcttgtatttcagcattttcaccattaacctatccttataagttaggtctacctgg

SEQ ID NO: 182082 - DNA, 102 bp, Homo sapiens
agcaccccccacccgccccgcactaccaccaccactgccctggtattacaacatgtgtgcctgtttgcagattttcaagtaaaaatgggaatttaaaggcca

SEQ ID NO: 182083 - DNA, 634 bp, Homo sapiens
actgaatagagtttcagcatggtgtgtgtgtgtgtatatatgtatgtatatctatatgtatgttatatgattgctcctgggagtttaattttgatgtgtaatatattgaatggttactctttcctttttagttgaatcggcttaaaaagtattttattctaggtgctggggatatggcaataaataaaatcgagtccttaggaggctgaggtgggaagattacttgagcctaggagttcaaggcttcagtgagctatgatcacatcacttcactcctgcatgtcggcactggacgacagagtgaaaccttgtctcaaacaaaaaatgaaaaacccccaaaaaactgagtccttgactttgaaaagcctgctttctaaagtgaaattttgttcatatgtaaaaatttttggccgggcgcggtggcttatgcctgtaattccagcactttgggaggccaggtgggcggattgcctgaggtcaggagtttgagaccagcctgactaacatggtgaaacccagtcgctactaaaaatacaaaaattatccaggcatggtggcacgcgcctgtagtcctagctacttgggaggctaaagcaggagaattgcttgaaccagggaggtggaggttgcagtg

SEQ ID NO: 182084 - DNA, 417 bp, Homo sapiens
ccttttaccaaagtgaattttaaaaattacattttccctcttgcaatcatgtttgtagcataaagaagcaataaatgggggcggggagtaaagcttgggaactattctatgttaggcttgagtagtctagtgcaatgtctgataaaggaggggtttgaattttggtatggaaggctttctaacactgcactattttaaagaatagctcagtgatatcagtattcagttacttaactaggcacgaggtaccagatacagagagattgtgtagaagaatgaacactgttaactactgtctcctctccccgtttgctggatctatctatggatagggtgctgacctctaatttactgaaataaaaggaacattgttcctggaaatatttatgaggcatattgcatcttctccacgttatg

SEQ ID NO: 182085 - DNA, 173 bp, Homo sapiens
actgtcttttgtccagtgtctgaaaccatggcttcgtatgttttatcttttttttaagagatgggggtctcactgtgtttctcaggggctagagtgcagtggctattcacaaatgcagttatagaagagtacaccctcgacctcccgtgctcaaacagtcctcctgcttcagc

SEQ ID NO: 182086 - DNA, 418 bp, Homo sapiens
aatgcattataattgatatttctaaaactgtactttttaatttgcattatgtcaggaaatgtaaattataaacaaagatgattttgtattgtttcacttacaatgactcttcattgcaattggaaaaataacatgcacttccaaatgtctaaattttcctactaaattatattcttaaggttttgctattgatacttttatatatgcttgtcctatgtaaaagttcgttttctgtgtaaatatttttgaacatagtctattttgattaaaaagaaatctcacatcattaaaaataatttcaattgttataagtaatgtttaatgtaacaaatactgcgattatttacatttgtctttatgcaaatctaaaataatatttacttgtatatatgtggtaatatacaattttgtatgtaaa

SEQ ID NO: 182087 - DNA, 627 bp, Homo sapiens
ttacattgaaaatactagaataaaatataagtacatatttgtttttaacttaatatacaatttcagtgttagatgaaatgaagatggaatattaacaatgtataagtaatgaaaaattactgaaacttgactctgttttagcattccaaatcttaaattatattccttgccctaaaataaaatatcatgaagatattttgggtgaacagttggaaattgttacaattctagagtattaaagataccaagaacattcagaggatccagccgaacctgacttgcccaagaaaataagtaaatcatttagtttgtcacttcagtttgcatgaccacaaagaactgtacacgcaatgagttattacattgttatagaagaaacaaaatattttataatagtttgccaaaaatatcatgccattatgagaaaaacctgttgactaagtcggcctttggtcacagtaaataatcactgcttttgaccaaaactgcaggaatgtaaatctacgtttttcagtgtttgaaagactttaaaattgcaccatataaggtaatgctggctaactaaactttataacatttgaatgtagaccataagctgatgagccggaggtcaaaattagatagctg

SEQ ID NO: 182088 - DNA, 314 bp, Homo sapiens
tgtatcactattatctagcgaacttgttaatgctctgtagatcctctgtatttgaatgtgctgggtgtgcttgtgagtatcaatcacttgctacatcataaaactcaaaaatatttataaagatgtgtagctgtttaacttcctaaagaggcagtaaacttcctcttaattgtctcattttcaaaataagcaggttgaataaaattacaattaaggtcaactccaagtctaaaatttcattacctataaacccatttagtgctctgcacatattacatggtctacaaatgttgttaagactatagaaatcaccc

SEQ ID NO: 182089 - DNA, 304 bp, Homo sapiens
ctgcagacagtgtgggggatggggtatactacagagaagagaaagtccattgactttccttacccataaaagcttttcaaataaaaataccctgttatttttatttaattagtattgagtctgattgccagatgcagttttactttgaaatgataaataatttaaaacttgtacttttacccggtgttataaccacagattaaaataaagcgaatttttacacattttattcttcagaaacagaccttttcaaagactattttgcaagctaattgaaggctttgtgccatgctggcttgcatgt

SEQ ID NO: 182090 - DNA, 1126 bp, Homo sapiens
gcccgaggtcccagacgcccggcgcagcgggagcggcggggcgtgcctggcctgcgggacgcgactgatcgcagtggggcgaagcggggccggagccgcccgcggtcaggagcagcaatgtctgtgcaggtagcggctcctggaagtgcagggctgggcccagagcgcctgagccctgaggagctggtgcggcagacgcggcaagtggtccaggggctggaggcgctgcgggcagagcaccatggcctggctgggcacctggcggaggccctggcgggacagggcccggcagccggcttggagatgctggaggaaaagcagcaggtggtgagccactcgctggaggccatcgagctggggctgggcgaggcccaggtgctgctggccctgtcggcacatgtgggtgcactggaggcagagaagcagcggctgcgctcgcaggcccggcggctggcccaggagaacgtgtggctgcgggaggaactggaggagacgcagcggcggcttcgggccagcgaggagtccgtggcccagctggaggaggagaagcgccacctggagttcctggggcagctgcgacagtacgacccaccggcggagagccaggtgccacgggcagggcgaggcggggggtgctgggcccttcatagagccccacagtcccccagaccctccttagaatcccacagtccccaagatcctccttagaatcccacagtcccccagaccctccttagaatgccacagtcccccaaccctccacagagcccccagacccaccagaacttccacagacgcccccactagctactccacgaagcccccgagcctcgccagacccccagggggcctctgacgctcgtgaccaccacctccctcaaaccttgagataggctgggtgcggtggctcacgcctgtaatcccaacactttgggaggccgaggcgagcagatcacctgaggtccggatttcaagaccagcatgaccaacatggagaaaccccgtctctactaaaaatacaaaattagccgggtgtggtggcacatgcctgtaatcccagctactccggaagctgaggcaggagaatggcttgaacccaggaggtggaggttgctgtgagccaaga

SEQ ID NO: 182091 - DNA, 303 bp, Homo sapiens
attttaatatgttgttttgtcaactactgaggctataggcccttttaggtcttcaggagaagtagaccagtaaaataaacactgtgtgtttaagctatgagagctcaggatccctgtggttagcagttatgaggcacttggacacatatttatactaagagttgtagcttttacttatcttgggtaaaagaaatactccaaacagttagaacaaaaaaatatatctgatggtaaaatggataatgtattagtccattttcatagtgctatgaagaaatactccagattgggtaatttataaaa

SEQ ID NO: 182092 - DNA, 812 bp, Homo sapiens
cttttttttcaaaacagcctcattaaatgtagaatgtaggtaagaaacactcaactaaagaatagacagaactcatgctctacccttacctgactggctatggggagatgggaaacgtcctggtacccaggtgtgccctgtgattctgaggaggagcaaaggagcaagagtgagaaactccctatcgtacaatttttctgcacccagaagttcaaagttgaaaattgaaatcaaatgatcatcaatgatgaaaaccctggttaagctaggggcatagcataaattctgagtgctcaggcactcaaaaataagttatacataatcaagttatatacagacgtgatctctgccttcatagggatattaatcagacattcaaatggtcatataaatatgatgggttgaaaggtatacataacttggttcctacccctaaagaacctgtgagctggagagcaaggtgcttacttgtggaagcatagctggtagcaggacaggtgcaggtgagtggttcagatgccaggtgccagtgaatcagagaccacttagagctcagtctcattggtctggggatgttgccaagcaggaaacaagatttgaacataaacctccagaaaactgaatagccttcccaggactaaagaggggagcatggtaggcatagtcaggtgtgggggctgccttgttcaggacagtgggcggtgaggacacaggtgtggctagagttgacagttaccttaatttgaacaagcaaactttctactagaaataaatggaaccaagttatgttatccggggtccctggagcggct

SEQ ID NO: 182093 - DNA, 639 bp, Homo sapiens
tctctccacactggagcatgtggaaaaaactggatgacactgcataccttcatcagcaccagaagcagcatattggagagaaattctacagaaagagtgtcagagaagcatcgtttgtaaagaaacgtaagctcagggtgtcacaggagccatttgtcttccgcgagtttgggaaggacgttctgcccagttcaggattgtgccaagaagaagctgctgtagagaagacagacagtgaaactatgcatggcccaccctttcaggagggaaaaactaattacagttgtggaaaacgcacaaaagccttcagcaccaaacactcagttattccacaccagaaacttttcactagagatggatgttatgtgtgcagtgatggtggaaaatcctttagcagatatgtcagcttcagtaatcatcagcgagatcacactgcagaaggaccttatgattgtggagagtgtgggaaatcttatagtcgaaagagcagccttattcaacatcagagagtccacactgaagaaaaaccatacaaatgcgaagagtgtggtaagggcttcggttggagtgttaatctccgtgttcaccagagggtccacaggggtgagaagccctataaatgtgaggaatgtggtaagg

SEQ ID NO: 182094 - DNA, 345 bp, Homo sapiens
aatctggtgattgcttcaataagagctcttttcattcttatcaatctaatcatacaggagagaagtcttatagatgcgacagttgcggcaagggattcagtagcagcacgggtcttatcattcattacagaactcatactggagagaaaccctataaatgcgaggaatgtggtaaatgctttagtcaaagttcaaattttcagtgccatcagagagtccacactgaagaaaaaccatacaaatgcgaagagtgtggtaagggcttcggttggagtgttaatctccgtgttcaccagagggtccacaggggtgagaagccctataaatgtgaggaatgtggtaagg

SEQ ID NO: 182095 - DNA, 367 bp, Homo sapiens
ctcccgggttcactccattctcctgcctcagcctccagagtagctgggactacaggcgcccgccaccacgccagctaatttctttttgtatttttggtagagacggggtttcaccgtgttagccaggatggtctcgatctcctgaccttgtgatccgcccgactcggcctcccaaagtgctgggattacaggcgtgagccaccgcgcccggccagaaatgggtattgttttaagctgataatgtgtagcaatttgtaacacagtaatagaaaagtaatacaagaagatctgacagcatgtatttgataacagtaactggaaaaaagtaaaccacttgtgccaccagcaagttaagaatgcttaataa

SEQ ID NO: 182096 - DNA, 447 bp, Homo sapiens
ctctgtttcccattaagttcattgtttagctaaggaagtgacatgggggaaaggtgtcggtggggaaaaaggaaaactgttgcctaagtagacagcaacagattagaggtccagtccagggtccaccattaaataaccacatgactttcccaaattcctatcatcacccttccgtggcctcaattttctagtcaaaaactaaactaaacaaaattgacccttgtcattctaaaatcctttgatttccaacttataaagctctcaactcccaacagagtcaagaaaaagattcttcttctggctgggcatggtagctcatgcctgtaatccaagcactttgggaggccaaggcaggagaatcacttgaatccgggaggcagaggttgcactgagccgagatcatgccattgcactccagactgggcaacaagagcaaaactctgcctc

SEQ ID NO: 182097 - DNA, 423 bp, Homo sapiens
agtcaccaccctctctttctcacctctgggcttttgcatgtactgttgctctgcctggaatatgctagattcaactaactctggggctcagtttacgtgtgacttctttcagaaagacttctctgacaattaccagtcccccaaatgaaaaaaaaacccactgggcagaaggactcccttaggggctcagccacactctatttctgcagccttgttcttagcccagcggatggagtccaccccattaaatgtgcacttctctggcagtctgtaagccctgagagaagggactctgtcctcccagtattccctcagccagtgcagtgcctgccacatggcaggtgctcaatatatatttcttgcatgaatgaacaaacaaggaatttaaaaaccattagcaaagctcctttctgaaactacgct

SEQ ID NO: 182098 - DNA, 662 bp, Homo sapiens
agaagacccagcgtcatttgcagggtggggcaggacagcccttcccagctgccgaggaggtggatgctggtgtggggtgacgtgggcacctcaggaaagacccacgcctctcccacctgccagcctgcctggggtcaggccttcggtgtccgaactgccctttccccgaatctgttgtgttttgtttttaagctagacctgacctctttggttagactaaggcagcaaacactggatagcagttcttataaccgcaatttactgaccacctactatgtgctattcactttactcgcactatctcactgaatcctcatattatcccattgtggtgggtactgttagcccagggtcacacagtggcacagatggcagagccgggattcaaacctgggtgtcctgaagccagagtatgtgataccacttctcacgtctaggtcctgaacagcagtgggagtctggcttggcgttacgagtttgtattcttctctggaaatcagccagtacaggagaagattcaggaaggggcatgtgggtactcacttgggcagagatagcgactgagtacaggtctcttaagtctctgaccctcatcagcctcccatggcagctccaaccatttactctgtcactttcccctctgctggggctcttgagagcac

SEQ ID NO: 182099 - DNA, 614 bp, Homo sapiens
acatggtcactggctctgatcctgattcatagcacctcagatccagagcctacaagcacgactgggcttccaaataggaattcctaataaatagaaatttggcccagtttatcttagcagctcaggtcaaaagtcaaatgttggctttcctaggggtgtgttcctctttggtgaagtgttggctttgatccttctgctgagcctggattttgggacagagatatatatatctcctagtagagatctttcatctctttggttaagtgtatttctaggtattttattttttgtagttattgtaaaatgggttgaggtcttgatttgattctcagcttggtcgttttttgtgtatagcagtgctactgatttgtgtaaactgatttggtaaattgagactttactgaattcatttatcattggcagagagagtttgacatcgtcttttccaacttgggttccctttatttctttcatttgcctgattgccctggctaggacttccagtactacgtttagcagaagtggtgaaagtgagcatccttgtcttgttccagttcttagggggaattctttcaacttttccccattcagtatgatgttggctgtgggtttgt

SEQ ID NO: 182100 - DNA, 247 bp, Homo sapiens
tctgcatcactgatgaggaatcacaggcccagagaggcttaaataatatgactcatccagtggcaggactgggattccaggttggtgttttcttggggtgatctggcaggactcaccgtcctcactggtctgagttgccccttcactctcagaattgtccccacatccgagtcctgaataatcaacctcagttcttgatctcaggtttccactcgtctcccctcgtgcccatgctcagcccctcaag

SEQ ID NO: 182101 - DNA, 307 bp, Homo sapiens
aagaaacacagaacagggaaattgataaaataatattttaacccatatttatttgtaatttcagcatggctaatgatagatcagatcagaaattgaaaagaaaatggaggcaaagggtgtttctttgaaaggactgaagagaaagttcaaataacgaatatgaagaatggccaagaatgggctgagtccccgggaggcagatgctgaggtggcctttgtatcacaagaggctcactggtgaggaatgcccctgaacagcagcaaggggaggaggccgggaggcctcagggaggctctggagatgacc

SEQ ID NO: 182102 - DNA, 180 bp, Homo sapiens
tatatataagaaagaactttacagcattgctgaaatggatgattatgagtttagttgggtctggaggtaagagatattaaaaatgtgtaaagaacttgggggaagagttctagggactgaggagatgagaagggcaagtaacagattcagtgagtcaagaagtaggttgaggaaaagagg

SEQ ID NO: 182103 - DNA, 268 bp, Homo sapiens
catcaaccgtagtatgtagtgggctgtaccatctaggtttgtggaaatgcactccatgatggttgcagaatgacgaaatcacccaaggacatatttctcagcaggtactcctgttgttaagcaacatatgactaatcagaatgtgacttttcctcacatgcatttgttcttcactttttgggagtcacagcccctttaagaagagtaatgaaaacaatggatgctctcctttattaaatgagctttcaaaaaaaaaaaaaaaacccct

SEQ ID NO: 182104 - DNA, 205 bp, Homo sapiens
aaaagagcatacaaattcaaactctactcttgctcttcacatttacgatggagacccagaaactccaagttacttgctcaggcctcaggcaggactagatctcagatctgagttctgggccagtatttctccaacacaatgttgcttacttcagacctctgtctatgatctattagctctccctttagctaggacagattaaagg

SEQ ID NO: 182105 - DNA, 391 bp, Homo sapiens
gtaagatctctttgccacacatcgagaggcaaaatggcaacgtttgactggtatatgaccttctaggaacatgaggctggtaagggaagattgcctcaagtgagcatgtgtacacttccaataaacacactgcccctgctcactttccaagcgctggcaagtcactgtgcatgtggacagcctaccccaagggaagaatcaggggataagactgatccctgaagaatcaagggatgcaagactccagaagtgtgccaatgtataaaaccctaagtcaaaggtcaaaccgtgcacttgatctctaaagttacctgcttggccatcttccaagtgtactttccttttgttccagatctaaagctttttaataaactttcactcctcctttaaa

SEQ ID NO: 182106 - DNA, 227 bp, Homo sapiens
gattacagatgtgagccaccatgcccagctaattcactttctagtgtactgaaacctaacagacaggtaggtgatcatagaatctcagatgttactgagaacttcttaaatccaaagtctcagcatatagcctcaaatacaacccacgcaaagctgacgtgcatctccagtcacctgcatgtgatcacattcaaaagaaacatcaggctggcatttaaaagggaact

SEQ ID NO: 182107 - DNA, 590 bp, Homo sapiens
ttgttccaggtactgttctaaatgctttatacatggattatctgataatctatttaatccctacaacaaacctaagcaggatgtgctattatcactatttttacagatgagtgcttgtgttggatcttccactatgtcactggaaaagtttacaggaatcataacctctctaggacttaggaaattaacacctataaaattttacttctagcatttattttatgcctgctgttttgccttacctactatgaattcctacaggaaggggcggtattcatcttggtattagacacatacatgtactaggtttacagttgttaaaagagaaaatgtcagtagggaggctgaactagaaaaacaagccactgaggtttctcacatttccatcacattctcaaaaaaaaaaaaaagaaaagaaaaaaaagtgtcaggagacccagtagaaggaatagactggaaatgaggaatttgaggtctgcccccagctctactgattggcaatttggccttaggcaactcacagatttctctctaagattctcaaccagtccaatagaaattatagtacctgcccttgattcagcagatta

SEQ ID NO: 182108 - DNA, 324 bp, Homo sapiens
taagtgaatgaacggatgtctagcaattgtagtcaacccactcttccacatcttcttggcagtggttcaataaaaccttgaaagatgcttgttttttctgttcttcctaattctcgtgtgctcctactatacacaaaaaacagaggggaagagcagggagatgaaggcagatctgcccaaggcacgatcccctggacacagtggccagctcagccctcactgtggccccctgcccaaggtggtgtcagctcggggtgaaagaaattcgccgtcacccaagtggactgtctcccagtccccagtccttggctgaggaaataaaca

SEQ ID NO: 182109 - DNA, 855 bp, Homo sapiens
agaaggaaaaaacctagagaatgcacccttttaggcatttttgtgatagaaatcataattttaaggatttataaatttaaccataacaacaccctacgacccctataaatggcaaccgctactactatttcatgactcttttcaagtgtacatgagaagttcagaatatgaaagtaatattcaaaatctttatcacagtttatttgaagaaaaattatagtataaatacaacattgctcttcaacctaagctcacaactattggtatgagtatcatttccagaaacctaaaagagctttcctgaaatcccaacatcccgtcagctccacctagtcttccatagttcattaaaaacaagcagcatttctttcatgcctcatcattaatgataaagcaaatgagtcaactgtacagaaacaaagaaaacatcaacaataatttactattagcatcattgcatttgtgtagcactttatacacccgctatctcatttgacctttttcatgagcttctgcagtacaaggaaatggaataattattttagagacaaggaaactccagtccataagatgtccaagaacacacggctagtaagaggttatggcaagatgtgattcaggattcgagaacttttcatctagatttttgttcatttatgcaaaactgtctctcttatctaataaaagtgtttaccaggcttaagaagtggatgatggagcttctgagatccacataaataagaagttgtctaattcaggccagatgtggtggctcatgactgtaatcccagcactttggaaggcttcaatgggaggatcgcttgagcctaggaattcaagaatagtctatgctgt

SEQ ID NO: 182110 - DNA, 1010 bp, Homo sapiens
tgtctgcaagattttagatgctttgaacatttgccataggcttcatctgctaagctatgcacttagcataagcgaagttcactctttctctctgtacttgagaatgtagctaccattcacaggtgacgccaaaggctcttcagcaactagactgttaaggcctgtggctttcttcttaaatattgataatatacgtaagccttatttcaggggcttagcattgatagtcataagtgataaccatatattgagcactaagtatgtgctaaatagtgtgctgagagggtatgatattctcaaacttattgccccccatttacaaataaaagcttggctgagagaatcaacggagactttgggaggtaaagtcgtctccactcccaacccaaccatgtcatccgaacgtggggtacatgtaccatattatgtctccctccccatacatacacagagtagtgttttcctgatttatgctttactttgatgccatcctcctgtattgaagtgtgctctaagaaaaagcatttcaaatgtagtgttgtggctgctaggaagatattaagtgatgttgtattatgtcatataaaatccgtatgatgaccttctggagagatttctttccggttcagggaaaggtgtgattctcctgtgcagtcagattcttctcgtggacacagtgagcaatataacccatcaactttcttttttctgtcggctgttagaaagccagattcaaatgcatgttttgtagtagctggaacttttatattgaactgaaaacctcagtcaaagctggcctgcatcaaacagggaattttttggctcttgtaacaggtaacagagaaggccaaaggtgggcacgggattccaagtcttccttgctaagcatcttttctctctatgtgatgtttctaaggagttacaggctaaatccctctggctccaagcctagtggaaagagaaattctcttccctcatggtacaactcactcctgtgattgggctccaag

SEQ ID NO: 182111 - DNA, 750 bp, Homo sapiens
ggcatttgtgatgtctcaatacatcctggagaatctagaaggtcacctccacacacctgcaccacaggtggcatcctataggtatttgctaaaggaagcaatgaaagggtaagataaataaccaagaggtgcccgccactgtgttcacccaattttacatactccaagttatcactagtgtcaaaatcagaagaaataactccaatgccagaaaaagccagctggctgtgcccttcaatatcctgagaatgatgggatgtgaaaaggtgtcgaatcctcaacagcagggagactgcttggatgactcccacccagaactgaaattgaaggcggagtttctgagcttagaaaggggaaagacccagcatttatgactgactccttcatccaacctctttccccaaatcagacgatttttgacatgggtatggtaacaccatacgtttgcatagagagattcatgggaagcctagctgctgtgacgtgcagcagtcagtttttaacaccatcatcagtggcgaaatgaaacattcccttgaaatcgcctttctctggatgactatttaaacagcttcacgttagcctgcctgtgcgactgaggacgtactgatgatatcctcattttccggtggaggaaagtttatgacgtcaatcccattccgaatatcaggactttaaatctctatgatgttagcacaaaatgcaagtggagccctctccaagctttcatagagccatgtattttggaag

SEQ ID NO: 182112 - DNA, 215 bp, Homo sapiens
ctatttacagttattccatcagatctattataacacccaccagtagttttttatttcacatgttcaatcatatcagaaaattcatcaatttgtttttaaattggatgcctcccttctggagtgtttctttttgttccacctgatatcaagttgtctttgggatcctgtgcagagcttcacctaaagcttctcctcaccataattttggacttctc

SEQ ID NO: 182113 - DNA, 888 bp, Homo sapiens
gtccctctatacgttaattataggaaagccttatgttctgaaagcttcaaagtttattctttctgtctcctcctctgcctgaagatacacttaagtcttgctcatctcaaaaccctttcttcacatctgctagttctctgaactgtcttattgaaaagctttgagaagttgctaaagggcagtgggtatccactgctcttcaggattctttctcttcttttttttctttttttaatagaaaccatgttgagatataactcacctaacatgcaattcacccatttaaagtgtgcaagtcaatgatttttttggaaacagagtctctactccttgcctggggcgacagcgagaattccatttaaaaaaaaaacaaagacagtgggtttagggtcaagatgtcgttggaacaaaaaaggttgggagggggagaaccagtttgggaccatttagtggtttcttggcttggggccggggccccatgggtcaatttttggtaaccccaagtggtttgggaaggcgggtgggaaaaatcgtttggagggcagagaattttaagcaagttggaggcagataagaaaggacttcttcttctattaaagatttaacaaggggccggggggtggggcacaggctgggtaatccccagcttggggcggcgccaagacggaaatacccctcgaggggggatccgaacaaagccccatgaaatggggcaaactggtctcttaaaaaaataacaattcgcccgtgtgggggtttggtcggacccttctcgggaggcaccacgggtgtcgactcggagaccagtgcagcgggtacaagccacccggaaggaattctcacaaaaaaaacgcggggctcaccacgcacacgagcaccgtgttcccc

SEQ ID NO: 182114 - DNA, 340 bp, Homo sapiens
caaaccaaaacaaaacaaacaaaaaaaacacttccctgagccataaaggaaaaggtagttttgactggaaccttgaaggatgggtaaactttcagcagataaagattgagagaagaccttccaggtagagaaagcagtgtgggcacaggcaaagatggaagaacacacgtggctgtgggaaacacagctagaagccagtgcggatagagagtaggctatgatgtgcagaggttagacactgggagagacaggtccatgagagtagcttggactaacacagggagggtttggaatcccaagctggggaacctagaaatcaggcattgcccacagagcacca

SEQ ID NO: 182115 - DNA, 434 bp, Homo sapiens
actgggccagttcagtttcaatgctgatgggcagtgttaaggtatgttgagttgcctattagtcatccatacccacgcttattaaaaatacatatccccctccacactagctttttcttttaataaaaaaaaattgaactcttccaacaaagcgccagttacttattccacagacagatgaacttagtattttgtttttgatttttcattacaagaacaaatatcttttggttattttgagtatttatgtggcatttatttggaaacagaacatgttctcgtgacaatgaaaatattttgtatatgatacaaaagaaatttaaatgttaatatgaaacttgttctagcataatatactaactatactcatttgggagttaaggttagagcatcttttgagaatgaactgaaatgaggccgggaccgagctcgaa

SEQ ID NO: 182116 - DNA, 1303 bp, Homo sapiens
  misc_feature (4)..(4): n is a, c, g, or t
  misc_feature (6)..(6): n is a, c, g, or t
  misc_feature (1303)..(1303): n is a, c, g, or t
aacngnagtgatgaagacgacctccctccagacctggccgaggcagtgggagtgaccacatctacaaccacaaacaccacaacggccgccacacaagtctccgtgccgctgccgtcccccaaggtccagaatgtcagctcgcctcacaagtcagaaggcaaaggcctgctgtcccctggggccaagagcccctctgaccgaggaggtgcctttaccctggagccgggtgatcttctgatggatttcacagaagccactcctctggcagagcccgccagcaacccccactgtgcccactctcgctgttctcctccactctctctccccatgaaggaagagaccactggagtttgcatgtaccctccaatcaaaacgaggctgataaaaacattcccggttgatacaatgaacccgtttcctgatactttcaccacagggccacagtttactgcagacttcagagacagtaaattacagtgctgtcctggcccgacttccccgctgatcccagcagcgaccctgaggcctttgacagagaccgtctccacagtgcagaccatttacaccacccggaaacctgtttctctggcagccagtgcagagacactccggcaggaactggagagagagaagatgatgaaaagactgttgatgaccgaactgtgaaattctccccttgtcacctggaagatggcatggtgccttctgtccgtcttctttcttcgggctttgtgtgctcactctagcacagcatacaagtgtgtgctctgttcgcccaggtctccatggttagttgaagccaatttctggcttgacttttatgggaaaagttattttatgtctcctaagcattagagtttttctattactctatgtagttgagacaggatttgataagtctaggaaaagaaagatgggaaaacgggattccttttcagaagtacctgtgtgtatctgttaataaccacaggggttaatatgatgtaggatcttttactatcaatttcaaccatttgattttgtatgattgaaacttgcaccgagctttgactgtttgttaaagagtcatttttaatgaaagaataattctttattgctggtttttcatttacactgataaatacacagatcttataaagtctttaacattcatttgtattcagatgtgagtagaagaactaaaaaaagaaagttacatatcactatgactgaaggtacttcagcttaatctgaaatataatttaacttgtgaactccttggatatgatattatttggaataaacagaatttatcattgaaccn

SEQ ID NO: 182117 - DNA, 424 bp, Homo sapiens
caaaatgaaattttttgtttattcagcctccaccttccccagctatccacacctaggcccaagtccttctcactcaaaggctaccaactcacccagttcttgaagccacctggacactatcaggcataatttgagctgccagtcaggcctggggtctgatgcattagccaagcatgactgctgagtccccaagtcccagccctccttcctccctcttccccattacaggagtctcaagaccagctcctgggctggtttctgctcatctgcttccgcgttggatctcctctgtggacctagaactctgcttcacaatctctcctgcgggctgggccctgggctccataaagagaatcctggacgatgactaactggccactatcactccacccgtctgtccaatgcccctgtgtttctctgccag

SEQ ID NO: 182118 - DNA, 318 bp, Homo sapiens
ttgtaaacaacagagaagtttctttcttgtgtaacacttcaggttggcaggacctcagcaaccaaggttctttccaccttgctgccctgacatttctagaacactgctacagcagaaggttgacactggaccaaaaccatgtgaggttccagccagcagaacggggaaggaacatggagcctaactaacatcttaaagcacagatccagaagtgacacaaattgccaaatcactcacattctattcataagaactcagccacatggccacacctatctcaaatgggaactggaagtcatagtgcctagctggccagcc

SEQ ID NO: 182119 - DNA, 172 bp, Homo sapiens
ctctcacatcctggacttgagaacttggtagactggacccaagaatatcactttccactcaaatctgtgacagatcactctcgtagacatggcttcaacatttcaacgtctcttttgggatcccgaagctgttgtgatctgtattctatccaagccactcttcccccgaagt

SEQ ID NO: 182120 - DNA, 402 bp, Homo sapiens
tggagaagggatcttactctgtcacccaggctggagtgcagtgtggtgcaatcatagctcacggcagtctccaactcctgggatcaagcaatcctcctgcctcagtctctctgggagctgggactacaggccagtgccatcatgtctggctatttttcaaccaagaattctatatccagtaaaactatctttcaaaaatgaatgagatccccaaaaaatatattagaaagctcttagaagaaaacacaggaggtaaatctttaatgaccctgaatttggcaatggattcttagatacaacaacaaaagtataagcaacaaaataaaaaactagataaactgaacttcattcatcaaaatgaaaaacttttgagcaccaaatgagattatcaataaagtgaaa

SEQ ID NO: 182121 - DNA, 498 bp, Homo sapiens
gagaattacagttaacagataagcaaatgtatttatgagatctatctgagagtgataggttttttgatgaaaattaaaacgaggtaatgtgataatgaagaggttaatttctgaaaggatggtaaggtaaggcatcaagagatgacatttgaacagcaacattcttaaagtgaggcaggtaagttaatatgtggaaaaaaatgctctctgtcaattttggagaaaggatgttcagagtaaagaacaactcatatgtgctgatgcagagtcattgttgactcatttcagttaaactaaagaagacactgagacaggagaggaggaagccagaagggagtgatagggaatgcaatcagagttagttaaaggctgcagcatgcagggtctttgtaagcccatgataaggggttggaattttatgctaactcattgagaacctactgaggtattttcagaagagaagtaatgaaattcatgtgtttaaagggttacttttcc

SEQ ID NO: 182122 - DNA, 291 bp, Homo sapiens
caaataagtgggtgcttagagcacaatgtgtgtggtgtgccaagagcagctgggagccctgggacccccagggaaccccagccccacctgggcatggtgggcatggctggaggaggcctgctggctttgctggagagtgggacatgcatcaaggtggccagagactgggcttctgggtgtcgtgctgtgactgctgcaaagggctcattgacatatggtggggagggccagcgtattttctgcgggcaggacatttgggggatatggggtgtgaccctgtactatctaaaa

SEQ ID NO: 182123 - DNA, 469 bp, Homo sapiens
ggtccaggcctggagggacctttctcagcaaagctcctcagagggagagggaggaagagctgggagatagcggatcctgaagggctgcggcacccgcttccttttaggagccttctacgacctgacacttgtttcaagtttgggcccttacactggagagctagccggattcacttgacaccaagagcctcacatttccaaacctctgctttgttgaaaatgtggtaggaaaggccatagggcatacaacctcaagaataaaataagaaatggagctgggacactaagagacggcttttccaggggtcactaagggggaaaggtgtttgggagagagatgtgtctgctgatggaagagtggtcacaggtgctctgtgccaagcctagggtacacagagggcaagggaaagaccattcggagggagaagcaaaggcaccaggcaacatggactggcaaggaggtaccagt

SEQ ID NO: 182124 - DNA, 289 bp, Homo sapiens
ttagccgtatttagagtacccccgcgggcactacccggtctaccttaggcacaacctgcgtcacaaccaccccaggtgatcttgtccttgtctctctctcacacacacacaccaccccagctgatcttgtcgcacacatacacacacacacaaccacaactgatcttgtctctctctcacacacacacacaccaccccagctgatcttgtgtcacacacgcacccacaaacacacatacccacaaacacacatacccaccacctcacctgatcttgtctcacacacaca

SEQ ID NO: 182125 - DNA, 138 bp, Homo sapiens
tcaaggtttcatgacctcagattctagttttaagaatctgggcagagtagtggcagcagttggggtggggtgggttatgtatagacgaagtacattaccaggaaattaactccaatctaacggtaggactcagttttg

SEQ ID NO: 182126 - DNA, 188 bp, Homo sapiens
ataaaggaagacaaaatgtagccaagaataaggctcatacaagtgaaaagtcctttacatttcttactgagaacttcaaatccagccaacattaaattttgattaattatacaagttataaaattcaaaagctagaaatccaatcattgttcaagagaatcttagccattaatgtcttaaagtacttg

SEQ ID NO: 182127 - DNA, 335 bp, Homo sapiens
tactgtttgcattaataaattacagctccatctcgatctcttctcttgtatacaagagaagagacgagatgacaatgactatgtttggctgaatgcagacaggtaatggaggctggcagtatagcctggattttagggctgatttgaagcctgtcctggggcttgccggggcatctccagttagcccaggggcccaaggcaactgtgaaccttgccttgttccagttggctttaattttttctttgaaatgttattaccatattttaaataaaaacataatgtgtccttgtcaaaagagaaaaccctgcagctgttccccatctcattcagagta

SEQ ID NO: 182128 - DNA, 1672 bp, Homo sapiens
  misc_feature (3)..(5): n is a, c, g, or t
  misc_feature (1230)..(1230): n is a, c, g, or t
ggnnngagggtgcaatttcagctcactgcaacctcagcctcctgagtagctggggggtcataggtgcatgccaccatgcccagctaattttttttctatttttagtcgagacagggttttatcacgtatgccaggctggtctcgaactcctgaccttaggtgatccacccgcctcagcctcccaaagtgcagggattacggcatgagccaccacgcctggcctattcaagaatattgagggacagaaaatatctatatatatccatcctcagaaccttaaatatacaggtcactacagtctttattattttaatttttgtttcttagggtttcttttggtggtggttttttgagatggagcatcattccgtctcccaggctgtagtgcagtggcacaatcttggctcactgcaagctccgcctcccgggttcacgccattctcctgcctcagcctcccgtcttaggtctttttgaaagaggttatgcctctgttgcctagtctggagtggtgcaatggtgtgatcttggctcactgcaacctccacctccaggtcttaagagatcctccctgctcagcctcgtgagtagctagaaccgcaggtgcatgccaccacagctaattcttgtattttttatagagagtgtttcgccatattgtccaggccgggctcaaacccctgatcttaagtgatctatctgccttagcctcccaatgtgctgggtttacaggcgtgagccactatgcccagcccctttttaattttttaaaaatgtttatttttgagatggagtttcgctcttgttgccccaactggagaccaatgacatgatctcagctcactgcaacctccgcctcccgggttcaactgattctcctccctcagcctccggaaaagctgggattacaagcatctaccatcatacctggctaattctgtatttttagtagagaaggggtttctctatgttggtcaggctggtctccacctcccgacctcaggtgatctgcctgccttggcctcccaaagtgctgagattacaggcttgagccactgtgcccggccaaatttttattatttttaaattagaggtggggtctcaccatgttgaccagtttggtctcgaacttctggcctcagtcccttgtcttggcctcccaaagtgttggggtttcaggtgttagaccccatgcccaaccactacagtttttgtttttgtttttgtttttntttcagacggagtcttgctctgtcgcccaggctggagtgcagtggcgcaatcttggctcacggcaagctccacctcccgggttcacgccattctcctgcctcagcctccccagtagctgggactaaaggtgcccgccaccatgcccggctaatttttttgtatttttagtagagacagggcttcaccatgttagccaggctggtctcaaactcctgacctcagttcatccacccgccttggccttccaaagtgctgggattacaggcatgatccactgcgcccggcctcactgccattttatagatgagaaagccaagttccagaaaagttgtgaaatagacggtgactataaaactgggactagagatagtatcctaatgcttgttgattgtttttgtccatactgattgtcaacctaccaatataatctaccatcaagtc

SEQ ID NO: 182129 - DNA, 436 bp, Homo sapiens
tcagcaagactgcagcagctgcacccagacctggggctctggtaggtactaatggtgattatgctccaatttacctaatgaatttggtgggacagcagaaaagaaagctgggaatgtaccaagagaaatttttgttcagggctgttggaagtagctgttagccttgcttccacaaggccattgctgctgtaataagaactgcaaatcagagtgctacaacataaaactgggaaatatggccctatctgaatgcctctgtcctattttccgctggtgtatcagttagtgcaggaagtaaagaatgctggaaagttgaatcagaaattgaaaaccttctaaaatcttacacagattagcagaagtcacttctcccagtctggtatattatttcataatggaccaggatcggcttcctgcctgttggtggctatctgta

SEQ ID NO: 182130 - DNA, 358 bp, Homo sapiens
gtttctccttcaggaaaataaagtcgataataggcttgcagatagacacttaagtttactggccctccctccaaggcttgcatagcacccaggacaaatgttagcgtgtaagccaggtcacaagtaacaagtgggtctttgcacaggtgggaagttaagttccaaaagccacgactactcccaagtcccaccttcaggccaacaattttcagatgacaactttgcagtgaggtatctgagaaaaatcggtgggttgccttgtatgttatactcagataggaatgttaacatctgctttagaagctggatgtcacagaggacatatattttttatttatttaatttaatttatttattt

SEQ ID NO: 182131 - DNA, 241 bp, Homo sapiens
ttttggcacccaacattacttagtattgcacatcaatggcagtttctctgaaacttttctcaatttcttactgaaatactgctacactttggtgattttaaaactccaatatgtacttcatgtcaaattatatcaatgcaatgaagttagacacattcatcaaaagttttaagaatatcaacacagtaaagataagtcatgaatttaaatttgtgattaaatattatcagaggagccaaat

SEQ ID NO: 182132 - DNA, 454 bp, Homo sapiens
ccttactgtatttgtagccagaattgggaaagatgttaacagtgtttcacatagcttcatactccataagtcagtttatccaagtattacttcttggctagcattctgtctgttaccactttctgaatcctattgttccttcaagtactactgaatagcatactctggtatattggacattactgaaaaagaaggattccgtagatagacatttttaaaataggagcttctttttagtaattatctatggtaatgagagcttgtataggaatgcaaacttctagtgagtggaatttttttccccatacattctagctcattgagaaggaattttgttaattgagagaatatacttttgtaatagtttttattgcttctttctctcctaaaatttgaacactgctgcctcatgctgtaacaaaagagttgtcagatgaatcaatgatcaacgact

SEQ ID NO: 182133 - DNA, 225 bp, Homo sapiens
agtctttaacccttttgaggatgtaatgaaaactgtgaactctctacttggaaaaaatatatataagaacacctacaaaattcacatttattttcttagtttacagactctctgaattcaaaacccatgtattaaaagatggaagtgttcagggggtaaaagggaaatctaggaagaatcgacttaatagagccaggaggcaagaaagcacaggctgtgtccata

SEQ ID NO: 182134 - DNA, 111 bp, Homo sapiens
tgcccacccctctaaccaagtaactggatgtagggagagttagtagctcaagttcgaatcagcttccttagcgggctgttgaagagcctctgttgggagagtgatgtcagc

SEQ ID NO: 182135 - DNA, 233 bp, Homo sapiens
acagccaggaaaaagagactcaagctgcaatagggtctgtggcctgtgcttttttccagagttttgaggactttggtatttaaaggggaaagagggcctgggtacggtggctcacagcactttgggaggccaagccaggtggatcacctgaggtcaggagttcgagactggcctgggcagcataacaaaaccccatctctactaaaaatacaaaaaattagccaggtgtggtg

SEQ ID NO: 182136 - DNA, 495 bp, Homo sapiens
actgttcctagaggatccggtattggtggcatgtgacttcactgagtaggtgtctttgtatgtctgaaatccagcgagtgtgtgggactgcccgtgtcagttacatgtgtgcatgtggagacgtagatgttctggagccatgttgtcgctttgtgagtgctgagtggctccgctgtgctcccgtgctgtctcaagagtgtggaccagaatggcccaacgctgggccatgtgtctcccatcgcgtgggtgctcctctctaactgtgtctgtgcatggctgtcggccggtgtcggtgtgtgtgcctgtgttgagtaaatgaggccagagggcagcttagcagaagacctagggcccaggtcacatattctcctggaaaagggatcatggaaggacagtgaccagaaggacagaacaggggaggagagggcccggccccttgaactttggtctctggtattctccctccctgcatcagcccagatgggaaagtcaggc

SEQ ID NO: 182137 - DNA, 544 bp, Homo sapiens
tgggcgtggctgccagctgtggtaaatgaggcaggtctgttcacaggcctcatatcagcgtgctcaagtgcctgttgcagtaggccaggtaggcctgttatcaggcctcttgatggttgcacaggcaccaggagtggtggacagggatgggttgatacccattctccctggcagtgcacttgggctctggtggctgtgctagtagtcggagtagggtaggcctttcctcaggccccccgatagctcctgcagcctctggctgcagcagacaaggcggtctgatccccacgtcctcgtattgtgcatttacacagtggtggcgggtggggtaggcctgtcttcaggcttccagatggcgcttgtgggcaccagtggcagtcagagtggatctatctgtaagccctgggacaaccccccagtgggccactcctcaggcctcctgaagccacatgcaagtgcatgacgacgctggtgctgggcagggtttgaaacacacagaaactgtgggacagggtttctgccagtgacagaggccccaggcagg

SEQ ID NO: 182138 - DNA, 417 bp, Homo sapiens
tgtgtgaaatgttataggaggtagattcagcaggactcctgtttggtttcagtttgatttttggttgtggttgggaggaaggaggaggaattgaggatgttcggggtcactagttagatggtgcggccattcagagcaagagagggaatacaggaagaggaacaaatttgaaggattaagcaatgttataatttcttcaccaatttgtcatcaactgggaaatgttacaccaattattttaactctcttgggaaagaaatgtatgtagtactgaatattgaaaaaagacttgaagtagctggaggagtaatcggaggcctcttgattgggaccgtgattgggaccactagtgatgatttattataatttaagaagtcagttaaagcaggggattctaaaaatgattaacgtcaaata

SEQ ID NO: 182139 - DNA, 399 bp, Homo sapiens
accaatgataaggcaggaggtcttgggaagagataaagaggtagcaaagggtcgccacgacccaccagaatccacagcccacttatgcactcatgacgccattgggacttacccagcatacgtttgttccatgtcgctgacatcccagccggggctaataaaccttaaggcaaacatcagcatgtctgggagaagagcctggcgctgagctggatcgtctagtcataaatgcctcatccagaaaccataaaactcaagtcaccatgtagtaagataaatagaagtctagaaagagcccatgtcagataaaggtaagtttggaaggcgaccaagccttgcttatgacaggagtggagagaggagccatctctaagttgggaacatcctgcagggaaacat

SEQ ID NO: 182140 - DNA, 681 bp, Homo sapiens
ctcaggcagtttggttctagaatatgtactctcttgaactttgtatttatttaacctttaggaacattaccaaaattaaccaccctgatggtgtagttatatggcttagtggaatgttggctgggacacctggagttcaaagataagtcctggatttataggcttagcaactaattcaaatcagccaacctcaaaagagctgagcttatcacacagaaagaccatttaatagtttccagtgggtggtcttttcctttcctgtgactggaatgagcagtggttaatagtatgggcattagcctgtattattttagccctagatttgaattaagatctaccacttactagctctgtaaccttggccaatatatttatcctcagtttccccatgtataaaatgaaggtaatagtcccatttcattaaattgtcatgacttaactcatataaaatgcttattatggggctagaatcataggtgacctttaataagtagttattaattaaagatcatgggaacacaatctgtttctgttatcctggtatctggaaaatcacataaataatcaatagatagaaagtcatatctgataaaaaagagttgctattcttatggaacattttattcaagcttggctaagtattcttccttctttcatcactgtgtctaccacattaggtac

SEQ ID NO: 182141 - DNA, 368 bp, Homo sapiens
aaatgaaatcatatatgactaagagcaaagtcaattaaaatactgtgtaatggtaaaaactgtgataaaccaactgagttatgagcatactcatgacttccacaactcatcccatgcttcctgtgtgcccatttggaagctcctactctattctaggttaaagggaaaaaatatttatgttattgttttatcgatatttaagttattatttttgaaaagtagaaacagaagccttatagcctttaacgtatatatcctgaaacaccttctggggcacctcgttgttcatcctcttccagactcttagtaacccaccataaggatctcagtttaaaaatctgaagaatgattcttctctgaggtcaagg

SEQ ID NO: 182142 - DNA, 168 bp, Homo sapiens
gttggtagtgttttttttttctttcagccctttgaatgtattatcccactctctcctggtctgcaaggtttcttctaagaaatcccttgtaatgttatggggattccctttatgtggtgagttgcttttctcttgctgcttacaaaattctccttgtcattgactttt

SEQ ID NO: 182143 - DNA, 756 bp, Homo sapiens
cgacctccagagctcgagctggctccattcatcacccacttttagtatcattttctggttatcaagaaatgagtagaagttttttttgagaccgagtctcactgtgacccccaggctggtacaatggctcgatctcagctcattgcaacctccacctcccgggttcaagctattctcctgctccagcctcccaagtagctgggactataggcgcccgccaccacgcccggctaatttttgtatttttagtagagacagggtttcaccatgttggccaggctggtcttgaactcctgacctcaagtgatctgcctgcctcggccttccaaagtgctgggattacaggtgcgagccactgcgcccacccagaatttttttaataactgaaagaaagaaggagattaaggaagatggagacaaatatgcaggagaaacaccctctgagggcgatttaacagagcagcgaatgtggaaaggggaaggggaggtgcttcttgggtgcccagtttccttgggaggaacttgggtacgtggtcaggggttgtgggcagttattcccctcgctggccctcagggggctcacaggccaagagcagcttggttgtcgtacatgggttaggggaagacgggagagttagggtgcatgataagatagagaggcaatgtgcaactggatatttctatgtacttggcctttcaaaattcaaaatttgttaactcatgaatacttgtatactgacataatgtacagatgcc

SEQ ID NO: 182144 - DNA, 527 bp, Homo sapiens
gcctgcctcctctccctaccccacgaatgttcacatcctaattcttagaacgtgtgaatatggtgaatatgttgaatatgttacctaacatggtcaagaggtactttacagatattagtaattaaggaccttgagataggcacaatcatctagattactcaggtaagcccaaagtggccaccagggtccctgtaagaggaaggtaggagggttaagagacagcagataaagagcagagactagagtgatgcactttgaagatgaaagaaggtcatgagttaaggaatgctggtggcctctagaagctagaaaaggtaaggaaatgggttctcccctagagcttcccagatgaaatgactgccaacaccttaattttaccacagtaagaccaatttcagacttctgacttgtggaactgcaagactgtaaatatctgtcatcttaagctactaagtttacagtaatttgttacatcagcaataggacactaatacatttgcctttcacctttttcttattcatttgtg

SEQ ID NO: 182145 - DNA, 351 bp, Homo sapiens
ccccttattttacatctgaggctgctgaggatcagagaggttaagtgagatgcacagagccaagttcagccaagttcattgaggaatgctgaatcctgtataagtgtatttccactattctaagcaattctgctatcctgagagaaaaggaggcaaattctaagataggaagaaaagaataaaagaactaaggtgaatgagaatagatgataatacatatatttgtcagcagattgcatgttgatttttggttcccatttaccagtactcacttctcctcacctctatctgctttaacatccctttcttgtcaatgttataagaatatgtggaatggcgtgaacccgggag

SEQ ID NO: 182146 - DNA, 742 bp, Homo sapiens
aaaaaaaaaaaaaagggatcctatggaatacttaaagaaagaaaagaggggggtgggggaagggagagagggatcaagagaggcagagagaaaaagggagaggattttggtagtcaaatttgagaaagtttgcattccactcttgagaatgtcacattctattaactgttcgaagtttccaaaaagtccaggagtgaaaataaagctgcttaatcatttttcccaaacttggacatgagccctttgttttttttccataatgtatgtaatatgtatgagaatactcggccaggcgaggtggctcacgcctgtagtcccagcactttgggaggccagggcaggcaaatcacctgaggtcaggagttcaacaccagcctggccaacatggtgaaaccccgtctctactacaaacacaaaaactaaccgggcgtggtggcgcacacctgtagtcgcaggtactccagaggctgaggcaggagaatcgcttgaacctgggaggtgaaggttgcagtgagccaacattgcataactgcactccagcctggcaacagagcaagactccatctcaaaaaaaaaaaaaagaagagaccataaccaactgaacaaccatagaacaaattaaaatacaatgagggggctatttataatagacacaatggtagtttcctgtataaaagcaacaagcaattagacattgttttttattcacttcataagaacaattttttttgggcggggaggg

SEQ ID NO: 182147 - DNA, 348 bp, Homo sapiens
cgagtgtggatggttttaaccagttctctcgatttgcctccctgtgaggtgtgagttgttgccatcattaacccaggcctatctgcttttggggttcagagttggaaccatctgcagggagtgtagatagaatcatggggggggacagagcacaccctagtggagcctgccaagactcctcattgagcccagaaaactgagatacaggttagaattggccatttcatcgcagtgtttatttcatgttttctcatctcacaggtgagttttctagaggaaagatgatgaagtaaaattttacaacaatttttgaatacttttcctaactgtcaaatctccgtctggatc

SEQ ID NO: 182148 - DNA, 217 bp, Homo sapiens
cggattccagtctcctgtatgttgcatctgagacggtcataatttctataatgattctactttgtaattctatttcttgtctaaagtctgccagttcatatttcacttccttttgttctcttcctgtttccccttgaagaaggcacataccttcttatgtttctgctttgtattcatcttccacagtggcaaaggattatcttttaatgtgacacgt

SEQ ID NO: 182149 - DNA, 804 bp, Homo sapiens
gacaagacagaccacgcagtgatgagaaatacaaatcagaaagaaatgagcacatcttaaataaaaataagaatactaaaaaatactgaagaaatatgcaaggtaactttggaaataaaggctaattttattataaggtgaccaaagaagaagcagtatgactaaaatttctactgaggacagactctagaaaattaaaaaacaaagaaaatgaataaaataaacataactaaagaaatgcatatcaaagcataataacgaaaaagattaatagctaactacataaacataaaacctttcatttggcaaaaaaaatcctataagcaaggttaaaagacaaatgacaaactgggaaaaaatatttgcgaatttaccagcgttaaaggactaatctccttaacatataaagtttctaaaagtgaagaaaacgaccagctgagcagcaaaatgagcaaaagactatataaaactataaacagctctacaagaaaaaatgtccattatcattcataattgaggtaagctcaaaaattgtaactatagtaaaataccatttctcaattggcaaataagtaaacatccacatttaacaacacattctgtttggaaagttttaagaaaagagatactgttgtaaactgctggtgggaatgcaaaatgttatttttctgtgaaggaggatttggcagtatctagcaaaattacacatgcatctaccatttgatgcaacaatcccacttctaacaatttatcttaatgatactttacatatgtacggaataatgcatgaactataagaggatt

SEQ ID NO: 182150 - DNA, 328 bp, Homo sapiens
agaggccaacagtgacagtggaactctcaccacaacgaaatgccaaaaacccagagtacccaagtatcagccagtgatggtccccacactgaatgctgaaactgcaggggaggcaatggtgaaccccaaaggccaagttaggggccactgaacaatgtgactttggcatctcagggtcagcacagtaagggacttttcacgaccaagtgtcctgccttaaacagttcttgactctgtcctgtcctgtcctgtgttatatcatgtcctgtcccatcttgtcttgtctttgtggtcaccagatgatgcaaggaaggacaaccccaaaatt

SEQ ID NO: 182151 - DNA, 343 bp, Homo sapiens
ctctacatctttgcgtatacaggggcatagcatagtcatgcaaaaccgtcttccttcaactcatagttctctccttcctcaaccagaagccactctgctttgttgtgaaaacaaataaactactttcttacaaaagaaagaccaaataacctgaaaagctcaaataaaatccaccttatgatacaatattaagaaacagaaattttcaatggagaaaatcccacaccagactgaggaagacagatcagtttaactggagtctctgtttgttttatatttcttttctactctccactcccatttgccaacaaaactatgctctctcacaggggacaggttcacc

SEQ ID NO: 182152 - DNA, 319 bp, Homo sapiens
gagaagcagcccaatcagtcttcaaaaggataagaactggtagcaccaggtacatttctagaactagggcaaggggtgggacaggagagaaggtcgctaaaacaagaaagtaaaaactgataagcagttaaatcattagatcttctctacactagcagaaatattcagtttcctctcaggaaagggtaaaattcagaacttggactggaagacaacagacacagtcaacagtatcaaagatataggactatgtacacattagaatgctaaatgtagagcctcctctacatttaaaggaacaccagaagccagatcttta

SEQ ID NO: 182153 - DNA, 402 bp, Homo sapiens
ttacttaagaataaactatgacaattaaagttgcatactataaattctaactcactaaaataacaaaacagtgtgatagctaaaaacccaacaaaagacataaagtagaatcataaaaaattctcaactaatcaaaaggaaggaagacaaacagagacattttaaaaagaaacaaagaagatgagactaaaagaaagcaaagacaacggactataacctaactcgttttatcaataatcacattacatgtaaacggtttatacatccccaattatgagacagaaatagactgatgaaaacaagcaagatccaaattttgctgcctgtaagaaataatactttagatataaagatgcaaataggttaaaagtaaaaggatggaataagatataccatgcatgt

SEQ ID NO: 182154 - DNA, 471 bp, Homo sapiens
gttcacctttacactgagggtgtccagctttatgagggaacctactagatttctcatttcctgttgcccatactttgtgtaatcactaaaatagaaggttatggtctgctgaatttggcaaaaattctgaggaaaagctggctttggcagttacttcctaggattccagcttttgcttcattttgaagagccgtaggttccttactttcgtgcctgctcagcaatatgtttaaaagtattttttataaatatatttacccagtatcttggttgcttctgctgaaaggacttttcagaattatctaatccagcatactgccaaaaacagagccctgaattagtttcaaatacgcacaccaacgcactccccctgccccgattctgccaacgcgtgaactgtaagaccaaagctaagcctgcctttaaggtggaaggaaaagaagaattgaggtgagccaggcatggtggctc

SEQ ID NO: 182155 - DNA, 494 bp, Homo sapiens
gacaacagtgagaccccacctcttaaaaaaaaatagcctacatttgaatgcagtctttttctattgcacgttttattcaatgcaatttttttttcatggtggtaaaaaaaaaaaaaaaatagtgcctatgtaataggaactacctataattccctcagaagctacttgtggatttacaaatcaagtgttttagccgcagctctatcccagtgttactgaactaatcacctctgtcccccaaaccccagtttctctgtctgtaagattgtgtagtcaagtaaaatttaaactctttgtgctactgaatccaataaagaatgaaattcacctagccttgtaactgctgttgtgctgacaaatgagcccagctggtaaaattcttattggcagagatttctatttttccttttaatctggaaaattccacaagacctcacaaaatgcgcgagtgagaagataagaagagggaatcactgtgacatctgtcctctttt

SEQ ID NO: 182156 - DNA, 628 bp, Homo sapiens
tggctactcagtgtgctgttttcaaacttttggcaaataaaaggagtttcatgtcatgtctatttgaaaccctctaatggcttttttttgttgttttttgagatggagtctcactctgccacccaagctggagtgcagtggtgcaatctcagcttactgcagcctccacctcctgggttcaagcgattctcctgcttcagcctcccaagtagctgggattacaggcacatgccaccacgcccagctaattttttgtattttcagtagagacagggtttcaccatgttgcccaggctggtcttgaactcctgacctcaagtgatccacccaccttggcctcccaaagtgctaggattacaggcgtgagccaccacgcccagcccctctaatggcttctgaatacacttagaataaccatgggctccgagacctaggatagggccatggcccgggccagcctccctgcctcatgccatacttctttattccttgcttactatgtttggtcagccatactggcctttctagtcctggacctagtcattctagtccccacctcagggcctttgtaattcttgtctcaagcactgttcccccagtttctgagtagctggctgctgcttctcct

SEQ ID NO: 182157 - DNA, 155 bp, Homo sapiens
cagcttgcaggagcagagagtcttttttgcttctccaggaaccaagtcctgttctcccgtcttgcctgctctctgctgccctctggaggtctgcagtggagtcaggcagggagctgattcagggacgccacagattatgtatcctccacttccta

SEQ ID NO: 182158 - DNA, 718 bp, Homo sapiens
ggggcgggtgtgggtgtaggtgcagtagagatgggaacaaagtagccttgtttgaggcattcttctcttgccacttgcctttcagcatctgcattactaattccacaccttatttttccttctccaaaataatcactgtctgctcacagcatcgagtaaaaagatacattgtcatggtatatacctggagaaaccagttgattctttgttgaaccatttcttttaatttctgtaaataagtaattttatggtcacattgtaaagcagagaaactgttgatattttacctttatttagatttttgttttaacttgacctttttcctttggaaagcgttgaacttgtttagctaactactcctattaggggagcttaacttgggtaaagtcaaaggcccactggctgtttctcatggtggcctgaagccccgctgctttccagtgaggaaaagaaccctcagcacgttactgagctttcctcaggtatttttttctctgtcacctactttacaaatacagtcagactaaaacattaaacaagaagtttaagggggaataacattgggatttgaaaagttgtatgtgattaatttcttgcatgcaaatcaatttaagatttcttaaatatcttcatgcttttcttggctggaacttgggtaaattaacctgtaattatgaattatttagtttaactcaaggtgcatttttatttcacagat

SEQ ID NO: 182159 - DNA, 686 bp, Homo sapiens
agatttcctatctcaaaaggtagaaatcagaaggaaagtaggactgataggtcccaaataagtttaaaacttagcaaggcaaatccccttaggtcttaagacttgaaaataatccttcttggtttgatgctctgctctccagatgcacttgagtggcagcgtcaccctcattgcttcatgtggtggccctgccccttcagctcagtggagtgccatccacagggctctctgcaagagccctgcccacacaactctgcttgccagtggtcctagcctttgaaactgaagtgaagacagcctgctccctgatcgccacccatggtgggtgtgatgagagtagaagccctgatgatcatcactgaattgcctttggggggatccttcttcccctttcttgaaggataatgcgtagtcacagtcttcctttattccatttcattttctctgtttcccttagtcctagctggcagtatttctgtttgcataatcccttctctatcctggcttctattgagatggctgattaggcctgtggttcacaccaacactaccctccttatatggtcagtcagccacactgttggtgttcccttccaaacatgctttctcattttttgcaatatgcacaggcagagaatgttccaagtaagttctggttcccttttgcttaactattccttctgcaa

SEQ ID NO: 182160 - DNA, 740 bp, Homo sapiens
tgtcgattagaggatcccccgtggtgtgtcatgcagaagacactgctgatctggaggctcagaatcacttgtctataccacttgtctggaggaattggatcttgtgccactcacgtcccatgaggaccatgacttcttccagcatgtggaaatgcacctgcggtctgaacatccccctctctgtgggcgggaccacctcagctttcgctcctactacttccctgtgacgaatgtgattgatggagacctctgtgagcagttcaattccatggaacccaacaaacaaaggaacgtctctgaagaactggaccgaaccccacccgaagtgtccaagaaactcgaggatatccggacccgctacgccttctgagccctcctttcccggtggggcttgccagagactgtgtgttttgtttcccccaccaccatcactgtcacctggcttctgccatgtggcaggagggtgactcagtcttcctttattccatttcattttctctgtttcccttagtcctagctggcagtatttctgtttgcataatcccttctctatcctggcttctattgagatggctgattaggcctgtggttcacaccaacactaccctccttatatggtcagtcagccacactgttggtgttcccttccaaacatgctttctcattttttgcaatatgcacaggcagagaatgttccaagtaagttctggttcccttttgcttaactattccttctgcaa

SEQ ID NO: 182161 - DNA, 165 bp, Homo sapiens
atttaataatacaatttctaagacattcctaggaaataaggatgtaccctaaaatttagcaatacagattttttgtggatgagttgttaataataacaaaatatataactaagtaataactaaagaaactaacctatgttgagcacttcctaagttccctgcctt

SEQ ID NO: 182162 - DNA, 503 bp, Homo sapiens
gaagcctcctggctgtgtcagtgaatgtttacatgagccttttaaaagaggggaaaggtggggactgtatttagaaaaaaagtttttttgaactgagtttggatgttgatggtgataattacgtaggctgctcaacaccctgaaatattttgcctgcctgtctgagaaagcaaagttacgtctcagtcttttcaaaatgctgatcagattatgctttcagttgttaattggtgctgtttagcacatatttcatcatcagtctcactgactcaaaagcctgtgatgcactgacaacggtgtcagtgtaagaagacagccttggtaagcaccaggaggcctcatctttatagttttctgcatctagcaaattgtatacgattatttaaatagcgatagttctgacaccgtctatgtagatggcaatattgcagccttaatttgccctaacattttactgttgccaaagtgttatcacaatattatcatatctaattttacaaaaa

SEQ ID NO: 182163 - DNA, 532 bp, Homo sapiens
tctgtgatattctaatttcccacttttttcatattgtttgttttccacagtggactttgaggacagatctatcccagagtcctccactaaaaccaagaagatacatatatacttataaatgtagttaatttcttggaaacattgaagatttatatgttctagaaatcagaaggtgaaaaggaagagattgagatagaccagtgttttatccatgacaattccacctgctttctcagggaaggctttggactgctagcagacatgactcctgaaaagaaggcgaagcacctggaatatctcatatgcctattcgatcatttccaaactaaatgaagcaagtaaaacttttaaaaaaacaaagcttaggccgggagtggtggctcatacctaatccagcattttgagaggccaaggcatgaggatcacttgagaccaggagctcgagaccagactgggcaacatggtgagatcccctctctattaaaaatcatcatcatcatcatcatcattaaactagaaaaaaataaaactg

SEQ ID NO: 182164 - DNA, 139 bp, Homo sapiens
atagtggtgtgtgcctacagtcccagctaacctggaaggctcaggtgggagggtcactagagcctggaaagccatggctcaatgagctataatcatgccactgtgttccagcctgggcaacagactgagatcctgcctc

SEQ ID NO: 182165 - DNA, 324 bp, Homo sapiens
attatcttcagccagaaaaagagaaaagtgtatgtatcatatagtggttttcttttttggagaaatactatttgagatgtctttagtatttaggtaggatttcttattctctggcagcaacacaatactgatgataattgaattagtttgtatagcatgtcattatttttgtaaattttatttaagagattccttcaatatttaatgaataggtttgtttccttacagcagctctttttggatagataatatgttcttttcttcatagtagctctttttggatttcctgtgcattaagatgaatttaaaagaaatgctttatcg

SEQ ID NO: 182166 - DNA, 461 bp, Homo sapiens
gttttttcctaatacgtaatatctttcatttcatttttctgtattattttgctagatagattctttggaggttaattgaagccattatggtgggcatccttttcctttcatcctaactttaatgaaaatgatcctgtattttgctgttggatatggagttttctataggctggtggtagttgtgagttatgttgatttgtttattgttttcgttgttgtttttagattaaagaagttctatttctagtttgctaagaggttgtagggatgtgtgtgtgtgtgaatgctttcacttgcatctgtatagatgatcatatgggttttttttaatctattggtgtggtaaattacattcatagattttcagttgataaaacattgattatgagattaacgcaaattcagcgtatttttttaattactggatttgaattgtaatgattttatttagaattttggca

SEQ ID NO: 182167 - DNA, 547 bp, Homo sapiens
tcagccctcaacctcctcagaggcgccaatgctgactgctgtcagccagcccagaccctttctccatatgctgcccgggacgtggactctgtgactgtgaggcctgcccggctgctttctgcttcccagctctgacaacctcgccatgaaccctcctagaccctcagctcctgcaataggaagctggctgccaaaggccaggagggtccctgaaaacagacactgcattaaagaaaaagctcctggaggactcctgaagcctgaggcagccttggggcagcagtggctcatggtttacattggaaaggtaagggaggtttctggtttcctgttttataaatttatgtttttacttggtattttgacaaacatttgtatttgaagcacactaaacatctagtattgccgttttctacttggctttagcaaacaagcattaagtgaataaactgttccactttcttccttcccaggtttatcatgagtaaccgggtgctttgcttctgtgattcttggccagtgtcggtctgtttcctttgccattgag

SEQ ID NO: 182168 - DNA, 638 bp, Homo sapiens
gactaaccatagcaagatatcaaggattttgagtagctatgccgtctcctgaatacaagcatctcttcttaatttctcccgtttgagaaacagaacatcctgtgtttgtaagtttataatccaacccatcttttacttgctcagacctccactaacaggctgaacaaggtgcagactttacttttagaaaataaaacaaaacaaaaaaacacaaaaaaacccaatttctgctaaaagtagatttcatcttgctgacgattcttaagtaacttaaactgtccctctacagttcatctttgatacctcctactcatcgctattatcttgagttttactagcaatgaattctagcacacaagaaaaaaaaatcagaaatgcacccttcgtttactaattacaaaatcaacagacctcagaaagacgggacattcacttctatgcactcccctcaattcaggggtggaattgggttgcatttttgtatctgtgagtctcagcgtgtgtaaactcatgtcctcacagatgcctgaggttttctgctagcccagctgatcttgaccaggaatttatttaatgtaactgagtaagtatgaagtcttatcagggctattggagaaaactggtagataaatgttttt

SEQ ID NO: 182169 - DNA, 456 bp, Homo sapiens
cctcagcctcctgagtagctgggattacagctatgcaccaccacacctggctaatttttgtatttttagtagagctgcggtttcaccatgttggccaggctggtcttgaacacctgacctcaagtgatctgcctgccttggcctcccaaagtgctaggattacaggcatgagccaccacgtctggccatcagcatctttaaaagaaagggtatacaaagcacggagtgccagagcctgcaccccagtttccttattgtctttctcctggcactaaggcagcagtgacaggccaaattgtccatgatgcatttatcaggaggtaagtgtttcaaatactgtttggagggatttcaggggaaacattttcagggacttgacttgcaggaatgatttatgaagaaatatgaaaagagctaaatatatatgggctggcaagtatgaaaagagcaagaaag

SEQ ID NO: 182170 - DNA, 423 bp, Homo sapiens
tacaggatagaataggacttgagactaactcctaactcttagcagttacactggatgacattagagcgaatggttctttatgtctacattttcttcatctgttagatgtaataatttccatatcaactatgatgtaaagtggtaattccaatgaaatgttacatgtgggaagtctttgaaatgtaaaaaaaacactgcagatactgaagcagttcagagaattaaaaaacactatgaaaacacagcttggtaaataatttttttttcttttgagacagagtctggttctgtcatccaggctagaatgtagtggcacaatcttggctcactgcaacctccgcctcccgggctcaagcagttctcctgcctcagcctcctgagtagctgggatagccaccatgtccacttaatttttgtactttt

SEQ ID NO: 182171 - DNA, 520 bp, Homo sapiens
tcctcgacctgaataactcttctccatccacatcctgttttccaattctccttccaaatgcagcccaggaaggagcccactgtacttgccgggcagcctgtgcttctcactgctagagcactcatcgctgtataggaattgactttcccatcaccccactacactgaaactccttgggagcagggactgtgttttaatctacttttctttctccattttattcagcagcattagacatagttgaccactctgtccttcatggagctcgtttttctctaggcttccatgacaccatgttctcctgggttacctcctacttcactgactgttcctttttaataccttggatgactgctcctcctctgtttagcctcaacattttcatatccaaactccaccctgggcccttttctgtactttatttacatactctccctaggtaatctcccccattgttttcaatgccatctatatattgctggcccccagatttctatctgaatctaatctcctccttggg

SEQ ID NO: 182172 - DNA, 654 bp, Homo sapiens
ggtcctgagcgaagtgacaggtgcagttccctcttgtgaggctcggaggcagagggtcgttgcgagcgtccatcagacgcaaaaaatgaaaaataaaaatacaaaaatggtgtctgtgggagagtttttcaccggagaattggagtactccggtggtcgtctgactttctgttttggttcacgcgatgcaacagttgggaagtattttcttccgggcgtgcactgcatctgaagtccatttgtgggagaggccgaccagaaagccttggacaagaagcgcagggtcctgagtgtccattgcccacaggatactcggctcaggagctttgcggcgtttccttagaacaataatgcatcgaggccttggggactcaaagccatctgtagtgattgatggagcgtaactctttagaggaactgaaacatgggcaaaactttcatgagacatttaccagaagtgcttgaaagtttctaaacttttttttttcctgtttgatgaactcttcttgcgtgttagtcggcttcggcttgtctcattatttcttccattttgccttttgactttgaaccagcaaggatcttggtgtcccctctttttgcctttgtttttggcacaaaattagtggttctgtgcgcaaatggaaattttcgttt

SEQ ID NO: 182173 - DNA, 396 bp, Homo sapiens
tattcagtgattcatttactcatttggcaagtatctatttagggcccacaaagggagaggctgtgttgggttctgggagtagacgctgggagtagaggggtaccctgctccctgctggggctctttctatgttgggccttgggcaactcacttgacccttctcttatctgttttctcatctgtggaatagggataacactagtagctgtgtcataaggcatggagatttgacaagaaagggcaggtaggatgctcatgatattgcgtggcccaggtcaaagcttagtaatgttggcttttgtcatgtaggggaggaatatcttttcttctaccctgttaggttctgtgatagagcctatgaattaaactgacaaaagacagattaataggagaaaa

SEQ ID NO: 182174 - DNA, 500 bp, Homo sapiens
ctgtcctgcccccacaactggcgagtggagcctccatcttcgaatccaaacaattcgatctcactctattagagataatagaaaggtcatgagttttgacatcagaaactcacaagtcttaatcacacattgcctgtgtattaggtggattgtaaactccctgagggcaaagtctgtttaaacactgcgtatctcagaacccagcacagtgcccaacatttagtaggcactccacaaatatttgatgttgaacacataaaattagctgtaatcctagcaaagttaacttctgagtccagcgttcctcttggtgaaacaggaggaatcacacctgctttaaaggagctgagaggttgactagaacggagggtgaggaggaagactccagactttccttgcctgggcccaaattctggcctggcaatcattagctctgtgattttgagcaaataacttgtctttgcctctgtttcccacaccagcaaataaggacaataata

SEQ ID NO: 182175 - DNA, 295 bp, Homo sapiens
ggaatatttacccaacacctgtactgcattgaatattggaagcaaataacttggctttgatcttataggctcacagatggaggaacgtaccttgaagttcagatgagatttcggacttttgagttgatgctgaaacagcttgagatttttggggactactgagagatgataattgtattgtgcaatatgagaaggacatgagatttggtgggcataggtgtgaaatgacattgtttggatgtgtttaccctccaaatctcttgttgaatgtgatcttaaacgttggtgggcctag

SEQ ID NO: 182176 - DNA, 559 bp, Homo sapiens
acatcttagagtacattaggcgcgtctgcgtgcatgtgtcgcctttttgtaacccaaatccagcattcttcagcttacctttttcatgtagcactatgtcttgtatctcagtccctatcaggatataaaaagcatgcttctgttttattggcggcgtcctgtcatgtggattctctgtgcttgctaatctgtgttgtaaacaaaacacagcaggcctcagggatggggctgataacaggatcaaagcaggagtttataacagcattttgtttttgttgatttattttcatgggaaaattcaatttatgcttagtgaggctggcttttcacttgtggagcagatataaagttttcttgatagaatgaagagcgttaagtaattggaatgtatacaggtgctatgtggttgttgggaaaactaaacccaggtcactcccactcctgcttacaccctcacaggatgaagctcctgctcggtccactggcctcatgccccacagcgcacccatccccacacttcatgccccatgtagacgcagacgcgccttatggtaccaag

SEQ ID NO: 182177 - DNA, 475 bp, Homo sapiens
cttggatctcagataaatctttgcattttagacatttaagttgattctaaacctgataaggctttagagactcttgaggtaaactgattggattttgtatgtaagaaagacctgaaatttatgtctgcagctttttctcctttatatcctcaactaacaatattttggggtttctatgattctttgctaaaatttggattcccgtttcaatttctcttgtgcataatctgtaattattttctctgtagttaccattggaatgacatactgcatcctatagttataccatccactttgaaatcaatgtgaatttaacttcaattccatacaaaaacttcttttccacaggtacctttctgcttcacattattgatgtcactaattgcaactttatacatggtgtacatgttaacagaaaggtattcttattgtaatgtaaatcttgaagaaaatgagagtaaaaaacaaatttcac

SEQ ID NO: 182178 - DNA, 266 bp, Homo sapiens
cttttgaaacttaatgaacataatcacaatttatgtcgacttcatttctatcaggtagcttgaagtggtgccgaagttaatttaataaaatcactcagttttacagataaagtaattgtggcctaaagggacttggcaagagtatcactgagtagaatttacaatccagaactaacagacttcttcatgatacgttaagtgggtgttttgtgtcctttataattccattttctattgtatctaacaatcccttcatattacaaact

SEQ ID NO: 182179 - DNA, 229 bp, Homo sapiens
gaaagatagagaagatgaaagtgttgaaaggacctgccattactgactcaaagctgaaaccacctcaatagaaatagagaaaataaatttagtttcttaaaaggcagccctgaaaaccacaacagaaaaagaatgtatcctacgaaacagatgattctaaattattctaaatcattccaggttgataaacatacccaatgagactaagttgtcatagttctccatcatc

SEQ ID NO: 182180 - DNA, 261 bp, Homo sapiens
aaatagaaaacaaaaaggaaaagaaagagcagaaattcaaatgaaaaagcatcatcaggagcgatgaagcagatttgaaacggaaccaaatgaaagctgtagaaatgagcaatataattattgaacgaagaaagtggatgaatgaacagcgcattagatacagctgaagaaagaatttgtgtaatagaagctacatttgaagaaattatctagaatgtagcacagagaagagcacatggaaaatgtgaaagcaagggtaag

SEQ ID NO: 182181 - DNA, 202 bp, Homo sapiens
acttaaagcaaaagccacctccaatctcatggtagagctgagaggaaaaaagatacaaaaacaaatttagcctatatcacagtctcacctgaagtgagtctagaggggaacgataggaattcagtatcttgcattacaaattaataacttcaccttaccaaccagtctgaactactttttcatctgagtgatttaagagaga

SEQ ID NO: 182182 - DNA, 577 bp, Homo sapiens
atgcaggtttttaaaaaaattccttctagaaaggggctctgaaaggtactctcctcaatttggacaaaaggcagtgtctcataaccaacaaaatcagctacacgggaagtcaggagagctgggaagtctggggtgtggggcaggtgctgcaaatgtactgcatggcccttggcttccaggtcactgcttaaagatctgctgggggctctgggtgactgaagaaggcacaggccccattggaggcccactcagtgctcacccaggacccctccgcactgtccaaccacgggtatcttttgcaccagcttgagtatgacggaccgccatccccccagaattcctccatatcaaagtccagccccagggccaatatttcactgcccagactcggtgacatactgactgtggccgtcacacagttcaatgcagacctttaacatatccgaccctccactttcaccatttttataggggactttgaaccgcactgtgaaaaattatctttgcatggacttaaaaacaactaatcacttcccttctttcttaccatcaaaagcttatagaatcaaaatcaggg

SEQ ID NO: 182183 - DNA, 591 bp, Homo sapiens
gtcctgctccagcagagtagtagttgattgctcacttgtagcacctgttccatcctttactgtagggtttatctcaaaagagaaaagtgtaataattaccctaggaaagaatactagtaactggggctgggcttaaataagtgcctcccagtataaatggacaccttcttttcaaaaaagattttatactcggcctggagaacaacctcagcttatctctgaaagtattatgtgttctctctctccctctctctcaaaatattagcagcggcttcagaatttctatttacgtgaggcgctctgccttaatctggttccgagagtggccgagggacttgtttgaagcaccctttgcactgcaagatgagatgtttttagagtgagcttatttggattggtttggagctgagggtaatgatgaggacagctgaggcctatcccagccactctggtgttctcaggactaaatatcaccttcagtatttttagatttcttgccagcagataaatttagaagcacttgcaatgtgcttttctgggtctgcagcatggaagtgttaagttcctgtccagcttcacctcacaggtggc

SEQ ID NO: 182184 - DNA, 427 bp, Homo sapiens
tttcattcccagttcttgatgctatcttcttcacgagaacagattcaaatttgggaccattttctgttcttattaagaggaaagtggtatcaattttaattaagtccaagaacactcattaatagaaggcatttttcatctacctacaaacatagtggaggccgtgtcggtgactcagaacatttaaataaagggccctccagctctgtgtcggctgatggaagatctgggaagggcactgcctgaacaatagcaaccattagaactttattcttcttctcatgtgcttcttcagatctcctaattcagatattatatcccatcaattttttattagagcataattcatttactgagattgcttcttttgaaagcatttggcgataggatctttcttattgaagatgcatggccaagaacatagaaa

SEQ ID NO: 182185 - DNA, 200 bp, Homo sapiens
gagggagatttgagacacagagatgatggaagcagagatgggagtaatgtggctacaaactgaggaatgtaacagtcaccaaaagctgggagaggcagggaagtatcctcccctagagcctttggaaggagtgtggccctgctgacaccttgatttgggacttctggcctccaggactgtgactgtgaaggaatactttt

SEQ ID NO: 182186 - DNA, 270 bp, Homo sapiens
aagtagagacgggggtctcactttgttgcccgggctggtctccaactcctgggctctagcaatcttccagcttcgcctcccaaagtgctgggattacaggcgtgagccactacgtgcacatttttgtgtgtgaccatttatggtacttcctctgtacagagagtctgtaacattttcaaagattctcaaaaggatctgcttgataaacaagattaagagcactcttcctagattatatccaatactaaacttttaatattccatgatttt

SEQ ID NO: 182187 - DNA, 571 bp, Homo sapiens
ataaggattttgatatttatactaaaagcaatgaaagtgattgcaggtttttaaacctaggactcacttgatatactagttaatctggaaacattgctctcaatgtaggtggagagaacactggagaggagcatgaatgaaggatggagagaacagtgaggaggccactgtggaatgtcaaggtggactgacaagtggggtagttgagaaagagaaaaatggatggatccaaaaatacaacaggacagaatgaatccagaagtactatttcagaacatagaacgggttagatatgggcaatgaggaagagggaggtaaaaaggatactgtctaagttccttgcttgcataactgggtgggtggtggtgacgttatttagactaaggaggtgatgcttttgtaatgcatttgacatatgtccccacgcaggactagtttcctgagtctcagcttgaggtattatgaggaataactatctgatccaaatctgtggtggacaattagatcattcctttgataatatccatatctgaaaatgccataattgtttatttaaaaaaacagtagtccc

SEQ ID NO: 182188 - DNA, 568 bp, Homo sapiens
ttacctgaacgaacgtgacatttttctctcccaacagaattcagcttagagaactatcatcactggacaatgcaagcccatgagctgttccggtattttcgaatgccagagctggttgacttacgacagtacgtgcgtgctgtacagactaacacgcttgtcgcctgtggaatgtcaaggtggactgacaagtggggtagttgagaaagagaaaaatggatggatccaaaaatacaacaggacagaatgaatccagaagtactatttcagaacatagaacgggttagatatgggcaatgaggaagagggaggtaaaaaggatactgtctaagttccttgcttgcataactgggtgggtggtggtgacgttatttagactaaggaggtgatgcttttgtaatgcatttgacatatgtccccacgcaggactagtttcctgagtctcagcttgaggtattatgaggaataactatctgatccaaatctgtggtggacaattagatcattcctttgataatatccatatctgaaaatgccataattgtttatttaaaaaaacagtagtccc

SEQ ID NO: 182189 - DNA, 394 bp, Homo sapiens
gaggacacaggtttcctctaggttgccaaaagtggatgatgaccccagctcagcccagctgtggatattcgctctctgaaaacccctgaactgtttgctctgtgcaatttgtcccaaacgtgatcaactgtctggctctaagacctggtcttggttggcacctcatgattattcccagatgttctgcggagttttgccttgttagagtctaacctgactagaaattcaggctccccttccagctgggctgtgagttgtgtgcacaactggggacaccatagagagagcttcacagccaggagccaaggatggtgtgaagaggctgtgctctttccacctgcatactgtctgctgcctgaggtctgatgcaccatgtgtgtgcctgtgcatgtgc

SEQ ID NO: 182190 - DNA, 544 bp, Homo sapiens
agtgattagaatgtactttccaaacataaaacattgtactgtaggagtttgtcaaaggggattaatattaccacatatctgtagaagaactttatgaagaccctgtgtatctctcaaccttaatgactaagattgtagatatgatagaaatctgtaaatagcatggaaaagcaaatttattgaagtctaggacaactgcattacccagctgtacatagtgtgttctttcttcagagattgcaataaatgaaaaagatggttgccatagagataaactgtgccctttggctagctgattagaagaccatttcaacctactataagagaatatattttgcctgtaagtggtatttacagataatttctatcacagttgtaacccaagtttttaaagctgaaatgttaaacctataaatgttgaattccataaaggcttttgttcctttagtaaaacttattttaacatttatgtgctttttgccttggaaaatgtgtttttaaagttcttccccctaggatactataaaagtcttccttgaaagct

SEQ ID NO: 182191 - DNA, 360 bp, Homo sapiens
ctcagttcctcacactggagtggtttcacaggatgattagaggtattaggccagcagtagagatgctagtttatatgtaatacctagcgagaggaatacgtttgctacacaatcaacacttgaagtcactaaaaaaaaatgactttaaaaatctcacaagaatgactaaatataccaaaaatcagcccagaaacatggcacagtatcatggtaagtcactgcactgaggagttggcagagcagggctggaacccactgcctgataccaagagaagacatcaaacaagggtttctcctttcaatgtcagccttttcctatgaaaatgacaaaaaacaatccgtgctctcctaaccatggtc

SEQ ID NO: 182192 - DNA, 806 bp, Homo sapiens
tgcagtggcaggatcatggctcgttgcagcctatacctcctaggctcaagcaatcctcctgcctcagcctcctgagtagctagggaccacaggcattcaccaccacacccagctgattttttgattttttgtagaaagggcacctccctatgttgccaggctggtctcaaactcctgggctcaagtgaccctccctccttggcctcccagccaccacatctttcaatctcctctatctttcttccctggccacactggcctttctgctggccctcaaattggtcagtcttgtaggccgggtgtgttggctcacacctgtaatcctagcaccctgggaggccaacgctggcggattacctgaggtctgcagtttaagaccagcctggcaaacatagtgaaaccccatctctactaaaaacacaaaaattagccgagtgtagtggcatgtgcctctagtcccagctactcaggaggctgaggcaggagaatcacttgaacctgagaggcagaggttgcaacgagccaaggtcgcaccattgtacgccatcctgggagacaaagtgagaccccacctcaaaaaaagaaaaaatggatcagtctcattcttaccattatacttgaaatttcctccagtaatgctctcccttctactcctcacgattccctcacatctcagccacaatgtcatcatctcagagaagccttccctaaccacctggtgtaacacagcacacctcattactgtattctcttatccagtttcatttttctttataccagttatagttatctaaaattatattgtt

SEQ ID NO: 182193 - DNA, 496 bp, Homo sapiens
catccaatccttcatcaaatcctgttggttctatctttgaaaatatgaaatatataaaaaccatatctcactactccacaactaacactatcctatctcagctggatgagcctcagctggataagcaagagcttcctacctggtctccccaccccacattgtcactctcaacagacatcagagtgacctcgataagttggattatatcactcatcagaatcctccagtgactttccatctctctgacgcaaaagctagtctttgcataaggccttacatgagggaccaggttacctcatcttctaccactcctcccccaacttactctgccctggccacactggtcttactgcttcttgaccaaggtaggcgcagcccaccttggagcatttccacacactgtgtcctcagcttggttcactcttcccgctgatagccgcgtgctaccacctcgatttcttcaagcctttgctcagatgttaccttctgaatgagg

SEQ ID NO: 182194 - DNA, 350 bp, Homo sapiens
ttcatttccactgagataagcattttggtattcagcttttatattcactaagaattaagaaatgctgttttaaaagcttaggaaatgtatatagaaaatatatcccatgttctcatatatgtgtttcagacataggggaggaattagaataaattttctaaataaacaaattatttgcctacttaaaattgcaattaaaaaatgaagctttccttcgttagctgtaaactacattgagaaattgtaacataaaaaagaatggatttttaaaacttcttgagtagatcaagtgtcttgtacaatatcattaaatttgtatcagaacacataaatggaaatgaggtggggaa

SEQ ID NO: 182195 - DNA, 285 bp, Homo sapiens
aataaatgcctgtatgactattctagtgagaaatgaatattttcagttttttaaaaagcactgtagtgcaatgacagcaaccatcataaccatcgtgcagatccttcaacatcatcatctgcgcagttcaacaaactatgagaaatatacttctttcacagacttatactaaaagtaaaatatagaaatagtaaggggccaggaatgatggttcatgcctgtactctgaggaggttgaagcaggaggactactagaggccagaagttcgagaccagcctgaataa

SEQ ID NO: 182196 - DNA, 451 bp, Homo sapiens
  misc_feature (281)..(281): n is a, c, g, or t
  misc_feature (283)..(283): n is a, c, g, or t
acttgtcaagcccagcttgtcccacttctccacatgagtcttccagtgacatctttgtgaccatctccaccccctgggtaaatgctccacgctgggagtccacaaaacacagtctgacttagagattctctggcatgactctcttccccactgtgtacactgactgccttagatgtaggcctcttgtttggggcccttcctggccagaccctgaagcagcctctgaggagggtggtaagaatggttccctagagcccagttacagagtccgcgtgtagaantngaacgttcaatttctacaaccatcccaatgcacaactgtcacctgtgcttatagaccacctccagacctgatgggagctgccacaccccttttaacttttgccaggctgtaaccatgccctctagtggtaggactaaggacatcacaattgtgtacgaatttgaacgg

SEQ ID NO: 182197 - DNA, 127 bp, Homo sapiens
tgatcacttctttctacctttctggtgtttgatatctttatcccaaatctctaaagccccaaccttcttgcccattagccacaactctcagaaatggacctcatagggcaggggacacagcctcttt

SEQ ID NO: 182198 - DNA, 101 bp, Homo sapiens
cttctggatcctttctgtgcttcgagttttttggagtaaaagctatttcttactggcaaaggtcgttcttatacctctctgctcaagctgttttaagactt

SEQ ID NO: 182199 - DNA, 452 bp, Homo sapiens
tgagggatacaagctgccttattaaaagcaggactgcttcagaggcattgaagtaatagaggacagttggcatggagaaatgattaatttggaggaaaatttttgatactatgtatttgtaatttggggcattttatgtgtactctagtaccatttgttcacagggaaccattccatgtaatgttatatgaacattataaaccctaagatacttaaaaacgacctagctttattgagatataattcacacgctgtatatttcactcatttaaagtgtacaatgtacttatattacagaggaatagtgttatatataacatggattcctataatgttgaaagtgcagggcctcctagtggtagggtttaaatgtactagagaagaaattaaattacttaataatatcataggggctctagtaattattttagctttcaaaatgtctgataaac

SEQ ID NO: 182200 - DNA, 415 bp, Homo sapiens
tgccaaaggatgtacccaagccttaattgtggcctttaccctcaaccatttccttgaaggcatcttgtgatgctgtaaaacttaaattttaacatccagcgtgaaaatttttattttttttgtgtgtgttaacttcaggactataacttgttggtcataatgatgcttataggtgaagctgatgcttatgggtcagcaccgaagcttatgggtagctctgcccatgctcacttttattagatgagagcataagataacgcttaagcattggcaaaatgtatagatatagatatacaaatgtatagatataattatgtatctatatatgtgtagtatgttgtaatgagtaatatagattcgtatatgtgcaaagtcacactgcacatactcatcaggttgggtttttttaatgaaa

SEQ ID NO: 182201 - DNA, 585 bp, Homo sapiens
attaatctttcaactgttaattttgttcattaactacatgaacaaaaattgaataccaaaactgtggtattcaattttggaaattttggctgcaggctaattttaagttgatatttttgtttcttccctctcttctctacccctcacttgttgtcctccttcttcctttgcgcaattttctctttgtctttgttttgtcatcttttttttgtttttttttcaggttgtctccagtgctctagtacaaaacaagatcatatgttggctttgaggagctcctgatctttatttctatgaggatactgctaattaacaatctggcagggggcttaactcagttactagtttagggatttctatctgtgttctctgaattttccaggagtgcagcctgatacaaggcataggccctggcagcatgaatagtagctgtctagtagctaaggcccctctgcaggagagatgggtgctggctgaaactacggcactaagcctagctataatctagggtgcatttattccctgatacctctcctagcaactaatctcatggaagtctctacctgcttttaaccactcagttga

SEQ ID NO: 182202 - DNA, 665 bp, Homo sapiens
actctaaagcttataactctgagttattgggaaggtaagaacatattttccccataaaaataagttctatatcatggttatgatccaaggtgaactcacagaaacctactttctttggttccttcaataaacattaaaagcctgttatttgtgaggcactatgccaaccattagggatataaaaccaaataggactcagtctctgcccacaggagcttaagagtctagtggaggaaactaaattaacatttgcaagaaatgctgtgtttcctaaaatatctacaaggtgttttggggagcaaagaaaacgggcaccttaatcagactacgaaagggagagtcacagaatgctttcccttaagaggtcatatttgagctgaatttgaaggctgatgaggaattacctacactaaaaaggaaatcacaggtaaaaaggtcgaacaaaccgtatttagtgatttgctgaatcatggaggtgggtgacacaaaggaccctagaatgactcaggtgtctggtttggataaacaatccaacgtaggcaccattcacaaagaaagggatgctaggaggtacgagggcaaagatgaaaaggtcatacgcagaccgcaaagcttaaaccttcgcctcacatctgtttggaacagcagtagctttttacttagcg

SEQ ID NO: 182203 - DNA, 412 bp, Homo sapiens
tgctgggattacaggcgtgagccaccgtgcccggctcctttgtcttttaacatggtgttttataatgaccattttatgtgcatttgctggtagattattccatgttcagcatagctagctagctctcatagagtccaacacatgaagtcttgctattttaaaatttatatagcaggtaaaggattcgttaaatgttgtaaggctcatagccttcccagttcttcttcctcttccttctcctcctcctccccctcttcttcttcttcttcttcttttttttttttttttgagacaagtctcactctgttacccaggctacagtataatggtatgatcacagcacactgcaaccttgaactcctttgctcagtgatcttcccaccttagcctcctgagtagctaagaccactgg

SEQ ID NO: 182204 - DNA, 407 bp, Homo sapiens
tggcagagaacagttgtaaagtaagagtaaacagttgatctttcttcctgttgtttgtgcatttgcataatctggagatggaatgtgactgactttatatgattttctaaatgctacacatacttaaacattaagtggagaaaaaactctaaaatgttctattttgcatatctaatctctatggaaatttgaaatgacctgtatttactttttagttcacagagcaaataataataatatctaaagggtaaaaaccagcataggcttgatattcaaaaataagtaatttattttcttcttaaagcttttgcttgggaaattgtatgtttgatatgtgaaaaatgcattatctaaaataaatctgatatttacgttgagacgaatatactgtcaatttagaggttttt

SEQ ID NO: 182205 - DNA, 338 bp, Homo sapiens
catgttggtcaggctggtctcaaactcctgaactcgtgacctgcccactttggcctcccacagtgctaggattataggtttgagccactgcacccggtttcattgtagcttttaatataaaagatatttttcaaaagtaccattagtgactcttttaagcaatgagaggagcagggttgttggaaaccatttaccaaccaaagtatttgtgttaggcttgttatgagtactttgtacccaaaatgaagttctccatactatttaggggtcaaaaaagttgttttaaaattctgcttcatttctactaaattagaaaattcaaagcaaaaatgttaaat

SEQ ID NO: 182206 - DNA, 254 bp, Homo sapiens
ctacagacagttggtaattttcaaggtgagtaattaatacagagatactttggcagtgaaaatattattagtgtgtttgtgcttatgtctacacagagaagagagaggaggcaaagataaaacctgtagctcccattttcttcttatatatttttacttattttttctgtcacagttataaccccttaagaaaaatttagatgagtactagaatctggcaaaattagttaaatcagactgagatgaataagata

SEQ ID NO: 182207 - DNA, 218 bp, Homo sapiens
ggtaacctactcttgtgccaatcatgcagttttggccaatcacaggcccaaaactgtttaaattgcatttaggcaaaggctgataaccaatacagctgtttctgtacctcacttctgttttctgtccataaatctcctttgaccatgaggtaggacaggagtctctcagaatctgctgtaattctgaggagtgcccaattcacaaattgttctttgct

SEQ ID NO: 182208 - DNA, 567 bp, Homo sapiens
cctggctttagcacaaccttccagatgtgatttggtatttcatactttgttgcttttgtaaatgctgtacccactgcctgagatattcttacctttttctttgtccccagcaaatgcccagtcaaaatttagcctttatttttttcccttggtgaagccatctcatacctcttaagtagagtaatcaccttctctttcacccacttttacttggtgttcgcattcacagctgttacccgctactattagagtttgggttctttgaggacagggaacttcatttctttatctcagtgtctgtagggctaagcctgccatgtcgaaggcatctaatccgtgtttgtggaatgactgatgcaactaaggagtgcaggatgaatcgctaagttgctgcttgatcctgccaatagaccaacctgcctcggttgacacgagtgaattgtgtagaaaaactttataactttcagaactcaagtcctgttgatcagacagggaccgatggcattaagactcagtttcaccagttacctctaaggaaacggaagggtgtctcccaggaccaaccag

SEQ ID NO: 182209 - DNA, 225 bp, Homo sapiens
tggaaccatcagaagtctttaaagactggctagccacaatctaaactgttttagaaggttcctttggtgcttctgtagatggacttggatgggaggtggttgggagaccgctaaggaggagggggaaaagctgctggagagagatgacaagagcaagaactgaaaggataaatgctccaggggtggatccacagggcttggtgactggtggaaggaagaacatgg

SEQ ID NO: 182210 - DNA, 311 bp, Homo sapiens
tatgttaatacatgttgtaaattgaaatattatacaaatgccaggggctattactatcattgataagtgttaattataagcaattactataacaaaagcgataatatccagtatccaactaattattaatgataatttgtaataattataatacataattaatgatatttaatagtaataattatatttaataataatacttcatagagctagttgctatgagaaaccaagaagaaaataatttgctgtctgccctcacaagacctaatgttcatttattgcatgtcagtagcttatacagtagctactgg

SEQ ID NO: 182211 - DNA, 396 bp, Homo sapiens
ttttacaagccaaccatatcacacatttacattgttaatatttgcattgttaattttcttagcaaatgacttttatttcttctctttactcccagagaaaatagataatggcaaaatcagttgaaaaactaaatactgatgaccttgttatgactgatcccaaatcaatctaatgaacatttcatggctccatggtggtcatcactaattgtaatatgacagatacaggaaagacagaactacttggtacataatgttaaaatagctgatgtcacagactagagttgacccactcctgtgttgtgtatagccttacgaagccagtaccagttaaagaaagcatccaatggccaaaagtcatttcaaaagcactcacactggtaatttgctttcttg

SEQ ID NO: 182212 - DNA, 167 bp, Homo sapiens
tcttttacttcacacactgaaggacacagttttcacccatctaaaactacggccctcattggtctgtctctgtagccctttcacacagattatcccattagatctcacaataacccaatgagaatgaatgtgtacggactgtcattccccactggagacatgaagaa

SEQ ID NO: 182213 - DNA, 474 bp, Homo sapiens
tggtggctgaatcctgactattgagctgcctagaattgaaataattaattttcctggagaaagtatattgtgttgtagttttttggatttgtgactataatctgtaatcaccagggaatttatttagatttgcaattatgctagagtttgtaatttatagtaaagagataggagtttgctaaataggaggcatggagctgtgagttttccattaatagttttgtgaaccttgtgtaatacccaaggtgttagtagggaactattagctaaatagtcagttcatgttcgtcttatctaatgaatgcagaacttaacatgttcacctagagagtttcccatttattttaaatatggttctcttttgcatgtaaaaagagtgttgctacaaaatcttatattttaaagaagtataactacaaataatagctttctattgttttaaaatagatattctagtaatataattcttattgt

SEQ ID NO: 182214 - DNA, 735 bp, Homo sapiens
atttagagactgattctcaaggtgaaagaaagctatcagaaagattttgggacaatgaataacattagcagactgtttgggaagatccacttggcaatgattatattcacttgcaaaatatggatgggtagatcttagaagtaggacgattataaagttggcttttggattagcccaggcttgaggcttccagatcctgaattagaataggaagtataaatttttaaaaaattatgcatttatttcaagtaaaccattttccagtgagttttaactatgtttaagacacgatccaagatacgaagatactataagttgtgctcttgatttcactcagatgaatatgtttatatctacaggtagtggtttatattgagaggtaatcatcttttaaaaaggatttagtgaacctttattcttcagtgggcaaaactaccacttaaattatatttagaggtaaatgcattattaccttcatctccaatttccccgcattcattctccaatcttgaagtagagccaaggcggtacttcaataccaagacctagagacttgggatacatttagaaggagaaaattcatgaagcatttgtatgctggtgcttatggtagtatatcaagtcaattttaaaggtcaccttttctgagaaggctattagttttaacctaagaaagaaaccattgggtggccaatgttaatcctgggtttctggagttccacttggcccaatttt

SEQ ID NO: 182215 - DNA, 562 bp, Homo sapiens
taaccaaagaccacctctccatcttcctgctggggccttgcaggtcagcctagagggagttttccagagcaggtggcttcctgagtggccaagatcatgtgagcaggataagttctcttctcgctgggcctttcctccctaagctggtgtcccaggcacctctctctgtttggaaatcagattctttatggtttatttttgacaccagataatcgctgcccaagtttcatcaatttgtcactgtttttattgtcagcaattgcccataactggagcacgtttaaaatgtcattgatcttggtattacagtgtcataatctgacagtaatatgtgtagccagcacaggaagcccaggctctgagattgatggggcacagcacaccaattatattctgtccatctaagtgataaaagagtacgtaggaggccttcaatagataaattagatatcactcccaattatgtcctttattttatggagtcatatgctccccttagaactttttttcttcatttggcttgtaaaggggaattacttgacccccctaaagactgggactg

SEQ ID NO: 182216 - DNA, 378 bp, Homo sapiens
tgctgggattacaagtgtgagccaccacacccagccctttctatatttttgtgtgtgtcatatttttgtacttaatttaaaaaaaagccttatatttatcagagggagaactgaggttgcctttgattattcatcatttgttccctagttccacctatattatatgaatagaaaatttattgcagtatgattgggaattaagaaatgggtaaccttcagcataagattccttgcaacttttctgggagttaaggattctggagtggttggatcattgtgaatctttctgatacgatttttctcactacattttgaagattttgtctgggagttgtatgcgggtctctaatattttggcatatcagctttattttttct

SEQ ID NO: 182217 - DNA, 431 bp, Homo sapiens
caatgatgattttactggcatacagatgaaaaagaaaaagatatttgaaataaaaataaaaatatagtgcacaatgaccaggcctgtgaatagccactgcactccagcctaggcagcatagcaagatcacatttctcatatgaaactttactagaatgaaacttatggtttattacatagatgttgcttattcgttgtaggaaaaattgaattacagatgatttttaaaactaccagagcaaaccatttaacctatttgtgtacatactcccagatttcttacacacgttgcaaaaaaaatagatcgtaccattctgctggttttctaagctgctttttgtaagtaatgtactgtgagcatcttttcatggccataactattacatacaaaagaaaaaaacaggcttcacaataaatagttaaaagacatt

SEQ ID NO: 182218 - DNA, 226 bp, Homo sapiens
ggacaaataaaaataaaaggacaggccagtacctccatgaacatacatgcaaaaatcataaatgtgagcacatcaaactgaggagggaagggattaaatacgtatatgttgattttcattaatccaggtgctcacagcgagcatgtaatcactgcaccaggggatatacagcattttcatcaagcaatcaatacataaacttgtttcaggtgtccacttaaagacg

SEQ ID NO: 182219 - DNA, 188 bp, Homo sapiens
ggcccggtcgttgcgtggccctttgtgcggctctttgcgcgctggagggaagggattaaatacgtatatgttgattttcattaatccaggtgctcacagcgagcatgtaatcactgcaccaggggatatacagcattttcatcaagcaatcaatacataaacttgtttcaggtgtccacttaaagacg

SEQ ID NO: 182220 - DNA, 206 bp, Homo sapiens
cacttagggtccagatctgtgggtggcattggaaaccttagctgtagccttgcctggggactttcttgccctgaagtgtggttttaggccagagatgctcaaacttttgtgcagagatactaatggagtaggtctgaagtggggccagaaaagtgatatttgaaaggctcatcagatgctgctgaattgcagacaaggatggattt

SEQ ID NO: 182221 - DNA, 163 bp, Homo sapiens
tggcctctctgaggtacatttgcaagaggtggcagtagaagtaatttaccagagcttgaatgtgcaggtcttcactctgaaatgtgcaggtatgaggcaaacagggactattcatgaaacaatagcttttcttctatttgttttctaattcttcttccaaggt

SEQ ID NO: 182222 - DNA, 332 bp, Homo sapiens
actaataatcaaatatcaattatccagaatattaaaaacttcagctatccagcacttttggagaataaggagccaagtattattccacctcccttaaagcaccgcctgccctctctaatctttccccaattgtttttaaccttcaatcatttgaaatgagatttttttctaacagcatcacacttttctgccttcttatacttcaaatacagtaatcataatttaacactatggctcagacatcactattatgctgatttagaatatccacagggtcttctaaaattagctattaatacaccaagtccatctcatttcttcacaagttctac

SEQ ID NO: 182223 - DNA, 364 bp, Homo sapiens
cagaactctctggggccgagaaacaaagttaaaacgttaaaagttactgccaaatgaaaaccaaaaaagcaaattaagcatctttgaagaataatagaagtcatgaagaaatagaatctatttgacaggaactcagattctcctggaaatatcagggccctagtcatcagccttaatgaatggcctttctcagtcacacagatagcagcactgtaactcctccagtcaccagggcttaaacttggatattatttgaaggttcctcctatgcctcattctctagagtttattcactaacaaggcttgttttatcttcctttgaaataactctaaaattctcgtcttctccattcagactgccacc

SEQ ID NO: 182224 - DNA, 474 bp, Homo sapiens
gctcacacctgtaatcccagaactttgggaggccgaggcaggaggattgcttgaggccagaagttagagaccagcctaggcaacatagcaagactccacttctataattttttttaactggctgtgctggtgcatgcctgtaatcccagctacttggaaggctaaaatgggaggattgcttgagcccaggagttcaaggcagcagtgagctatgattgtgccaccgcacttgattcagcctgggtaatggagcaagaccccatctctaaaaaaaatgaaaaattaaaaataaatcaaataaaaaaaaacaggagagggagttctgtaaggttacatttggtgaagtcaatgtgtaagctcaaatgatttaatatcaatttgttactcattaggtaagagcatccatgtcccctacggacaaaggcttctatgactacgggaaatttagtcaaggtaacaaatgtgaggcataac

SEQ ID NO: 182225 - DNA, 262 bp, Homo sapiens
cttcaatccttaaaattatatcctatgactgtatagaaatttcagtgcctttcacccgatctttctgtgacatgccatgtctacaaaaatttggagatctctcaagtctgacgttttaataactagcatttttgcaacgctggaagttcgcaaaaggcttttgcatattttcttctgacggcaattttgagagttaggtattattctcctcgttgtactggtaagatcaatagagttaagtgactaagttcaaggtcgcaaa

SEQ ID NO: 182226 - DNA, 257 bp, Homo sapiens
gaacgccaattatgaactgttcacagagaagtccagcccttcacggctcggggtgctccttggtgcccccgtaccgaaagtggtgcgtgccagctctgcaggaccttagcaagccccaccccaagtcttcatccacttccctaggccttaatatgaacatagcaggttagcagcattattacactccagtacaatagtagtagcaggggtatttctactcatccgcttctaccccttaatagaaactaacaaactag

SEQ ID NO: 182227 - DNA, 176 bp, Homo sapiens
aagctgggcctttaataagctattctgtgctgtgcacttttgtgactgtgtctagctagagatttattcattttttttttgatcttctcaaagaaccagcttttgatttcacaaatttcttctgtttttcttattttttcgtattttttcttttgccaaagccaaatatttctaat

SEQ ID NO: 182228 - DNA, 335 bp, Homo sapiens
cttcggcccctgaagatgacttaagtgtccctctctgctcccttgtcatccatcccctgtgtatctttttatcatagcacttttcataacacattgaacatactgatgtttttttgtctgtctctcctgtcctgtgtgattgtcaaggaaagggagtattttgtagcctcttgtacctaaatataatgtgtcagcccacatctgttggtgaatgaatggatgaacaaacaggccctctcttagccaagatgatttatatgttgaagaaaagaaaaagaatgaatatttttagtttctagttaccttcctgccattgggttgtaatactactccct

SEQ ID NO: 182229 - DNA, 530 bp, Homo sapiens
tgcttttcttgttataggcgatagtaggaagattactgaaagtaggtttagggtgtttgctttaatgatggtaggcagatagaaattgctacattcaattgataaaatttacatataatttttttttttacaacttttcatagaaaggatcaagttaatttttgccattaagaaagttattgaccgtgcatattaatacttttaagcaattaattattggtttagtatatctaccagtttttcaaatataacagatgctcagtaagtatttgttgatcaggataatagcatataattaggtttgtgtaaccttctccctcaatatttctgaatttgtaaatccagttgagtgtcctgctacattgatttcaaatttcaagtaagtgttatggctacctttgttctcactcagggcttttctattcctttctcacacaactgattcctctgagagtcaagaattgtgatgtgagtgtattcagatatattctgactttatttcttcccaatttattaaaaatgttcagttg

SEQ ID NO: 182230 - DNA, 503 bp, Homo sapiens
agtaaataatcatcttaaaatcctcccacataggtcgtggccattttcaaagccccaaattcatctctctattttgtatatttcctccctcagaattcatggcatcatagtacttgctgatattttaagtctttaggtaattacgcttggtgagagtaaaagaagttgaggataatagtcgctcaactgccttttttagtttaatccttactctttatagtttttcatgtttttggaatctttacatcaaatgttgtataatgttttagactgtaaaagccagtctaaacattaattttggcttgttacttaaattgaaaagtgaatctcaattatataagttgagttttaataatgaaaatatgtaaatattggctgggcacagtggctgacacctgtaatcccagcactttgggaggctaaggtgggtggatcacctgaggtcaggagttcaagacgcctggccaacatggtgaaaccccatctctacaaaaatacaaaaa

SEQ ID NO: 182231 - DNA, 405 bp, Homo sapiens
ctaggcaagcctattcttcctctcaagagtaggtgttccacttttgaacacctatgccaggcaccggctatagtgcctacaagaggatgatatgtggacatgaccactttccctgactacatcagtggttctcaactggggatgattttgcaatgtctgcttatgggacatttggtaatgtctagagacatttgtggttgtcacaactagtggaggggtactacctgcatgtagtgggtagagtccagagatgctactaagtatcctataatgcataggacagctgcccacaacaaagaattatctcactcaaaatgtcaatagggtcgaggttgagaaatcctggtctaggctgggtgtggtggctcatgactgtaatcccagcattttgggaggccaaggcag

SEQ ID NO: 182232 - DNA, 673 bp, Homo sapiens
aaatctaaagtaaatccatatctatccccctcccattaaatacaagaatcctaaaatgtttctgatttttttctcccatcttctaagtgttgctgtcatgtattttagttttagtttgttttaccttgctctaaactagtcaccattattacaatacttgcttttacagtcaatgctttagatttatcaacatgatttccctgttttgtcacaactttttctcactaccctctctttttttctacattcaattttcttcttgctgaagcacatccttaagtagacttcatggtaagggtccatgagtggcaaactgctaggccttagtttgtttgaaaatatctttattttattcctactttcaactaatactttaacaatacataaaatgctaagttgacaatgatttccctcagcactttgaggatattttcctactttcttctgatattttgttgcagatgagaaggtaattggtagtataactggcgttcctttgttttctctcaattggcttgaaagtctacattctagctacagtaatgaatatccaatattttttaaacattctctaacaaatctaaagtaaatccatatctatccccctcccataaaatacaagaatcctaaaatgtttctgattttttttgaggggaaaaggcctgggggtcca

SEQ ID NO: 182233 - DNA, 392 bp, Homo sapiens
gcctgctaccgctacagctacgttcacacctttgacacttacagtaagacacttccaacctggcaaattcctgcacattgttcaaaatgtggctttgatattttctttcctagaatctgtctgattcatttgcccaatctttcttctaaagatgtcttctctttgcctccttatcagagttcacattaaactcaccatattttattaaaacactccttgcagttgactttattcactacctagattataagttccttaaagcagcttgtctaatacatcttacaccctcaattattagacaaaagcctggtacacggtagctacttgacacatttttattgtccctatatgatacgttttattgcctgtactgaataaacttattattttaa

SEQ ID NO: 182234 - DNA, 308 bp, Homo sapiens
tttctatcatgaagggatgttgaattttatcaaatgctttttcagcatccattgaaatgatcataaggtttttatccttcattctgttgatattgatgtatcacattgatttgtgtatgttgaaccaccttgtgtctcaggaataaatcttacttgttcatgatgaatgacctttctaatgcattgttgaattcagtttgctagtattttgttgaggatttttgtattaatatccatcagagatattggactatattttccttccttccggagaggtcgagtaggattgatattagttctttaaatgt

SEQ ID NO: 182235 - DNA, 188 bp, Homo sapiens
aagacacaggtcagagctggaagcagccctgaaggaggcttcaatctgtggctaaaacagagctggtgctgaggctccagttagagctcaaactggacccttcaagcaacacagacagcactggaagcattcaccagagaagccccaggacacatctctggggtattcagctcaaaatgcaaaacctg

SEQ ID NO: 182236 - DNA, 870 bp, Homo sapiens
cacagacaattttctttggaggattatcctggggccacttgaatctcttctcccacaagtgctgaaagtcagaaattttgagagtgtctgttttcccggagtggtccttatccactggctgactacttgggaatctgaataccaagttccgtcactgtaaggccatgtgtattaaaggagacacagaagtgaccaagaagcctccttcaatcttcccaaagactcaatcaccctcttgaagaggacattgggacacagatatgcactgaggaaaggccatgtgaaaccacagggagaagaccgtcatctacaaataaggagagtgaccttagaagaatcctgccctgccaacaccttgatctcagacctctcgcctccagaactaccagaaaaccaacttctgtcaagccatccagtctgtgggacttgttatggaagctctagcaaaataatacattcactaacagagatattacaggaattaatagattattttaatattcatatgttacatatgttcactattggtaattaacataaatataatgatcctaccatacagtctccaaaatcttctccaaaagagagagagagagacaggaactaatatttaccaagcacttactaagttccggccttgcagtctctaatgggtaatacaatgtttatttcattgttaaagcgttgattgtgttacacccccggtgacatagcattggaatgaaggggccggaggacaggggttggtaatccgagatgattaggttcaagcataaatcctgggaaaatacgggaggtaaatagatgtcagggcgataataaaaatagccgtaatcaaaaaggcgcgggggggtatgcaacctcacagtt

SEQ ID NO: 182237 - DNA, 213 bp, Homo sapiens
ttgaaagcaggaaaaaaagagatttacattaaatagcggtcatcacggcgttcgtaagtttccaactatttatcaacatgcttggttcgcaactgcaattcacttaattggacttgcatcttcagtaacactgcagcttccatactggaggtggtagagttattctaagccatgggcaggctggtcaaatgtacatatggctgtgtaattgtc

SEQ ID NO: 182238 - DNA, 758 bp, Homo sapiens
ttggttcctttgctggctgtagcccactaaactgacttctcatggagcacagaggaaaaagaaaaaccaggctccaggaagggcagctcctcctgtcacagggtccccagtcccacctctccaggcaggaggggcgatggtctcacttgctgcagatgaccttgtaggtgaccccacccaatactccatagtccagttttactggcagttctgtggagggtggggagggggaggagtggagctatttaactgaaaaacaatagcatggatgggaatgaaaaatggtgcagctgctttggaaaacagttaggcagttacttaaaaagttaaacataaacttagcgtgtcgcccagttgttcctccgctacgaatctaccccagagcaacgaaaactcgcagcatccacatgagactacacagacgtccacagcagcatccacacgaggacgacgcagacgtccacagcagcatccacacgagactacgcagacgtccacagcagcatccacacgaggacgacgcagatgtccacagcagcatccacacgagactacgcagacgtccacagcagcatccacacgagactacgcagacgtccacagcagcatccacacgaggacgacgcagacgtccacagcagcatccacacgagactacgcagacgtccatagcagcatccacacgaggacgacgcagacgtccacagcagcatcgaggacgacgcagacgtccacagcagcatccacacgagactacg

SEQ ID NO: 182239 - DNA, 431 bp, Homo sapiens
ggagttggaggctgcgctgaggtatgattacaccattacactccaacctgggcaccagagcaagatcttttaaagctggtgttagaaattcaggccaggcctggtggctcatgcctgtaatcacaatgctttgggaggccaaagtgaaaggatcacttgaggccaactctttcttactgctcttggatgtttttcagggcataagcaggctgctattaaaattgactgatttaaaaaataaagctaacagcttatgctgaaattaacctcgtctttgtgagccaaagatcaaatgcgagacaaaagctggctagagtcatcatttcctcagctctgcaatcaccttacaacttaagaccattttcacagtggagacagttgttaaaagttctgacaagccctgcggtaacctttgattacaaagccactcc

SEQ ID NO: 182240 - DNA, 375 bp, Homo sapiens
cattgccagaggaggcaccctaacaagctctccttccaagacctagttcacgacattctacggtctctgcacacagtctgaggggcttccaaactctggagattaatgatgacacaaatcccacaactcagcttgaatacttctggtcctctttgctggccaccatgcaaagccatccagaggtcctgggaagctgagaggataacagggatttcctttccctggatcatgttcggtccgggcagcctcccaggagatctcatggagacaatgaagtagttctggatccagctcaggtggtggggaggtaggtaaatcaatcaagtgagtgaggtgtttcctcagagaaagcacacacactgttcatgtaacctt

SEQ ID NO: 182241 - DNA, 129 bp, Homo sapiens
ttctccacagtattgcaactgtcttccctgaaaaactcttcaacactttactctctccaagtacaattcagacatcactttctttctaaagccttctcagcaacggccccttgagcaattaacacatat

SEQ ID NO: 182242 - DNA, 401 bp, Homo sapiens
tcagcggtacattaagcgcgtctgcgtgggcgtctgcgtattaggcgcgtctgcgtcctgtgccctcccggagccgccctgccgctccaggccccgcagcccacaccggacgcagcctccaggctccagggcttcctttttcttgctcagcagtttgatcagatgtgcagtgctgggctgaaaacccttctcctgtggaaattccaaagcaggcgagtggggctgggctgagtcttgtgtcccggtgggtgacatcccccacccgtggtatcagtaaaatcccagtcctgaacctgaacactggggcgcctcccaggccccgacattcttcccgctcctcctgtgaccgcactgacggtatcacgttctctccctccacggcactcagacggcggcgacct

SEQ ID NO: 182243 - DNA, 786 bp, Homo sapiens
cacacatcccaccagcaacatcttggttccggaagtctggcccatctggtaaggctctccctcttcctgccacatccatgtcctgtccatccttgggccccacttcctccacggagcccttcctggtcacttcagcccacagcaaagtcccttctctggactctctagctctgacctgcacactgctatcacggcaccaatgactccacaccttgcaccaccagcagtcttcatgtgtgtatatcttagtttcttaaaagggaaggaccacctgctgtcatattttttggtccacataatgcctaccagtatgttttgcatataataatgtacagttgatgattaaaaaaataattctcctgatttggtgaaagagagaactgaggcctactgagattaagtaatttgcactgaaatcacaaagtgagaccttcaagggcagagatctagtacattattcactttgcaacactggagcccagcacacagtaagcacacaattctcttccgctgaatgaaggaacaaaagtccttcctctttccacacatctttcagtgaagatatattcctcagactgcctcagaaggaaagaaggggcaaaaagaaaaggcatccaatggcctagtcgattctgaagcggacctaggatgggacagcttcctgggataaacctgctgggcacagagtacacctccagacactcgggttcctgttatcccttccctgcctcaaaacccaagacccacagcattctgggtgagtctcccatcaccttccagagccag

SEQ ID NO: 182244 - DNA, 316 bp, Homo sapiens
tcccaagtagctgaggctaccagcatgcacaaccacaccaggctaatttttgtatttttagtagagacagggtttcaccatgtcggtcaggctggtcttgaactcctgacctcaggtgatccacccaccttgtcctcccaaagtgctgggattacaggcgtgagctaccgcgcacagcctgcagttgtaattttaacagatattgccaaattgctctattttctgtaagctttctgttcatattctttaaaaaaaattgttcaaatttttgcatgcacgtgtgtgtgtgtgtgtgtgtgtgtgtgtgttaggggat

SEQ ID NO: 182245 - DNA, 629 bp, Homo sapiens
atgtagctgtctctgatcatcctaaacaaaagttaccctgtcctcttctaaaatcttacaacagcatttatgccactttgatggcatatctgagtttattcaacaacttcattcatttacaatatactggctgagcgcgatggctcactcctgtaatctcagcactttggaaagcagaggcaggaggatcgcttgagcgcaggagttcgagaccagcctgggcaacatggcaaaaccccaactctacaaaaaatacaaaaattggccgggcatgatggcacaaacctgtattcccagctatttagaaggctgaggtgggagaattgcttgcgccaaggaggtcaaggctgcagtgagctaagatctcaccactgcactccagcctgggtgacagagtgagaccctgtctcacacacacacaaaaaagtacaatgtattgtgaacctaacaatgggccaggcaccctgtcattcataaagcttttattccatgaccaaatgattatgctcctttatccctcacagattctagcacaatgccttgtataaagaaagtactcaaacatttgccaaatgatatactatataactattaatagtatcataaggtacattcaaggacctgttatt

SEQ ID NO: 182246 - DNA, 731 bp, Homo sapiens
acaataagacctacttattttcctcctgagcagtttttagtgacatcaataacaatttttttaggctgggcacagtggctcatgcctgtaatcccagcactttaggaggccaaggtgggcagatcacttgagctcaggagtttgaggcaagccagggtaacatggcaaaacctcacctctataaaaaaaatacaaaaattaacagagcgtcgtggtgcatgcctgtattcccagctacttgggaggctgaggtaggaggatctcttgagcccgggaggtcaaggctgcagtgagccatcattgcaccatcgcactccagcctgggctacagagcaagaccctatcttaaaaaaaaccaaaaaaattataagcgagtcatacaagttcttcacagcttttcattatggtaaaccttgattaaaagccaaggttataaatgtaatttttgctaagtgcggatgtattgtatctgtagcaaactgtaattcaggcccctgaatgtaacatcctagctctcattccttttgctgtcagatttccctatagataacgtctacatctgctaccttatctactcgcaaatatttatgattttcttccatgaaatttacttttctcccctgaacctgtaagccaaatcaagtgaccttttgtgaatctcaaacctctgtgaattttaggtagatttaatattcttggccaccactttctattcagtcaaattcaagaat

SEQ ID NO: 182247 - DNA, 270 bp, Homo sapiens
agaatttacaaaaaaacaatggcgacattttcccttgactcatttggacctgtctgggtcttgttatgaatattggcctccatttgtgaactgtggatgaaaagggttagggttgggtcatggccttgggccacagttaaattaactggctcatagtgtgattgaactaatgaccttagcctcattaccactatgttttaaccagttgagtcaatcgaacattacagaaagggtaatcaaggtatctcttagaaagacagctgtatttct

SEQ ID NO: 182248 - DNA, 718 bp, Homo sapiens
ttcagaaaactgaagaaataaaactgaagcagaggtggttaggtgttgatgaaaaaggtttgcatagatgatgggtaaatatcattgatttatgttgggctttggagtcggtaagggtggagatgagtgtattaggtcaccagctgctcctccttctcccagagtcaggggaattgggtgagtgggtaaggaggccttgcttccggtaaacactccttgatgttcccttagagtcatccctttgaagactcccgtccctttgatgacaccagcaggggtgaccccttttaagccatcagagtagttcacccatgggagcacgtgtgaaacattagcctgcttctgcccctctcctgctgtttgctgctgcacaagtatattctgagcagaatgggggtccagagagggatggtttttagtcttccaataatgcatgggaaccaaaaagtcaatctgtaattgatccctaaactccaagcctactataatgacatgaatttctgcctagattcatggtattttgtattttacagtctttcattttctgatgaatgtttctcaatgcaattcttcaccattggaaaccccaaccaggagtgagaatatgggattttctagatagatatgtagatgaatgtataaagagatggataggtgagaatcagattgtggtttagcacaggtttcagagtcagtctgcctgcatataaaacccagt

SEQ ID NO: 182249 - DNA, 332 bp, Homo sapiens
tccaacaattccactcctacgtatacaccaagagaaataaaaccatgtctacccaaagacttgtatgcaaatattcacagaagtattactcacaacagccaaaaagtagaaatccagtaataaagagacaaaaataacaaagcagagtgtttttcctattctttcccttaacaatcaacacaggatacttatgtgaccacacatcatgcaatcagttctgcagcagacaccaggtgggtgtcctccaattcaattccaacaccatctacctggagatagagtcagatcccacagggtgaggactcagtcccacaagactgccctcgacttct

SEQ ID NO: 182250 - DNA, 570 bp, Homo sapiens
  misc_feature (497)..(497): n is a, c, g, or t
agatggctgaggtttcgctgaggattttgggtttacagacttccatggcattcccctcagactcctcagtttactcaaggtccctaaccaagaagacaaaatactgtagcctatgttattcattcattcattcattcatccatcattgcattcatcccaaaaatacttatcaaaatattactaagtggcaagcatgcagctacttctcccttttagctcttgggtcctttaattaatcaacataggtgggaaggagccaaggatggctgggtgctccgacactaatgactttgggccacgttttgagggggtggaaacgtgtttgatgcaactagcatttgaaatccagattcccattactgggtatatacccaaaggattatatatcatgctgctataaagacacatgcacatgtatgtttattgcggcactattcactatagcaaagacttggaaccaactcagatgttcatcaatgatagactggattaagaanatgtggcacatatacaccatggaatactacacagccataaaaaaaggatgagttcatgtctcttgtagggaca

SEQ ID NO: 182251 - DNA, 529 bp, Homo sapiens
tcttttggaaactggaaatcgattttaggaatatttctgggatagaacaaaacaagtcatctggagtcagaacccaggttctaaatgacgatccttcctaccccaccaaaggtatccatcacagcagcctacagattcatttattgaaatctcacatcttagaagtgttatcctcacagaatcattcatttacgcggggaaatcactcacttggagcttatgatgtttagtcacgaaagtatgtttttgcaaaacacctacaatgcattatctaaagctgctaagcaccactgttctatttgcagcaggcattaaggcattatcctttgtcccatgctgtggacaaatgaatggtgcaagaagtactggctccaaattaccgtgaaggggagaaatacctttctttaaaattttattttcatttttaattttttaatagggttgggatcttgctatatttcccaggccaatctcaaacttctcaagcaatccttctgcctcagtctcacagactgctgggattacaggg

SEQ ID NO: 182252 - DNA, 210 bp, Homo sapiens
tttgtaatgcatcaactttatataaatggaatatagaagtgagtataaatttataaacggattaccttgccaaaaatgtgatggttattgaaacatcatttaagatcacttatagcaaaactaaagtgatttttctggaggaaaacaaagtgacttggaagactttaatttttctcaaaggtggcgctgttactctttcaaaatggtttt

SEQ ID NO: 182253 - DNA, 181 bp, Homo sapiens
atagacgtacacatcgaatcccaaattcaaattaattgtagcacaaatctgaagttataataatgctgccagttacagtaaaagaaaagttgtcttgaaaagtatgaatttagatctctattaagtgtcacagtgctaaaacatggccaaaattattctactttatatagtttgcagtgac

SEQ ID NO: 182254 - DNA, 309 bp, Homo sapiens
tgccacttaaagctgctgatcgtagacgatttacttaacctgagttatatgaaaactaagaaggttaaagcaacacagaaggacaaatattgtatgataccacttacatgaggcacctggaataggcaacgtgaaattcatagagacagaaaatagaggttaccagggtctgaagggaggtagaaaggggggctatttatttaatgcatagtttctgtttcagttgatgagaagttctggaaatggctagtggtgacggttgctcaatactgtgaatgtacctaatggcactaagttgtacacataaaa

SEQ ID NO: 182255 - DNA, 447 bp, Homo sapiens
ggatgacagcacatgacagcatcttagccaaagtaaggagttgacacagcagtgagcaggaccgtaaatcaatgctgcagagccaggtgggtagatgcaaatgaatgctgtgggctgggtgaagacctaaggaagtaaacttcatgtgactcacacgaagagagcaccagctactgccccctcatctgctgccacagaaatcagaaatagagatttctatgtgaaatcgcccaatttttaaataatagaaagtaatatggatcatgtgttaaacctcaaactaagcagcggatcaattttgctgcaagtctgcaaacaaggactagcaatgtgcaagttgtcatagatattgagatcgtgcacggtgaaaccactggagaggtggctcagaccaccattcaggtgcttgctagttgtgtatgttctccaaagcttacttttctcatc

SEQ ID NO: 182256 - DNA, 595 bp, Homo sapiens
ctgcttttaggcagggcagagagcttttgttctgtttcttctcagttgtctcttattcaaaataatgcttttgctaaagtgacatattttgggctggcagattctgatctcctacaccttccaagttccaggaacatgttttggaggacttctatggttccttccaacttcgatattatgtgtttccaggaaacaggtgtgaggcattccatggtagccagaggtagcatggaagatgtttccttttgcctatgtctctgaaccccttactctgaaggggcgtgaccaccgactctcccagtttaaacagaggtgggagaaggtctttgtgatgactttccacttagtttatagaccagtcctataccagagctgaggccaggattattaggaaagagaagcatgaaccccaaactcctctccctcattgaaacatgaaagctaaacagggcttccatgcaatttcccaggacaaagagaaacaagcaagagagaaagcaaaaagccctcccgcagatgaacaaagagtgtttcaaagcacaatactactgttgttttagttcctctcgtaaaactcttcagtggtctctcacta

SEQ ID NO: 182257 - DNA, 175 bp, Homo sapiens
aacaggagatgtcaatgcccagagatctgaactaacagctcaaggaagacttcctcagataaaaaaataattgagtgctcataactacaccatccaagtggtgaatgtacaatcttaggaagtagaagaatgaagttaccagttgattataacacaaagggtctgtgaaaaatgt

SEQ ID NO: 182258 - DNA, 103 bp, Homo sapiens
ttgctgaagtgttagagctgggactggaacataggtctttggtccctcatgtgatagccacagtagtagtggtagctcctaccccaggccatgcatcttgaag

SEQ ID NO: 182259 - DNA, 131 bp, Homo sapiens
aaaatcacttgcaaccaggctaaattaagagccccttttatgggcttccataagtactttacatgtcaaaacactcatcacatttataattacttattcaatataaatttccaagaaacgcagatcacaaa

SEQ ID NO: 182260 - DNA, 745 bp, Homo sapiens
tagcctcacagccccggagctctgatgaccatcgtggccactcgctcctgctgtccactaccaggaggccacagtctggagcacttcagcacctggcctcccttcctcagagacaggaatcccccagtctggtccctaaacacactgactcacctccctgcccaccctcagcttcctcccacgagaccagccctctgacttcatggtcttggcttccagcgtccctgtggctctccttcttctcctgtcccgccaggaagctgggtggcctcaagcctctgcttgcaaacagtctccccgccccctggcctcctggtccttcctccccagctggatcctaacgcgcaccttggacagcgccaagcccttagctgctcagcacctgccccgcaggaggaaaccccatcacgaatgggttacacgggggtggtctcagcggcgcccttcgtgccctgcaagttagagacagggacaattgtctcccttccccaagcctcagggacccttccccaagctccaaccccatctccagtttgttttttctgtctctgtttctgtctctctctgtctcagcatatgaccccgctccttctcatccagccccaccaaggaacttgaagctccccctaggagtcttgcctactctaagccagcctcccctctcaggctccatcattttccctcctctctcttttggggctctctcctgacaatctacccctccttttccttgtatattcatctt

SEQ ID NO: 182261 - DNA, 136 bp, Homo sapiens
ctccatctaaaaacaaaaacaaaaacaaaaacaaaaaacctgtttctgatggtctcagaaatgagagagagaatgagaggaccctaaaggaagggagatcagaggtaacacattgattaagaatcctcctcagcta

SEQ ID NO: 182262 - DNA, 186 bp, Homo sapiens
gtctgcagaaattagtttagggaaggatagtgtgttacaagcaatgtctgtgttctttacccctgcaaaataggaatgagacagcttttggaatagggtctatgaagatatccttctttttttttttttcaaattgggttcccaccgggcaacttggtgggggtacccgagccctcaattcgatat

SEQ ID NO: 182263 - DNA, 619 bp, Homo sapiens
tcttcagagctagataacagacactatattaaagacttgcagaaatatggacgctgaccaagcagactggatggggatgtggtcctctgtaatgaggcaaaagtaagaaatagagatgtagactatgtggactctaagggctacaggaccaccccttgagaatcactctaaggagggctctgtatgttccatcaaggtcaccagcaacattcagtcatcctcctggcaaggaattgtcctggaaaggcatctctcaaattgttgggttgacacaatggtctccctggtgaatgttatgggctgaattgtgtctccccctccaaatttatatgttggagctcaaactccgagtatctcagaatgggacttattaggagataggtcctttatttattttttatttattttgagacagagtcttgctctgttgaccaggctggagtgcagtagcacaatcttggctcactgcaacctccgcctcctgggttcaagtggtcctcccacctcagcctcccaagtagctgggactacaggtgcatgccaccatgcctggctatttttgtatttttagtagtagatatggggttttactatgttggccaggctggtcttgaacttc

SEQ ID NO: 182264 - DNA, 303 bp, Homo sapiens
tcctatgttctctcaaagctgtgtaaatctaacttgaatggtaagcggctttattttaacaagtgtgagttatcagagttcgcatatcaaattaaacccaatgaattctggacttgttttaaatttcaagccagaggccctaactccctgcatttcacttggcggctggccagacttagtaataaagtgctaagcagaagacaggaaatactagagaagtcgaacaatgttatgacaatgtttataacttttacagtcaagcctggctgcacatctgcacaacatcagactctggtcagaccc

SEQ ID NO: 182265 - DNA, 641 bp, Homo sapiens
gcatttctcttatcctgccttttcttaaatctgcagtacttagtgggagaatagaactgaagaactctaaacaaatgtttcttgctggctgctgttttagtgtgaaccccttcttgtcttctttatgcttaattaaaaaaaaaatttttactttttcattttactcatgtaaaaagtcagcctagaggttaaaggatgtgagcctatgtgttctaggcaagtagcattaatctttcagagatgttttctgggttgaacaaaagggaatagatcaacccagggtgctcgccaactcgtaatcatcgtcctcattttgtgaggatttttttttttgtcttctaggggagaaaactaattatacagttatcagttaaaatctcaattaataccttaacagaatcagttggtagacagttaattggtacttgaggtcaagaggtcactagaaaggagttgggaaaaagccaaagaaactttatgtattaattgatttgctgctgtaatagatgtaaaagtctgaataggtggtaggactggtatctgaaactataatcaccaaggactcagattctttctgtcttgttgttctgccatccttaattaataagcagcctccattttgtggaccaaggtagccactt

SEQ ID NO: 182266 - DNA, 208 bp, Homo sapiens
tcttctttgcttatatatggctgccttctctctatgtgctcacatggtgtttcctcgatgcatgcgcatggaaagaaagagagcaagttctattgtatttcttcttacaggtggaaaaatcctattagattaggattcatacccctataacctcatttagccttagttacctcctaaaagccctatcttcaaatattgtcacattagg

SEQ ID NO: 182267 - DNA, 179 bp, Homo sapiens
catccctgcacaaacacaatatattgagattactatgatcattcaacctcttccatctatctcacatctctgtctttattcccaactatccatctttttaatttacaaattcatttacctatttcttttttttttttttttgggggtccgggggggagtagggttgcaaaaaccgggag

SEQ ID NO: 182268 - DNA, 487 bp, Homo sapiens
tgaatgggtgttcgatcttagaacagcattttctgtatcttttgagatctgtgatttttcttttttaattctgaaaatatggtgaaagtattaattttctaatctttaatcagtcttgcattcatttgatgaacttcactttgtcatgatatattatttgttttatatatggttggattacatttgctaaaatttgtttttacatctaagtttatgagagatattggcctgtaggccagtctggaagcaaagatagaataagtaatagccaaattcttggtttatgtctgagattgagaagatgtgatcagtatgtagatctttggggtattaagcaccaataggcagtacttgattctaacttgttattgttgtagataagggaggccctcaacatggagtaaatctttcttctccccactgcctgctttcattctcctctgaacagtgactagaggaatagaggagagccccatattaatttgag

SEQ ID NO: 182269 - DNA, 241 bp, Homo sapiens
ctctctccacactgggtatcttgcatttggaagtcacttgtgggactctcagtgaaggtagagttccatgcccaattggaagggtctaagagctgaggtggaagggagctgtagaaatctgaaaccacgggagaaaaagcataagcactgggggatgctgggtgaggactttatgggttctcacaaaatgacctttgcagcctgggttgtggttcagtccttggagccagtgtggagagag

SEQ ID NO: 182270 - DNA, 653 bp, Homo sapiens
tttggaggaaatgtgtgcccacaaggtaaatttttaaacttacagagaaagctaacaaagaggaaaatgggaaaggatagaaaatagaatggaaattaaaattaatattattttaaaaaatctatttggtaccagaaactagcatatacacatacatactatacacacacacacacaatcttatatatacatctatgtaatcatatatataaatctctaatcctcactacaatatttacttaatagaaagctattaatattccagtttcacagatgagggaactgaagctcagagaaactaaacaagctgatctcacgattaaaaaaataacagatttaagatttcaatgcaggtttgtctagccccaagccctattttctttttcctaaaacatcctgcacaagaagtgcaggaaaaaaggagggaggagaggagaccctcaggtctttcttgttgctgcatcctccactaaacttttcctggtggtcagatttgggttagactccctcttacttgctcctgacatgcttggcatttccgttatctcatggcttactgaactgattgtaatgaattgtctgcttttccagtttaccatcagatcatggcctgtgtgaaaacaaggaccatatcttatttattttggctgaaa

SEQ ID NO: 182271 - DNA, 269 bp, Homo sapiens
agctggaagtggtggtgtgtgtttgtagtcccagctacttgggaggctgaggcaggagaatcacttgaacctgggaggtgaaggttgcagtgagccgagatcgcaccactgcactccagcctgggcgacagagcgagaccccgtcttaaaaacaacaacaaacaaaaactttacatttaaaaataaaattgttatagaactgtttccaatgtagccaagagaatccaaatattacggtaatttgatacccaaacctttagtttaaaaaa

SEQ ID NO: 182272 - DNA, 478 bp, Homo sapiens
ctatgtctgaaggctgtgcatgaaatgacataatgtggtaataagtaaatattcagtgaatgaatgtaggcctcatatatctttttcccagtagagagattgaggttggtaatgtagataacagatctggtgacactgtcttctactttagagacctgatattggctagaggtggggtaggtaaaggggagggaataggcttttattatgttggtgagaatgtggagaaactggaacccttgtgcactgctggtgggaatgtataatggtgcagcttctgtgggaaaaagtatggtggtgcttcaaaaatataatcataataaacagaagtaccacatgagccagcagcttctcctgatgcacagtgcaagaaatgaacataagtggtaataataaatattcagtgaatgaatgtaggcctcacatatctttttcccatagagagattgaggttggtaagtaataacagatctggtga

SEQ ID NO: 182273 - DNA, 677 bp, Homo sapiens
aggtatcaaattatccttgcctaagcattacttcacaggctggtcctaacctagttttgcaaaacaaatcaaaacattttaaatccatggaacactttatttaaacagaattttctgtagaagcctggtacaaaaattaaatacggggctgctccattgcatcgaaaacggggaggcccactgaggcacagggatagttgcttttccaggaccacccccctcatgtcagtattattcagcagggaacacaacccgttcccccagccccacagggatttcagtaatctaagtcccctctgcataggtcactgtgacagtgtcattgtcattctctttggttttgttagtgaaagatttaggattcagtgtttatgaagacttgttttgtttttgtttgagacagggtctcattctgttggccaggttggagtgtggtggcatgatcctggctcactgtggccccacctctcaggctcaggtgatcttcccacctcagcctcctgaataacaggtgtgagccaccagtctggctaattttgtttattttttttgtagacatgggggtctcactatgttgcccaggctggtctcaaactcctaggctcaagtgatccactcgctttggcctcccaaagtgctgggattacaggtgtgagccactgtacttggcctatgaa

SEQ ID NO: 182274 - DNA, 242 bp, Homo sapiens
taccttagacttcacaaaatcataataatcaaatacataaaatcatattggaaactgtaagttgtcttgcaagtacaaagtattttatagtttagcttttagagagatgttgaagccattttacccaatcattttgaataagaaattggcaagaatgagaagaaataggttatagagtagataacagtctgggataaaggaaccaggaaggaaaaagtaaagttctcaaaatgagctgctaa

SEQ ID NO: 182275 - DNA, 188 bp, Homo sapiens
tcactcgctagcatcttctgtatttctgggttttctacctgatttccttctccccttacttccccttcctctgttttttccccacaatgcccagtggattcttgagcagtgctgctgtttgtctcttgctggtcaccacgctgagtgcccctgcggccaactgagaagtcctgctcgtggggtggggc

SEQ ID NO: 182276 - DNA, 393 bp, Homo sapiens
tttcgctatgttggccaggctggtctcgaactcctggcctcaagtgatctgcccacctcagcctcccaaaatgctaggattataggtgtgagccaccgtgcccggctgcatgctctggttttagagaaatcggcatacggaccaaaagtcctaaaactgcaaaagagcacaatctgtaagggtaaaaaatgaaaaacgccaaatacacactgcttcccataaatcatgtcaagactacaacaagccgtgtttgagaggaggaaaccccaacgaggaaataatagagtaatggcattcagcaggataccctaggacacaggcaatcgggatacccaacaaatggaaggacagaagaagccaaatgtcatttatgttcagctttgggccattact

SEQ ID NO: 182277 - DNA, 426 bp, Homo sapiens
tagatcgagctggcccactgaaatgaccagatccgcatgtcaaagttgtaaacctttatactcccctgaatgaatctgaagaacagattaaaacggcctttatatgaatgatccaagcacaactacaagagctgaatgagtctcagcaactgcttagaggcttcaagcacaagttgcctttttttctttccatttaattcatcttctgaccatgaattcaatccgcatccaagcttgtctcaatctggagtttcttaaagtctgaggatgcacatttccaacctaagacacaacagtgttcatatcttttgtacctactgttcagaataagaacaactgatacaataaaacccaaaacacctgaaacaaaaaaggcatgtcaagcaataatgagaagtaggtttggacaggtagagtgggacagga

SEQ ID NO: 182278 - DNA, 470 bp, Homo sapiens
gtaaaactgtaaaccctgtgcagtttaactgttggtagttatttttcatctggagctggcctcaaggagtcccattcctaggtagcccaagtaaatgtgcttatggctggggagaaaagcaccatcctactccccagagattcccagggtcttcgtcaccatggacccaggccagggattaagggaagccagaaagagccatcctgagcgtctggccagaggatgtcctctcccgagagctcaatatcaagctcctttggaggagcagttagacacaatagcaccatctcctttgggctttttgagtactttggggcttgcatggccatttcctgtcgcttttgctagggctgacctgggtaaactggagcagacatagaatccagaagtcccatggagctccaaaagggaggaagcctgcagggccacagggcagggttctaccttccaccagaggccactggtccagc

SEQ ID NO: 182279 - DNA, 558 bp, Homo sapiens
tcactatcttctgaaggtaccctctttacctttgtgcactttgccaaatagaacatatatatttcacaaaataaactatagcctgacttcttaaatgttctatccactggtcccaattttgctccttaggaacacagagactaaggctaaagtgtcttgcatttggtaaccgttcatttgaaaataatagctcttctaccgtatttctattttgtcttatccaatattagtattgctatttcctcaaatattccttttataaaatttgttgaatttaccttccaggtactgaaggctttgatgggagaaagcatctcatttcccatttctgaggtaaaaacaagacaaaaccaagagaacaaaaccaaaaaatagatgttggttgtcaaaatatacaaaagataaaaacatctgatcactagctttgactaaaagatagaagctatgatttatttaaatttacattgggcagtgtattgattagagtaacattttttttcttgtttatataacagtccaaagtgagtattcctggttgatatgtgtttttccatcacg

SEQ ID NO: 182280 - DNA, 279 bp, Homo sapiens
ttgataccacacccatcgtccacaaggaagttaagacgcttgtactgtatatgattagaatgcatcaaagccaggattcaaaaacaggtttctatgaacttaggagccctgtcattatgccaataagatacactgactttctccttttctattacaattgttcctttcttggtgtgtataatacacactaatacttcaggagggtaagcactgtggcttacccctttgcagccatcagagactctagaacagacctaaggaatctatatttgcttagca

SEQ ID NO: 182281 - DNA, 1378 bp, Homo sapiens
  misc_feature (595)..(595): n is a, c, g, or t
  misc_feature (751)..(751): n is a, c, g, or t
  misc_feature (981)..(981): n is a, c, g, or t
  misc_feature (989)..(989): n is a, c, g, or t
  misc_feature (1015)..(1015): n is a, c, g, or t
  misc_feature (1019)..(1019): n is a, c, g, or t
ggcacgagggccacatggacggagctgccggggcggcggcgccgggagcaggatgcggccgcccgtaattaaatagcatttactcttattattactaataataataacgtaatcatacctctagtcatagcataccatttatcgggctcggcgcaggcccgcggggagcgcagcccggcggaggtctccctctgatgccgagccgaagctggacggtactgctgccatctcggctcactgcaacctccctgcctgattctcctgcctcagcctgccgagtgcctgcgattgaaggcgtgcgccgccacgcctgactggttttcgtatttttttggtggagacggggtttcgctgtgttggccgggctggtctccagctcctaaccgcgagtgatgcaccagcctcggcctcccgaggtgccgggattgcagacggagtctcgttcactcagtgctcaatggtgccaaggctggagtgcagtggcgtgatctcggctcgctacaacctccacctcccagcagcctgccttggcctcccaaagtgccgagattgcagcctctgcccggccgccaccccgtctgggaagtgaggagcntctctgcctggccgcccatcgtctgggatgtgaggagcccctctgcctggctgcccagtctggaaagtgaggagcgtctctgcccagccgccatcccatctaggaagtgaggagcgcctcttcccggccgccatcccatctgggaagtgaggagcntctctgcccggccgcccatcgtctgagatgtggggagcacctctgccctgccaccccgtccgggatgtgaggagcgtctctgcccggccgccccatctgagaagtgaggagcccctccgcccggcagccgccccgtctgagaagtgaggagcccctccgcccagcagccaccccgtctgggaagtgaggagcgtctccgcccggcagccacctcgtccgggagggaggtnggggggtnagccccccgcccggccagccgccccntccnggaggaaactcttggatgatgtactgaccaaaacagggaataacctaacagagaggaagacagggattttaggaaaccggagatcacacaggaaggaggtaaagggaaatcccaggatgatggcaaagggaagtccccaaacaacagctgtgcaacaagaataaagaacaatcagaggacctcttgagcccagaggtcaaggctgcggtgagccaaggtcgtgccactacactgaagcctgggcaacagagtgagaccctgtctcaaaacagaaaaggacctatcagccccaagtggagcagaacagagggatttgggaggaatgtcctcagaaaaagatattaaaacacagttatctg

SEQ ID NO: 182282 - DNA, 329 bp, Homo sapiens
gtctccacccacgtttcaccttgaattgtaataatccccacgtgtcaaggataggtccaggtggagataattgaatcatggggcagtttcccccatactattcttgtgatagtgaataagtctcacgagactgatgattttataaatgggagtttccctgcacaagctctcttgcctgccaccacgtaagacatgactttgtttcttatttgccttctgccatgattgtgaggcctccccagccatgtggaactggagtccattaagccactttcctttataaattacccagtcttgggtatatgtctactagcggcatgagaacagac

SEQ ID NO: 182283 - DNA, 635 bp, Homo sapiens
gcctggtggggactaatctaaaccagttcaagatgcttttgcttaagcctgtttagaggaacggaaggtgctgcagaaatggaaatagagtggtatatgggcctctttgccaccccgctcctgagctcgctgcctcttttttgtttttgtgggtttcttggcacctacctagatttctgctgagatctctgtttcaggtcttttcagagatcatgtttcctaaaagatggttcctttctgctggacatcctgtctctgtcctatttggccagatagtacttcagttgggaaaagccatctttctcttcgtgcctggtgccctatttcagaaggaagcctgaaaagtcatttccatattctgtgtgtgattgcgtcctgcctagcttatcacagtggttgttccctctcggatgaacaattcctaccctcctctttgcccagcagatgaaggcaaggattgtaacccattattagagtattgaggacctgagttccccactcatgttgaacttgaggcaagactgggcggtttattcccctctggctactctcccacttgtaaaatgaggcgacatctctaatcattgacaccaaacaagaacatagcctaataataaaatgaatggtgttatatg

SEQ ID NO: 182284 - DNA, 409 bp, Homo sapiens
aggaaatctagaatttgcccctgccaacatgtgtgttgcctcttcttatcagccttctcattctgtcttgacttagggcctctcctatcagactaagctctcctgaaggcagggactttgttgtatctcaagcacctgtcatagtacctggctcacaggttgacaatgacatccttaacactcatcaatagctagtgtttactgagcacttactatgtgctaagcaatgccttaggggatcccatcacagcctatgagggtttgttatcctcattttacagaagagggaactgaggcatggctaggaattatgagacttgctctaggagacctagctggggaatggtttgacttcagacttgtctgacgtaaggcctttgcccagtgatcagcaaactacgacctgtgg

SEQ ID NO: 182285 - DNA, 194 bp, Homo sapiens
ggaaggaaattcagctgtgatagtaacctgagttctttcactctcagtggaaattttaactaaagaatttctggaaattaaattgaagtattttgttaaaaacgaatgactatgggaggactttaaagaaactacaatgtattaaaattgctgtcaccaatgcaaaccattgctttccatgatttgtaaatagt

SEQ ID NO: 182286 - DNA, 438 bp, Homo sapiens
cccaaggctgcctgctgagtataaaggcaatcaccaaagataataaaggaaggaaaatcttttcttgaacctgctttcatccttgattatccttaataataatcctcttgttaatcctatccctgcaaacatatatgaattcatgactttacaaataggaatactcactgcgcaaaagatattaagatatagcaaaaccaataactgtgcataatacaaccttaaatttggtaggttatgctgctttttcaacctacagccaagagttttgtatagaaaattccataccaatgctataccacatatttagatactactactgccttaaaaaatgtaccataggtgccaagttagccaataaaactgagacacaccttaccagtccagtagctggtattaaaagattaagactgcttaatgctacccacttaaatactg

SEQ ID NO: 182287 - DNA, 193 bp, Homo sapiens
tggatctagaggacaggctgccaacattggaactgctgagtgaaaagcggacctgcttgtgttttctctaaacttcacattataccattggcatttcccatgtcctgtggacccgtgagggtcatttcgaatggctccagcacgttcccttctatggctggatcctcacttacttctctgtcctcatcgagga

SEQ ID NO: 182288 - DNA, 392 bp, Homo sapiens
tcatctctttaggtgttaaaatagaaactgccaagacagctcaacaccaaggttgcaaaatgtggagaagccacaatccagaaaatgcagaagcgaaggcgtcggtgccacgcaggcggcagtgctgtggcaggcggcacgccgacgctaactcccgccactgcagcccgcactgagacaggtggagagatgctttgctagaaagagggtcttcccagcatttctaaaccagtcatttaaaaattttacaacttgtggccgggcacggtggctcacgcctgtaatcccagcactctgggaggccgaggcaggcggatcacgaggtcaggagatctagacaatcctggctaacacggtgaaacctcatctctactaaaaatacaaaaaattgg

SEQ ID NO: 182289 - DNA, 246 bp, Homo sapiens
cataagtgaagaaaggaaggtggaattgagcagaaggtacactctccctgcagcgtcacctttcctcggcttggcgtgtcctcagcctcctcctgatgggcagagacctgaagggcctgtggagtccagttggcagcaggatcctgcggtggttgggccaagaaggggctctggtgccatcatcttgtgattgaaatctgctctttatcagttttgcttccttgttcagggatgggactgatcaca

SEQ ID NO: 182290 - DNA, 316 bp, Homo sapiens
ttggataaaatgagtttatttgcttactatttccctactgcctgaaatagttccaggcatatcagtgttcataatgtatttattgaatgaatgaataaactcatttgtaaatccagtatttaatagctgtgtaaccttgggcacatcatttaacatttctaattactgtagcctcagttccttcagttggaaaatggtgaggaggagacaattcctcctacctcacagcattattgtatgaattaaatggaaatttatgtgcaaaaaatgaatcatagcaattgagttgaggtagaagagagcaggtggaccccaa

SEQ ID NO: 182291 - DNA, 656 bp, Homo sapiens
ggcctattttcagttcagaaagtatggttaatattgttttctattttagcataaagatatagttaagtggcttgttaaaaaccacctagagaatagtagtgatatcaagatttatattgtcagctacttgttaattctaatagtaatgccctagtctaattttctagactcttattttgttttctacgtagtagttttggattaaaatggactacttttttcttacctcctatattacttaagaaaggcgaaatgaataatttgtttatatttaactttaaaattttgggagcctagagtaagttgaaagcatagcttttgtgggactgcttcaggttccagaaactagttgtaaatgtcaccatctttaccttattttaattttttccctatgaaagcgcatattatagatttattctccctgcagttgaagtgttgatggaaaactaaatgcagaattcctttctcatttcgatttagatgaaaaaccctcacttttgccacttggtttgtagaaactcacaacttagtgcttctatattactattttaattttcataggtttatgtgattgtattcagtattttccatcttatatttaaaaatttaaagaattatctcaccaaaggtttctactgttaccttgggtggaagtg

SEQ ID NO: 182292 - DNA, 248 bp, Homo sapiens
ggcctattttcagttcagaaagtatggttaatattgttttctattttagcataaagatatagttaagtggcttgttaaaaaccacctagagaatagtagtgatatcaagatttatattgtcagctacttgttaattctaatagtaatgccctagtctaattttctagactcttattttgttttctacgtagtagttttggattaaaggcatgagcccccctgcctggcatcatatgtcatttttgaga

SEQ ID NO: 182293 - DNA, 215 bp, Homo sapiens
tcatcgagctcggccctcattagtgaggtgaattttctgttttcaagttacacatcttttttgtaaaaaaattataatacagaaaggtctaaagaaaccaagaactaggtaccaagcacattttagcaaacagcttttttcttttttttttttttttgagatggagttttgctcttgttgcccatgttcgagtgcaatggtgcgatcttggctca

SEQ ID NO: 182294 - DNA, 306 bp, Homo sapiens
ctatctgcaaggaaaccatgcgccatcattatttcatggacacttaaacaagtatcatttgaaggaagctaaagtaacttatctatatacaatgaccagcagctttcacaccagtttggacagtgaactcacatgtaagagataccagattaagtgccatgtgcccacttgactactttacataatgtttcactggtatttatattttagagctcataagaccacttcaagctgatatctaagtgagaacagttctagaatttcaacttattcatgaatcatttaagtatgaatgtacttagacta

SEQ ID NO: 182295 - DNA, 386 bp, Homo sapiens
agggagcacgagtgaaagaagctcaaacacagggcgtgaggtgcccctgccagcctcggtccctgaccacacggccccgcctttggctggagggagagccctggctgtcagccgcacggtgtggaaagcccagaaggaaagcagttttgaaattttacttgtgattgatacacttttggccacgttggctattttcagagcctagctcccccatcctctgtcacagacacctttgagttctttaaatggctgtatcttttgttgtcatatggacacatggtctttatagtacattcagacagaacaggttttgtgagcaaaggatatcgagcttttttccctgatatacaaattgcaagagttcgttctcctcataagcctgttac

SEQ ID NO: 182296 - DNA, 764 bp, Homo sapiens
gccagcaagcttccagtttgctagtattgtttcttatgacaattatgtaaaatgcctttttaaaaacgtgtaacacttacgatgccattcaatctatagctaagttttgtgggatgccacatcatttggatcaatggttccagtaaaatgttctgtaaacttaaatccagaagatcagtcatttgtggtgaagttatttatttgaagaagatacttctcagttttatatgaatattggcaaacacttttatacttccgatttttaaatgttgttcacatgaatagccagttctgccttattcctaatttcccggccagcaacccagtcatcctgaactgatggtgctgtcatgtgtgaccatttcctcacttccccctcagtgaaatgatgcgccatcattagtaatccattgtatagtggcgtgtaattttttttacccagtactctattggtggacatttaattcatttgtggtttttttgctgctgtgaatatcctttcatatgtatcttcttaaatttgtgtaagtataccttaagatcaattcttagcactgaaaatgcttgagatataatttttaacataatttagaatgcttaaattaaaaactttttgtaggaaaagaattattttacaaataaaaatatcttttccatttttttaaataatatttcttagaaattcattggtttcagtttttgacaaataaagacaaccagttcaggtacttcatctagcaaaataatcctttaataaaaatcac

SEQ ID NO: 182297 - DNA, 385 bp, Homo sapiens
agtaggaacagttgcttcgtgaacagaaacaagctcttgactaatttatatagccactttaggtgtgcgcccacccccacaagaaaaagcaaaacagaaggaaaaaaaatcactgaaatagtcttatattactttattgaatttgttttatataattagtacctagtcactgagagtgattaggctgcttgtctgcattatgggattcagtttttacttttttgaaaagtctataatactttggaatcactcaacacagagataagttgctgaagtacacagcccatgcccttattagagtatttacatttaaataaacatgtggagtgtatatacagaggattctaatactccctgatttaggatttgagaaattttcaactat

SEQ ID NO: 182298 - DNA, 559 bp, Homo sapiens
ttagagatggggtctccctatgttgctgaggtcggtctcaaaactcctgcagcccttttattttcaactgcattttctgaggcatgtaccttagactaccagaaagcaaaaacagaagactcttgctctggcttgttaggaaagagcactgtggtgtccctccatgcttaaagaaatgtttcggagtcaaaatgtctgatcttacaacactaacccgatttccttatggctgaatccagtttgatagaaattgctccgaaggccacactaatctctaggacacttagttccccttttggctaattttttaagaagccgtactaatttttaagaactatttctgtcctctcataagctaaaggatttgtactcaatggcgtgtttcaacatgcagcactatgtcatgctatgcatatttttgctcatattgaatactatttctggactgagatcctgagatgttaagctactacactttactagctttacatagtactgagtttggcattacacacttactgaaaataattggtggaaatatccctcctaggctttcttt

SEQ ID NO: 182299 - DNA, 306 bp, Homo sapiens
ttacaggcataagccatcatgcccagcctactattgtttaaagtcctaaaaaaagatttaaaagatttagatccatatactttttctccaatggaaaacaaaaatacatgcaaattcacacaattgcatattttaaactcacaaaataaaaccacgaaaatatgataaaacagtagaaaatgaacattgccttattaaattcttttcagacctactttctgatttgttaagttgttcacagaataactattttcagcccaactttccaataaacaatgtttacacatatggctgtgtcaagagagg

SEQ ID NO: 182300 - DNA, 307 bp, Homo sapiens
aaaatgacatataaaagtgtagatttctgtactttcttaaaaaatgggaataccaggttcctggatctcacactccctataagattaacaactctggtgctgggtgtgactactcccatagagaggccgcagtctccaccactcccagctgctcgtctccccgttttcacgcagcatgacatcagcatggccctggagacatttgagtttgccaccccggggcaggccagtatcctctatggggcctttacgtgttacagttactgttttcaggaatgtccctacactgtatgtgtttgttctaagg

SEQ ID NO: 182301 - DNA, 231 bp, Homo sapiens
ttctcagagttatgtagatatgtgttcatttctatttatgggaatcagaccaattctattaagctttgaaagaggtttttgtttttattttaaagaaaccagtaacgatttggaagctaaataagcagtgagggttaggggtggagatgtggccatacacctgtcttgtgtctcattaactatgaggtggctactactgtataggactgattaaaatgatggagggctctg

SEQ ID NO: 182302 - DNA, 128 bp, Homo sapiens
tgatcgagctcggaccattgcggtgagcatctgatttcattgttttagtggaatatctaggtagcagaactgctgagacatggggcatgtgcatgtttaactttataagaaactgcctggccaggcgt

SEQ ID NO: 182303 - DNA, 558 bp, Homo sapiens
tggatggaagctgtctgccctagcgccgtggcatattgatggggttggagttggaggggaaggcagctcagagaccaccacccctttcagggcattggcacttcatgaactttctgaatccaaatccctaatgccagttgatcacgtgtgtgtgctcacgcgtgtgcacaccacgtagattccattgagagagacacagcttgaggagtaacctgcctgactggggcagtgtggacaaggatcctgtggaacccggctgagcctggctcccaggtgaatgggtcagaggccccagcagaagttgctgtgcccactttttgggaacgcttggggtgactcgggggctccctgctggcttccgtgtgtattggtggatgtgtgcaagtgtagcagtgggaggagccgctggctgaggggtgctggagggtggccggggcccttctagcctgtgcgagtggccgggcagctcaggttcctgccggggtgcctctgtcctcctgggaagggagcgtgtagggtggtgggagcaggcggccctgtccgtctcgtcctggaatc

SEQ ID NO: 182304 - DNA, 691 bp, Homo sapiens
ggcctggaagaattgatagaatcatctatgtgcctttaccggatgcagcaacaagaagggaaatatttaagctgcagtttcactccatgcctgtcagtaatgaagttgacctggatgaactcatccttcaaaccgacgcatactcaggagcagagattgtagctgtctgcagagaggcagctcttctggctctggaagaagacattcaagccaatctcatcatgaaaagacatttcactcaggccttgagcactgtgacacctagaattcctgagtcattgagacgtttttatgaagattatcaagagaagagtgggctgcatacactctgagaaaatatatatattcaagatgctgaaaatcctttccagagaaaatttgtttctttttaaaattttttgagagtgttaaaaaaaattttactaggcaaaatgtttgaagtatgttcagtagaatttaggggctttggttcttacagattttcaagtcatgtaagtacagtgaaaatatctctgagcataagtttcaatcagttttacctggaaatttgtggtgtggtttaaaaaacaaatgtttagctttttcatttgcgacctagtctgttcatcccatgaagcgatttctttttccagaatctgtttgagtgtctttctaaaatgccaaacatgttggcatcaattttatacaggga

SEQ ID NO: 182305 - DNA, 883 bp, Homo sapiens
gaattagggagagatttctctttgtttccaatggatcctgaaggtgagctgccatcacctcatctctaggaggtgctgtagggagaaaaactggaggtagcagggtatttctctctcttttctcccctccgtctagccttaattaatagtttcatcttttgggtcatcgaaaaagtcagctctgattcatccatatccaataaattgcagggtcacatggatcgggtcttccgagccacctgccttctttttctcaagttccctggtggcgcctcttcaggtcctcacatctcttctgtcccgtcacagaggaacacctcagacccatcctctctaccttggcatatcaccccctggtcccttgatgcttcttccttctggtcctcggagtcttttctgagctccagcgtcaccggcgttggtggcctttccaccctcccctctcgcatgtgccttttccagtccattgggactactccctgctcccccgtcacacacgttccctaggccagttccttttcacctggctgtagtcctcatgaccagctaaaagtgcgcctgccccagatatttgtgatttccctctcttcagagaaagcagggagcccctggcatccctatctgtgacaggtgccacacccgccttacaatgcaggtctgtgtgcccttgttgtatccctaactgctctcaaatcccttagtgacggcctcatttctctgcctttgtgtagcatttaaacagtttaaatggctgggcacggtggctcacatctctaatcccagcactttggaaggccaaggcgggacggatcactggagctccggagttcgagaccagcctggccaacatggtgaaaccccctttctactaaaaatacaaaaa

SEQ ID NO: 182306 - DNA, 517 bp, Homo sapiens
taatccagatggcttaaaaatttaaatatgaaagatttttttaaaaaattttacagaagaaagcatgagaccatctttgtgtccttagagtagacgaagatcttaaagagtcaacaaaaagcacctattagaaagaagaaacctgataaattggactctattaacactgaaaactacagttaaacagagtggggaaaaaataatcaccatatctatatctgacaaaagactcaattccaaagtatacagagaagtctcacaaaaccaataggaaaaaagacaatacaatggaaaaatggttaacagacttaaacagatacttcacagaaaaagatatgctgaaatgaagtataaacaaatggaaaggtcttcaacttcattggttacagggaaatacaaattcaagccacaatgcaatcaatattagtgtttatttaccacaatggctaaaacataaaagacataaaaatagctagtgttggtgagaatgtaggagtatacattggtctaaatagtt

SEQ ID NO: 182307 - DNA, 967 bp, Homo sapiens
gctgggactacaggcacatgccccatgcccggctaatttttgtatttttagtagagatggggttttaccatgttggccaggatggtctcaattacaggcatgagccactgtgcccagcctcttctgtgtctttaaaaaggaaagtgtcagtcaacaaaagagcccctctgtcatacaaaccaaatcagttttcaccaaaatgtccttagtcctctcagaaaggcctggcctttaggaccttggaagcaggccctaaagcgcatcggcagggtcagagctttgtgttcaggaacactgggatctgctgagagctggtgtagccgctccaaaactgcacactgcttttcctgtctgctttagtttgtgttgtaaaaacataggaagttcgtgtgtgtgtgtgtgtgtgtgaattcaaggcataaggtgcagttgtgttatgtgggtatagtgcatggtggtgcagtctgggcttcttaccctcacacctcctgcctcccctcgttagagtcccccacatccgccttccactttctgagcccacattgcctgttgggcagctcctggttatgaggcaggacgtgtggtgtttgactgtctgtttctgagctgttttacttaacacagtgtatatggtgcatctttaggaaagcatgcttgtattttcctttcaaagccagatatgggcgggtgtggtggctcatgcctgtgatcccagcactttgggaggccgaggcaggaggattgcttgagcccaggagtttgagagcagcctgggcaacatatcaagactctgtctcttaaaaaaaaaaaaattagccaggcatggtggtccacacctgtggtcccacctattcgggaggctgaagtgcgaggatcacttgagcccaggaggttgaggctgcagtgagctgtgattgtgccactgcactccagcctgggcaacagagcaagaccctgtcttaaaaca

SEQ ID NO: 182308 - DNA, 507 bp, Homo sapiens
gctgggactacaggcacatgccccatgcccggctaatttttgtatttttagtagagatggggttttaccatgttggccaggatggtctcaattacaggcatgagccactgtgcccagcctcttctgtgtctttaaaaaggaaagtgtcagtcaacaaaagagcccctctgtcatacaaaccaaatcagttttcaccaaaatgtccttagtcctctcagaaaggcctggcctttaggaccttggaagcaggccctaaagcgcatcggcagggtcagagctttgtgttcaggaacactgggatctgctgagagctggtgtagccgctccaaaactgcacactgcttttcctgtctgctttagtttgtgttgtaaaaacataggaagttcgtgtgtgtgtgtgtgtgtgtgaattcaaggcatgagccactgtgcccagcctcttctgtgtctttaaaaaaggaaagtgtcagccaacatggtgaaattccgtctgtactgaatatacgg

SEQ ID NO: 182309 - DNA, 576 bp, Homo sapiens
ggtatgggcatcatgtgatataagtattacatgaatttcctactttttatccagttatggttatatcacctatcagtgatttaacttcagccaagacagaagtttatctcataataaccaagactgggccgggcacagaggctcacgcctgtaatcccagcactttgcgaggctgaggtgagtgtttcacttgaggtcatgagttcgacaccagcctgctcaacgtggtgaaaccctgtctctaccaaaaatttaaaaaattagctgaatatggtggcacgcacctgtaatcccagccattcgggaggctgaggcatgagaaccacttgaatccaggaagcggaagttgcagtgagccgagatcacgccattgcactccagcctgggcaacaggacaagactctgtctcaaaaaataaaaaagtaaaaacaatactggaggttgtcagtctagggtggcgttagggactttcatttccttccagaggacattctgctatccacagggtagaagcctaatcctcaaggttcaaggtgacaagaatagctccaaccatcatacgcttattccaggaag

SEQ ID NO: 182310 - DNA, 274 bp, Homo sapiens
cgacaacaacattcgggagtcagatggaaagcattcctatcattggttaatttcctccaaggaggcaacaggtgttggctccaaccactgcaattggatcacctccaactacccactagggggcgctgctatgctgcaagaagtggggcaggcttgcggaactcatccctgcaaaaccattaatacccccgggagactgaagtgtgaagttgtaaagcttggtgttaacaaacaaaataaactcactgactcatgcagttgttggctgaggagt

SEQ ID NO: 182311 - DNA, 510 bp, Homo sapiens
tattaaaattgcactgttctcaaaccacacaatttaatactgtgtgcaattcaaatttatatttgcacttataatgccactttattgcattgagagcacttccagcttgacattttaaggaggttttcacactggcctgcccaggttgtctgtacactgttgaactgatgggggtgaggggaatgaggaaagtagcaaagatagtgaagcttgattgacttatttaagaaaagacttattgccactaagagtgaggtgtgcctatgtgtgtggacctgtagttagaacaaacagtgacagagggacagagaaggagaaagagacccagagagaaagcagggtgtcaaggcaggagaatcacaaccacagcaggtgggctggagtcaaaaaagaatgaaggccagacacagtggctcacacctgtaatcccagtactttgggaaagtgaagcaggtggattgcctgagctcaggagtttgagaccgggctgggcaacacggtgaaacccgg

SEQ ID NO: 182312 - DNA, 206 bp, Homo sapiens
tatttttaaaaaccactatgagtgctttttaaaaagttctatctcatacttgagagaaaaagccttctcaacagtaatactctcattcattaaacaaatgtcagaaactgtttaccttagcaagccttaaattttaggagaaatggaattactttgcatgacagttataaatctcatggatttcaattccaaaaaaaaaaaatctg

SEQ ID NO: 182313 - DNA, 417 bp, Homo sapiens
gagtgtttattgggcagtgttgacagcagcttcagtctcagaaaaaggatgggaagttgctctcagactcggaaccctaaagcttggtcggaattaggtttctgccctgatcctgatgctctttctgcccggtggagagcacctttaaaagtagtcacctgagggtcaaggatgggtacaacagcttcccattttattctaggagatgtgtctggagataaaatgagcatgtgatgtttggcagggctgcatgcctcgagggtcatagccattgtccctgatgttcaggacctggtaactgggggagtaaggacttaaggtacatgttttcctgtttcctctttgctgtgagttgtatgtgagttgatttgggtggtaaatgaaatcatatcttttttttttttttttttttttttt

SEQ ID NO: 182314 - DNA, 523 bp, Homo sapiens
tgggggtactgtatcatgcagttttgatacatggatatactgcatagtggtgaggtcagtgcttttagtgtaagcattattttagtagtgtacattgcacccattgggtaatttctcatccctcacctccttcccaccttcctacccttctgagtctccaatgtctattatcaatctatatgtccttgtctagctcccatttataagtgagaacatgtggtatttgactttctgtttctgaattttttcacttaagataatggcctccagtcccaccaatgttacaaaagacacaatttcagtttttatggctaagtagtattccatggtatgtgtatgtgtttgtgtatgtatatatataaatatatatgtgtgtgtgtattttatggtatgtgtatgtgtgtgtttgtgtgtgtgcaataagtgcccattgatgggcacttaagttgattccatatctttttatgcaatagaatattatacagttattaaagtggttgtatatggtatagacaaatatgta

SEQ ID NO: 182315 - DNA, 253 bp, Homo sapiens
cccagggtgtggtagatgtggaggaaagtggtagacgaggaggatgttctggagggtattgagaggtaggatcaaacagggtcttcaaagctttggtaatgcacttagattggattggtaatataatataaagctacatgaggattttaattgggggtggttggtaataaaggctgattatattttttaaaaaataccattctggcttctttgaggagaaaagattggcagggagtgagagtgtcagagaaaa

SEQ ID NO: 182316 - DNA, 759 bp, Homo sapiens
aaaatatgcagagctattacagttcttggttttgtaatggtcacaaagttatggttgatatctatagcttccacctccaactacctctatatttccctttcccagtcagaatcagctgctctgggttctttgcctggtagagtgcttcaaaccttcctttttgaaaggtctgaatcctcaatcatcctgcccttttctgattcttgtggttttccattgaacctttacagttggacatggaagtattaagaggcactttagaaaaatctcctgggtaccagaaagtcctccttgcttccatttgcagaagcaaaccaatttaccttggaaattcagatcaatcactacagccaataaattaaccccctgtttttcatccgttggttaagtgttacaagaagtgcaaaatgaccaggtggcagtctgataagcagaattctgagatgaatgtcgtgactttccctctcttgtacacaccctgtgtaatctccccttgagcatggttgaaacctgtaaatataattggatagcacctccacgattatgctatatggcaaagggttcctaatcagttgactataatccaaagggagattatcctgcgtagatatgatctaattaggcaagttatttaaaagcagaagagttatcctgctggtctagaagaaaaacagcctgttgtgaaagtagggaccacagggacctgagggtgacctccaggagctgagagcagtcctcagctaacagtaaaaaaaaaaa

SEQ ID NO: 182317 - DNA, 666 bp, Homo sapiens
gggttgggatccttgggaccacctcgggatgcaactcaggtgcctctaagtcagcctttgaggcgaggaaaagtcctgaaggacactaggttaagtcagggaaaatgtgtgttgggagtagagtggggagtggttgccgtatgtgcaaaggacagggtattatgggagaactgcaagccacagattatcattattatggtttgttattaataagcttggtagggaagggagtggtgatagtgagaaaggattctaaatgtaggctcaggccagaccaaaaagcaccttgtataacatgttaagcactgtgcccttaatctaaaagtaacagggagctattatagggatttacatagaggagtgataagaagagctctccattttaaagtgatcactctggttttgttggagagaatcaaggtgagattataaactggaaatcacttataggaagccttttgcaatggtgttggtgagaggaaagagtagcttcaattaagacaatggcaatgggtaaagaaaaaagagtgataaattgggggtgatattgtataaaaaaatagcttggcacggtagctgacatctgtaaccccagcactttgggaggccaagaaaggcggattacttgagcccaggagttcaagaccagcctgggcaacatagtga

SEQ ID NO: 182318 - DNA, 346 bp, Homo sapiens
ttttaatcagctgggcatagtggcatgtgcctgtagtcccagccactctggaggctgaggtgggaggatggcttgagcccaggaatttgaggctgcaatgagctatgatcacaccacatctcaaaacaaaaacaaaacttatctagggactacacgtggagctttggatatgggcagctaatctgtctatgattaaaaacacgcaggtggcttactttattaatccaaaataaaagaatttgggaacacaagaaagggaaaaatgagcctccatgtcaagacctttcccagaaacctgatagcttatagttagaaattgttatagacagtccagtgcaaggaggac

SEQ ID NO: 182319 - DNA, 720 bp, Homo sapiens
ataatcatgaatagaatgttagaatggtagaaatatgtatgttaaaggccattctggtaagctctcagatgtaaaagaggaacaggtggcaatccttgttataaaggggcaaaaatcttgtttgaattatgttctagtattttgcagtaagtagaatttttaagccaggggtccccaacccctggctgcagattggtatgagcccatggcctattagtgttgcaggaagtcagggaccccaaacagaggaaccagctgaagccatggcagaagaacataaattgtgaagatttcatggacatttattagatccccaaattaatacttttataatttcttacacctgtctttactgcaatctctgaacataaattgtgaagatttcatggatacttatcacttccccaattaatacccttgtgatttcttatgcctgtctttattttaatctcttaatcctgtcatctcataagctgagaaggatgtatattgcctcaggaccctgtgatgattgcattaactgcaaaaattgtagagcatgtgtgtttgaacaatatgaaatctgggcaccctgaaaaaagaacaggataacagcaatgttcagggaacaagagagataaccttaaactctgactgccggtgagccaggcggaacagagccatatttctcttctttcaaaagcaaatgggagaaatatcacagaattctttttctcagca

SEQ ID NO: 182320 - DNA, 328 bp, Homo sapiens
cggaggggagccccagtccattctcatcacgaatttgctttgagcagtcctgcttctttccgggactcagtgtccgtgtctacagaatgagagagtgtgcccctgagcttcctctgctgcttgtgaatgcctggggcacctcacctacgtggcttcatcctggccctccctactgttgacataagctggcctggggagggaggacgagctcctcagccatccctgtgtggagaaaaccttcctgtttgtccagtaagccatgagcacgcgagacgcagctggagaggacacaggcactcagggcattcggctccaggcttgaatcctg

SEQ ID NO: 182321 - DNA, 141 bp, Homo sapiens
caattccacttcctccacagctcctggataatgactatactagatctactccaattctccacactgcacccagaggcatcattcgaaagtgcaaatctgatcatgtcatctcctggcttagtactctccaacatacaaagg

SEQ ID NO: 182322 - DNA, 115 bp, Homo sapiens
taaacagcttgaaaaaagagacatttattagctttcacagttgccaagcttcagaaattcaggaacggcttagctgggtggttctggttcaggatttctcatgaggtttcagtca

SEQ ID NO: 182323 - DNA, 231 bp, Homo sapiens
ttcgttagaaatagcccctggttttcatgccaagaagttcatcaatgtgccacttggtagccttctcgaaggtgatagaaatgtggccattgcagcctgattctgtacggtgactccagtccacgtattccaggtctccaggtgttggcaaacaagacctgggacccagggcccctccggagagctccctgtaacttcagtagcaggagacatgcgggatccctttacaaa

SEQ ID NO: 182324 - DNA, 495 bp, Homo sapiens
tttccccagggtcgtgctctctcgttgaccgagtgacgagagcggccacactgcatcctttccccagggtcgtgctctctcgttgaccgagtgacgagagcggccacactgcgtcctttccccagggtcgtgctctctcgttgaccgagtgacgagagcggccacactgcatcctttccccagggtcgtgctctctcgttgactgagtgacgagagcggccacactgcatcctttccccagggtcgtgctctctcgttgactgagtgacgagagcggccacactgcatcctttccccagggtcgtgctctctcgttgactgagtgacgagagcggccacactgcgtcctttccccagggtcgtgctctctcgttgactgagtgacgagagcggccacactgcatcctttccccagggtcgtgctctctcgttgaccgagtgatgagagcggccacactgcgtcctttccccagggttgtgctctctcgttgaccg

SEQ ID NO: 182325 - DNA, 242 bp, Homo sapiens
ggaggtcgaggtggcagtaagccaagattgcaccactgcactccgggctagactacagagtgagaccctgtctcaaaaacaagcaaaccagcaaacaaaaaacgaaacaaatgaattaccaagtcatgaaaagacatagaaaagacttagatgcatattactaagtgaaagatgccaatctgaagaggctagatattgtgtgattccatggaaacgtgaacagtcaacgattagtggttgct

SEQ ID NO: 182326 - DNA, 491 bp, Homo sapiens
atagcaggagaggcgcggaagcgctctgcccagagttttgaagtgctcagcgtttgcgatcggccacctctttatccagtactacttgggaccccgttccctcccacccgcctttgtagaacgggaaattgaggccccgaacgggaaaagagctcctagaatgttagaggctcttgcctcactataactcattccccatcaaagattccagtaaccggaaggctaaaatgtaaattaaaaggccgggcgcagcggctcacgcttgtaatcccagcactttgggggaccgagtagggaggatcgcttgaacccaggggttcgagatcaacctgggcagtatagccgaaccttgtctctataaaacataaaatgtaaattaaaatgtaattgtagtttttgttaaaatccttagtgggtttaatggcatttgtaggtaaaatcaaaccctccctatgccaaggtactgtgtgcttcgggcactcatctctgcc

SEQ ID NO: 182327 - DNA, 590 bp, Homo sapiens
tgtactctgtccctttatttctcaagccagccgacgcttaggaaaatagaaaagaacctatgtgattatcggggcaggtcccccgctagacgcgggcctccaggaaacacattctcatttcctaggggctgtttccaacctgcatccgctacctcccgcgcagcaagctgccagtgggtgccaaagaggtgctcccaagcccggacacacctgtgcaggctcccctgaggttgcctcatcccgggcacaacaaaaaggcccaaaacagctccgaggatcctgccaaggctacggatgatgtcctgcccgggacatcaatgtcctccttgggaaaatgggctcagccacaccctgtctcacatggggaaactgaggcccacagaggtcctcaaggaaatgcgttcattcattcattcattcatttgttcttacatgtagtaattataaagcaatgatcacgtgctggataaacaaaacagatgtggtttttgccctcgaggggactgacagtccaatgagggggaccaacatttaaaagtaggtgcacaaggccgggtgcggtggctcatgcctggaatcccagcactttg

SEQ ID NO: 182328 - DNA, 482 bp, Homo sapiens
tgaacagaactaatggcgacatttcaagattatgtgtttaaggccaggcgcagtggctcacacctgtaatcccagcacttggagaggttgaggcgggcggattgcctgaggtcaggagttcgagaccagcctggtcaacatggcaaaaccccatctctactaaaaatacaaatattagccgggcatggtggcacatgcctataatcccagctacttgggaggctgaggcaggagaatcgctcaagcccaggaggcagaggttgcagtgagctgagatcgtcccactgcactcaacctgggcaacagagcgagactcatctcaaaaaaaaataagtgtgtgtttagaaagtagatatgcttcctgcctttccctttcaccatccactggctggctgtagttgaaaagaaagccctaaggaattgctgagtcataaaatggaagaatccagagtgcctgaatcattgaaatggtcgccaatccg

SEQ ID NO: 182329 - DNA, 456 bp, Homo sapiens
cgcagcccgcgagcccgcatcaggcttccagtgggccccgtgggcagtgccagcctttcccacctccgcatctggcaaagcctggccttcgctgcgcttcggtgtcgccacatgccttctggaaatatcacacctccccacctgcgcatgcagccgtctggccctctgtgggcctcggttcccgcatgtgccccgtggaaagaacataccttccccaactatctggcagcgtctggccttctccgggcctcggcctccccatttgctgggtggagaatcacggcccggccacatcggagccaatggctggtctctggacctcggtctccacatttgctcagccggcaggaacatcccttctcccgccctctacctcggtgggtggccacggccgagcaggcagcgacggcccagtggaaagaggacaaacccttgtgggccttagggcgaagacgt

SEQ ID NO: 182330 - DNA, 313 bp, Homo sapiens
acccgggaacgaaattagcatctcttaatggtgggtaaaattagagtagactcagtgtttagttttcgttcatttcccaggccacttctttatgaagtaacctccatcacaatgtatagtttctagaaagtctgaaggagcactgatgttttccctcgaatgcagtttctatgtcaccgtggtaaagaagaattttcaggcttgcagtcaaggacagcctttcaaattctctttggatgaaactaatccccaaggctgcccaacctccctgtaactaagaagtttacaaggccaaatatttgatgcactggcc

SEQ ID NO: 182331 - DNA, 494 bp, Homo sapiens
aaagaggcaagggttggatttgaagaagataccagcactagatgagaaagaaccaaaataggatgccccaatagagagcagaaaaatcaaaggcaagtgaagggcaaaaagaattgtcatctcagcatgggaaaggagatgctcagctgttaatctcacaggcagaaacatgaaattactgagatattacctcagatactctgaaagccaccttttcagagcactactactacggacatctttgttttggaacccaagatcagtaacacagaaccccacgctcagaagaaaaagaactagtctgggataaattacaagggtatgtagtcaaaggacaaaagcataaatactcctctgtgaaggttattagaacattctacaatgtgtgcagaataaaactccattcaaactgggatcttaccacatcagtgttgtagctagaacgcataatacagccagcagtctacaatttgcccaattatattcaatgcctt

SEQ ID NO: 182332 - DNA, 604 bp, Homo sapiens
tttgttggtaaaggttgtgacttctcattcggagacttgataaccaggagtgaccatttaatgaaggttaagttagatttgaaaacagcccaaaagaaaagcaaccgtcagagaaagctgatatactattacaatagtgtcaaaaaccaagcaaacttcattcacacaatgtaaggctagcacaggacatggagaacatgtatcaggaatagccaaacatcttttctaaaatagcataaaagagttcacagacaagtttcagagtctgagaaaccttggcatagatgctgcctatctagtatgggattgtaacatgtaccagaaactaaccttcaatttcctattaaaatgaataagataaggcatcgaaaggacttagcacaatatctgaaaaactgtaagtgcaaaattaatcagaattccatttccttgccatccatgcacaggtcttaaatacaggcacaaattaatggataattcaggtttaggagtttgtccaatagtcatgaagaacattttacatggccatttatcactaatacccatttagtgagttgcaaatcattttttgtttaggactggacaaggtgctatgaaattacag

SEQ ID NO: 182333 - DNA, 166 bp, Homo sapiens
agtgactgttaatatggtttggtgccactgcccgtttccttgatttgtgcagtttcctgcactgttgcttttgtaccatgtgtgcaaatgtcgacacaggggaaaagcaatatgctcccattgctctctctctctctttttctctctctctcctttcctctatctg

SEQ ID NO: 182334 - DNA, 457 bp, Homo sapiens
tctgaaactatggtattcagagatgatccgtcaggttctgattaagtttcttagaagcccagtgcactgaaaagattatggtgtgtcttttctcttcctagcaaaatggaaaatgacaatactgaaatgcaaactaatagaataccagcaaaaattctcattgttactcatggcttcaaaaactacatcagatgccttaaaaaaaaatcctcttacttcttttggtacctcatttttgttggttttctaagcatgtagaaggggaccagagcatgccaccccaaaatatcccacttttagtgtaggtgttgttttaagctgaaggcatttagtttcctgccctccacctttctgtctaaaagcaggctatccatttacatttctgaaagtgttccgtactaaagaacccctatttattatacatttctagttatcttcccatgatttgtacctccct

SEQ ID NO: 182335 - DNA, 245 bp, Homo sapiens
tatggaaatgcagctacccaatctgcttattttaacatgtagaggatgttagccattgatttctcttgactgaggcccttcaatggcttccctgttctcttaggatatagtctaaactctttaacatgggttatgagaccttgtgtgctctgactcctgctgtcccctctagcctcatctaaaacaactctcacaatctcactatcttttttcaattttttttttttgggtactacgctttggca

SEQ ID NO: 182336 - DNA, 350 bp, Homo sapiens
ttgagaaccactgatacaaagcattgccaaccaaagcaaatggccatttcacagtgacattaattggagaattaaggaatcggagagagtgtataattttgcagataaatatggtcatagaaattattacttccaattggtaggtatacttttcctcaggctctgccctcaaaaattattaacctgtactggcagaaaagaacatatgactgatgaagttcaggaagcattaaccataaacccagtcatagaggttagcagatttatttttcccttagataagctctctccttcggttccacaagagaattaagctatacaccctaagacacttagcgtttatacagtgg

SEQ ID NO: 182337 - DNA, 289 bp, Homo sapiens
agagtagtaaaaacagctatgatgatccagccagaattagctagtggggataaaagaaaaagagcagaaaaagtggagaaacacttaagcattaaaagtattagaactatggatgggtagatatggaactgtgggagaggaaaaggattagacagcaattcaggaagaggagccatttagagggaagatgacacattcagatttcaaactattaggatcaacgtgatggtaagtggttgacggaagtttgaatatataaatctagagcatggggattaaggctgggctg

SEQ ID NO: 182338 - DNA, 319 bp, Homo sapiens
ctgccttacttgttgtaataaaacacttatattaaggtaacaaaaatcttaagatggtagacactcttatctccccctgccccaccatttacagatgagggaactcagcttgagagattaatttgctgagacatactagagctggaataggaagccatatgtatcagactttaaaattcatcagtttaataagttttttttcttgattattaggatagtagactaggtttcagaagtgaaatgctaagttacttttatgcatacaccagaatatatttttattgcagtttggagaaacatgaaataactgttttttccc

SEQ ID NO: 182339 - DNA, 324 bp, Homo sapiens
atcttagacgaaagcctataatcactgcgcccgctcataaggggatggccatggattaggttatacgatagttgagtggtaggtgtgaatgattgaggcaggagtccgaggaggttagtcgtgactgtgaaaatgcttacggatcgaggctatagtctatttgtgtcgaggtgttgacttagcctttctcttctgttcctagtgtgtccaagtcaacctgtggggactgaactggactatcccctgggtgagagtagtcccgagggagatgttgttgtattagctttatagaagcagtggaggcagggccacacttaatggcat

SEQ ID NO: 182340 - DNA, 309 bp, Homo sapiens
ttcttggctccagcaactcgaactgccattactatccaggatccctggttgattctggacgtagaaaggagaaaggtagacttccttctggacaccagagccagcctctctgttctcctctccagtcctgaccttctctcctcccatatcacaaccatggtgaatgtctaaggaaagtctttaacccaatatttttcatagcccctcggttgtagtaggggggaattgctatttactcatgcctttttaatcatgcctgagcatcccagtcttttactagagatattctagcccatatgggagccacca

SEQ ID NO: 182341 - DNA, 360 bp, Homo sapiens
gatgtgttaggataggaccaggagactgactttaggatcacagctacctccccggaacctctcctcatttctcccagctagaaagggttccttttaccctactttcgtgcctctgttgtactccttactggagtcttgccttatagttggttgtatccaatctgcctgccccactatgttatacattccttggggccagggactgccctacccatctttgctttgtccttgagttggaggccacagttgagaccacagcatatgccaattgagttgaactagtgggctgcctggttaatgttgagatgaaaggtgatgttttttacttgtgttgatgttgttgttattttactttctggg

SEQ ID NO: 182342 - DNA, 631 bp, Homo sapiens
ttcaactttaaccgtgcagtatcagggatctgttaaatgcagatcttctttagtaggtttgggtagggcttgggattctacgtttccatatgttcccaggtgataccaagtgctgctggtcctgcaaccacactttgagtagtaaggctctagacaggccagctacataatttgtggggcccagtgctaaatgacaacgcagaaatccttgttcaagaaacaagagaaaagctgtttttgggggggtctgtatttgtctgtggacctgtcattgtgctttttgttgggtatttaatgtcattctcccgtctaaatgcaatcatgattgcatttagaccttgtagtcccagctactcttgaggctgaggcacgagaatagcttgaaccctgggttgaggggtacggaggttgcagtgagcccagattgagccactgcattccagtctgggcagtctgggcaaccaaagggttgatttttatcctttgaaatttaatattactttagtgtcctgacttaaaggattaatttaattatgacagaatcaaaaagaataaaaaagttttctctttgataagatatgggagtttggaggaaatgtgataagactcttaaaatcctgtctaaatgaat

SEQ ID NO: 182343 - DNA, 514 bp, Homo sapiens
agacggggtttcaccatattagccaagatggtctcgatctcctgacctcgtgatccgcccgccttgacctcccaaagtgctgggattacaggcgtgagccactgtgtccggcccagattttattttagtctaccaggtagtagcaaactatccaaggacttgcccaggaccattcaggtcagtgagctacagaatctagttctggaaaggcagccattcttactattcacaaagtgtagaaaacgtgaattcagattccagcagcaacaaatgactggagcacaaaacgccagccacagttggtgctaacgcagctggctatcagctccacaggatgaagcactgtccaagggtctgatcagtgaagcatcacccaagactgatgaacacagctgatatgaggggacccaaagttccctgagtcaagacagaagagctgtgtcacggtttgcacagaaagagaaagagcaactattcttacccacggaaagaaaaagggagaaggccatcaata

SEQ ID NO: 182344 - DNA, 620 bp, Homo sapiens
gtgactacaaatacaaggaagcctatgagaaacagaaaggccaccacattggagcccagagcattgaagatgatcccaagattatgtgtgccatacatgcaggaaaaattcaaagtgaaagggagtacaagaaggaattccaaaagtggaaaaccaagttctctagcccagtggacatgttaagcatcttgctggccaagaaatgtcagactttggtcactgacattgattatcgcaattacctgcatgaatggacatgcatgccggatcaaaacgacattatccaagcaaaaaaggcctatgacctgcagagtgatagtgtgtataaggcagacctggagtggctgcgtggcatcggctggatgccagaaggctcagtggaaatgaacagagtgaaggttgctcaagacctcgtgaatgaaagactctataggacacgtccagaagctttgtcattcaccagcattgtcgacactccagaagttgtcttggcaaaagccaattctctgcaaataagtgagaaactgtatcaggaagcctggaataaagataaaagcaacatcaccattccttctgatactccggagatgctgcaggcccacatcaatgccttgcaaatc

SEQ ID NO: 182345 - DNA, 464 bp, Homo sapiens
attggcaaaagaaggctctttctattttaatcatgccagaatcagatcagtcctgagacctcggcttttgagaattagggtgcatccctgtggtaatgactcagtactatgattcataaaactgtagaaaatgaagaagttctgagatgtagatggctcaaaagctctctgcagaaccacaagaagaatttaaatgaagttcagtaagtaagcaatgctttaaggaaaagtattaatgtgtaagaaaattagtggaattatgaatatgtaaagactgacttcaatttttgaaggtctctcaccagacatctagaagaacagttgatacggtcactgaaatgttgaagtatttgtttaaactgatatatgtcacttggctgtaatagccaagctttccaattacaattttgcaacatttcatgaaaagtcctattttaaatactaaatgtttgcattaaaaatca

SEQ ID NO: 182346 - DNA, 560 bp, Homo sapiens
ggagtggctgtatgcaaagaagctggaggcatcctgcctcctgacctgtgactcacatgggatgctgcaggacctcattcctaacatctcacaggaagagatcagctgagaatggtacattcaggcaggagacattcttgggttttccagtgtaaaagacatttaaaaacaattgactaatgagaggaatgtgtagcaaatgttgaagctgccagtattcttgcaagtgagccaatgaccttttaagctacatctacaactgactagtttcttggccatcatcccaatgaaggctcctttcccagtttagactgtattgagatctggcttggcagtaagacttttagcatcctcagatacagatttatttcagcatgaaatcacattaaatcagctttctaataaaggcctcaaaaaaacaaaaaacattgctgggtgtggtggctcatgcctgtaatcccgacattttgggaggccgaggcaggtagatcacctgaggtcaggagttccagaccaacctaaaaccccacctctactaaaaaaaaaacccgcaaaaatta

SEQ ID NO: 182347 - DNA, 276 bp, Homo sapiens
atggtgaagatgtgacaggtggaatgggctgggagaagggagcaggctcatttcacaggagagcggaaagcactggaccagggcagaggaggggccacgtgagaaaggtatttagactgactgggcagagcctgggggagggctgcaggtgagggagacaaggcaggtgttgggactccagggtttctcgtttgaaagccaggaaggatatggagtgttgggacattattacccacccccaggctgatgcatactccctgggccatgctgtatctt

SEQ ID NO: 182348 - DNA, 153 bp, Homo sapiens
cccctctgaggccctctagtccacccgctctggagggcaggtccgtggtgtgtgctccccggtatacatcagccagattcctcgcagcaatggcttggtctagacaaaacaagacagcaataaaaaccagccaggaggtaatgactgcctctg

SEQ ID NO: 182349 - DNA, 148 bp, Homo sapiens
cccccagaatagcaaatacacagccaagccttgccagtgtttgatctattccctaattttaacaaatacttcaagtgacatataatgctaaggaccactgggggaaggagaagtcgagagctatgctggcctcagctcttaatctcaa

SEQ ID NO: 182350 - DNA, 391 bp, Homo sapiens
tagtagagatggggtttcacagtgttagccaggatggtctcgatctcctgacctcgtgatccacctgccccggcctcccaaagtgctgggattacaggtgtgagccatcgtgcctggccttaaaaacaaatttctattagcagatgcagggatacctgcatatagtgatggttcatgtttgtttcactgtagactgcatgctgatagaatctagtgtgcctttaaattatggaaaataaattttcttcatttcataataactaagtcacccaatgttttgggatcattttagtgtgtatgtatttttggagatagcgtgcattgaaaatagattagtaggaaatgcgtaaaaagtttacaattatttctgaaatggtaggattttgggtaa

SEQ ID NO: 182351 - DNA, 105 bp, Homo sapiens
attacccgcctcttactgttgaggctcggagagcagttaagtcacttgcccacgatcatgcagcaacaaagtggaaatgccctaattctaacccaagtcagcctg

SEQ ID NO: 182352 - DNA, 482 bp, Homo sapiens
gattcatgtaacttggtgcttacatttttatccactctaacagtttctgctttgtgattggagagtttagtttatatgcatttgatatacttattgatatgattgtatttaaagctctgccattttgctgtttattatctatttgtcttaccaaatttttttggttttttgttcctcattttcttccttttatgttaatcaaatattttttcatattccattttaatttctctgttgactttgtagctacatttttcattattttttactttttctagtgtttacaaagtggatccttagctaatcccagtctacctagttatatagaattagtccagatgaaatatagaaaactcacaagagcaaattccatttaccccttctccttagtgctattattgtcatatatattacatctacatttgttataaacccattaatattagtgaagtgtcatacttttatttttgtaaagagaattg

SEQ ID NO: 182353 - DNA, 241 bp, Homo sapiens
aggagctgggcagtgactccatgagcgaggccccgcaaggagctgctttccagtgggagcgaggggtagaccggaagagggttttacagaccaggggtaacgtccagccccacctcggagctgggcaaggggctgtcagtctgctaggcccgcaggaggaggcctgagttggcaggagatatggtctccagtagccaggcagaggccttgctctgtggtcctggggcaggccctgaatagg

SEQ ID NO: 182354 - DNA, 264 bp, Homo sapiens
tggtgttgtcctattatctcttcaaatcccaggtccctctaggcagtagctattatgcctacttcaaaggttattatgagactcaaatgagagagtgaatcggaagcattttgtacattattatccctcaacctatttgtgccccatacatagtaacttcaggccttatagtttgtccctactgctcctgtttccgtaaacctttgcagaaatctggtttttacgggcaaaaagaggttataattcaactttccatgctctaag

SEQ ID NO: 182355 - DNA, 1722 bp, Homo sapiens
cccgccccagagcacagcttcgccgagcccacctggtccccatcccggccttggcaatgaccctggcggcttcctcccagcgttcccaaatcattcgctccaagttccgatctgtcctccagcttcggatccacagacggaatcaggagcagaatccagttcaggcgcccatctcccagcaatcaagtcttgctccctggcctgccctccggcaccctggagccccgctttccacacagccttgctcctcccggcctggcttgctgcctgcaggcctctcagggtccttcaccgtctctccagtctcggatccggacccgtggatctcagcctcagaccctcctctggccccggccttgccctcgggcacggcccctttcctcttcagccctggggtcctgctccccgagccagaatattgtcctccttggaggtccccaaagaaggagtctcccaagatctcccaacgttggagggagtccaagcccagggggaacttgacataccaccagtacatgcccccagagccgagacagggatccagggcggacccccaagccgaggggtccgccctgggtcctcctgggccatctctgtgggaagggacagactcgcagcagccacatcctaggatgaagccctctcccctcactccctgcccaccaggagtccctagcccctcgccacccccacacaagttggaacttcagacccttaaactggaggagctgacggtctcagagctccggcagcagctgcgcctgcggggcctcccagtgtcggggaccaagtctatgctcctggagcgcatgcgcggcggcgcgccgccccgcgagcggccgaagccgcggcgcgaggacagtcccgcgggtgctccctggccgcgcctcaagcccaaggccctggcagccgcccggcgtcagggctcggtcaagcccagcgcagcatctcacaggccacctcttccacgcgccgcggataccccggggacggctccggctccaactcccactccggctcctgctgcagctccagccctgaccccttcctcagggccgggctcagcggctctgactctggaggaggagctgcaggaagcgatccggagggcgcagttgcttcctaaccggggcatcgatgacatcctggaggatcaggtggagcctgatgaccccctgccccctattcccctggacttccctggctccttcgacgtgctgtccccctccccggactctgaaggcctctcatctgttttctcctcttcactcccgtctcccacgaactcctcctccccttctcccagggaccccacggactccctggactggctggaggccctgagcgggggtcctcctctgggttctggtcccccaccccccagcatcttctccgctgacttatctgactccagcagcagccggctgtgggacctgctggaggatccatggtgatggattctaggatttacagagacagagaactgatgggggtggagagaagctccttgtgggaggagagggaactaccagcagagcccctcctaccgcagacacaggatcggagacaacctccaaccccacctgcctcctgaagtgctgctgacatgcaactgccttaactttgcctacctggcctccttatgatccccctccggcgtggtatggttggggggcttcttttgctgctggccacggcaaacaagctgcttgctgcttcctt

SEQ ID NO: 182356 - DNA, 456 bp, Homo sapiens
cccgagccagaatattgtcctccttggaggtccccaaagaaggtgagtctcgactggagggagaggtccctctgagagcctagtctttgtctcccttgttgctgctgccatttttgctcctcttcggtggcaccgagctgaccccatactttgcatgtagtcctggggccggaaggtgggagccgcgctgaagcctaaaacatcacacctgctctttcaggagtctcccaagatctcccaacgttggagggagtccaagcccagggggaacttgacataccaccagtacatgcccccagagccgagacagggatccagggcggacccccaagccgaggggtccgccctgggtcctcctgggccatctctgtgggaagggacagactcgcagcagccacatcctaggtatgacacccacttctgttctcccgggacccagaaattcaggtcccagca

SEQ ID NO: 182357 - DNA, 825 bp, Homo sapiens
cccgccccagagcacagcttcgccgagcccacctggtccccatcccggccttggcaatgaccctggcggcttcctcccagcgttcccaaatcattcgctccaagttccgatctgtcctccagcttcggatccacagacggaatcaggagcagaatccagttcaggcgcccatctcccagcaatcaagtcttgctccctggcctgccctccggcaccctggagccccgctttccacacagccttgctcctcccggcctggcttgctgcctgcaggcctctcagggtccttcaccgtctctccagtctcggatccggacccgtggatctcagcctcagaccctcctctggccccggccttgccctcgggcacggcccctttcctcttcagccctggggtcctgctccccgagccagaatattgtcctccttggaggtccccaaagaaggagtctcccaagatctcccaacgttggagggagtccaagcccagggggaacttgacataccaccagtacatgcccccagagccgagacagggatccagggcggacccccaagccgaggggtccgccctgggtcctcctgggccatctctgtgggaagggacagactcgcagcagccacatcctaggtatgacacccacttctgttctcccgggacccagaaattcaggtcccagcatcctcctccctcaaacctcgagtccaagattaggggattggggcccccaaccctctcttctcccagggtttaagagtccaggatcccagcccctcccttcgcccttcagacccgagtctgaacgcctagttcctcctccccca

SEQ ID NO: 182358 - DNA, 287 bp, Homo sapiens
atcatgccactgtactccagcctgggcagtagagcaagactccatctcaagaaaaaaaaaattaaaaaattatgaaacagaatttttgtatgtgattgaaaactcatcagtactttctttttttttttttttttttttttttttttacccaggcagttactgttacatcttggtatatttcatagccagtttctcacctgtgtatggatatttgctttatttacttattcaatctaacttaatgtgtgttttttcaaagtaatattttgaatattttaaattttcaa

SEQ ID NO: 182359 - DNA, 173 bp, Homo sapiens
ttagtctggaattcagaaagaagttgaggtaggatatttaatttatgggctggagaggttaaatgagaatttaaagccatggaatgaataagatactgctgaggctacgaaacagctgcccagtgatttggctaaattctctagcctcagtctaatgtgttagctctagaaag

SEQ ID NO: 182360 - DNA, 154 bp, Homo sapiens
aggtcagggtgggcatcctaccaggctcagggcagcccccacaatacagaagcatctggcccaagatgtcaacagtgccaaagctcagaaacacccatctatagtcgtcctcctgccaaacaaattctcagttgtaagggatagtctttccttt

SEQ ID NO: 182361 - DNA, 501 bp, Homo sapiens
aaactagacatctatccttaccctagaagaactgaagcagtctgtttatttacagtcatgtcacagaactttaatttacttgctcaatggaagaatgagttctatacctgggttaacaatactgaaaagtataaacaactctttttggttaaataagagatgatttgtgttcatttctttatactaacataatcatagtatttatttcacacagctataaggcagtttggcttctaggattaacatatttaacagtgataattacagatgatgggagaagaaacagaaatgaaaataaagtgtagtcttaaaggctacagataataggtaccacattacaaataataggtaccaaccaatattgaattagtgaatgcttactgaatgtcttatgaagataactacttctaatccatcagttagtcttaggatttaatttctatcatgggagtgatgtcataagcaatttctaaaactcagctgagtaactgtctttaattg

SEQ ID NO: 182362 - DNA, 494 bp, Homo sapiens
acatgctttcctccacatcttgtttgggatcaaacatcacccatctgctgctcctgcacaaaagccttgttaaacttgctcaactctgggatcctgtgtcaagctgcccgctgcaggagcaaccattcactgtgctcaggccctaatactccacaccaggctgccctcctgcctgatgccatccttaccagggtcagcctcagatatcctgatctggtccccttgggctccacccacttagtgaggatgtctccttgctcttccccaccaaataactataggacctatggagggaaagatgagaggtaggagggaagggaacgagggtgacagaagatgaggaagagtcagttgccctaattcttaacaaatgttttcaacatataatttttttgtgatgataaatttagggtaaaaatggtcatgcatcagaaacatcactattaaaagtaggcttaggctgggcaccgtagctctcgcctataatcccaaca

SEQ ID NO: 182363 - DNA, 502 bp, Homo sapiens
tgtacgtggctcataagctatttccattagacagcagtgctctggagcaaatggcctatgtgtgtgccccaggggactcaagggtgttcaccatctcacttttcctcctcatagtggagggactggtaacaaatgctcacaaacgggggaagccgcgcacacagccatgaacatggatgcacccgatttacacatagcattgctgacaagctccaaaacgaacatgggttgaactgtaaaatacgattgctgacaagctccaaaacgaacatgggttgaactgtaaaatatgatatatgtgtatacttatacacttttttttttttttttttttttgagacagagtctcgccctgttgcccaggctggagtgcaatggcgtgatcttggctcactgcaacctccgcctcccaggttcaagcgattctcctgccccagccttccaagtagctgggattacaggcacctgacaccacacctggctaatttttgtatttttagta

SEQ ID NO: 182364 - DNA, 107 bp, Homo sapiens
agaattgtgccagtatatttccttttccccacaaagcccattactctggctgttatcagacaagaagagctaggcagcccattacttccctgttggctctggcttcc

SEQ ID NO: 182365 - DNA, 477 bp, Homo sapiens
cgcagaccccggcagccgtgttctggaatgctatgattgggtctatactgtgaacctcagaagtgttcctctgtttaattaattttccaccttgggcggaacatgattagaatgggctgcagtggaaggggataattcccttcccctaggttatttagtctccgattatactagagcagattaggctgaagttaagtagtttctcctgtggacaagccttgttaagaaatgggtgctctgacatatttcaaaatggttttcctttttccttccgaaaggttgaagcaggaggggagttttgtcaggtgtttgtcacaggagcctggtgaagctccatgagacaattttacagtattgtgccccctccccgacaataactctatctctttgtagtttttaacacttagagttgtccacgcggatcctccagccgttcaccagttacggtttgagtttttctactccagcacgggttcc

SEQ ID NO: 182366 - DNA, 413 bp, Homo sapiens
tgtctcgatcgatatgaccttttggaaagggatactaaattttatatgtattactgtgttgggctaagtgattgtggtatgtgatttaaaaccaaacaaacaaatactggtttaggccaggcttcttttttagaaaatcttattcgggtatcagtgtggttttgatgtagcctagtgagttgctgtttagatgggaacttgagaactctgcattctgatggcacaggccactggctgggttgcctgacttgctgtagaagtgaaccctgagtgtcctaatttaagtttctaaagttgatgaactctgcctggggaaatctatataggctgaagttggtgaactctgcctggtgggagagtttgtaaaggcctacactaggaatatgactgtaagattaatgaaaccatttggt

SEQ ID NO: 182367 - DNA, 99 bp, Homo sapiens
actgatttggtgttctgagtaaatcaaagcggcttctgcctccaaggcccatgatgctgtgctgcctcctttacctcttcaacatcttgccagacaagt

SEQ ID NO: 182368 - DNA, 499 bp, Homo sapiens
ttttcccattgatagttctattttagtatgtctacttttaccagattcttgtaggtttctttgtccttcgcatgtgaattattaatgtttcttactttataaggaaagaatcattcccattcaatgtagtctgagagggtttctgttcatttaagttgcattacttttgttggcaatgattatctcgttgtcatcacctactgaggagaacaagtgtactctcaggattgccacttggagctccttgggttaagggagagcttagtgaagacaagtggtagttctgtatcattgggaggctatcttctattcattagccttttgatttttgttccccactttcagatattctcagttcatatctgttgcctgcaaatagctgaaatagcattgtacgagctagaaaggtgtcaaatgagctaatttcctgctcatgaattcagagaagtttctagaactgcaaaaaattatatagcggcaaaatgtactagccaaagat

SEQ ID NO: 182369 - DNA, 907 bp, Homo sapiens
cctgcacatgctctcatggccgagcacagtggtccatgcctgtaatcccagcactttgataggccgaggtgggaggattgcttgagcccaggagttctagaccggcctgggcaacatagcgagactccacctcccaaagtgctgtgattacaagtgtgagccaatacacgttttctggtctccagtttacattgtaattgctactctaaatggaaaaagtatgctgaagagcctagacactatacctccactagaaatcctaaggagagagagctgctgaaaacctagcgaaggttggctcactggtgccagcagcaggatgtcggagatgctgaacatcatgtcgagtgtggggatctcaggaacgcaggcctgcagagccaggctgatggctgaccaactcctgacccagaatccaatactaaagcaaatagtcttgtaggaatgctgcctgtggtctccttgggaaggaaaagcaggcaagaacaaagcaggggatcccctgtggcagctgagctctcccttgcctttcttaccaggagggcactcccacagcttcccagctggagtgctgcagccagctggcctgcagacagcaaaccaagtcccagggctgctgagggtggtgtttggctagcacgagctcctgcatgccaccatgcagaacatttgggaagtactgtcctgacagcagagcaagaggccaggctttgttccacagtgatcctgggggtctggcgaggactagggctgtgagcaggggttctcatggccaggtgggtcaggagccaccctgcatagggttatgcctcccgtgagcacttctacgctctgtctaggccctggtgatgtccacagaccaaatccgctgttgatccggccgcgaatttagtagtagtagtcgacc

SEQ ID NO: 182370 - DNA, 343 bp, Homo sapiens
gacaactatgagttcatactctcctctcaattcactgtttcaatcttctcattgacaaggatcaaacatttaggattttattcaggtctctttaaacacttaaattcaggatatgcataaacactcatggatatctttaggatttacttaaccttggttcttatgaatagttacagggtatcaggagaatgaattcaataatacttcttttgggtctgttttgttcagagattatcagtttctcagaatacagggaacacttgttttgaggttaaaaacctaacgtggctctaaatttggtaaaacagattttgttctgtcttgggttatgtttgctgacaaa

SEQ ID NO: 182371 - DNA, 147 bp, Homo sapiens
ccctgtacaaattcagagacagaaaaagttctagattcgggacaccttgaacctttcaggaaaattaactattatcatcaagaaaggaaagctgtaatagatgattaaggcaccttccctactccactggataaagaacagaaagtt

SEQ ID NO: 182372 - DNA, 667 bp, Homo sapiens
ctgtatgattttatccatctcagacatccttggcccctgcttcttaatttttctctctgctcctccaagcttgcctcaccatctgaaattccacctagtctaccccaacatatcctatcactattctctgtgtaagggtactaagatgtatgaatgtctaaccagccgatgtgtgtgtgtgtgtgtgtgtgtgtgtgtgtgtagtctcacaggccttacaacaatcaagcaaaataggtattagaaattccacattacagataaggaaatcaaactcacagaggtttagttaatagcctgaaatggaaagttggcaaaggtggacctttattttgaactgaggtctgttgaaattcaagggcagcctctccaactcctgtcgggctcttgcacagctgcttctcccacctgctggtggctccagatactccctgcttggtgtaccctcagtgggcctagttaccttttccagaaacgaatctgattatgtctctccttttctataagcccctgttgattacattccaggattaagaccttacgagctggtttggccagtggttaccaaactcatctgcacactggaatcgcctggggagccttgaaaattatcaatgccggctgggtgcagtggctcatcctataatcccagcactttgggaggctg

SEQ ID NO: 182373 - DNA, 525 bp, Homo sapiens
ctttatacccacgtaggtaattgtacagggaaattgtgttttgttttctttctaaaatgggtattttgtcatttttacctgatacttgaagtcttttcaaaattctgagttaaaaaacccatctgggtattgctttggataggtatatggcatggctggttactcctggactatagtccaaaattggttaacagttcaatattattataagaactattgtagtcaagaccctggattttgaataaacaaaattgacaaaaagatggaccgaaaactcagaccatctcctagttcttcaagctaagttagtttcctgatatgtccaactttctgccaacccataaaaggaagccacatataagggctgatattcttggcaattgctgaggaattgcctctccagtcttctccagaccaccaccactaccatttaatcctgacatatttgcttactttcatcccccagttccaaatcctagctacttagtttgtctttgaaatccacttctgcccctcactgagttg

SEQ ID NO: 182374 - DNA, 432 bp, Homo sapiens
cgctctagagtatcccctcgtcttttgataggatactaacatccttctgctagctaggggtggtgctcaaagggtaggatgctgttaaaacatcagtagatctgagacctcggctctccatcctgaagccccctgaagaaactgcaataagcctgtttgaccccaccacttgctcattgtggttatggtggaccttgctttttcctgtcctgtgcatcaccttagacaattgggaaattacttttaattcagagatggcctcagttatggatttacagcattgcaactatgtaacattgtaacattgtgactaagtaattttaacaatgtagctacagcattgccctgctttaccgcggagacagcgccacctaatggttaaacaagtgcccagccgttccctatcaaaagacgagtggatcctctagagcg

SEQ ID NO: 182375 - DNA, 448 bp, Homo sapiens
cccatttccttcccttgagcatctctggtagagaagagcatgtccttggattctatgacccaattcaggttctaggctctaggccatcgggggccaggcccaaggcacagactcagcgccccacttctttctcttcccttgttgggtgttcctgagaatgagagggatctaatgatgatgatggcaatgataatgacaacaataacaactaactcatgaaatgtgacactgcttatcatgtgtcaggcaccgtactcagctcttgccatgccttatctcattttaatcttcacagccagcctattatttttatccccattttacagatgaagaaacaggggctcagagagttaaacccaaggacacagtaagtgttaaagtgttagactccacagttctggcatgaactggattgttaagtaaacaatagtttaaatgacaataggaa

SEQ ID NO: 182376 - DNA, 153 bp, Homo sapiens
ccattgctaaactgtatttattttactctgaaatttaattaagttctttctaagctatcagattctaattctttcagcaacaattacatttcgtcttaagtgctcctattttctttctaattggttccatttcatttttattttagttttacc

SEQ ID NO: 182377 - DNA, 655 bp, Homo sapiens
cgaggctctagaggatcccgccatttactccatggcctgggactgcaggtactggaaggtccatgggaagatgtcgggacaccacagaagacaagaaccaattctgttagcctatcgaaaatgcaagatgcagttctttcatgggaacacttattagaacttaagaataatcattgtgaacaacttacagtaaatattaaacaaatggaaaatatggttggtgtactacaaaaggagctatgtgaagcaaaagaaacacaattacagttagagcatgaaaaaggtcaatgggaacaagaacgctacagtttgagaatgaccttaaaagaagaagaaaagggaagaaatgctgatatattgcctaaaaaagacagtgaacagttaaaaagaaaagaaaaggaatgtgggaaagaagttgaaacaacaactcaaacagactctgaaatcactggtcacagaattgaggacattaggaaagaatttggatcaggttgtgcagaagcgaagcgatacccacagcaactttctgaagagcagaatgccagaatattacaagatgagattctgaccagtaagcacaaggaggtcgaaggggctcaaaagcaaatgaattctgagatttctcaaagccatggataaatgcaggaccgcttga

SEQ ID NO: 182378 - DNA, 712 bp, Homo sapiens
cgaggctctagaggatcccgccatttactccatggcctgggactgcaggtactggaaggtccatgggaagatgtcgggacaccacagaagacaagaaccaattctgttagcctatcgaaaatgcaagatgcagttctttcatgggaacacttattagaacttaagaataatcattgtgaacaacttacagtaaatattaaacaaatggaaaatatggttggtgtactacaaaaggagctatgtgaagcaaaagaaacacaattacagttagagcatgaaaaaggtcaatgggaacaagaacgctacagtttgagatggagctgtctagttgaaggaaaacaagctcaggactttcactgattctacatcataatgaccttaaaagaagaagaaaagggaagaaatgctgatatattgcctaaaaaagacagtgaacagttaaaaagaaaagaaaaggaatgtgggaaagaagttgaaacaacaactcaaacagactctgaaatcactggtcacagaattgaggacattaggaaagaatttggatcaggttgtgcagaagcgaagcgatacccacagcaactttctgaagagcagaatgccagaatattacaagatgagattctgaccagtaagcacaaggaggtcgaaggggctcaaaagcaaatgaattctgagatttctcaaagccatggataaatgcaggaccgcttga

SEQ ID NO: 182379 - DNA, 524 bp, Homo sapiens
tggcagcgttcagaggatcctccaacgcgctcacaacgcctaactctgacagaaaaggccactttaagtgttccactacataagcacatttctcatgtaactgaggtttcttccttagatacaaaaggttatttaaaaattgattaaaatgttcctaaagtataagtctttcagattttctgacaatataatgaatataatctaacttgatgacttgggtcatcattatgaacgagttattttgttagttttaaactcctaagacctgcttttacttatttttttcaattgctttttaaaaaaattattcattagccgggcatgggggctcatgcttatagtcgcagcactttgggaggcagaggaaggtaaatcacttaagccaaagagttcgagaccagtctgggaaacatggcaaaaccctgtctctacaaaatatccaaagattagccggccatggtagtgtgcacccgtagtcccagctactggggaggccgaggcgggaggaccgcttgagcctggag

SEQ ID NO: 182380 - DNA, 352 bp, Homo sapiens
ttatggatgtaaattcaaacagtcatgctgagccatcccgggctgacagtcacgttaaagacactaggtcgggcgccacagtgccacccaaggagaagaaggtaacgtggcaactgcacatttgccacacggttgggagtccttccttccttgctctgacactaacacggctcttatactcgacctttgtcccctctgtcttttttctctctcttttttttaactaatggagacacaggcataggttaaaatcagagatatcttgctcaggttttcagagcaaacactgtgttccagcccacagcatacaatagtatatgcagaatttagacactatcttcccaaactaaag

SEQ ID NO: 182381 - DNA, 479 bp, Homo sapiens
tgcccactcttctttctccttatttattttttaaattaaaagccatttatggaaagccgctgataacatcataatcaatcggaaagcagaaatagccattcttctggtaccaggcaaggatgcctactcttaccacttctattaaacatgtaccagaagtactatcaaaagcatttagaaaagacacattcaacttggaaatgaagaagtaaaattacctctatttgcagatgaaatgattctacctgtaaaaaaccctaatgactccactgaaaaaccattaacactaacaaataagttcaataaagttgcaggatataaaatcaacatacaaaatctgtgacatttctatacacgaataacaacctagccaaaaatgaaatcaagaacaccattccatttataacataaataatacttgggaataaattttactaaggaggtgaaagacctgtataccgaagacaataaaacattaa

SEQ ID NO: 182382 - DNA, 711 bp, Homo sapiens
aatagagctcggtccgattacgctcctaacgggaggttgatttggtcttggttctttgatctttaggagcccttgtgccatcccagtagctattcatttacagacactcagctgccatttcccctgtgcctctcacatcgagagcaaatccccagacctgggtaaccccacctcttcacctacctgaacaggggaagaatgctgagtagaaaaacactgtcttgctgactggactcattttgaatttattaccccaatttaaaattaggatccttagtatcgccagtagtactgcatttcctcagtccactcacttgcccacactcttctaagatgatatagtctccttcctcccagacttctaacacaccgtcccccatactcatgttggtagcaaaattttattttttggagagaaaaaaaaagcaatcctactttgattctgcaaccaccaaatctcccatgctgcctgaatctataacacagtgctctactttctttcctggtgtcaagtactagctgtccatcatctaatcgaaggccagcttctcactgctgcacggagttcacttccttctcaaggatttagctgcgtcagttactcctgcctgttcactcactgatttctccctctctgttgggccatccccaccacctgaacagaacaagctcatgacacctctcattcccttctggccatcaccccattac

SEQ ID NO: 182383 - DNA, 398 bp, Homo sapiens
agcataaactattacagcatacactattacagcataagctattacaaacaagcaagtcgtccaagaagcttaacaaaaacagcatcagcgagattcacttactttcaaggcaggagatacttctgggaggctcaaatacagaatggacaaaaggacacccactcaacttgttagaaattatcctttaccatctgtactgcagtatgcattcaacaatgaaaaattgttatttgaggctttgaaattaatacaaatgtcaaaaattaacaccctttagttgctgtaccagcagctaccaccaaatcttaggaatatacttgagagatgacatttaaaatctgctttttcagaaaagaaaaagtcccactcaagactgactgccaagaacttgcaattca

SEQ ID NO: 182384 - DNA, 353 bp, Homo sapiens
ttacaaatatttaatttcaaaggatgccaaagcattggcaaatatatgtgtcagagcttagagttagttgcagccttcttaataatcattttactattttatttcagaaatataatctagcatttcagcgtcactggaaatcttggtaggtagtcagtatttttgtttggaagtacaggataccagcagtgaaacacttcattttattaacgtcaagcaagtaaggcattattttcctataaatgtgaggttgtttgaaatgaaaacaaacaaaaccaggtaagacgatagaagcagatgttttctctgtttaaaaatgcggttggtatgtgaggtatgtgtagggaatggct

SEQ ID NO: 182385 - DNA, 617 bp, Homo sapiens
aagctagttgaccggcatctaatcaccacacattgtatgtattgaaacatcactatgtaccccatgggtatgtgtcattatttgtccatttaaattgttttaaatttcactttctggttgttcatagctaatacataaaagtagatttgacattttcccttgagttcctgctaaattcacgtattaggtctagtagttgtcttatagattccttaggagtttccatgtccatgatcgtgtcatctacaattaaaaacaattgcgcttttctttcatatatatatgttcatttgtatatgacatttgcatattgatttacctataatgtacatatgatgtgtacacatatgcatacatatctatacaggattttttcgcctatgtcagtggccaggtccgtcagtgacaatgttcagtgaaagtggtgtgagtgggcgtccttgacgtgttcctgattttaagaaagcgtttggtctttcacaattaagtacagcgtaagctgtagatgtttctcctaaatgcctttttatcaggttgagtgagtttccttttcattttagttcctagagagttttattttttcgtaaatgggtgttgaattcggtcaaatgctcttt

SEQ ID NO: 182386 - DNA, 210 bp, Homo sapiens
cttttgatttaggttgtgttaaatttagagaataatttgaaagagtttacatattttcaatgattggatcttccttcacatagagattatgtctctcaaatcatgcaagctttgaaaagtatcttgcagcaatttcatttcctgagcatttcttctttttttctttttctttttctttcttttttttttttttttttttttttttttttt

SEQ ID NO: 182387 - DNA, 567 bp, Homo sapiens
aagagaaaggcttttcatcaaaaaagacctattcttaagtcaatgagtcgcttttctttaatcagtgagtttttactgtattatattttagtaactagcagctaaactacattcttggaaacataaatgactatcacaaagtgtatttcacatttataaataatgatctttaagaatgattagtcttcttttagtgggaatttaattttagtaattcttacagctctctgctgttaaattttggctgataaattagccagatgttatgagaattataaccatattcatcaaatgtaagttagtaagattctgtcattcatttagataaaggtggaaattaaatacatactttcatactagtaaatacatacactaaccccaagaaatgaccttcagtcgatgaaattcaggccaagaaggaaatgatttctttcatcagatcccctcacataataaaaaatcctgcaagactccagttagccaccaggaaaatctaaaactaactaaataaaaacctaatgattttgtttgctagtcttaaaattgttaacagcctaacttttcata

SEQ ID NO: 182388 - DNA, 340 bp, Homo sapiens
agcatctttgtcattgccatggacagaaaaattgaattagggctagtctatagaagttgttattgtagaacgaagttattaattctccaagtagtttgttatgtttaagtttcatacagctaaaataaatttttttagaaaggcatttccttttctttctatttttttttctttctagttgtttcatccttggtgtagctctggattaagtaatcaaattgtgaatattctgtatgctgatattaagtacattgtttaataatgtagttttatgttaaaaaaaaaggctcttccctttagtgggtcatgagatatggacaggggtgaagagagctggacc

SEQ ID NO: 182389 - DNA, 481 bp, Homo sapiens
gttatcttctatagcttcaacacattcctgaggaatagatattttcctgttttacattcagggaagcagacaaagaagttaagtaatttgcctaatccaggggtgtcaatcttttggcttccctggcccacactggaagaagaagtgtcctgggccacacataaaatacattaacgatagctgatgagctaaggaataaaaaacaaacaaactcataatgtcttaaaaaagtttacgaatttgtattgcgctgcattcaaagccgtcctgggctgcatgtgactcacgagcgacaggttggataagcttggcctaatgcttcctggttgcttactttagccattagatcacatgatcttccctgcacaaaattgtttgtgtgcatcttggccaaaagcttggggggaaatgacttaaatagtgttgcttctggggaatacctgtgtcacaggtttctacttgtttggtcgcagtagggatt

SEQ ID NO: 182390 - DNA, 589 bp, Homo sapiens
aattaagaacttaagccttagtcaaacagcagtgctccaaaagtgaaacccaaaggagctgaaaatgagttaacaataagagaaaatgaagagagagagagagagagagacacacacacatgccttctcttcttctgacatccttctgttccttttaaagagaaagagtagggattagatgactggaaccacaaagtgaagactaaaaaatagaaagtgaaaattgaggtttgcagttactcccactggtcctgacattctaagcagggcttcacaccagctacagccaaggtctttggcaacattgaaaggaaaactaaagtgtctttgttggccacccaccatcttgccccatctctgcccttcaggaagcaagggtactcaatatatcttctggctgtcttaaatctcatactgtatgatccactctacactcattctgtgtaaaatgccacagacaactaagtattgatgaaatagcattttaaagtaattctcacgcattaagaaggctcaataaaacttactgtatttgctgagcaactactatgtctctagcactgtgctaaatgcttgagggcagtgtttt

SEQ ID NO: 182391 - DNA, 203 bp, Homo sapiens
cagctgcagccctgttttgcagagggggaaactgaggacaaatgagcatgggagaaggttctctccctgctacagatgtcagggcagtgggtgtatgtaatagggggtgtgtaggtgttactgggtgtagctgtggctggggacgagggggcagcgcctttaccgagtgtgtgcaaaggtgtgtccccgtgcatatggggtgg

SEQ ID NO: 182392 - DNA, 376 bp, Homo sapiens
caccctcttaactactgcattatactgtcagtgcactgtcaacaactgagcactaccatttaataggagaaatggcatctcctacatttcaatgtacaactttactaataaaattgaacttttaaaaaatacatgtttatacacacaaactatgtaagtgtatattaaattaactacatcatttgtggtctgacttttggttagtcttggtgtttttccaaatggcttttatcatctattattatttctttttctaatacgttcaaaaagtttttctgttttaatgtgcctttcaaacaactggtttaaagcaatatgtttctgcctatttgtacaattccccattattttaatattgaggtgtttcaatttgcaa

SEQ ID NO: 182393 - DNA, 579 bp, Homo sapiens
gccatacactattgacagaagggagatatttgtaatatatttattaaacaagggatttgtatctagagtatatgtagaatgtctgcaatgcagtaagataagattaaagaatttggaaggaaacttagctgaaagagaaaacctaaatatataagcatgtacttaacctcactattgttcaagaaaagcctaggctgatctcaaactcctgggctcaagtgatcctcctgcctcagcctcctaaaatgctgggattacaggtgtgaggcactgtgcctgaccagttatgttaatcttgtaactaatgatgacaaacctctcttcatatatttgtcagtcatttctgttttgtgaattacctgtttatatcttttaactcttttaaattggtttcttgttcatgtacagggattgcttatataatctagatagtgattccatagatattgctgatatcatcttccattgtgttacccatctatgccttcctttgtttgaatagaactccttcattctgatgtagtcaaaggtgttctttaacaaatactgaacttttaaaatgttgttttaccccagatc

SEQ ID NO: 182394 - DNA, 220 bp, Homo sapiens
gctctgctctggggattaaggggctgactagaaggatttgagtctttccttctgtccactgccacagggttcttggagtaactgcagggtttaaactgcagggtctaacttccagaggctggggttccctgccccccagcttagagacattcctgaggtggctgaagagcaggaaggagaatgaatgcacttccagactggcccagagtctcagcccctc

SEQ ID NO: 182395 - DNA, 455 bp, Homo sapiens
gcgtggtggctcacccttataatcccagcactttgggaggaggatcacttaacctcaggagtttgagaccagcctgagatagtgagatctagtctccagaaaaaaaataaaaaattagccaggtgtggtggtgtatgcctataatctcagctactctggaggctgaggtgggaggatggctgcagcccaggagatcaaggccgcagtctgggtgagagcgagaacctgtctcaaaaaatagaaaagcaaaaaataaaacttatgctgcaataaaaagcatgacattatttaacagttatccgttactggacatttatgttgttcccaatttttaatttccttaacccatactgaaaaacatatttttacactatttccttgaatattagtaaataaaaattgttaaatcaaaggatatgacaaaatttcgaacttttcaatcatactgcaatata

SEQ ID NO: 182396 - DNA, 261 bp, Homo sapiens
cccatgattaaattacctcccaccgggtccctccccaagacacatgaggattatgggaactaaaattcaagatgagatttaggtagggacacagccaaaccatatcctatggatacagtacattttgtccattgaaggatatacttgaaatgggtaaattttatgatatacaatacataacttaattagcttgtcagaaaattaaaaataaatcaataaataaaaccattgcaaaagccagcacccctctagttgcataca

SEQ ID NO: 182397 - DNA, 334 bp, Homo sapiens
  misc_feature (200)..(200): n is a, c, g, or t
ttttagtccacataaattagaatcacagaactataggctttgagaaattataaaagccttggaaggggtgaacgtgaattagtgcatatggtgtgcaggctttgtgccatacgtgctagatatgggatcccaggaaatggttgcatacaccttgttgggtagatgatattaaccctgcttttgcagatcagagaaacctngagctttgagaaaatcctttacacaagtccaatatcaaagtctggaactgtcaaactgcactcctgatggcttctagaaatcctttccatttacagatatgacaagacttgctttcacattgtggattcgtttt

SEQ ID NO: 182398 - DNA, 186 bp, Homo sapiens
agcagtcatccagaaatatctctgataaaacatactataagctttgcttcacaatcttgtaatatggtattgagtggccatgggatgagtgtttacaccacagaaattggcaaacactacaggtcagttttttttttttccttgagaactggttgttaaacgttggccagcacaccactgcactta

SEQ ID NO: 182399 - DNA, 268 bp, Homo sapiens
ggttcaggcacaacacccagagaaggaaatggcagccacctggctcggttgaaatactcatttcaagggaattccttgtccattcaaatgactgaacaacagcttgatttcatggaataatggcttttattaagaagccaacaggaatgatcatagtggggagtcttgtgtcctggcagtgggtgtttgtagagcacccggtggtcaccagcaactctgtgcaaggctcagtgggagggtgattggtgtgttggaggatgtgggtaca

SEQ ID NO: 182400 - DNA, 116 bp, Homo sapiens
ttttaccatggaaacttttgctcactctggacaattgcctttagtgataataaagaatttgtcttgcctagggtgaaacaactctgttcctagagaccaagaggctgggacagtgt

SEQ ID NO: 182401 - DNA, 284 bp, Homo sapiens
ggaaactgattttggttattagtggtcccatattgcaatttttggagcttgcacctgatgtccagagtggactggctgataaaatgctgtgccattagcacaatacccttgggagaggaagggtctaaatttgtatattttctgaaggcctcttccaacctgccataaaacatagctgggtttttctccttcccttatgtgacttccctgaccttataatttatggtcttggttatcccctttttcatccctccaaggagtgcctcaagaaactttgcttgcct

SEQ ID NO: 182402 - DNA, 519 bp, Homo sapiens
ctctttttctaaaagtaaattataatgttaaaattccagtttaattaaggtatgtttactgatgttatgggatggcttactttagactcatcaaattctgtaaaactggaaaagaaattgaaaggccttaattcttacagcttttactcaaggaaatgagcaaatctagcaccatttacatttgagttcaaataggaataaggtactaactttaacctcaattgttgaattataccattgatttgttggaatcatggatcagtgggaacttttcaaattaagagggaattcttttctgttcccatctatgtcaaaacttgtatatatttctatgcattcagaccctgcttctcaattcacagagaaatgaacttaaagtttggaaaggaagcatgagcatgcttcacagttgttttctttgtaaagcacttagtacaagaccagaactaaggggtgctcaatgctttcttattaaatgtatcttattggtatggaaaaaggtgtcctagcaaacctatt

SEQ ID NO: 182403 - DNA, 147 bp, Homo sapiens
tacacccagctgagccattgcccccatgaagccctcctagactttccacctctccctactcaagtggagtcattctccgtctgctttgcatcagtcctgccccttgggtaaaacctcaattgtagttggttgcttttgtttatgctt

SEQ ID NO: 182404 - DNA, 493 bp, Homo sapiens
atactagcagttctctggaatgcactgttgatagccacttgacctctttgagcctcagactctgaaagaagcaggtactgctacctgcttcacaggtacctgtgggggtaaatgagaatggagatacacaaggacatcatatgttcctggcacagagtgggacatggacgagtgtcagttttctcttctctcccttccccatcatctactagtaccctgaactattgcaggatctggccagcagcccgcaatgcaacagggctctttctttgttcccaggtggatcggcaggtcgagaaataatagacacacgcaagataatgaaagctgggtccaggggagtcaccgccttctggtcctgcgatgctgccaatgtgctggatataccagcatttattattaagtttagtgagggcgggggtaggttagtgagggatttagggtcatttgattatgaggtgagatggtcacatggggatgaagtaattcttta

SEQ ID NO: 182405 - DNA, 363 bp, Homo sapiens
aactgattacagacataaactattacagcataaactattacagcataaactattacagaaatcttgtgtgaaaggtgtgttgactagttgagtcatttgtaatttgctttctctaagtttttcttggtgcagttacagtagttcaagattcttagtcttcggaataaagacattttacacatcagttattcgtatgcatttttttcaggttgcaagttagaaaatgtcttggaattacacgaaatgctaataaacaatttcattttgaaatattacaagtgaatttcatatgtaaatttacagtttggagacactctgtgggctcgttttaagagatcatttcaactaattgaattttttacg

SEQ ID NO: 182406 - DNA, 384 bp, Homo sapiens
aaaaagatgatgtgaatgataaacgatatgattagtggctacttggtaaggcaaggaaatcattaaatcttggttctcatcaagttcattttctgaaaagatagcactgtattgggaccagaattctacaaaacattctttttatgtaggaccaagattttcaacaaatatttttcaatgcaattctcagcgctccataactaatagtagcttgttcaacacagattttttcggatggttcacacctgtagttcttacccagggatagttcaccacccctcccttccctcccatcatcgttggtgaacggtggcaatgtttggaacaatttttggttgtcacaacaggggtttcttctgatattcaatgagtagaagccaggga

SEQ ID NO: 182407 - DNA, 575 bp, Homo sapiens
caagacctcatctcaatttaataaaataatccaccttggattaacacgtataatttccttttctaatattcactgggcacctgttttacgccatgtgcggtatgttccacgatcagcaaaacagatgcagcagtccctgcagtggggaaaactcagtccatgaacattcacaccagcagggggtgctgtctcgccttttaaccagggagcccctctgtgtccttctcaaggctgcccttgtccatttcaccttcttccaattcaaatcttgaaaactcacctctaaggcgaatgggggtgaggagatacagaagaaaaacagtatgttctctcttcaactctgccccatgggctatgaataaagtcagaagacaaaatcccctgcttggtttttggcgtttttttcctattctaaatcaaagaccacagcagaccagaatcctgtggcttctcaaatgaccaagcctgacatattgaaaagcagatcgtcttgctttgaaaaaccttctccacccacccccgcaaccaatttcagctgattaaattcaatcactcatgccttaagactggcaatg

SEQ ID NO: 182408 - DNA, 548 bp, Homo sapiens
acatggtacacatatatagagcaattatgatgaatggagcttatagaactggaatttgcttggactggaagttgctccaagtcagtgagtgagtgagcagtgagtgaatgtgaaggcctaggacatgattgcatgctattgatgactttataaacactgtacgctgaggctacactaaatttataaaaagaaagtaattatgctacaacagctatgatgtcaccagatgacagcaatatttgagctctattataatcttctaggaccactgtcatatgctgtctatcgttgaccgaaacattatgcagcacatgactgtactataatttccgtttatctgttgatagatacttaagttgtttctaactcttggctactaatggccacttcttaaaggatgttcactaagcatgtttttcatttcctctctgattttgatttctcatacatttctttaaagcaaatatggtgaaaattaaaatcagagtttagacccaatgactgctagtttcctttattctagtaaatattataagtctatttgtatg

SEQ ID NO: 182409 - DNA, 103 bp, Homo sapiens
ccattaaaatggagatgaaccataagatactgcaaagcccagaaggtcatgtgtaattaagcacatattctccggcttcttttatcatatattcatattaaaa

SEQ ID NO: 182410 - DNA, 162 bp, Homo sapiens
cccactgcccaactaccagaaattgctactactgaaatgaaactattttctctccattttaacaaaaaaggttcttactgtacctgcagatttatgcttttatcaatgagcaatatattgagaatactttttcttatcagtaagtgttcttttacaagaaca

SEQ ID NO: 182411 - DNA, 681 bp, Homo sapiens
gggaggctgaggcgagaggagcactggagcccaggagtttgaggtcactctgagcacatagggagacccccatctgtaccaaaaaaaacacaaaaattcaaaaaggtgtactgagaactacaaggacaactgccatttagcttaatctaggggttgggttgggggatagcagaggaacggccaatccaatttcaaaagacaagtagacttaagcaaaagagaaagtactggagaagagatttcaggaagaaagtacaaactgggtgtggcagtacaaaggacaaagggtgtgattgtgcaaatgagtatggtagtacaaagcactttgttgttacttaagaatgataggagatggagtagaagtaggccacagggccttgtatgcaggctaaataacatggaatttatcccctatattggaaccactggataattttaaccagggcactgataagcatttaatatccatcactaaggaggataaatttaagggcaaggagtctagttaggaggctattgaagcagtcgatatgaagaggatatgagtttgtgctgtagtagtaaagatgggaaggattaattaaaaaaaaaagggggcagtcagcaggatttggagactggataatagaggtgagggagagaggagatataattctcaggtttctggcttggttgcctgga

SEQ ID NO: 182412 - DNA, 754 bp, Homo sapiens
aaattcttagatattacattaatctaaaagagaaatgcattccaaggacttacaaagaaatttttcaagtagaacaaaagacaaaaacttggctacacgaaaagatcaagctgcaaacaatttaataatctggactattcattatttgaggctatgtgaatgagatagacccaaaataagtctactgtgggtcaggttcaccaaccactaccaggttcagagataaaatatggaaaatatcatcaccatctgataaaggctgctagaggaaggatacagatcctacaactgatctgtcaatgcggttctattgaaaaaagcaaacattttcaaaattctaattataaaaaacattatttccagaaacatttttgtggacagacggagacaacaaaaagtttgagagacagcattttctgaccacagtggtcttcaaagcgaagttggactaacatataatgcagatggagcaatttttttgtttgtttgagacggagtcttgctctgtcaccctggctggagagcagtggcgcaatctcggctcactaaaacctccacctccctggctcaagtgattctcctgcctcagcctcccaagtagctaggattataggcgcacgcctgactaatttttgtatttttagtagagacaggattttatcatcttggccaggctggtctcaaactcctgactttgtgatccacccgccttggcctcccaaagtgctgggattacaggcatgagccaccgcac

SEQ ID NO: 182413 - DNA, 511 bp, Homo sapiens
ctagaggatccccatacattgactgatgacattagtttggattcttcccccaggcttctctgcatgttgattcccaagtagggctaccagatttagtaaataaaaatacaagatgctcagatagatttgaatttcacataaacaatgaatatgtttttagtagaaatatgtcccatgcaatatttgggacgtatttacactaaaaagttattcaatttttatctgcaattaaaagtcagctgggcatggtaaatatttttcatctggcaaccctacccccaaacaaccctcaaacctatcttcttgtaccaacattctcttctgggtgagcagccggcccttccaactcaaaatctctaaaaccagctcatccttttaatgtaggtgtcatctttcaggttctccttcatatcggtcagctgttaagcattctggatgctggttcccaaatgtctctacccttcccctatagaagagtctcattccaactgttgagtttcacctacagctg

SEQ ID NO: 182414 - DNA, 617 bp, Homo sapiens
tagatttattttctatggcatttaaaaaccctcctggggccaaggtagcacttttagtcaacagccttccaagcagacacttgcctttgaaaccatagcagtcccagggcaggttggaggtggctgatgccggacacggtgctccagactgaaaggtggtcatttgctgtgaacttccctctagattgtgtagactaggatgaggatgatgggatgtttcttgagctctgacccaaggcagcatcctctgttgacataattctccctccctactgccccttcctcgggcagcttgcctgaaagttgagaattcttaggttatttcttccaaagggaggaccctccccgagcctggccagcagagaatgagtgccactttgcactggcctagttgcacctctgctgggaagatgtgaatcgggggcgagtcgcccagtgagtcagggttaggcttctgggtaagacaccgtgctgacaggcctggcttcccctctgcttcatgagcccctgtgctccccttcacccattcaaaccattgacttcatccctacccagaaggtcacctggactcccagtgtcatagctggaagggggtgagatggtgatgatgatgggaa

SEQ ID NO: 182415 - DNA, 1871 bp, Homo sapiens
gctcctgaattctgtggtcccagcttagtgaccccagaggaaaacaggtttctcccagctttggcctgaataaacctacaagacctggcctggcccatgagccagacactcccactggagagatggaggatcgtgatggacaggccagggtcactgccctctccagggcctgggggcagagtattggaattggcagcccccgagaaccaagtgtacacggggagggcatttctccagagcaagggaacagatgctgggccagccagagcaacagctattccccagtgccttgatggttgagcctgggggtgtgtaagcccagagaacccagccagggtgtcaggaaaatcttttctgggtcatgaaggatgaatacacatttcccaagcatacaggggcaatatgggcatttgaaagataatgtacagcttcagcaaagggctggaggcaggaaggtgcatggaggggcctgggagcagagaatcagggagtgggcatagctgagttcagggaaaagaggctggaaagaggtgggcagaggccagatttgggaagccaaggatgccactctaaggagcttggacactgccccgtaggccactggaagactccgagcagggaagtggtgctgtcatatttggtttctgatacttagggtctggttttctgggctagggagaagacccactgccttctactgctaggactagtgctcagtggcagaaaggcagaacagtgaagtgctcatatgctgacatcaggctgcctggacttgaatctcagctctgccacttgctgaccgtgtggccttggggagaagacttgtcctctctgagccctggtttctagaactgtaaaatggtgacaatagtctctgccactcaaaattgaatggtaccaggattgagagagaaaatctgtaaatcactgcgttgtacattcaaggcaggaagaggcaggcagggcaagggtacctatccatgtattagggaagcacaagcttattcagaatccctgtgcacgcacctctgtgtacctgttgttggccagatgaaggttgcagtgagccaagatcacaccactgcactccagcctgggtgacagagtaagactccgtctcaaatatatatgtatatatgtataaagaaataaaaattaaatggccaggcgtggtggcttacgcctgtaatcccagcactttgggaagctgaggtgggcagatcacaaggtcaggaattcgagaccagcctgaccaacatggtgaaaccctgtctctactaaaaatacaaaaattagccaggcatggtggcgcatgcctgtaatttcagctactcagggggctgaggcaggagaatcacttgaacccgggaggcagaggttgcagtgagccgatattgcgccactggactccagcctgggcaacagagcgagactccatctcaaaaaaaaaaaaaaaaaaatgttggccagagctgaccccctacctgcaagtaaggaattcaaggaacaggattttcctgattggcttagtcttgcaccacacttatcacctgggaaggctgcctaacacaaaaccaggactggattagtaaagaaggcatgaggtagcagttaactgtgtacaaatcatctaatcttcactatcaccctgaggggtcagttctgttgtctacccgtttcacaggtgacaaaactaaggcaggtaagtaacctgtgcagagcacagaactaggattcagacctacagacccacaagtcagcctctaaggcccacttataactgctcttctgcttgcaaggccctatggatgaaatccagttataacctccttttgctataactagacacagagggaggcgtttctccctaa

SEQ ID NO: 182416 - DNA, 508 bp, Homo sapiens
cagcaggtctcagcctcattttacccagcccctattcaagataaagtcactctggtttgaatgcctctgacatactgatgcaaagatactcaacaaaatacttgcgaatcatattcaactattaaaagagagattacaccatgatcaagtgggatttattcctggaatgtaaggatggttcaacattcaaaaatctatcaatgtaatataccacattaacacgatgaaaggagataaaaaaaaactacgtgatcatctcagttaaagcagaaaaagcatttggcacagttaaacaccacttcatgagaaatactcaacaaacaaaatagaagaaaacaacctcaacatatataaaggtcatatattaaaatgccatatattgggccaggcgcagtggctcacgcctgtaatctcagcactttgggaggccgaggcgggcggatcacaaggtcaggagatcgagaccatcctggctaacacagtgaaatcccatctttactaaaaatac

SEQ ID NO: 182417 - DNA, 376 bp, Homo sapiens
taaccaaaatgaagcctggaaaagatctctccactcgctgatcagcctaagactcttagcagggatggcatgctaacaagggcaaccctagcgctgcccgggatgttttcagcaccacggccagcggcaaagaggcacaagtttaatttcacttgcacccagggatgggaatccccggggagagaaaacaaaaccagcagcaactattaacactctctgagacatctgcaaagacctacatttcacatacagggtagaggcaaaaaagattaatcatgtcatcaggaaaatcaaatgaagagaaaattaaaaacagtatcaaataggtttgtgtgtcatttgtttttcatattatccaacaatgtccaacactttg

SEQ ID NO: 182418 - DNA, 563 bp, Homo sapiens
ctgtgttacttgtgtgaggcaactaattaagttatagtagacttgagttaatagtaattcatatgaaaaagactaagggttttattacccacaagctcagtttgagtcaggagtgaaatgtgcgtgtcaggaaaacaaaggctatagtaacagatacatagtgttaaataactttgacagtttggagcatcagacagaaatacccaagatccagcattactaggcctcaataagtgtcactgggtgtggctagatctgttgactctggctggattcattattttcttttgggaatctctgtatttggtggaaatttttagttattagaaatctgttaaagaaatggtattaaatcattacatgttgaaaagtgatgatttccttcctattcaccctacccaaaacacaatatatgtgttgtggttttcatcataatatatcatatttctgggcactcatcaattcgcggggcctctgcatggcattatgttggcaacagaaactatttgttgaagactttgctgtaggaactgattgttctacacacagctttaaaatgtatc

SEQ ID NO: 182419 - DNA, 392 bp, Homo sapiens
acatatgctcaatctggatctgaagggagtggtggaagggccagttctggaaatccaattttctccatttcacaggtcctcatccagaagtcacatggattgactgagagtcacccatcctctttcattttcctttttcagaagagtgcagattatatttgcaggaacataaaatcacgagcaactgggaagatctagaccaaacatctgactatcccatcattttaagaattgtatattaattaatacaaattggaatgcaagatgtgatctcttaccgcggttaaactgcccttagagaacttcaacacaagccccaaacatgtacttgagacaggatttggtctttatcagaactcacactagcaaacaaatggcttttttgagcaaag

SEQ ID NO: 182420 - DNA, 275 bp, Homo sapiens
tttcacacaagtctggtgtcaaacattctgatcttgtcagtcttgattctctgagttttgttttgcatttctcttattgtgagcgaagtcgaacatattttcctatgattaggagccatgtgtaattccttttatgtgaactttttgcccatctctgtccattttctttacttattttttctattgggttatcagtctcattgatttgagaagttcttcgcatgttaaggaaagcagccctttgtctgaaatatacttgaaatatatatacatat

SEQ ID NO: 182421 - DNA, 406 bp, Homo sapiens
atccaacgaacacgtcgtggctcacccttgtaataccagcacttagggaggcagaggttagaggtttgctcgagccccggagttcaagaccagcctgggcaatatagcgagatctccacaaaaacaaaaacaaaaaaaaaacaaaacaaagaaatagaaatccagaataactcaaagtcaaaactaaatatcctaactgctgcaaattttaattacttttttttctgagacagggtctaactctgtcacccaggttggagtgcaatggcacaatcacaactcactacagcctctacctacccatgctcaggtgatcctcccatctcagccttccaagtagctggaaccacaggcatgcaccaccatgctcggctaatgtttgtattttattttttgtagaaatggg

SEQ ID NO: 182422 - DNA, 204 bp, Homo sapiens
acgttgacacttcagtagaggacaattcctgttgagatttactttagtgatttaaagatcaaatgcaaaaaataatccaaattacaacaaattggtacaaacaggaattctagaagaaaaggaatggtgaaggagatggaagtctgaattttaaaaataaggacttatggccaggtgcagtggttcacgcctgtaatcccagca

SEQ ID NO: 182423 - DNA, 339 bp, Homo sapiens
agaggtctctgagtccaaaatctaggttttgcagaggacgaagttgaggcatgtggaaatgaagtgactgacccaggcagcaaggtgagtcactactggagacaagagaaagcccagaccacctgctctccagcccaccgtccaccacctctgatactgtttggatatttgtccctgcccaaatctcatgttgaattgtaatcccccgtgccggaggtagggcctggtgggagatgatcggatctttggggtggatccctcatggcttggtgctgtcttcgttatgagtcttgtgagatctgatcatttaaaagtgtgtggcaccatgccccaactctc

SEQ ID NO: 182424 - DNA, 446 bp, Homo sapiens
tcgctcatacctagtcagggatgagcaatggactgggagcacataggaaaaggaatctgagccttacctgaaggcttccccaaggaagggactgaccactaagcaggctcctaaagaataaggaggagatgttagccagacagagagtagggcagaaagggcatcttagcctgaaagcctgtcctgtgcagagccctggaaggacaggcagtggagctagagccaggcaggggtcgttaagtgggttgctgagaccaggtcaagcttccccacttagggtaagggaaaggatacaatactccttatcagggtagaaaattaccaagaagtgatgtgggcctcagttcagtgaatctttactaagtgaaggctctgagtctttggtctgaggaggctttggggaacatgtggatattctactaggcccagaaaatgagaaggatacc

SEQ ID NO: 182425 - DNA, 195 bp, Homo sapiens
aatataaaaggacaaagaaaaaatgtgaatgataagcttaagatacaaggaaaatgggttaagaaattttaatatgcactcagaaaaatcagacagagaaaatggaaagtacaggagcatctatatgttcagctagaaatagacactgaacatcaattcctccttcttttgccaacggcatacttcagtttctct

SEQ ID NO: 182426 - DNA, 320 bp, Homo sapiens
atccagtgccacagagacatgaggtactgcctccccatcccatgggccaaccaagtatttcgtatggctttcagttcaccaactgcagggaactacgtggtcagagcttcagatactcagaatgtcctgccaggccctcagtgtgggataattcggtcagacctgagcgtttcataaacctagaaaaggggattaggtcaaccgccacctcgaatgttccctgtgccccatgcagggagcatttcataccagggccaggagaaagtactgctcttaaagggctttatccaaggcatcctggttcacattgagctgtagga

SEQ ID NO: 182427 - DNA, 305 bp, Homo sapiens
ttgttagtttataatttgtcctctttgacatgtattgactcttctttggtggtccaatgtgtggtcaaatgtgtaagttccaggtgttttggttttgttgttgtttgacataaggtctcactctatcacccaggctggagtgcagtggcatgatctcggctcactgcagcctcgaccacctggacccaggcaatcctcccacctcagcatcccaaagtgctgggattacaggcgtgagccactgcacctggcctttgtttgtgttttaagagatagagccttgctatgttgcccaggctgggctt

SEQ ID NO: 182428 - DNA, 350 bp, Homo sapiens
gatcactggcacgactgtacatggcatagctgttcttgagtaacctggtcatccgctataccatacagctctgtctgtcatgatcctgtcttttctcctaacctagctaactgcagctgcatctattccacaggtgactcaaagacagcaccaggctgtcgggctggaaggctcataggcagggcagagccagaagcttctgtggcccttctctcccattccattccagccaggaggggccctggctctggggtccttatttgcccctcttcaccactatggtgctccaatgcacacacataccaacaggcttcagtggacgctggttgagctgaatcctgactagagct

SEQ ID NO: 182429 - DNA, 353 bp, Homo sapiens
caaccaggccagagcaccatggaaaaccattaagtggtctaaacggtggcttgactgaaatttcacactctaggtccttcttctggtcctgtcttttctcctaacctagctaactgcagctgcatctattccacaggtgactcaaagacagcaccaggctgtcgggctggaaggctcataggcagggcagagccagaagcttctgtggcccttctctcccattccattccagccaggaggggccctggctctggggtccttatttgcccctcttcaccactatggtgctccaatgcacacacataccaacaggcttcagtggacgctggttgagctgaatcctgactagagct

SEQ ID NO: 182430 - DNA, 305 bp, Homo sapiens
caattatcaaaaacccattcacaactcaggaactctcaagaggttgctcccttgtctattgccacttacagaccatcttgctcaaagtgatgctagaagtgctggcaaagagaacatcttcactggagtgtcttgggagaaaaatttctttgctgcacatttcttaataaaattcaattatgtaaaatgaggagagagctgactaaagaagatagaatgaaaaggaaacattgcacaaagatatgtttttatttgaccaacaggctttattttgattccccaatcttctggaactcagactttct

SEQ ID NO: 182431 - DNA, 615 bp, Homo sapiens
agaagttctgttggacagtgctgctttagactttcctctctgcctctgccacaatactgccaggagagagctttccaaaatatagccctggccatagctctttttaaaactctgtgttattccttattggctatgtgataaagtccaaattcctatgtttgccaaaacagtctgcctagctttccagcctcatgtctaaccacttcctcttgggccctatattccagctgtattgaactgtttcccagacacatcattttgtttcatgcctctgtgttttacacatgtgcactttctatatggagtagacttttccccaatctatgtacgcccaaataacatctctgaaaagcttaatgttactgttcaagttgagctaactgctcattctttggtgtcccttccccttatgattttactttccacagtgaatggcatttatgtgattacatgtttctctctagtactagaccttgattttgagagcagggccattatgcattctttttcttgctttgctttttttttttttttaatatccctaggtcctagcacagtatctggccaatattaggttctcacaaattgagcaaatatggaggtgaattgatgtgt

SEQ ID NO: 182432 - DNA, 252 bp, Homo sapiens
acaatgctggcctcggggactttagtccatccatggagaacagacaaaggtgaaggttgggacaaaactcatctaaagacctgctttcagcagcagtcttctttatttgtaaataattaatgtacaaagtaagtcactcttttttttgttgttgttgttgaaacaggatctggctctattgcccaggctggagtccagtggcccagtctcggttcactgcaacctctacctcttgggctcaagccatcctcc

SEQ ID NO: 182433 - DNA, 330 bp, Homo sapiens
taaaattgtaggagtagatttctcttttggagctagctccctgaccaatataggcactaaagaagtcttctcagataactaactttaagcctatatctaaagagtaatagttgtctgtagaatagtgataggcagtagattttagataacaggaaatatttaggtatgctgctaagtaagagtgaatgctggttacaggagccaaaagagttatgtatggttagaatagcaaggaaatggtgagatcaacctgaattcgatgactctagctcaatgcattgaaagccacctcacaaaatgagcaattcactgacaaggaacaaatcacca

SEQ ID NO: 182434 - DNA, 203 bp, Homo sapiens
gagaaaatctgagttctggatggaagcattgggaacccaatgttgtatccaagcatgtttctttggaatggcaccagagagcaaattgcccatctgacctccatgttaaatatttggccttgatggaaaacagcaggcctatgcagtgggcaagacaattttcagctacttaagtctacgttaatgatatacactcaaaatga

SEQ ID NO: 182435 - DNA, 480 bp, Homo sapiens
ccaaaaagctggaggcaggggtatgacgtaatctgatttaagtactagaatgatcccactggctgaatggaagctagggatcctgagaaggcttctgttgcaatcttgggagatctgggagaggagatctcggatctcagtattttctggaggccaagcaggctggtgggtgtggaagcagggtgaaaagttttaagaatgattccaaagtgctgagtggctgctgctgtgggggaccctgactactgagatgggggtgggggcagcctatgctcccaccatgccaaggctcagggatttcaacttgctcttcaggacacagctctggtgccaagccaaggtgggagggcagcgaggcctccctctttgcgggggtggtgtgataaataagaatgtctccatctcactcctcatagctgagtggcacttccaggggcagtcaggggagacacagccaaggggtggatgctgccttcagca

SEQ ID NO: 182436 - DNA, 833 bp, Homo sapiens
ccgggtacggtggctcacctctgtaatcccagcactttgggaggccaaggcgggcggatcacctgaggtcaggagttcgagaccagcctgacgaacatggagaaaccccgtctctacttttaaaaaatacaaaattacctgggtgtggtggtgcatgcctgtaatcccagctactcgggaggctgaggcaggagaatcacttgaacctgggaagcagaggttgcagtgagccgagatcgcgctattgcactccagcctgggcaacaagagtgaaactccgtctcaaaaaaaagaaaaacaacatcatgggagaagacctaccttagcctgccctcagcagctcagctccgaggtccagcttgcagccgtcgtggttttgtgcaaagcagctgagtgtccctctgttaatgtgtgcaaaccatggtgagagctgagcctggatctcaagaccttgcgtaggccaaacatgctcaacacatgcagagagctcatctctcactatctgtcctgaagtcacagcgtcgctatggatctagccacctcaccagtgtctcttaaggctagggtcctgtcactagtcttgtggtgggttggctctcccatcctacccttgtcccttcaaaattcacatcctcagccctgagaggggacagccactttagacaaaagaaggcatgtttcagggcctggcacggtggctcttgcctgtaatcccagcactttcggaggccgaggcaggcagatcacttgaggtcagaagttcaagaccagcttggccaacatagtgaaaccctgtctctactataaacacacacacaaaaaaatggccgggc

SEQ ID NO: 182437 - DNA, 147 bp, Homo sapiens
tgagaaaatttaagaccagcaagatggggcacccctccacagctaccctgctagccagcagcagagaaggacccacctctaacccatcttctgagacccagtctttctcccagcacctccccacaacatgcacagtgctgacgggat

SEQ ID NO: 182438 - DNA, 624 bp, Homo sapiens
cattgatacaatgctattattatctggtctgagatcttattccaacttcactattgtctagtaatgtcctttgtagcaaaagacagttctgagttgggatagtttcatgcctctttcgtctcctttcacctggagcagtagttctttgtttcctgatattgacgtttttgaagagcacaggtcagttattttgcagactgtcctcaatttgggtttgtcccgtttcctcatgaagagactcaggtcatgcgattatgtccgggtgccacagacatgatggcgtgtccttagtgtcacatcggcaggtacatgatgccattttgtcccataatgcatgatgtagagaattctttttttaagttaaatttattcatacagctatctaaaatcgtttccatggttccaaagtcaaggtatattcagagaagtcgagtttgtctccttgcaccccgcccccatttcctctcttcccctgtagataaccagttttcttctaattttacactgtattcttccaactgaaattttttataaacatgagcatctatattggttcttaccttcctgcttaggtaaatgttaaggtgctcacactttctgcatactcacattatatcctgtagg

SEQ ID NO: 182439 - DNA, 498 bp, Homo sapiens
gctgctctgtggcacatgcatctctgtccagggcacttccaagaccaggctgggacacactgaccttgaggactgctgtgcaggagaaactaagcatgtattccctaatggcgggcagtggttcctgccactgttgctctgagagtggagtggagccccaggctgctctactcctcagacctatgcctgtttttccaattctcttccccactcataattgcagcctcacctttcccacctgcttctcacaaaataaagcatacttcttgccatctgccttgaccccaacaccccactgcctgagttgggaggaaggttttagagaatcctagagagaagggtgcctgtaaggcccttgagaacagaaagaacccctctggttcatttcagtgcccccatggatcactacaagagagtgaatgccaattacctcacggttaccagaatcaggcacaagcagagactcagaaaggaaaatgcctccttggcttagtaaaa

SEQ ID NO: 182440 - DNA, 567 bp, Homo sapiens
attaatattttagattacaattgtgctaatagagtcatttgcctgtatttttaaatgctctaaagataacaaagacattctattttggaagaaccaaacatgggtatgctgatgttttgccgagggtttatacacactgtgactaacgacacttctgtttaataggactgtaccatgccctgttccatggctccaaccagagccgcccagagatgtgggtgacagctcccacccctttcacatccttgggagggcattcctactccctgagaaagcaggtcacagcaatatcctcctctgatcttcaaggagctgaggcgcttggcgtccctgctgaaggcatatctctaactatggcctgcagaggtcctgcctgccaccccctccttctgctggttccagcaccccaactgtccttggcaagccatcttccctacacccctgacccagacccggccagtcacccttgctggtgcccccaccccctagccagagtgactggttctgggtgggcatggacatcattcaggtcggtcccatcaggactctcgctaagaagctagcaca

SEQ ID NO: 182441 - DNA, 134 bp, Homo sapiens
agagctgtcgggaatgatggaggctagtttgctaaatggggattttttttaaagatgggagtatcttggctcagcacagtggctcatgcctgtaatccagcactttgggaggccaaggtgggtggactacttga

SEQ ID NO: 182442 - DNA, 492 bp, Homo sapiens
atcaagatgttattaaattcatcttgtgcacataattgtttctttaaatttatgtttcttgcaaaacttgcggtaatgctcatgcacaaaataattttctaaataaaaaataaaaacattttctcagtcattaattcttaaaaagtatttctccccagtaattaatgtgaattaattcttaattcttaattatagaataatgttgcccttcagagttctgaatcttttgcacgttgtatacatttcactgactggaacatcttctggaatattggcattaattaatctcactcagcaattaatgatttcaaagaaattaaataccattcatattctgaatcacaagggtactttggcacctaatttaatcaagctctttgtatcatcatctacagtttaattacttaacaaacatttctttgtgtgagaaagattgagcaggttattgtgcttttcgttgtatacatttcactaagtagaacatcttctgga

SEQ ID NO: 182443 - DNA, 475 bp, Homo sapiens
ttgccttaatgaacataagaagtaaatattgactgatttttaatgactcatccttttatagccttcttcataactttgatgagaagcataattgcaactggttttatgtgaaataccttaaggagctgcattatgcatgccattcactgccctctaggagcttaccatgtaagaaatatacacatgtagaatacacgcatatatgatcaccatatagatgcattaaaatgcaaatattaaccacaaatatacaagcaacttgcagagttttttttttttcctaaaaaggacacaatatgagtatttttcaaaggttgtgggagagagtgaaaaatggatagaaaaaaagttaaggtcagtgttcagcaagtttgagtaatgatgagatatttattgcaagctctaatgcattaaacctctttaatcttgtcacaatagaaattaattgcatcaggtagttttgagatcaggtaaa

SEQ ID NO: 182444 - DNA, 362 bp, Homo sapiens
cctcattactccctttccccaaattattattcctagaattccagtttcatcaagtcattctcttgctctaaactacccagtaatttcttacagcctagtactgtaaactctctgtctctaacaatctccccaatcttaaacattattgcaccctatacaaatgtcagtcttctcatcacagtctgtcagacacagcttgcctgcctacccactcatttattcatctgtgcacatgctcatccatctacactgtcacttgacaatgcacactgaacacccactatccatagaatactatccaggaaaaccgtagaaaataagtcacacacggtccatgatatcacgtgggggaagggagagca

SEQ ID NO: 182445 - DNA, 124 bp, Homo sapiens
ctttccactttgcatctgaaattcatttcactggtagcagaggagagacagaacccaagtctgatcagcagcgcactgtccctttcaccacaccatgatgtcttcccagatcaggaaaacaaca

SEQ ID NO: 182446 - DNA, 244 bp, Homo sapiens
agggtggatcccaagttgtgcagctttcactgtaccatgtggcagcagactctactagatcagggttgttggtcctaaaagctgttcagtgtgactgtgcccttacaccgtgcaccaagaagccttctagaagccgtttggcttcctctgacagacttttgtggtggttttactagtggagggtgtccaggttcttagcgtcttgaacaaaaattggacaaaatgcacaaacaaaacaaagaat

SEQ ID NO: 182447 - DNA, 186 bp, Homo sapiens
taggggataagaggggctggggatacgtggaaagggtgaggtgagggacgcagttcattcattcgagggtatgggacctggttccgtgctgcacacaggggagactggactggccaaccggacagacgggagcttacactcttgtgggagctcacgggcgggccagtctgagagaatgcgggtttt

SEQ ID NO: 182448 - DNA, 220 bp, Homo sapiens
ggaatatggtatgtcaaaagcagcaggcttccatggaaatgtctggcatctcagctacatcgctgggcacagggatggatttggggtgagagctgagatttttaaaaaactctcagcagcacacgaggctgttcacagtaatacttaataaacgtctgttgaatgagtgaatgaaatgtggcctcagcaagccaccctagtgtctggctgggttctcagc

SEQ ID NO: 182449 - DNA, 609 bp, Homo sapiens
caagtgtaacaaaacacatagtaatcttttgaagcggttgtgacttctggccttcaagcgggagctttaggaggaatttcagtgttaaaaaggagaggcttgaactttgacatctttctctcgtgatttaagattctaaaagtagtgttaggcaaattcttatattccagcacaggagaaacaccagctttccaagaggatttagcatttcttcatccctttagcaatacaagagggcaactgtgctcagaggttggctacatttgtgaagtgggaagtatagaaagatctggaagtatgttttcagggtcacgagcccagtgggcagccatatgctgtggaagtaccttggcctggaaaccctccagctaaatgatgagtgtgtctttctacacaaaccctatttgaaggcatgttgctgcagtgttgtttttacccctcaggtaaaatgttattttctaccccatatccgaggcagataagccctgaaattggccagcatgtggattccacatgttttctcccactcttccaactggatgtgctcttgaaaacattgactttcttggtccttgtcatatgatatgttttcttattgccatacttcct

SEQ ID NO: 182450 - DNA, 154 bp, Homo sapiens
accagagcaatgcagagataagagaaagtaggggcctccagatcccagatagggtgaccaatcatcctgactgtctgaaactgagatgtttctttaggatactggactttcagtgcgaaaactggaagagtcccacacaaaccaggacaaattg

SEQ ID NO: 182451 - DNA, 429 bp, Homo sapiens
cctgctcggtgctgagagggtagaatggaggatgcgggtcctgcctttcaggcacccctggtgtaactgagaaccctgccatcctgaagtagggtaaggtgcagaagaggtcaagacagccgcacaccaccctcatcactcctccatgtgttcattcctggccccatggccagatcggctgggaaggaaactgccgcggtgagctctaattactagagatggagacgctcaggtgcaagctgcctaattacaaaagcccagaacacacatgctctcagggggcccaccagggttaaagagactgaaaaaataattttggctgcaaatttaagtgaggatgaacaccacgaggagcttcatatgcagaaatgaagtcctggctttcttaaaaaaataaaaacactaatgcctcaacaacaactacaacag

SEQ ID NO: 182452 - DNA, 375 bp, Homo sapiens
atgagattctctgcctatggaagtaaaggcttgcacaatcctctggaaaagtaaaagtgcaagaatgtgtcccaagtggacacaggttgtaccaggaacctccagggtcccagatcagtccacccagagtgagtccttgtgtctccggctctggggtcagaaagggcaggttgacttagttcctgaaggaaaccatgtagccctcacatatgtcacaagcatagaggaaacgtgctacctttattgctcaggttcaccagggagctttgcaatgctgagaccattcctaggcccaggacaatctgccattagctctgcccatggtaactttatgccacagagcaccaggtcaaggacataccaaacttccctctt

SEQ ID NO: 182453 - DNA, 552 bp, Homo sapiens
aataaaaaagaaaagaaagaaaatgtggtatatatatacagtggaatactattcagccttttaaaaagaaggaaagcctatcatttgtagcaatttgggtgaacttggaggacatggtaagtgaaataagtgaaataaaccaggcccagaaagacaaataccacatgatctcacataaatgttaatgttttagatttttaacattgaactcacgcaagtagtgaatagaatgtcagttaccaggggctggaggggtgagggttgaggcgggagattcaagagatatgagtcaaaggaaacaaaatttcaatcagacaggaggaataagttccagagatacattgtacaacatggagactatagtaaatacaatgtattacatacttgaaaattgctaagagtgtagattttaagtgttctcagtacaaaaataagtatgtgaagtaatgcatgtcagttagcttgattttgctattccacagtatataaacatcatgttgtataccataaatataatttttgtcaattaaattaattttttaaaaagttaaa

SEQ ID NO: 182454 - DNA, 417 bp, Homo sapiens
cactgaaggcagggctgactgcagactctgcactgtgaccagagtgtggctaactagcaggcttctgtagggttggcatgggtcttccctctaaatcttcccctaaggctctgaactgggaatctgaggcaactgggcactcttgctgttataacaaagatgcttctcttttaaaataagcctcacacctcctgttgcttcattctttcattcctttccttctgaacagacatgtgaggtctgagatagtatctcctaagtggtgcaagaaggcagtgtgcttgaccaagcctagggggcagaggaggcatccagaggagctggtagcaggatcaagatcccaagtgaagaaccacaaacagaggatagagacccagtgaggagaacctcctctcagtatggtgtctgaagcattgg

SEQ ID NO: 182455 - DNA, 332 bp, Homo sapiens
acgggaggagagaaacagtgagtagagtggggaggcagtgctgaaggacagcagaggagagagaggaggccagacagccagaggaggcaggtggctccaggtctcccagggaggaagggagctggagaaactactcctctcacattcagctgctcatttggcgtgtgaagaactagatgggccatttttaatatgctatgttagtttctctactctttttttgaaaaatcaaatatgctctttctttgtcttgacacatacacacgacgttaagatgtcatcagggaagaatcattttttccacttacaacatgaaaatgccttctcaaatt

SEQ ID NO: 182456 - DNA, 233 bp, Homo sapiens
taggtagaaaaatccatttatgacaaaaacagtcgtcttcattttgtgggaaggacacagaccttcaaagatttatatgcagcacccatagtaaaaacaaaaaacaagaactaccagaaattatactgatattgtgactaaagacctaaaatagcataagggaaagagactacctaacattgtgatttagcgatatcagatacagggaaatgtctataatataataataacga

SEQ ID NO: 182457 - DNA, 229 bp, Homo sapiens
tcaaacagtgctcagagtgcatacagtgccgaggagtcgaaagtcgttcctcggtcttgtgtagtggaaaccctggtggcatgccctgtggtaatgtatgccattagttgccaaaggctgcttccttcaagggctttctctcacagaagggttctaaggctgaagagacatgagcctctaccaccactaggagtccccagagggacatattctgaataggaatctgtca

SEQ ID NO: 182458 - DNA, 101 bp, Homo sapiens
taaatccccacatgaaaataccatatttgatcaccccagactaagtggaattatcaaaaaccagaaacaagagacagattacctgaaattaagtcataaca

SEQ ID NO: 182459 - DNA, 221 bp, Homo sapiens
aggcctcacagaactagcatagccaagatttacacttcaaaggtaatatatgaagcagtaatatgtcacctgatgataatgcatattcctttgtgtacttgatcttagtgatattaaatccttttttatatacacatgcaaataaactatgccatggttaaattttgctgtaaaatgtccaattgttcaagtgattaggaaaaggttataatttcttaaga

SEQ ID NO: 182460 - DNA, 427 bp, Homo sapiens
atgaacagaaacggattggcttgcagttctggaggctggcaagggccttcttcctgtgtgctcacgtggtgatggggtgaaggcatattcacccttttagaatgaactcactcctggaatcatgagcctgtcccttggtgacagcattaagctgttagtgagggcaaagccttcatggtcaagtcaccttctgaagatgccacctcctaattaggctgcgtgggcaagtgagtttcagcatttcaggagacagatgcccacaccatagcagtgacctcatctcattcagggtattggtgcttgtcagacactggctgtgactcgcatctgggtgcgtgtgcctctctctgtgggggccaccctgccgtcaggcgccaggaaaccgacgtcagggaatgtgggggtctccctgagagggtgccgacct

SEQ ID NO: 182461 - DNA, 449 bp, Homo sapiens
gtatggggacaagaggttcaattggcaggactcttggtaacacaaggaagggtggaaatgcagagggaacaagccatgactgtctgctctgcaaacataacttgtcacattaaaatcacccactctctgcctgggcgcggtggctcgtgcctgtaatcccagcactttgggaggccagggcaggtggatcacaaggtcaggagattgagaccatcctggccaacatggtggaacctcgtctctactgaagatacaaaggttggctgggcatggtggtgtgcgcctgcgatcccagctacttgggaggctgaggcggaagaatcgcttgaacccgggaggcggaggttgcggtgagccaagattgcactactgcattctagcctggtgacagagcaagactccatcgcaagaaaaaaaaaagaggcacctgaaagatgcttcgctatgac

SEQ ID NO: 182462 - DNA, 493 bp, Homo sapiens
tcgaactcattggcgtgggtgtggcatgctgtgctcctgactcgtccctgctcatctctggccaggcttggggcagtccggatcacttgagcccaggagttaaaagttggggcatcagaaattttagacacttaagctgatttctttgatgtatttaacaacatacatccagaaaagtggatcatttgggtgctgagggaacatctagaatctgctttagtcataatttttttttagatggaattattttgatctagaatattaacagtggagaaaaagctaatataaatgggatggttttgagacaggcaatgaaggttaaggaaaaacaatctgtagataagttagatttccaaggcatttgttgaaatgaatggctaaagtagcttgagatgaaggggtgatagatgggagaaaggaggaggttgctggaatgacaagtttttggtgaagtattactccttggtttattggcagtagaagggacataagg

SEQ ID NO: 182463 - DNA, 318 bp, Homo sapiens
tacaacaattgcttcaatctaggaggcagacgctgcagtgagcaaagatcatgccactgcactccagccgtgtgttgatttttgcatcctgaaacttagtttgtttattaaattaagagttttttggaagagtcttcaggattttctatacataagatcatatatcatcagcaaacagatacactgatatcctatttcccttttctttctctctcttgcttgattgctgtggcctccaggatatatagtagtatgttgaatagaagtggtgaaagtgggcatctttgttttgttcaagttcttagaggggattctttc

SEQ ID NO: 182464 - DNA, 505 bp, Homo sapiens
gaccaggacctgcccgacgcccccggtccgccgggcgaacgggtcgtcactttctgtgatcagtttgggaaaaggcttgggggccctgccacgggccagtgtgggaacccagggttcgaattcccgccccgacgctgcttccggaccgaaagccccctgaacgccttgccccaagtgccctgggccttggtttctccatcagtgaaacaatgatgggaatcgcttgacgtgaagtgagtggaggtgctggcacacttcgagtgattgctaaggggaagcctttggtactagttaggataattattttaattacagtatagttagggtaatgaattccaaataccagtgtagcatcatgtgctttatatacaataggtaatcgataagtaataaatattaaatttatataacagaaacaatggataaatttatgtgcatacaaaatatatttacctaatacatttagaagtatataatatataataaacatgtaaaaaagtacaat

SEQ ID NO: 182465 - DNA, 346 bp, Homo sapiens
aaaatgagatcaatcacccaggccctaaagaatcaatgcagtctctggggttggtgtattcattggggtaatagcccttcagtaggatagttaattacagccttatatgggtcagtttctttcagaatagtttatagtctctactgcatggaagcagaaccccggaaaaaccttggtcatttgcctgagtctttatttttcgagctcccatgtaattgaatgcagtgaaatatctttctatgttttaatgctagttaccagctgagctaaggcgaggcccagcgtaaactgatgccctctgtgataaacgcaggtggggaaataggctttgttttgatttctctgt

SEQ ID NO: 182466 - DNA, 729 bp, Homo sapiens
cctccagacctgccaggtgttccctggggggcaaaatcaccccccagttgagaactgctttagtacctcagaagcagggagtacaagacagacttttcgctaattggaagttgaagtctaaataaagttacatgatatatatgcaagagctttcaaaaaattaaaatgccctatgtgaaggaactattaagaagtctaatacctgttttttgtgttttgttttgttttaccatggccttctaccattctgattattcagaacttattgaaatgttaagatctaggtttttgtcctccctggctcttcttttctttccctatacaatatattaggagataatcagaaaagttaagttaatcaatgcattagagagggaggaggagagaggatgaagaaatgaggcatgacaggggaaatgcctgtccttcctatctcatctcagtgaaacaacacttttcatttccacccacacattttttgctcccaatgatagcaaaaggttttgttgttggtattgtttttagagagagagggtcttactctgtcacccaggctggagtgcagtggcacaagcatagctaactgcagcttcgaactcctggacttaagagatcctcctgcctcagcttcccaaagtgctgggactataggcgtgagccaccacaccactttagaaaaagtcttgattccatatttacattcctttgatttcaatatttactcaacaa

SEQ ID NO: 182467 - DNA, 493 bp, Homo sapiens
ctgcattagacttgttaggctggtctaaacagctgttagtctagatttttcttttcttttcttttctttttgcctctggttccagttcttgtgatagaattaatttgatcccattactgtggactctattcaatgcctgtcatgttaagaggtatttccatacagactggtctaaatgctgattgcatttagaccctgaaaagtactttaaggaaagataaagaggtactggtttagaccatttatagataaatatgcatggctaaaacccctgaatgtaatccttccaggcagaagataaaacctgaaatctaacgtataaattgtcatgggtacaatattataaaagagaccataagttaccgagaacatgactggaattcaggaaatgctaaaggtcctgtcttatctctgtaactcatttacaaagaaatcatgtatgattttctcaactgcaatcttttttgtttctgaattagactgacaaaaatta

SEQ ID NO: 182468 - DNA, 227 bp, Homo sapiens
gggtgaatgaatacatgaatgagtattgaatacatgaatgagtatgaattcagtcataaatgtctaaagacaaaatgactctgtagacatgagaatttcaattgaaacatacgcttttccatagactgtaacagcagtaacttaaaacaactcatgagcagagtaattttctaatattaacctgtttgttttcacacttttgctacatgaatggtactgcagaattg

SEQ ID NO: 182469 - DNA, 194 bp, Homo sapiens
gaaaaaagaaaagctaacccagacgagaaggacgttcaagggaggttgtcagagaaaatagtagctatataaacaaggaaagtacattagccaagaagaatggagcaaggtatgctggccaagtgaaacaacctgtgcaaaagctactgtcagaaaaagtgtagtacattgagggtctgagagtgtaagtgtgg

SEQ ID NO: 182470 - DNA, 282 bp, Homo sapiens
gggagctagccctagaaaggtgagttggggaggtgggagatgaaacacagcaggctgttggagttggctggtaccagcttgcaagagccagttgctagattttcctattgtttaaatattgtcatcattaaatgttaagttgtagaatgataaaaatttactaatgtaatatcaattatttatattaatctcctagatgtatgcctgtaataaacatgttctgttgttttcctatgctgtttgttgtgataacatttattaaaacataattttatatctgta

SEQ ID NO: 182471 - DNA, 624 bp, Homo sapiens
agctttgaaggtacttacttcattttattgcttattgttgaagttgaatcatgtgttatttttaggggtttttttttgttattagtttttcagaggacagagtctgactctgtcacccaggctggagtacagtggttccatcatagcttactgcagcctcaaactcctgtgctcaagagatcctcccacttaagccttctgagtaactgggactgcaggcatacctggccaattttttaaaaacaattttgtagagacagggtctcactgtgttgctcaggctagtctcaaaactcttatcctcaacctatcctccctctgtggcctcccaaagtgctgggattacagacatgagccaccacacccagcctatttttagttatgctctttgtagtgttcttgggtttaccatctttaacaattaatttaacttagcacattacaatacctcatataagttatgtttcatctttgctgatatatcaatgtaagatggtaactaaattagacctcataatcagtagctagttcttccaccaccagaccatactaattatgctgtgacactgtcagaagtgcatgatgatgtccacactgtacctgtttttaatcatttcctcactt

SEQ ID NO: 182472 - DNA, 556 bp, Homo sapiens
cgggcacctgtagtcccagttactggggaggctgaggcaggagaatggcgtgaacccgggaggccgagcttgtagtgagccaagatcgtgccactgcactccagcctgggcgacagagcaagactctgtctcaaaaaaaaaaaaaaaatagtttccatatttgatcagtgtttgcttccaattagctgtttgatcaattttcttttctttttttttttttttttttagtatttattgatcattcttgggtgtttcttggagagggggatgtggcagggtcataggataatagtggagagaaggtcagcagataaacacgtgaacaaaggtctctggttttcctaggcagaggtccctgtggccttccgcagtgtttgtgtccctgggtacttgagattagggagtggtgatgactcttaatgagcatgctgccttcaagcatctgtttaacaaagcacatcttgcaccgcccttaatccatttaaccctgagttgacacagcacatgtttcagagagcagggggttgggagtaaggttatagattaacagcatccc

SEQ ID NO: 182473 - DNA, 476 bp, Homo sapiens
gtagagacaaaaataaactgtgttgctcaggccagtctcaaactcctgagcttaagtgatccttctgcctcgacttcccaaagtgttgggattacagaacagagggaatttcctggaaggcagggtctgtgttcatctcccacagagcatagagcacagtggatgctgaggaaatggtgaatgctggaaaggagcaacagaaggagctccagttctccctgagaagtgtccccattggggaagtgacccaaagtctcatgtgtctctgggagataaatcaagatcaaggctagggccttgggactcagcctagccctgtgaacaatatctcacctggactttcaaaagatggggtgaaggtggaccacaccgggtgttctcagtggcttcccagggcagctgcctcaattagaggatttgctagtacgtagcagagtgtgcaataaatcttattgtttcattaggagcactgtgtt

SEQ ID NO: 182474 - DNA, 126 bp, Homo sapiens
tggttttcataatcagttaactttcaattacttgtgcttgtatgcttagatagggggacagttgtgtttgtaatccaaactcacatgtgttgcttgaagtacattctgtagtttgtctttgtgttg

SEQ ID NO: 182475 - DNA, 543 bp, Homo sapiens
ctttaaaataataatttatcagtaattttaacatagtaatatacattagcaactcctgaaggggtcagatgtgtgtattttctgaacatattgattagaaaatatatgatgtgttttttctttggttactttgccagttttagatgatttctatttttttgcatgcctgcgtgggcacatttgtgtgtgtgttctccactaatctcagaagcaagtgattatgtaaagtaaaaatagatctggcatttgattctgcaaataagtgtaagagacattattttaattcacaccttgcatcgtgtatgggcagccaactcaccagtcatcatgattaacaactgtgttattaccaaaagagaacaataatataaaatattctccacttattgtgtgcctaccatgaggcaagctctgtgctgggctctatgaaaacatgattcatgaacctaataccaactttcccaatgcctccatattgtaattggttaaaatccacaattatagctgtaaataagctgtaaataacagccttggccacgtact

SEQ ID NO: 182476 - DNA, 1101 bp, Homo sapiens
aggagatgaggccttgggcccacagaaagcagggagctgaaactgagacctctatttaaagctgggatccttacaggactactccttaagacaaaggcaggttagaacaaacccactcactggcaaaggaggaagacaaagacagttgtctccttggccagcactttcaatgagaagaaaaaagaattccttaggaaatcaataaccaataggcctgcccacattgaatgtgcaattcaaatttacattgtctaaatgatccaagaagtaagcaatgaaattaacatgaaagaggccctgggcagaaaaaacctttagggtacctgacagaaataaaatgcaaaatcactgtagagcaactcttcttcagtatagcctcatgggaatctcaagaaaaaactccaatgaaggtgagttcacaatccacaattataaagcacatgagcaaacaattcactatgagattcacatacaaaaaaacagcacaataggtcatccttttgatcatccttttaatccttatagaaacactaataaaatagaattcaatagatatttctttaacatgtttactaattacagaatattactaaagacagtacatttgggaagtagatattttctctttattcttacaggggcacaagtcctcctatattcccatcaatactgtcaggaagaaggggatcaggtggccacggatggaaaggcacatgacacagagcacaggatgtccaccagcagtctatagctgtgattgttttggcttgcagaatattttcaaaaaatttgagccaatattttaaaatcaggtgattttacataatatccagattccaggcttctcgtgaaaaatggtagggattattgctattgggcccacactgtgcaaagcaataatcaaatagagctgaggagtgtggctacactcttcagagaaaacaccctgacctatagagcctaccaatcctattcctgccaccactcagccggccttattaagtaaggttacatatctggcccctgtaaatactgcatttgtgatacagagaaaagggccaggcatcagtaccctgattcaactctatggttagtaatgga

SEQ ID NO: 182477 - DNA, 379 bp, Homo sapiens
gtgttctacattcctatcatcacctgattgattggaatgatattgctatataataaggatttcgaacatacataagcattctgaggaaacatgaggttagattgaactgcagtggatgctctaccacagttcaagggcaagattattacagttgccttgacaaccatagctctgcactctctgttttattacatactcttttcctatttgggaatccttttgagaagaaacaaaagaaagaatgtcagtaaggtctcattttcaatttatgaggcttctggaaataatagagtcttatatagctacaaaaacgtctccatttcttaaaatttccccaaacattggaaagtccaggcatatgaaatgaactgaaatgagc

SEQ ID NO: 182478 - DNA, 274 bp, Homo sapiens
ctgcaatacactattaattccccacaacaatgatgctcttttactgaaacaaacctgaagttcagacaggtcaggcttccatcaagacttgtgtatttgagccagcatttgaattcaggcctgactcaaaagcctgtgatttctctgacatcccaagaataaaacttgattattaaagcatgaataataaaaataatttcatatggtatgaaattattttaatatatgtatatagcttacttctgaaaagttgattcaggatgtagttacctat

SEQ ID NO: 182479 - DNA, 203 bp, Homo sapiens
tgaatttggttgcaataatacagaaatgcaagcacactgagaaaagataatacataactaaggctaaaaatgaatggtgtgatagaacttcacttgcttcctggctgatttcagagaaccttatttgcagagcacagttggatctataaatatattatgaatgtaaattaaaatgacaggagatattatctcaccccagttaa

SEQ ID NO: 182480 - DNA, 224 bp, Homo sapiens
atggaagccaagtgaacaagcctcagtgacacaagtcaaattcatagtttcactctgggttttttgttgttgtgtggttattattctcactacagaaagactgagtttcatgctcctggctatgtcagatgtgaattttcatgggaataataatcaaccttgcagcaagccaaagcaatgcctcgcttgggttcttcatgttcttactacccagcgttttttac

SEQ ID NO: 182481 - DNA, 493 bp, Homo sapiens
acaaatttgtaaactttcttaaaacattatgagattctttttttttgcaattttttaaaagctcatcagctatcgttagtgttaatgtattccaagacaattcttcttcttccattgtagcccttgccaaaagatttagagcattaagagatccaaaaagtaggtattgctagtgcaatctggagtttttcgtcagttctacagacgtgtgagtgatgtgaacccaaatggggcaccttccttaaagaattaacatactatcaaaaagggaaaaacttatatgtccacaatctgccctatgatacttccttttaacctcatttttattaattgccactcccctcttgacccatactattctaaaacatacagtgcagaaacaaactgtaatgattagggaaatagaagttaaaaaaatgcaggaattttaagtacacaggtatcaaggaaaagagagactaaatggactgaagaaatattttatttttatttt

SEQ ID NO: 182482 - DNA, 388 bp, Homo sapiens
actttttagactcctgggttccatttctcatttgatttttcattttgttatctcagcaccatcaggcccatcaaagagagtaatgcagcaattagcccagggagtcactcactgagaggggactttttcatctacaggggcttctcctttctgctgccactaccacagcccagcgagaagggccttcctttctattcaagactctctatctcatacctctggcaccacctccccttctcacctttccccagagcttttgcctcagcctggggagtctgaacatttgcaagggcatggatgaccttacaacatctcctcttctattggcttattttaaattttgtgttgctatttaccttttcaccagtataacaaccttaaagattca

SEQ ID NO: 182483 - DNA, 615 bp, Homo sapiens
tgagggaggggcttccaaaggcagtgaaagccatatgaatgctaggggtaaaggaagacaccagaggggacacctgcccacctgcctgtacaaatcccaggcaaagcgagcacttctccagggaaggcaacatatcctcaggccaaaacccggaaatgccttgtttagaggaaagggaaaagggtgggtcgcctggtggtggaacttgcctgaagctagtttgacgtggagagaaatagtgggagtttgagtggatggagacacattgtatatgcagtcagcagcctgttgtcaaggtggggtaaggagagagactgcactatgagcagccggcaggagctggcctctgcaaaggaaaggaactaagtgaatgctgaaacagcccccatccccagtgtctcacctcatatgaccttgtgaacagagagggggtctgccaacctccagtgaggccccagccctcatccccaaaccttcagtgaataacttttctcaaggagtaagttcttatttgttcacagtcaggaggcaccactgtaaaacatcccttctgagttaaaggcttcagatatgcaggccaggcgtggtggctcacgcctgtaatcccagcacttt

SEQ ID NO: 182484 - DNA, 184 bp, Homo sapiens
agggtcagtgaccatgtgcagcgagcccgtttaacatcccaacaggcgatcttgagctgagcggctggtaacccagctctggcctagggcactgagagattgaacaaacagaggatgtgttttgctagcctgaaaaacgccacccgtttgcataacctgaagagtcattgagtggagaatcagg

SEQ ID NO: 182485 - DNA, 245 bp, Homo sapiens
acatttcaacagaatgtcttaattctagcaaataaggactatattgtgtatttgagtaaagcaaacacatatttgtaatatcgtcaacaaatacagttattactattttttattgtttttcatgaacttgtcctaaaatatctttaccctttgaccattaatattgctatttcaggcacataatgtagtctctaaaaagcagtgttttttttttttttttttttttttcctactcttacttgaaa

SEQ ID NO: 182486 - DNA, 1114 bp, Homo sapiens
  misc_feature (723)..(723): n is a, c, g, or t
  misc_feature (841)..(843): n is a, c, g, or t
  misc_feature (870)..(871): n is a, c, g, or t
  misc_feature (1028)..(1028): n is a, c, g, or t
  misc_feature (1101)..(1101): n is a, c, g, or t
  misc_feature (1105)..(1105): n is a, c, g, or t
  misc_feature (1109)..(1109): n is a, c, g, or t
  misc_feature (1111)..(1111): n is a, c, g, or t
catgttattctttgactttttagtaatagccattccgactggtgtgaggtggtatcccattgtggttttgatttgcatttcactcatgatttgtgacggtgagcatttgttcatacgtttgttggatgcttgtatgtctgttaacggctttttgagaaacgtctgttaacggctttgcccacttttcaatggggttgttttttgcttgttaatttgtttaagttctttgcagatcctagatagtagaccattgttggatgcataatctgcaaatatttctccaattctgtaggttgtctgtttactctgttgatagtttctttttctgtgcagaagctctttagtttaattaggccccaattgtcaattttcctttttttttttttttaggtggagggggcctcaaacagcactatctctcttggaaatgacaaaagtgaaaacaggaagcttccaagtgccccagtggactcccagggctcccagatcccccagtgcaatgcccaccagagaaaacagcaggtatccaaaatcaacaagtacttatgcggcacctgttgtgtgtcaagcatggcaagagtccctgggacagctacaaaagctccatgacactcaacaccactgagcctcagcccagcctggaccaaacatcactaagtgatcacagaggttcttcctcaagggcctggtgacctcaggggtctttgctacagtgcccaggcngcacaacccatttgcaattcctctaacggggaggcttggaaagggtctccccagagtggacaagtggagaggcagcacctggaactgggaggccgccgaaggaaaggtggcctggatnnnctgcaggagagccaaggccaagtctcnnatctgccaccagcttttgtggggcttgggacagggcatggccctctctgggcctcactgtccccatctgcgaatgaggtgattggaccagtgtccccacggcccctcccaggcctcaagtcttggcacatgggtcaccagagagctctcagaaggtngggccaggcactgccaggagcagcccgagaagccaccaaggcctggactgggccaggctgggcagactgcagncctncccngncgg

SEQ ID NO: 182487 - DNA, 635 bp, Homo sapiens
cagtcttggctggatctccacggtgtccaagggtgctgaaggaccccaaaagctcaggagaaatggggaggggctagacaaggtgctgtcctgggcttctttttcaaaatgggcaaaaagtatggctctgaaaatttggaggtttaaaagtttaccatatctagaaatacatgggaaaaaagtcactattcatttgtgaaattaggccccaggaaagcaatcagcagtgtgactctgaaagtaacaatatctcatcaatttaatctcttcctgcaatagaatgactacactggcaaactgaggtagagatcaaagtaatgatcttgattttagtacagatcccagttcttttctgcacgatgcattcaccaatgggctgatgaagtaaaatctacactgtgtagctcttagatgggcgtgcaattggctgccagtttgaaatgaaaccaagaaggaaattaatggtgggccagagggattagttgtgggaaatccatttctcccaacaacaacaacaacaacaaaaatctttatcagtaacttcaatgatagaatagataaaatgctcataggtctacaggtgatatcagctgctgctagtaggagaatggaaatcaaagcaaattttcttaaga

SEQ ID NO: 182488 - DNA, 250 bp, Homo sapiens
cagtcttggctggatctccacggtgtccaagggtgctgaaggaccccaaaagctcaggagaaatggggaggggctagacaaggtgctgtcctgggcttctttttcaaaatgggcaaaaagtatggctctgaaaatttggaggtttaaaagtttaccatatctagaaatacatgggaaaaaagtcactattcatttgtgaaattaggccccagacagaaccacacgccagcacaagaagggatcctgtaga

SEQ ID NO: 182489 - DNA, 282 bp, Homo sapiens
cattaagtccgagagaaattaggatatcagagacagtgctcaaaataggaagatgatatttatctagagaagggcttcatctattgcagagcagctaaagtagaagattatttgaaatgccgccttcaacatcataatcaatatttaatagcaatctctgaatgtctaaaatgacaggccttcaagttcttatttcaaatacctcttcctctccaaaatatttttcaaattgccaagtaggaaataatatttcccttttctaatttctctcgaccaatgctt

SEQ ID NO: 182490 - DNA, 686 bp, Homo sapiens
tacccatggtcataaacatggtctcactgcaattctgggaaatacaaaatttttaaatgaagtatttttatggtggtccaaccccccatcatctgtttgtctgaattactgcaatagcctcttaactagtctccctgcttccttcatcgcttccttatagtctgttctcaacacaacagccagggtgattcttacaaaacagtcaaatcatgccatttctctgaatcaaatcctccaatagcttttcatgtcacttcaagccaaagttatgacaacggtgccacatgcatcctctgcacaccatgacctttttcacctcattacctactactcttttccagttcttgacacatactaagttctcaataaatattggtagaattcataaataaattttatccccattcatttcgggtaaaaagtattgaaaatgttggcattgatatggggaagctcccatacactgctggtagcagtgtaaatttgtacaaacctttacaatttataaatacttgaggatgagcagatccttcccctaggcaatgctccttctaagtatacactctagagaggttattttatgtgtgcataaagagactgtaggaaaatacttattatagccttgcttttaatggtagatgggaggaaggaaacaaagaatgaatgaatgaagaaatggtcagagg

SEQ ID NO: 182491 - DNA, 518 bp, Homo sapiens
agcatccttgttaagctaaaggagcagcaggaggagaagagtaagggtagaggggaagagtaggtagcagtcatgaggtttctgcaagagtcctggagagagatgatggtaatgaaattgatgaactttatgtctttctttgttatatcctgttctttgactaaaagtaataaaaataggtaatacttctatagctcttaatgtgcatcaggcactattttaagtgctttacatatattagtcatcagatctttccaagaaagtatacctagcctcagaaaatgaagatttgtcactctttaggatatacagtggaatgtgctgctggttcagagagcactttctcaagcagtactgaaatcagcagtgaattcactgcctctgttcacatactggttaggttgcaaaggcaagcctaaagtgtcgataacagaccacccaaccagtatgtatgcattgggttaagttcagtttcatggaagaactgtagaaggccatggcattttttattactcttc

SEQ ID NO: 182492 - DNA, 381 bp, Homo sapiens
tgctactgctgtactcccaggaccaagcttgacagtaggtatttgtaatagtaagtctgtctcagtgaatgaatgcaaagcacttagtaggtgcttattaaatgggagcccctgttattcaaaatcctagggagctagcaagaaaccctggcctcctgactcctgccccacccgcatggcttctccccatccctgcaccgcagccccaacctttttttttttttttttttgagatagagtctcactctgtcacccaggctggagtgcagtggcacaatcttggctcactgcaacgtctgcctcctgggttcaagtgattctcccacctcagccttccgagtggctgggattacaggcacacgccaccacaccagctaattt

SEQ ID NO: 182493 - DNA, 510 bp, Homo sapiens
atgaagactgtttcaagttcgaggatgggcaaaaataatgactaggacttggctcaagattcctcaaacagccaataaacaatgcaaagaataaatgagagagtaattggagacaagctttcccttggcttcccttcttttctcacagaggcttttccagaaggtggtcatttccatagcccatgtggaatgagatgtccactagggcagagaagcacagaaccgtgggcactgcttcccttcctttaaccctatcatattgctgcccagtgagcaatatggtcattggtcaagaaggcttatgcccaggtatccctgtggctatgagcattgctccttatctatgcctctgctcttagacttttccattctgccctcttaggggccttcctggccatgaccacactaccttatttttctctatagtacttatcaccatctgacatgtatttatgtttgtatttgtttattgtctgtctctacaaataaaatgtaaattccctaaaaaca

SEQ ID NO: 182494 - DNA, 228 bp, Homo sapiens
attggtgctgaaaattagtaaggctcttaagtaacataaaagaaaactcagtggcaactggatcggacagctcaaattgggaaactttaaactagatgtttatttagggcatgccatgcaccaccgacgtcactaggttctgtggttactctaaacgtaactacaccaggtgtacaagcctgcacatttgatctctgctgtctcttccctaatttctcttgtcttctc

SEQ ID NO: 182495 - DNA, 362 bp, Homo sapiens
tggcggggagaagaccggtgcaaacgctttcgactttgctgttcgccaaagcgatgcaaaatctcgcaccgaaaatgctaaacgttgaccacatgctttaattaggttagcattgtggccagagccaggaaatttaaatttaacgctgatacaccgtcattcatttgcgccgcagcgttgcaaatgagaagggcatagccagaactgtaagttctggtcgatgggtttaaaccagcttcaagtttgagagttaccaatttggatctttagacatgttttgtatgtctccatgtaacttcttttgacgtatttcaaagtagacttcctgggagtacagaagtttggaaggctttctgttcttc

SEQ ID NO: 182496 - DNA, 403 bp, Homo sapiens
tctcatgaagagggtgcattcttcacttggaggatggaaaataacaaacctacttcctgacgctttcagccttgggctgactgcagtgacagcatcacactgcacacagagcagaggtggggcacatgtggaaaagtagcagagcctttctggcctgaaaaccagaaaagagaagttgagaatccataaactctgaaaatagtggaggaatcccagaagagaaagagtcagagaaaggaatccttaaactctgccagtccacatctttgactaaaccttgaaccacacatctgcagaacaaactttaaacagcctggctaaaaacaaaagatcaaaatacagagttttcagttctagcccagacaagaatctctacagctcccctctcccctctcccctctcc

SEQ ID NO: 182497 - DNA, 209 bp, Homo sapiens
gcgtatagagtggcatgtgagaaggaaagtaacagagactaaagtgttcctacattttccacccttctttcataccattcttccccgcaaagagacttttgatctaactagacaatgttgagacattttctcaatgatctacactttttttttttttttttttttttgaaaaagaatattcccctttgtgccccaaagggaaggcaaag

SEQ ID NO: 182498 - DNA, 188 bp, Homo sapiens
ctgggcccaaacccagatgttgtgattcctagtctgttagacattctgttccatcacagcccctctcccaccctagtaatcctggattcacaaacctctccgcctgaccaggatacctgtggaatacttttgagagctgcatttggaaccttcttgcccacggtatctccatgtcagtccctcatcct

SEQ ID NO: 182499 - DNA, 509 bp, Homo sapiens
ccgcgggaactgcaaagagatgtgattgagagtggtgacctctggggtggcaggacccagttttaatgtcatacaaatgattgtttaaaaggaatgagaaaaaagttttattgaccagcagcaaaatttgttcaaaggagcaacatgacaattacatatcccagtggcttctagctgtttagttttagaaatcttaggcaaagaagcacttcagtgatgggaaaatactaactgtaattgcagatattttattacctgaatgttaaatgtagcctgtaactgttttaaatcttcctaaacttgcccttatataggagaaggggggaggattgctcaatgctggtataaacttgattgcctttctctttaagatcttagatttttttgagttaaaaaaaagtgaacttctgtggggttctccgcaaagacttaagatccctggaataatctagagcttactctatttaatacagtagttaaactcttatgcaaaaatttcactttttcca

SEQ ID NO: 182500 - DNA, 192 bp, Homo sapiens
ggattctagatgccattaagaacattcatgagaggaggtaaaagtatcagcatgaacaggagtttgaaagaagttaactccaactctcatggatgaccttgagggcgttcaagacttcagtggaggaaatcactacaaatatggtgaaaatagcaagacaattggagttagaaacagagtctgaagagttga

SEQ ID NO: 182501 - DNA, 224 bp, Homo sapiens
ctggaggactgcttcaggccaggagtttgagaccagcctgggcaacacagcaagacttcatcctacaaaaacttttaaaagttggtcaggcatggtggcatatacctgtagtctcaactagttgggaggcggcagaggctgcagtgggccatgattgtgccactgaattccagcctgggcaagaaggagtgagaccctgtcaagaaagaaagagaaatgcagaa

SEQ ID NO: 182502 - DNA, 633 bp, Homo sapiens
acagacacttttcaaactcatccccccaagagttcagaggctagagttttttaactactactttggcaggcagggggctggagaactgaaacaacggattggctggggatgaaattgcaggggtgtctaaaaccattttcacacagccaggtcatttcctgggaagcggtctcaggacgaagtggcatctcttggtctcctgaaatgctaaatctgaaaaatgtctcaaagaccagttcttcaggttttacaatagtaatattacctacaggagaagttggagaagctctaaatcttgcgaccccagatacaagactctggggcagtaagcaacttatataacaaaaacaagctaagtaatggcgggtcattgttcaactatgtctattcttcagcaaagttcaagcccctaccataattttaactttgttttatgaatgtggttttaactgtaaactaaattcctcttatagttatcttggcccccacattagaatggacaaaaaaacaatttaacttgagaggttggaagcaagatggagtcaaccatattagacttctctcattacttatagttctgcaaaggtggtttcatattcatgaattataagactcaacattaagatgtcaatt

SEQ ID NO: 182503 - DNA, 634 bp, Homo sapiens
tcacaaagtcaggagatcgagaccatcctggctaacacggtgaaaccccatctctactaaaaatacaaaaaaaaaaaaaaattagccaggcgtggtggtgggcgactgtagtcccagctactcgggaggctgtggcaggagaatggtgtgaacccaggaggcagagctggcagtgagccgagatcgcgccaatgcactccagcctgggcaacagaacgagactctgtctcaaaaaaaaaaaaaaaaaaaagaaataaaagaaaagaaaagaaaatgtgtgtcttgctcttattctgcagtctctgccatggctttctgcagtcttgtttcataaaaacaaaatgtcttgtgatcactactgaataatctcctgaagcacaatatttattaatctcttgagcacatattaattatgcattaaatactaactatataagcaagtgaagctgaccatctcgaaccatagaaattacactgagtttcctatgaacctaggaataaataactcatattggagatggaaaagatatggaaaaaaggaattcaggctgggcgcagtggctcacgcttgtaatcccagcactttgggaggccgaggcgggcagatcactttagctcaggacttcaagaccag

SEQ ID NO: 182504 - DNA, 103 bp, Homo sapiens
catttgggtcgagctgacagagctgtcatggacacagcaggttaccctgtactcgggaatgcttcatgaagcttcccactcactgccgtcagtccaaggctgg

SEQ ID NO: 182505 - DNA, 388 bp, Homo sapiens
agaatgtgaaccaaagcagtccatgacatgggcctctgttcaaactattattgggagacttccattccagcaaatctctggtttggaactgatagctgcaagagctggaatgctgaccatgaagtctgtcagcaacaggtcagggaccacaacaaaccacgcatggaatttcagcttacccaccctgcagtgctgtagcaaagcctcgggaagcagggcgactctttccaggaaggcagtacttacttctctgttctagaaaatgcccagcattcccctcgtgtttggacacaccacacttgcacctatgagtagcctgggcttcaaagaatattgaccctagggaggacaatgaaggatgaactgcttgggctgttcattctcagat

SEQ ID NO: 182506 - DNA, 187 bp, Homo sapiens
taactgaattagaacttagcttctagagtcagactgcctttattccactttcagtttggctactccagctgtgtgccctctctcctttgagtatgataggtgtgataatttaatactcaaagggctatttgagtattaaataagataatataactaaagaggctattataatgcctgatacattagt

SEQ ID NO: 182507 - DNA, 187 bp, Homo sapiens
taggcaccctcattgcccacttaaatccagcatcttcctcatctcttgtcccagtgaacagtaccccccgaccctgcactgtttggtctgtgcctgccctcactccatcctgggtagggtccctcctgtggccccagtggagttggatgggagcaggcctgtggccagtgtcctgttaagcccttag

SEQ ID NO: 182508 - DNA, 1601 bp, Homo sapiens
gagaatttagactctgtcttcagccaggcactccctccctccctcccagcactatgccctacaacttctgcctgcccagcctgagctgccgcaccagctgctcctcccggccctgcgtgccccccagctgccacagctgcaccctgcccggggcctgcaacatccccgccaatgtgagcaactgcaactggttctgcgagggctccttcaatggtagcgagaaggagactatgcagttcctgaacgaccgcctggccagctacctggagaaagtgcgtcagctggagcgggacaacgcggagctggagaacctcatccgggagcggtctcagcagcaggagcccttgctgtgccccagttaccagtcctattttaagaccattgaggagctccagcagaagatcctgtgtaccaagtctgagaatgccaggcttgtggtgcagatcgacaacgccaagctggctgcggatgatttcagaaccaagtaccagaccgagctgtccctgcggcagctggtggagtcggacatcaacggtctgcgcaggatcctggatgagctgaccctgtgcaagtccgacctggaggcccaggtggagtccctgaaggaggagctgctctgcctcaagagcaaccatgagcaggaggtcaataccctgcgctgccagcttggagaccgcctcaatgtggaggtggatgctgctcccactgtggacctgaatcgggtgctgaacgagaccaggagtcagtatgaggccctggtggaaaccaaccgcagggaagtggagcaatggttcaccacgcagaccgaggagctgaacaagcaggtggtatccagctcagagcagctgcagtcctaccaggcggagatcatcgagctgagacgcacagtcaacgccctggagatcgagctgcaggcccagcacaacctgcgagactctctggaaaacacgctgacagagagtgaggcccgctacagctcccagctgtcccaggtgcagagcctgatcaccaacgtggagtcccagctggcggagatccgcagtgacctggagcggcagaaccaggagtaccaggtgctgctggatgtgcgtgcccggctggagtgtgagatcaacacataccggagcctgctggagagcgaggactgcaatctgcccagcaatccctgtgccacgaccaacgcgtgcagcaagcccatcggaccctgtctctccaatccctgtacctcttgtgtccctcctgccccctgcacaccctgtgccccacgcccccgctgtgggccctgcaattccttcgtgcgctagaacctagggaatgccagaggagcaaggatgcagggcccaggactccagagctgtgacctggctctggttcaacaaaaggggcctgaaaacatcatttgcatggctggagttgcccgcgtaaggcagccaagaaactcacccaaagcctgtagcctccccaactactccagactgtcctgctcaccctttccttcctgggggtctgttccttcctatgctcacccagagaactctctgatgtgccagtggccctcccttttaacctcctaataaatatcatttccttggcaaagcaga

SEQ ID NO: 182509 - DNA, 1214 bp, Homo sapiens
cttgcttcctcttttatttcaaaatggcttaagtcatttttaaaaaagttgatgatttcatatttattttcagtcctcactaagccacctctcactccccagatcctgtgtaccaagtctgagaatgccaggcttgtggtgcagatcgacaacgccaagctggctgcggatgatttcagaaccaagtaccagaccgagctgtccctgcggcagctggtggagtcggacatcaacggtctgcgcaggatcctggatgagctgaccctgtgcaagtccgacctggaggcccaggtggagtccctgaaggaggagctgctctgcctcaagagcaaccatgagcaggaggtcaataccctgcgctgccagcttggagaccgcctcaatgtggaggtggatgctgctcccactgtggacctgaatcgggtgctgaacgagaccaggagtcagtatgaggccctggtggaaaccaaccgcagggaagtggagcaatggttcaccacgcagaccgaggagctgaacaagcaggtggtatccagctcagagcagctgcagtcctaccaggcggagatcatcgagctgagacgcacagtcaacgccctggagatcgagctgcaggcccagcacaacctgcgagactctctggaaaacacgctgacagagagtgaggcccgctacagctcccagctgtcccaggtgcagagcctgatcaccaacgtggagtcccagctggcggagatccgcagtgacctggagcggcagaaccaggagtaccaggtgctgctggatgtgcgtgcccggctggagtgtgagatcaacacataccggagcctgctggagagcgaggactgcaatctgcccagcaatccctgtgccacgaccaacgcgtgcagcaagcccatcggaccctgtctctccaatccctgtacctcttgtgtccctcctgccccctgcacaccctgtgccccacgcccccgctgtgggccctgcaattccttcgtgcgctagaacctagggaatgccagaggagcaaggatgcagggcccaggactccagagctgtgacctggctctggttcaacaaaaggggcctgaaaacatcatttgcatggctggagttgcccgcgtaaggcagccaagaaactcacccaaagcctgtagcctccccaactactccagactgtcctgcgaacctatgagggatcctctagacgacct

SEQ ID NO: 182510 - DNA, 1302 bp, Homo sapiens
cttgcttcctcttttatttcaaaatggcttaagtcatttttaaaaaagttgatgatttcatatttattttcagtcctcactaagccacctctcactccccagatcctgtgtaccaagtctgagaatgccaggcttgtggtgcagatcgacaacgccaagctggctgcggatgatttcagaaccaagtaccagaccgagctgtccctgcggcagctggtggagtcggacatcaacggtctgcgcaggatcctggatgagctgaccctgtgcaagtccgacctggaggcccaggtggagtccctgaaggaggagctgctctgcctcaagagcaaccatgagcaggaggtcaataccctgcgctgccagcttggagaccgcctcaatgtggaggtggatgctgctcccactgtggacctgaatcgggtgctgaacgagaccaggagtcagtatgaggccctggtggaaaccaaccgcagggaagtggagcaatggttcaccacgcagaccgaggagctgaacaagcaggtggtatccagctcagagcagctgcagtcctaccaggcggagatcatcgagctgagacgcacagtcaacgccctggagatcgagctgcaggcccagcacaacctgcgagactctctggaaaacacgctgacagagagtgaggcccgctacagctcccagctgtcccaggtgcagagcctgatcaccaacgtggagtcccagctggcggagatccgcagtgacctggagcggcagaaccaggagtaccaggtgctgctggatgtgcgtgcccggctggagtgtgagatcaacacataccggagcctgctggagagcgaggactgcaatctgcccagcaatccctgtgccacgaccaacgcgtgcagcaagcccatcggaccctgtctctccaatccctgtacctcttgtgtccctcctgccccctgcacaccctgtgccccacgcccccgctgtgggccctgcaattccttcgtgcgctagaacctagggaatgccagaggagcaaggatgcagggcccaggactccagagctgtgacctggctctggttcaacaaaaggggcctgaaaacatcatttgcatggctggagttgcccgcgtaaggcagccaagaaactcacccaaagcctgtagcctccccaactactccagactgtcctgctcaccctttccttcctgggggtctgttccttcctatgctcacccagagaactctctgatgtgccagtggccctcccttttaacctcctaataaatatcatttccttggcaaagcaga

SEQ ID NO: 182511 - DNA, 747 bp, Homo sapiens
gtaacatctaagtttcttccagtaagtggattttgtttttatcctacctgtgtcagaaagaaaaatggcccctaccccagatatccacatcaaattcataaaacctgtgaatgtgtcttgtaagatgaaaggtgtgattaggttaaaagtctgaggagagagctattttgggaggccgaagtgggcagatcacttcagtccagggatgtgagatcagcctgagaaatatggtgaaaccccatctctacaaaaattacagaagttagctggacatgacagctggcacctgtagacccaactactcaggaggctgaggtgggaggatcacttcaccctgggaggtggaggttgcaatgagccaagattgtgccattgcacttccggctgggtgacagagcaagattccatctcataaaagaaattaaaaaaaatgaaaaataaataaactaaacagaaagagctagatcctggagtatcctggattatcgaggtagatcctaaatggcatcacaagtgtgtttataaggtgaagggtgatttcatgcagacacacacagagaaggcaatgtgaagatggtgtcagagattggagcgatgaggctacaagcccaagaatgccagggcaaccactagaatctaaaaggagcaaaaaataaataaaaaacaaacaaacaaaaaatcagattcttccctggatccgctagagaggacctgggcatgctggatttcatggcctccagaactgta

SEQ ID NO: 182512 - DNA, 282 bp, Homo sapiens
atttcatatatcttcccatacattaaatacaaaatgttgttttgaatatttttgctaacactaatagatttcttgtgggaaagactgtactcaacattatattaattttgaaattgactaaatattgagagcaaatgacataactttatttgtatcttttggtgtgaatataaaaacagtttctgctttttaaaattagaattaatcagttctatcttaggtcattaaatacatttttaaatttaaaatatccttataagtttattttaagtttatttttgt

SEQ ID NO: 182513 - DNA, 425 bp, Homo sapiens
aacacaaccgggcttctgaggcactattcaaataaaacacagaattaatgaggagaaaatttcagagaaacaaagaacagaattagaagcaaaagctcagcagaatcacctgatttcacttggctttatcctctctggagggaagaagcagccttggagagatggcaaggtgtggctgtgttgctgtcaacttctactttgccctcttgaactgtctccttcatctttccattctccaccctcttctttcccccctctcttttcctctctctctctcttttgtttctgcaaccgccttttttcagtcttcttattttctttggctatgttttattgcccgctcataagctggcacacagacttatttgcttctgctatgttcttattatacattagctcaattaaagtaattgaagagaaaccat

SEQ ID NO: 182514 - DNA, 662 bp, Homo sapiens
ccttgggggctatgactcagcctaccacattcaccaaccccctattatgggccaagcattggacgacatatggttgcacagtggtaaaaaaactggatatgctctctgctctcaagaaatgtatggtctagtggaagagtcagatatcaatcccaaagtcatacaaataatcaccccaatacaatcattacaagttgagatgagggcactgaaagcctgggaaacatgggagtcccaagggtctctttgaggaagtagcatccaatctgaggttggcagggcagggtgataaggcacccctggatggggaatcagaagaagaccttccaggcagaggcatcagcaagtgcaaaggccctgaagaaaaagagtttgggggatgagggaggtggaaacggcaaaacaagatgaggctgtaaagatgagaaggaccagatcccttgggaacttctggagcatggtggggactttagcttttattcaaaacataacaggaagaggttgaagaggttttttgcttaataaaaaattttttgttggtttttgtttgtttgtttgtttgcttgtttttgagatagggtgtcactctgtagcccaggctggagtgcagtgacgtgatcacagatcacttcagctcctcctgtgctcaagtgatcctccca

SEQ ID NO: 182515 - DNA, 229 bp, Homo sapiens
gacctatgatcatgccactgccctccatcctgggtgatggagcaagacagaacaaaaaaccaaatcactttttattttatggatgtagcatattttgtttatctgttcacccattgatggacatttatattgtttccagaatttgactttctgaataaagctacgaacattcccatgcaagtctgtatggacataagttttcatttttgagggatagaaatctaggagt

SEQ ID NO: 182516 - DNA, 253 bp, Homo sapiens
ccttatacaaaatcagtggaggaaagtcagttactttgagaaagagtaagaaaaacaaacaaacaaacaaaacaagaaaaaataaggccgagctcccctttcatacagtaccagctatttacaattatgtttaatttttcaatgtacaaaacagaagtgactacttacttcagtatacattcataagacttagtccttacaaaaaaagatactgtttcttccatagacatacggaagaaaatcatacttcctg

SEQ ID NO: 182517 - DNA, 392 bp, Homo sapiens
tgatacagagtctcactctgtcacccggactgtagtgcagtggcaaaatcatggctcattgctccctgcagcctcaacctcccaggctcaagcaatcctcctgccttagcctcctgaacagccgaactacaggcccatgcaccaccacgcctaatttttgtatgtttttgtagagatgcagtcttgccatgttgcccaggctggtctcaaactcctgggctccagcaacccacccaccttggcctcccaaagtgctgagtgacaggcaaaccaccaagatcagtccaaagcaacatatatctttgatgtctgatagttatagaaaggagatatgaatcactgtagtttaccccaattctagcatgccctcctgcttgcaataatctctggag

SEQ ID NO: 182518 - DNA, 265 bp, Homo sapiens
tggttgtgtgcgtccataaggtatatgtgttgacaggtgaaaagatttcgtctatgctggtagtacttgctagatgtgccagtgagttaaccacgaatctatcagcaaggatgtcatggtttgtgggagttcagtagacaggcccagtggcgatgagacattgcactttgggatataatctacaatgatatgatttcttcaagggtatcaattaggaacactgggggagttctgagagactatcaacctcaatcctgtcatatta

SEQ ID NO: 182519 - DNA, 186 bp, Homo sapiens
aaatatccatcaataaatcaaatatggtatatacatatatattactaagccataaaatggtatgaagtactgaaaacatgttaagtgaaagaagacagagaggaccatctttttatgattccgtttgtatgaaggctcagagcaggcaaatccacagagacagaaagtacattggtggtgactgag

SEQ ID NO: 182520 - DNA, 426 bp, Homo sapiens
gttggctttagggagcgcgaggccgaggccaagaaaagctacgcattgggaggtcttgacccagtgtgcgcccggctgtaggcatggaacgtgcgccaaaggtctcctggcacccactccgctggactcagcaccattgtcctaagtctccgattgagaagtatctgccccaggtcctctgcgggccccactgaacagtgtggagcgttcacaggttgggggtcaccatttcagaatccagtttgttgagacgtggagggtacaggaggagggatctgcatatgcgaagacttggacttgaccctgacctgagcgttcaggcaggctctcatgcccccttggcagcgagtggagagcgtaagaggagtcctgcctctcctggcacaccgagggcgcctgggagccatgaaaggtgttgaacagaaa

SEQ ID NO: 182521 - DNA, 249 bp, Homo sapiens
tcagctcggatccaagtgagccgcctctgagaagttacaacttctgccagcagaatatgccctgggtgcttgctgtttccagaaaaaagaaacatggaacagatctggaccaaacctgtagcctagctccaaaccctgctgagatcatcagagctgtcctagccaacccaccaacatatatgtaagaaatatttgcttattgttgaatatgactgagattttatagttatatagccatcttttttaaag

SEQ ID NO: 182522 - DNA, 135 bp, Homo sapiens
gacttcttgttcctgtttatgccggacttcttgttcctgtttatgccgtgccagtcacccccaaattgcaggtgtgggtctgcactgccttgctgcccggccattgggcatcaaagctgcccatgctggggctcc

SEQ ID NO: 182523 - DNA, 185 bp, Homo sapiens
ctgctgggaacgggtcccagcagggcgggaggaggctcttttttgcctctgcagccacacgcccatagctggtccagcagccgtttcgctcagcccagggcctgggctctcaaccagggtctgattctgggctcctcagagagcttttgcccagaacgctccttacctcgaagactggagaggag

SEQ ID NO: 182524 - DNA, 715 bp, Homo sapiens
caattacggctaggtacgaggctgggtgttagtagaagtgctttgcctcccaccattattctgaggcctcctcagccatgtggaactgatgacacatctagaagaccctcaccttatgcttatgctggccccttgatcttggcctccagaaataacccagaacagcaagattttaggaattattggaaaagcattttttgaactgtgtgttcatcttaaaagccaaattctccctcccttcaaaggacagcatgaggtataatgaagaatcttgaggtcctcctggattaccaaagtgggccctaaatccagtggcagaagacacagacacagagaggagaccaggtgaagacaaaagaagaggctggagtgatgcaaccatcagagagtgaaaatactcagttacctcctggtttatgaggcaatgaagtattccagcacataaatattgacgctgagacccatgggatgtaggagtgctgagcacatttgcaagacataaagaccgaagggaagtttaccaaccctggagaacatcagctctccctttcttccctctttgcaattgaatcttgaaagaagctaaacaaatggacatggatgtgtttcaataaaactttatttacaaaaaccagctgcgggctagatttggcttagaggctttagtttgctgactcttctagagcagagtatgtaggtaataaatatttactga

SEQ ID NO: 182525 - DNA, 278 bp, Homo sapiens
ccaggctgatcttaaactcctggcctcaagcaatcttcccaccttggcctccctaagtgctgggctgacaggcatgagccactatgccttgctaagtgtttaatagaagagtgtgaatggcagaggcagaaggtttggtggatcatacagccttacagtctcttcagaaacatcactgatatttgctgttgagtcaacctagcaaccaattcttgtcccaaagatatgacactgttcaaaaggcacctcagagatgccagtttcatctcttttcaatg

SEQ ID NO: 182526 - DNA, 286 bp, Homo sapiens
atacactagcattaaacatatgctgaatatgatttaagtgttctctgataaatcagaagctacttcactactctgtaatgtaacagagttcttatatgaacagcaatttatgtggtcagtaatttcagttaaaagttaattcatcagctgggtgccatggctcacgcctgtaatcccaaaactttgggaggccgaggcgggtggatcaaaagctcaggagttcaagaccagcctggccaagatggccatctccactaaaaatacaaaaattagccgggcgtggtgg

SEQ ID NO: 182527 - DNA, 605 bp, Homo sapiens
attgtcctgcctcagcctcctgactaagtgggactacaggtgcctgccaccacgcctggctaatttttgtatttttagtagagaccgggtttcaccatgttggccaggttggtctcgaactcctgacctcagatgatccacccgccttggcctcccaaaatgcttggattacaggcgtgagccactgcacccagcctaattagtcttttgctcctatttgtctttatttgggataaaagttatagccttgttggggtcttcttacacagtagttctgactcacagccatcatctgaacctttcctctggttcacaaccaaaattaaacatccatttatggggattgagatagttttcatagtaaaggaagttttgtttgtaatgaccttcctgtttgatgggtctaagtatatggctggcccttctggctaaagcaggctttaaactggtcctgcctagaatgtgtacctcccactccttatcatctctcttctaggtcccttcccctttccctttcccttccccttccccttcgcttcttccttccctttgttccttttcctttcctttttttcttctttttttttttttttttttgacagggt

SEQ ID NO: 182528 - DNA, 521 bp, Homo sapiens
aaaataagtggctcataaacataatttcatatgttccagcttcatttataatgaaagttatggaggttaagactaaaattacagaccctttttaagttattttacttaggctggtaaatatttaaaaactgataatacacactgctggtgggaatgttggaaaacaatttgtcaataggtattaacattgtaaacgtatgttcccattcctctaggaatttcactgctaggactgtatcctaacaatatgttcatgcatgcatagaaaaagtatgaattagaatgttctcagcaggactgtttgttgtagcaaaaagccagaaatagcctgaatattctcagcagaaaactgcttaagttataacacagtcgtacaaacaatgacataaaaactctaaaaagtgcaataactatacctatgttgacagggcaggatctcttaggtggattgttaggtgaataaattaaagtgtggttcagtttacacattggtattaaaaattttaaatgatatgcatttc

SEQ ID NO: 182529 - DNA, 181 bp, Homo sapiens
aataatagctcttcccaagtataacactttaaaaaatatgaatcttaatatgatcccaaagaacttatcagactactgagagaggaaaatggcagatagaaggcaggactaaattgcagctcccactgggacagatagagcaacatgtggaaacacatacatctagaacttttactccagg

SEQ ID NO: 182530 - DNA, 270 bp, Homo sapiens
ctttgaaactcaggggaatggaaggctcagggggcgctgtcactgggcatttcagatagagtttgcagtgagaatctcagttgacagccagggcggctcacgccaagagtagatgtcaggaagctctggacagccgctctcttcacatcttgtggctgattagaagttcattttgaattttttcccagaagcagcctatgccccaagaggcaaccagaagaaagcaattttagaaaatgcaatttcatttgcagggcaagatgtgggaat

SEQ ID NO: 182531 - DNA, 206 bp, Homo sapiens
gttcaaattctgactgtgacactcattggtagggtgatcttggacaagttatccaattttggaaagtgtccttttccttctctcccacatcaaccagaacacccactaagtctgacctgtgcgtggctgtcatgaaacggactggagactccgcactggaggaggatgctgcctgctgtagtcatctctctcatctcccccaccaa

SEQ ID NO: 182532 - DNA, 479 bp, Homo sapiens
tgatcctgcaggttcgactctaagaccccctcagacagtgacctacacgtgttgtctacgtctgctgatgaggacttccgagagttggacactgcatgatctttcatacatggtagacacagtcttattgatgcattctttattggaaaaaccctagtgtgagcaaatggctccacttctctgagccacctctgccatttataaaatcagaagcgatacccccaaggtcaaagggagctgcgggaactcagtgagttcccaatccctgagtgttcactctgtaaaccagctactttgtgaagcaacttataggcattatctcatctcacgtcacatctaccctctgcagtaggttctatcatccccttgccaaatgagaaaaccctacctcagatttaaatctgtgacagtgccaggattcagccctggaccatcagcctgcaaagttagctctaatatatttatgtaatgcttggctc

SEQ ID NO: 182533 - DNA, 282 bp, Homo sapiens
catagaggacccgctggagtggcatataactcgatgagaaactgccaattactagaacagctgttgggctaagttgcagtctaacatcacacagcaatatcatacacactctgtatgaagaagcaggagaggcaacaactttcataatcagtttttctgtttcccttcattttcttgtgaacccttaatggcatctttgaaggtgactgtggtcacaccaagtgtcaccaccagcctattcgagtcttgctgcagagccatggagttatatgccactccagc

SEQ ID NO: 182534 - DNA, 679 bp, Homo sapiens
ggaagacctggacaacaaccctaagatccagcaggcactgaatatacaacaggtgctgctggagggcgtgctgtgcaaggtgcaggaattctgcagggaacatcattggataacaggcatttatgaattcctgcaatcctgggggcctcagaagctggaagacatgagaggtggtcccatcaagaactacgtgacgctggtgagccgcctgaatgtttggcaggcccgtgtctccagtatgcctatcgagttgctcacaaaaggcgggttgctgctacttagctgccatgatgtacaggcagagatggaatccaagctgaacagcataaggaaggacattcttgcgcacgtgcaaaatgagtgctggaacctcagtcaacaactcatgacagagctcacagatttcatgcatatcttccgaaccatcaactcagatattcatgccattgcacagtgcacccagaagttgaatgaagccaatgaacagtacgtcgagctggaggagcgaatggaatacgtacgggcactccacgaactcatccgcaaccactttagcctctttagtgctgagaatgaagcactggacatctcggtgagaaggcaattcggggagtcacccatccctccctgccctcctcccccacaaccacatctactccactgccctctgcttgcccca

SEQ ID NO: 182535 - DNA, 467 bp, Homo sapiens
gggatccccgactctgagcactgggaaggaaggacattcttgcgcacgtgcaaaatgagtgctggaacctcagtcaacaactcatgacagagctcacagatttcatgcatatcttccgaaccatcaactcagatattcatgccattgcacagtgcacccagaagttgaatgaagccaatgaacagtacgtcgagctggaggagcgaatggaatacgtacgggcactccacgaactcatccgcaaccactttagcctctttagtgctgagaatgaagcactggacatctcgttcagcccagctatggcccaggagaagacagagggctggctgacagaggcagcacggatgagcacaaccctggagctgcacagccccgtgctgcagcactgcatgcgcatcctgggggagtttcgcagctacctgcccctgctcactaagctgggcagcctccacccacagagcctc

SEQ ID NO: 182536 - DNA, 576 bp, Homo sapiens
ctgtgatcggagaaggcggctgggtggcagcgggggaatttaggacactggggttctgtttcctggtttgtgtgggagtctgtgtgagcgctgggtagtggaggaaaatggataaacttatctgcttcacacctgcaaactgccatccagagctccactaagactggatgggaatggccaaaggaaagtggggaaggaaggctaaagggagactgttggctcagattttaggcttctgtccttccttggatcacaaactgcttccgtgggcaaattaaccctgctgaaaggagttattacagcagcagataacagagagagaggggattttcctgggttgggcaggagaggaaaccttggcctctttatcaccctccttcaataagatgcttgtcagccctggtttttgtttttgtcatctactaaacttgggagagcattagtcatagttgtccatagcacccaggaagtaagcaacacaccaaatactggggatgcaagtttcccacaccagcagttttccaggccccaaaataccagtcacgctttaagaaagccacagaagtggagataggc

SEQ ID NO: 182537 - DNA, 259 bp, Homo sapiens
ttgtgttgtcaccaaagctatccctgaacaatagcagcccaagacaggggtggggggacttaggaatatttccattgctggtccaagcccttaaacaccagaacacctctggatgaaagggagggaagactctgaagggggcgggccatgggctggggctcaggttgctccagtgggccactcactggctctgggatcaagtccccatctaaacagtaaggacagcagggtgtagtgactcacacttgcaatcccaaca

SEQ ID NO: 182538 - DNA, 383 bp, Homo sapiens
caacccttctgctagtaaaatcaggcaaagctcccaccggcacggagcgtcctctcagcaggtccagccagcaaaagccagaagcctcttggctgtcctgtctcagggacccctccagccttggccacagctggctgtacccgacaggacagtggagttcaccctttggagccgaggtctgaagccagctcccatttcagcccctcgctgtggacaaaaaggaaatgaaagtcgctcccatgcctggctgagtatggagccccctatgtcaggcagggagggggattcactgcagagaagccaagcaagggctgcactcggcgctcaggatgctgctgatcacgcccccagcaccgctgacatgcggggcaggtttcacactc

SEQ ID NO: 182539 - DNA, 468 bp, Homo sapiens
tgaggaaactggggcagatagaagtgaggtgacttgcacaaggtcacacagtgagtgagtgatagagtaaggatttgaactcaagcattctggcactttttcttttttgagactgagtctcgctgtatcgcccaggctggaatgcagtggtacgatctcaggtcactgcaaccttcacctcctaggttcaagcaattctggcactttttctttttttgagactgagtctcgctgtatcgcccaggctataatggcaattcttccacttcagcctcccaagtagctaggactacaagcatgcaccaccaaacacagctaatgttttgttttgttttgctttgttttgttggcagagatgggagtcttgctatgttgcccaggctggtcttgaacttctggcctcaagcagtcctcctccttgatctcccaaagtgctcggattacaggcaagagccacaatgcctggct

SEQ ID NO: 182540 - DNA, 960 bp, Homo sapiens
gggcgacagcggagaccctgtctcaaaaacaaaaaatgattgtcccaccttaggtaagtagatgcccccaggttgcaaatctgtactaaggatcttcctctagatatgcttcccatgactgtcatggccttgtaggttacaattgctggaggtccatccctctccagaaaggaggtagagatgccccattttgggataagggtgcaggagggataatgggtctgctgcggaagaagatggcaccctcacctggaagcactgctcaatcccacacacctgcacacccatgagtctgctgcctttggtggtctggggctgactgtgggaaatgagggggcggctgtacttctcaccccagtccttacctctctcacgatccttgcccccaccctcacgtctaacatggagtcagcactgctgaaattcttatctcccctaagtctagcaagttatttaaatttttctgttaccctttagttcttaataagtgagacagttttctataaacatgtctgtaattcagcacacatgtgatttttccattgtcatctcttaggagaaagggtgtatatatatatataatctggtttctactgaacactgtgttcagtaaacttgtccagatgaccaaagtatctgttcctttagcaaatgctgggtaagtctcaggtaccacgtgctggagtgtaatggtggtgcagtgtgaagaccttgactgcggagggttcccaggcagaggcatcctgatcaggagcagataccctgactcctgggcaatgaggctggtgtttaggctggggcatacccttgggcaggaaatctctaagagaaagaagtgatgaaaccctgagttcaacctctgggaatggagaagaaaggagttctagaaaacaacagacacatagctagagttaggctctgagggaacagtagcatattggtggtggtctgggggaactg

SEQ ID NO: 182541 - DNA, 204 bp, Homo sapiens
cattttgctgtcctcctaaaaccctctgcttctaaggcaaagatggtgccttgtttctctgttccatcccagcaattaacacaaacgtttgttgaaagatagatacaaggggcatggttcagagatacaaattcaatgttatctattctcttctagtcctcctttaaggaggctgcagaaagaggcgttttatctattcacaaa

SEQ ID NO: 182542 - DNA, 382 bp, Homo sapiens
ctttctaggatagagatgatcactgaggtccctccaggctactcagttctgcaatctgtgatttaagtaaatcagaagttatttagcatggcttcactaatcagaaacctgaaagaccagaggcctgttttcagatgatcccttgaaaatgagattcaaatgaccaaccactaaaagaatcaagtgctaaatcacgagatcgagaccctgaaacatagtctccagctattacgtgtttttttgaagaatggctatcatacaaacacaatttcagcgggtctttatattaaagacaccatttaaatgggaactgcatccggtgttctttgtatggtaataaactgagcacataaaatgaatgtgtagcagaatagaagttatc

SEQ ID NO: 182543 - DNA, 356 bp, Homo sapiens
gaacttttgaataacttcacttagctagcttgttagtgctaggaacccaaagatgacaaacagcccattcctctgaaaaactgtgactctggtgaggtgcatagttatttagacctgccggatgagaataccacttttccccgcaccaaatctacctgctggagtgaatttatttcatgtagactctgaggtccctctgttgcttttgataacgtgctctcatctgaggccagctccgttacttgtatactcatcctgtctcccccgccaaggtcattgctcctgcagttttctgctttctctgttggatcattttccttctttgctggatcattcctatcatcaaacattctgtg

SEQ ID NO: 182544 - DNA, 715 bp, Homo sapiens
tcattgcactccagtctggatgacagagcaagactccatctctaaataaataaagttactttcttagtggttgttctagaggttatataacactatacttgagattaatattaccttaatgctggcaacacatagacttggttttcatgttgtttcatttttacccccttctttgtgtgactgtcatacatattacggttctatatgctataaaccccaaaatacagtggtatacttattgtttaatgcaactttatgtcttttaatgaagttaaagagaacacagttttttatatttacctaggtactgtttaccttttcatttctttgagtagatttgaactactatctggaattatttcttttcagcctcaactattgcttttagtatttcttataaagctggtctgctaacaatgaattctctttttttgtggagtgtctttatttcacctgtacttgttttaaggacagtgttgctggatataggattcttgtttgacagcatttttttttttcttcttgtggcactctgacaatactgccccactgcctcctggggtccattgtttctgattagaaggcagctgtgatttattttgttattcttctgtaagtgataacttgtacttctctagcttcctttaagatttttctttgtctttcaacagtttggccatgaggtatctaggtgtaagtatctttgtttatccta

SEQ ID NO: 182545 - DNA, 293 bp, Homo sapiens
caagatcatctttggcatcatttctactggattccatttctgaaggcattgacctatccattttatccaaagaagtcattttaaaacttctgggttctgctggtccagacagtctttcagaattagaataaaatctgtcttccctttgtggaggaagagttgaatcaggatatgattgccctggtggaggaaacatcatcctacggtcctgttccaccggagatgacagggacccagtgtcagaaggagccctgtgaggatcgattaacctgtcatagcttggttctcctctt

SEQ ID NO: 182546 - DNA, 1280 bp, Homo sapiens
caattgtgccaggttcccaattcccagagcagcatcccggagtcttgtttagtcatgatcttcagcctcttgacagcatttggttagcagacactatagcttggactccttggatgtgttcataggcattttatcttgactctgttctctaaacatggcacactctgtaagtttcattgtaatgtggctattaaacatgtccactgtacattaagatttactgggaaagaaaacctacctagaattcagtaaaattctaactaatgaaagagtaaatacaccagctgttcaggcccaacactgatttttaaaagggcagattgggcctgggctacagctcagaatgttgaagaggctggattggagcagagctgagggaaaaagagaaaaagacaccttacgccatgggctttcacacacgcaggagaaacaaacgctgtctcctaagttacaggaacttgggtgtactttttcagagactgcaagtaaagggtgtgatcaaatgctgccctttaaacactgacatgccccgagttctgttttcactgctttcttctcacgccgcgtgatttctttaggtcccagtgatcccaggcttccgctacctctacaggctgctgccagccaaatgtttatctgaaaatcgggcttctctgctaaaccccagacttagatacccagtatctgctattgaacagatccattcaaatggtctacaggaaattccagtactaaaattactattaaccaggtcttcctcctgtattgcccatcttaagtgaattggtgggtcagccaaagccaaacgcaagaaatggtcttcctcatctcctcttcctacatacacttcacctttctaacccccaacctccaacagtgaagataccgggatgctaccttaatggcacctctagaattgctccgtctttatcaagttgggactcaccagttgtcattaggggtaataaaggcacagcaagggtgaggggatttgggaggttatccctgtaatccccatgcttcctagtattctagatgctctctagaatgggagaggtgggtgtgccagagttgtacatcaccccctacacccacaggcatatgtgaacattgctgcatcttgtatcagaaaaatcagatgtgactgctgagtttgaagggtgagatccacgctctatactgtgcccctacctttttcttcagcttctgggacatttttgctcatgtgctgtgtcccagctgtatgatacgagacacacatttggtgtcttatcctggga

SEQ ID NO: 182547 - DNA, 994 bp, Homo sapiens
atatgatagcacacaaaagtgtacatttctggcaacactggcctggaatatttgcatggccacagcgtatggagcagggttgtaagtgcccctttgagaggaagaatgcatatcactgtgtgcctcagttctctcccagcctctcacatacatgtatgtcacctgcctggccctaaggacatttgagacctccctgtgttcttctctttgtcttgggatagcctggcttttaggaagtgttctcaaagaggcaagtgacatttgagcccctacagtggctcaggtgtgaagtcttgggcttttcccctgtggacttggagtgaagccttgtcagtgactgtaatgaccaaatgaggagttattttagcttgtgtttgttactatcttctgtcatgttaagggcatcttcgttgctagagtaatttcttctaaaatatggaaggtcaacacttttccctttagacttgtggatagtgatggataaaaataactctcttactctatagtaaacttgctcaagtgcaaaagttatatttagcttcagcaataggagtctataaaactgtgagagaaaagccttactaactgaagtcatccttcaaacctttctaccaggggttccaatagcaattgctaagaatacggcagcttaaaaaaattttttttcaattgacagatattaagaatgcctgatatttactgacttgaacattagttaaattcagttagggtgaccagagtgttgctatttgtagaactgttgcttggtagagtcatccaaagtgtcttcctaagctgtaataaatatgcttactaatgtttgactgcttaattaatggtcagtaagcattcagtcagagttcgtttaatacatggagaaagatatatgctttagatcaagggttagcaaaccactgcttgtttgggccacggcctgtttttgtatagtgtgggagctaagagtgggtggtgtacatttttaaagggttatgac

SEQ ID NO: 182548 - DNA, 213 bp, Homo sapiens
taagtgccccggagcgcaactgctgggtcatgtggtactgcatgtttagtttttttttttttaacaaactgacagttttccagagtggctgtaacacgtgacattacctccagaaatgcatgggtgctatgtacagagtggtaaaaaaaaatctctgtcgccaaaccatctgaactctagtgaaagtggggtgggtgtgaacaaatgaacaaa

SEQ ID NO: 182549 - DNA, 760 bp, Homo sapiens
ctctagaggatccccaggacagtcttaacaaaaacaagcagctctagtaactggtctaaagattcgcctctcaggtaacaatgcattctctccttagcaaaactaccaatcatcaagtccttgtgggtattttgtttgtccctctattctgtgcaattaatggctcattcagattttcagttaggccacaatataagtttcatccaatcaaatcatgacttgattttctcatataactagtatgcataaatcaagatgttagacaaaatccattttaatattttatatctacaaatagttttagttataacagtgtaattcacggaagtatgtggttatctaattattttaacatgcaaaatccaatttggatagctaatccctttctacatggataaataccctcataaattagatttgagaaataatttgcatgcagtagccactttactgaacctcccacttcaacaaatgtaactgttaaactctatttttaagactggtccttccactagtgtaggcatctgaggtatttgatgctctctgcttttttctttcacaccccactttcagtctctcagtatgtactgtgagctctgctttcagactagattcgtaactcagtgatttcctactcctccacaaacaccaccctggtccaggccatcatcatttttcatctgggctactgtagtcacttcctaactggactccccacttccactcttgctgcttgccccttattgtgcccatagcagcc

SEQ ID NO: 182550 - DNA, 652 bp, Homo sapiens
atggggagagattgctccagacctaaccccacagcatacacctgccacagcgaaatccagggtgttggcacctgtgtgtccgtgatgagcctaggaaaccagagcaggggcagaggggcgtcatcctcccaccggacgctgggagctcagaccccaaaactgaaacaccgtggcttcggcggggggtgtgcctcctgatgtcaggagccccatccacgtgtgtccacacagatctcgtcgcagcacggcaggaaggggtgctgcttagggctcattgttggggacatgaccgggttcagcggctagaacatctgccccacagcagcctcctcctccaccgaagagggtagttgtctccctgaagcagtcacagcaggcgtctctgccgctccgtcaccacagtggggttaggtctggggatcgcgctggggttctgcacctgcagaaggagaggggtctgttgtcgctggctttcccccaagcaggctcttgcacactctagaaaaaacaccttgtaagtctgtgcatttttattgtcttgataaattgtatttttttctaatggggattgggagatggacttcgtttttaaaaatatgtggattttggttaccaagtttagtgttaatatattccatatacatacaaaact

SEQ ID NO: 182551 - DNA, 909 bp, Homo sapiens
atgaacccacaagcttatctgaggtacacttcccacagaagctactagtccatggagctgcaggcagcagaaggccaggaacacatgcaggcatgacatcggataggcgacactttcaaaacctttaccacattgagttcattccttacttttcactctttctctgcctggagtgttctgccccatctttacgtggccagctgctcctcctctgatgaaatgtctcttcctcacaggccttccctgaccacccactagagtagcacatcttctacctcataaacttgtttattagtatttcttactctaaattttcttttaaattgcttaattccctaacagtagaatataagcttcactgtatgtatgatcttgctgactctcttactcattgttattgtaataccagtaacaaagggtgtttaaaatttgttcagtgggtgaatatatgttccatttaatggataaattattttttattcagtctcctgttgatggacatttgaataatttccatctttttctctatgaatgcctcacttggcatgcttctgacagtattgccacagaatacatttctgttataaaaattgaatttttaagtcaaagggtagttacactttaatggatagtggcagcttactatcaaaagtttctgctagtttcaccatatccttattagcagtagatattatcaatcttttcaatctttgccaatctgataagcaaaaagtaaatgggtttaaacatcctttgtatatattcattgctcactttatgtttttcctttgaaatgttatttcttgttctttccctgcagtatgattctttctttttttgacttgttcccagttttttgtgtactatggatattagcctttaattatgttacggatgttctagtatgtt

SEQ ID NO: 182552 - DNA, 174 bp, Homo sapiens
tgaattttagaaagcctaagtcatacatcacattgcttcatgggcatcccagtacactttggattttattttacatccttactgatctgattctcatctctgtctcttcatggttctctgccttctagttacactggtgacctttcaaaacctttaccacattgagttcattcc

SEQ ID NO: 182553 - DNA, 203 bp, Homo sapiens
gaaaaaaagaaaaagctagacttacatgtgtcacttaaccccttttctcaacctctttctcttccaggaatagtcaaccctggatggcttcaggggaagggggatcctgaagcccagggcagcctccaactctaccccttcctcctttgaaggatactaaggggtccagaaaggaggggcaggacactgttacccaccccaca

SEQ ID NO: 182554 - DNA, 449 bp, Homo sapiens
agcacatgcttgtagtcccagttactggggaggctaaggcaagaggttcacttgagaccaggagtctgggcagcagtgagctataatcactcaactgcactccagcctgggaaacagagcaagaccaccttttcctcaagtgtgggtgtgtctcaaaaaatatgtattacaataaaaatttggtttatgttttctagcttagtttttagaaatagtaaattctaaattaaaggcaaatgtataaagttattatgagaaatttattgttaaaaagaatcatgtggtaatatttcatttcattttttgtttgtctgtttatttgtccggagattcagggatcctttgaatactttaatcagagcctaacacagtctaagagtctgaagtctctaagagaaatatatgttcaagaaagaaaaaaataaaacatgaatgagataaaagtagca

SEQ ID NO: 182555 - DNA, 155 bp, Homo sapiens
cttttacacactgatttttttcaaaatttaagatactgacagaaactgaatatttagttcctctagatattgatccaagcctcgtatagaaacaaaataagactttctataaatgctcattaatgaacagatttttgggccccagtgtggcattt

SEQ ID NO: 182556 - DNA, 702 bp, Homo sapiens
gataactttcaataacgaatgctaaactataaagcatatcagataattgtttgacattgtaaatgcttttattctctagcttaatggtttaagaattaattatgtctttaaatgaaagtgcaagtctatatcccgaatattttaagtgtctttttcaatttaaatttgaaggacacttataatgtgtgaaattaaatgggaatttggataaatattaattgcatcactaactcaatgttataattaaacacaaacttttccatgggccatatttgaacccaactcataaaagaggatattaatatatattttgcaatttccataaaagggctctcaatgcatagtagtgaacttgagtcatatatacagaaatgaataattgtcatctaatagcatatttcttctgctctgtgaatcccaattatattcgtttgtaaccatagggtttatgattgcacttcttaaataaatctcattgcacatgtatgccagctaagattacacaaacataaattgcactttgtggttctctttctgtaaatacttttcaattgctgattttgacatttgtgagctttgaagcttactatcagtgaatattgtaataattattgttctttgtgtaagccatttgaaaggtgtagctaatgaataatgcccaaggacaggctttttaatcatgggaaagccaagagatatttc

SEQ ID NO: 182557 - DNA, 220 bp, Homo sapiens
aatctatccatccctcccttcctcctgctctcccttccttcatccaaacatccacctacctactagtaagctacatatggtgctgcattcctctaagtaatagtgctgaggtggaggtcagtatcccttgtgcaccgcagagctactgttttactgaatcgatagtgctctgaaaatcaaactataaaaccatttaggatacagtagggagaggggatca

SEQ ID NO: 182558 - DNA, 648 bp, Homo sapiens
atcaatctcctttttgtgtgtttgtcaaagggcagcccccaaacccccaaatgggacataaatagaactgaagtacaacaagctactatattctcagcacagggagtgtgaagcccttagtcttaaagtgacaaatgggtaggaaattatttcttgctaaagaataatgaggagcataaattgcttctgtgtgcggatgattcactagaaggtaggcacctccggctgcaagaggaaggcaccaccacttcaagcctcagggccacgcttcatggctttccccctacatcaagcaccaccacccagctgcatcctggccaggctggcctgataacccttgcccttccttctccccagcctctggggaagaggcactgagaaaggcgtggggaagggcagtctgctcagtctgaaagctcctttactcctagaaaagggttttcaggacccagaactgtgccctgggtaatggtaagcatggctgtggcaggctctccttagaaggctgagggccccaggcaggagacctttcccctgcttggttaagacccaaggttggggctgggcgcggtggctcacgcctgtaatcccagcactttgggaggccaaggagggtggatcatgaggtcaggagatcgagaccatcct

SEQ ID NO: 182559 - DNA, 494 bp, Homo sapiens
atcaatctcctttttgtgtgtttgtcaaagggcagcccccaaacccccaaatgggacataaatagaactgaagtacaacaagctactatattctcagcacagggagtgtgaagcccttagtcttaaagtgacaaatgggtaggaaattatttcttgctaaagaataatgaggagcataaattgcttctgtgtgcggatgattcactagaaggtaggcacctccggctgcaagaggaaggcaccaccacttcaagcctcagggccacgcttcatggctttccccctacatcaagcaccaccacccagctgcatcctggccaggctggcctgataacccttgctgctgctggccaggactgaaaaatgcagactgcaggcaacataagcaagcaggacaaccccgctcagattgtgtgtgtgtgtaaagtttgatggaactgctcgggctgggggcgtctggggaagtatctataagtggcaatcggctgccattg

SEQ ID NO: 182560 - DNA, 137 bp, Homo sapiens
attagttgcttacatagctcatgcctaccaaaagtggatggaaagggaaagagaaaagtgtacagcaaagaaaacccaggagctgagatggcaggagaagtaagtgattgctccaggtgtaattgcttgcatagtaa

SEQ ID NO: 182561 - DNA, 237 bp, Homo sapiens
tcttagtcaatccccacccctacatcctgaggcaaatttgggcttttatcactatagctttgtttcacttgttctagaacttcatataagtagaatcatatgatatctaatcttttgtgtctggtttctttaaccttaataattttgaaatgcattcactgttggtgaggagtgttccatattataattgtttgtttatccattttctgttcttaagtattctgggttttggctagg

SEQ ID NO: 182562 - DNA, 281 bp, Homo sapiens
atcgctctcctcgatcctcaggacctttctttatcatcaaccaccccatctccgaactccagtctctctttcacctgggtcctgctagtcagcatacgagccagtttaagtctcttatctattaaagcatcccacttccacatcacatctgaaatcctcagccccgccatctctagctaccatacaccactgtctcacctgccattccctcttctgtccccaccatccccttgaaactcctctcacctatgaccctctagttgccaagtccaatggactcc

SEQ ID NO: 182563 - DNA, 393 bp, Homo sapiens
agcatacagaagtagccctgcaaagttatatcttgtgggggaaatttgcatctgtagaaaatctgcattgatgaagccaggccttcccttgtctagatctgggaaagattaactgagagtctgaaacacctttaaaggtctgaaagaaacatttgccatctattctctaacaggactgctacctgtgaagtttcaactatgtaatgagaacacctttgctagccaagcctcctcttttctccctttggtaatctgttttgccacagccgaagccctcattctttttgtaacctcaagatggcatttaagcttctgcattccattgcggggttgggtaatcactcagtaatgttccccatgtgtatgctaataaaatgtgtatgctttttctcc

SEQ ID NO: 182564 - DNA, 357 bp, Homo sapiens
cttcttgattgtgtgttattatgaagagcttgatcctacagctgtgtgatccacaagttactcaacctctcttcagtttcctcttcactaagatgagagtaataattagccgggcgtggtggcgggtgactgtaatcccagctacttgggaggctgaggcaggagaattgcttgaacccgggaggtggagttgcagtgagccaaaattgcatcactgcactccagcctgggtgatagagcaagacactgtctcaaaaaaaaaaagccacaaaaccaaaaaaaccaagatgagagtaataatagcacctatcccatggaatggttttggggattaaatgagtcgattagtgtgaaagg

SEQ ID NO: 182565 - DNA, 446 bp, Homo sapiens
tagaacagctggttccagataacatggtatgtctcattagagagatactagatctaattatgcaacatataagcgggatcattatagaaacattatctcgatgaggtaagtaaagtacatgtgaaatctaactctgctgtttgaaagaatttttgaaagcaaatgtaaggaattaataattacttaagtgtatgaagaaagctgttgcaaactacttatgaatctttgacatgtaatgaaaaaatataatagaatgataagtaccctgattatttgtgctagagataaaaatgaacttctgggcaaatatcttttgctaccgacaaatttttttcctaaacagtaaaaatgagtgccttttcatagcatttctactgtgtcagaaattctcaaactttagagtgtaactgaaacacagagagggcttattaaaacaaagattgccg

SEQ ID NO: 182566 - DNA, 463 bp, Homo sapiens
tttttttttaaactaaatgtcaggaaggcaagaaaaagcatcaactcacctcagccatggcttctagtattgcagatggttagtcttccttgaggccgttctcctgaaaaaggacagtgttctgaggttgcatgactggggaagtaaaaccctctagaaatcacactagaggtcagataaaaccacctccatatttcttggtcttgagatacaactccagttagtaggaatatggaacaaatcctactccttcctcaatcctacaaacctcaggctttagctgcagcaagacaaggactcagattcattctccctcatgcaaacaacctaagttcctgccttagccaacggattcgggccagaccttgtcccacctcagtgatgttgctctgaacccatgattgagctattatggtctgccctgagctaatgacctactatgacccaagactgagctaccatg

SEQ ID NO: 182567 - DNA, 379 bp, Homo sapiens
  misc_feature (15)..(15): n is a, c, g, or t
  misc_feature (19)..(19): n is a, c, g, or t
  misc_feature (23)..(23): n is a, c, g, or t
actctagagtatccncggntcanttgagatctacaagtttattatttttaaattttatgtttttatttatttatttatttaagtccaagttgttctgacagaactacaaatttaaatgttataaagaagattcattctctttttctataagttacttattgaactgtatagattggtattatatatattatatatataatatatatattatatataaaatataaataatatatatgaaacaattattatttatatatatatatatatagagagagagagagagagagagagaatccttatcatcttatttactgaaatgttgtagatctgaaacccccactcttcttgttggagggaggacagtggggatgagagcgtt

SEQ ID NO: 182568 - DNA, 649 bp, Homo sapiens
atctgtaatcccaacacccagagataaagccatcgtgaatgcgtaacatatgtgaaattaatgctgagtaaccagccctgccacaggcagcagcagcaaggtgtgtggctccgacctctgtggtcattgcctttggctgtgctcagctgctggttctccgtcccagccgggctcccttagtgccttcagtcacttgatggttaggtggagccttgcttcggggccctggctgaaggcaggagtagtggaggctctgttctgtcatgatccagccttggttccaaaaatgatagcagtgtcagcctaggaacaggcacagagtctcagaccctattccttgacccaagtcccaagccagccgcgattcaaggactggggcccagactcagtgagagggtgtggaaacaggcaggggatacttatggacacttttgtattctattacagtgtatttctttccagtattctttctaagcttattttaattagatatgatcctatcagatgcaattcatacccaatgttctccaagtatcctggtataggtattttaaaagcgttattacagtgctccatggcacagctttaaaggattgtctaacatgccattaggtgaccatattagtcttttggactttacactgctcca

SEQ ID NO: 182569 - DNA, 535 bp, Homo sapiens
ctcaaacttagcataacatattaccaattcttgcactcccattaactgatgggtcctaagcctggcaggtgtcaatgtcctcgcaaaggtttaagcaaaagccttagctttgccactagcattcctacaaagtgttaaaagcacacttcatgccgggcgtagcagctcacaactgtaatcccggctactcgggaggctgaagcgggggaattgcttgaatctagtaggcggaggttgctgtgagccgagacaccagcctgggcaacaagagcaaaactctgtctcagaaaaaaaaaaaaaaaaaagaatctgttagacatggagatgtgtacatgcgtgattgacaaagctacagagcaagagagaggataatagtggtaatgagaaggatgagctcttggatgacttctagttttctgggttccatgctaaggtggatagtgacttccatttataaattagggaatataggaagatgcacgtttgggaacaaaagatgagatgtttggtttttgaatggttgaatttgaggtac

SEQ ID NO: 182570 - DNA, 346 bp, Homo sapiens
caggagaatcgcttggacccaggagtcggaggttgcggtgagccaagatcgcgccattgcacaccagcctgggcaacaagagcaaaactctgtctcagaaaaaaaaaaaaaaaaaagaatctgttagacatggagatgtgtacatgcgtgattgacaaagctacagagcaagagagaggataatagtggtaatgagaaggatgagctcttggatgacttctagttttctgggttccatgctaaggtggatagtgacttccatttataaattagggaatataggaagatgcacgtttgggaacaaaagatgagatgtttggtttttgaatggttgaatttgaggtac

SEQ ID NO: 182571 - DNA, 518 bp, Homo sapiens
tacaatctatttattttttgggtaattgtgaaactaggaacaggaaggatattatagtaattcaagtaagtagcaataatttggctactctattttgatttaaaaatatttgggcatggaacaagtcgttatttaactgaacttctagttttgagatcttattgttaggatattactagctacaataagttttatgagagaattttctcccttgaacatctccacatcctaccttttattaaagtaatccactgatgccctttactatagaggctttgggtcttttcattgttttccggtcagcaggttggtacagctgaactctcagtacctagtgcctgagtgttaaatctgttcgacagccctctgctttatctaattttgatactatgacatttatattgttttaaaggaatcttctgtggatggttttaggagttctgtgggaattaataccatttagaggatcatataactatggcagatgatgtttgtgataaaattggtacctatcttgt

SEQ ID NO: 182572 - DNA, 576 bp, Homo sapiens
tactaagtttctttcatgtgtaactataaaatttcagggaatttcaaatatccttgaaatgctctttgaattgccattagatatattcctggaagccatcccaacaccatgatggctggcaatattttaacctgtgtgatagttaacacatggccccccaaatgctttgatactccccccattgagaggtgggtctacctctcccttctcttgaatccaggtgggattgtgacttggttgtaaccaacagaatgcaagatcacaaaggtgaggtggctatggctttggtccctggaatactcatctttggtgtcctgactcatcatgtaagaagtctaacttctctgcagcccccaagctttgaggaagcctgggctatgtttaggggatgcagctgacagccctagctacaatcgccactggcagccagcgtcaaccaccagacatgagtgtggatgcctccatttgattccagcccctgtcagtagggtcactcccaccatggagtcttcccagctccccagaagttgctgagcacggacaagctgtggcctgtccaaatttctgtcccgcaaa

SEQ ID NO: 182573 - DNA, 354 bp, Homo sapiens
ttgatggcaggtccctgagaagagagaacacagagcacagtgttttccaacccttccttctcctgagtatcacattttatggaaaaactggtccagtccagtttcctcatgatgtgcctacagaaaccaaggtccagaaaggcaaatgacatgcccaaggacaatcagctatgaggagcagggccaaaactggaatctgtctcctggtttccagtcaaaagctgtttccactttcccaccatgccaaataattaacagtgcaggtgcctccttgcacagaacagagtaatatcgataaatcaaaatgtcggttgcagactggttgttggaataagtaatctgaatgggcaagaa

SEQ ID NO: 182574 - DNA, 495 bp, Homo sapiens
tgagaatgaaaattattaacttttaaatgtttttagatatataacacttctctgatatttattcacatatcatatatcttttctgatatatctctctttccagaagtatctatagagaaattaacagttatctgctttaagcattctttcttatgttgcagtgttttcactgatgatgaaaatctggtctattttttaatattgatattaagttttaacttggtagatactttggaactttcttaccttacctagaaatattgcttttattagatgtgcgattatacatactaaagataagtgaggatcatacatactacagataagtgtgaaagagggagcaagattgagcagtcattattttttctgagttccagttctgattatgctttcagtgatggatattctctttgctgacatttgccttgttgatatagctttgaaatcttaaatttcaaacattaaatgatgaattgtttgagatttgaccctttt

SEQ ID NO: 182575 - DNA, 523 bp, Homo sapiens
ttgatttgagtctattcctgctcacacaaacaagctcacccgggaaagatcggctgaaagtgactttgaccctaagatctgacagttaacactggaggtcagagggcagcttttaggctctccttcaagtatccaagctgggtggaccttccacaaaccacttgggtacctcattaggctgggagcatttctgctgagctcttggagacaaagtttgctctgaaggcaggtaggtaggtgtgcatttgtgcctgtgtccagctttccatgttagctgagaagtcagaaaatgctagctttcttgttggtaagaagtaggccaggtatgccatagcatactttaaaaatgcaatgagaattcgttccagcatagaatgatttcaagaggccaaccacaaggtaacagcaaaggacatcctcctttctcgaaggactaaagtacctggagctatgaagagccccatgttaatcccaagatagagggattacatccttggttcttcttcttctttttttttttttt

SEQ ID NO: 182576 - DNA, 636 bp, Homo sapiens
ggactacattattttcactctaagattgatccacatttttactgtaagcagaaacttaggacccaagattataatgctgcagaggatgctgatcgatgtgttcttcttcctgttcctctttgcggtgtggatggtggcctttgcgtggccaggcaagggatccttaggcagaatgagcagcgctggaggtggatattccgttcggtcatctacgagccctacctggccatgttcggccaggtgcccagtgacgtggatggtaagcctgacttggctcagatggaaacagcttggaggaggcatttgctccctgaaccaacccccagggctgccccggagaccgcacttcagaagcacgcgcgtgaaacggagtccaacataacagagtaccacgtatgactttgcccactgcaccttcactgggaatgagtccaagccactgtgtgtggagctggatgagcacaacctgccccggttccccgagtggatcaccatccccctggtgtgcatctacatgttatccaccaacatcctgctggtcaacctgctggtcgccatgtttggctacacggtgggcaccgtccaggagaacaatgaccaggtctggaagttccagaggtacttcctggtgcagga

SEQ ID NO: 182577 - DNA, 121 bp, Homo sapiens
tatggacaagaaatgaaggctcaatggcacatctaaatccacacaaatagtaagtagagagctgtgatacaaaccctaacctctgatcccaatgcctgaggcttccactagacccctgagg

SEQ ID NO: 182578 - DNA, 164 bp, Homo sapiens
cgagagccggtccatttccaactttaagtacttgagaccgtttgagaaagacttaccctaaggatgcagtggcttaggcaatttacttggttttctcatttgaagatttgctagcttgcagatttgttcagataagtaaatgagattatgtatgtaaagtccag

SEQ ID NO: 182579 - DNA, 155 bp, Homo sapiens
aggggaaccacttagcccagcctcatccgacatgggcatgaaatatctgacatgtttaagaaaaagggagaaatttggtgtggctgcagtggaggatttcagagagagcacagcaacatacgaggatggggatgaaagctgggctcagatcaaca

SEQ ID NO: 182580 - DNA, 273 bp, Homo sapiens
aaaggatggagcattaggtaagcatttgcaatgagcataatttgtgacaggtggggattagaggagtataaaggtaattccaaacagaaagaacccaaggagcaaagctgcaaagggtagaaaataaggatgtgttaaagaaacgtcaggtagtctaattcaacgggcaaagagaggtcttctcagagactaaggaatgacaattctataggagatattgtagaggcattaaaagggtcttcatatgctgggctaactagttggagggcaatg

SEQ ID NO: 182581 - DNA, 294 bp, Homo sapiens
gtcttcttttgcattaataaatccctatttgaacaataaactataggctgaccttttgtaacagcagctaacatttaaaaaacacttacctcaagtcattatagacattaactcatttaatcctcacaaggctgggaagtcataggggacccagtatcattcctatttgttcttgagaaaacagagctttgcagcagcgaagtgggggagccataagcggtacatggatccgtctcactctgcaccctatatatactcttaactcttttatggtactggtcacagcctgaagac

SEQ ID NO: 182582 - DNA, 272 bp, Homo sapiens
ggaaataatgcctaactatatacaccagtaggagtacttgagagtttataacaataccatgtaatgtaatgtgatgattatttataaagttcatatgaaaatccaaagctgaaaagggtgcttttaaagttcaatgaaaacacgaagagcctgttagcagtcaatatccactgacggaatttctctgatgataaaaaggcacagttggccgggcgtggtggctcacgcctgtaatcccagcactttgggaggccgaggcaggtgggcggatt

SEQ ID NO: 182583 - DNA, 515 bp, Homo sapiens
aacttttattctttctttatttactttttgagacggagtctcgctctgtcgcccaggctggagtgcagtgtcgtgatcttggctcactgcaagctccgcctcccgggttcatgccattctcctgcctcagcctcccaagtagctgagactacaggcgcccgccaccacgcccagctaatttttttgtatttttagtagagatggggtttcaccgtgttagccaggatggtctggatctcctgacctcatgatccgcccacctcgcctcccaaaggctgggattacaggcgtaagccaccacgcctggccgaaaacttgttcttttaacaagatgccttccggaatgcagaacaaagctgagaagccttcttttaacaacctgatgatttccaaactctagattcttggtcatctcaccctggactattagaaccatcctgatgaaaatagcaccaggtatagtttctgcacagctgcttgtccagaaatgtgtgaccttgggaaggtcatcctca

SEQ ID NO: 182584 - DNA, 1233 bp, Homo sapiens
gaactgggagagctgatggtagtgtgggtgggttgtggctgcgtctcagcgtgcaccagcgcctgagtcggtcggggttgttggagtcagtttcctaattaagactagcggagtggtcagatgccacccccactgtaacgagcaagcacttcaggaattgtctttggaaattcacggactttttctggagatttaagaatctagcatcgaaatatctagtatctcagaatgatttctgtcctggtactgtggtcctttctcaagtctatcattctttactccagttctagtcttaaacctccaccaccttagcataagacaaaaccagtcctgcatcgctgcttcctgtaaccccggggagaggccctcctgccccatgagcttcctcctccaccctctctctagatggaatgttctcaaactcccaggggagtattaaacaccactgatgcctgagtcctacccccagaggttctgatctaaaagtgggggtgtggcctgggcagtggggctttgaaaagctccctgggtgactctaaggtacagctagggtgagaggcacggcactgtgctagatcctgggcagcaggtagatatccttctagataaatatcctgggggtcacttcacctgtctgctgagggaaagaggtgatggggaaggcagaccctgggctggggagagctgaaaggcaggtggctgtgcggggaaatgaaagagcagcggcaaatgtccctacccccaaacccaaacaccagtgcttccaggatatttgtgagaccatagccagttgtaaaagtgactcaagtactgatttttaaaatgagaacgtatcaagaacgtatcatagtcacttaaatttggctgactagagcctaatagaccaggagaattaaaataaaaaagtaattatgatctagttcttagagcagtggttctcaaactcaagtgtgcagcagaatcacctgcaggctttgttaaaacacggatcgcgggtcctaccccagactgtctcatttagtaggtcagggtggggcccaagaacgtgcattgctaacaagttcccaggcttgttgatgctgcttgttgaaggaccacactttgaaaactactgcattagagtacttcacaatgaacccaatgaaatgatgtttccacctgaagccatttctgtttagttgtgtgaggtctgcctcagctactcttaaaagtgctacaacacaaaactgaatg

SEQ ID NO: 182585 - DNA, 250 bp, Homo sapiens
tagagcctccagttccctgccatagacagggaatcctgtgatttgagaatcttgggccctgaaacttgggagaaagctggggggccatgggattggtggcaaagtaattctatcagttcaaaacaatgattgtggaagccagttatgcaattcacacacagtctcacatttcttttgttaataatgaatgcaatgagacacacatgacaaaatgttaccaggagtgttcattccggatgtttggaatttg

SEQ ID NO: 182586 - DNA, 482 bp, Homo sapiens
gattgaaacttacattctttaaaataaaagcttgcaaataactttgtaatacagttaaggtaacctagcatgggttaatttttaattcattgatgactctaattataaaaatgtcacatggcttaaaaaaatttttgctttttaaaaataccctgagtaaccaacatgatggggctgggcacaatagctcatgcctgtaagcccagcactttgggaggctgaggcgggcagatcacctgaggacaagagttcgagaccggcctggccaacatggtctctactaaaatacaaaatctactaaaagtctctactaaaaatacaaaaattagccggtgtggtggtgggcacctgtaatcctatctacttgggaggctaagacaggagaatcacttgaacccgggacacagaggttgcagtgagccgagatcacgccattgcactccagcctgggtgacaagagtgaaactccatctaaaaaaaaa

SEQ ID NO: 182587 - DNA, 276 bp, Homo sapiens
aacgtaggctgtcaggtctccccctgtgcaaatgggacatccacttgagagtcaagggtctgtttgggtggcagggatagccacttctgaaggtagaaagaaaaataagccaccaaattggtatctttctgtgaaatggacatcgtgcttagagtctccattttccccacaacctggaggaataagtattgtcatctgcattttatagctgaggaatctgactcaacaaaattaaattactcacctaagcaattagcaattaaccaagtctttctg

SEQ ID NO: 182588 - DNA, 469 bp, Homo sapiens
cccttgttttacaaaggaggaggtcgaggctctgaaagcctaacagctcgtcagggccaccagctagtcagaacttgtttcctgagcctcagcctccaaatccaggctcctcccttccctctgcagcgcctcagttagccaggagagcatggccagttccttcctgtctccgccctagccctgggggcagccccaagccctaccggctccccgcttgccccctccccgctcggtagcctggggctgagcaggtagctgagcaggctcctctgaatgatcattttgtgtctggttcacgtgccccctcccctcagaatcctctcttctcctctagcctggcaggatgctttcctggaaccccagtaaccttgcccttgtagaacttctcggaggtactgagtggaggtgtggggcaccgggtggtattgttttcaaaatgaaacgattataggatttgggtggaagccaa

SEQ ID NO: 182589 - DNA, 392 bp, Homo sapiens
actgagaagggacatgaggggactttttgcggtgatgatagtgctctatcttgatgggtgtttttattatacaggtacatgcatttttcaaagcacatcaaaccatatagttatgatttatgcattttattctatgtcaattttaccttgaaaacataaagattcaattttaggtaatgatattgatattcaagtgtctgggggtgaaatgtactggtgtctgccatttctatcaagaagcatcagaaaaataggcgaggtgcagtggctcatgcctgtaatcccaacactttgggaggccaaggtgggaggatcacttgaggtcaggagttcgagaccagcctggccaacaagatgaatcccgtttctaccaaaaaatacaaaaattagcc

SEQ ID NO: 182590 - DNA, 273 bp, Homo sapiens
catgaatataagaaattaaatctcccaagttaggtaagaaataccataaatgatgtctccaaagaccatctgtgttgtcaaaattaagggggatatgttacacctacttagatttctgtcatttaacctgccccatgaaccttccatttgaccttttttacacaccacattagaatctttgggtatcattttatgctgttctcccatattttaacgtgaacttgactttagtggaggaaaaattaaggaactatttcattgtattacttgagc

SEQ ID NO: 182591 - DNA, 257 bp, Homo sapiens
atttctgttagtgctcctaaaagtccatacaggcttctccaggcctgcacttctaccactcagagaaagtctaaggaaccaaacaaataaataggaaaacactttggcacaaataaataaatctcccaacaatctatctcacccaaatacctggcaaatttatgtgctgtcaaaaaagtttggtaactaaacttaaatttaccccaaggcgtgcgcagtggctcacggaatgtaactgagagaacagaaataaaact

SEQ ID NO: 182592 - DNA, 367 bp, Homo sapiens
cgtctatgtctcgatcgttaaaatataccttcctcccaaagtgctgggatataggtgtgagccacagtgcccagccttgttttgttttggttttgttttgacagtctgtcactctgtcacccaggctggagtgcagtggtgcgatctcacctcacttcagcctattcctccttgttctgcatccaaacacacagaccatttattttattttattttacttgaacagacagggtctcactatgttgcccaggctggtctctaactcctgggctcaagcaatccatctgcctcggccttccaaagtgctggaattacgggcatgagccaccatgtctggcccatacagatcatttatagactgcatatt

SEQ ID NO: 182593 - DNA, 98 bp, Homo sapiens
attagtagcttattagggatatgggcagatctgtcagattgccctgtctttgccagctgctgtgtgagggtcatgagtagtgacactaagtggccagg

SEQ ID NO: 182594 - DNA, 359 bp, Homo sapiens
ctctggagacaaccaagaggagaagttcaggaggtggccggctgtcttctaggcaacagggcatatctccctcacctaccagagtgcctggcaggtgctcaatcatacgtactgtagcaaattagcatatgtagcatttttttccatagttgtggggaatacatattgatgcagctccattcttatctaattacccttgtgacagagaacataatgacaaattgttagctgaggttaaaattgaagtctagctatgccatgtgcccataagatcatatccataactttagcttcatgaacaccaaaatctagtcaattaagtagcatctagagtagccgaaattcttgaataatgtatt

SEQ ID NO: 182595 - DNA, 726 bp, Homo sapiens
ggaagatttcaatcctagcattaaatgtaacactgtcttttttaaaataaaacctccatttctaagaagttatttgatgagaaaatatttgagaggttatctgatgagaaaatttgaagaaaaaaattttaactgtacaaccagttaattagaactttgtcaaataacattgcctttaattcccagaaatccaatacattatgctcagtgaactgtaacacctgagtttttaaagtggaatacttaaaaaaaaaaaaaaacaaaaaaaaccagccttctggggtaatatctcctctttggaagtttctttttttccaaaattatacttaaaggacgattcttttaatgaataaattttagagttatctcaaggaataaatagaggaaatattattttatttcaaagagaagaatgtctattgtggcaaacaacaaacctgaaataaataaaacgtgacagtctatgaagtccgtgagcctaaagaacaatggttattttactgtcttagaaaagtttaggaagtttggatttgaattcaaactttaatttgaacttataacgtcaacttgaaatcatttggaataaacattgaaaaccttctttgaaagttttatcaaaggagaaagaatttgaataccaagaggatggaaaggttaacttctgttatctgaaatatcttcaattgccttgagccagtttaaaaataaacaagcttactgatatag

SEQ ID NO: 182596 - DNA, 811 bp, Homo sapiens
aactgctctaaaccataaagtttattaaataatagtaacaattgaaaaatagtagagggaatgtggaaggatcaactcaatcagaatttggtgagggcataggaactgaagtcacgctgttccacatttaagcaatgccacatcctgtattttattaccaatgataatttttattttcttattgtctttgaatgcttttaatctttccctttgttgacaaataagaccaatacagttttggtgtttgccatggtttgcatatttgccccctccaaacctcgtgttgaaatttcatccccactgttggaagtggggcctgatgggaaacgtttgggtcatgtgggtggatcccttatgaatgacttaatgccatccttgcggtaatgagtgtgttctctctgtattagttcctgggggagctgattctttaaaagagtctgacacctctctccctgctctcttgctccctcttaccatatgatctgcacacgctggtcccctttcaccttctgccatgagtagaagcagtcaatggccctcaccagaagcagatgctggtgtcatgcttcttgcatagactgcagaattgtaagccaaataaacctcttttctttatagattactcagccttaggtattcctttatagcaacacaaaatggactaagacagtgttcctctaattactgatgaaggagttgagagaatgcctaggtcatattctgggtccaggttatgatcccgaattcaacttggggggggtcaaattctattaggttttcgccaagagagcgaaggcatgctctcgtgact

SEQ ID NO: 182597 - DNA, 221 bp, Homo sapiens
tccaaattgactcaaaaaaaaggagaaaagatacacagaagattatttcccatgccctatggccttgggaaaaaactatttgataacaatttccagcatagtttctgtctccacttcatggggccccagtccagcaaagtcttcctctcaccaccaaccaaaatgatgtctgtagcaaaaaattagttattttaacacctttaagttaatagtttatgctg

SEQ ID NO: 182598 - DNA, 375 bp, Homo sapiens
aaggggaatgaatggcaggggccaggggcaggggagagggaaaaggggagtgagtgctgagtggggacagagtttcagtttgggagatgaagaagttctagagatggatggtggtgatggttgcacaacaatgtgaatatatgtaatgcccttgaattgtacacttacaaaatggcttgcgcctgtcgtctgggctacccaggtggctaaagtgggaggatctcttgaggcgtggagtcggaggctgcagtgagctatgatcagacctgtgaatagtcactagacgccagtggagttcagtgtctctgggagaaacatagcgagaccctgtctttaaaaaataaataaataaataaaataaacataaaaaataat

SEQ ID NO: 182599 - DNA, 161 bp, Homo sapiens
gagctgagatcgtgccattgcactccagcctgggcaacaagagtgaagctccatctcaagaacagttttgatgaaattgtccctagatttgcatctggcatctagctcatatctcagagccagaatgaaggatgcttacctctgggtttggtaaattttag

SEQ ID NO: 182600 - DNA, 443 bp, Homo sapiens
ggcgaggccagggcagggcctgggagccaaggctcctgaagtgctcccaggctactgggcaccaagggcctgggggaccagaagtgtaggtgttgccggctagtggccccaaccaactggcagggggcagggggccagggcatggggggcagaggaagacaagaaaccagaaaacaaaaggatcattttgttcacactgattattttaattttacttttttaaaaaagcatccaagcaattgttatgagaaaaataagtttgttggccttccttgcagtttagtttttaggttggttttgttttgttttgttttgttttgtttttgttttttggtgagacagagtttcactcttgttacccaggctggagtgcaacggtgtgatctcggctcactgcaacctctacctcccaggttcaagcaattctcctgcctcagcctcct

SEQ ID NO: 182601 - DNA, 580 bp, Homo sapiens
aattttaataactgggcattatactgaatcttatgaatttaagcagaattacttgattcttttcacattgctggacctctaggttgcttgtaaattttccgttttccaaatagcactgtgacagactttcttatcataatcttcgtatttctatctacttcttaaaagaagcttaaaagcctatcagtatttcacattcaaatttaaatcacttagtataccagtaaattcaccattggaaatctctgaggacaaaatgcaaataatgcatatgagacaaacaatactattttacgatcacttgaaatctatatttatccttctagaatagtcatctttcagggagcacattatttcctctaggcaaatggactattactaggttaatctaaatgcaataacatgaaacttggctgacccagatttctccaatatcggtatgcatgcaattacaatattctgcagaatgacaaatactcaaggctctcaaaaacacatattttatcatcctttcatttaaaacgatgtacaatggacgctaaaataaaacaaataaagtttatagccaatgaaggttgat

SEQ ID NO: 182602 - DNA, 450 bp, Homo sapiens
tcttggattgcagtgagttgaacccctgtacagaagtgtagaagaaggaaacatcttctagttgagttttagcttctgtctgttttgagctggtgaactcaaattgttcactgaatatttaaattctttgactttcacctgtgaaaatctcctgaatgaaatgagatatttgatcctatttagtgggtcactgaacatgcttctaacatgaaaacattcagctttgagctaggaaggtgagctgtgctcacaatctcaaacagggtaggggagagaagatttacatgttctgtgccctgtgccctttcttggggcctagaggacacattgacttatcttttctggggatagtataaaggaacatcaacttgctcctattttgtgctggagaagcttagagaatcagatgctagttttatactacatccctcagtattaaaagctttaatt

SEQ ID NO: 182603 - DNA, 548 bp, Homo sapiens
ttaatgttctctctgcaacatggttaggtaagaattctggtttcagccgggcgtggtggctcatgcctgtaatcccagcactttgggaggccgaggcgggcagatcacagggtcaggagatcgagaccatcctggctaacacggtgaaaccctgtctctactaaaaaatacaaaaaatgagccgggcgtggtggcgggcgcctgtaggcccaactactctggaggctgaggcaggagaatggcatgaacccgggaggcagagcttgcagtgagtggagatcacgccactgcactccagctgggctacagagtgagactccgtctagaaaaaaaaaaaaaaaaagatttctggtttcttcaacctcttaccatctgcatacagtctttcctacttgtgtttgaggtgatgacaaaataccaataactctagttgtcactattctgtttcctaaattaagaaacaagtcaactttctcccaaatgccctatcctgctgtcttttcccaaagacctgtcatttctcccttctcgcactataggaagatccc

SEQ ID NO: 182604 - DNA, 278 bp, Homo sapiens
gctcagcacccaaaaccatcatttaaaatgcgaccctgcctgggggctgttcgaatcctctattgagataaagtagcaatcatacattcatcagtcactactccctgctggaggcctcttccccagcacagagccttccctctctcagctgagaccccaggcaagggtagggagaagagggtgctgtctccctccccctcctcccctctctctcctctgttcctccctttctctctgtgtctctctctccttctctccctctctttgtgtttctccct

SEQ ID NO: 182605 - DNA, 451 bp, Homo sapiens
tgctcaacagggcttcactgaccccgatgcttatcaaatagctttcagtctaatatcgacacctctgcccctgggctccagggagagatggccagacagccatctgggattccattggccacccccagacgggatgtgtctcagccttggggagggctgcctggctctgccagtggctccagcatgtcccctctcctgggtgctattatgcagacactgctggcagccacaccgaggttccatcctgctgccgccagggtggtgatagcaagctctttaggtggtggccaagactgtcacagtggattatagtcctggccatgtcctaaatctttcataagctctattgcaggcaccagaaaccattcaggaggtggggtgggggagcgaaacaccaataaaagtcacacagatcaaaccgggcaacatctgttaaggcaggaggcaccag

SEQ ID NO: 182606 - DNA, 129 bp, Homo sapiens
cagaaaatacattacaatcctttagtgtttggttatgtccatctatatttatcttacatcatttttaatggctaaaatgactatttttgaagtcaataaataaaaattaaaaaccaaaaaaaggtcaga

SEQ ID NO: 182607 - DNA, 386 bp, Homo sapiens
agttcattgggatttactatctgtaggatcatggtcatctgtgaattgaattgattttacttcttcctttccaatttggatgtcttttatttctttttcctgcctaactgctcttgctagaacttccagtacagtttcaaatagtagtggtgaaagtgggcatctttgtcttactccttatcttaggggcaaagctttcagtctttcaccattgagtgtgatgttagctgtgactttttcataaatgccctttatcatgttgaggaaattctcttctatttttagtatgagcataagtcctttcactctattaatgtgatatgttacattaattgattgattttcttatgctgaaccatccttgcatttctgggataaagtctacc

SEQ ID NO: 182608 - DNA, 199 bp, Homo sapiens
gcgcctctgcattccagcctgggtgacagagcaaggctctgtcaaaaaaaaaaaagaagaaaagaaaatgaattcactattgtactctttctacagtgtctttatgcgtgagctttatctttaattgtgtatgagtttcagctgctctaaaggatgctgtttgtttgaagtgtcttccctccaatccactaaagtaaat

SEQ ID NO: 182609 - DNA, 118 bp, Homo sapiens
gatatgtctgcacagtctccagctctggccactctaccaagctacgcatctcattccagttgccccctagtgccatcacaggaatgctcacattctccacaacccgcactttcctcct

SEQ ID NO: 182610 - DNA, 454 bp, Homo sapiens
agaaataaaggcccagtttccttgagagggtagatgaagtaagatgttggggcctattactgagatgagagattacaggaagagagggtccttccacctggtcaaagtgaatacctcctttgatactatgggttctaatccccacatctcttcagggaccttcttaaagcacgaatttttcctcttcttgtatcttcagcctcacccttttttgcctcccaagtctctgctgctccatgttcactaccatccctcctccagctgctgccttttcctgcagcctcactctgctccaccctggacatcatccttctttcttcatttctccaaagttccactgacaacagattggggcctgctacagacattttcagaaagattggagtattatatgttaattgctactcaaggaaggaagcaacaattgaacctcagacattactattgcaagatt

SEQ ID NO: 182611 - DNA, 581 bp, Homo sapiens
gctagagattggcgcccaatgaatgctagtattaatgaatctgttaacaaaggaaagcttaggacactttgtgtttccccaaaagaatgttttaacttcagacacagaggccacgcagtggggatgtggactggaatggtattgcctgtgaactatgacctggcacaaagtagcttatcagtaatgtttgccaatactgtttttaaagttccagcagccagtcttcagaattgtcctctttcctgtggccatggccatgatgacattttgttcatgaattcatgcatgatttatttattgagcatctacctctgggaacatgagatttgtttgttttctccaagagtgagtgacccatggggagccatgggttcctgtgtccaagaccagacattctcagggagcatctgcttcccccatcaggaaggaacgagctttcatacctagtttaagttaacgaacccagtgagctatgaacagcctccttgccggctgttgttcctccctccagcctgtcctgcccactgcagctagacagagcttcctaaaagcttgctttcatcctgtcacttcttactcga

SEQ ID NO: 182612 - DNA, 316 bp, Homo sapiens
taggactgcttttcctgcatcacatggttttggaatgttgcattttcacatttatttgtcttactccctaatttccttattgaattcttccttgactcgttggtgttcaaaggtgtgttgtttaatttccacatacttgtgaattttagttttccttttgttattaatttctagtttcattgtgttttggtcagaaaaaatatttggtatggtttcaatcttaagtttattgggtcctgttttgtgatctatcatgtgatccatcctaaagaatgttccatgtgtgcttgagaagaatgtatcttctcctgatgtt

SEQ ID NO: 182613 - DNA, 408 bp, Homo sapiens
cgtgagaggcccggagggagcaggggaggtggagaggagctttccccagtggagctggcaggaagagtcccaggtgcaaggagcgcattttagaattccaggactcgggaggaaacctgcaggatgagggctccccttgggggcggcctgcatttctcagcgggaaggtgggtgtgggtgcccctcacatcacctggcgtttatttttgcatgtgtgaaatataacaacaatttcctaggggaaaacaccctagggtgcacaaaagttgtaaaaatgggaacatatggtccgaaactcactgctgaataatgtgctgtcatgaaatttacttcaaaaaccccctcacggagtacaatcttgggtagatgaaggagaaaaaaagtaaaaatgaatttaaaaatctctta

SEQ ID NO: 182614 - DNA, 368 bp, Homo sapiens
ctggagtggcatataactctacattagggctgtcctctctgagtccctgaccttagatggtctttctctattttggcacatatttgcatatcagttacggtgacatatttgataaataatgggcctcactgttttttggccagtgaaaaactattttgctattatcctaactcttagtttctgttattgtcttcgtgtctcaaaatggtgtgcttttactctttttttcttgatttgtcgattgtattatcttctattatggtaggtaaaaatcatgctgtcttaacattcccacatcatttttctcccatcctttcaacagttatataacccaattttttgataattcactgtttacactatttaac

SEQ ID NO: 182615 - DNA, 209 bp, Homo sapiens
actaaatgagataattcatataaaacacttagcacagtgtctggcccgtagcaagacctcagcaaatattagctattattattgttgttaacactgtaccagatggcccacaatactcaaaattaactagaattaaggaagatggggtcataagaggagataaggaattagaaacagaagaagagggcagaggtgggtctgagagagaa

SEQ ID NO: 182616 - DNA, 358 bp, Homo sapiens
agatgtgccacggaaataaccttccaaatactggactctgtcatctgtctgaatcaattcccaaggacggtgaggtcagggcattgttccttcctaccaatgagtgggctgcggaaatgatgtgcagagaacagactcccgggtctcatgatggggacaaaggtctcatgaaatgaggtctgacttgcattggagaatgagaagctcagcaattctgggctcataaataaaccccctatttactgtcaatttttttaaaaagaattcagtctagcattctagtaatgtaacagaacacactagtcttggcaggaacagaagacttcattaagatcaatgttccccactggctgacaga

SEQ ID NO: 182617 - DNA, 356 bp, Homo sapiens
gggggttggtcatataggcatggagcatccacatggctgactttactcagtccccagcctctccagaagtcaaactgatactatgtggcccaaggctgcaccgtaactcacattgttagcataaactatttggaatggcccaaggccccagataaagaaagacactcttatcaggcagactattctacatgtgtaccctttgtttaactcccacttataagtgagaacatcagtatttgactttctgtttctgagttattttacttaggataatggcctcaaattccatcaatgttgttgcaattgatagaatttcatactcgttatagctgagtagcattccatggtccatatat

SEQ ID NO: 182618 - DNA, 220 bp, Homo sapiens
ctgtaagacctatattcacctcatggtgtcatatcccaattacagtttcagttgttttcaattgttcagctcagtataagatcagagagaagacaccataaataagtgcacaatatactgagtttgatagaattcctcatggtccagagaagccaaaaatcagagattattcattttttttatttctaagataaataatatatgtgcttttttttttttt

SEQ ID NO: 182619 - DNA, 593 bp, Homo sapiens
tagagacagcagacccaggttttctgactcacgtcacatagaactacccctagagaagaaaactggatcctaggcatgagtcctctaaggcttgcagaaacactgagccagtcaggtacggtggggagaggggccaaggggactttggctgaattgccttctagccctgggttagtcagagaccctggcaaccggtagatactggctctcagccagggacacacatcagagtctcctgtgacacttgctaaaaatacagaccccccacctgggatctgctgaatcagcgcatgggcaggtgggtcaggcatgcatgtgttccaaatgctccttgtggctctgacaggtgcccctggagaagagccaggtaggcacagcagtggccccaactgcctgttttgccccgagcaggaaaattcctcttggtggtcccgttttactgtatgttaaagatctgtggctcttcaaggggagtcctaaagttttcagagtaaatggacagagtaatgatccatccttgtttacccagtaatggttacagccaatatttatagagtacttgccataggcaaggtactattcctagcatttta

SEQ ID NO: 182620 - DNA, 128 bp, Homo sapiens
tcatgcaaggtttaggagcatggggcctgggtcagacagaactcatagtcttctttctgtgtgacctgttaaggtgattaattccctaagcgtcatttttctcatctgtaaaatgaagtacctaaaag

SEQ ID NO: 182621 - DNA, 706 bp, Homo sapiens
atatcttacttagctagagttgttggatcttgagtgtgatctgtgatttctttttttttcttttgacattaccagggcctgctaattttgtatttttaatcctccagcattcatcttgctttttcattccttccgatgaaaccattcctaatcattatgacccctaaattgtaatcctaagtagcctccccggccccagtgtttcctacttgcagggcatcctttcagagcgttttgagagcttattctcaaaatcggctcttctccaatgctgctgtcccatgtcagcagtgcccagcgtatgacagatgcagctcccttaacacacacaccagacccttgcccagctcacgctaatctgcttccctgatgccgatgcttgctggctcctggtacggacctcccggggctcttctcacccagctctgtgtcacccactctgctgctgcctctttcaggcccctgagcacgttctggctcattgttttatttggcaggtttttattaaattcttctgtgctaggtactgttctaggctctggtgatgagagtcactgcccccggcggctaacaccgcagtgacatcttcatggaaagtttcctcatctccatcctgcctctcactgcgctctgcgttggtctgaatttgctgattactgtctgctgcctggcatgctgtcctttcaacagtgtgtgtcttcctctt

SEQ ID NO: 182622 - DNA, 518 bp, Homo sapiens
gttggaggcagggggtcttgctggggatggtgtgcagagggtggttggtgcaggtaggaagaggttccaagcaccttgttaggcttagtttctgtgctattatcttagggctagacttttgggaggggttgtacttgtacttcagtttgtatgtgggtcatgtttgcaccatagcgggtgtggttattgacaactgtgtttcccggtggttccccttccagcccatgctcaccagatgccattagcaagttgtaccttctctaataccctgaggtttttctgagaaggctgcagaaataccccctagaacaaagaagtcagcaaaaacaaaacaaaacaaaaaacaccacttaagggtaagcacacaaacacatacaaatataaggacatacatcataggtattgtaatgttccaatcccataattttggaatgattacataggtggaatacagaagtatccctgcttttcagcatgactgcccttgatgactcatcaaaaaacagcagtgctagtca

SEQ ID NO: 182623 - DNA, 388 bp, Homo sapiens
agtaccagatactgctaatttcaatttaaacaggagacacaggggaagcttttgtgagagtggctaggaatcacacagcaaaactaccaccgatgatgtgtctatttatgtaccttcatggtcttaactgaatgagagcaccattggttacaataccccatgataactctccctacttaggtttcagacctcttaggttaagccttactctttttcttttgttttgttttgttttgctttgcttttgagacagagtctctctgtcatccaggctgaagtgtaatcgttccatctcagctcactgcaacctccccctcctgggttcaagcaaatctcccacctcagcctcccaagtacctgggattacaggcacccaccatcatgccca

SEQ ID NO: 182624 - DNA, 490 bp, Homo sapiens
tcacgcctgtaatcccagcactttgggaggtcaaggtgagaggatcacttgaggccagttcaagattagcctgggcaacatagtgagaccctggtccctatgaaagaaaaatgtttttaatttagccaggcaagatggcatgggcttgtagttccagttacttgggaggctgaggtgggaggatcacttgagcccaggattttgaggtggcaattagccatgatcatgctactgcactccagcctgggtaacagagcaagactctgtttctaaaataaaattaaaagtaaacaaataaaagtaggtgcaaaaaggtcatgaaaaaatttctccagaaggctgggcatggtggctcatgcctgtaattccaacactttgggagggtgagttgggagaatcacttgacaccagcagttcttacctgcctggacaacatagtgagactctgtctctattttaaaaaaaataaatacataataaaaaatataaa

SEQ ID NO: 182625 - DNA, 175 bp, Homo sapiens
acttgtgaggagaacatccaaaagaaagagctgcaatgctgcctgtgatccttcttctatgtacacatgagcaacgtcatactacaaaagaccatccatttggtcaaactatcttttttacacacattttgataatacaatatcttaggccttctagatatgctcagattcaaat

SEQ ID NO: 182626 - DNA, 262 bp, Homo sapiens
agctgggactacagacacctgccaccatgcccagctaatttttctatttttagtagagacggggtttcaccatgttggccaggctggtctcctgccctttggtgatcaacctgccttggcctcccaaagtgctgggattacaggcatcagctaccacacccagccgttgcaccttgcctgattaattccacttggctctagctagtatctggaaggacacctgggaggaacacttcaaacagctgtcagtgcagtgttgttg

SEQ ID NO: 182627 - DNA, 304 bp, Homo sapiens
gggtctcgctgtgttgcccaggccagtccgggcaatatcttgtgtgtcaggcccctgtgtagtgggtgtgctgacatacaattctggcagcattcactgcaacctggacgtgggggctgctcactgggaccccacgcagtcctccctcctttcccaaggggtggtgttcactcagagacactcagctgatagaaagagagctctgttgtctagacacaggctgtgccccaaaactgaggaactaggccgggtgtggtggctaacacctgtaattccagcactttgggaggccaaggcgggcgga

SEQ ID NO: 182628 - DNA, 338 bp, Homo sapiens
agataaggttaaatcttagaggtcaacagtcatggtttcaaatctcaagttcatcatttatcaactatgtgattgtgggcaagtcacctaaaatatctgagcttcattttcctcatctataaaatgggaatcaaaacagaacccacctaatgggtttgttatgggaattaaaagagagaatgtatgaaaagcgacaatatagtgacagaaagtgggtcagtaggtagttactatggttagtaaaccagtgtgagtcatctgcttttgttgaaaggtagatgagatgcttgtggccatgtgggaagaattaatttaagaatctggtcattttactaagg

SEQ ID NO: 182629 - DNA, 501 bp, Homo sapiens
acctatcacctaggtattaagccctacatgcgttagctccctcccactgcccctgcagcagatcccagtgtttgttgttccctccctgtgtccatgtgttctcattgtccagctcccacttgtaaataagaacctacggtgtttggttttctgttcctgttttagtttgttgaggataatgacttccatgaagcttgagttttcattctacaatttactgaatgacatttgagcagctagctgactttttaatgccttgattttaataattcaatgagttattgggtgagataatttagaacagcatacatgatatcgttattattagtcaataaaatgctatttatcttatttattactcataacaaaaatatgtatatgacccttcgctatgtttgaatatgtgatatattgaattgaattcactgtgaggcttcagtaggtacctataatattcaaatatgttacctgaaagctgtgaaaaatatatttttaaaaatt

SEQ ID NO: 182630 - DNA, 386 bp, Homo sapiens
tgtggacctctactactgtatctagggtgcaatatggactgcttgtggaacatgtggaaaagaagtagttcttgacttgtgaaggatttcggtagggagagagaaacaggaaatgcatgcctggcaggggggcatctcaagggttattgtggatgcagaatgagtgtagcatttggcatttcagcatggctcaatggatgggttggttagagaggcaagcaggcccggattatcaaggaccaggagtgccaggccaagtttgtatcaactctgcgaatactgggaaacacttaacatttcttagcaactaagtgattcatgaagaaagcctgttttatagaaacttagtcatctgacccactgctgttaagattttagaagggaga

SEQ ID NO: 182631 - DNA, 635 bp, Homo sapiens
ggtgggcggtcctccatacggggtgccggcatgacgttgacaatttcttactttactgagtcaagacacttttaaaaaagcaattaacatctgttatcacagtaatttcatgtacaaacaaacaaagtttctacacctaaaaatcaaaaaagcccaggaggggaaaaataactcatgtaaaaggaatgcttttagctagctttaggaaaagctaattacattatttgggacaggggtaatagatgaaaagggttaccagaccactatcaattttatctcagaccatcatcagtccaaagacctgaatttgggaaacattgctttgtgttttaaagaaccagcatttgtactgtgttctatggttgacaaaaaaaatattgcacagatattttatttaactctaagaaaaaaaaaactgcccagagaggatgatactgtctatttaatccaaaaaaaatttaagcttagcccaaatgcctggaaaatgacaaagccaaaccttaaatcagaatctctggccccaaatatcaaggtctttccactacttaagccaccattcccttctgacaaccaacagggcctattcaaccagctctgggcatacacactaatgatgctctttcacgcctgttcaa

SEQ ID NO: 182632 - DNA, 535 bp, Homo sapiens
ctaatggttctcaaagtgcggtccaaggtcctcaagaggtgaggtgaggtgctaggattttcatgctttcagcaaacagcacatcctaacagattgaatgcagaagaagagaatccagctgtcttcatttaagccaaacattaaagagatctgaaaaacaatatcgtacttccacattttttgggaaaaaataagttatttttctttaaaatgtgttctgttactagatagtgggtttattactgtttttaagtgactacgtttttgtttgtttgtttgtttgtttgagacagtctcattctgccacccaggctggatggagggaggagggaaggtgctcagaataaacattcaatgtccctgagcattcctagatcaaccggatcaggatctctgaaggatggggctcaaagattggcatttgaaagaacacccgtggggatcctgatggtgcaataaagttgtagaaccacctcactaagtgctcccaattccttttacaattctctattattgcaatttaatcctttcactt

SEQ ID NO: 182633 - DNA, 300 bp, Homo sapiens
cagacccctgcctttgtgaaccttttcttgaaggaaagagtgtgggttggggccacttccagtggaatcaccaggaggggagtggagggaggagggaaggtgctcagaataaacattcaatgtccctgagcattcctagatcaaccggatcaggatctctgaaggatggggctcaaagattggcatttgaaagaacacccgtggggatcctgatggtgcaataaagttgtagaaccacctcactaagtgctcccaattccttttacaattctctattattgcaatttaatcctttcactt

SEQ ID NO: 182634 - DNA, 499 bp, Homo sapiens
atggtgggagttcagctcattgcaacctccgcctcctgggttcaagtgcttctcctgcctcaacctcccaagtagctggaattacaggcacccaccaccatgcccggctaatttttgtatttttagtagagatggagtttcgccatgttggccaggctggtctcgaactcctgaccaggtgatccacccactttggcctcccgatgtgctgggattacaggcatgagccaccatgcctggcttctttttccttttcataaagtatgggacatttaaaatttgccaagttttgcttgaggaagttagatgttgtgcagtggttttgcagcatgtattttggctcttgggcaatgacgtttcatttgcagaagtttagatgttgattgaaaatcaacagctgacgttaaacaaactggtttgagtaagatacaagcaaggagctcctttcacagaaagggacagttctgattcaagcttggagctctcagctgtacctcag

SEQ ID NO: 182635 - DNA, 387 bp, Homo sapiens
tcatctattaaagccatcttttatattaagaaatgttctcttttctctggatgaacgacctctaatgaaaattccaaaagtaagcacactgctggtatgtgtgtgtgtgtgtgtgttagtattttatttagcattttttaatttgagcattttactagattggtctgtattatattttcttattttgtccatgcctgtttttggttgtaaaaatttatactagcctaaaaaaaatgaatcatgttgtagtttatagagtttttacaagatcagaattatctctttcataaggtagagcagatactgttaatgtctcactaataagcattctcccctcatttctcagcaatagatatctatctagacatatgatcactcagtataaag

SEQ ID NO: 182636 - DNA, 306 bp, Homo sapiens
cagatttgaggataagaagcatacctctgccatattctaatgagatgatactgaatagttatttaatcttagagtgattatactatctgttgtccagtttgggacatagtcacttaagttcttaagtaagaggagaggggctgctaatattaagtattccaggccaaaaatataaactgggactgccctagacaaggatcacctttctttttaaatttaaaatatatataacaaaaatttcctcttgtaatcatttttcagttaagtggtacagtttggtggcattgagtacgttcatattttttg

SEQ ID NO: 182637 - DNA, 278 bp, Homo sapiens
gaagggtcaaggctgaaagaatatttacacaagaactccagcagggaattaaaatgtaccgtatgtttttgcctttcaaagcatgattccctttcctgtttttgttattctgaaattaaaaacatttggccggtgtgccaggcagcaaaagcagcagacagcctaggtcaccaacacccctcatgccatgccagcagaaggcaatcaaaacatctctgacttcagatcatggctaggctttgggcttgacaacaaattaatgtatcaccattacatat

SEQ ID NO: 182638 - DNA, 480 bp, Homo sapiens
tcccagaaacatcaaggtttgctaaaaacagaaaatcggaagtagaacaaaaaaagcggtgggaaaagcatttaagacattgaggcaagccgtgaggagtttgtcagtctaaaggttgagtagaggacctttaagaagagggagacaaacattaaattttcaactttctgtagtttgatataatactttccaagttctagggtttcattaaaacttcacaagcttttggattttttaacaaatattagggctgtgcttcatgcttgggttaatatggggtgaatagaaggaacagctggggaagaagagataagagacagattctctagtagaaattaggagaaacgtaagaatcctatacatctgcgtatatttgaggagtctttagagttcactgaagttcatggatcggacgttatagccattttaatgtattttcattgtgacaggattgactttagaaggcttaagaattttgac

SEQ ID NO: 182639 - DNA, 436 bp, Homo sapiens
cagtggtaacaacgcagagtacgcgggtagttttcctattgatttccaaaccctctttgtaagacaaggacatcacagtgatttaagatttctttggcagagttcttcacactggactgaagctgagagccttttggcagggatatcggctgagaggaggctgttttaaatcaatcgcaagttgagaagggctccaaatagggtcatatcagaggaataagaaatacattcaaggactctggtgagagacttgagataaattgggatgaaggaaagaaaggacaaagatgaactcaaagtttctaacaggaaacagaaagactggaggtaaccctgatagactggaaagaagggccaatttggaagggaagatcacaactcaatgttgtagatggtgactctgaaatagtagtgcatcttcaaaagaagatgattt

SEQ ID NO: 182640 - DNA, 472 bp, Homo sapiens
gacacacagaggcagttgctgaggccacagggagctctggggctgggaccgcctttcagagctatcctgaaaaaggcaagggatggccctttaaactatcaccccagccagggattggctagagactccttctcctgtcttccctgggaggggccataaccttgggccacgcggtacctgcagcagagagtggttctcagtgagggacagcgtcagcagcagctggtaccccagccctgaagagggggcctgccaggactgtgtgaagcattcgagaactaatggagaaccaaacagaattgcagcccacatggggctttggggctatatttggtctctgtttacctatttggtctctctagccagcttggcagcttccttgggtcagaatgttctcattagaagagctcatagttggtgcttaataagagtctatcggatttcatgaccagtaatgcacccaggtcccttt

SEQ ID NO: 182641 - DNA, 544 bp, Homo sapiens
tcaaagtgtgagatactggcccaggcacagtggctcatgcctgtaagcctagcactttgggaggctgaggcaggaggatcgcttgaggccaggagtctgagaccagcctgggcaacatagcgagaccctgtctttatgaaagaatttaaaaaggaaaagaaagaaagtgggaggtattggtgttaagtccattctttatcaaggaggcgaaattgtacatttgaatgtcagaaatccacaattgtctctttttctttgtgttccctctgtagcaaatcgcagtcttctccaggctgacaaggcgaagggcatggcttcgaagtgcaaaagagtcatcatgaaacatcatgaatcatgaatcattaggcgtcttcccttcgctccccacttttttttttttttttttgagactgagtctcgctctgttgcccaggctggagtacagtggtgcgatcttggctcactgcaacctctgcctcctgggttcaagcgattctcctgccgtagcctcctgagtagctgggattacaggtccccgccacca

SEQ ID NO: 182642 - DNA, 472 bp, Homo sapiens
tcgggggtctttttgggggtcccccccaaaatggggttccaggggggaattccttttcccaaaaaaaaaaaaaaaaaaaagcaagaagtaatgctgtcttacattaacttataagtatttaccttatctcattcaacccttatagcagttcattgagatagatattatttgtgttaaactgtactgccacattaaaagcatgtgctcagtgtctggctgctgggtttttttaaatcttgactctgccacttgcactaactgtatgacctttggtaagttcctgacacattctgtgcctcaatttcaccattcttccaagtgggaataataatagtacctaccaccacaacagtatgaatgatgcatgtaactagtttaaagcagtggcacaggccaggtgtggaggctcatgcctgtaatcctagcacattgggaggccaaagcaggcagatcgcttgagcttacgagttcg

SEQ ID NO: 182643 - DNA, 864 bp, Homo sapiens
cagttattagagtaatacctttaaagtgattgtggcatattgaaagtcctcaataaatgccagtttcctttctttccttaaaaatgaaaccgtggaatttcatgctcattgaggcatcctgaaccatagaaaagcgctcaaaagcctaacaaatgaaagagcaagaagtggccgggcgtggtggctcacgcctgttatcccagcacttcgggaggccaaggtgggtgggtcgcttgaggtcgggagttcgaaaccagcctgaccaatgtgctgaaaccccctcctctgctaaaaatacaaaattagccgggtgtggtggctcatgcctgtaatcccagctacttgggaggctgaggcaggagaatcacttggacttgggaggtgcaggtggcagtgagccaagatcccaccattgcactccagcctggacaacaagagcgaaattccatctcaaaaaaaaaaaaaaaaaaaagcaagaagtaatgctgtcttacattaacttataagtatttaccttatctcattcaacccttatagcagttcattgagatagatattatttgtgttaaactgtactgccacattaaaagcatgtgctcagtgtctggctgctgggtttttttaaatcttgactctgccacttgcactaactgtatgacctttggtaagttcctgacacattctgtgcctcaatttcaccattcttccaagtgggaataataatagtacctaccaccacaacagtatgaatgatgcatgtaactagtttaaagcagtggcacaggccaggtgtggaggctcatgcctgtaatcctagcacattgggaggccaaagcaggcagatcgcttgagcttacgagttcg

SEQ ID NO: 182644 - DNA, 357 bp, Homo sapiens
gaaaccaatccatgtgagcaatatttactgaattatcttcaacaggtaaggctacaatcaagacactatgggcagaacaaagatatatcagacattcagtccttagaaggcaagcattttcatgatcagatatgtatactttttaccttttccccatttcaggtacatgacaaagaaccacagatccaatcctattcgctccacttcctcacttaagatcacaaaactagagaaagacagaatgggtctttctaaaattcaaagcatcattctaaaaggagagaattttgacgaaggcccttcaagccctttcagaaagtgaatatggagaaattaatttactgtgtgattggtgga

SEQ ID NO: 182645 - DNA, 194 bp, Homo sapiens
gacaggaacatccctctctttagctagactgaggtgccgggcactgtcctgtgggctgcccatggaagaacacaggatttctgttaatcccacaatacctgtgatgtccaaatgatggtccccacctgacagcccaggaaaccaaggctcacgctgagtaagaaacaagaccagatccaaatatacacaaaggg

SEQ ID NO: 182646 - DNA, 387 bp, Homo sapiens
gaaagtgaaaatacggtttttagttggggtgggatggaattgtgatactgtagttggtagagctgaaaatgggtttgagaggaatggagaagaaaatgactttgagtttaaaccatgtttgagattccttcagaagatctactagtagcagtctactaggtgattgagtttgtggatattggccccagagttagactgctagagataagtagacttgttttatatattgggttatgggagtttaactctggaagatgatgatgttggggctggggtgctaagagtatagaaatcagtagtagagaattagtagagtaggatttgtggaagccaagggaaaaggggacatttctaggtgactagagtgattgccagatttatatactg

SEQ ID NO: 182647 - DNA, 244 bp, Homo sapiens
acacacatacacgcacatgggtgcacacgtgtacgcacccacattcacacatgcacacacatgcatacatgtgcacacattcacacgtgcgcacatacacacattcacccacacatacatgcgcacacatgcacacatacacatgcatacatgtgcacacacatgcacacacatctacttccaaatacgctgtgtatcaccttccgtgatctgggcaagggaattaaactcatgggctctgggt

SEQ ID NO: 182648 - DNA, 114 bp, Homo sapiens
gaggcctgagggcaggtcgggaggctgcagctggcccacggggcaggggctttcctcccagaccaccctcctgctgacctgcagcaggagctgacctgcagtggggagattgct

SEQ ID NO: 182649 - DNA, 379 bp, Homo sapiens
cagtcataaattaaatattgctcaagatgagagtggacttaagacaatcacactgacaagaaaatactaaaaagctaataacttaatcattgaaccaggagtcagaaaatctctgaaaaaccctaaacatcagttgcagcaaaggagcaacatgaggccatttagcacgggaacactcactctgtattagcctgtgcaagcatcgattcacagaagagcataacagatacatatgaagatgtccctgagtcagccagaaaatgtttgttacgctcaataccagtctggttaagtaagaaatgaggtaatgcattttagaaatatttctgtcaaaatggttaaagttaaaaattggggtgtacataaaggagacaagcct

SEQ ID NO: 182650 - DNA, 451 bp, Homo sapiens
tgacttctcaaatctgtaaaagaccgatcgaactccccactttgtcttgcattctttacctccctgcaaaatgtttcctatagaaatcctttcaccaaaagcctaggcagtcaatcaaaaaagctttggaagaaaagcaaaaatagatggtgaattgtctatgaattctaatcactgcaaacatttgagaaagagggactgtggattctgtgaaaaaaactggtatacaattatatcatgtttcttacaaaaaaaaatgaacatacaaaatccaagttgttctttatgcttttagcatagttgatggagctaagatggctgtgcgggctatagtgggtcatctgtttctgcattctctgcaccggccttcatggctggaatgttcattttccttcatcttccccacagctcatgactcccccaagacttggaatcatgtgttcccctctca

SEQ ID NO: 182651 - DNA, 687 bp, Homo sapiens
gcgatcctcccacctcagcctcccatagtgctgtgattacacacatgagccactgcacccagccattttatgacctttacaatgctggccacccttggaaattctattttatttctctggcgtttctctactggaggtccattcatgagagcaggggcacagtctgtcctgctcagagattttctttagcacccacagcagtggcgtgtagtagaaatagattgagtaaatgaatggatttcgagtgtttggtgcttgtagaatgaatgaatgagttatacatgactgggaaatggtgaataaatgaatatgtttttagggctttgttggctggaagaacttttttgagggatttataagaacatggtaggtgtttgttgtgtgagtgaatggatgaatggatgcattttaaggactaactagttcttcctggataaacaaatgacttgtacgtgcccagaaactgctgagtcactggatgcatgcctggaggagtcctcattccacctgggccttagagaggaaccctcggacttgatgccacatccctgagccctccagagtgcttgagccccacttagcctccatggccgtgactagatcatgtttccctgaaagggagatgcttggagcacatcagggcagccctgaacacccagggggtccctctacctctaagcaaaggcc

SEQ ID NO: 182652 - DNA, 375 bp, Homo sapiens
aactgagtgaggtcctgtctcttaacacaaacaaacaaaaacctttggacagcaaaagcccatctcctcttctcctcaggcacatggctgcctggctggggactacatttcccagcctcccttgaggttggctgcagccacatgactgggtcctccccagtggcttgcagttggacatgacttgcgcaatttccactttacctgctttcaaggaaatgtcttgctctgaactttctcttttttccctttcaccaagtcactcagaggtggcacattcaattatgcaaatgctgacagagcatgaggtcagtggctctcaaagtgggcatcagaattccctggagagtttgttagggcacagttttctgggtcctg

SEQ ID NO: 182653 - DNA, 401 bp, Homo sapiens
tgctgattgacattatgacaaaacaatattagcataaactgaggacttctgtttagctaatgacttaaattgaatacttcaactcagcaaatcaagaaacaaatgctttacagtacagaaaatgatgtctgtgaacatgcatggaattcttgaaactggaaactgccaaaaagatttaattaagtacaagaatgaattctagcagaaaggtaatacaatttttaaaaagcagttttatatcaatttaagcaattcaaatgttaaataaaatattaatttgcaaaatttaaaaccagttctcatatcacaatgctacaatttattgcagactgcttcacacatatgttgcttttatttataagtttgaacaaaaatcttcaagttaaatatgtataaatctg

SEQ ID NO: 182654 - DNA, 539 bp, Homo sapiens
catattcattgatcagcaaaaacagtagagctttatgtttgtccagtgacttaggaaattgtggcaattatattatactccgctgataaaattgaggatgttaccagcttgaatataaattactaaagtgagagcaaaccattttcaatgttctgtaaaacagagtaatactgatctgcctaggtaaatttttttccctaggagcttctgatgaaaaattgtagcaaaggcagagagtagcaatgaaatgatagagcggatgctgggattgaaatgtgtttcctctttcagtctactttttaaaaaggggtttatttttcaataaaagaagtttgcattgggggaaggggacaaaaacaattattttcagtttctgtactaagttaactgtgattaacattttggggtatagatgaacatttttttctttggatacacatggaaatgtatatacttttaaatgttttttccctaactgtgatgatacaacgtatgctcctctgtttaaagttctgtttatttttatttggcatttattg

SEQ ID NO: 182655 - DNA, 594 bp, Homo sapiens
agttcaaataagcctgaactcagcatattgaaatgattacaacttaaaaagttgtggtctttatatgggcacttgcttctattttaagaatggatatccattaggcaaatttaaaaaattgaaaggcttcatttgaaaatcagacttacacatgtgtcccatatactagtaattttttattttaaagtcaaatcatattttaaaatagctattgggtcttattaatttatttaataaatcaagtccaaaactgttataaaaatagcagtatctttgaaatagtactttaaggtaatgtatgttttggttttgagttgcaaccaactttttcttgtactgataatttagtcatgaaaagaaaaagctcaattttctaacgtttctaggcatccttgacattttaaatgtaatgaaatattcttgcaatccatttccaattacagaaaaatgtagaaaaacatatagataaaatatggaaacagtaattttatgtaagtaacatgatattgtaaatgaaaagttgttagaaaagaaacttatatttatgttttctttactatttctacaagacactttaggaaagcttacaataaa

SEQ ID NO: 182656 - DNA, 519 bp, Homo sapiens
ctcggaaccttggggtcaccacctattgtcccttggagaatccacaggtctccagcccaggatgagggctcatgagggccacaccacccagcctccagggcagctgtcttcatcctcaaagcatttcaacccagggtcctgggactgtcattctatttctaattctacaatggagctaagtcagaaagcgtgctctgtttgaagggcagcttagcattacagatgtattatatgatctgaaccctggggaacatctataaagtggggacgtcccagagacctgcggccttttccacctgagaaggtgcctcagccgattcaaataagaggatgttcctgtgttcccttcccaagaggatctaccaggaacttcagcgacagctgttcccaggacaccctttattttatgctgggaggcatcgtcctccgtggaccactcatttggggttagctgcctgtagaaccgattcctgggacaaacccgttgtcacgtatccacagaatggaatgctgcatgag

SEQ ID NO: 182657 - DNA, 915 bp, Homo sapiens
ggcctatgcatatattgttttctatttttaccatctgtggtttagattactggaagtaatattactaagtcaaagagtagatagtgtatttttgctgggtattgctaaatgaacctgcatagaaggtataccatgtgttagaaatgcttgttcctcggtgctgtaaagaaatagcacttgaacattaatttcctcagcaaggccatttttactttctgcagaaagggtacacttaccagcagttttgccatgagagtacaccgaacaaaggagacagggtcatttataacctgacgcatccaccctactgctgtgtctggtttccattggctggaacgggacctcacattctgtatttgtcccgattggctagcaacttagaactttttaaaagaggcaaaggcagaggagaacaaaggaaagaggaagtaacttgtggaatgctgagaaaggtaaaaaccttcaaataaggaagaggaacgggctatgacctaatgcttgcttggactagtaaaagcatgccagggcagatatttaggctaaagtgtgggagctaagaacataaagtacattgatttctttattatggctagcagatatttaagaatgttagcacaggtctttgaataaattttgctgctaagagaagttactatttattcctaattagatggggaggaaagtttttgaagaggaaactctcctttggtttttacacatgtatgaaagcttccctacagcctcactctcagaatatgttgtcaagcttttggattttttcagtttgatcgggtgggaaatgatatttcaatgtaatttaaatttgcacttctcttagtataagcaggtttgagcattttttcatatagctaagaactatttgtgtttctgttctgtgaatggtttgtaaggttg

SEQ ID NO: 182658 - DNA, 384 bp, Homo sapiens
tttatgggctcccatcactaaaaagtctagaggtagtcagtttcaggcaagctggatccagaggcttaattgatatcatcagaactaggtctctctccctcaatctcccctcagctctgcttttatgtgtgggcctcacagttaggtgggattcctccacatggtggtgcccagactctcttaagtttataccctcctggtttaagcccagaagaaagacgaatgctcctttccagttattcaaacaaaagtcccacaaatgtatttcactggatcaaattggatcacacgccaccccagaaccacttactgtggcagtgattgtagtgcactgattggctaagcctgagtcacatgtccctccccttcccgtggagccaggaa

SEQ ID NO: 182659 - DNA, 555 bp, Homo sapiens
tggaaaacagtattgcggttcctcaaaaaattaaaaatagaattaccatatgatccagcaattctacttctaggtatatacccgaaagaattcattggccaggtgcagtggctcactcctgtaatccagcacttgagaggctgaggtggctggatcacctgaggtcaggagttcgaaaccagcctggccaacatggcgaaaccccacctctaataaaaatacaaaaattagctgggtgcggtggcacgtgcctgtaatcgcagctactctggaggctagggtgggaggatcgcttggacacaggaggcagaggttgctgtgagccaagatcacacctctgcaatcctgcctgggggcgacagagcgagactcaatctccaaaaaaaaagaattcgtaactccattattcacaatagaaaaaaggtagaagctatccaagtgtccaccaacagataaatgagataaggccaaagagatcaggcaagtggcctttaagtgcaatggaaagccactgaagaattttaagagggaacataatccccgtaagtcatattt

SEQ ID NO: 182660 - DNA, 276 bp, Homo sapiens
ctacaaaaaatacaaaaaagctgggcatagtggtgtgcatttctggtcttagctactcgggaggctggggtgggaggatcgtttaaagccagaagtttgaggctacactgagctatgatggcactgcacgctagccagggtgacagagtaagaccctgtttcttatttaaaaaaaaaacaaagggagaggggcaaagtgctgggattacaggtgtgagctcctgtgcccagcccagatgcttggtttacggtttggtataaatgtacccacagtaa

SEQ ID NO: 182661 - DNA, 540 bp, Homo sapiens
tatacttcaagcttctaaacggtgagacatttctgacaaaacactgccccctttggccacagtgcccttccttcgggtcccccttggccaaacacttccaaaggtcaatatcctcagtgttatcaccagaaccagcacaacttccaaatcatgaattcaaatatcccactatccaaccacactctccctttcccactcatttgtttaaatgcctccttgaaactcagactaccaattcacagatcctcccaacttggccttccctctctgcatctgcccccactggcttgactttgtttttttttaaattcagcttagattccatcatgacaacagcttcctttcgaataacctcaagtcccttgtcactctctgagcaacagacaaaccgaaccatataccctcaggcctgtgctcatacagcttagtattgctaaagagaaaaaagatatgggagcaaatcggagtcattacccactgattattcccaacctcaaatgggcctttgccacctggccatcctactactctccagcaagc

SEQ ID NO: 182662 - DNA, 228 bp, Homo sapiens
ccactctagtcattagtccagtgattaatgttaaacagttttacttataggatgatcttaatagattttcctttcaaagataatatggggagaattattttaccgtgtgtcttttgttcagaattgtatctgacacatttattttatcttatttttacttttgtcttaaaaatgcatacttagtcttcatttttacaataaagttatttttattaaatggaagagtgg

SEQ ID NO: 182663 - DNA, 287 bp, Homo sapiens
gaacaatttccaggagagcccacactaacatcagtggtcagaatgagggagggtctgcaatgtagaaagaagagcatggagggatctggaactgtcattctggattcttctatagtacttgaagtgttcacagtatgtgagtattcatgctttaattatgttatttacttaataaaagttgtttgactcttcttgttaattcgtatttagatatctctggactttatgacgttttgaaagattgttacgtcaaagtttatcatttcattgttgaagaaagataacta

SEQ ID NO: 182664 - DNA, 395 bp, Homo sapiens
ttgagggcagtatttggactttgatcctgccttggcagcagctacagtgtgtgtgtaaaagaatcaaaggtataactaggaacagtggccagaaaactggccatgctgcagtaaaagtgattctggtccttgtgcaagtgatgagctccttcaacagacatacacgcagcacactaggaatttggaggtcccattcaacactagcacaaggcattctaagaactgccaggaagactctaatgtatctccttaagctgctgtcgacagcttgcactgtctgaccccaaaatattaaaaggaactaaggtcctttctgctaggtagtttatcaactatggttcccttcttttccatcctcaaagccacagcttctgagctgttttcttttattcact

SEQ ID NO: 182665 - DNA, 283 bp, Homo sapiens
ccctattaaaaaaagactaacagtagttaataaatcactaaaagaaaagagaaactatagtactgggattctgatagctcatgggtcacaactgggagaaaaataaaagtagattcattcagcccttaagaaggactgagtagagcaacaaattccctgtgatactccccaaactctaaggcacaatcctattcatcctaaatatacttataatagtaaatagatactcacagaaaaagtccacattttctccaactcctagtattagagtttcagaacctga

SEQ ID NO: 182666 - DNA, 526 bp, Homo sapiens
tctcattgatctaaggtaggtacggttgttattcccttcttataggttaggaaactgaggctcagagagattaagtaacttgcccaatgttacacagcttgtaagtggcatttctgtttaaagcttcccattttataaagttttgtgtttttaaatatgctttagaattttaagtttttactctgttattatttcgcgaagtcctatgtctacatacacatcaaagcaattctgtggttcttagggaattatttaataaatgaaatagccatagactgtaattacattatgagtggcatcttttagctgtgcccagcggtagcccagttgctaatctttatcccttgagtagtcaagtagataagaagtggataagcaagtggagtggtggccactcaagcaggcctccaccagaataattccaaataacttcacacagtgaattgcaacccactcaatccacttcactggatagcattgctcaaaagatattcttttactcttttatctaccttgttggcaagca

SEQ ID NO: 182667 - DNA, 438 bp, Homo sapiens
caagaggtaaaatatctaatcccaaattaacttgtgtagcaaggaagctacaggatagagagcagagtttctatactcttccattaactcctctggaaatacaaaagacaggacacctggaacctcccagaatgaactaggtactgtcttgggggagtttgggggctttccatgcccacgacaaaatgtaacatctggatcaggagacaggaaaccaaataacaggttctcctctcagccccaaatgagttataactgtaagcccgtgcatacaactttagagtttgctcagcagaactgcccctagcagttggcactcatacatagaaattactttatagagattttggctaaggcctgacggtgttcagagctcctgattgaggttgcgtaaacccaccgagtgtccaagaagcacaacagaacaggccctcacat

SEQ ID NO: 182668 - DNA, 381 bp, Homo sapiens
gttcgagcaggagggagctgttgcgggcagaaggcagccggctcagggagatggggagtggccccagagcaggcgggggcctggtgttttgggctctggcataagcatgtttgggaatcacctggtgtctgcacagagaggtccctctggcacagcccactatggggcagatcagagcactcatccaggccctgaggctttggaggtggccaatgtgatgtattctaatgatgggggccttttcccagaccggtgctaggagggaagaaaatgtcaattaagtgccactgccattgggtgaggcggtgctggaggctggtagcattgtatcttcaagcggggtacaaggcattggaggtgtggcagctggaagggggctgg

SEQ ID NO: 182669 - DNA, 297 bp, Homo sapiens
aggaaatccttaaataacttttctttgacccaggggagataaacatttttataaattgaccattatggccattagtttaagatgttagttcttttcattagcagtagctttttatagattacttattttccttgttcttaaaacaggtatttttaaaaatgtaattgtaaagctgggcacagtagcatgtgcctgttgtcccagctactcaggaggccggggcaaggaggatcgcttgagcccagggcaacatagccagacttgggcaacaacctgggcaacacaacaagacctatg

SEQ ID NO: 182670 - DNA, 136 bp, Homo sapiens
taatgcatgtggatgtgctgtttttcaaatgcagacttactcagacattgccaccatctccagcctctgtaacctttaaagggcttgcagataatgccacgtttcaggatgttgattgctggtcttgtcttcggat

SEQ ID NO: 182671 - DNA, 528 bp, Homo sapiens
gcccaacacaatccacaggcctgtcttctacagctctaaagaagcacttactatagcaaaagagagaaccaagcagcagcaggaaaacaacactcttctttttggaaacctatatttcctaatgactaagaattgcttctccctacttacaggataaaaatagaccttacaccttagcacaaacttcctcctgtcacatttttaccacatattttatcaccaaaggattcatcagcacaaaaaaaaaagatttcatgattctttttcctttgattctattggcctttctcacacacccagtggataattatttctggacatcacacttgagaaagtacatttcatttttactaaagataacaaaagaattttttaatgtactttataaaggtgaacacaacattttaaccatatgcttacatttttattccatttcccagtaatcaaagaaaagactgcaacaaaacaggaaatgcaaagctggttatctaaccttcctcatccagagcagttacacctaatatagta

SEQ ID NO: 182672 - DNA, 346 bp, Homo sapiens
cgactctgaggatcccgctctctgggcagttcctacagatgaagcagagagcttgcagaaaagaatggtatacagtaagtactcaaaaggtgtcatcagcctccgtttctaaaaaaaaatcagcaggtacagaaaagagtagtctagcactaccagaagacttcgcttaaagatatgattaaacttgctcaaacttcctgcagcgctgctaattagtgataccctggggcctccccagctgaggagatagcagctaatccagggcttcagtgagacaagaacacatctgaccagaaaccgggtagcagtctcctaatggctactgtcaagttctaggcacctggaa

SEQ ID NO: 182673 - DNA, 446 bp, Homo sapiens
ctaaagttttaaatgcatccttgttcactgtttagacttaatcctgagattttaatgtaagagataagcttctttaggagccaggcccgcttcttaaacttctctaaattttctgccgaccccaacccagtgcacatttctggagactcatgccttctctctgcagaataccatcccacacggccccacaggacctggcctgggcctgcttctgacctcagctgcagtcacaccttcttctcctttcctggctcaacaagcccagccccatgggccaccctctctgtttctccagcatagcaagctgatttccacctgctcctctgtcattgctggttggtggatacctgcctcattggtcaagtgtcaccccaaatgaggtactgtcgagtagtcatccaaaacactgcttctagcatcccagggcctgggttcacatcccggct

SEQ ID NO: 182674 - DNA, 501 bp, Homo sapiens
cacatgtctcgccaacactgttcattaagcaggatgtacctgcccatatgcaaatatcaagccccattaaacatgcaggaagtaacctttactctcttagtcaggcaccttgttgcaagagagaaactcaaacacaagtctgaagaccactgagaacctttacattttcaccaattcttccatggtagggctgcacaaagtgcttattatcacaccagtatttcataagatgtgtcatgacgtagtaaggccaagagtaaagataagtaggaggaagtaatgaaggaatgttcttgctttcaagccttacattaaaagaaaaaaaaaaggctagtgtgtggggcgataacatcacggatgtcataggcccaatacgcatgcaaggactgagtcgggtactgatgcttgtacagactcttcaaactgcatagtctgccttagaagtatgcttggtaattatctgttgataggtagccatgatacactgggtaaaaggaattg

SEQ ID NO: 182675 - DNA, 399 bp, Homo sapiens
cacatgtctcgccaacactgttcattaagcaggatgtacctgcccatatgcaaatatcaagccccattaaacatgcaggaagtaacctttactctcttagtcaggcaccttgttgcaagagagaaactcaaacacaagtctgaagaccactgagaacctttacattttcaccaattcttccatggtagggctgcacaaagtgcttattatcacaccagtatttcataagatgtgtcatgacgtagtaaggccaagagtaaagataagtaggaggaagtaatgaaggaatgttcttgctttcaagccttacattaaaagaaaaaaaaaaggcttttagaggttaaaagtttaattactagtggaagaataacttggtataatgtgtgtagggcaacaggg

SEQ ID NO: 182676 - DNA, 210 bp, Homo sapiens
cataaataataaatcatagtatgctccagtatgggaaaccattaatatataacacagcctgaatgattttgcctagagttatgcaaaatggtgaccccagaaagaatccattggaaaaaaaaaaatcaaaagagattctgcaatagataagaatgacaagttaagggtggccatgaatgccaggctgaagagtttgttctaaactgaaat

SEQ ID NO: 182677 - DNA, 507 bp, Homo sapiens
taacatatacgaaccgagctgtgaccctatgcatgtaccaagattttcaattttaaatgctttttggtgttcacagttagctataattggtcaattttaccctccttatgcataaaaagaatgataggcaaagaatgagccttgaaaagaattgggatcagaattctggtcccctgttctttgcttcttaactttcttgactgtttagaaaaatgtacagcttttcttccaaaaaccaaagcaataatacttttatttttgaaaataatggaaaacagagaccgctgaagttctatgaatgaggttttctgttttagaaatcacaggttgaggaggaaagaattgtgttttccttcctgttctgtttcgagtctcagtatttctgacttagaaacctcctggagaagagggagataccagctctcctttgtttcaagtaaaataccatcttaggtcataaaatagtttgcttggagaataattcatggcttatatctgaatttttgg

SEQ ID NO: 182678 - DNA, 825 bp, Homo sapiens
atctacccacaaaatctgttggttctaccctcaaaacatatttagaatataaccacttttactctacccttagtctaaactatcattatttctttttgtttggattattgcagtgatgtcctaaccaatctccctgaaaaattatctgtgaaatttatttctatacatccaacaagcacaatgaactctaggtagaataaattcagtgaggtccacatcaagaacattgtaatcaaactgttgaatgtcaaagacagagaatcttgaaagcaacaagaaagaatcaactatcatgtacaagggaaccttagtaagatgaacagttggctatttatcaggaactatggaagccagaaaacagtgggcatatttaaagtgctgaaagaaaagaacctatcaaccaagaattctgtatctggcaaaattgcccttcaaaagtgaggaagaaattgagatattcccaataaacaaaagctgaggggttcactacaagtagacctgccctgcaagaaatgctacaagatgtcctcaagttgaaatgaaaggacactaaatggtaacttgaagctgtatgaagaaataaaggtctacagtaaagtgggtcctagaggtgttgacagtgtgtttccatggacttaaaatcaaccaaacctgtgagcacagaatttagcaccagagtcaggatttccaaaatggtattttgaaggtaaggcagatccagatctggtaagaaacggttttggagtgtgaaaccatttcttggtggggcccgaggttgggggaagggttaaggggggccccggggcatttcacggggggaaaatg

SEQ ID NO: 182679 - DNA, 304 bp, Homo sapiens
ccacttaaatacttcatcagagatatgggaaattgtcccatcacacacccatcatattcaaaaccttcagttagctctcctactggacgtatttctattgaaaagaatttagaacaaatctctcttaaatttagtttacattctttcacagtatgaaagagctgttgaaaacaaattttcttctgttggaaatatgttaagatttgggatctaacaggctaaggaccattttgaaggcccacttgtaattgtcattgttttataaaatatcagatctatacaggagaaaccactggttaggaga

SEQ ID NO: 182680 - DNA, 541 bp, Homo sapiens
gacatgaccctcaaatgaaatgcttatgtggagcatttgagatttcagattttctggtttggggtgctcagctggtataaatgtaatgcaagtattccaaaatccaaaacacttctgatctcaagcattttggataagggattctcaacctgtatggtcaaaaatgtccttgtacatagtctttcatgcttatacttcatacctatttcactcctagttactgagattataacagcatgcaagatagatttgccttatttccctaaattaatgaaagataaagataagtatatttcctgtcctttcatctttcttgttctttcagttatttttctacatcattatgttctcctatatattgacccattttgtccctatccatcagctgtcttctgtcatttttcttccccatttaacttacattttgtctgctctctagcatacactttggcttttttttttttttttgaggtggagtctcactctgtcacccatgctggagtgcactggtgccatcaaaactcactgcagcctccaccac

SEQ ID NO: 182681 - DNA, 639 bp, Homo sapiens
  misc_feature (499)..(499): n is a, c, g, or t
atgtttttaaagaaaaccctcatcttcttgagacgcacactgaaatatttacaaatgagatgacagatttctgggattttcctaaaataatcctttttggggaaagggaataaaagtgaaatacaactgactgtgagttgataactgttgaaactggtggttcattattccatatgctctacctctttttgttttatttttgtttttttgtttgttttgagacggagtatcgctctgtcacccaggctggacaaccacatgctgaagaataactgtgcgcccctacctcacaccatatacaaaaatatttttaaaaaagaataagcagaccagcctggccaacacggtgaaaccccgtctctactaaaaaaatacaacagttagctgggtatggtggtgcgtgcctgtggtccaggctactcaggaggctgaggtgggaggatcacttgaacccgggaggtcgaggctgcagtgattgcaccactgcactctggcctgngcagcagagtgagaccctgtctccaaaaaaaaaaatgatagattacattggtattttgtgtgattgctctggcctttgtgccatgagtttatcctatagtagtggtgtacttttagtaatttcagtaccttgtaatcttc

SEQ ID NO: 182682 - DNA, 481 bp, Homo sapiens
atgttaagtaacgggaatttatagtacttaaatttatctgcaaaaggaaaacatgataaacactagcatggttttctatcatttaaatcctaaattcacaggatggaacattcaactcctgattttccagaaaatctactcttatgaatcctaaagttatcttgaaaggcaggctttgtatttttccagtgaatatattgctgtttcttatcaatgttgcacttgatttttttttttttttttttttttttgagatggagttttgctcttgttgcccaggctggagtgcaatggcgtaatctgggctgaccgcaacctctgcctcccgggttcaagcgattctcctgcctcagcgtcctgagtagctgggatgacaggcatgtgcgactatgcctggctaattttttgtatttttagtagagacagggtttcaccgtgttagccaggatggtctcgatctcctgagctcgtgatccgcccg

SEQ ID NO: 182683 - DNA, 217 bp, Homo sapiens
cacatttcagaatagaggtaaggacatccttgggcagtagctttcctagttttgatgttgaccactcccagccatcatagggaaggtacatagcaaatggatgtgaaagcaatcccaatgaccttggagaacccccaacttggaaagccctacctggtgaaacttgagtgctccaaggggaaagggatttctttcttttttttttttttttttttac

SEQ ID NO: 182684 - DNA, 323 bp, Homo sapiens
tggatggagctacttcatgggtgacatggagaggtgggctgggccatgtgtgggagggatctgggccctgtggatggagctacttcatgggtgacatggagaggtgggctgggccatgtgtgggagggatctgggccctgtggatggagctacttcatgggtgacatggagaggagggctgggccatgtgtgggaaggatctgggccctgtggatgggagctacttcatggtgacatggagaggtgggctgggccatgtgtgggagggatctgggccctgtggatggagctacttcaccggcgacatggagaggagggctagg

SEQ ID NO: 182685 - DNA, 316 bp, Homo sapiens
tgagccacagcacccaaccaaggattacactttgtaacagtcctcaggtggctcacataggacttgaaagcaaatatggtactggaagggaacgcagagccaggggatatcttcccactgtctcttcaccaatgacttactgcttgtccccacttacacaacaaactgagccacatgagaactggtgcagggcgctgggcattttgtctggggaggtggagagcaagggcctaaatggagtcagagactttgaaatggtttgaaagggctttcgctgcctgagcataaatctagatttgggtaacacaaagttgct

SEQ ID NO: 182686 - DNA, 446 bp, Homo sapiens
aggaggatgtattgttaagtgaggagaaggggaaatggttgaagagtttagaagtgggagtcacatgccagggatgagaagtagcactaatcctgagagcccaaactggtatatggcaggataaaaaggtgggccttgaagcatatcattaagacttctaatctgactcaagaagcattccaagcaaggtgaacctctaaataaatatggaatttatttagctaaataaatatgcatttagcaaaatctgacccaggtgcaggttatactctttttttttcttttctttttttttttggagaccccagagtttcgctcttgttgcccaggctggagtgcaatggtgcaatctcggctcactgcagtctccgcctcctgggttcaagcaattctcctgcctcagcctcccaagtagctgggattacaggcatgtgctaccacggccg

SEQ ID NO: 182687 - DNA, 568 bp, Homo sapiens
taggcagacttcttggtcaatctgggtttacatgacccatcagtgaacaaggtgctggaagaggtgaggtctaacagaacaagatgtgcagaagagcatcttgttcagacgggacatgaagatcttaccaaggtgtgggcaagttcaagttgacagatggtctgcactattaaggggctctcaagaacccagggccagcctaggtgggcacacagctccaacctgacacacaggggcctgataaacagggccgtactgtaccacaccatacctcggctagagaacagaaactcaccactaattaagacaaacagtactaaatttgcacgtatcggtgtttctagagaggggcagtgggtgaaggctaaaaaacaaggggcttagagtcacagacttgcaaatcctagctttgtcatttactcactcaaatgacctcgggttatcaaaacacctagcagcctggggcccaccgttccaatgagaatcaaagtaacgagctttcagccctgctgtgaactctaaaaaaaaaatgtgggcaaaatgcctggcacactgccttgccaataaa

SEQ ID NO: 182688 - DNA, 765 bp, Homo sapiens
ggcgtgggctccgcggggcttccccgccggttcgctgagtcccagctccgctcggccgggacctccgtggcaggctcggggagcccgcggggggcagaggcgccgacctccgcctgggaccgagaggaacccgcgccctgccctgccccgcccggcgcgcgtgggcctgagtcaggcgcctcagcacggggacccccgggccggccttcacgccgcagagccgctgcaggtgagactgtggcccacagacactgcttgcagcaggcagaggatgtgggagcctcgtgggaacccccccgacttgtccactgaagtaacagcagcaatgaccttccctcgggaattccacctctgcgtttttccctccaggtatctttttgagcaccttctacaaggaccatccagcacatccataggaatgttccagaaatccacggccgtgctcagccctgattcctcactccacctcatcctcagtcaggctctggggccctctgagtggtgccactccaagagtgaaaccagataggcagtccatgctttggatggcagtgagacccagacgcagttccagcgctggcctctgagcggcagtacagccccatggaccaccagagcccctgaagcccagctctggttggaggtgatgccatctgcacctccctggctgtgtttgtattagtcatctatgctgataacaaatacccacaattcatgatgtagcagcacgttcattatcttccagattctgtggacaggaggctg

SEQ ID NO: 182689 - DNA, 169 bp, Homo sapiens
aaaaaacaaacaaacaaaaaaataataataaacacaagaaactgtggaatgattaaaatgaaagctaacttctcaataccaacaatgttgagagaaaataattgtcatcctagaaacttatatctgaatgttttacttagtgaatctatctatctatctatctatctat

SEQ ID NO: 182690 - DNA, 733 bp, Homo sapiens
caggtaagtgtgatgcctagttgtcactgtaatttttttaagtgactaaatgtatggtattggagtaatgaactagaaaacagtttaatttaatcattcttgtgctacaagggacaagcataaattgtcaaactcctgatgttgtcattgttccttttctatgatcaaacaacatctttctaatttttttcttttttgttatgtcctcagtttataaaacatactgatttctgtctttgaccctcatgtattaaatatccaaagtcttaaatccctgcgctccctaccacgttcctatactttccccagagaccagtgtgtttccctaaccctcccacttctcaaagttctctgaggaacacattcagcttctcctttcctggaggaccagtctcctttactgtggttaagggcccaaagtggctgagttgctagactataataatcagaattatactttacatttttatggccttctctcatcagatagaaacacctgaggagctagttcaagaggcacatccctttgcccaaacccagatataataaatcaatgactactgttgtggggtggctaatatttttagcaggctccccagctgagcctgagcaccaaagtttgagagtcattgctgtactgactgttttggggtccaaaacaagatcatcaaccgtgaacaagtcaggctgagcaaaggatgacataggaggacgaagggcactggaagagagg

SEQ ID NO: 182691 - DNA, 438 bp, Homo sapiens
gtgatggatatacttttctttgttttgttttgagactgagcctcactgtatcacccaggctggagtgcagtggcgcgttctcggttcactgcaacctctgactcccggggtcaagcgattctcatgcctcagcctctcgagtagctgggattacaggcacgtgccactgcacccaaattatttgtgtatttttagtagagacggagtttcatcatgttggccaggctggtctcgaaatcctgacctcaagtgatctgcctactttggtctcccaaagtgctaggattataggtgtgagccactgcgcccggctgcatgtagtcttatatctactcttgtgtatgtttgatatcatccacaaataaaacagttttttcaaataaaagtaaaaagtgaaggacatgaatagacgattctcaaaagaagatatacaaatgg

SEQ ID NO: 182692 - DNA, 832 bp, Homo sapiens
acagcagggaacaacaacaaaaatctctgccctacatttaagtagtagagagagagtaaaaatacataaaaatgtcaggtgcaatgaagaaaaataaaacaggataagaagacagtagcaggatgacactttcacagagagtgatcactatgatctgataaggtaccatttgagcagggacttgataaagtgacagaataagtcagaaagcaagaaagtagatagtgaaaagggaaaataaagaaataatctggataaaactgttaggaggtgaagaaggccgtcaccctgaaagggcttgccacgtgtagaacatcaaacctaagacacatcctgtgaaatagaattcaagaataaaaaaagttcctgaaagttgccacagaaaaaaactagattacagacaaaagcattacaatggttaggttcagggaatcaagagtattctcatcagccactgtagacaatacccaatctcaatggatactgacatgatcacaaaaagaaaaaaaaaaaaaaaaaaaaaaatttttgggccgccttgggccctgaaaaaagttttttaaacccattcggttggggcggggggcgcccggggttagggtcgacatggggccacagacgaggtgtcccaaagaggaaaccgggggcgcagagacacaacgggggcctgggagattccttccccacatatataaaaaaaagcgcccgcgggggcacccacaaaggcgtttgttggaaacaactcccagagaggggagttccaggaaggcaccaaacggggatccacacacaacagggggttccccagggaaagccggagatacaaatagca

SEQ ID NO: 182693 - DNA, 216 bp, Homo sapiens
acaaaaatctgtaaaatacttgaaagcaaacttaagaaacatgcagaacacctttgaagaaaaactatacagcttcacagatgaatataaaagatgatctaagttaaacggtaatatcatgttcctgggttcagattctacaaacatcaaatttctctaaaacccaagtttaatgttttaaattttgtgtttggcctttttctcttccaaggggta

SEQ ID NO: 182694 - DNA, 555 bp, Homo sapiens
ttcttgctggataggtatctacataagtaaattacatataatattcaacatatacagtaatatacttgcacacaaaaaaattttatgaaattagtaaacttccatttacaagtagagagagaaagaacttttttttttttttttttttttttgagacggcatcttgctctgtcacccagactggagtgcaatggcatgagccaccgtgcctggctggaaaaggtttttaataaattagcaggaaaagtaatagtaggacaagagttggctgaatccctctaatggcaaacagagctctgtgtagggctaagaaacactaaattagaaaaaaattaaaaatctgcaagaattctggcctgctctattgttgaccacccacttagtatgtgtaaaccactcagctaggctccgcagtctcaacagtagtaagacatggtcctggaccttgtgactctgtctcagagaaacatgaatgcacgataggtgaccacaatctcgtttcaacgcacaagggggtaaggagactaaccatctcaaaccacctttgactacaca

SEQ ID NO: 182695 - DNA, 700 bp, Homo sapiens
cagctactagggaggctgaggcaggagaatcacttaaacccgggaggcagaggttgcagtgagccaagattacaccactgcacgctagccttgtgacagagagagacttcatctaaaaaaaagtaaacacaatgttaagtgatggagggatgtaaaaatatatggccgggtgcagtggctgacgcctataatcccagcaccttaggaggcaaaggcgagcagatcatttgaggccaagagtttgagaccagcctgaccaatattgcaaaaccccatctctactaaaaatacaaaaattagctgggcatggtggcacaggcctgtaatcccagctgcttgggaggctgaggcatgagaatcgcttgaacctgagagactgagaggctgcagtgagccgagatcatgccaccgcactccagcctgggtgacagagcaagactctgtctcaaaaaaaatataaaatatatgtacacatgtgcacacacaacgcaaggcaggatccctttgtcaagacagtatgttgatgagaccagtatgaatgactgactagaggaaacagaaaccttttttttttggtgagagggcattatcagataaaacatctggaagcaggtagtaattaatagtttttctaggttctagaccataagtaatactaaaagatggcgtgctagacaaagggaataggccagaggcagga

SEQ ID NO: 182696 - DNA, 273 bp, Homo sapiens
tggtcttgatctcctgaccttgtgatccgcccacctcggcctcccaaagtgttgggattacaggcgtgagccaccgtgcccgggctgtcactatttttttattttggcaattcttacagatgtagtgatatcatgttgtggttttaatttgtgttttcttctattcagtttaacatgtgttttaaaagtttgtttgctaattatctcttttatacttaatatcttgattcttagggtcattaacaagattgcttgccttctcctatagtataa

SEQ ID NO: 182697 - DNA, 365 bp, Homo sapiens
agaaaaatggttgccatcaccactaaatggagatacaaagtgccaggtgagaaatcagcactgtctcttaaaagcttttcctaactttgccctagggaagcaagagggattcaaaaagtgggaaaatctgtatggcgatcgctctcacctgattcaaaatacacactagacgtttctaagaagtgtcattgttggccgggcatggtggctcacgcctgtaatcccagcaatttgggagaccaacgcaggtggatcaccagaggtcaggagtttcagaccagcctggccaacatggcgagaccccatctctactaaaaatataaaaattagccaggagtggtggtatgcgcctgtaatcccagcta

SEQ ID NO: 182698 - DNA, 146 bp, Homo sapiens
gtcacacacactgggcattgttttttaaaaaatcaccccatcccccaaccaaaaataaatacttaagtcagtaataatgtggcatgtttctcaactaacaggacaaagttaaaggcaaaatggcagctcacactcccagccccctt

SEQ ID NO: 182699 - DNA, 565 bp, Homo sapiens
tcaggagttcccgaccattcccaagccaaaaccaaaggattttgagatcagtgtgggccacttagccatacccatctctactaaaaatacaaaaaattagctgggcgtggtggtggtcgcctgtagtcccagctacttgggaggctgaggcaggagaatggcgtgaacccaggaggtggaaggttgcagtaagctgagattgtgccattgcactccagcttgggaaacaagaaagaaactttgtctcaaaaatcagtcagtcaatcaataaataaaaagaaccagtcaaatgcggaaggagttttgaggaggaagagattacttatgatgggaggaattggggaagacttcatggattggtggtggttgtcctggatgtaaaaaagggaaagggaacataacaaagaaagggaggaaagaagcatgagcttttgaggagtaactgaaagtccagtttaattggaactaagtgggtgaaggggaatagtgagccataaagccagaagggtactttggaaccagatgatgacccccctctaggcaagagagcatggcactggggctg

SEQ ID NO: 182700 - DNA, 680 bp, Homo sapiens
tctgtcaagtccttttgttctaggatatagtttaaggtcattgtttctttgttgcctttctgtcttgatgacctgtctagtgctatcagtgcagtattgtgtccgtcactataattgtgttttcatcagtctcatttcttatgtcctgtaagaattgttttataaatttggggggttcctcgttaggtgcatatatagttaggattgtgatatttttccttttggagtgattcttttatcatcgtatagtgttgctctttgtctttcttaactgttgtggctttaaagtctgttgagtctggtatcagaatagttcctcctgcctgctgttggtttccatttgtatggaatatcttttctgccactttaccttaagtttatttcagtccttatacattaggtgtgtctcttgaagacagcagatacttggttggtggatttttctccattcttccactctgtattttttagatggtgcttataggccatttacattcagtgttagcatttggatgtgaggtactgttttattgatcatgctagttgttgcctgaataccttggttttttaatttgtgttactgttttctcagtcctgtaagatttatgctttaaggaggttctgttttggtgtattttgaggttttgttttaagatttggaactccttttagtatttctt

SEQ ID NO: 182701 - DNA, 299 bp, Homo sapiens
ccaagataaacacatacaaacacacacacacacacacacacacacacacacacacaggaacatcacagtcacattgctgaaaatcaaagagagagagaaaatctaaaatcatacagattgcataaaggcaacaataggacttcaaaagagccacaataagactgacaaaatcaacaaaaatgatggaagaagaacaacgggatggtatatttaaagtgccgaaagaaaataacagccagtttcaaattctatccaagggtgaatgtgaaataaagattttttttccccagagatgggat

SEQ ID NO: 182702 - DNA, 316 bp, Homo sapiens
gatgcttaatttgtcagcttatcactccctttgccaatttgagtagttaatttgtcttgatccactttcatttacaactgccagccaaaagaaaattaaaccttatctgaagacaagcactaaacggatttaaaagaagttatatctccaggtatcctttcttgaaagctggcatgaagctcgtaataaaaagctaaatgtaaaaaacactattacagctatcttcattatccataatatcagtatcattgtagaaggactgcttaatactttgcctctggagttcctttatttcttcatctttagtaatctttcc

SEQ ID NO: 182703 - DNA, 407 bp, Homo sapiens
atatacaaaccagacaatgaactagatgttttacacatactattactcactttagcctcataatatttatggataggttaagcagcttgcctaaggtcacaacactattacattcaaaagccaggattcaggccgggcttggtggctctcacctgtaatcccaacactgtgaggccgaggctggtggatcacttaagcccaggagtttgagaccagcctgggcaacatggtgaaactctgtctctactaaaaatagaaaaattagctaggcatagtggagcacacctctactcccagctactcaggtggctcaggtgggagaatcacctgagcctgggaggcggaggttgcagtgagcagagatcacatcactgcaccccagcctgggccacagagtaagaccctgt

SEQ ID NO: 182704 - DNA, 185 bp, Homo sapiens
gggcactagcaggacgtagagagaaggggatttggggttggttttggaggcagggctgagaggcttgctggttggattgtgctggcgggaccgtggtcagggaggatgggcaggagccaagcgtgcctcctgggctttcgctgaagctgcaggcaggggagacatttcctggggtggaaaagtct

SEQ ID NO: 182705 - DNA, 392 bp, Homo sapiens
taaaaggagaagctattctttgcagggcgcagctgtgaggatgagcgcaggactctgcaggaagcagacccaagactctgccagctcctcctggccctctccagagagtccgtggaatgccatcagcaatgacttttggcaatttcagtaacttcttggtatcctgaaatcttggggtgcttttccctgaccttcacgcgaacagccctgctaacgattctgtaaacaccgaattccttctgtagaatccatccagcttgacggaatggaagttttctgtttccatgaccgggccccagctcacacagcgttggctccaagctgttttcaggggacaagaactctctaaagaatgagcacgtggggtggctaactaacaaggggtagattaa

SEQ ID NO: 182706 - DNA, 298 bp, Homo sapiens
gagactgcctggggctacagagggagagtcactggctgagagtacagagaacagactccaggttttccaattcccaggctagggcagccttcgaccccctgcaccccatgtccccatgcaattatttacactctgacactggtgtgacaggcactgggagtcagttccaaatccctactgctttttagaaatgcatgagtcaagtaatggcaaatttaaccccctgtagagatttacaaggtttattttacataggaaatgctaatagaagaaaacagactgggctctgtttcccgta

SEQ ID NO: 182707 - DNA, 446 bp, Homo sapiens
atcaatgctaggtacagacttgaggccagaatgcattccaggaggtaaggtgagccactataatatggcaaaaagttcctttcacaagagagctaagacggtccgacatttatgcaaataaaagcctctgagtaaagaacaagaatcaacagaacaggccagacacaggctcatgcctgtaatcccagcactttgggaggccaaagcaggcggatcacttgaggtcaagagtttgagaccaatactagaccaacatgttgaaacccccgcctctataacaaattacctgggcctggtggcttgtgcctgtcatttcagcggaggcgtgagaattgcttgaacctgggaggcagagattgcagtgagccacgatcgcaccactgcactccatcctgggcgacagagtgagactgtctccaagaaagagataataccagcttgattga

SEQ ID NO: 182708 - DNA, 166 bp, Homo sapiens
tttgcaccagtaccaagcaacggaagcccagccctgtgtccgggagcttgggagaaatgttgttgccatcagaagctcttgaggagtcagtttagactctagtaatgcatgctgttgttctagaattcaggaattttacataaaatgagagcttagatggaaattg

SEQ ID NO: 182709 - DNA, 212 bp, Homo sapiens
acattgattttgtatcctgagactttgctgaagttgcttatcagcttaaggagattttgggctgagacagtgtttgataatcctaaattaaagcgcttgcccaaaaattgcagtggttctgaatcagttgggaataaggaggcatatttaataattacattttttcaactttgttttctttgcatgtccaaattacagtgtttcaaagagat

SEQ ID NO: 182710 - DNA, 227 bp, Homo sapiens
tgaaaataaggatttccaatgtggtggatagaaatatatccaatatagaaaaggttaagcaaaacatcctatagtccagaatttgaattataagtatcagtatgaacttgggatattttgccgtgtgtgtgtgtgtgtgtgtgtgtgtgtgtgtgtgtgtgtgtgtacatttcctagctatcattgaagaccattgtaaacaatggtcaatacagtagcaattagcc

SEQ ID NO: 182711 - DNA, 750 bp, Homo sapiens
taagccaccgtgcccggccaacccaaacaatctctacaaaaaaaacaaaaacaaaacaaaacaaaacaaaacaacaaaaaaacccaccaaacctggtggactcacacttcctgatttcaaaacttactgcaaagatatagcaatcaaaactgtgtggtatcagcatgacatacagaccaatggaacagaacagaaagcccaaaactggaacttcagatatatggtcaaatgatttttgacaaggatggcaagatccttcaacaggaaaagggcagtctttttaacaaatggtactggtacaactgaatatccacatgcaaaagaatgaagttggacccttacctaacaccatatataaaaatgaactaaaaaatggattaccaacctaaatgtaaggaaagaacaaaactcttaggagagaacagagagcaaaagcttcacaacactggatctggcaatgatttattggatgtaacgccaaaggcacaggcacaaagaatagacaaattggactgcatgaaaatttttttttttttgagacggaatcttgctctgtcgcccaagcttggtctcaataacaacaacaaataaaatgaaacaaaaaaccctcccataacttcacatcttcaatgatattagaaaaagaacaatctcaaacccaaagctagcagcaagaagggtaattatagagcagagattaatggatcaagtgaatatagagatatagaaaaccaaataggggaacaaaaa

SEQ ID NO: 182712 - DNA, 340 bp, Homo sapiens
catatctcacttgtgcacttaatagtggtatggagtggccatgtgaagttatttgtttgtttcctgaaatgtttagcagaattcgccaatgtaaccattaaggcctggaatttcctaagctaaggttttgttttgcgttttgttgttgttgttgttgttgtttagaagtgggttcttgctatgttgcccaggctgcagtggctattctcaggtatgataatagcacactatacccttgaacttctagactcaagtgatcctcccaccttagtctcccaatagctgggactacaggcatgcgccaccgtgcccagcttgtgttaaggttttaaactacaaa

SEQ ID NO: 182713 - DNA, 325 bp, Homo sapiens
tagttatttatttatttattccttaaaacattgccatggtttctaacccaaactctagaccaaaaataccttcagtaagtcacctatttatcttatcactgctaagtccaaagctctattattacattctcttcctaattgacccagcactcaaaactactttcttttcccccattgcatacagagtatacatttatttgtttagtctttctctctcctgtaggaagtaagtttttatgaaggcaaagaccttgcctgcttgattcactgtctagaattgtgtctggcatgtaataagcgatgaacatctattgaataaatacca

SEQ ID NO: 182714 - DNA, 445 bp, Homo sapiens
ctaaacgttgcaggcgctcaggacgctgtggcgatgactattattatcattcatgtcagcagaacagatttaccaaacagcagtaactcagaaacagcggggaggatggaatctgtaacagggaagcggtttaaaggagagcatgagagagaggctaagatcctactgcacagtgcccaagagacaggaaactcacagttcctcaggatttggggtcgccagtccaggttacctgtgatccaagtttcaagatccacagagatccccaccaactctgactcctcaagtaccttggatttggaattccaggaaataaaagtgcaccccgtattactgttaaaataaggacaggccaggggcagtggctcatgcctataaatgctgggactcgttggggccaggagtttgagaccagcctgggcaacataaagagacactgtctcta

SEQ ID NO: 182715 - DNA, 212 bp, Homo sapiens
aatatgggaaggggctgatgctggtttaggataatcccagatggaatattatctatttagttgctgatatttcttggcaattgaagactaaaacaccattctaaggcaccaaatgatatcaccttaagtttcaaactgtttaaaatgagctgtataaaatagtttatgcaatagtttgctgtaatagtttatgctgtaatagtttatgctgt

SEQ ID NO: 182716 - DNA, 234 bp, Homo sapiens
ttcaaagagtatggcaggtagaatatgaaaggcagtaattcactctctttatggcatttgtgtacagcactaaagaatgtggcggtcttcctccaagacactgatgctactcacctatgatcactggggagaaatctttggaatatattcttatgaatgtgttcatggaaagctgaccatatgcatcataccattcatttaatatacactttttaagtggctttaaaacaacca

SEQ ID NO: 182717 - DNA, 129 bp, Homo sapiens
attctgagcatggccatgtgaccatattttctgtttgttggctgggtttgtttgtcctcagtttttacagatgcggaaaggaagctcagacacgtctccagttcttgcggagcatgacatccaccttct

SEQ ID NO: 182718 - DNA, 487 bp, Homo sapiens
cctggtgggaggtcattgaatcatggggtgggtttttcccgtgctgctctcgtgatagtaagtctcatgggatctgatggtttgataaagggcagttcccctgcacatgctctcttgcctgctgccatgtgagacgtgcctttctcctcctttgccttcctccatgattgtgaggcctccccaggcacatggaactatgagtccattcaacctctttttctttataaactacccaagtctcgggtatttctttatagtagtatgaaaatggactgatacagttacctaggctggagtgcaggggtaagaatacaggtcactgcagcctcgacatcagcacccacatagctgggactataggaatacaggcacgcaccaccacacccagctaaatttctttgtatttttggcagagccatcttggttttttgtttttgttttgagatggaatcttgctctgtcgtgcagtggcgcgatctcggctcac

SEQ ID NO: 182719 - DNA, 400 bp, Homo sapiens
tcctcagctgtaagtggaactaataacactgaatttgatgagttgttatgaggattaaattggacaaatgggaagtgtgtagcatctatggcacatagatgtaaaataaataagaatggacaggtgctattaaaaatattacctggccgggtgcaatggctcatgcctgtaatcccagcagtttgggaggccaaggcgggtggatcacttgaggccaggagttcaagaccagcttggccaccatggtgaaacctcatctctactaaaaaatacaaaaattggccgagtatggtggcacatgcctgtagtcccagctacatgggagaacaaggcagaagaatcacttgaatctgggaggtggaggttgcagtgagccgagattgcaccattgcactccagc

SEQ ID NO: 182720 - DNA, 152 bp, Homo sapiens
ttagcctcgccttctgagcttcccacagtacacattttttgcaggtgcatttgcttgtatttgcaagacagaagctcactttgttggaactttctttcctcggtccctcttcatcgtcttcatctcctaattggtgtttgtaataactccca

SEQ ID NO: 182721 - DNA, 1028 bp, Homo sapiens
accaaaatcaatgtggtatgaggttttatgaataggagacaatctagaagtcatggtttctgtgacatttttcacaacttcaaacgtttaaatatagtctacatttttcttggtgtggaatattttccttgctcttctgaccccaaagaaaagtatttgttagaggaccaattaaatgaaatttgagtggggattatactgtgtttgagctataattcttaaggggaaaattgtttatatgtgtatcttgtctgaagtaatacatagttacattaaatctcataaaagtacctcaattgtgtcaactgtttgacatttttgtttaatcttctgtgaacagatactaagcatccaactatgatattgatgtttgtgcacaggtatgcactcaggtcttcttgacaaagatctaaagttataattctaagagagtagataattgttttactaagtacttattctggtatcagaactcacacttcacttattacagaaggaaaaagaaatttgtttcctaaacttgctttgccccattaccttgtaatctagaccctttggtaaaatttgcatttttgataactacagtaatgttcattttacttgcctgcatctgggctctacttagagaatatcacataatattacataatctgacaattggtaccagtttaaatccatcaacgtcaactacaagtaagccctctactctactttaaaaatctcttcccatttcttcagtcaacagtttttctgtttttcacaatgcctatgtcagatagaaattttcccttctaccatatctctcctcactctcacttgcttgaagaggaaaatcacatggaagcttcatcagcttttcttgcaaaatctgctaatactcacacttgtctttctcttttaataaaaggcatagatgtttagttatctaagaccaataaacaccaaagcctatcgtcttctgcctgtcaagagactgcactatctgtcatcccctttctcatttatttctctctatattggccactttt

SEQ ID NO: 182722 - DNA, 991 bp, Homo sapiens
gtcaatttaacttaacaagtatttattgaatatccacatgtaggccagaatcagattagtaaccaggtgccttggaattttaaaatttctcctctctttattaatggatttagcgagtggaaatcaggctttctgtgatggtttataaaggtattttcctggctctcttggagttctctgtccaccttgctgcagtctttgttgtgatggggagaccacatgggagcggtccagatgagtgatgctacgggcccaaactgttagtggccgtgaggatataggttgtaggggacatctggagtggaaagagtgctcttctcacacagctctctctacttactgcccctaggatggtgggtgcaactgtggcaagggcagtcagggtaggggaatcccttagaggaattcagcagtgactagtctggttagcctttcccacaaggcccattgagttatgagccccctcctttggtttgtagaaagagaaggtagcagcctagaacaggtgagaagatgaggtaggtccttctgctcaaacatcctctctccgtattttaccaacacgatactgacctaggttaaaaagctactcttggccaggcgtggtggctcacgcctgtaatcccagcactttgggagtccaaggtgggtggatcacctgaggtcaggagttctagaccagcctggccaacatggtgaaaccccatctctacagaaatacaaaaattagccaggcatggtggcagacacctgtaatcccagctacttgggaggctgaggtaggataattgcttgaggccgggagggggcggttgcagtgagccaagatcgctccattgcactccagcctaggcgacagagcaagactctatctcaaaaaaataaaataaaataaaataaaaataagctactcttagccaggcacatagtggctcacatctgtaatctcagccctttgggagactgaggtgggaggatcacttgagcccag

SEQ ID NO: 182723 - DNA, 291 bp, Homo sapiens
ccttcaggtctttgctcaaatattgccctctcagtgaggagtcctttgtctacccttatctaaaactgcagtctcttgcaccacacttcctatccctcttctctgctgtatttttctccatagaattgtaactagtacataatacatattttttatttacacttattctcttccactagaatgtaaacacaataagggcagacattttgtctgttttgtttaatgctgtgcccctaaaacagtgccaggcacatagtaagcaaccaataaataattgtgaattaatgtata

SEQ ID NO: 182724 - DNA, 314 bp, Homo sapiens
tgatgtcatttggagggcttggtgccagggaagggtcacggccattggaatggatgagaggtaaagatggaaagatgtgaggatcagcttgagggtgccctgtgtattccacccatgccagagacctctttattttatcctccagcagtgggaaactggggaaggtgtttaagcccatcctcagttaaattcaaaggcaggataatcttacagtctgtctggagcctcctccctgtgttcaaattcttgtaaaaagaaagaaactaccatctcgtctcttctcttgtggctgcaccatctcgtctcttctcttg

SEQ ID NO: 182725 - DNA, 383 bp, Homo sapiens
tactgtgtgattcaccaaacccactttggagaatttagcatatgaacgaacctgctcatgtacagaaaggtgcaggtacaagattacgcattacagcatgactttgtttgtaatgtgcacattggaaacaacccataagtttattaacaggagtctggtcaggtacaatgtggtactatgaagtctgattagatacaacgtggtacaatgaaacctgattagatataacgtggtactacgaagtctgattagatacgacgcggtacaacgaagcctgattagatacagtgcggtactacgaagcctgattagacacaacgcggtactacgaagcctgattagacacaacgcggtactacgaagcctgattagacacaacgcgg

SEQ ID NO: 182726 - DNA, 536 bp, Homo sapiens
  misc_feature (389)..(389): n is a, c, g, or t
  misc_feature (396)..(396): n is a, c, g, or t
tgctgagattaaaggtgtgagacatgatgcccagccttggttttaagctttaagatgcaagaaaaaataactatttgcttactcatatttatctctttttagtataatagtgtctccctccttccataaggaacatgtgtgacatgggttctaatctatagctgaagagtgaactgacaagaaaaataatgactatttgtacactagaccttctgatgtgattattttaattttttttttggagagagtttcactcttgctgcccagactgtagtgcaatggtgcgatctcagctcactgcaaactccgcctcctgggtttaagcaattctcctgcctcagcctcccaagtagctgggattacgggcatgcactaccacgcccagcccnaaaaggnttttaaaatcagtcacagtcagtcagtgtccaacttgttgattattggctatgaatgaagaaaattgccctccttaaaaagtgactcaatcctaaagcattttattataattaaaatattaatagcaggacgtcaaggca

SEQ ID NO: 182727 - DNA, 398 bp, Homo sapiens
tagggtctctccacatggtagggtctctccacatggtagggtctctccacatgggttctaatctatagctgaagagtgaactgacaagaaaaataatgactatttgtacactagaccttctgatgtgattattttaattttttttttggagagagtttcactcttgctgcccagactgtagtgcaatggtgcgatctcagctcactgcaaactccgcctcctgggtttaagcaattctcctgcctcagcctcccaagtagctgggattacgggcatgcactaccacgcccagctaatttttgtattattagtagagatggggtttcaccatgttggccaggctggtctcaaattcctgacctcaggtgatccacccgcctcggcctcccaaagtgctg

SEQ ID NO: 182728 - DNA, 412 bp, Homo sapiens
cccagactatagatcaaaatcaagatagtgggcatgattatagttgctagggaactttaattttcccaggcccacgcttgacctctgtacatccagactccgggatccagaccatgtgcacctcatgccaccaaacctgagtaccaggccccaaatgggcatttcacaacttcacctgtttatttagctcacaaacaaggcttttgaagctccactattatcctctaagtgctctactttatgcctgtgagagacagaggaactaccttttcttcaaattgagatgcctgacaagaggaaagcatcttccttttggagaatgtggggctgccccccacttcatgcagagccacctagggttcctggagctatcaccagccctatctcccccagcaggaaccaagcacaccca

SEQ ID NO: 182729 - DNA, 354 bp, Homo sapiens
ctcatggtcagagacgggatggtgggtcacgtgtgtctttgggtgttccctccccgatcatctttcctgttccagagatggggccaaaaagatatccttaactgagcacaacttcacctgtttatttagctcacaaacaaggcttttgaagctccactattatcctctaagtgctctactttatgcctgtgagagacagaggaactaccttttcttcaaattgagatgcctgacaagaggaaagcatcttccttttggagaatgtggggctgccccccacttcatgcagagccacctagggttcctggagctatcaccagccctatctcccccagcaggaaccaagcacaccca

SEQ ID NO: 182730 - DNA, 931 bp, Homo sapiens
aaagacttagctcttaggtgactattacttttttttttaggtaaattgaacagcttttcaattagtaattttctttgacttctctcagtgtgcgactgacaatgactgccagtgcttcccttctttgattttacaacactgagctattgaaaatagctaacttttagccatctgaccgaatcactcaaccatcctcaagaaatttacctattaagctgatgatcccaaatgggttcggcattcttatccttacacttgaactgtaaactcgtatctccaactgcccactagccaccttcatctggatgactactagatatctaaaatctaacctgccaccaaagacactgattcactatcctcccaacctgttcctctcgcagtcctccctgccttagtagctgctaaggccaaaagcctgattctttcatcagcaagtcttgctggctcaacctcatcaacttctatcaattctcattacttctaatgcctccatctatcagccccccgccttccattttcattgctagtctctgttccctattttccacacaatagccggtgatttgcttaaaacataaattaattatctgtccaaaagtttcaaataacttcacataacatttaaaataaatttcaagtttcttttcatgggctaaaagacattacatgttttggctcctgacttcctctaaaactttattttctgtgactctcctttgctccctgtactctagccacaccaacattcttgctgttcctcaatcatcttcctgtgctggggtgtttctactgctgtgtcctctatctgaattgccctttgtttggattacttctcgacatcatttcaaggtttctgattaaatgtcatctcctcagagaggcctttcctaaaatctatacctatattgctttccgctccccaacttga

SEQ ID NO: 182731 - DNA, 550 bp, Homo sapiens
atgaagagagaccctcaaggttgaacaaagatgggagggctcacatccattactggttatatttgatcttttgtctcctccagtgcaatgatctttttcatcttcttaattcttaatttagctaggcaatgtttaattattagtttaattcttaatcaaactaggaaaggaagaaaacaccccatttctttgtgcttttttgcctcattgtggtggtttaggtcatgatgaggtctagttgggcaggtcatgatgaagtctagttgtattaggttctgatgatgtctggttgagttagatcatgctgaggtacagtttggtttggtcatgatgaagtttagttgtattagatcatgataacgtctcctttggttatgtcatgatgaagtagttgagtagaatgtaatgaagtcttgttcgattagatcatgatgactggttgagttaggtcattatgaggtatggtttgattaggtcttaatgaagtctagttcagtaacagcatgatgagatctagttggattagacttgatgatgtgtgacttattta

SEQ ID NO: 182732 - DNA, 254 bp, Homo sapiens
ctgttgcacagttctctagtacctttataccacacagtcatgtgccacatagcgaacctttggtcagtgacagacagcatatacgatggtggtcccttaagattataatacttgtctttttttttttaatcggaaaagaattaccattctttttgccaaggtggaattagtaaggctgttgactctggctccacggacaaccttctccttctcccaggtttcacgcgaattctccgtgcctaagcctctcccaa

SEQ ID NO: 182733 - DNA, 3234 bp, Homo sapiens
ccatgtgaccctctcgggtgggactctgcagctgcttcgcagcgcaactctctcaccaaactccgcgcccttgcgctagcggtgccaaaaggctcccgccccgattgaaaaggcgcagtgcatgcccgcccgcgtcactccgcgggcggaggacgcacgtcggggcgcggctctctggctagcgcgcagctccagctctgtcactcgcgcccttccaaggacctggagcacccgagcgcctgcctggtggcggcggcaacaatgcacggagccgccagagcgccagccaccagcgtgagtgccgactgctgcatcccggccggcttgcgcctcggaccggtgcctggtaccttcaagctgggcaagtacctgtcagaccgcagggagcccgggcctaagaaaaaggtattgaccattcagacctctgcccaccaggtgcgcatggtgagaggggagctggtggacgagtcggggggctcccctctggagtggatagggttaatccgggcagccagaaactcccaggaacagactctggaagctattgcagacttacccggaggacagatcttctaccgagcattgcgagacgtccagccaggggaggagctgacagtgtggtattctaactccttggctcagtggttcgacatccccaccacagcgactccgactcacgacgagaaaggggaggagcgctacatctgctggtactgctggaggacgtttagataccccaacagccttaaggcacacctgcgtttccactgcgtgttcagcggcggtggaggcggcgccttcctgcaccacgaacacgcggctcgccaaggcgccgtcccagcggctgatggcctcggtctctccccaaaacccccggcgcccgatttcgccgcgccttcccaggcaggaactttgcgaccccaccccctgggcccgccaccagttcaggcctgcggtgcgcgggagggcatcaagcgcgaggcctcttccgcgccctcggccacctcgccgaccccaggcaagtgggggcagcccaagaagggcaaggagcagctggaccgtgccctggacatgagcggagccgcccgaggacaagggcacttcctcggcatcgtgggcggctcctcggcgggggtcggcagcctggctttctaccccggcgtgcgctcagctttcaagcccgccggcctagcgagggcggcggcggccgctcacggcgacccctaccgggaggagagcagcagcaagcaaggagccggcctcgctttgggcaggctgctgggcgggggccgggcgtgcgggcgccccgggagcggggagaactcggcggcgggcggcgcgggtcaccaccatcaccaccacgcgcaccaccaccaccatcccaagtgcctgctcgctggggacccgccgccgccgccgccgcctggcctgccctgctctggggccctgcgcggcttccctctgctctccgtccccccggaagaggcgtccgccttcaagcacgtggagcgcgccccgcccgcagccgccgcgctgccaggagcgcgttatgcgcagctgccccctgcgccggggttgcccctcgagcgctgcgcgctgccgcccctcgacccgggcggtctcaaagcctatccgggtggtgagtgcagccacctgcccgccgtcatgccggcctttacagtctacaacggggagctgctctacggctcaccggccaccaccgcttattacccgctcaaattgcacttcggcgggctgctgaagtatccggagtccatctcctacttcagcgggcctgcagcggccgccctaagccccgccgagctggggtcgctggccagcatcgaccgagagatcgccatgcacaatcagcagctgtccgagatggctgccgggaagggtcgcggacgcctggactcggggacgttgccaccggccgtcgcggcggcgggaggcaccgggggcggcggcagcggaggcagcggcgcaggtaagcccaagaccggccacctgtgcctctactgtggcaagctgtactcgcgcaagtatgggctcaagatccacatgcggacgcacacgggctacaagccactcaagtgcaaagtctgtctgcggcccttcggcgaccccagcaatctcaacaagcacatccggctgcacgccgagggcaatacgccctaccgctgcgagttctgcggcaaggtacttgtgcgccgccgggacctggagcgacatgtcaagtcccgccaccctggccagagtctgctcgccaaagcgggcgacggcccgggtgccgagcccggctatcccccggagcctggggatcccaagagcgacgacagtgacgtggacgtctgcttcacagacgaccagagcgaccccgaggttgggggcggcggggagcgcgacttgtaacgagtcttcccgggaaggggcggggtgaggacagagaggagtcgagggtttattctcgcagtagaggaactcctggtggtgggaagagggacccaatggacaaaaccgtttttgtttttgagagggcgccagatttgaaacagtgagaggtcccacatctggtgctgaaactcagagcaacagttcagaggtggcgtaaatctggccacctggagagctcgagtgccaccagtacctccgcaccccgggcctctggacttcttggatgagctcaccctgaaccgcccaggcggtctgctcttggtgttcagaatcacatcaatgcgaacgtcacagcgccttcgagggcgcagattttaactgccacgtatttttaagttgtacttttctgtggaggaaattgtgccttttgaaacgacgttttgtgtgtgtatttcacgttagcatttcattgcataggcaaaacactagtcacaattgggtagatgtgacatccatatacttgtttacattttatctgttctcatgtcaaagactactccttgccccattgaatatatagtggtagcaggtgtacaaattggtcaagttgcaattatttatgagagaataatgataaatgtaaaatatctaaagcatgaatctaagagcacgcaatatataattttaaagaaaatattctatttggtagaatacaaatgtggtgtgtgttgttttataatgactgctgtacagtgggtatagtattttggttttggttccagattgtgcaatctttaagaaaaataaagatacaaacgagagttttgttcacttagt

SEQ ID NO: 182734 - DNA, 644 bp, Homo sapiens
ctgcctcgaaggtacattgccttcccaagcccgcccagtgtggctcagcttcctcacaggctctctgttctgttggaaatgctgggtttaaactgtcacgtggcagtgttggagcagcttcttccctacaggcctgtgaaatcaagcccaactctgggttttatttttctctttatttatttttataaaagccttaaaatttttataaaagccttatctcagtagagatatagctcacttaccatgttatgcaaccatcacttctatctgattctagaacattttcatcacctcagaagcccctacccattaggagtcactcctcttttccccatccccagcccctgtcaaccacggctctttctgtctctatggatttgccttttctggaccttgtgtctaagtggaatcataccgcctgtgctcctttgtgtctgccttcttccagcatcatgtctgcaaggctcatccatgctgtagcattcatcagcacttcatttctttctgttaccaaataaccttccattgtacagatttaccacattttgtttatccgtctattggtggacatttggttgtttctcttgttaactattatgaataatgctgctatgaacatttgtgtacaagtttttgtgtggaca

SEQ ID NO: 182735 - DNA, 698 bp, Homo sapiens
ctgcctcgaaggtacattgccttcccaagcccgcccagtgtggctcagcttcctcacaggctctctgttctgttggaaatgctgggtttaaactgtcacgtggcagtgttggagcagcttcttccctacaggcctgtgaaatcaagcccaactctgggttttatttttctctttatttatttttataaaagccttaaaatttttataaaagccttatctcagtagagatatagctcacttaccataaaattcacccttttaaagtatccaagtctatgatttttaagtacactcccagtgttatgcaaccatcacttctatctgattctagaacattttcatcacctcagaagcccctacccattaggagtcactcctcttttccccatccccagcccctgtcaaccacggctctttctgtctctatggatttgccttttctggaccttgtgtctaagtggaatcataccgcctgtgctcctttgtgtctgccttcttccagcatcatgtctgcaaggctcatccatgctgtagcattcatcagcacttcatttctttctgttaccaaataaccttccattgtacagatttaccacattttgtttatccgtctattggtggacatttggttgtttctcttgttaactattatgaataatgctgctatgaacatttgtgtacaagtttttgtgtggaca

SEQ ID NO: 182736 - DNA, 919 bp, Homo sapiens
catggagattgtgggtagaacattcccttgaccctctcgccaacacatgcctacacaccaggttagcagtttacctctttgtaaatctgaagcggtggtagtagtgatggtggaaggagtgaataagggcctaacctggctagctttctgtttgcctgtcttgcaaatggtccagcaacaggtgttttcttaaaaaaagcatgaacttggattgaggcttgactgcgagttcttgcaaaatataactgctccttgttgacttggaagatgctggatgtggggcccctcaatgggggtttggattttgtccttagagctggattttgcaacaaatagtgcccatcgttgtgtctgcgagaggtctctggccacttcaatggcatttactcttgtcagacatttaatcagtctcccagcggaagggcagcaaaacatgaatcctattggctaaaagagtgtacgctattcaaactatagtaggttgtgagtggctaaatgagttttgattgtagagtttcttccagaaattggcttcatcaaattctgctttattctgactttatcatatacagcatgccttgttttagtgggttcttgcttggagcttagtttattatacctgaatctcctaccatttaaaagccaatttataaacagggacttggagtgtgactccactaatgtgtgtctgtgatcctggttagaaacccacttggctgccttttcctcaggaggtgggggttgggggaagggagctgccgggaagtgattgataaggtttcctttatagattctgtggtgcttcactggagctcagagcactttggcaacttaagcactccaaattaaaagctcattaacaattcctgcccaaagatcctgtaaataatcagctagctaggtcatagagcttggctaa

SEQ ID NO: 182737 - DNA, 785 bp, Homo sapiens
caggagaaatatttgtaaaagatgcatctgatctaaaaacaaacaaacaaaaaaaacctgttatccaaaatgtacaaataataggccgggcgcggtagctcacacttctaatcacagcactttgggtggccgaggcaggcggatcacttgaggccagtagttcgagattggcctggccaacctaatgaaaccctgtctctcactaaaaatacaaaaattagctgggtgtggtggtttatgcctgtagtcccagctacttaggaggctgaggcaggaaaatcgcttgaacccagtatgcggaggttgcagtgagccgaaaccgcatcactgcactccagcctcggcaacagagggagactctgtctcaaaaaaagaaaaaaaaaaatcatacctacataatgaagcttacatttaaaaaaaaataataatactaggtctacagaacttctagacagctgaatatgtggaagttccctcctgaagggtggcacccctggagatggcatgggatctccacattccttatctcataccttcccctatgcatctcttcaatctggctgttcatctgtatcttttctaatatcctttataacaaatgggttaagtgtaagtaaaaagcttctgagtttcagcaagttaatcaaacccagggagggagttatgtgaactctgatttatagccagttggtaagaagcatttgggacttgaaattggcatctgaagtggagggcagtcttgtggtagtgagtcctcagtctgtgggttctgacgctatctctac

SEQ ID NO: 182738 - DNA, 276 bp, Homo sapiens
agcgaactgtgatcacaccattgctctccagcttaggtgacagagcaaataaaataaaataaaaaatttaaaaaaaagtctcaaaaaataaaatggctgtttctacagaaaaactaaggagaatttaattgatttaaagaaaataaacatatcgtagttatttccggtgagagtttggaataattgtttatctaaacaattctcaccttttccaccttgctatgtctgcagagaccttagctattttccggacacctgtgctctcctgctgctttg

SEQ ID NO: 182739 - DNA, 248 bp, Homo sapiens
agggaggagcagcaccactagggacaccatcactccacagggcactccagacatccacatcacagggcacaggttgctcaatggagaattctgtctctctccttgtttctctttttcacctgagccgaatggctaacactcctgacctttggttgcctgtgtacacctgagaaggtttctcatatttcacctgttcaagaagaagaagagaccaggaacctcattccgctgcgctgaggagtaaatgt

SEQ ID NO: 182740 - DNA, 444 bp, Homo sapiens
gttacatgtccctataagaagcagaatttgaaaggaagtttgaatagtgttgaatttagatagaaggaaggagatgccatgcctggtgaccgaaaactatatgaacagaacaaaggtaaataaaggtgtatgtgtgggtaagcatcttttatattgggcacagtgagaagtcatagtttcagggagtaataaagaataaggtttacctgaaccaagaactgcttctgtattttaatttttaattttaaactcctttataattgtataccaatatcaattgcataccagaatggtatgtgactcacagatacactagaattttgaacatttctagatctgtatttaattacttttgcatatttaattacttttgcatatttaaccctacatttctttttttcttcttcatttttttttttttttttgagacagggtctagctctg

SEQ ID NO: 182741 - DNA, 533 bp, Homo sapiens
aggaggctgaggcaggagaatcacttgaactcaggaggcggaggtgatagggagccaagatcgcgccactgtactcactccagccttggtgtcagaggagactctgtctggggggagggatgggagggagaagaattagaggatctctctctccagctctctcctctctgtggttccactcattttctgattcataagaatcccttttcctctttgatttctgtaagatttatctgattgtggacctctgtgactggtgcccacccttggggcaaggccgttagagaagtaggagcagggaaagtgggggaaggaaattaaccctatcttaggttactttgccaacatttgactcctctctacatcctgcctgattttgttttgttttcctagttctgaggtagttgctgtttatattttgttgagaatttctagttgtgagcagaggaagaatggctgggcacttaccatgatagctccatgactttaaataccctattggcaactctcagatttacctgtgttgcctggac

SEQ ID NO: 182742 - DNA, 486 bp, Homo sapiens
aatgaactctggctgccatgtggagattagaattattggagtgttcaaggcaatagtagatagtggcctgtaaacagtcttatattccaggcataacttggagatattgcaggttccgttccagactatagcaataaaatgtatattgcagtaacacgaggagtcatacaatttttttgtttcccagtgtatataaaagttatgtttttactatactgtattctattaagtgtacaatagccttatgttgaaaaaaccaatgtacaatgtaattttaaaaatattttattgcaaaaaaaatgctaacaatcatcagagccttcagctagttgtaatcttgtaatctttttgctggtggaaggtcttgtgttgatgttgatggctgctgactgatcagggtggtggttgctgaaggttggagtgactgaggtaattaaaaaaaataagaccgtaatacagtttgccccaacagttgactttctttca

SEQ ID NO: 182743 - DNA, 460 bp, Homo sapiens
acatacaaaaaggtcattatataatgctaaaggggtcaattaaataagaagatataataattgtaaatgtatgtgcacccaacataagagcaccttgatatgtaaagcaaatgttatcagatctaaagggagagatagactctaatacgaaattcccctgagagtgggaatttcaacaacccactctgagaattgagcaaattatttaaacagaaatccaacaaagaaacatcaagtttaaattgcacagtagaccaaataaacctaacagatgtctacagaacatttcatccactggttgcagaatacatattcttatcagcacacgggacgttctccagaatagaccataagtcaggctacaaaacaagtctcaacaaattgtttaaaaattaaaaacatatcaagtgttttttctgacaaatatgaaataaagctagaaatcaataacaagcagaac

SEQ ID NO: 182744 - DNA, 315 bp, Homo sapiens
gaaagggaggaggagaggagcaaattacaacaatatattatacagtattttctttatgaattggttgagagttttaaaatgataatacagtggtgttagggtacagtgagagaaatgctatcacatattgctacatagatgaaaatcaggacagccttgagcagtttggaaacttataccaagatttttcaaatgttcaaactctttgacttagtaattcctttcttagaaatctgctccagagacaggaagatcacttgagcacaggagtttaagaccagcctggataacatagtgagaccccccacccccaac

SEQ ID NO: 182745 - DNA, 407 bp, Homo sapiens
atagtattggatgaaattacctagatggtgtcagtagagaatggaagcaaagagcattgacatctgaggagtgggacattccagtgattcaagtttacaagatgagtaggtgacagttgaaaggaggagaatgacagtaaatgatatttcaagagccaagtaaagaacatatttcaaaatcacattggccactggctttgacaacatggagctcactgattgattacattaacaagagcaattatagttttagaggtgtatgtaagggagggagtggattcaggaagtagagacaactctttcagaagagatttatgtcaagaaagcagacaatcatgatatgtttggtgggtgctatgaggtcaaagtactttttttttcaagttgatagatattaatgcattatc

SEQ ID NO: 182746 - DNA, 345 bp, Homo sapiens
cctaggcaaaccagatggaaactaaatcgtttctgcagaatgaacgatttgtgaaatcttggcaaattgaattccaaatatacttagagatgatcttgactttctctgtaactctaccacaacatgcaatgcatttaaggcctacatgggaaatacactaattagttgcataacctttatgcagaaatgaatgagaacagaagatcaccatcaaaggaataaaagtcagtaactccgaaaaagaagtaatatgcagatgggacatcttcactaagaaagtatgagtttaatgtagatattgtgggaggtattcccttgtcatctttgaattggttctttttaacc

SEQ ID NO: 182747 - DNA, 460 bp, Homo sapiens
  misc_feature (21)..(21): n is a, c, g, or t
agaggagatacggctcatttnagatctcatttcagtttcaattaaaattatttttagtatgtgactagtaggccatggctaacatacaaaattttttccttcttcaatgttataatattctcaccaattatgctgcaaaatcagtgtttccccaagtatacaagatggtttcagactatattaatataggaatgaacattttccattttaacagtactatttactttaataagtattaggaaaaaactagtacatcaaaactatttcatagattactaagtgatataatgtgatatatcactataataaatgagaataaatgcaaatagtaaagtttatgaagggactatgggactcattgaagttcagtgaattttttttttttttttttgagacaaattttcgttttgtcacccaggttggagtacaggggggctatcttggctcactgcaacctcgc

SEQ ID NO: 182748 - DNA, 499 bp, Homo sapiens
gttcttggctcactgcatcctccgcctctcgggttcaggtgattctcctgcctcagcctcccgagtagctgggattacaggtgccctccaccacacctggctaattttttttttttttgtatttttagtagagttgggatttcaccatgttggccaggctggtcttgaactcctgaccgcaggtgattcgcccgcctcggcctcccaaagtgctgggattgcaggcgtgagccacggcgtacctggccaaaggtacaagttttaaatatgcttttatcatgcatacagtactcttatagattctgtcagatttagggatattcttttcagattgataaattgcacaaaaatcttggagtatattcttgtaatttcttctacaaaattctcaaaacaacctttttccaatggggagaagacatgaacactgaagtcatgtttttggaaaataccttgttaaaaacagaccccatgcccacaggatcctgcagagtcacct

SEQ ID NO: 182749 - DNA, 437 bp, Homo sapiens
tcccgccatttactccatggtgaagtcatgtttttggaaaataccttgttaaaaacagacactgctgtaagggtttccttgcttatgctcttttgtagaactttattgatgtgaagagttctcctttttctgtaaaagcttattttagagtacgaagtaaatgaggcactcagagagttaacctcatcaggtctgagtttagttcagtttaaactttttgctcttatgctggttgatatctttgtaactactctacttctagagttattttgattggaaaatgaattccttttttagaacatggaattgtaaggtagaaaactgctaggttctcaaaagaagggagataaattccaacttgaaagttttttcccctaacgttctaatgctttgtttttcctgtgtgtaaatgccttccttaggaacaaggaaaatta

SEQ ID NO: 182750 - DNA, 107 bp, Homo sapiens
tcgtgtaggggaacacgggaagctactgagggttttttaaaatggcgtgatatctcagatttagatcattgaactgttaagactgaatcttatgggatcaagactgg

SEQ ID NO: 182751 - DNA, 260 bp, Homo sapiens
aggttgcagtgagccaagattgtgccactgcactccagcctggaagacagagtgggactccatctcaaaaaagaaaaaaaaaaaaaaaaagctaaatctaagtaaagcacttagaacaatggctggcccatagtaaatgccgtgttagtgtgttagttgctgttcttccacgtcagaagaggcacagacaaattaccaccaggtggcgctcagagtctgcggaggcatcacaacagccctgaatttgaatcctgctctgc

SEQ ID NO: 182752 - DNA, 242 bp, Homo sapiens
aggaaaacaggcatgagccaccatggccagcttcagatctccctttggtgtcagtttcaggaaggaaaaaccaagaaacaagaatgttgactatttgcctggctaagacctgacacaggaatccttttaaacagctttagagttgaaagttgacttaattagaagctgatatttaggatatatgtgtatacaattttttcgaggcctctgctttctataaaagcttcttggaggccgggcgc

SEQ ID NO: 182753 - DNA, 338 bp, Homo sapiens
  misc_feature (255)..(255): n is a, c, g, or t
  misc_feature (260)..(260): n is a, c, g, or t
  misc_feature (296)..(296): n is a, c, g, or t
agagtttggagcctactccatctttcctgagcgtatacacagccctactcatgcatgtggccctctagatttccaggaatatgttggaccctttcaaagcccttacagactccccagcttttcctctcaatctttagactagtgtgttgttttcttcaacagttatctgtcaggcagcagcaaattaagagattagcataaatgttttcaactcctccacccaaagtgctgggattacaggcgtgaccaccgtgnccggncttctttacattttgattgctcacagtcaaacattnctattggattgtaaaataagcaaacctagagttgtggagatt

SEQ ID NO: 182754 - DNA, 319 bp, Homo sapiens
ttgaaaagtgaaaagaacaggtgtcagttgagaactgttattgaaagcttgcttttcgaaagtatgctgagagtgtctagagaaaaatagcttatctttcagtaatagtgctttaaaacagataatgccacccctttggtgttaaaatggaagagataatgccacccctttggtgttatagaggcatttttctttattcatcacaatttaaatttagtattgtagagcctttcacaaaatttgtcccctcttacggaattttgaggtcttcttattttagaaaaatatgccttcattacattttatttgcttgttcgtt

SEQ ID NO: 182755 - DNA, 560 bp, Homo sapiens
tttgctaacatgaatgatgctgcagtggccgtgtgtgtagctgcatcatttcacacatgtacgtttatctgtaaggacatttcagtttaaaataatttcagtcttagtggaaatgtttcaaaacaatacaaggaattcccatatacccttcatccatattcccccaaatgttaacattttactacatttgatttcgctgtttagctatttttttcctgaattttctgagagtgacttgtagatataatgcccttttaactgtaaatattttttagtgtgtatttcctaaaatcaaggacatccttgtacataatcatagtaaagtcatcaatatcaggaaattaaaattgacccagtactattgtccactgtaccgaccttattgaaattttatcattggtgtcagtaacatacttgataacaaatgaaaaggattttgtcaacagttacactttcctttggtaaaaaggaataagttttgataaacagttatactttcatgtagtcatgtagatttacccttctaggagcaattattggagcacctgtttcctcacagc

SEQ ID NO: 182756 - DNA, 367 bp, Homo sapiens
gtttaatttagttacatgtattctgtttttttcccccctctggaaacatttatgaccttctctttgtcttgatgctctgaaatgttttattgatatgctttgtcagtgttcatttattgttttggagaatcatgcatttattctgtaaatatagagaaatggccatgtagcagacactgctttaggcactggagatagagcagtgaacagaatagacaaaatcctttccctctttgaatttacactctagtggtaaaggcaaaaattaaataaactagtacataatgaaatgccagatagtaataaggatttaagagaaatgcaaaccatggtaatgggaaagataagagcaggataattttagata

SEQ ID NO: 182757 - DNA, 109 bp, Homo sapiens
atacctcttttcttaacatcactggttcacccttcttgacctcccttgtaggtttatgcttccctctgagcctcagtcccatatctccacttgtctactgacattgcca

SEQ ID NO: 182758 - DNA, 195 bp, Homo sapiens
attttgggaaagggcatcaccacagcccacatcacagggccacagactcagggcagcggggattacagagtatccctcacacccccacctaatcacccgcaaactttgtcaaatttaccacctcaacagcttctttattgcccctcctctgaaattcaattgctactgctttagtgtagaccctcatttcccttt

SEQ ID NO: 182759 - DNA, 476 bp, Homo sapiens
caggctgcaaaccagcggagcagggtccaaaaggggaaagtgcagttgtcttattttctcctgcgcctgcgatctgcgggcaggtaagagccagtgggtcttctcccatctgaacctgtttgtgcccttgaggctctacttgaatccttatggctcctctgattttctgcaccatcagccagactgaggagaaatggctgttgatagctttaaagtgttaacactccgaaaagtatctctatattaactggtaagagcttaaagccttgaaccaaaagcgttagagttctaatagcttaaaggagaaaagccggtatggttttaacaatatattgtttatcaaatgtggaaagccattgataaaattaaatagggaacaagacatttgttcaatgaaatcctaagtaaccattaaaaacaatgggatagcttcttataaactggccttccaggctggagtgcagtggcacagtctt

SEQ ID NO: 182760 - DNA, 289 bp, Homo sapiens
attttacagagcttgtatttttatttgaaatattctgtttgctattaaaatgtgagaaaaattaaaactcaattttgagaagtttgaacttgatactctttagcaaagctattatgtttgaaataattgaactggaatattttaacccaataaggatgtattttgcttaagctactggaactattccttaaagttgctcctctgaacaaggagtaaaatttatatatatgaaatttgtgactaaagattttgatttgttattggaccttatattattgtaaaacaaaaa

SEQ ID NO: 182761 - DNA, 533 bp, Homo sapiens
caaggcgatatccccccaacttgggaaatgaggtacaggagagcgaccctctactttatagtgttgccaaggctgtccaacttactggttcagataaattacagcccaaaatcagagcaatttcacccatggtggtcactgttccacagtggggacggtgctctgctggtgactatcaactcggtgatctcagtcattttccattcagggctttagtttcttcaactgcaaaactataagctggaatgagattatctccatgttccccactatctttataattgaataacagaaataattgaaagacccgggaacaacaatttcgcagtcagagtaccctaatgctgaattacaacctgatgccaactaccatggcagttaaaagagactccgtgcccctggcactaggtcagacgttgtgggtagaatcacaggggaaagggagtgacaccctgactcggagtgggaggagggagattaacccatcacagagctactaaggaatgcttacagagcctcacatagcagcactg

SEQ ID NO: 182762 - DNA, 478 bp, Homo sapiens
gtatcagccggtatcaatgagtattggcccgtatcaatgagtttggccagtattgatgagtattggctggcattgatgagtatcggttggcgttgatgagtatcggctggcattgatgagtatcggctggcgttgatgagtatcggctggcattgatgagtttggctgggcgtgggtggcgcggtgccttgccccctggccaggctggctcgtgggtgaaatgtgacatttaggcggttttctcctgtccttttagtttgtatttatgtggtatccgggtaccatggggagatctggcattcagggcagtattgagtattggccggtcttgacgagcagcagccggttctgggccaccgtgggtagcattgatgagtattgactggtatcaatgagtatcagcctgtatcaatgagtattggcccgtatcaatgagtttggccagtattgatgagtattggctggcattgatgagtat

SEQ ID NO: 182763 - DNA, 352 bp, Homo sapiens
gtatcagccggtatcaatgagtattggcccgtatcaatgagtttggccagtattgatgagtattggctggcattgatgagtatcggttggcgttgatgagtatcggctggcattgatgagtatcggctggcgttgatgagtatcggctggcattgatgagtttggctgggcgtgggtggcgcggtgccttgccccctggccaggctggctcgtgggtgaaatgtgacatttaggcggttttctcctgtccttttagtttgtatttatgtggtatccgggtaccatggggagatctggcattcagggcaggaggctgcagcgcaggtcatgggggctcaggcgcaggtgatgg

SEQ ID NO: 182764 - DNA, 377 bp, Homo sapiens
tctttgctcctgcattatttactactgttagagattgaaaggatataactcaaaacactatgttaagggttagtaatggctcatgtcactctcctgcctctacccgttttcccaacataacatacccacacagagcagtacatccacattcgtgtgtatgtttgttcaggcgtttttttctctggaccactatcgtttctcatattaaaatataaagggccctaaactagaaagttagttcttacagaattccatataaactggctcactctacttgcctggagggtgaggggaaaagaatgattaagaaggaggacagttggtttctctatataatgttgacattagccagtcattattgtctgcttatatgacct

SEQ ID NO: 182765 - DNA, 949 bp, Homo sapiens
cgcagatgccaatgacccagaccaccaatcagcctcccatcgccaatggtgtcctggagtatttggagaaagaactgcggaacctcaacctggcccagcctctgccccctgacctcaaaggcagatttggccatccctgcagcatgctgtcctccctgggctctgaggtcgtggaacgcagaatcatccacctgcccccactgatcagagacctgtcatcctcaaggaggaccagtgactccctgcaccagcagtggctcaccccaattccctccaggccctgggatctgagggaggggagaagccaccaccattaccctgatttccaccaggagctccaggaccgggggccaaagtcttgggcattggaaagaagggagttggacccatcgtggagtggaaggcaccgtagctctaggctgaatgggtcacccatacactggtcagacagggacagcctaagcgatgtcccctcatccagtgaggcacgctggcggccgagccaccctcctttcaggagccgctgtcaggagaggccccgcaggcccagcccccgggagagcactcagaggcacgggagacgacgcaggcaccgcagctactctcctcccttgccctccggcctcagttcctggagctctgaagaggacaaggagaggcagccccagagctggcgggcccaccgccgcggctcgcactccccacactggcccgaggagaagccgcctagctaccgctcacttgatatcactccaggcaagaatagcaggaaaaaagggagtgtggagaggcgctcggagaaagacagctctcatagtggaaggagtgtggtcatttagtcaccaagcacagcacaacttctgtggctacttctcggctcctgtgtgtcatcagcatcacctaggtttccagctgacttgggaactgcaagtctgagtctaacagtttt

SEQ ID NO: 182766 - DNA, 350 bp, Homo sapiens
aggagatggagattgcagtgagccgagattgtgccactgtactccagcctgggcttaacagagcaagatcctgtcttgaaaataaataaataaatatgataacatgtgaagtgcatagcacagtgcctggctcttacccacagttaatgtcagctgtttcaagatatttgatatctaaagctccaagtataatgcttggcacgtcatagacacttagtgactggtccatttctttggggagtacttatgtggacgtggcatgtcttcactagcttatttatttattttaagcagaaccttatttctagcatctaactactgcctccgtggttggcaagggtgacttcatg

SEQ ID NO: 182767 - DNA, 294 bp, Homo sapiens
atttattgggcaattaatgtgtactaggccctgttctaactgcattacatcaagaaatctgaaacaacaagaaactaagtaattataaaatatattcagctagaaaatgaggaagccagaatccaaacctaggcagttagcttcagagcctttactcttaactaccgtgctttaatggcctttagtacagttcgctctcattctcagcaagtcctaaaatccaaggacgcagagggctgactgtaagggcttgagcattgtgagtgttggtattcatggaggtgctggaaataa

SEQ ID NO: 182768 - DNA, 144 bp, Homo sapiens
gcagaggccgccatgtaggggaacgggccccgagggcagagcctgcagtgatctccagtgttctggggtaagtggcagcggcttcttggcagagctgtgctgctgtgtcacagggctgtagcgtcagcacctcccttgaaggca

SEQ ID NO: 182769 - DNA, 245 bp, Homo sapiens
atttgcaaggacttgtcatcgcctttcaagtcgtctctgaaactcagttgtcctgactacttcccaagaagagccccgctgaaaacttagaaaccagtggcctaccagaacgcctttggaaatagcccacattgcactggcctgggagagctttctggcagagccttgctgctccctggggtggccactgatcgagaattcggcatcatgctggacaagagggaagatgaaatgaacaaccagtc

SEQ ID NO: 182770 - DNA, 317 bp, Homo sapiens
ctgactctagaggagcccgctgatcgcttaggggatggatacctaccccattttccatgaagcgattattatgcattacatgactgcttcaaaatatctcatgtagcccaaaaatatatacacctgttaggtacccacaaaaattaaaaataattttaaaaatgattgaatcacaagagccaagggcagagtttgtttcaataatgatggagtaatatcaatattgccaccagttataatgaggtaatgaatggtaagtattgagaagcagtcattatttttagcaaaaatgcaaaaaaaaaaaaaattcagggact

SEQ ID NO: 182771 - DNA, 539 bp, Homo sapiens
acacaacaatggaagctgagaaaggaggcggtctcaaagaaaagatgagtaagacttccacaggaagcagaaatcaaaaagaaaaaaggctgaaaaaatggccgacttaataagtaggagtttgtcaatggacttctctggaactgtggggaaagaaaccaagtttcaaagggcaactggatgaatgggttaaagaggaagaggaggcagtcttttaaaaagtttggcagtaaaaggagggaaagggtaagaaaagtaagtagtctgatgaggagaagcagcaagactgttaataagagtataaggtgaggagcaggagccaaaagaaaaggaaaagttgaagacagaagatacatggagaagatgtaagaaagaaacaggaggaccagactccagcacgtcaagagggaataggatacaacacacaagtgaaaggctacccttgggaaataagtcaccttctgctctaagacagaaatgaaagaaaagagattttgacaaatggacatggtgaaaagttactctgaatcaaccttgaa

SEQ ID NO: 182772 - DNA, 318 bp, Homo sapiens
agtactaatattacatgaaccttcacacctcttgggctggtatgagaattaagtgaaaatttgtaaagaaattagcacattgtgttatatgtacacagtaagcaccatgtaaacatttgttaaataaattccagtcaatggacccatattttaaaaagtcttagctcttcatctaaagattagctagcctcttttgtgtgttttatgttaaaataagatgtttaaggcatgctttatatctttttccctcggtttaacaattctgattaatctgtttcaatctcactgcaagacaactgtttcttacatactgcctag

SEQ ID NO: 182773 - DNA, 489 bp, Homo sapiens
cagttgtaaaccccaaatggtcatttttaccccgattctctatggttactaatagtaaaaactccaggaaaccacctggagagttgccctcttgcttcaggcactagtgaggagagaagtctggaagccatagcccattggtcctggccaagaaggagagtaaacacgtggaagagtgggtggtggagctgcacagcagcaggcgagcaaatatgcagagtctggccagaggacaagaggtcagccaggcccagagctagcctggaagtctatgccctgaggagatgttcaagagtctggtggagtttggagacataaggacactaagcaccagcctcctaagaggactccctgcccactgtcctctctcctgctgccattctccacagtgcagccaaagcaatctttcttaaagacatatcagatttgcttagagtccttcacttgctccctatgattttcaagataaagttgaatttgtgacctggc

SEQ ID NO: 182774 - DNA, 636 bp, Homo sapiens
cctgtaatcccaacactttgggaggccaaggtgggtggatcacctgaggtcaggagttcgagagcagcctggccaacatggcaaaaccccatctctactaaaaatacacaaacacacaaaaatagctgggcgtggtggcgggcacctgtggtcccagctactcagaaggctgaggcagaggtgggaaaatcccacctgagactgggattgcagcactgcactgtgtatgagacgctccccacaataacaaattataagtagtttccatagcaccaaactattagcacccaggcatacattagagaaacatgtattctagcaagaagcctggttaaggtacaaattagttaaggcacttcacaaatacctacctaatcaggatctggcaatgtgctaatacacaaaagacaaaagaagctttctattcaggtaaaatcaaaagtctttgtaaataaccaagctgtgaaaagcagttacaaggggagttctccccagaattcattaacaaaagaatacttaaccacctcgggcaatgtatttacacccattaaagccctaaggacagatggaccaatttgaccaagagttcctttcagccctgtgagtcttgtctttagttagctattgtttaggtta

SEQ ID NO: 182775 - DNA, 661 bp, Homo sapiens
gggcagtgaatcgtagcgttctcatagctgttcctgtgtagaaacggtatgctagatgggagttagtaagaatgatatatttgatgtagttcattaactagtagtattcatgcagaatactaggagaattcaggaaagcaccacccatattgtgggttaaattgtgtctgtcaaaaatatacttagaagtcctagtctataatacctgaatgtgaccctatttggaaatgaggtctttgcagatgtaataaagtcaggatgagataattagatagggccttaatcaatatgactgtttctctttcgcccaggcttgagtgcagtggtgcaatctcagctcattgcaacctccgcctctttggttcaagcaattctcctgcctcagcagctgggattacaggtgtgtgccaccatgcccagctaatttttgtatttttagtagagatgtggtttcactatattggccaggctggtctctaactcccgacctcaagtgatctgtccacctcagcctccgagagtgctggaattacagccgtgagccaccacacccagcacaatatgactgttcttatgaggagagaaagacataaagggaagatggccatgtggcgatgacagaaatacatattggagtgataaatctgtgagacaaggaaca

SEQ ID NO: 182776 - DNA, 531 bp, Homo sapiens
acccccacccacccgctagatacttacaggtatcctagcctagctgatcccttttcttgcaggcctggcatttaccctttcatgggttttagtaaaacatttataattttttaaaacttcattaactagtagtattcatgcagaatactaggagaattcaggaaagcaccacccatattgtgggttaaattgtgtctgtcaaaaatatacttagaagtcctagtctataatacctgaatgtgaccctatttggaaatgaggtctttgcagatgtaataaagtcaggatgagataattagatagggccttaatcaatatgactgtttctctttcgcccaggcttgagtgcagtggtgcaatctcagctcattgcaacctccgcctctttggttcaagcacactcctgtagtcccagctacttgggaggctgtggcaagagaattggttgaactgaacccgagagggacgcggaggtcacagtgagccgacatcgtaccactggactccatcctggcgacagagtgagaccct

SEQ ID NO: 182777 - DNA, 1254 bp, Homo sapiens
ctgtgatctttcccaatattgactggggtttgttgagtgtctgtaatcccacaggtggatgttcatgatctgaagtgacaatggtatatttgctcagcatttcctgtacctgaaacaacccttgaaaactgaaatagaaagagcaagtcaatggtaatatcatccagcactctgccaggcttatggcgaccttgcttacccgaaagcaaattacttccctctcatttctatataataagtactttacggctttgtgttttcatgcattgagatttccctaggagtctgagaagatgtccaggaataaaagagggaagaacaatgattaaactatttctaggactttagacattggattatattcagaaacccataatcagaccgttaatgaatgtcttcgcattcattatcagactctgaaaaagcatatccagtctctccatggactggccttcacatatgctttgctatctggtagaaatatctgcccaaaagattattttttatggaaataatagtgcacatgcagattctagatattattttctatttatcaactgcattcaggcagtgctaagtagatgactgatgctgaaattttactagatgatctttgctctctattttgttatatgacacatggggcaaatacgtgagatgagcaattagtgaaattctggaagggacagatttatgtcatactattgaaagggacaggaagtggattaagtatgatatatatatagtatgtgtgtgtgtgtaggtgtgtgtgtgtacgtataacaagttagtttccttttcctaccactgaaattgttaaatggaatggtgacgtagacactttacttctctactcctggacttactagtaaagaagaaatatataaaagagcaagatagtattgatctggggtggtactatggtatgtattaataccataccgtaattctatgatctattaatgtcacaaccagctacatttagctggcttttatatacgaatgtgcatagtactgttttgtattaaatatcaccagaagatatttgtcacataaaacggaaatacgttttattttgcgactcatgcagagtgaagaggctggggggaaataagtttcgggaacccattacaacaaaataaaggataggggcgatataagaagaaaaaaaaggggggaagcgaaaaatatggaaaacgaaaagggcgaggtgtaaaaaaaaaggggtcatggggggttattaagagatgaaga

SEQ ID NO: 182778 - DNA, 666 bp, Homo sapiens
tggatgccctgactttacagaccatcatcgtgtaggaggtgaggctgctgaggagaagatgctttacacacgcaagggttgtaataatgactttcaaggtactcagtctaatcacaaaatagagctttaaaggtgaattatttttgaaatgttcatatttagtattttcctcataggcagaattttgaaagagtgcgtatctgaggcctgacatattgttttgggagctaaaatgtgtttaaaatgtaacgttcagaggaagttaactgctaacttttctcagttgtaagatgattccagattcccatgtatataaaatacatcagtcttaagacaaattaaacaaaatgtattatgtattttctttaaattattattttttgcacttcaggcataaatatttttaaatatgaaaactccacataaacatatgcgtacaactctgagctcatgtcaaaaatgtctgcgactgcctcatcatagttttggaaataaacatctttattaaaagacattcaacaaacttaaaattttttttaagggggaggatggaatcaaggttaacagaaggaagtgcctttaatttttgtatacttttgtaatttgttttacccctggaaattagcatgtattatttttaaaattcagaaaaataaagtcagcatt

SEQ ID NO: 182779 - DNA, 199 bp, Homo sapiens
cgctaacaaattgtataacctagaagaaactgataaattcatagaaacatacaacctacgaagactgaatcataaagaaataagaaatttgaacagacctataactgagaggacattgaaacagtaatcaaaaacctttcagtaataacgacaacaataaaaagcctaggcccagatggcttcagtggagaattctact

SEQ ID NO: 182780 - DNA, 164 bp, Homo sapiens
ttcaccttcctctatgcccattccctttgccccactagctgttactctcaagaatagatgctgactttactcttatgaactgtacatgacttgacctgaaaggggaatcgttttccttactcctcattgtggagtattttctttcccctactctaaaaatctgt

SEQ ID NO: 182781 - DNA, 623 bp, Homo sapiens
acctgtcccgcaagttgacaagtagaatgggggacgaaaatgtccgctctttcccaccctgtctttctccttcccggggctttatcatgacactccaggaggctttgttacaaggcagcgcttatttaaagcctttcagccctgctatgctctgcgctttgcagtttacaaagcgcttttcacctctcctctcgtttaacttcaggaaaattatctgaggtagcagtcacaaattcccatttcacaaatgacgacccgagaggagaagggactggcttaagattagtggtgctgtcaaagcactggacttgctcattaggaaacagagaaagcctcaactctggcactaagggcaaaaaccagccttctccagccccagtcccacgcctgggctcttctgcagcccagaacaaaactcctgggtggagaactcttactttcccattcttctcaaccaggcaagtcatcctgacctctgcacctgggacagccagcttgtctagctgaatgaaggagaacccttgaactccatacctgcaaagattcttagggagaggagggcggcccaatacctgcactcttcaaggtcacaaggctgggtctggaatttgggccgacgggtg

SEQ ID NO: 182782 - DNA, 613 bp, Homo sapiens
cccacagggctgcattcatttctggaggctcaagggatgaatctgtttcccagcccttcccagcttctaggggctgcccacattccttggctcatggcccctgcttctatcttcaaaggcagcaagagcaggttcagttcttatcacattgcctcactttgacctcctcttctgcctctctcttccatttataaagacccctgggactatgttgaacccatctggataatccagaacaatctccctattttaaggtcagttaattagcaaccttaactccatctgcaaccgtcattaccctctgccatgtgacatatcctattcacaggttccaaggattatgatgtagacatctttgggaagagcattctttggcctgccatgctctctttcctttgccactgaaaccagcaatgatctggatgagaaagcctccatcaacctaaatcccagggctgtcccactacatgacagatgtgtagcataagggagaatgaaagctcttgagccactaagatttgggggttcttaccggccacaggctagcttctcctggctgatacaaaaagtgagtattggctgggcacagtggctcatgcctgtaatcccaaca

SEQ ID NO: 182783 - DNA, 278 bp, Homo sapiens
ggtggttctgtggggtgtcccttccctatctttgttccctcactgagacattttgacctgcaaaagagctagactccagaagaagaaatagggacccaaggctgttcatgaggaccacttcctgacacaaggtacacacaaatcaaatcataaagtcccagaggcagggctgggtaggtcaagatgggcctcaggatccctgggagaaagtaggctctggcccagaggactggtgcatccctgaaatgcctaactgctaaagccatccccacacaagt

SEQ ID NO: 182784 - DNA, 549 bp, Homo sapiens
tataaaattctctgggaagaatttggcatgattgatccaaattgggtggaaagcaataagatgcaaagacagagaggaagagagacagaaaaagagagaaaaagagtttctgtagttcagtatttcaggaaatagtagatatttgttttcacaatgatttatttggtatcatagtaaatgaaactgctaaagaatcctcagatttattaaacaaaagaaaacttacctatatgatgagcaccttgacttggaaaagggagaggctcaacaaaaactatcttcactcaaaagtttactccatgattaggaagtccccaaagttagtaattcacacaaaaactatttgaatcactgtaaaagatgtttaaatttttatttccaaggttcactaatacattcgttttgagaaagttattagtttggtcacttcagctagtacaaatacatgacataactattttgtgcccagaatcttgttaggtaccagaagaaacacgaagaaaatctatgcttcagttcttacccacaactgagttactgtcttctgaa

SEQ ID NO: 182785 - DNA, 420 bp, Homo sapiens
gctcttcctactatcaggagtgggtgtgtgtgtgtgtgtgtgtgtgtgtgtgtcagacatgggattgaggagtggcccagagctcccaccaccatggaaatgcagctcccatggccacccacacttccacccaggggcagctcaaggctcaccccttcaatagagcctttccttgccactctgtcctacatgaatcacacctgcctaggggtacaaataataatgcaacagaatgttttagaataccatttttccatttccatctaagtgtgccaagtgttggcgggggggtgtggtgggcagagtccattttatagcccacagcaatgaggatcctaccttgaaattatgcacagtgatgatatcacaaatgctggcaatctcaagcaagtattcagccaccttggttggcagcctggg

SEQ ID NO: 182786 - DNA, 457 bp, Homo sapiens
atgaatctcatactatgaacacaaggatagtaataggccaaggagcatttaaatatttatgcatattctacttagatttatatttggaaacattttaaccctggtagaagaaacgtttctcttctcatgatctactatattttctaggactttaaaagtgggtatgttagtacagaaaagcagcaaaggagccaatccaccctgtagctttgaacaaagacaattctattaaactttcctttacaaatcatgattagggaattggctgagagtaacaatatgcatcataaataaattgaaaattgttccaggtattatcacacaataaaatatatgtaacactgatgctgtattcaagatcaagacaccttaatattttattcgtttccaagtcacttagaaaacctgcattagtttaggatgttcgttaatagtattgtaatcttggggaaaaaaa

SEQ ID NO: 182787 - DNA, 861 bp, Homo sapiens
actctattaaccaaattgtattatacaaagtgattattccactaaaataatatgatacaacttaggaggagatgatgaaatgaacatagcatacaaaataaaaacaaaacatttcccccgttttcttaacattatttctgatttgatctgtaattgatcttacagttactacttgtgcattctttttcttaaaatatttagtatttgcctgtgagtcctagcacagatgaaaaccacgtggatctagaattctttaaccttttccacttaattagtaaagaatctgtcataatggtgtttttacacagcatcttcagcaagataacaaagagcttggtagctcagcattacattgtcatggcaactgcccaagaatgtttttggtgtttttggggtgtgtgtgtgtgcacgcacgtgtgcacagggacgtgctttaaattgaaactgtagtcaggttcttaaaatgtcgactattcatttttagatttctaaagctatgtccaaaccaagagaaattacatttatttgggattcttgaaattctcctcttgctatgttttattttctagtatatttaagagtcataataagttcaagttcatacacatatgcatctacccatctctggatagttcataatcttactcagtttttcttgaaatcatgaagaaaccatttttttcttttctaaatatgagatatttataacaccaaatgtaaaaaatattgacagtaaataattggcaagaagccagtggaacaggggctcttgaaatgagcgtgcagagacatgaatgggcagctggacactttcaaccacggtcttgcaggactttgcttagaagtggatgttaaacccca

SEQ ID NO: 182788 - DNA, 502 bp, Homo sapiens
agcagttcttcttcatctgtgtggtcttggcattgctggaccgtggtcttctcctctgtaaaatgggaataataatagcacccacctcataggtctataatgagggcaacctgagataatgcagggagagccgtgggcacaggctgccactcactaaggggggttccaagatgaaggcgtggcctctttgggcctctctcttgctctgtatggggaaaaggttggactcatcatctcaaaggacccttccagctctgagtcagtaatgagctccttctcttcccaggtgcaggtaagaggtgctgcctggcccaccttgttgcaggcagtggtgactgatggagtgtcagggcctggagtcaggaggagacttctgcctctgatggcttgctcaagactttacacctgggtgtcaggttgtcagggactctggtgacctcatctttctcctgtctgtctgtctgtctgtctggtgagctgagatcacgccattgcactccag

SEQ ID NO: 182789 - DNA, 209 bp, Homo sapiens
ctcaggtgactctgacactggtgttggcagtgaggggtcccttgggacctgcagtgttaccatcaggaaggaggggtccccagagccaaaggcagctccttctggtccttgtgcttgttgatgacaggaagttgaatgtggcttttagttaaaacaaaaaactgttctggaaaccagcttggtttcagctcatcactgtcatctgaaca

SEQ ID NO: 182790 - DNA, 430 bp, Homo sapiens
agaggagggagctttccaagaatgaatgttccggggaggaagaaagcagaagttatgggtcttcttaaggtccttaagaggcgttgaagtcccagaccaccacttctgcttcattctaacaggtcaaagctgtcacaaggccagcagggaaacaatggcagtgaaagtaaactccacctgttggtggcaaaatggcagcacacgctgggaagggtggagttgacagtggctgtctttggagatgactacactaatattgtcccttttggaatctcaaaggacagtgcaaggctcttggacaaaaagaggtcagaaagctctcaggacaaagggcaaagggcaaagggtaaaggctgcagcagtgattgatcaatcttgtcgcctactgatattccctctacccccacctctccactctctatgccttgtc

SEQ ID NO: 182791 - DNA, 156 bp, Homo sapiens
agggagactgattcagtgaacaaataaagacggttgacatttaaccaggattttaatgggtgtgccaaattgcaagatacatacacatgtccactttgggaatcatgtttaataaacaatttgccctaagaatttgattcaatcagcatctcccag

SEQ ID NO: 182792 - DNA, 186 bp, Homo sapiens
tcctatgtcttcctccctctccctactctgccagtaaccaagtgacaacaatattgctagtcatctatttttttaatcatgtgattttcttacaaaagacaaggacaattgctcagattgttgtttccaaaaaaaaggcacatgatggttagatgagattccataccattcagttgcaaattcaag

SEQ ID NO: 182793 - DNA, 315 bp, Homo sapiens
acatactcctttgccacaaagtgggatgggtgtgcttggccccagggccatgacccccttcggatcttgcagacttcttgcaaacttgaagtggcagcagcacatacaggctaatgactaagcagttcccactgcgctttaaagtcttgccttaggctttcaattgtgcttatcattcaaaatgctcttttttgcaaaagagcccattttgtcagttttcttcttgtttagatttaatgattaatcagaaaagtggttttttgtttttaggtttttttgtctggtttggagataacattggaggcttaacgcctg

SEQ ID NO: 182794 - DNA, 117 bp, Homo sapiens
cgtataattatagctattcctgtttgcttttagtttccatttgcactgaatattttttccatccacttccagtctgtgtgtgtatacaggtgatacaagtttcttgtagatagcata

SEQ ID NO: 182795 - DNA, 510 bp, Homo sapiens
ttctatatttggggatttgaaataaaacattcatgttggaaaagctatgaatgatgcttcacttcccttggaggcaaactccttgctaatgagtgatgtcaaagaatatttcactcctccagaaaaactgaaattccctgtaatctcatggctcataaatgaaaagaaatgagaaaaatttccctaagtttgacaataattctaaactttaatatgaaattgctaatcatgcaagttggggagtttaaaaatatattttaaatattcaataatgtaaaaacactatttttcaccacattgaaaagaaaaactaaattattttttaagcttctccatagaaagagatgtaaaattgtcatatgaagaggcactaaagtgttctagagatgacagactcctaacttgaaatttgttatggtaatttttgtttgtgttttttgtggcatttaactttataagtatacagtttgttgtgtcttattttctcattaaaaataaatattttacttc

SEQ ID NO: 182796 - DNA, 325 bp, Homo sapiens
tacaaaaaaattaaaaaattagccgtgcatggtggcgctaatagaacctatagttctagctactggggaggctgaggcaggaggatcacttgagtccaggaattcaaggctggagtgagctatgattatgtcactgcagtccagcttgggcaacacagtgagaagaaccccatgtacatcatctgccaacctcataattggtattgtgacatcatttaatgcaaggaaacagactcagggaggtcagggaacttgcctaaggttgcagagctaattaaaggatggagactgagttcaggcccaggacaaaggataatgatccaag

SEQ ID NO: 182797 - DNA, 626 bp, Homo sapiens
tggctagtgttttccatcaggaggcaattatggcaaaactacaatatcctttcatgtacaggtgtaggcatacgttttgagaactacctaggagtggaattgctaggctatgtgataagtgtatgtttaactttattagaaatggcaaaactattatccaaagtgactgttttacatttccagctgcaatctatgagagttccaaattttccactttctctccaacttagtgttggaggttccagccagggcaatcaggcaagagaaagaaataaagggtattcaatttggaagagaggaagtcaaattgtctctgtttgtggattacaatattgtatatttagaaaacaccatcgtctcagcccaaaacctccttaagctgataggcagcttcagcagtgtctcaggaaacaaaatcagtgtgcaaaaatcacaagcattcctatacaccaataacagacaaacagagagccaaaccatgagtgaacccccattcacaattgctacaaagagaataaaatacctgtgaatccagtttacaagggatgtgaaggacttcttcagggagaactacaaaccactgctcaacgaaataacagaggacacagacaaatggaaaaacattc

SEQ ID NO: 182798 - DNA, 300 bp, Homo sapiens
taattttacttatttcctacttattactaacttgacttaataatatcttaaaaggaggaggatcattaaacattcctttgggggagacaaatacatcacgtcccatcccccaactaggttgcctaatctactaggaaggatgagaaagacatttctcatctgcaactgcatcaaatgggaacccaaactgaaagatggttttcattttttaaaaaattacaagccttaaaatatgtttctggaaacgtatcatattagcattttatgattgtagacaattcagctatgtgaattgaaaga

SEQ ID NO: 182799 - DNA, 356 bp, Homo sapiens
tgctgggattacaggtgtgagccaccgctcccagcccagacctttcttactgacagaatctggtctgggccagaggtctgatacagacctttcttactgactcatggataaaaacattgtctctccagaaccaaaggccaggcatgggcagccatgtggcccaaggtctagtctatgagagagtgggggcagtcccagccccttgaagactgggggcagccccttctcactaggcagggctcagctttacccacttcagtagaggatttttcagtttttattcaaacttcctgtttttcttcccaattacacacatcttttttcattgtagaaaacttagaaaatgcaagtgagca

SEQ ID NO: 182800 - DNA, 258 bp, Homo sapiens
agtccttcagactgatttgttaatgcctctcttgcaactatgtctggatttcacacaggatcaagtcattctacttctccccttagcagtctaaacctattttgctgccagatcactctcaagcttgaacacatctactatctcaatgttctttgttcaaaactaagttcaaaacaaaactttgttcttgcgtagcaacttctcaaccttacatttgaagtgttgcaaatttttcaactattactgattctatgctat

SEQ ID NO: 182801 - DNA, 211 bp, Homo sapiens
tggttttatcaaatggaaaagatttctctcatcccatcattcaacattgtaagcacatgtgaagcatgaattacttcaaggatcataactccaagacataataataatatagcaagaataacaatggtgaaatatatcttgacagtttttgagatcttgtacctttggaaagtaaaagaaacggggatatgacttctggggatgacttctg

SEQ ID NO: 182802 - DNA, 300 bp, Homo sapiens
ctgacatcctttcttttattggaagacaaatccaacatttgttagacatccaacatttgttggaagtctaccttacaagaaaccacctcttatctgcaacataaacagaagctacatcaggttgaaaatccacatagaagactggagaaaattgccgtcccctttcgcactaggttttaccaggggcccaagatgtcagaggaaagtccgcggagggccaaacacaggtttacctaattatgaatctcagattagaatgtcttattgtgtggaaaagtcagaactcaggaaatgtgtctg

SEQ ID NO: 182803 - DNA, 546 bp, Homo sapiens
atcgttcattctgttagtgtggtgtatgacgtttattaatttgtgtattttgaactatccttgcaaataaccacttgattatagtgaatggtccttttaatgtgctgttgaattcagtttcctagtattttgttgaaagttttgcgtctagtttcatcagtactattgacctgtaattttcttttcttatagtatccttatctggccttggtataagggcaatactggccttttaaaatgagtttggaagtgttcctgcctctttaattctttggatgaatttgagaagaattggtactagcttgtgcttaagtgtttggtggaaatcagctatgaagccatctggtcctcagcttttctttgttgggaggtttttgactactgctttagtcttctttcttgttattggtctgttcagctattaatatgtcttcacttgtccaggtacagtgtgtaatcccagcattttgggaggccaaggtgggaggatcacttgagaccaggagttggagaccaaactgggtaacatagcaagactggtctcta

SEQ ID NO: 182804 - DNA, 307 bp, Homo sapiens
ctaagttggttttgttttgttttttataaagaggataagaaatgaaggggggcaacttcaaactggcttagacaggatgctgtagttttgctaaatttttcccaagcatgtttctatttaaaatcatctttttggattattctggaagaaagggtaacttatctcatccaaaattggtgtttccaatttccttatataacaaggcttgaatgttgtggaggaagtaggcaaaaactaaagaaccaagaaagatcaaaaagcaagagacctataacccgtaaggttaagaggttatgaccctagggcc

SEQ ID NO: 182805 - DNA, 625 bp, Homo sapiens
ctctaagcaactccccacacaatagctaaaggaatctttctaaaaacctgagtgtgtaccccttaacagctccccagtccttcgtttgacttcctcagagccctatttattgcttaccacaccctgcactccagccctactaacctgcttgacattccaagactacacgccattttaaaccccacatgttgacaccaactgcagtgtttcttcggcatggaaggtccttgccctgcccccttattttacttggagaattatttagaatgccctcctgatttccagtttgcttttagattacaaaatgatatccataatgattagaaagatacataacttatacatacatccgaaaaagaagtcatctgaaaatctacaaatttttataaatcagtaagaaaaacttacgacacaatattttttttaaagggtagggggcaaaagacttaaaaaggcgcttcacaaaacaggaaactcaaatgaccaagaaacatatgaaaagatgttggctgggcctggtggctcacgcctgtaatcccagcactttgggaggccgaggtgggcagatcacgaagtcaagagatcaagaccatcctggccaacatggtgaaaccccatctctacc

SEQ ID NO: 182806 - DNA, 417 bp, Homo sapiens
tggccgactctagagtatcccagcggacgcctttatctacttggagaattagtttagaatgccctcctgatttccagtttgcttttagattacaaaatgatatccataatgattagaaagatacataacttatacatacatccgaaaaagaagtcatctgaaaatctacaaatttttataaatcagtaagaaaaacttacgacacaatattttttttaaagggtagggggcaaaagacttaaaaaggcgcttcacaaaacaggaaactcaaatgaccaagaaacatatgaaaagatgttggctgggcctggtggctcacgcctgtaatcccagcactttgggaggccgaggtgggcagatcacgaagtcaagagatcaagaccatcctggccaacatggtgaaaccccatctctacc

SEQ ID NO: 182807 - DNA, 236 bp, Homo sapiens
taaggcagattggatttggcctgtggcctatagtttgctgggattgatggaaggttctttaccatgtaaagaaaccaggagacaaaggaagttttcgcagtagtcagctatagtttccttgtcatacatccttggagtagcatcaatgtattacaaggttttcacccgtccttagtgaaatacataaagttaggaatctcaactacttgttttaatatgttggcctttgttttttt

SEQ ID NO: 182808 - DNA, 220 bp, Homo sapiens
ttgccactacacaaaacttaggttattttaaaacttggaagccatgtaatgtcaataatcaaccccacattatagcccgtcacagtaattctctgaagaatatgtagcagtttttgattatgtcctgatcaaaggataaggtagtcgggttgggtaaggaaatacagagtaggtcccaggtcaccatggtccaagcccaggtgctcagtgtgtgtcctct

SEQ ID NO: 182809 - DNA, 653 bp, Homo sapiens
ctgcaggattcagtaagaccaccaatttttagagccaatgcattataaagtcatattcaaaagaattttggggttctgtattctgtggccttcaacttaatggaatataagaatgttcttttataattataatctccaaattagcctagttgtgtatgagagagggagacagagaaagagagagagagaaaagccaaaaaaggtggtgtattaaaatagctacacttaacatgcttctttacaaattatttagagacaaggctgactgtgccaaactcatttaaaaaatgcaattctagatgacatttaggttttcacatagtcattaaaatacattttagacacagcttagatttggaataaatgtgcagaagtgacataagtatctagatcacttccaaaataaacagtggcactatagtacctcctgccagtcttcttcgatggcaccccctactggatcattgaggaacttattcgtgttctaaattagagaaatgattcacgaggaaacagttgattttgaaaatgcctaaagactggttatttagtaaacaatatttgatttaggaagattgaccttgccaggtactaagagaatacacattaaaaaagtggtatcaaggcatgatatatatttatgatgtgtttaa

SEQ ID NO: 182810 - DNA, 505 bp, Homo sapiens
aggctggagttcagtggtgcgatcttggctcaccgcaacctctgctttccaggctcaggggattcttgtgcctcagcttcctgagtagcaaggattacaggcccgtgccaccacacccggctaatttttgtattttagtagagacggggtttcaccatgtttgccagactggtctcgaactccgtacctcaggtgatccactcgcttcagcctccgaaagtgctgggattacaggtgtgagccaccatgatggcccagttcttgaattttgatgactacagttcaaattgattgtatcaagagttcaatacctgaatttatttggtttggatattggatgtcaagagagttcaggataatttcatctgaaaatttataaatttattcatatctgttcagttcttgattttttttcttttttttttttgtttgtttgtttgtttgtttttgtttgtggagatagcctcactctgtcttccaggctggagttcagtggtgcgatctt

SEQ ID NO: 182811 - DNA, 262 bp, Homo sapiens
gctctatactttctatattaaaaaaaaaatccaagtgctacttttccttcccttgccagctggtatcatgagcctgttcttttgaagttagagagataagtagaaaataagaccatttgtcactccctgctgccaggcagctgggttgcaagatgagggagcacctgagttttcagagaccattggcagggacacgctggcagggccctccaagtccctttggttttcttcaattactcccttgccccttcaagtgcttgta

SEQ ID NO: 182812 - DNA, 544 bp, Homo sapiens
agtgcaccctctccagagtgaagcaggatgctcgtttctttagggaaagaccctgccttggtgtgggaaatagagcctccaggggcggccctgccccacacctgcctggggcctagggaaatcctgccccaagatccagacccagacacctgccactctgacagctggcacagggatgggggctggggacatcacaccacccgcattctctgcagggatacccagccatccattttaggctaaaagccttctccgcatctcagccttccccaaaattttacaaatactagaagataaaagcgcaggaaccagcatgaatgaagttggtttttaagagacagtgtttaacatcaagatccttctgatgtgagtaatttggattctgatgcaattctggattgtttgttgaattatgcatcagcagcttctgttgctgtaaaaagcaccaccgtcactcgagctaatctgaaacctgcagcaatgaagacagttgggttcacagtttggatactgagatgcgtctttgatgatagtgaaccagcag

SEQ ID NO: 182813 - DNA, 222 bp, Homo sapiens
acaacagaaaaggaagaggaagtgaggtagggaggctatttaagccttgggagtcggaagtagggaggttgaaactgtgacatgggtgaccagggagttgggaagggacccttggaggtggctgtggcaggagaatcgctggaacacgggaggcagaggttgcagtgagccgagatcgcgccactgcactccagcctgggcgacacagcaagactctgtctc

SEQ ID NO: 182814 - DNA, 778 bp, Homo sapiens
ttccctcaaaataaggtagctagtaaatggcagagctaacattcaaccttatccatgtctgactacaaagtaatccatccattacttaccttttttcatggtaagcttttgctttttggtcaacaccatgcactgtgccttgagtacatgtaccaacattggaagaccattcccatgtgatatttgtaatagaattaggtattcaaatcacgcattcttgagacaattaaagaatgtaggatttatttacatacaaagttgagagaacgtgcatcatgctgtgtcaggcttcctttccatgattctgttagttttcagtgcaggtatttgccacctgacttgggtttcctagatgtctataatcaatgaaatattttctctttttaaaaactatttttaaaatacatgttttaacagtgttgaattacaagatgttttaagataatataaacctggacccaaatttctatgtaaatgtttattttatagagacaagtaaattaaccaaataattcagtgaatcttcattgagaacctaatatgacctaggtaccgtgctaggtgtcagagaccggctatatggtttagtagaaagagaaatggtagacgctgtgccaagcatagtgcctggaacaagcagaaagtccataagaaatatatgttaactgaaaggaagaacaaaatggaaactgtgtctgtctgagtcacccaaattagtaatgtctgtgagtttatttcctcatctgaaatgaagggtaataaacctacctattcagaa

SEQ ID NO: 182815 - DNA, 298 bp, Homo sapiens
tgctgtgaaatattaacagtgcctgctacatacatgtcatggcctaggagaaacagaaagaacttgatagcctggaggtagaaagaggcacatgtgtttgaacagtgattctcaagaagtggatcctggactagcagcatcagtatcatttgggaccttgttagaaatgcacattctcctaggagatgtaggagaagaaggttttgggggagtgatgagaatttttatttttgcacatgctgaatttaaaggaatcatgggtgggctaggcacagtggctcatccctacaatccaagc

SEQ ID NO: 182816 - DNA, 381 bp, Homo sapiens
tactgaatgctgcccttcattcacgaaaagaaacagtgcatgttagcacctcctgaaatattagtatctggctccaggatgctttgtccaggtcatttggcatggagctatttcaggctcacaagtagaatacatatgtgcggttagcagagtgaagaggagctgtgggtctgtgaggtatggaacagggaagtgggctttggggctgtgcagacctgctctacacccaggctctgtagcgtcgcgaatgggtagcttgggtgcatcacatcaccttcctgaatgttaacccttcatatgcccagtgggggagagaagcacctgccctgcaagatgcaatcaggatgcaaaacatgttggggtgatgcaggtgatggtaat

SEQ ID NO: 182817 - DNA, 155 bp, Homo sapiens
attaaggtaattcaacggaggtacaataattttttaataaatggtgctggagcaactggatgcacatatgtaaaaatactaatcttcatccttacttcatatgacacaaaaatgaactcaaaacagatcacagaatgtaagaagaactataaaag

SEQ ID NO: 182818 - DNA, 377 bp, Homo sapiens
atcactcaatgtatcagaagtcatctcaaaaaatctgtatgttaattttcctattagctttcactaaatttcacattatgtcttctttccatctcatatacataatacagatattaccaacaaagtaggctatagtatagtcccattagaaaaaaatctttgtgttatatgttaagtacatgtataggcatgtgtgcacatgtatgtgcatgtatacatacacacaccataacactcctaaaagaggaatgagttaaatgacaatgaatacatattcattgggactacaaacaatatttgcacgtggaacagcaaatggctccattcttttaaatctagatgatgagctgggtgcggtggtacatgcttgtaatccc

SEQ ID NO: 182819 - DNA, 375 bp, Homo sapiens
gtgggtagttgagggagtagggaggggctgaacaacttctcaaaggtattccatgacagaacacagaaggctggaccactgccagtttctggggaaaccaggactgaagggattggcagtggaccgagaggccactcaaggggctgacctttaggagtatgtctacagtcagagtacaagttggctagggctactacatccaagggcacagactgggtggcttaaacaacaaaaatgtatttcctcacagttctggaggctggaagtccaagatcaaggtgtcagtggggttggcttcctttgaaggcaactctccttggttggtaagtggcatcttctccatgtgtcttcacatggtcttccctatgtgtctgc

SEQ ID NO: 182820 - DNA, 326 bp, Homo sapiens
cataaagaaagagattactaattcccatgtggtactaaaggttataaagagttaaatcacagcatatgaaaacctgtgtttaaataatttttaggcaatgacacaagctgaggagggaaataaaattaataagtgacaggaatgaggggctgtcagcaccaactccaaatttcatgctccttggcttgatcctgtattttatttaacacagatttctacatatgcaaaatttgcctcttcttgtgaggtcttgtacaaagttgaagaaccttgggctgtgagcttatctgagagatacaatgaagcgggatgaactgcttgggcag

SEQ ID NO: 182821 - DNA, 169 bp, Homo sapiens
aagaagtgcctggcagcattgtgcacatagatgtgtagtaaatatttgctgaaggaatgcttcaattaatatccaaggcacaagagatatgttatagacgaggaacttgacttagaaagatttagttgcttggggtaacacagctcttaaacagtggaggtgggcttca

SEQ ID NO: 182822 - DNA, 386 bp, Homo sapiens
tttaattcattaagaaccatgttgattttgctatacttaagaacttaagtcattatatgttaagtttaaaaacaagcagaatcgtgaggaaaccttgtatcatctaggtttttttattcaactgtggtaaaatataacaaacttccagtttaatcattttaagtgtacagttcaataacattatagttacattgttttgcagctatcaccatcatataagtggaatcctatggtatttgtctttttgtgactggcttatttcacttagcataatgtcattgaggttcatctgtctatgttatagcttgtgccagaatttgctgaacttttaagactgaatactatcctattttcctatctagttttagcatacatagtacataatg

SEQ ID NO: 182823 - DNA, 576 bp, Homo sapiens
gaaggctgagagctgactgggctaatgaggcagggaagtacattctagaaataaatacaaacactgaggaaggagagagcctggtactttcaggacattgcacttgttcctgtggctggtacagaggtgatgtgccaaaggggaagagaagaggccacagaagctgcagaagtcagcctgtgtctgcagaaacaatcccttctgcttcttatgacaccatcagcacctgttaattataacactgctccaggtagagttaaaattccatgcatgcatgatctcttaaattacccgtctgtggaatatagcatgatgtaattctgtggttaagtttttaaaagtaagtaagtgtcatccagaaagaaatgtgacttggcttgcgacctgggtatgttcttgaatttgtcttaatggattcacggcttttctgtttccgggattggggaataattatctgtaatgtgaaatcatctacatttattctgaaaattcacctgtcagaacaagtctatctataccttttctctctgaataaacagcttccaaacgaccaaagaaaaaggtttccttttttga

SEQ ID NO: 182824 - DNA, 556 bp, Homo sapiens
ggacttgagtatcctttgttatcctcaggagatcctgaaactagtcccccatggatactgagggctgactgtatagtcctatcctcacggaactttcattctaatgagggaagactgactataaacaaaatatacgtaataggtggtggtaagtaccgtggagaagtaacaaatggggcaaagtgagttatacagctccattcttagaaaccttggagtacttttcttagtttatactcgtggtggtttccttttgtctcctttattacatgggactctgacatgtgcccatagctaggggtggcagtaggatctacccgaaaagcatcctgctgatacaggaccaaagcatcctgttgttctcgagcctataaaaagagctaatggtcttgcttctcttaactgtggcctcctacactgtgttttggatgattggtgatgtcttggatattctgtttctttggaactttgaatatacaacactttactagggaagtagcaatggaagcagagcaaagatgtacagaggaaacaatgcataactctgatggaattg

SEQ ID NO: 182825 - DNA, 577 bp, Homo sapiens
atttgctccttgagtgatcacttccacattcgaatggtttcaactttattccaacaaaggtagatctttatctctactgaggacctggctcctgagcttctgactcacatagtaactgtttgctagtcagatatacctatatccctcacagccatttcaaagtcaagtgaacaaaaccaaactcatcatcatttcatggctcaccactgcaacaaaaaataaataactctaactctgtctccattattttattttagtttatggtatcaccatccatttagatacccatactaaatatttggtggttatcctgtttttacttcccacattcaactttccatcaaggtcagatagttttagccccataatatttatctagttcttttctcctccagccctttgacaactggcctagttcatattgtcattatttttctttcagatgtctacagctagcaccataaaatcaacaagcagccaacctaaaatataaatctgataccactactctcctgcttttatttttcaatggcccctatagtctggaggataaaacccaactatcttaatgttgttt

SEQ ID NO: 182826 - DNA, 519 bp, Homo sapiens
agacatgaaaaggataagcgttggcattttgcaaaataaagtttaatttgtaaatttaaaagtttaatgattgcctgttaaagtattggcttttggttcttttagctggggcagtaaacctagatgaagtgaagttttttatttaaaagaaactgtactttctgtactttgaaaactgaactagtaagattgaatttatttggaaatggcagtgaaacttgaactctgtaagcacctcttaggtggcagatgccgtgctacctggtaaatggctgtgtcaggtactgtgctgagcaggactgacagggagcttacagtttagagaatgcagacatgtccacaagcaacgatagtacagcagccgtaaaatgataggggaagggtagtgttataaggccgtccatgggagggatagatacgtaaccgattttgcacgtcataaaatgcttcccactggtgacatctaagctgagacctgaaaggtgagtaggatttggtcaggtgaagaaagagggaagg

SEQ ID NO: 182827 - DNA, 198 bp, Homo sapiens
agcaattgtttctttccctttttatctagtaaattgctccctctacctcctcccagtttgggaaaaaaatacaagtatgaagaagaaagtaaaaatcactcctatggttaggttaggcttgactgcagaattgtttcctttttttttctttttatctttttttttgagacggagtctcactgttgcccaggctggagt

SEQ ID NO: 182828 - DNA, 220 bp, Homo sapiens
cttgaggataacccacaccaaactcaaaccatgtagtagaaaagttgctaaaagttcctttcaacttgcaggtatagacaactaaagttttggcaactcaactaacaaggaaactgagaatagaaaatgttaccttttctattactcatttattctatcacccttatatgcaaatttgaaggacattccaattaaaactcattctgaatatgatctgatg

SEQ ID NO: 182829 - DNA, 297 bp, Homo sapiens
tctctcaactggattactacaacagcccccagcaggtatcccaactcccatacttgcctggatttagaccacatcatccaagaagaagtctgggatggtggaaatgttctgtatctgggctggctactgagcatctgaaatgtacctactgaaactgaggaactgaattttcaactttattgcttcaattaatttaaattccaatggctacacatgcccagtggctactagactggaggtttagaatactgtccatacagcagctgagggatgctttttaaagccagagtcagattt

SEQ ID NO: 182830 - DNA, 613 bp, Homo sapiens
tggtgacgattcaatactataattgcgatgagatcatatcaaatattgatattagctgatgactatggtaacactagtcacagctgagccatgtagtatactgtgattatttttccttttctgcacaaccttttattttccctggagttcatgatggtcttcctttttcatttgcttcattttctatattcttattgctaatttagtccaagttatataaacttttttttttttttctttaatcacccaggctggagtgtagtggcacgatctgggctcactgcaacctccgcctcccagattcaagtgatccacccaccttggcctcccaaagtgctgggactacaggtgtgagccattacacccggcaaattcatttttataatcttgccacccccacaaccactgccctcatggaccctgggcacgcctcacccgaattacagaaattccctcccagctggtaaaactgtttgtgtgtggctctccttcattccatcctccctggtttagccagagaaataattctaaaatgtacacatcccaaagcatctcattttcctgcatgcagtctttcatcatccattcactaactggaggacaacatctgaat

SEQ ID NO: 182831 - DNA, 300 bp, Homo sapiens
accacaaggcgcactcgttattagaggccagagagggacagatgcttggtgggaattgtagtgcgaagccaagaggctcccccctcccccccttcccccctgccccaagtgcttagaccgaaggcggcgctgcgccaccgggggacgccctgggctcatttctctgacagtccttctactagcttcattttccttgtcaacaaaatggggataatcacatctaccttggaattgttatgaggatcacatggagaaacacaagtgaaatgctctgtagatataaagcatgtatcaacgatg

SEQ ID NO: 182832 - DNA, 520 bp, Homo sapiens
gtaggtaggattacaggcgcccaccaccacgcctggctaatgtttttgtatttttagtagagacagggtatcaccatgttggccaggctagtctcgaactcctgacctcaggtgatccacccaccttggcctccgaaagtgctgggatttcaggtgtgagccaccgcacccggcccactttaattctctcaaggtggtttggtacagtcattcccaaagagacaacatcaaaaacacctgggaaatgtcttaaacatgcagaccctgaggttctacctttcttcccatcccctaaacttcttcattattatatctgggcagggcctggaaatctgtattttaaataagtgcctccagtgagttttgcttttatgcactttgggaacccaaggacagatcctgggactctgaggccaagccctgggcttagtttctcctggcactgtctctgtctgcctggatgatctcctggtcacgaaggttcttcgtgtctcagggttatcaggtgtgagtgtctgat

SEQ ID NO: 182833 - DNA, 308 bp, Homo sapiens
ccccgtacgcccaaccatataattgtcaggctagaggaccacctgttgagtgatgcataaactttcactgcatttttgttgcaaagagctactgtttctctgattagtgtgacgtcggcatggcctagtctttacatcagtgctcccgggaggctggcccaacgttgggaggtgcagcaaatgcatatgggagggaatcgtgtttgagccatgtggcaggaaggttgtgcacctgggcactggggctagtttattcctgggttcaaatcctgcctctgcctctcactagtgggtgaccttgggcaaga

SEQ ID NO: 182834 - DNA, 694 bp, Homo sapiens
atttttaggaaccagtcttaactttttgaaacctaaatattaagcttgttttattatacatttttgataaaagaataagtaattaaggaaatggatgaaagagggaaagaagtgggagcaagtaacaaaatgttgctcatgcatttccatgagtcctttggatcctttgatcaatcacagctcaccaaaacgagtcagtgcacaactgcacgtggttgccacaggttataagaatctcagtgcctgaacggacctggcaagtaatctcatctcatggtttactttcttaagcctttgagctgtttcttcaaagtaaaggttacccaggaacccaatggtaaagcagatagatacagagctggcatagctgacagggagtggggagaggatggtgctttggccctcctctccttcccccacccctccagcttgaaatctctgccctgtgggggaagctggaaaggctgttcaaagctagaaaggctgttcaacctgtgcatgagcattttcaagagactggaaagtaactacctctccaggcaatccattttttctccagacagttcagactgtcagttcctacaagcagtgaaaaatcagccgaagttgtgttccttgggtccgtagagaataggtttaatatcttatccatatattaggtcatcacatgtttgaagacatgattatagttctt

SEQ ID NO: 182835 - DNA, 436 bp, Homo sapiens
cacatctggcaaaagcacagaaactcaaaatacttcaataaccatttactcaagaagatttaccttgataccagcagagcatacacagataaacaaaatgtgctcacctctctcaccttccccatccccagaacagggaccacatataccaggagtccaaaggagggggaggatcactggggcgggctcaacttcttacctcactcttagtaaaaggaaagatttagttacatgctaaaggcaactggtactctctgaacttctggattttattgctcttttgtaatcttattttctacttgaaaatgggaaattaggccgggcacggtggctcatgcctgtattcccagcactttgggaggccaaggcggctggatcatgaggtcaggagatcaagaccatcctggctaacacgctggaaccctgtctctactaa

SEQ ID NO: 182836 - DNA, 455 bp, Homo sapiens
gagataacatttttaaattaaaaacaatgcttgactctaaaagtaatgagctgtcttgtgtacctcatatactgtattagtctgttctcacactgctataaagaactacctgagactgggcaatttatgaagaggtttagttgattcagttcctcaggcttaacaggaggcctcaggaaacttacaatcatgaccaaaggggaagcaagcatgtcttatcacaggagagcaagagagagtgagagcgagagagcgagcgagcgagagagagagacacacgcacttttaaaccatcagatctcataagaacctcactatcatgagaacagaaagggggaaatccacccccatgatccaatcacctcccaccaggcccctcctttgatacatggggattaccattcaatgtgagatttgggtggggacacagagccaaaccatatcatgtactatct

SEQ ID NO: 182837 - DNA, 245 bp, Homo sapiens
gggcagaggattacctcctacgagcgcagcgggagcgttataaaagccgtcgttgcgtccaaggcatctgtgagcccgcggagtatacaccatgagcaaagctcaccctcccgagctgaaaaaatttatggacaagaagttatcattgaaattaaatggtggcagacatgtccaaggaatattgcggggatttgatccctttatgaaccttgtgatagatgaatgtgtggaaatggcgactagtg

SEQ ID NO: 182838 - DNA, 282 bp, Homo sapiens
ctaccagtaatctgtgaagttaatattttttatctgttttacagatgaagagaagttcaagaagaatggtgtttgagccatattaaaacttcaatataggttgttaattattaacaatattgcaatagcaataatagtggttttagtattagttcctatctaatactttagttccttttaaaattccttgactgatgaacacttcagtgattagttagtaattctctcatcttccggatgagaattctgaggtctaggtcgatcccataacttgattattgc

SEQ ID NO: 182839 - DNA, 173 bp, Homo sapiens
ctactataatgtttatacaaagaaaagtccctgaatcttgtgtatttctgtaagcttagctttgacagacagcatctctcctactgtttggtttgtggtatgagagttatcacctcacctatgagctgaatgaaggtatatgtcacaatcccacctgtgcatagaggtagcag

SEQ ID NO: 182840 - DNA, 305 bp, Homo sapiens
cacattcctaagcctcagctttttttgttgctgttataagtttaattattcatataagctatgtaatatagagcctcaaataaggtaatcactcagaaaatgtttgctattgtcattattatattgtttttactctgtggggcttgacatatctggaaaagatttttctacagttttctttgccctaatgcagcttgtataaacacaaaaaactaggaatgaaaaaatcacttgtacttgaagttgtttcttatttaatatagactaatagtcatttgaaaaaatatagttgtaaggataagaag

SEQ ID NO: 182841 - DNA, 504 bp, Homo sapiens
atgggagtgtctcagtctattttgtgctgctataatagaataccacagactgagtaatttataatgaaatgaaatttactggctcacagttctggaggaggagaagttcaagagagagggaacagcatctggccagtgccttctcactgcgttatcccaagggagaaggcagaaagacaaaaaagagacaaaggggagccaaactcattattttataaggaacctactaccaggataacaaaactcactgcattaatccattaattaagggcagggccctcacagcctaatcacttcttaaagttcccactattttttttttaaccattttcttcaatagccctgacagtcccacctcttaatactattacaatggcaattaagtttcaaagtgagacattcgcaccatagcagggagttaatatccagaatatatgtataaataattttacaactcaacaataaaacaaaacgcaaatgacccaatttaaaaatgggcaaaga

SEQ ID NO: 182842 - DNA, 603 bp, Homo sapiens
tgctcaagacgcagccagccttcttcagaaagagacccaaggtggtggaggggacatgcatgtctcagcatttctgagagaccgccaacccttgcaggaggcattttatcagatgtttattaagagactaacgattacaggatatgatatatatataaattttaatttccctttctaatataatcagggcatggggtttcactatgtaggccaggctgttcttgaactcctgacctcatgatcctccagccttggcctcccaaagtgctgggattataggtgtgagccaccgcacccagcctagtgtttaattttcaatttaatttttggcactatttttttttaagttgctcatcttaggacagtataactggaatgagccttgtgtttccagttacaaaaacaagacagaacaaaggatgaggctagatttttgtattattgacaaccccatattcttccctccagaggagagatcatctttcggaagcaagcccgagatacacacagtcttacccattccttcaatgctgttgatgattagccttaagatggttcttttctctaaggaaaccctccccatttttgcaggatgtttgaaaa

SEQ ID NO: 182843 - DNA, 340 bp, Homo sapiens
ggaaccaatcacacaagagtctgggacaagagtaattcaggtaatgggaacaacaattagaaatgttctgagatgaggagggagcccagaatcagccagggacagaaatattgctagtctggctggaatgcaacaagtacttggaataaagaaccagataatgttaaggcagaaggcagggaccagattcaaaacatctttacatatgagatgaagtaatgtatagagtgttaatatggttgagtagattttcaactggttgaatgaaacccaaatactatgcatggcatttgcaacatggatgattgccagcagcgtagttccttccttggattggtcc

SEQ ID NO: 182844 - DNA, 357 bp, Homo sapiens
acttcctccaaggctaaaatagctgaacctgctgcattttaaaccaatcctcagccactttggtgttttctcaaggatttccagggatcccaggcagtaaattctgctgataataggaattggtgtgataaggtgggtgctgagcagtttaagcaccaagattgtagctctgtctggttttgtggagatttactcaactagaagaacagagatttggctggtttttcagtcctggggtgcagggtgcacctgtactggaaaatttaggacctggtttcattctttgagtctcatgttcaagttggttttaatgttatgaagacacttgggacgtaatcctgagggcagctgggggga

SEQ ID NO: 182845 - DNA, 295 bp, Homo sapiens
gtggatgggcagatgattcaagctgcatttggggcttacaggacatactctcaaaatgcaaaggagggaacaactaatgccattgggagagaaggaagagtgggtgatcagaaaagacttcttgggctgggtgtggtggctcacgcctgtaaacccagcactttgggaggctgaggcgggcgaatcacctgaggtcaggagtttgagaccagcttggccaacatggcaaaaccccatctccgctaaaaatacaaaaatgagctgggtgtgttggcacacgcctgtattcccaact

SEQ ID NO: 182846 - DNA, 460 bp, Homo sapiens
aaggcccctcatgcgtccacacccccatggcaccctcgaatccccttgatggctaaaaacaccagctttgaagtttgtcagaacgagttccagtcccagtaccaccacttacaaactgtaacctcgggcgaggtacctgacctcctatacccggtgcccacatttgtagcaccaggatagggaacaacagtccccacatcaaagggtgttgacgggatgaaatcacacaatataggtgaggccctcagcaggatcctggcacacagtaagcactcaataaatgttcaccccaccaccagcaactcagcaggaagactccgcaaaagcagctagctatttccagaggactgaattccttggtccgagcagctctcaccagtgagaaaatgtgtctaaacttccactctcagggccgaaattcgatgccttggagccacgcagaacgcgcctaatctctcct

SEQ ID NO: 182847 - DNA, 1205 bp, Homo sapiens
aatttcattaaatgaggtctattgaaaactaagctccactccctaaaatatgacatccacgtgtgtgctctggcaaattgttaaaaagttttcttatgatttaatgttttattattttttctttaatttctttgaatattttaggcttaaattttagggagaggtggggaattttaaatgaaattatttaaagaaaattctatctattctaaagaaacaggaactgtttttaaccagtctcatctggaaaaaatgagttagatttcaaaagtgcaggagactggcagagtctgctttatattgtggtatttgcgaacccccacttcgtcctgcaccaaggagataagttgtgggttactaggggttactcctgtggagtactagttagcacagtagttgaaataactgtgccctccagaacattgaaaggaattacatcaacactcttctttgctatctgagaacataacgttaaggctgaaggccctgaaatcagactgtgtttaaattgcaacccaactgctcagcaagcagtgtgacctccaacaagacacttcgtccactctgttgtgttatttgtagaatggaaggagtagtatcctcttcatgaaattatcgaatacattaaataaaagaatacgtatgaaagtgcccagtgtagctaggataatatatattataattgttatattattaaattagctcacctagtttccaaaaatgcccattttgtaaacatgcaaactgaggttcagatagatgcaatatttaggtctcaataatcaagggataaacagagctgaggtttaagttcaagacaatctgacttaacgcttatatttttattatactttgtccctttgacttgtgctgatggattttgaatattgcatcatagaggaaaacttaatgatttaaccttatttcataggattgaaaacatcatccattttaagatacatcattattttatgaaccaataagattttaaatgccgctaagttttgacagtgtttattttatacttagagaattttaggataaacagttttatcatgtcactgacaggtatacctaaacagaaaatggaagcgaaataaattggttagggcagtgacaactctcactactgccaacctcccccaaaaaggtatatattatcgatttaagattcattctgttttcagagatgttagaaaattggg

SEQ ID NO: 182848 - DNA, 635 bp, Homo sapiens
  misc_feature (287)..(287): n is a, c, g, or t
agggaaatttatagcactaaatgcctacaagagaaagcaggaaagatccaaaattgacaccctaacatcacaattaaaagaactagaaaagcaagagccaacacattcaaaagctagcagaaggcaagaaataactaaaatcagagcagaactgaaggaaatagacaccaaaaacccttccaaaaaccaatgaatccaggagctggttttttgaaaggatcaacaaaattgatagaccgctagcaagactaataaagaaaaaaagagagaagaatcaaatagacacnataaaaaatgataaaggggatatcaccaccgatcccacgacggacgcattcacctatcaaaggccccacctcctaataccatcccgttttgggttagaatttcaacatacgcctttagcagggacacaacgcatggttcataacagcaggtatcttaccatgtttctgttatagttgtgttagctttgagcaagtcaccaagaatccaagggctcttaactgaatattaaggacacccaaatgtctttcttaggtccaaacctctcactggagtcccagactcctatatcaagtccccctcgacatctgacatttcactctgaatgcgtccgtcgaagttggttccca

SEQ ID NO: 182849 - DNA, 187 bp, Homo sapiens
ccctcagtttaggacatattaggactcataatatttttggttcatagttatttttgaattaccatatccaatgtattttcaagttctattgagtgtaccacctactaagttttccagaagacattacaacctctataacctaattcacctccacacccaaatttaaaattctccctaatcgcttact

SEQ ID NO: 182850 - DNA, 474 bp, Homo sapiens
aaggaggtgcgagtgacctgaaactccttttaaaaacagaaaggacaaaaagaggtatgggctgacaaaaggaaagtggtagattactgatgtattgcattatgcttagaatgtctcagaatgcgagaggcagtaaacacaccagaagaggatacaatatccggaccatgtgcaactgcaaataaatgtttgggttaaaacttggttgattctaaattacatgaagagctgatgataattgaggcagaactgatagacctaacaatagaaaaaaatcgatttaaattcagagaagaggtcatttaagaaagtataatgaagccacttaataaaaggaaatattcctctaactaaagtttgagatttagggcataatcctcaaagacaggctaatataatctattttttgattaaaaaaaggaacttttggtttaaagtaagatgttcagctgctcttagagtttatttctccat

SEQ ID NO: 182851 - DNA, 205 bp, Homo sapiens
cccaggttagaatatttgcaaaattcatataagcgaataagatctcctgcttagaaatgactttcctgaactccaaattcacatgtcctccttttcccagtcactccattatatcattctgtcttatttctttcatagcatttgtcacatcttgcttgtattgtgaaattaatttacttgcttaatgtctataaccatctctaaa

SEQ ID NO: 182852 - DNA, 397 bp, Homo sapiens
cgacctagaggatcccttctctgatcgctccaacgggtctctaacttgtgcatttgggttgtttccaatcttttgctattacaatgtgcaatcatatccttgtatacatgtctttgtacacataaatggcacacttcagtacgcctgctgattccagataatgatagtagtgaaggcactgatgaatctaaagacttgaaaacctttctttacactctgtcctataaagtgtgtgtcctgatattgtgttaaacttcaggtaaacgccttttagaagtttatctacagtcattttgaggatagtcacgtctgtccttgctggtggacaagattctacattttcctaaaaaggtccatgcaatctaaagtatattcatatgaatactttacctgtaca

SEQ ID NO: 182853 - DNA, 440 bp, Homo sapiens
tcttgatattcataaatgagactttttgtgggggaggttcagtctttgtcaggtctttgaaatcaatgttatgttcatttcataaaacaaattgggaagctttcctttaaaaaaatatttggcttaagtagcagtaggatttcctctgacactcttctctgtgcctggtagtttgtttttgttgttgttttttatttttttctttggtgtttttattttggggtttttttggggaactcttttatgactttctttgggactggggtcaattttaataagttgtattttctttaaaagttactctcttctagctaggtgtagtggtgcacacctgtaatcccagctattcaggaggctgagaggatgatgacttgagcctagagtgtggagtttgagtctagcccgggcaacagagggagaccctgtctctttaaaaaaaa

SEQ ID NO: 182854 - DNA, 434 bp, Homo sapiens
tagaggatcccccccctctgtgtgctctccaggaattccatgagtacattcagagctctgctgaaacccagatccagtgtccgagtgcttttgagaggacaagtagcaccatcaaaaagggaaacccattcctttattcaaaaaccacccggggccaggcgcggtgggtcacacctgtaatcccagcgctttgggaggccgaggcaggtggatcacttgaggtcaggagttcgtgaccagcctggccaacgtggtgaaaccccgtctctaccaaaaatacaaaaattagctgggcatggtggcgcatgcctgtaatcccagccactcaggagggtgaggcaggagaatcgtttgaacccgggaggcggaggttgcagtgagctgagatcgtgccagtgcactccagcctgggaaacagagtgagactccatctc

SEQ ID NO: 182855 - DNA, 380 bp, Homo sapiens
tgaacctgggaggcggaggttgcagcgagccaagatcgcaccattgcactccagcctgggcgacagagggagaccctatctcacaaaaaaaaaagaaaaagaaaaaaagaaaaaaaaagaattaagaggatttccccctaaagtattaaaagaagagcaagtatacttgttcagaccatagaatacaaaaaataccaaacctgcaacttgtacccaaacccagatggaagtggaccagcctcccaggcagtgtccagggtcctaggtcctggccacctgcctgtggcaaggccacaaccattcccttgaggacacagagggtcccaccccgctggtgacaggacctgcctaatgacaattatcttgcagcgagacctctc

SEQ ID NO: 182856 - DNA, 504 bp, Homo sapiens
caacaataatgtgctcctatggacaaagggtgggaaagagcctcacacagaaccattttttgcaatgatgctccccatagattaagctgcaaattcactgtacatcctttgatttctttctttttcaatagaggatgatgttcttcccctttgatttctaaggtgacacctttaaatgtgaactgtgttatgcaaataactgtgaacaaaatgatcaatttatgaatctaaattctttctattctctgtacacctgaaaattattttctagtttgtggccacagccattatttcaagaacttgccagcctgggcaacatagcaaggccctgtctctacaaaaaataaaaacaattagttgggtgtggtggaatgcctgtagtcccagctacttgggaggctgagagacaggaggatcacttgtgtccaggaagtcagaggtcagaggtcaggttacagagctatgatcatgccactgcacttggcctggacaagtgaaaccttg

SEQ ID NO: 182857 - DNA, 340 bp, Homo sapiens
aagagacaccagacacagatggaggaaggacacgctggggaaggcgtctcagatgaagctatgtctgcattcattctcaaagcaatcctcatgttaaccggaagatgtggaaaggacatttcagggaaaagaacaatttatttggaggcacagaataagagaaaataggccctactgttgatcaagaacaatgatacgatatcctaaccaacagaggaagcaacggaagttgttgttgtttttatgctgtttttttttttttgagacggagtcttgctctgtcacctaggctggatggagtgcagtggcatgatctcggctcactgaaagctctgcctcc

SEQ ID NO: 182858 - DNA, 339 bp, Homo sapiens
gagaaaatggaaaaagtgcacagtgaggacattttttaaaagccttgggctggtgtctctctggtcttcaacacgcccaagtcgtcttccttgggcttattacttcagtggatgaagtgcttttattggcatggatgtgggcttttttggtcgtgggattttttttttcctcccagaaaccctatgttagctttcaaaatcaaggagaaaggagttttagattatatgcttttaggattatcagcacagaggccacgtgttgcctggagagtttattcccaagtgccatcctcactttctgcctccgctcggtccctgcagcggtggggacgggcccac

SEQ ID NO: 182859 - DNA, 694 bp, Homo sapiens
agattagaagtcacaagatccaagcactgcagattttctaccaacttggtagttctcaaaatgctgttcaatcttctatgactgtcagattgattcggttttttaacagttatgtcccttggctagtcaaattgtgtgtgtcttcctgtttattcttactctcattcttttagttctgatacccaaatcatagttttcatttctcattcctgttccattttcttatttccagcttcttacagaatacctccaagtccccttctttaagactgtcattttctctataaaattagcctcaccaccaatgttctaaacaaacattggctcctctattgccaaattacctaccctttattttatttactttattgcatgtatagagagacctttgtttagtttatgtgaattacatgagttcttaatttcagaaattatgttccataaactttttgttttttagagacagggtctcactctgttgcccagaatggagtgcagtggtgcaatcacagctgactgtaacctcaaactcctgggttcaaagtgatgctcctgccttggcctcccaaagtactggaattacaggtgtgagccactgtgccagccacatttaaaaactgtaaattaaacgtgacatataaatggaaagagcactgtatgctgagtccaaacctgggttcaagttctcgctctt

SEQ ID NO: 182860 - DNA, 341 bp, Homo sapiens
ttgctccttcccctgccatatgagatgcctgctcccccttcagcttctgccgtgattgtaagcttcctgagtcctcctcagaagcaaatgccagtgttatgcttcctgtattgcttgcagaactgtgagccaactaaaccttttttcttataaattacccagtttcaggtatttctttataacaatgcaaaaacagcccaatccagtatctgtaagaaagccaaggaaatcccaaataggcagttggctctgcagcctggaacccagaagtagatctgtacaccatccctggctcttccagggtctcactctgttgcccagactggagtgcagtggcataa

SEQ ID NO: 182861 - DNA, 192 bp, Homo sapiens
tttattcaccccaactccaccaacacaaataacaacaaaccataaacattcatgtccctaattcatttcctttggagattagaggttttgttatatacaccattaaagtcttcggggacccatctcaatatgtttttttcatcttgacttaaatccaactcttcttgtttccttctccatcaaaccacagca

SEQ ID NO: 182862 - DNA, 365 bp, Homo sapiens
aacaaaatggacgaacagttcagtcacttcctaacatctagccacaaaaatacatgggaagatatagccacatctaaagattgtgatctcctgattttctttataacttaggtagattcagaataccatcttccagttttcccttggaatacaaggaacattagtcttaatctactgttctgtgttgaatagagaaataattccttcccttccacacactcttttttttttcctattgaacttttcctaggccattcatatagatgcagcctagatgaaatagacttggactgttcgtaaactcacccttttcttgaaatatcatactgcagtgtgacatttcttacctgtgttacgtggcagac

SEQ ID NO: 182863 - DNA, 175 bp, Homo sapiens
cagtaagagcatccacataggagataatatttgagattaatttctgaaccttaaaggaagagggcagtgtagttgtggcttcagctgaaaaaaactacagtacaaggaacaaggcattaggatcttacttcaggattatcaaacctttctattggtatgatggctgggggtaggg

SEQ ID NO: 182864 - DNA, 563 bp, Homo sapiens
aaccaccttggagtctgggatagcccaaaacagagaaggcatcctttgaatttctccctggccgtgccctgtctggcccctagctagtccttggagcagattggtgtcaaacagacctacggcggttgctgtggcctggtcagacccagctgctggccccctgggggtcattttttggagctgctcaagtcttctgaaatagtttgtgcaggctgggattatgtgtttaggggcccagttatttcagaactgagatagccatctctccgtgttatcagtatgtccagccagctggccaaacactgtctagcaaaagaggaatcgttcattcagtagatacctgccagcaactcttctaggtactagagcctgtgagagtgaatgagacaggcctgctttttgccttcaaggagtttatgagcacgaagatcaagctggcttccaagagaggccctaactttgtcaaggaactgaagacctcaccgcaagagtggttagaaacacatccaggctgtggagctgggccagcctatgacttaatttttgtttctgccactcccttg

SEQ ID NO: 182865 - DNA, 356 bp, Homo sapiens
agtcgtctctaaggatcccccattttatctgaaggctgcatgtgcctaacaggttacaaaggagagtggagcttgagatagggagccatagagaagagtgggcaagatcacatttgatgcttccttgagtactttgtataaatttaggaaatccaaggtaaattgggagaagcaggtccagaaggcaaagtttgacaggatgtgaaaaggcaagagggggatggcattgtaggagttcaggtatttgtcaagaccatcatggtgactggcttttggggagtgcctgagtgggaaggaagtaaagtcagaggggagcccctggtggcttagcagcccagtagtagccgccagaggct

SEQ ID NO: 182866 - DNA, 321 bp, Homo sapiens
cagccgtggtcacaccatcacacccagctccagactgaacaaaggatcctgccagtggccacagggagcctgcacccagacctgtttttccaaggatgccaggctgaacgcccaaccctgggtgtagctaaatgggtctagctgggtgtagcttcactgcatctcctgccgaattggtgataccgcaaatccaaaggagccctgcttcacctccaatggcagctttcagaaagtagaagggatcagtctacacgaaacatgaagatcatggagaaaaatgtacaaccagccagatcaccccataccctgcggctggctctg

SEQ ID NO: 182867 - DNA, 241 bp, Homo sapiens
aataaacgtaagtggcaatgaaatgtgattttgtgctctagtaaagcaccattagtgtggtgcacaatactcttaaattgcattgatttttaagagttaaggaccacttaagtatagctaatactgattgttctatatcaagcatgattttcagagctgggaatacggtggcaaataagacaggcaaggtctttgccctcagagtttacattccaatggggaagatgaataatacactagt

SEQ ID NO: 182868 - DNA, 318 bp, Homo sapiens
tgtagagaaaagctagatgtacagagagatgaaggacagcaaggtagggagagggacagcaaagagggagtctcatcagagtgagggagaggaggagggatttggagccagggcagacagagcagagtggtgctggtggcaaggagaacagagggagaagcacagcagggaggacacctggggatctggggtgccagagagtggggccagggaggtataacaaggaagagacaatttaacagggagagcagaggatgcacagagatgggagaagaggtggaaatctatagagattgaggatgatctaaagattgggga

SEQ ID NO: 182869 - DNA, 514 bp, Homo sapiens
aacatcagctcggtaccgattacgctcctagacgggaaggtctggaacggagacccatggggagaatggagggtcctagagtcaggctgcctgggttgagtcctggctcccctacttattagctgtgtggcttgaggtgggttacttaacttcttggagcctctgtttcctcttctgtaaaatgggaataacaacattacctgcctcccaaggccattgaatgagttgaatgtaggaagtgtgatgtaaatattagccattgttacgtgagatgttcaggggatagagtgacaggctcaacgtgtggctgaaggaggagaaaagaaggatttagaggcccctgtgaactccggagtccccatcctttctgggagaaatgggcagtgccttcctctctgcccaacactgaccagctgtccacccacctctctagggccagaggaagcacttgtgatcttgattactactcatggacgctgggtagagggctagcctgggcatgctgggagaggcc

SEQ ID NO: 182870 - DNA, 580 bp, Homo sapiens
gccctcccacctgtgtggctcaggaagaggccgatggctgctcaggagatgggagggaggcgctgtctggggctatgttaagaacagataagaagtgacaggaaggtctggaacggagacccatggggagaatggagggtcctagagtcaggctgcctgggttgagtcctggctcccctacttattagctgtgtggcttgaggtgggttacttaacttcttggagcctctgtttcctcttctgtaaaatgggaataacaacattacctgcctcccaaggccattgaatgagttgaatgtaggaagtgtgatgtaaatattagccattgttacgtgagatgttcaggggatagagtgacaggctcaacgtgtggctgaaggaggagaaaagaaggatttagaggcccctgtgaactccggagtccccatcctttctgggagaaatgggcagtgccttcctctctgcccaacactgaccagctgtccacccacctctctagggccagaggaagcacttgtgatcttgattactactcatggacgctgggtagagggctagcctgggcatgctgggagaggcc

SEQ ID NO: 182871 - DNA, 511 bp, Homo sapiens
agttcaggctcggccacttttctcctagacgggaaggtctggaacggagacccatggggagaatggagggtcctagagtcaggctgcctgggttgagtcctggctcccctacttattagctgtgtggcttgaggtgggttacttaacttcttggagcctctgtttcctcttctgtaaaatgggaataacaacattacctgcctcccaaggccattgaatgagttgaatgtaggaagtgtgatgtaaatattagccattgttacgtgagatgttcaggggatagagtgacaggctcaacgtgtggctgaaggaggagaaaagaaggatttagaggcccctgtgaactccggagtccccatcctttctgggagaaatgggcagtgccttcctctctgcccaacactgaccagctgtccacccacctctctagggccagaggaagcacttgtgatcttgattactactcatggacgctgggtagagggctagcctgggcatgctgggagaggcc

SEQ ID NO: 182872 - DNA, 530 bp, Homo sapiens
caaaaggtaaaattaatacagacggtgttttggttggccaaggtcaggtagcttgtttttggaacagatatggattgtatatttcaagtaataaccctccattagtctttaaagttatacattttttatttattttacacagatttatctaaatttggatatttattttgaggttggtatatcttataagcagttttgacatgtgaaacatattcagatatagatgattgaggtatttatttaagaaatatagatgttggccttatccactgtgatagcaataataaatgactaaagaaataaataagaggataaaagaaagaaaagataatttgcaaaatacttactgtatactccctcacattcatctctactctttcatatttgaaacagtgaccaagtgacaggcagggattttgtccaatttgtcatgagcaggaagagaggagtctattgctaacgctcaaaagttattaattccagataccattgtttattgaacctgcttcagtattcatatctttacatta

SEQ ID NO: 182873 - DNA, 244 bp, Homo sapiens
tgccactgcactccgatctgggcaacagagtgagatcctgtatcaaaagaaagaaaggaaaagaaaatagtgcagctggaatattttttctgattatagaaggaaaagtaatcccaagtggtaccctttaaaatgcagccttaccattccctatgtaaacctgaggaaaattttaattgtttataagaaaaaaatcagagatgttggcatagctttatgattatgttagttggcccttatccga

SEQ ID NO: 182874 - DNA, 317 bp, Homo sapiens
atttctttctctacttagacttaagtggtgacagcctcatattaaagctggtttctcgcatggtagaaaaggactttggcagttccaagcttcatagctgcatcgtgcactagaggtcaacaaatgttttctgtagagagccagataagaaatgttttaatctttataggccatacagttctgctgcaactactcaactctgccactgcactgtgaaagcacccatagacaatttgtaaacagatcaacacaactacgttccactaaaattatttactaaagcaggcagcaggccagatttagccagaggccatcgt

SEQ ID NO: 182875 - DNA, 430 bp, Homo sapiens
ggggatctgagcggtggcttcaagagggggcaggaattctttctgtggggaaggacaaggtggggcgtttgcacggagaaggagagaaggacgaaagaaggcttatccacatcacagggacagagacgtcccaggttgggacagggagctccttatttctgccctatcctcggaagcctggactaaatggaggatgcttttgcctccctctccgtccatcttatcggttcccatcgaggcactgccatcttccttgggtaactgaggcacgagggtctccacttaggaagctgggaaatgctaggctgctgggcaaagcttcccagagtcagccagtcactgctgccctgtctcttgggcccagcagagggaaacggctgggacaggaaagcccagaggggagtgaacttgctctaggacaaaaagcaag

SEQ ID NO: 182876 - DNA, 353 bp, Homo sapiens
ttgtattctcaatttaggagtctgcatatagacatctagtataggggttggtaaaaattaagacattatggagtgtctacaaggacccatggtggacagagttgcctgtctccacatagatccttatcccaagggcttcacccacactggccagatgcccagtgttttctgtttccccattaaactccagtttatgactccagtttaagatattctatgatgtctataactgcttaagctggcacgtatttttactcttcatgtttagggggaaaaaaaaggctgtacaagagataaggcagtggttctcagctggggacatttggcaatgtctggagatagtgttggttgtc

SEQ ID NO: 182877 - DNA, 458 bp, Homo sapiens
acgtagaatagggcctttccctgtttaggcacccacagaagtgcttgactgtcgataccttgagggacaccagttggagaaaaggtcaagcatccgttcaactctgggaatgttcttaacagtgccactaagctgtcaaagagatgcactcacatgctgtaggaacatcattgactctgaatggctccatctgggaataaaaagcaggggctctgaaggatgagtgggagtttgatagaatggatgaaaatgagaagaactttgcagcagaaggaacccacacggacaaaaggcacagtgtgttagacgaacaccaaatcatctggtgtggcaagaaatgaaccttttgggaagaaaagctggggtcaggttggggcacgccttgaagctttggactttattgtgtagctacactcacatatgctttgatgcaaggttgctatgtaaaagttgcctcc

SEQ ID NO: 182878 - DNA, 305 bp, Homo sapiens
ggttactgacttttgtgaactaattctgtagagtttgtattctttgtcatgtctgtccactgaaatctctgcttggtggtcagctaatgattgaatagacatgtccttaaatttctggaaccagtaagtctaccagtctttgccaaggagttctgtgtgtgtttgaacatgcgtttgtattactcaaccattcatttgaaaactctgtcttgctttcacctcctgcttgtatagaacttcaaagtcagccaaaggcaagagtgtagagccttctcaggactttcctaatgcacaaagccttgagc

SEQ ID NO: 182879 - DNA, 217 bp, Homo sapiens
aatcaccggaccaacatcgaacggactgatcgatgctgatgtgacgtgtgcatgtgtggggtgtgtgtgtgtgtgactgtgtacgtggtgtgtgtgagtggggtgtgtgatcgatgctgatgtgacgtgtgcatgtgtggggtgtgtgtgtgcgactgtgtacgtggtgtgtgtgagtggggtgtgtgattgatgctgatcagtccgttcgcatgtg

SEQ ID NO: 182880 - DNA, 128 bp, Homo sapiens
aagtcctgagcacaccaagcgctcaggaggtgtttaaaggaatccagaacatggtttaggcccacgctgcactgggggcccggccaagatgagaagcatggccagaatccctggcctccagacctgag

SEQ ID NO: 182881 - DNA, 260 bp, Homo sapiens
tgtctagttccagaaaacactttttaaagaatcaagatcatgttaagtttatgaacttaaaatctatttgacttctctgagcctcagttttctaatctgtaaaaggagcaatagtgcctgtaagaatgctggagggattaaaagagaaaacgtgtgaaactcatcgcttagtgcccttggtccactcccacctttgttgccaacatgggctgaggttgccattccctcatttttttcccactgttacccatctcactttc

SEQ ID NO: 182882 - DNA, 457 bp, Homo sapiens
tgtcttcctggagtttacagaaaaagagactcagggattttcccaaagcacactgcaagttaggggcaggaatgacagcccagaccttctggtttccagtccagggctcaactgcctaaacagtggcatctcttcaggcaggccctgtcagaggcagattaggggacttgtccaaagttactcaactatgaagagtcaagattcaaatccagagacatctgacttcatttcccttcattaacaaccatctaaggaagttcctattactttgggaactcctagtagcaggtggttaaaaaaaactcctggacaacatactatgctatttgaatcatcctacttcttacgcgttcctccaggatgcactcttctcccattctgaaactgacagttctctttacaaactgtgtatgtttcattcctggattgcatctgagctgccgccatggaacgggca

SEQ ID NO: 182883 - DNA, 404 bp, Homo sapiens
tctaccggaaaccccgtctctactaaaaatacaaaaaattagtcactgtgctcagccttcttcagcattattgataattggggctggatgacttttttgttttggcgggctattctgtgcattgtagggtgtttagtggcacccttggccttcatccactaggtgccaatagcacccccacctcccagttgtctcccaaaatgtctccagacatggcaatatgtcctgagggggttggaaaaagggtaaaatcacccccagttgaaagccactgatttctctatgtattctggataggaaccctttgtcagttaaatattttgcaaatatctcctcccactctgcagcatgccttttcaggctcttaaaggtgtttttgatgaacagaagttcttagtgtagtc

SEQ ID NO: 182884 - DNA, 360 bp, Homo sapiens
accacgagttatagttaataagcctacacaagagataaaatagaataaaaagcattcaaccaaaaaaatgcagaaaaagagaaaaagaataacaaagaacagacagcacaaatggcaaacaaatagtaagatggtagatttaaactcagccatgttagtagtcacattaaatgtaagctgtctaaaaactctaaagatacagactgtccatttggattattaaaagtaacatctaagtacatgctgcccattgaaaacaaatttaaatatatagacactaaaaggacaaccaaaaaaagaaagagaaagataaattagactttaagaagtccctttataatctattttgtgcccctaatt

SEQ ID NO: 182885 - DNA, 378 bp, Homo sapiens
agacccttcaggaataaaggttagtgttagtccaccaggaaaaacagaaaaaaaaaagaaaaaaaaacctgctgaggtgcttgctgaaggcaaagagaatacagaatgggtagtagaagaaggtagtcatcaatgctctctatgaccacgtgaccagctgcagaaatgaggactgtaattgtcatgagtacttcctcattcttttgttaaaaacatgtttgtacatatatatacttgtattaagaaaataccttcattttatttcctttctcccttagcatgtgacataagctttattgacttcccatcagcaacagtaacaatacttattattgctaactttatctaatagtatttgggttggggattagtgtgttt

SEQ ID NO: 182886 - DNA, 384 bp, Homo sapiens
tctatcatgccttggttccaaatcactgcctctcctggtcatgcctaaacttctataagaaactgagttatgcccagaaaataccagagcagtaacccacttaagaaacatcttctcactttttcctgcttcatccttcagcaatcaaaacttacctgttctgttttctgcacctatgggtcaatgttccttaagccaactcatacatacccaaataagattaaagtattcataattaatcagtgacttccagtcctgcattacatgttgaatgcacatggatttggaagccagagagacctgggtattatatttgatggtgataaactttatgagaaaactttctttaccctttaatttaaaaatgaggaacctaaaatttaa

SEQ ID NO: 182887 - DNA, 428 bp, Homo sapiens
tggggagattcattgtactgagtgcctactgccagatattctggagcttttatcccagtgggagatgcagacaaaaacaggtaaacaagagaatgcagatagaagtaagaaaaataaggcaagggaaagaatggaggggagggacacgtgaaactagttgcaagtgatatgaaggagccttccgtgtgcagaatttgagcatggaccttatgggcagaggaaacagcatagataaagtcctgaggcgagcgtaagcattgtgtatttgaataaccattgcgaggaacagtgactatttttctactagatgagatgtgtgggtttctcccatctaggcacttccttggagctgactagagaacagatacggctttttttttttttgagacagagtctcgctctgttgcccaggctggagtgcagtggcg

SEQ ID NO: 182888 - DNA, 424 bp, Homo sapiens
acacagcccttttcttcacaaacatgctcacatacacatgcatgcacacgcacacacagcctctgtttgtagcagaatttagtataaagctttaagtatatggaagaaaagttattcacagtaagacaaacaatttagaattgtagttgtctggctctttgtcatgattctttgtcttttttttcttttctccccacccctcagtcatgaatccatctttatttttaacaccttctgatttattgtgtcttacttatgtcctcgatattccaataccaatctcatgttgctgatcaaagtcatttccttaaaaatcatctctgctacatgttacctcagtaggcttcttggaccatcatatcaaaaatgaccaatttccccctctctacttctttattttattccaagcaccaatccttaactg

SEQ ID NO: 182889 - DNA, 495 bp, Homo sapiens
gtgatcacgtgattgcactccagtctgggcaacagagcagaaagctccgtctcaaaaataaagaaataaaaataaagaaacaggccaggtgcggtgactcacgcctgtaatcccagcattttgggaggccaaggcgggcaggtcgcttcagctcagaagttcaagaccaccctgggcaacatggtgaaaccccatctctacaaaaacatacaaaaagcaaccaggcgtgatgatgggtgtctgtagtaccagctatttaggaggctgaggtgggaggattgcttgagcctgggaggcagaggttgcaatgagccaaaactaggaagccagttctctatttcagaaaaaaaacaataaaaccctaacagcagagctataggagaagctattttaaattttggaggctttgctttctgggatcattttttgggtcaacgaggagagcagctgacacctcgtgcacagccagggagaacaagcctgtctcacctctag

SEQ ID NO: 182890 - DNA, 142 bp, Homo sapiens
tgggacatcaggtttctgtttccttaaaaatgagagagttgattagagattccctaaggcccaggtgcagctcctgcatctctatgggagtaactcagaggtagccatctggttggcagtctacctttcggagttggcggaa

SEQ ID NO: 182891 - DNA, 487 bp, Homo sapiens
  misc_feature (392)..(392): n is a, c, g, or t
ctcccattttgtttcacagccctctccctttggctccctctaggttccttcctcagcagtggttctttattgtctcagggcatctgcttttgttgtttcacagttgttaacattcttctttctgctttcatgtatttggccttttctcagtgttcaagtcttggatcaaatgtcacttcctcagaaagccctctccaggccgggcacagtggctcacacctgtaatcccaacaatttagaagaccatggtgggaggatcacttgagcccaggagttcaagaccagcctgcgcaacatggtgaaactccacctttacaaacaattgtttaaaattagctggatatggtggtgcatgcctgtaatcccagctactcaggaggctgaggcatganaatcacttgaatctgggaggcagaggttgcagtgagcacagatggagtgactgtactccagcctgggcaacagagcgagactcagtctcaaaaaa

SEQ ID NO: 182892 - DNA, 145 bp, Homo sapiens
attgcctgctgggtcaccctgaaaccttttgggaaagtgaaagttagcgcacaggtgcaggaaacctggttaacataacaactaaaatgaacctgactgggtgcagtggctcgtgcctgtaatcccagtactttgggaagccaag

SEQ ID NO: 182893 - DNA, 245 bp, Homo sapiens
ttgcatccaaaagcagctcttgctagggtataagcttcattataggactacagtgcaaaaatctggtccttttgctacgggacactcaaatattggtacgtgttaatttttatcttgggcaagttagcttccccagagagaaatcctctctgccactattcttgaagttgagtggatgaaaagggccagtgatctcactttgcactaaatctgttttcagtatggcgttagctggctagagtctc

SEQ ID NO: 182894 - DNA, 109 bp, Homo sapiens
ctgattccacgggcacgcactctctctataccacatacaaagactacgaactcatgttccacgtgtcaaccctgcttccctacatgcccaacaacagacaacaggtatg

SEQ ID NO: 182895 - DNA, 294 bp, Homo sapiens
taaatgtttcacagcaaaactgtggcatggtttcagctttacttgggattctgtgctctaacagtagggctatgcaaatagcctttcagcacctgagccagggtcaggaataatgcgcccttgggtcctttcaggtcaatatacagaaagacattgttccctggctatgacttcagaggtaagaaaatctacacctatttcatagagcctgaccatcatcttaagagcctccgtgactcattaaatattaaattccgggccccggctagagcacaggtaccctcaattggtaaa

SEQ ID NO: 182896 - DNA, 618 bp, Homo sapiens
gccaaaccactgcaataggcctcccctggcctccctggccctcaggcaggcgggccctcctttaaaaaccttgccctgcttcagcagagagcacaactctggcctcagaaaaatctggaatcaggggcaaatggaatcatcaggcactaggagagggtgctctgtttgactcaggggcaagggcaaatcctaaagctgagcaggggctctggaactctttggtgggaacatctccagcttcagccacaagccaggggaacaggcctcagcccctaggactcctgcaaagaggctccttccaccaacaaacacttggtgctgcctacctctgtgcctactccgaacagtgccagagctttggcagtgagtgaaaagtggtccctgccttgaggagcttaccctaaggtctagagacgatgtggaggcagtaaacctggccaacggtgactcgatggggatgatcttgcctaatgattaaacactggggctctggagttcaaaccctggctctgccatctaccagttacatactttgaacttagcctttgagcctcactttcctcacctgtgaaataagcaggcccctagtacagggcctggcacacagaggctctccca

SEQ ID NO: 182897 - DNA, 309 bp, Homo sapiens
ggcaaccatgaagttttcttacgaagttcactatcgaacaggcattccattactaaagtctgatgaacaactttttgaaactctagagcacaaccaagtaagatggatatttttattgcatatatttttcattttatttttatttgacaaataattgtatatatagggtaccatgtgatgttttgatgtatgtttacaatgtggaaagattaaatcaggctaaccgtcatctcatacacttaacattttttttgtggtgaatcacttaaaatctcctttaggaattttgaaacatacaatgcattatta

SEQ ID NO: 182898 - DNA, 123 bp, Homo sapiens
acctcaggaaagacatttgctccctctcagaacttttcaccccatctgtaaaatagaaggatgaactctttttctcatccctttccctccaagcagcagaactcttccagaaaagtccaatag

SEQ ID NO: 182899 - DNA, 524 bp, Homo sapiens
taaatgattccgaggcagatggtggaacaccactaaggagtgattgatgtacaaatccggagggccctagaactcttcttccctagtggttttcaacgtctttgttattttactcctccttcccccactgaattcacaaccagagccccaatatatgagacagataaaggagtagtttatgggcgtaaattgctgagtctacgtatataacaggtacttctaaaccatcagtgagaataaggaggctattttattgaatacaggaatttgaattaaaggctgcattcatgagaccaggctctgaaccctgtggggacggcctggctgcatctgtcaccttgagaaacaagtgattcagtggaaagctagacttgagggaggacaaatgtcctgcgtgtttttactattctttgattaaactgctccccacgtttgcaagaagaggaaggtgaaggagagaaggtttatatttcaaagttgaatcaccaacaatatccaataaatggttacattctcataaacag

SEQ ID NO: 182900 - DNA, 415 bp, Homo sapiens
atccgcttaagccattgtaaattcgggtcttcgttacagtagctgaacttacatcctaactagcaagtggtggaaggagaggaggctaatcaatgtaacgggatgttacacatacaagaaacttgctcaataggtgccaagaaaaggtggtgaatagtggatagatgtggactacaaggaggttcccagaagcagcagtattgtctctgttaatgctacagaggtaaccaagcctttaaggaacatattagaagtatagtattcccatgtaatgcaatacccagaaatgcattgtggagaaaaaacaattctttatcactgaaactcaataaacaacttaaggtattccctagaagaaatgattaaaactccatcccagtactgtttggctgaccttaagctcaacttgatgttt

SEQ ID NO: 182901 - DNA, 351 bp, Homo sapiens
gtgctgaatcctaaccactagacaaccagggaattataatgaattttaaatcaaaagaatgactccttagagcataacaactttgtgtccgctctttaattttcatctttagggacatattttaaatatttcaaaataggctgtcacagtatatttggaagaaaggaatttgtttccctttatggaaatcatcctcaaatgtattgaggaataattttacattcaataaattacatcaggatgtttccaatgttataatgaacctacttttggcaacatagtaaaataaaggggttcctaaagcccacccattagtaaaagttattgaatattttatttaacattaaaagg

SEQ ID NO: 182902 - DNA, 384 bp, Homo sapiens
atgtcatattaatatcatgaacatcttgatatgatataatgagaagggcatcattgtagtattcttaccaaaatgctaaatttattcctatcatgaggaactagcggtcaaacccaaattgaaggacattctataaaataactgattagagctctttgaaattgtcaagatcgtgaaagataaggagagactgaagtattttaacaaactcaaggagactaaggaaaaataacagatgccatgtgggatcctggataggaatctggaacagaaaaaaaaaaaaacgagtaaattaaaaattgtgtgaaattttaaaaaggcgtatagctaataatattgtgtaagaatttatttcctgttcttaattgtctcatgatcaagtaa

SEQ ID NO: 182903 - DNA, 529 bp, Homo sapiens
ccacacaggaggaccggacctcgatgatgagctcaccctcgctcttaacaagcactggctctctacagatgtcacttcctttaaggatgagtaaataagggaggaaaaactctatggggcggggcggggtctgggaggtagttttttgtaaagctacagaaaataggaaagagacttcatctcaatgatttagaagactttagaagactctaaaaataatctacaggaggacccaagagatccaacacgctggactcctctataggatatcaaaaggaactccgggtgaggacgacaagagctgagctcgggtgcttgccttctgcactctcgggaggaggcaccagcatgggcacccttcacagttcgggcccctcactcacaaacgtctggcacatggaaacaagctggcaaaaagattgtttttttcttctgtactttttgttataagcctgtggtgaagtgtccatatctggcataaatgaatgtgagtggtcttgggaatctaaatataacatgtttctaagtt

SEQ ID NO: 182904 - DNA, 707 bp, Homo sapiens
ccatcatctgccatgtgaacccatctgcatagaaccatgtggacatccgtgctaagagtgataaataaaactataaatagcttcatgttggttcacaccaggttttgccagcaactgcatagtgccaatcttttgatggtttagagctttctgggtttcagaattacagaataggacatgatgatctggagtggggcctgtgggtgttagaaggactcgggattttatccgcagtgggatgaggaaccaaaagatggacacgatctgacttttgttttaaaagtgtcgcctggctacatgtggagcccagactacaggaggtgaggatgtgtaggtgaccatagcggtactggtccaagcagaaaaagatggtgacctggaccaaagtggtgggatgggctgagaagtgctcagattctggatatattttgaaggtagacacaagaggacttgctgatagattggctgtagggttaaggaccacctcaaggttgggggcagtggagtgctgtatcctgagttggggggtgcaggtgatgggtggagtgatggggcaaatatcaggcaaagcagttgcatatagcaggagcagctcttctgccagagaaggctctgggaagcatcaggtgccccgctcctgcccagcagtgtgagtccaaggtactcttgggataaagccttgcttcttgctctgatctccacagggg

SEQ ID NO: 182905 - DNA, 761 bp, Homo sapiens
ggtttactttgaatctgtagatcactttggatagtatgggcattttaatgatattctttaattacatgaatgcaggctgtcttttatttgtgtcttctttaatttctttcatcagcgttttatacttttcatcttagagatcttttatctccttggttgaatttatcactaggtattttagctatttttatagctattttaagaggaattgtttacttgatttttgtttttttcagatagtttgtggttgatatatagaaatgcttttgtatgtttattttgtgtcctacaactttactgaatgtgattattagttctgacagtattttggtacattctttagggttttctgtgtatgagatcttgttgtcttcaaacaagaacaatttaatttctacctttccaatttgtatgccttttatttctttctcttgcctaattgttctggctgggtcttctagactatgatgaatagaaatggtgaaagtatacatccttgtcttgttccagatttcagaggaaaagctttcaatttttccccattcagaataatagctttggatttttcatatatggcctttattgtgctgagctgcattccttctatacccaatttgttgataatttctaacatgaaagaatgttgaattttgtcaaatgcattttctgcatctattgaaatatggttttcccgcttatgtggtattcacagttggttgggttttgagcctccttttctggggaggaccactgacctggga

SEQ ID NO: 182906 - DNA, 402 bp, Homo sapiens
tggtttgagatttaattttacatatttatctccttggtaccaataaccatggatatgagagatgggattttgagaactaagtgtgagtttgggggcagaagccctttatgaattaaatgtatatgtgcatgataggtgtccttttggaaatcaggtatattggtttttcatcagtaccgttttcttttttcaagcagcagtgactgggacctgctgataaagcctttgctcagaggcacagatcccagagttcttaaagccttttccaaccataataagtgaaactaatttttgatgtttaacatttataaacctatgaaaccaatggggcagcatcagtattgagaaaaatgaagccaaaagtagaaccatgtctgagaataggccttgaaaacagttctt

SEQ ID NO: 182907 - DNA, 207 bp, Homo sapiens
agggctggttcttgcttttgttaccttcaaatcctgaaggattcagacagactaacattccaatgccctttataacctttccccctggcaaaacttcagccagaataaaccaaaaatgaaatggagagaaagatcactgcatctttctggatccccaaatttccattccagatttagggctgatgttcccagctcgttgtccctaac

SEQ ID NO: 182908 - DNA, 262 bp, Homo sapiens
cagggtccttgcaagggaggcaggagtgggtggtgggagatgtgagaacaggagcaagtgggggctcatgcctgtaatcccagcactttgggaagcttgaggactgctttgggagggaggactgcttgaagcctggattttgagaccagcctgcacaacagagtgagaccccatctctacaaaaatacaaacattaagcaggaatggtgtcgcatgtctgtaatcccagctacttgggaggctaaagtgggaggatcccttg

SEQ ID NO: 182909 - DNA, 1456 bp, Homo sapiens
agcgggggagaggcgtcaggatccctggcgccgcctgagccagcggctgctaggaggctgtgtccgcaagccagcggggcgaggcggctgggccctgcgcgtcaggtcccggcctggggcaccggggctgccagcgtcggaggaggcctgagaactgggaggaagctggagaaaagatgccctctgaatctttgtgtttggctgcccaggctcgccttgacaccgaatggttgaaaacagatatacagatgatagtgtcgaaccaagtggaacaaagaaagaagatctgaatgacaaagagaaaaaagatgaagacgaaactcctgcacctgtatatagggccaagtcaattctggagacctgggtgtgggtcaagcaaccaggaaacggaagcccaaagaggaggggagcttacagcaggccctggactagggattaacacaaaaacaacagcaacaaatctgatttaagcttcacacatgctggaatgcagtggcgtgatctcaactcattgcaagctccaccttctgggttcatgccattctcctgcttcagcctcctgagtagctgggactacaggcgcccaacaccacacctggctaatttattgtattttttagtagagacggggtttcaccttgttagccaggatggtctcgatctcctgacctcgtgatccacccgcctcggcctcccaaagtgctgggattacaggcttgagccaccacgcccagacttgtgaggttttaatatgaagtattaaagctatgctggttagacaatttggaaaatgtttcttctcctatttctgacagagtttatgtaagatgtgtgctatttcttccttaagcatttggaaagaattcacttattaagccatgtgagactgtagttttctttataaggtgtttaactacaggttcaattacatatatataaatattcattttggtaacctgtgtttgctgaatcaatttgttcattttatcgaaaatttcaaagttattctattattcatttatctttttaatacttataaagtctccggttagagtttgtgccttttgtctgttttgttaatcaatcttgctggaggccatcaattttattagtgtttcaaaaaagcaaactttgattttattcatccctttaccatactgaaaatgttttgcttaatttccaaacttatagttccactgtgattaaatatttgtataactaaaactctgtggaatttgtgtcttctcaatgattgaaaatatgattaatttttataaatattgcttctgcacttgaaaaggatatgtattctgcatgttgagcgtagtgtaccacgtatctcagttaggtccagtgtgttaaatgcatcctttaaagattctatgtgcttactgatgtttgtttatttttcagtggctgagacacagatattaaagtttcccacaatgatcatcaa

SEQ ID NO: 182910 - DNA, 872 bp, Homo sapiens
tttgaaacgcagtcttgctctgttgccaggctggagtacagtggcacaatctcggctcactgtcacaatgtccgcctccatggttcaagcgattctcctgcctcggcctcccaaagtgctgggattacaggcttgagccaccacgcccagacttgtgaggttttaatatgaagtattaaagctatgctggttagacaatttggaaaatgtttcttctcctatttctgacagagtttatgtaagatgtgtgctatttcttccttaagcatttggaaagaattcacttattaagccatgtgagactgtagttttctttataaggtgtttaactacaggttcaattacatatatataaatattcattttggtaacctgtgtttgctgaatcaatttgttcattttatcgaaaatttcaaagttattctattattcatttatctttttaatacttataaagtctccggttagagtttgtgccttttgtctgttttgttaatcaatcttgctggaggccatcaattttattagtgtttcaaaaaagcaaactttgattttattcatccctttaccatactgaaaatgttttgcttaatttccaaacttatagttccactgtgattaaatatttgtataactaaaactctgtggaatttgtgtcttctcaatgattgaaaatatgattaatttttataaatattgcttctgcacttgaaaaggatatgtattctgcatgttgagcgtagtgtaccacgtatctcagttaggtccagtgtgttaaatgcatcctttaaagattctatgtgcttactgatgtttgtttatttttcagtggctgagacacagatattaaagtttcccacaatgatcatcaa

SEQ ID NO: 182911 - DNA, 548 bp, Homo sapiens
agcgggggagaggcgtcaggatccctggcgccgcctgagccagcggctgctaggaggctgtgtccgcaagccagcggggcgaggcggctgggccctgcgcgtcaggtcccggcctggggcaccggggctgccagcgtcggaggaggcctgagaactgggaggaagctggagaaaagatgccctctgaatctttgtgtttggctgcccaggctcgccttgacaccgaatggttgaaaacagatatacagatgatagtgtcgaaccaagtggaacaaagaaagaagatctgaatgacaaagagaaaaaagatgaagacgaaactcctgcacctgtatatagggccaagtcaattctggagacctgggtgtgggtcaagcaaccaggtaatcttctgagttttggcattttggaaagcttgatctgacgctccttttctaaataacttggatggattattcgtattttttggtaacaatttaaaaaaatgtaattaaaaaaatttaaatattgtggtaaaatatacataccttaaaacttgcaaaaaaaat

SEQ ID NO: 182912 - DNA, 755 bp, Homo sapiens
agcgggggagaggcgtcaggatccctggcgccgcctgagccagcggctgctaggaggctgtgtccgcaagccagcggggcgaggcggctgggccctgcgcgtcaggtcccggcctggggcaccggggctgccagcgtcggaggaggcctgagaactgggaggaagctggagaaaagatgccctctgaatctttgtgtttggctgcccaggctcgccttgacaccgaatggttgaaaacagatatacagatgatagtgtcgaaccaagtggaacaaagaaagaagatctgaatgacaaagagaaaaaagatgaagacgaaactcctgcacctgtatatagggccaagtcaattctggagacctgggtgtgggtcaagcaaccaggaaacggaagcccaaagaggaggggagcttacagcaggccctggactagggattaacacaaaaacaacagcaacaaatctgatttaagcttcacacatctactcaggagactgaggcaggagaatcggttgaacctgggatgcggaggttgcagtgagctgagatcgcaccattgcactccagcctgggcaacagaatgaaactgtctcataaaacaaatataacatgaaatggtaacgtctttctttaaaaccaaagaaaatatgcaaggcggatgtcttcctgtcacttcgcacagtctactcccatagcgcctgagccccagaccccaaactcactgtcctgctcggggacccccagaccacagtgaac

SEQ ID NO: 182913 - DNA, 337 bp, Homo sapiens
tatcaattgcttttttctttcttgattgagcaatgttttttcttatctttttatgttgataaggtaacttaacagtgattggcttttgaatgttgaacattgcatttctggaattaaatcaactttgttgtgataaatgattaataccatattatgtatggttgagatgggcttgctcctagttcatttggtagttttgtacttatgttcacaagagaaagtggagtctaatttttttttttctggtgatttttgttcgtttgtttgtttgtttgtttgtttgtttttgccatggagtctggctctgttatccaggctggaatgcagtggcgtgatc

SEQ ID NO: 182914 - DNA, 1376 bp, Homo sapiens
agcgggggagaggcgtcaggatccctggcgccgcctgagccagcggctgctaggaggctgtgtccgcaagccagcggggcgaggcggctgggccctgcgcgtcaggtcccggcctggggcaccggggctgccagcgtcggaggaggcctgagaactgggaggaagctggagaaaagatgccctctgaatctttgtgtttggctgcccaggctcgccttgacaccgaatggttgaaaacagatatacagatgatagtgtcgaaccaagtggaacaaagaaagaagatctgaatgacaaagagaaaaaagatgaagacgaaactcctgcacctgtatatagggccaagtcaattctggagacctgggtgtgggtcaagcaaccagtctggctctgttatccaggctggaatgcagtggcgtgatctcaactcattgcaagctccaccttctgggttcatgccattctcctgcttcagcctcctgagtagctgggactacaggcgcccaacaccacacctggctaatttattgtattttttagtagagacggggtttcaccttgttagccaggatggtctcgatctcctgacctcgtgatccacccgcctcggcctcccaaagtgctgggattacaggcttgagccaccacgcccagacttgtgaggttttaatatgaagtattaaagctatgctggttagacaatttggaaaatgtttcttctcctatttctgacagagtttatgtaagatgtgtgctatttcttccttaagcatttggaaagaattcacttattaagccatgtgagactgtagttttctttataaggtgtttaactacaggttcaattacatatatataaatattcattttggtaacctgtgtttgctgaatcaatttgttcattttatcgaaaatttcaaagttattctattattcatttatctttttaatacttataaagtctccggttagagtttgtgccttttgtctgttttgttaatcaatcttgctggaggccatcaattttattagtgtttcaaaaaagcaaactttgattttattcatccctttaccatactgaaaatgttttgcttaatttccaaacttatagttccactgtgattaaatatttgtataactaaaactctgtggaatttgtgtcttctcaatgattgaaaatatgattaatttttataaatattgcttctgcacttgaaaaggatatgtattctgcatgttgagcgtagtgtaccacgtatctcagttaggtccagtgtgttaaatgcatcctttaaagattctatgtgcttactgatgtttgtttatttttcagtggctgagacacagatattaaagtttcccacaatgatcatcaa

SEQ ID NO: 182915 - DNA, 305 bp, Homo sapiens
gttctccccagagccattgaccccaccgagagaacacagaggaagccatggtgtcttttataacctaatctcagcagcaactgagatctctgtaggccacacacacctccctggggtgtgggaaggcctggtggatgccagggccaggggtagcggagtagggggctagagactgcctgctttccctctgcctgcctgtcccaccatcaagcaggccaaagctgtaattcatgtccttctctcctctgttagatctaagaaagaggatctgtttcctagcataccttcttcagcctggagagttg

SEQ ID NO: 182916 - DNA, 375 bp, Homo sapiens
ttgggaaaagagacccttaagacaatacccaggagcccaaatgtcccaagaacttcctgtcttggcccccagcctcaattgtcaacaccaccaccaagcactgagcaccacttgtgccaaaagctgaattatgtgccagacagcatgaacagaagtgaggacataacctaaaagtgggaataacctctaggggaaaagctggacttgactaactttaagggtgggactcaaacaagcagagaggaatggatgctcttcctggaaggcaaaaattcaaatatgtacatagcatggctaagaaaccaactggcccttttggctggagctgagaatcataaacaagggagagagtggaagatatgtgagtgttgaaga

SEQ ID NO: 182917 - DNA, 379 bp, Homo sapiens
atcaatatccctaggggaagctagatgcaatgtcatgaaatcattcaaacagtcccatggaacaatccatctagcaaggaactgatatctcctagcaatagctggcattaacttacaagtcgtatgagtgggccatcttagaattggattcttcagtccaaatcaagtcttcagataactgtagccctggctgacatcttgattacatcctcaagagagaccctgagccagaatcactcagttaagccactgagttctttttgccaaaaactttttttttaccaagttctttttgccaccaactttattgaggtataattgacaattaagattgtatatatttaaggaatacaacttgatgatttgatatacacataca

SEQ ID NO: 182918 - DNA, 631 bp, Homo sapiens
gtttctgggaatcaaaaaatggttggagaaggagaaaaaggctgagagaatgctgttttttggtaacaagcctgtataactattcggttctggtaactctgtacatgtatacctttaatgaaaataaaacgcaaaacaaacaaatcaagatcagcaactgataacaggcagacacaaacgccagtcctccgacttggagccaacgttcttcctggcctatctctacccttgctctccagcctttgcttttccagactggatagttctgtctgcatccctcatcattttagttgtcacttctgagctggctttgtgccataatgtctttcttgaggtcacagaaccagaaacacacagattgctccaagcacgcagttctcccaaggccctcaacaaaggcgggtcacagtccaggtaagcacctcctgacatttcccagtaattctttccgtggttctgctcgccactctccaaaactacacagctgcaaactcagggagttcccaccatatatccttgcccagatatccctcaactcaggcctaatcagggagcagataaacccggagacaaggatgcattaatctacttttccaacatctgtgccaaagagtaccctagcccccaacac

SEQ ID NO: 182919 - DNA, 208 bp, Homo sapiens
cagctactggggaggctaaggtgcaaggatcacttgagcctggcaggtcaaggctgcgggtagccgtgagcaagccactgcactccagcctgagccacagagagagacccctgtctgaaaacaaaactggcaaaactctatgcaccctctaagtatctcacttttcaggatcagctgaatttcacttagagtggcatcaacagactaa

SEQ ID NO: 182920 - DNA, 236 bp, Homo sapiens
cttagggaagtggatttctggccagacggtaagaaatgcttttatctactctcacctgaggtggaaggagaaaaataaatttcagagacactcaggagcaatgaaaagatagaaaagagctggggaggatatgtcagagagaaatgagtgactaggacagcatgacaagcccagtccccatgagcagaggggaagagagacccaggccaccttcggctggctggctactcagtgtg

SEQ ID NO: 182921 - DNA, 642 bp, Homo sapiens
ataataccaaggtaggcatgtttgattatcaaaaatttgattctctgatataaaagcaatacaatgggaacaacatttagagtttttctatgataggtaagatttttcatgcaactggggatgtatctgtacgagtagatccagtaggcagataatcaaaggacaggttacactgttgaaaataacaacagtaatgtttggcctaaagatcttcatttgtaaaatgaaaataatagcagtacttccttgggtgttttagaggagtaaagatcataaatcatgtatactccttagcacagtgcctggtatcgtgaacgttaactgttgtttattataatcatcttcattatcatcatctaaaacaagcttcaaagttacttaatcaaggcttcgtccctttttaacctagatggggaaaacacagctattttaaccaactgttaaatttatgtagtttacaaagcactctcacatattctgtctcattgattctcactatccctgggaactgcttaaattttttctcaggggaggctttcagggttccgtttttcatagacacagcttggtctttgtcatcacccttaattgttctacctataaaatcaattcagagtaattctaaactttccccactctcac

SEQ ID NO: 182922 - DNA, 438 bp, Homo sapiens
gcctcagagctgtgtattaggaaaactgacagctgagcctttgcattagctagaagggagggagcccacctgtggaagtacccccttaggagtctcttgcagtcggttgagaagaagggtttcctgtcttgaattatctaaaactggaattattttggttaaattgtgggccttctgatacaacttggtgaatttgaaagtcctcacacacatattattctacttcattttctgggaaaataaatctgtttcctagtaaagaactgtctgggcctgctgaacggtggtgtgtggaccctcattcaaccaataccgtgcacggcatcttctttttcttctattcctcgccacctgtggtggtgttgttgtttttcttctctatttcctctctccctttctaccccaactggatctactttctccctgtccctcagcttt

SEQ ID NO: 182923 - DNA, 624 bp, Homo sapiens
aagaggaggtaacccagaggaagaggaaaagagcagtgggttgaacgtggtttcagtgtgggggagggcatactgcatgccactccccgggtgggagaagccaagtttgcctatgggacaaatcctactgcaaagaaaaatcctttgtggtcaaacaaactgggtgctcttggcgtgggcccccttttcctccaggtcccatcttctgtaatatgtactgactggccatacacttttttttttttgagacagggtctcactctgtcacccaggctggagtgcagtggtatgaccatggctcactgcagcctcgacctctctaggctcagatgatcctcccacctcagcctcctgagtagctgggactacaggtgtgtagttaaatgtcttttaaacctaagtggatggaagtgtagtatgataatacaggtgtacggatttattaaaactctaattgaaagtgatcagcaaaatcatactattggtgacctcatcatggcttttttggtggttggtttggagacagagtctcgctctgtcacccaggctgtagtgcagggccgcagtgtcaattcacgggagccttgacctcctggtattaagccatcctccttcctcagcccc

SEQ ID NO: 182924 - DNA, 482 bp, Homo sapiens
gctgtggccacgtgtatgctgaaaggagtgacaggactgggtctcttgtttttaaacagggtctcattgctacaatcattgaatgtattttttaaagatgaatataaaacagctaccctcccaagcaaatcataaaacaaattatgcccttgccacccagaactacagagaaacagcaggcacttcgtggcacagagagtaatggctgcaatattaaaacaatgatgggaaaaccaggatccaatagctgaaagcagggaggaaaacagcctcgtaatcccccagggataatgggtctcaccgacaggtccctgtgatttattgtgcttaatgtacttatttttatttgtccccttcaacacggagctttgtcactgaagagatttgataatggcctgtttgcagtcacttagactctcgtaataaagcgccacattttggctgtctgtaggttccgctggcttcattggcattccccctct

SEQ ID NO: 182925 - DNA, 643 bp, Homo sapiens
aatcgcttgaacccttgaggcagaggttgcagtgagccaagattgcgccactgcactccagcctggggacagagtgagacttggagactccatctcaagaaaaaaaaaaaaaagaaaagaaaaattacaaatagttttgctacttccaattgtaacacccttattaggcaacttactaatttaaaaagcagttcacaatagctctacattataccaatcacaaacaaatgctgtgacgtatgtgaatgctatttagaatctgaagttagaaatgttactattttttcgttttttgaactgagttagttgtttaagatgggtggattctccaatgaccttgaaccttcactgatgaacaaattagttttttggttttttaaccatttaaaggtcttgatctgtgtctagtgattgcctgcccccaggatattgtctcttatggttttgctacactttcaagctcccgtgtgttacacccctcgcagatttgccacaaagtaacctctgtgacatctaagacttgacagttgtctaaataggattgtgactttgagaagagctgaacttcactgtggtttatagagccatttaactcctcctgccccctctcccccttcccggttcccggtgggaagtcggggat

SEQ ID NO: 182926 - DNA, 290 bp, Homo sapiens
ggtttcaagcctcatcttataggcagggcagtcatggaagggttttgagtggagggggagatgcggaccatggattgcagagggatcagagcaaggggagaggtcattgtgtctgaggactaggatggcagtagtgggtgaacagaagtagatattgacatgctagtgctgtgtgtggaaacagaggccactgcaggggagtacaagaggctgtgatgggtctgctttagaagcattgggcttgaggggcttatggtgtgactaggtggaaatgttggataagcaggtag

SEQ ID NO: 182927 - DNA, 265 bp, Homo sapiens
ccaggctggtcttgaacttctgggctcaagccatcctccttccttggcctcccaaagtgctgggagccaccacgcccagcaacagacttgcattttatggaatgattactctagtaacaggctagaggctggaatttatgcggaaaagactaaaccagaaaaccagtaaagtgctgcagtagcccagtgagaggtgacaaaaggctgaattacagccacaggagtggagattcagaggaaggaattcattataaaagtgcagcct

SEQ ID NO: 182928 - DNA, 374 bp, Homo sapiens
tttgcatctgctgcctttattgtgcatactagtggataaaagaagtttatccagagaaaatgagttttgcattgaatttcaaattactagttagctagataaagaggtagaatggtaagattcaggggcattcagcaaagagataagcatataatgtcatgaatcaagaaaaatggcatacatggaaaacaacagtgggtcctttgagagctaaggcaatacattggtgtgaagcaggaaataagccagacatatcaaaggagccagatcacacagaccaggggtgtctaatcttttggcttccctgggccacactggaagaagaactgtcttgggccacacataaaatacactaacattaacaatagttgatg

SEQ ID NO: 182929 - DNA, 255 bp, Homo sapiens
tgtgtgcttttcagtgcatcacattaggaggcacatgtccacttgtttccttatcagtgatacttacttagatctttaggttaatgtgatacctgccaggttcctctacttaagttaatatttctccttctgtaatacataatttgtgggaagacactattacatcttaagatgccagaataatctcctttgactcccttctggccacgcacttgaaggacactacccaatcgatggaagcctttaatcgcacag

SEQ ID NO: 182930 - DNA, 525 bp, Homo sapiens
tgttgctaggaagcgagatggataaattttccaaataactggaggatgcttttgttagccattgaggtgtacaatgttaggcttgactttttactgaatttcttgagaacgttgtgcttaactgacactatattacttgtagatacatctgtgcagccatcagtggttctgacatgtagaacattttcatcaccccctaaaagaagttccattagcagtcactcacctcaattccccaatcctaggcaactactaatctaatttctacctctattattttggacattttatataaatgggatcatataataatgtgggcttttgtgactggcttctttcactttagcatgatgttttcaaggtccatccacattgtagcatttatcagtactactttattcctctttatttgctgtataatatttcattgtatggatataccacattgtatttgatttattcattcatccatccatccattgatggacatttgggttgtttccactttttggttattatgaataa

SEQ ID NO: 182931 - DNA, 206 bp, Homo sapiens
ttgaaagccagggaaagactaatgaactaatgaaggcatctagagagacatgataactaattgcaatgtgtgtttctgaactggacacttattttgacaatcaaatctgaaaattagagagtagtaatatctcaacatatcaattgcttaataaatacccagagcagagtaagcactcagtttaactatgatgatgacaatgatga

SEQ ID NO: 182932 - DNA, 337 bp, Homo sapiens
gcgggcaattagtatgtatcagtaaatacatctggaataataaaatgggtttcactaactcacacgcacctggtataaccagagtatttcttgctatggtagagaaaaagctattcaatattccaccttttctccgtatttaggcagcttactggaagtgagaatcccataaaagtttaaacagacccattgactcacttaatgatctatgtgatattttgacctcatatttgcaattatttagcttccattaataagttctgtttctattttcagcactgggattcacttccttctgagcttgggcagatttaagaagtttctaacttcaaatggc

SEQ ID NO: 182933 - DNA, 276 bp, Homo sapiens
tacaatgccaaatattaactaattaagaatacatatgttcaactacaagaaataagtctgaatatcaatcaacctcaccacgtccactgatacctctttgagcatttagaaaagaacactgtgcctgccaaccagtttaaatttaaaaaatcccaaaaaccagaaatggagggagaaactgggtaacttacactaatttttttaaactatttttctccaattaacatttaatttccaaaagcatcttggcaggtatacttgagcacaactgcatgc

SEQ ID NO: 182934 - DNA, 589 bp, Homo sapiens
tcctcctcttctactttttcaaggatgccatccctcacagaccattttctcttagttgtgttgagaggtataacatcagcattcattgagaaatgttttcagaaacaggtgtataacggcctttggtgtatttgtttcagaagttaggagatgaccttattactcaaaatatggtcctctaaccagcagtatcagcattacataggtccttgttaaaatagccaatcagcagacagccaagacccactccaccagattctgtactttaaaaaactcccgaagtgaacacccagcatattaaagtttgagaagtactactctagaccactttaagagcatagggtatagaaggatcaggcttcaaatctagactctgacacttaattatgtatatgacctgaggcaacattataaatgttccaatttcctcatctgtaaaattaaaataataatagtagttacctcaaagagttgctatgaggattaaatgaaaatccatatgcagcatttggtagactgcaaagaaaacaggatgtgcccaataaatgttagctgttgttattgttgaaatcccccattatctactata

SEQ ID NO: 182935 - DNA, 852 bp, Homo sapiens
  misc_feature (852)..(852): n is a, c, g, or t
ggcacttctccttgtgccgccatgtgaaggattgttgcttcgccttctaccatgatgtaagtttcctgaggcctccccagccatgctgaacttgtgaaaacagactaatacagagacccagcgggtggagacctccagctcctcatccctcaagatacaggaagtgagctgttcaggccgcctgttccccgacgaggtaagttccaggggacagaaacaagctctctgaagactctcattaatctttgctgtccgaagctaccttctccatctcctgctcacctgggaggactccctggaggaagccaggaaaggtgaaaatccatgtatctcttcacatttggagaacaaagggaattcaagaacaattttatggattttctttgttttttattaattaagacatgcctgttttaaattagacaataattttttaaatatccttcagattataaaatgtaaattgtcatggcctcttttaaaggcaattctacaaaaaaaaaaaaaaaaaaaaaaatttggtggggcggtcggcccggaaagtttaaaacccttggtgggggcggggcccttggaaagcgacgggcaagcgggcccaagagaccgtggcatgacacggcgtggttcacccaaaaaaagcgccggggacgggcgcttggacaaccagggcgcgaggcatcggcctacccagaccaagagcggtcatccccccgcggggatcaagaagagaacgaagaagaagaaaacagatacacacacagcacacgatagacgcacacaagaagcagacaggaagacagaaaagaggaaaacagacagaacttcaggataaaccagcacgactactcacgn

SEQ ID NO: 182936 - DNA, 1100 bp, Homo sapiens
tcgcactcattacgtctattggcaacgtgggggcgggactagcccagacacccactcagctgcggcatcacggagaggggactaagtccagataatgtccttgcaggctgtggccccgggggcaagacacgcaccctgcgggcgtattaaataatgagttaaatcacctgaaccacacccacttccggggacgctccgggcatcctggcttgagggtagggtgggcggaggtccctaagggagaggtggggctcgggcttaatccctccttgggggcatctgggtcaagtggcttccctggcagcacagtcacggggagaccctctctcactgggcagaagctaagtccgaagcagcgcccctcctgttaggttggactgtggtgcaggaaagcctcaagtggagggttgaggcttcagtccagcacctttctcgggtcatggcctcctcctggctcccaagaccccacaattggcagaggcaggccttcctacaccctactccctgtgcctccaggctcgactagtccctagcactcgacaactgggtctctgaggtcacttcaccgtggtctctgcctcacctctggcgctagaccactgaggggagagggctggggcgctctgctgagccactcctgcgcctccctggccatgtgcacctctcgcccccggggggattagtgtccaggttaccccagcatcctatcacctcctggtggccttgccgcccccacaaccccgaggtatatagccagatacacgaggcaggggatgcaccaaggatggagatgctccaggggctgactgctgttgctgactgctgagcatgggcagggggcacatggcgcatacaacgggaagaccagcattcgacgcaatgcgtgccaaagccccaattccaatggccataccagggacatagcggaaagaaacagacaggggaatgacaccacgaagacgcatccaacacggacaacgaaagcaccaagcaggaccacgagacaaacagaaaccacaaacatggaaagcagcggtggcaaacaaaagacggaccactagacgaaccaccctaccctcacggagagaagctgaacacaa

SEQ ID NO: 182937 - DNA, 392 bp, Homo sapiens
ttgatttttgtatataatgtaaggaaggggtccagtttctatcttctgcatatggatagacagttttcccaccaccatttattgaatagggagtctttttccccgttgcttgtttttgtcagctttgttgaagatcagatggtcatagatgtgcagccttattcctgggctctctattctgttccattggtctatgtgcctgttttagtaccagtactatgctgttttgggtactgtagacttgcaggaattattttctaccctgcttgaatttttccaagggcaaaagttagacctgagccatcgagattgggatctataatccattaagcttgggtgtcagaagtcatcatgttgatattgaatgtaagatgtcactatttatggtttct

SEQ ID NO: 182938 - DNA, 413 bp, Homo sapiens
ttgatttttgtatataatgtaaggaaggggtccagtttctatcttctgcatatggatagacagttttcccaccaccatttattgaatagggagtctttttccccgttgcttgtttttgtcagctttgttgaagatcagatggtcatagatgtgcagccttattcctgggctctctattctgttccattggtctatgtgcctgttttagtaccagtactatgctgttttgggtactgtagacttgcaggaattattttctaccctgcttgaattttaaaatagctctcaagggacctgatccataaagatttgcatctataatctatagagttggagcagaataatcatttgataaaaatgaaagatgtccccatttttagtttctctaacgttcaagtaatcttaaagttaag

SEQ ID NO: 182939 - DNA, 303 bp, Homo sapiens
aagttttcttagaagaaagcaaatgctttacttctaaattctgcttaaatagtattaattattttctgcatactctaacaatgtataaagaaattcttagctttgatgcaggtgaatcctaaaaatggggctcatcccaaaagggttcttggcttcactcaggaaagaattcaagaaaaagcagacagtgcaagaaagcacattttgttggagcaactttgtacagcacaatggttgctttgtagaccgaacaggcccatcctatagagcagcactagcggatttatatggactactccttac

SEQ ID NO: 182940 - DNA, 230 bp, Homo sapiens
agatacttttatgtatcagatgtaatcttgtacaaaaacaggaataaaaatactgtttgtcttctgttaagggtttagataggtatttttaaaactatacagagagagagagagagagagatttaaggctcagcccaagatttaacattctttccctgccccagttccccttcatgaattacttttttttttttttttttttaaatctgtaggatcaagccagtccttgc

SEQ ID NO: 182941 - DNA, 292 bp, Homo sapiens
aatggtctcatgtgatatgtggccatctgcgtctgacctccttcacttggcaaatgtttgcgaggttcatccactttggagcatgggccagagcttcattcctttttacgggtgaagaatagtgtggggccaggccacaatgtgcccatctgtccctcagcagatggacatgtaggctgtgcccacctttgggctattgtgaataatgctaccaggaacatttgtggataagcttttgtgtggataagcttttgtttctgattctcggggacgtgtacccaggagtgggatt

SEQ ID NO: 182942 - DNA, 228 bp, Homo sapiens
tccctagaaaaacaggtgactttctttttcggtttctgtattgacttttccacttagccctgggcattagtctaagtatagcaagatgctttacaattatacaggctccacattgtcccatagggaggatgtctactagggcaagtttttcattcataataaacctggccccagtggcttgaagctgacataaatgccttccagagcccaagtgatatcagtgaacat

SEQ ID NO: 182943 - DNA, 283 bp, Homo sapiens
agaacccatctaaccattctgtgagaaacactaaggaaccacatggggagtcttgaagtgtattcccacaaatcacttatttacaaaggggaaaatgaaaactacacagtggagaaacctggtagacaccaccttgacctagttatcaaagttaacaagaccaatagataaggaaaatagattaatgcatctcctgtcatggtcactaaggacacaacatcactcctatggtatttctgcagacatcacagctaagtgtaatatatgattctggattggatct

SEQ ID NO: 182944 - DNA, 450 bp, Homo sapiens
tctcaattctgaacactgtacaaaaatccaatttctgttcttttttgtgactagtctgctggtaagcattgccagtgacagactcaggagtcaaaacatggtgactggagaaaaatacacatgctaggttgtttatttaaaaaaaaaatattcatttgtgatggcttttctgcagatattaaaatactgaatatctttctcctagtttgcacttgcaaagcatttcttagcctaggttttcaaaggggcacctgggcacctatcatagttgaggctgcaactgtgtgtgataacccatcagaaaggagaaaacccaagcaaatggtaaatgtgactataatgaacaaacgtaacttttactgacttcatttattttggggtttgtttttaaaaagctggcttttgttataaaaataatacatactcttaccaaaaagtccaaacagaact

SEQ ID NO: 182945 - DNA, 612 bp, Homo sapiens
tgaattgccccactgatgttggtcaatttaggttaagaactgttcagtcatttgggggaaaaaaaacagtcaaataattcttaaaaagaaaaggcagctgcatctggagaaaatactctgaacttctgtcattaacacattaaagtcttagaacatagacagcttatttccttccatatctgctagcttccagcaaccctgatgatttaaatcaaaaacaatgggacaacaagctcttgtttcaaactgacattacttttttccctttaaaggtctgttgaggaaactgggggcccgctacagaaaagggtaaaattagctgaaaagcaaacaatttctcactccaataggaaaatacaccatcaactagttagatacattgtatacaccaccacctcttacactcacatttacccaagtcatttgcctgcagatttcacaaactgatacatttgaggcaattcaaagaaataacagtacctgcaaagataaccaagaccaccccatcccatcccaaaaagaataaaagatttctcccccagtgcctgagcaagaaaacctatgcttacttcttaacctgcatgcactgaaaaaagagcaattaaaagttgc

SEQ ID NO: 182946 - DNA, 515 bp, Homo sapiens
tggtaactgatgtacgactctgtgaacatacaacaaaactactaaactgtacacttctaaacagtaaagcttacagtatgtgaattatagctcaacagagctgttatttcaaaaaaaaaaaaaaaaaaacaccaggaaaaacaaacagcctgacaaatcaagaagatggaacagcatgttcacaaccacaaccaggagtggtatttagtctgtgatgcagtattttagagcagtgaaggaaggatagattggccaagaaaaggtttgaggacaaggggttaatcatgtgggaaaaataaagttaggttttaagaaaatttctacctcttccacctcctagctggtggcctgtgaaagtccctttacttctcagagcctctttttccacatctgtaaaatgggcatactattcccgatccatacgatttgtgcaaatattcagtgagacactggaagcctgctctctggagtcactcagtcagcagggttgctgtttctacaacacagcaaggtcc

SEQ ID NO: 182947 - DNA, 359 bp, Homo sapiens
gacactcgtaacgataatcagtatttaacaaggctggtattcattcaacttcaggcatgttttaaatgtaaataaactctagaaccctagactaataaatttatgaagacgactccttccaagtcttccctatctctgtaaatggcaaccgtttccttcctttggctcaggccaaaaccttcagagtcatccttgactggcctttctcctcaggtccattgcacttgctattccctctgtccggaatgctgtgtctccaaataaccacattccctccccttaccacgtgcagatttcttctcaaatattctttcatcagtgaggccttggctgaacaacccatttagaagagtaaattg

SEQ ID NO: 182948 - DNA, 256 bp, Homo sapiens
acttcctccttccaagtccaaaatgggactacaccatgcataccataggctctgtcaatgtctccagccccagctatactcaccagacaggagcaagaaagcctcagtaatacaggcatcttgcttgcatacccgcacatccagagtactgccctccatgggaactcaatttctagaagtctcttggcccagcactctttatttctcatctgagccctccctactgctttcattcttttttaaaactagacagctg

SEQ ID NO: 182949 - DNA, 330 bp, Homo sapiens
aaagtgctgggattacaggtgtgagccattgcgcccagccccatcttaaccatttttaagtatacaattcaatagtgttaagtatattcacattgttgtgcaacagtttctagaagtttttcatcgtgcaaaactaaaactcttcaccactaaacgatttctctcctctccccctgcccttgacaatcatgattctttatgtttcattgatttggactactttggacacttcatatgagtggaatcacacagtatttgtccttttgtgacatgtttatttcacttggtgtcatatcctcgaggttcatctgcgttgcagcatgttacagg

SEQ ID NO: 182950 - DNA, 449 bp, Homo sapiens
tccagcctttgagacagagcgagattctatctcccaaaaaaaaaaaaaaaaagcaacagaagcaaatgagagtgcctgggagtggtcattgtggggcattcctgttcgtgtgacccaggtcatgtccctccctaagccctggtctctcttgcctcctgcagggctggtgaattaccatatctccgtcaagtgcagtaaccagttcaagttggaagtgtgtcttttgaaatcagacaacaaagtcgtggacaaccaggctgggacccagggccagctgaaggtgctgggtgccaacctctggtggccgtacctgatgcacgaacaccatgcccggcgttgactttttaataataaccattctgactggtgtgagatggtatgccattgtggttttgatttgcatttctctaatgatcagcgatattgactactcccgggtactgagctcg

SEQ ID NO: 182951 - DNA, 701 bp, Homo sapiens
tccagcctttgagacagagcgagattctatctcccaaaaaaaaaaaaaaaaagcaacagaagcaaatgagagtgcctgggagtggtcattgtggggcattcctgttcgtgtgacccaggtcatgtccctccctaagccctggtctctcttgcctcctgcagggctggtgaattaccatatctccgtcaagtgcagtaaccagttcaagttggaagtgtgtcttttgaaatcagacaacaaagtcgtggacaaccaggctgggacccagggccagctgaaggtgctgggtgccaacctctggtggccgtacctgatgcacgaacaccccgcctacctgtactcgtgggaggatggtgattgctcacaccaaagccttggacccctcccagcctgtgacctttgtgaccaactccacctacgcagcagacaagggggttctgtaagtcaatatgatctgtgtggacggccagtactctgggtataagaatgcaggtcgacctggagaggattcactcgctgtgggccgcccagtttgagaattggtgtaagacatcacaatcccattattcagagcgagtatggagtggaaacgcttgtagggtttcaccagggctggtgaattaccgtatctccgtcaagtgcagtaaccagttcaagttggaagtgtgtctttgaaatgcagaagacaaagccgtggcgtg

SEQ ID NO: 182952 - DNA, 1224 bp, Homo sapiens
ggtgcacaccaccatgcctggctaattttttgcatttttagtagagaagaggtttccccgtgttgcccatgctggtctcaaactcttgggcccaagcgatctacccatcttggcttcctaaagtgctgggattataggcatgagccaccatgcccggcccagaaattttgtaaggtgttacttcagtgttagtgctcaaggaacaggcttggtaaggttgtggcttatctaaaactaaatggctaatgggtttgaatgccttcacagttcagacccagattatctgatgcctgtccttccttttactatatttcaagttcctttccagacagattattaagaggagtcagatttttaccctttttgggattctggctacagacagcgccactaggaagacttaggaatgtttgttgggttactctctgaattactgtgttgaattgtatagtctcatacttgaagaaggacaggaagcccggacacttaagcacactcattggatatcacctgctaaacagaacagtcatttctttgtcaacagcattaccacatacagttgcaaataacctcccccaccctcagatatacccagactgtgtgtctctcagctcctgttccatcattcagcatctctactaagaggttccatttcccttgaacattttctgtcctgctgactgcaggacactatagatctgacatgaatgctgtcctgccgcataccttacacctcccacaccatcattcagagcaactacaggcagcaatgagggggaatggaaagaaagatagggaacactcccccttttctggtctttatggtttttattttcctgcatctaatcctatttgtttttctgtctatgtctcacacacacacgaagagcttctagctatggccctggggtttggacgaaaaagttggtcattaaattctccttatgagactgtggagatatatatatatttttacatgtaggctctattaactactgtatttgcctgtagattaattacacctcagttggttgacctgaagacctgattaccatgtctaatattattcctgttggaataattttgctttgacccaaacaactgccacattcagaatgcagtccatttggaaatcagaagattcccatgggtgcagagatagccaactccaaagggcaccattcacataatatcccgtgtaaataacacaccccctgaagtctt

SEQ ID NO: 182953 - DNA, 368 bp, Homo sapiens
tccaccttcccagccaaatgttcctgccagcttgtcttccccttaagggcagaagaagccagttcatttagttcctacgaaataatcctcatgagagaccaagggaaaacaaaatgtgagacggaaggaacacatcaaaaatctaaccagctccacagatatttgatggcattcctgtagtgcaggcagcaatgctcagtgaacactatttgtctctccagcagtgattctagcccttccatattgtggagcttcctacttccagtttcagggtcctgattacatgatatagatcatggtcattcctacatctcttgctagagaatggtgtaaaactcagcctaagctaatccaccatggggcctttc

SEQ ID NO: 182954 - DNA, 173 bp, Homo sapiens
gacagtaacatgacccagtccttggaactttctgaattcattttcttgtcccctttgaaagtacagaacgatagtcaccactttctatctcccccagcaaattgttctttttttttttttttttggtattggatcaaaaatttctgatattggttcatcgtgccatttgtaag

SEQ ID NO: 182955 - DNA, 377 bp, Homo sapiens
agagatgaggtctcactatgttgcccagcctagtctcaaattcctaagctcaagggatccacctgcctctatctcccaaagtgctggggttacaggcatgcaccaccacgcctggaccacattgcatgcattttatttaaattttttttttttttttttttaagacggagtctcattctgtcacccaggctgaagtgtagtggtgctggcagagacactgcttttccctaattgacctgtttggtcctcacattaaccatattttacagctactctcatttacagataaggaaactgggccaatgaggaggtgagaaatcactcaaggctgccaggtacagtggctcatccctgtaatcccagcactttgggaggcc

SEQ ID NO: 182956 - DNA, 649 bp, Homo sapiens
ttatatctgagttgctgacagaatcatcattacagagcatttccgtaaacggacaaatgaaactaccaaggactttaatcacacacgaaggcaacggtggcatcagaatataaaaacaacaaaacaccatctttccagtaccactcccaagcacatacaacataatttatcctaaacgcaatgttaacacaatctttttgggaatggtaggagccaccttcttttcagaaatgcttcgagcaaaatcgaaaatctctaacctaacaacttgaaaaagacattatacagaaattacttcatcaactgccgttctttcttaccggcgggacccctctgtgtcttccgctacaattcttttttttttaacgccagtcaaatttagcggtaggggttgtatactaattttcgtgacactaataactattaagttctgataacccactaccattggaccagcctgagtataatttttaaagccctccaattgggtcgggggccgtggcttatgcctgtaaccccagcactttgggaggccgaagcaggagggctgcttgagcccaggaattcgagaccagccagggtaatatagagagaccccgcctctataaaaaataaaaaattaaccaggagtggtggcgcgcgcctgtag

SEQ ID NO: 182957 - DNA, 248 bp, Homo sapiens
aggatctgctatcttctttggcatcatgcctcctttttaaaatcttaattatcttgccataatcattacttagtttacatgagaaagttaaccaatactttttaatgtcaagtaagcttctttcactatggtcaagcttcttcattagtcagagtaaagactaatgaaaaaattagtcacacttcttttacctccaattttagaaacatcatttaaaggtttcacaggtattttcatagttgcaacct

SEQ ID NO: 182958 - DNA, 307 bp, Homo sapiens
tagagctcggtccggttctgcacaaagcaggctcaaaaatatcagttgaagaaaaataaatgtgttaaacgaatgaaagtaagttaagcaaatgcttatcatcagagtgaagaggcagtgggggccaatataatttatttacaaagtaggcaaagggagttaggaggaagcagcctggtacggaggaaagtgcattgaagcaggcatcaggagacttagctcatgactggagaagttcttaaaaccatgactctaggcagaccttcatttctagctgtagaattttggccagggtcctttgtgcagc

SEQ ID NO: 182959 - DNA, 316 bp, Homo sapiens
tagagctcggtccggttctgcacaaagcaggctcaaaaatatcagttgaagaaaaataaatgtgttaaacgaatgaaagtaagttaagcaaatgcttatcatcagagtgaagaggcagtgggggccaatataatttatttacaaagtaggcaaagggagttaggaggaagcagcctggtacggaggaaagtgcattgaagcaggcatcaggagacttagctcatgactggagaagttacttcagaagccactgtctcctcgggccaccatcaatttatacgctgtacaatattggaccagctcctatgtgcacgcc

SEQ ID NO: 182960 - DNA, 312 bp, Homo sapiens
gtgaaggggtattacctctactttatgaatgggaaaacaaagccaaagggaaatttggcttttctttccccttaggctgcttatgtaattattgtaactagggttttattcctagatgagcctcagaattcaattccatacattcaatgccaggcattgtcctatggacttaggctagaaggtgaaatgatatagaccttgctctcaaacctactgcatcttgctggggagaaagacatatagactaatgtagtaccaatgttggttactcatcctgtggtcattctcttttctgcttcagtttataggatc

SEQ ID NO: 182961 - DNA, 296 bp, Homo sapiens
tgaatagtagcttctgcccactgtgggcattcagataacatttaaaaagcaggggcaaggagcacttttcacatctgctgtgtgtttctgagcttctgcctgcggtcactaactttctgattcttagcattcatcccatattttagacacagcctccaccccaccccagtcctgcaaggcatccctctggctcctggatgcctcctggcctcctgcaccaccagccacagcatcacacagatgctggtctgttctgcccacagctcttggtgcaggtcagattcctgatcctggct

SEQ ID NO: 182962 - DNA, 213 bp, Homo sapiens
gcaagttattacaccactgtgcctggaagagggacacacacacaattacacagagcagccatgaagcagcatgtgggaaggcagaggaggcctttgtattgtcctcacagagatgaagaaactcagtctcagagcttacagaatgtttgagctgaaaacagctgtttaaatcagccctgtcatttctgcattggggatggtagtatcatggta

SEQ ID NO: 182963 - DNA, 387 bp, Homo sapiens
tttcttatgttatcttgcccgatcattttgacagtaagaatgacatccacccacagtgctaagatagcttgcttctaaaggctgctttctcctctcggattcagtgttccatagaaatgggattgtttataaatcttttatgattattctcttgaagagctgaagaaccagagaaattgcctcattgttgagcttaccacttgagaataaaccatttttagatagcctcattatagactatgcattcccctcatctttctacactggagcctctgctgcacttaagtctcctcactcctaattttacctatctcctgctgctcagatgtgttcaggcatggcaacctccacagtctctaaagcataattgcatgggcagatgttgcg

SEQ ID NO: 182964 - DNA, 553 bp, Homo sapiens
accttatagtagcgggaagtcaggaccccaaagtggagggacctgctgaagccatggcagaagaacataaatgtaaagattccatgcatacaattggttatgctcatgtactgtttctgagaatgtaaatttgtatagccattcttgaaaacagtattgtgttgtctcataaaacaaatgatgtaaccactatactgtgtcaattccactactcagtatttatcacaatgaaaggtatcagtatattaggaggatattttcatccatctccttattgcagctctattcacaatagcttttgaattaacctgaaagttcatcaagggatgcatggaaaatggcaatattatatatatgcactattgaaaattgttaattaaaaggaacaaaatcatatcactttcagtaatatgactggaattggaggtcattatggtaagtgaaagaagccaagcacaaaaaaataaacactgcgtgttctcatgtatatgttaaaatataaaatagttgatctgcttggtgcgcagagttgattgctggttactgaatgatc

SEQ ID NO: 182965 - DNA, 218 bp, Homo sapiens
cgccgaggcctcggtgccccttcccattttccatccgcgctcccacgaaggttgaggcggcggggagaggcgaagccgcgagcgctcggccgggcggtcccgccgggtggtcgcagccatgacagcggctccccttccgcgcccctcccgccggagatgagggaagatgtccctgtcagggttaaggccaagctgaagttgctggcgtctaccttcca

SEQ ID NO: 182966 - DNA, 453 bp, Homo sapiens
cctcatctgtcctgttcctcctgtggcctgggtcgtagcaccatgtctggtacagtgtagatgctcaagggaagtttactttgtagaactgtttacctgggagatgttactgttagtctaacctgtaccattttgtaaacctccagccattttgcagactctgatcacagtgaaacgttccatgggaacttgggccatgagaaacatccttcctaaccacgtgactgcagaaacatccttatcgcatcttcctgggcaaaggcccaacagcctgactgcagggacatccttgccatatcctgctgggcagcaagctctaccacccagatccctccctcccagtcccatgattaccccagcctgtgagcggcagttggtgctggcactaagctggtttcctcctccccagggttttgctggcaataaagatgttgctgttgaagccacaaaaaa

SEQ ID NO: 182967 - DNA, 568 bp, Homo sapiens
gtctattgccctcaaagatgaagaatcatcataaccaaaaatgtgatatgtccacagtggatgaattagcataatagtgaagtgtttgactgtccagggctgcatttagatgaagactgaactcacgctgtccaccttgctcacgagttgacatatacttccatatggcacagttcaggaagagattgaactcggctaagccatccttttgtgactttgtatttgacgatcctaactggaggaggaagcaggagtgagaaggaggaactggagtgagaagcaggagctcctaacaatgcaggagacacaggcaccatgcggagaaacgcccagcggcccttcatgacccagagccggggagctgggtgcgggcagaggccgctgcacattcacccacagcagacgacggcgtgccgtccgacccgctgggccaccctccatgacacacgggatcaatccactactaccccgcgaagaccgcgcgcgccgcccaacactaggctgcactacagcggaccaccaagaccacctgacacacaactccaccagcccacacgcccagttgccc

SEQ ID NO: 182968 - DNA, 463 bp, Homo sapiens
gtctattgccctcaaagatgaagaatcatcataaccaaaaatgtgatatgtccacagtggatgaattagcataatagtgaagtgtttgactgtccagggctgcatttagatgaagactgaactcacgctgtccaccttgctcacgagttgacatatacttccatatggcacagttcaggaagagattgaactcggctaagccatccttttgtgactttgtatttgacgatcctaactggaggaggaagcaggagtgagaaggaggaactggagtgagaagcaggagctcctaacaatgcaggagacacaggcaccatgcggagaaacgcccagcggcccttcatgacccagagccggggagctgggtgcgggcagaggccgctgcacattcaccacgctcacgccacgtgccggcctcaggcttgacaagctcaggcctttggttaaagcctttctagcacat

SEQ ID NO: 182969 - DNA, 189 bp, Homo sapiens
gctgtgttgcccaggctggcctcaaactcctggcctcaagatatcctcttgagtctcagcatcctgagtagctggaactacaggcacatgccactgtgcctggctcccaaatcattttaatattgggctatgatacatattaggccacagcttacctttgtcagctgcattgctcatgccactctccca

SEQ ID NO: 182970 - DNA, 818 bp, Homo sapiens
cggactgggactattccaaaatatataattatcacacaacttagcatagaaagtctgaataaacaaacaactactggaaaattcaaatggtaattgaagtgggtcctccaaaagagatcgggctgtatatttcagagcatactagtattaactttcatggatagataactgttttctatgagatttgtcattaggtcgtaaaatataaatctcttttggaatttcacattagaatttattttatttttcacatacaataaaaatgcttagaatatttcaaatgttagcacaattactattgatagcataaggaaacaagtatttgtaaacagtctaacatttttaaagaagaaacccactgtcattgtgaaagaagtatatttgtcatcactgggtttaattagaagacctttaggcttatcccaacctcttcagtatttaaaaactggaaaactgtcagatgtcttattataaggaacacatgctgtatgattaaatcccaaaacatatgtgggaaaaataaaaataacgaaaagagcaacaaaacaaaagctgcttttctgaaaacaaggcaaacacaatgctagcaaaaaggagataagcatagaagagacagatataagaaagaggcaatataactaaaagctagcataatttttttaaaataagagcacattacaaacaactttatagcaaaaagctaagtactcagaagaaatggctaatttcaaaaatatataattatcaaacaacttagcaatagaaagtctgaataaacaaacaactactggaaaattcaaattggtaattgaagttgg

SEQ ID NO: 182971 - DNA, 232 bp, Homo sapiens
gtaaggaatggtgtcacacattaagcaaatcatgattcaggattaaaatgtacattaggtgagaggccgggaaaactaaaggaaagtacatttaagcaacttctcggtgaaggaatatataaggctgatcacaaagaaggcaagctcatgtgaggggctggtagggttcttgaacctctggccacctgcagataaataattgattgaaataaaacccgaaatgttctccaga

SEQ ID NO: 182972 - DNA, 118 bp, Homo sapiens
gagggggaggaggccacgatttgatttcagatccacactgcagctaattttcaagacactaccacttgctgaatttttggtatactgtcaaagaatacccacaattagaatacctctg

SEQ ID NO: 182973 - DNA, 539 bp, Homo sapiens
tcagccaggcggtcgatgtcagcatccactgtgatgagtcctgttgatggtgtggacccttgatgggatgtgatgagatgggcacttcaccccggggatcgtcctaatgattcataaacccagtctaatgagaaagacagcagacagtcccagtagaggggcactctataaaactcctgagccatccacacagctatcatggtcctcagagacaaggagagtcggagaagctcagggcccagaggaacctgaggaggcgacaggacgaaacggccagtgggaccctcgacgggatccctgggcaggatgagctgcggagcactggggcagtgaatgaagtgtgggccacgctcccggtaacgggtcagtgccggttcctgatccgtcacaagggcgccaaggagaggaaggtattcatgctgggaggacattggtgtgggcgtgtgagagctctcggtactatcgtctcaattttctgcaaatacaaaacttctaaaatagtgtattaaaaatagagaattaaagtgcaaacatacaaa

SEQ ID NO: 182974 - DNA, 717 bp, Homo sapiens
gaaatcagacaatacctaggttctagtctaggctctggcacttaactaatgggtgatcatgggcaggtcgcttaacctttttgtgcctcagtttccttatctttacaatgggattataatagtacctccttcataggattgtcctgaggattcattaattgaaatgaccctaggaaagggtcagtgccttacactgagtaagttctcagtaaatatttataatatcatcatcatcatcaattattattattattaatttactttaccaaaacacaggtcctgctgagccatgttggccagaccacacctagaacagcatgtccagttttaggctaatctgtgtaaaattcagtgcctggaccattgaaaggggctcgatatatggtggaggtattattgttaattaatgctgctgctaaccttcctggagtgcatacaacatgccaggcactgcatacgtgctaattctattagtcctcttaacctttaccactctatgaataatatacaattattaatcccttttgcagatgagaaaattaaggcacagaaacgttaagtaactctcccacaattacaaagcatggaagtggcaaacccataattcaagtctagactctctttttccagagcctggactcttagccaccatgccaaagagctgtgctgtccactgctgtagccagcagtcacatgtaactatttaaattaataaaa

SEQ ID NO: 182975 - DNA, 196 bp, Homo sapiens
aatttcaacattgtggttacaaaataagagtttccttcatggtacacatagaaggtcatttatgtggtggtttagctgcgaatttaaatactgagctcatttttttctttccccacttactccagaaacattaaaagcaaccatgcaacctcattatatttgttagcattccaaaaatatttcaaagggcagtatg

SEQ ID NO: 182976 - DNA, 903 bp, Homo sapiens
tagatgaaaaagaaatcctgaatgttctgaaaggttatcatttttgttctctcctaggaataatgattttcctccattattattatttttatttatttatttattttttgagacagagtctcgctgtgttgcccaggctggagtgcagtggtgctatctcagctcactgcaagcaccgcctcctggattcacagcattctcctgcttcagcctcccgagtagctgggactacaggcacctgccaccacacccagctaatttttttttgtatttttagtagagaaggggtttgacggtgttagccaggatggtctcgatctcctgacctcgtgatctgcccacctcagcctcccaaagtgctgggattacaggcatgagccaccgtgcccggcccctccattattgttttgggtgggtgcatggttgcctacctagagacatttaacatcctcctttgcagcttggtgtggtcatatgactttaagttcaacccaggaggctatgagttgtaatgtgtacagcttctagaccacattcttaaaacggtgctttcgtttttcttttcttttttccatgggctggaacatgacctattgttagggagctttggctttatagatagaaagatactccagagaatgacagtgtaggtagacagaagcaaaagtcccctgaaaatggttgtcatgaagccctctcctctcccgctaatcagcttggacttcgacatgagagaagtaacacttctatgttattaagccctttgtgataggagcaaatcctgtactctgatgtagggtgatgcagtagtggccaattcatattactctatgatatgctctgtatggaatcaatttttaggaatgacaagtgagtgtactgtgtgtttagcatacattatag

SEQ ID NO: 182977 - DNA, 349 bp, Homo sapiens
gcattgacaatggctagggcatttccaacaggaatgcaagtctgtgataaacaggggagaaacatgctaccccacacctgcacaaactaaatgatgtgtaaaaaatagttcctagcctctcatcacattgagaactagttgcttccaaattcagcactctttttaaaaaaatcattgtctaagaggaaagcagtcaggcctttcttaaagcaccactgcctattagatgaaagctgctgaggcccagcgacactacgtgttccttactccatgagtctctgtgttacaggaaaggggtcctgatccagaccccaagatagggttctgggatctcatgcaagaaagaatt

SEQ ID NO: 182978 - DNA, 644 bp, Homo sapiens
gcctcaagctgagcctaaaacataagcatggaaataggccctttttttaatcattttaaaactagaagcctcagtgggaaagtgatttgactgtccagagaaaatacaggaatggaaagcaagctcgctgtcactgtaaagcactcaaaggagcagcccaagtgttcagggtggtgacaggtgcctgcctttctgcaggaaagctgagaactccctccacctcaccccactcacagcacagaaacacccgagggctgggcaaatgagactctggaagggctcccagaggtcacacggcttggcttctcaaggacagacatcccctgtgtactctcggagggctggggcacacagtcctcacgggcagcccatctgcaacactggtatctgcatccttgcactttctacccatcagcccaaggaaatcaggagtcaatcaatcgaacaaaagttattcaatgaactcaggccatgtggcctgcgatgaggcaaaaacaaaagcccaagagcggtccccactcaaagcgtgtgcagactcattgaggagaaatgggaacacacatagttacccaattaaccaagagattcagtcagtacaagaggcttcagtgtttggggaaggcttaagagttgcagaagggcct

SEQ ID NO: 182979 - DNA, 390 bp, Homo sapiens
ttttaacggtaaggtgctgttgtctgtacctttgcatgtgtgttttggattatcatctgtcacacctgggtggaaaaaacaaacttgaaaaaggttcaaagtcacacactgatgaatttgcgagaaacacattttttaactaatgttcacctggtgcataggctacatattcattttttaaataaaaaaaattttgcatctgtaggcttttctgcacgttgccgcttaaactacgcacctagaaattcatgctgcatcttttgggaagatgctttcctggggtcaaaaacacattcatagtggtttgggcactttgtattctttcaaacctgtaaactttagttggtgattagaaatagttaaggcagattctaggctgcaaggtttagg

SEQ ID NO: 182980 - DNA, 474 bp, Homo sapiens
tcagctcacaaggatgtttaatgctaaataagactgtgtagttgtgctgtttagacatctcctttgggtgattaaaatacattattctaatgtaacacaatgcatatgtgatatacttagtgatgagatttttttcaaagaactggtactatagccttatgtacccgtacaacagttgcatattattaactagtcaattgtttaaataatttggtgtgactttcagtccctgatttttctgtgtgtatcattaaaaaaaatctgtaagcaattgcagcaacactgacctgcttataaaaatccatcattatgggatgtgtatgctaacaatgaagaatgttatttgaaaacttgcttttttgttatcttaaaagaacagatggtaaatataagcttactctaatgtattaaaacacataaaattttccttaacactaacatgttgacttgccaaataaacaattgctcctgcct

SEQ ID NO: 182981 - DNA, 187 bp, Homo sapiens
ggattggcgggcacttaaagagatattatcttcacattagaggctaacaggcttatacctactgatagctgacaagtattataggaatcctggcaggcaaattgtagcataaaaattatgtaatttactaactgtaaaataacctttagagtttagaatcagtcagataagttgcccgccaatcgaa

SEQ ID NO: 182982 - DNA, 225 bp, Homo sapiens
ggacctaattaaggagcttctacacagcaaaagaaactatcaacagaataaagagataacctacataatgggagaaaatatttgcaaactatgtatctgacaaaagtctaacatcgagcatctataaggaatttaaattccctttagaatgaaatctaaatcctttcctctggcctacagggctctgaatgatggtgtgtgtgtgtgtgttttaatgttatcttg

SEQ ID NO: 182983 - DNA, 459 bp, Homo sapiens
ctatggtgaaaaaggaaatatcttcgcataaaaactagacagaagcattctcataaacttgtttttgatgtgtgaactcaactaacagaggtgaaactttcttttgatacagtagctttgagacacactttttgtagaatctccaagtggttatttggatagctttgagggtttcgctggaaacaggaatatcttcatataaaatctacagagaagcattctcagaaacatcgctgtgatctttgcattcaagtcacagagttgaacattcccttttatagagcaggtttgaaaccctgattttgtagtatctggaactggtcatttcgagcgctttgtggcctatgttgaaataggaaatatcttcccatagaaactagacagaagcattctcagaaactagtttgtgatgtgtgtactcaactaacagagttgaacctttcttttgatggagcagtt

SEQ ID NO: 182984 - DNA, 379 bp, Homo sapiens
atcaatgttcaaaacgtttaggaattaagtcaaactaagggatatgggcctgagtggaagaggctttgccactgaaatgacgtgcatgtggcagccgccggaaccagaggacatgcagccgcgtgcggagagtgaggcggatccattacgggcacacagcttaccatttccttccagaattccttcttccaaacaagctatactgaaatccctctagtaaaagattgagacgaaacactaatagttttgggccaaaacgtggtggagaagtttgaaaagacaaacatagcaacgtgtctttggctatatggttccttgccctccagcaagcttgaaatataaaaaggctaacatgcaaaactaggggtactacccccct

SEQ ID NO: 182985 - DNA, 224 bp, Homo sapiens
ccaacatgcgaacggactgatctatgcaaaaccttccctctttgatatactaactccagaaagagccactctgtcttggtgtcagctttcaaagatgtcactgcttcatcagtatgaaatatttacctaggctatttgactggtggtgtctagacaaagaaagcatggaggcacatatggtttgattcaaataatgtagagtcttcctgaaagcctcagatcag

SEQ ID NO: 182986 - DNA, 223 bp, Homo sapiens
ccgtgccgttatttacaatgacataacaataagatttaatgagtaccagctttgtgctaactacttttctataactggacagtcctgatcaggtttaatctttaactctgaagtaggtgaacaagacagatgcagtgtcaaccctcctgaaactgacagtctttatgggtaacagataagtacccaggtgctgtggcttggatatggttggtttgtctccacc

SEQ ID NO: 182987 - DNA, 332 bp, Homo sapiens
tgaatattgccaagtcttcaggaacacgtcactctcataaaatgaaaccgtattgtactttctctgctttagtcatatgcctgtaccattcatgtcaataaagtttctttaatttgttgactggcatctgggttttaagaagcagagaagagaatcatgataaatttatgtttcaggctattaagcgatatttagaaaaactgaaataaatagttaattggatacagtcatcttgttagctttaatagtttttctgccttttttgcagtcatgaaactctttgacaacctaaagaaagctatgggtctagggccgggcgcttgggaggccaa

SEQ ID NO: 182988 - DNA, 184 bp, Homo sapiens
atgatgtcatgaaatcccccatctgcagtcattttgctgtacatttgcctgcatcatctgggagcacctgcctcacaaaacccatgggggtagatagtagcaaaaggccaggagtggtgtttgtgtggggcctccttccagttcattagcaaatattttcccattacagtggtttttgcttctc

SEQ ID NO: 182989 - DNA, 667 bp, Homo sapiens
tcccagaacagagttcaaaaatacttaaaatgaaatgatagtatacagaaagcaatgagataaaattcactgtctagcatgcggccggaatattgaacgtagatgcgaacaataggagtgtgtaccaggaatcaaagacaaaagttaccaggcatgagaacaatcaagaaactataacccacaatgagaaaaatcaaccaatagaaaattaatcacaaatgatacaaatagcagcattagtcaaactgtatttcatatgctcaagaaaataaagaaaaacataaacatgttaaagacagggaaaatataaaacagcctaaacaaaaattacaatgtcttgaggtaaaaaacatactgatgaaataaagaggagattaggccgggcacagtggctcatgttacagttcttaatcaggtcccaagtatcagcctgtgccaaatcagactcaaaataaagtcagcaatgaaatgctaaagatcaaaatgaagaatgagcgcagtgactgtcacaaagccatctaaaacacaaagaaataggacctaattgggtacatctctactccattcactcctaccctcactgaaggaacatcaagacagcataaactatggagcgaaaattctcttcctggaaacttcttctacctgaccaccctgggtgacctct

SEQ ID NO: 182990 - DNA, 556 bp, Homo sapiens
tcccagaacagagttcaaaaatacttaaaatgaaatgatagtatacagaaagcaatgagataaaattcactgtctagcatgcggccggaatattgaacgtagatgcgaacaataggagtgtgtaccaggaatcaaagacaaaagttaccaggcatgagaacaatcaagaaactataacccacaatgagaaaaatcaaccaatagaaaattaatcacaaatgatacaaatagcagcattagtcaaactgtatttcatatgctcaagaaaataaagaaaaacataaacatgttaaagacagggaaaatataaaacagcctaaacaaaaattacaatgtcttgaggtaaaaaacatactgatgaaataaagaggagattaggccgggcacagtggctcatgcctgtaatcccagcactttgggaggccgtggcagatggatcacctgaggccaggagtttgagaccagcctgtccaacatggcaaatccctgtctccactaaaaatacaaaaattagccaggcgaggtggcagatgcctgtaatcccagctacctggga

SEQ ID NO: 182991 - DNA, 863 bp, Homo sapiens
tatgaaatgtaatgatgaaattgaaatgaaattgaaatgagttgaaatgatgagatgtaatgatgaaatgaaatgatgagatgagatgaaatgagatgcaataatgagatgaaatgcgataacgagatgagatgagatgaaatcatgagatgaaatgatgaaatgaaatgatggatgaaatgatgagatgaaatgtaatgagatgaaatgacaaatgaaataatgaaatgagatgaaatgaaataatgaaatgatgagatgagaagaaatgatgagatgaaatgatgaaatgatgagatgagataaaatgagatgaaatgatgagatgaaatgatgagatgaaatgaaatgatgagatgagatgaaatatgatgagatgaaatgacataatgaaatgaaatgatgaaatggaataatgaaatggaaatgatgagatgagatgcaatgagttgaaatgagatgaaatgatgaaatgatgagatgaaacgatgagatgtgatgaaatgatgacatgaaatgatgacataaaatgagatgaaatgagatgtaatgatgaaatgagatgagatgaactgagatgaaatgatgagatgagataaaatgatgatatgaaatgagatgagtgatgagatgaaatgatgagatgagatgatgagatgaaatgatgagatgaactgatgagatgaaatgaaatgaaataatgaaattgaaataaaattgaaatgagatgaaatgataagatgagatgatgaaataaaatgatgaaatgatgagatgaaatgatgagatgagatgacatgaaataatgaaatgaaataatgacatgaaattgaaatgagatgagaagatatgagatgagatga

SEQ ID NO: 182992 - DNA, 439 bp, Homo sapiens
cgaaccacccggggagaaatcccctgtggttgcattgcgagagactgtctcagaaaaagaatatctgatagttcatttgaagtttttgttgatgagaagtaaataattctttttctaaaactaatacataatgattgtgcaaatttctggagaagttggttaatgggtacaaaaaaacagttacatagaaggaatatggtctaatgtttgatagcactgtgtgatgactatagttcacaataatttatggtatatgtcaaagtagctagaagagaacatatggaatgttctcaacacaaatgataaatgtttgaagtgctggatattttaaataccttgatttgattattacacattgtatgcgtgtatcacaatgtcacgtgtacctaagaaatctgtagctttccttcctaactaaaccttagtaaagtccacacac

SEQ ID NO: 182993 - DNA, 843 bp, Homo sapiens
cactgctcctccaggccccccagactctttgccaaacccttgtagccatttccacctattccaagccaccagtgaccttgcaattggacaaaatcgccagcagataaatggcactcaaatggaatggaattcagaagtctggagcagggcttctggaggataacagatgggaaggcagcctttcctccagcctcacattcccatgccctcgtggctttggtaaagtcagctgagctcctggaattcaccaagacccaggggaacaatgatgagcaagagttgtcctgggcctcgaggagcctgtagtccagtagagaatctgggaacttagataacctgcagtacaatacagataaacacacatatggaagtgtttaggccatctttcttcaaatgtaagggttttgcttgaaaatacagccttttgatttaaaaggtcatcagaaaaataggtgagaagagctaagaaaattttggaaaagagaaaactgaggaaggatttatactatctgatattggaaaattttgtaaaaactaagaatgagagcactgtgttatcggatgaatggacaatcagtgaaatagacagaaaacccaaagcaggtgcaagcccacttcctcactcatttattatttcactcagctccctgcgtgccaggcactaaattctgagcactgagggaaagcagtgaacaaaaaagaaaaaagaatttctgttccaagtgaggagagagacgaacatgtgaaaattatagtatgtgcaatggtacaggaatgctggtgagggccaggaatggctggaggtgtaaagaggtagccaggtaaggccttttgaagaagata

SEQ ID NO: 182994 - DNA, 695 bp, Homo sapiens
gccactctggggcttggcctgcaagaacaaaacgaggggcatgtctcgagcctggcgcgtttaaatgaggcatctttcctaaccatgcagcctcgaagatgcaactcatgtgacttgtttaaaaaacagtctttggtacctgttaccgccaacctcacctaggaacaagtgggcttccaggaagacaagaacaaagagatgtgactgtgagggtgctgtgtacaccaatgccatcccaatgaagggccacagtctgtctcctaacataattctgtctttattgttttcattttcaattatcaataacctcaccccagataaacctccatggctacgatactgcctctgtgcaaaacttctaaaataatcttgtagggttattttaccaatgtgtggggaaggattccttacaggtaagcacttgctccccatgacaacagacaggagaatactgcggttaagagcaagcagacagacgtgcctgcccgcaagccaggcttattcactgacaaaccacttgcttttccacctgtaaaacaggggtgccaataaaagctcctaaactttgagcattcctgtgaagattaaattggttaaaatcctatgtgccaggcattctgtgtacatgctaaatattcaccattaataatgaaaactgaacttctcttccatcaaatcctcgatttcctacctgg

SEQ ID NO: 182995 - DNA, 284 bp, Homo sapiens
gtttctgatgttcagattgtcccaaatttggccaggtggagcccttcaagtatctcttatgtccttttgacattcactctctagtctttggacacttgattgccttctaacacaagatatctcaagttggccttgcattttcaatgccccaggcctggaatgaaacctttttccaagaatccctggctccttttaataggtagctatttagaaaccaagatctgggcactagggattctcactgctcccggagtgtcactggcaattctttccaaccattcaag

SEQ ID NO: 182996 - DNA, 580 bp, Homo sapiens
attcttgggtccacgagagagaaaaaacgaaaccagccagttgttcacaaacagcttttcctgggagagacaaattcgtgtaaatgtctgttatagggagtactggaccacaggcaacttccaaacaaaaaaataagcagtaagagtcagtattaaaacctgtgctatttgaaaaaagaatctgctgacaggggcggaggctcttgcacaatcaccaaaagcagctcctctcggtgaaatttgatggtgttcattccatttcaggcattctgctgggggctaagggagatccacaaacatgaaagatgtgatccttgccctcgaaaacattctactatggaagccaaacacaaatgcatgtggagtctcccaaaggaagcaagggtttacaggttttgtctgctggagaaagtctatccagctgaaaaagttcatctcttcccttccctgcgatgatgcctcttcagagagggccaatttgaagcattcccgaagatttactatcacccaccaaactatagtgttggtaaatatttaagtattgtgagtgtgggctcgaatttgttggtgctaaatccta

SEQ ID NO: 182997 - DNA, 502 bp, Homo sapiens
ggtgcagaccccctcctatctgaatccagatcctttatagccctctctgtgttaaaggcatcacagaattaatttccacttcattgggagctctcagtccctgaaagttgaatccagagtggctattctgcaggtcatgcgattgctgccccaggcatcagaactcaggcatggcccactccatatggaaacaggctctctaaaaccccagtggcctggctagccagcatgttatattgtacctgtcctatctctatcagtgtccagtgcaggtgtgagagagagtactgtctttggaaaagatgagagcccagtaggatgctctgcccacagcctcgcatccacctgacttaaaaaccatcgtgatagcaaattgggtgttgatttcagaagtttttgatttgttatcttaaacgtcatacctatctggattcagataggaggcctcctatctgtatccagaccgccatgatgacaaaaatgagacggacgtacgtctctg

SEQ ID NO: 182998 - DNA, 464 bp, Homo sapiens
ggtgcagaccccctcctatctgaatccagatcctttatagccctctctgtgttaaaggcatcacagaattaatttccacttcattgggagctctcagtccctgaaagttgaatccagagtggctattctgcaggtcatgcgattgctgccccaggcatcagaactcaggcatggcccactccatatggaaacaggctctctaaaaccccagtggcctggctagccagcatgttatattgtacctgtcctatctctatcagtgtccagtgcaggtgtgagagagagtactgtctttggaaaagatgagagcccagtaggatgctctgcccacagcctcgcatccacctgacttaaaaaccatcgtgatagcaaattgggtgttgatttcagaagtttttgatttgttatcttaaacgtcatacctatctggattcagataggagagggatcgtctagatcactca

SEQ ID NO: 182999 - DNA, 271 bp, Homo sapiens
gagggggagtcccccagaggtgcttcaccaattccgtaataacagttctgctctgtaacactcttaatgcttgggcgagagaaactgctgccaccccatgcccaccttcacacgtgtcacgtttttctggcccatctgcacaggcaggggcccaggtgttgccatctgttctgaattctcaaaatgtcagtgtaatatgggcagcctagagtttcacaattcagccagttattcaccctgccacgtctgtcttgattgtggctctcatgtg

SEQ ID NO: 183000 - DNA, 463 bp, Homo sapiens
tgggaactccctagtgatcacagtaacgatttgcttctctatataatgagaggggccagagttctattttgatgctttggggattgggggagagcagaattataattgtatcagacccctccaccagggacccttttctatcatgagatgaagagctcacataagagttaactgccctacaataaacaggttttggagttattctttctattactcttaaatctaaaggttgcactctaggttccttttaattaagctccagaatttccataatgaccaaaaggagatggccttgggggctaaaaacacacttaggagtctgtagcctgggccctcagacacgatgccttcctgagcctattgtagagcagtcacctacacagacactctgtttctgaggtcatgatgtctgggacaaatcacagcttcttatacttggcttaattttcttatacttttttga

SEQ ID NO: 183001 - DNA, 455 bp, Homo sapiens
gcttgttctaaggctcacagatggcaccttctctgtgtatcctcacatggtggaagaggcaaagcagttcctgggggagttctttgataaaggtgctaattccattcaagagggcacctcccaagggctccactccctaatactatcacgtggggagttaggattcgacatgtgaattttggaggcacacagacattcaggccaaggcataaacagtgaccacttttgttctgtctgtccacacactgcctagagcttccatttatttcaactacatttgcttttttcttatttatctgttcagagtatcttctcagtggctatttatttaccaccctttaacatgttttcttgacattgtacttcagcctgtatatgctttgcaactcaggaactatgctggcttaactaatagtacctacttaacaggtgaaactgacagtaacagcttaata

SEQ ID NO: 183002 - DNA, 478 bp, Homo sapiens
gagatgaaaattttgtgggaaaacatctgcaaaataaatttctttgaatgaattgggatagatggcttggccctcaggtccagacctccctaacataataaatgaaccagttattgaccagacaaaagatttcccttaagtgctctttaattttaaagcagaatagctttaactggctcttgatgaagaaatcatcttaccattcttagctgtcctctcttctgcatatgcagtgccaggagtgcttttgggcatttgctgtgttagggtagtgatatgttttggaaagataacggtattgaaattagggtactttcaagagaaattcaactttggattgatgtaccctctgatatgtgctgtcttgtttttaaagaaacacctttatcaggatatgattcatacatgaaatgattcatccatttaaaatgttcagtggttttcagtatattcagagttgtgcatccatcaccatagt

SEQ ID NO: 183003 - DNA, 1100 bp, Homo sapiens
gggattttcaagaagtgttattaatagtgctctatgctatagggcagtcaagtatggaaaggtttttaaaatgtctagtggctttagcccctggctgggcactagtgacctaaaggggaaaaacttcagttgagcaatgaggatgtgaggaagcagaggcaatgagggaagacagacatttcacgcaggctgcatgtcatgacgggaagggaagaaggaacatggtgcctatttaaaaaaaattattaaaaaaaaaaggcttgagcatgtttatgatctgtgtgaatactgctggaagagatgcaggaggaagagagaggacattgggaggggcagggtcccagaagagtcaggagggagggagatcctgaaggaagtaggtggaagaactagtcttgaagcaaaggaatcctgcccaatcccctgagacaggaagccggaaggaaaggaaggatgcagataagtttgcaggtggcaaggagagagcacaagaagttaaggaagttcctgtctgatggcatctgttttctctgttaagtagctgggaagtggtggggtagggagaatggtaagctcttgtaaatagctcttgtgaggactagtttgcctgcaatgttgatggacccacatctatacccaggtagatgctaacctatagcaactgtataatttcttctagcaatgccctaatctgtcagcattgccctctcctatgcaggcacagtagaactaaggattaagagataccttagataacaatgggaagaaaatagagtggtctagtggaggagaaaaagactgaaaaataggcatagttagaaaatcagaaggttgaaaggctgtggtcagaatattgggagtttatgatttttgatatgaagtgcttctggatgatttcatccacccatctatctaatcagtgggagattctgatgggtagagaggcaatacagcctagggtgtggccatagtgaagtagaaggcaaatggaggtagctagagttgaagtgccaagataacaagaggacaggaagtggacagtcaaccagaatgagaagactctgacctaggaactagactgattgtggaaaactaatcag

SEQ ID NO: 183004 - DNA, 175 bp, Homo sapiens
tgacaatcattagtcatgagttcatcttgaatctgattctgaaggcagaatatgtatctttcctcatacctgcagtgttgagtcattgtattagtcctgaggaagtgactggaaaagaagtcttaatttcactgccaaagaaataattggatcaaggttacatagcgtatttaaa

SEQ ID NO: 183005 - DNA, 404 bp, Homo sapiens
cctgtgtcctgagagggcctagaagcaatagtaccctagtagcaacaagcacacccaatgctaagaccttggattctaatatcattctccaataaaaggaactagagctacttggagaaataactgattctaggaccaaggcaggggaaatacaagatgggcctggagaatctcatagcaccagaaagtaaggaattgaggaaaaaaaaaaaaaaaaagatgaaggcatggcaaaggaatagaggagtcatcctgaaagattgccaaatttggaaaaattgcctcaataaaatatagatactcctcaccttctgatggggctatgacttaataaacccatcataagttagaaatattgtaagttgaaaaggcatttagtaccccaacaaacccatcataaagtc

SEQ ID NO: 183006 - DNA, 554 bp, Homo sapiens
  misc_feature (498)..(498): n is a, c, g, or t
  misc_feature (542)..(542): n is a, c, g, or t
  misc_feature (550)..(550): n is a, c, g, or t
agcctggcacatctacagaaagaactctgaggagaggggcctctcggcccatagttaaattgtccttattgtctgacccctggtccttatctggagaccgagccccagatgccatgtgcactcactcccctgtcagcctaaggggcacatctggctgccacacatctcactccataaagccattcaggaattgggaaacccgctgtctgcaaaggcaacataaatcagcaaggctgtttctgagttgcacaacatgacaccacagcagctggaacaaagctgcaggccccacatgccagcttaggccctgcctctgtgtgcttcccattccagtgggaatgattttcccatcctagcccaatagggtgaggctgagctatgccgacactgggaagagagctagtgtcattaagtggaattgagtttcggatctagggaaagttacaagaaatgtgccctccacattctcaaaccttcactcaacacttccttccccanagccagaagatgcacaaggaggaacatgaggtggctgtgctggnggcacccnccag

SEQ ID NO: 183007 - DNA, 446 bp, Homo sapiens
acgtgcttatagcagctttattcctaatcgccaaaaactgtaaacaaaccaagtatccttcattgaatgatgtaaatcaaattggtacatcaatacgatgaaatactactcgctgttaaaagcaacggcatagatgaatctcaaagacattatgccaagtaaaggaaggcagcctccaggttatatcatgtatgatcctatctatgtgacattctggaaagggcagcagggacagagaacagatgagtgtttggaagaggaggggtggggtaacaaaggggaagcatgaggggatttttaggtgatagaactgccctgtgtcctgattgtggtggtagatacattaatctttacaaatgttacaactcagagctgtacatccaaaaagttacgatgcaaaaaagttttatttaaatcctcacatttatgatgtttagaattctaaa

SEQ ID NO: 183008 - DNA, 464 bp, Homo sapiens
gcactggaagagcactaacagggaaacctcacctttctaatgccagcaataacctgaaggataaaagctgagaactagaaattatccctgcaaaagcaagacaatttccaggacaaagcagccaggtgtccaggagaaaaaaaatcaaatacatgactaaactaaatatttgatcttttacactttggtaaattcagtttgtctcctttaaaaattataattagaccaggcacagtggttcacgcctgtaatcctaaaattttgagaggtcaagggcaggagtttgagatcagcctggccaacaaactgagatccagtctctacaaaacagaaaaacttagatgggcatggtggtgcacacctgtagtcccagctacttgggaagctgaggcaggaggatggcttgagctcaggagttcaaggctttagtgagccatgactgtaccactacactctagctgggc

SEQ ID NO: 183009 - DNA, 702 bp, Homo sapiens
aacataaaattgaaaggcaagagactaatccagtggtatgagattatttttaattgtcaaaaaggcaaaaaagcatcaacaacagcttaattagtgcatagtgtcttgtattaagatgacacagtatctaagtactttcggaagcaggtggctagtgatgttccccaaatattttataaagtttatacaagaacaatggcggtatacttttttcctctgaaatctggacctaggtgacaaatgttcttgtgaaaatattagtgagtcttggttatctggaaaaactgtggccacaagggtacaactgatagcaagaaaccacccttgaatatattctgtcaaacggaaatcctgaaactgaattaccaacggcacaagcccaaacaaggtcatctgtacatgtgctaaactgaaagtcatgtcattgacattacctagcaacagatcgttcgcaaagtggcaccttccgcaagactgctaggaagatgtggtcaaatagagtgtcaacacactgtctcccagagctatgaattggggaattgtccagaaggtctttgagaaggtgaaaatgatgaatgtatgtaatcatccccatttaaataatttaggaaccaaagcccagaaagcataagtaaattgttcatcgtcccaaagctaggaagtggaatggtttggacttgaactctagctggcttggctcaa

SEQ ID NO: 183010 - DNA, 371 bp, Homo sapiens
ctaccactagtttttgggggcaagaattctttggtaggaagaaacattgcagtgatagagttgaagtgttatttaagctgtctaatggaatggatcagccctgtaatctggaggaaagactgatggggatctcggtgttctgttctctctacgtccagctctgctaatgtattctaccactactaactactacttgatcaggtcaggtgacctctaaaaatagagggtggagtcaaccattgtgtcctggatttcagacattccgatatcatgagatgcttgctgcgtggtatactactatattaatgtttgtgtattatttttcttcagtcatgtttattatatctataaacagaagtgttttcccagta

SEQ ID NO: 183011 - DNA, 456 bp, Homo sapiens
gaggtatcccccgattgtcgaacgagctctgcaggtggttctgagggcagcctggtgagggaagggttctagagggcattggggcattctagagaaaggtctgagctgaagctaattttgagtttgtccctgtatggatgattttttaaaccatgggagggggccagtcatcaaactttgtggaagttctgtctgtgtaggttctatggtttgctttttgtcctctgtaagtattaaacagtaatctctcagagcattgtcatttggctgaagtttttcacatgtatttcctgttcaaatctagaatgtgggatggctctaatccttatgcccctgtgctagatttctccttttttgttgctgtttcttttagaaggcagaggaatatatgggattttattgtgggctgtacctgtcttcaatgacaatctcttggagagcatgagctctgtagtt

SEQ ID NO: 183012 - DNA, 300 bp, Homo sapiens
cgcaacttggggccactctggtgagcctgtatatcttcctgacacgtttgcacctggtggtaatctacctgtgccaaaccatttctgcccttatggtggtgtggtatctcatttttttcaaatacttttcagagtcctaacagctctcagatctcagaatgatgacctcaattggagcctgcttcctggagaaattggccaaggtagagattacgagaaccagagtcattccaggacagattaaaccttagcattgttgaaagcaactaccattacatgacagcttgccaagatgggttg

SEQ ID NO: 183013 - DNA, 421 bp, Homo sapiens
ccattcaatttccgcataacttttgtcttctaccacaccaaagattcccaggaatgagtttcaagggaagcagggttatatggtagaaagcattccacaagcatggaattattaaccatgaagccttggatgagttacttaagccaacagttgtttaccacctaactcacagcatagttataaatggtgagaccattaatataaagcatttatcatacagttcattcaacaaataaagttctcttcctttctactgcccaatgcaatccatccactcatcccactatttgatgaatatgtaccaagtagctgttatgtgctagggcagcgagatgtgtgaggtcaacaagacagaaatgtctgtctccaggactttacctttgtgtcctatacccaggccggggatgagatcctctagatg

SEQ ID NO: 183014 - DNA, 317 bp, Homo sapiens
gccggaccgagcatcaatactgggcagtatctttccctcttaacctttcacacgtttttaaagtgtcaaaattgatgaatggtcgacggattcattcaacaaataaagttctcttcctttctactgcccaatgcaatccatccactcatcccactatttgatgaatatgtaccaagtagctgttatgtgctagggcagcgagatgtgtgaggtcaacaagacagaaatgtctgtctccaggactttacctttgtgtcctataccctgggttccactgtttttcacattgcttcctctcagaatttgtccctgcactt

SEQ ID NO: 183015 - DNA, 299 bp, Homo sapiens
tccctcccaggttcccacaggggcttggaagtcaggggagccgggaggggcggcgggggccggggcaagaagccggacggcttttattttgcgccataaagggctgcacagtgtctgctggaatctcagcagttaaagagacccctctgcacaaaggggcgctccggccgtaatcgggaaataaatttgattttctgaattctttggcagctggtgacaaagggccaggtagcgccgcggcgggggtgatccttgcagaaggcggcgcgcggcggggcgtgcgcgccggagggacaaag

SEQ ID NO: 183016 - DNA, 226 bp, Homo sapiens
agcggaccggatgggacattcatatataattttgatgagatcaatatcaaatatttatattactatgactattgtaacactagtcacagctgagccatatagtatactgtgattatttttccttttctgcacaaccttttattttccctggagttcatgattgtcttcctttttcatttgcttcattttctatattcttattgctaatttagtccaagttatataa

SEQ ID NO: 183017 - DNA, 455 bp, Homo sapiens
cagcatggtatagtgcaaaaaagacacttagagtcagaagcttcaggttccacgttggccagtgccactatcgagttgcattgtgtggatgagtcggttttctgtgtgtctcagtttttttccacctgcaaaatgactgtgtgggattatgtctattattgccattaaacatgcggtgaccgatttctagtagaggcttgacgttagagacttgacatatgctgaatgtctaccctatgcatctactctgctgagctcttcattatatattagctctgtgaatcatcacaaactagagacagtcattatagtcttgtactgccactgcactgtacagctttggaaaaattcatttaaattttctgagtctcagtttctttaccattgcgaaaaagggaaggaactagaccatctttcagtgtccttctagctgtaacaattttataagtctaggc

SEQ ID NO: 183018 - DNA, 506 bp, Homo sapiens
ccagacttaaactagtgggatcttggcatttatctttttaaaaacctggtgctcattaaggaaaggaaaatattctgaaataatcgaaataaccttttgggcattggaactccattttaaattaaaaacatttgtgcctactattatcttatgctaaattatacccaggtattgtaagtaaaattattttgaagttactttgttctaagaaactatggagattcttgacagtgttagacaaagtccttaaatgacattatataaaaattgagaattagtaccttatgacttaaccattttacactgagatattattggacattgagtgtacatggaaatcacgtgatcaaagtatttgagaagtaaatatctaaaggaagagaccaatttaaaacattctaatgagcatcatctcataatttggtaatctcatgtaaaatgcttataataggggtgtgtgtatgttatatatatttttaaaataaatttgtaatcatgtatacagt

SEQ ID NO: 183019 - DNA, 146 bp, Homo sapiens
cgacagagcgagactccatctcaaaaaaaaaaacaacaacaatatgaattcaaaattctgaaggtctctttcctgctgtagcaggtgaccttgcccatgctgccatggtagtggcatcctcttcagcctgggacccaggcttcaga

SEQ ID NO: 183020 - DNA, 224 bp, Homo sapiens
ttaaaaggctccaccctaaagccaataattcagtcaagaaatttacacctttaaggaagcctccatgtctcagaatgtctgtttttcctggcagtttgactgaacttttacttacaccgtttttcctttgtttaaataaaatatgaattccctattttgtttcacctaagaattatctctttaaaaatgcaaatttggaacagcttggctgacaattgtttagg

SEQ ID NO: 183021 - DNA, 194 bp, Homo sapiens
acgttgacagagttgtgcaaccatcaacactatcattttaagaatattttcatcacccaaaaagaaaccctggtactcattagcagtcattccctatttcctcccaatccttcccaccccagtctttggcagccactactctgctatatctgtggatttgcctaatctgggtattttgcacaaatgaaaccata

SEQ ID NO: 183022 - DNA, 347 bp, Homo sapiens
ctctggataagcccaggctagttaaaatttgaaatgacctaaaaatccagctaaaaattgaggtagggtactttttgtactatttatttgaaatttcttcccttgttccctctaagccatatctatacaaagctggaattaatgttcatgtacaaaggtgcatgatctgaagtcataggatgggattataggtaaacagctgttgcttacaagcttacagttttgcttaagctatttggaagtggtacaaaaagcagttaattagttgccctttgtcatattccaaacaccaagctctagtggagtttgccttgacatttaatgaaacatttgcttatgagaatatg

SEQ ID NO: 183023 - DNA, 276 bp, Homo sapiens
tgtgctctgcggtacagtggagctgggggcatcctcaggtcctgctgatgacaggggccccgtttttatctgctcggctgtgccctcttccctctgactagcaaggcagctgttgcacgcagcacagttgtctgtatggaaggcgcacggaagacagccaggatgccgggaggcagagaggaggccaggtggcagtgaagaggccaagaggcagtgaggatgccggaggacagtgaggatgctaggagccagtgtggaggccaggaggcagggtgg

SEQ ID NO: 183024 - DNA, 713 bp, Homo sapiens
tgtctgctgttcacgaggatccccgattgtgaaataggtaggtgagtgagcccattgtgtcgattgtgaaataggtaggtcataataaggcacacctcatgagtacactgggcatgcaaagctcttagaagagtgtcaacatagaggaaatattacctgttgttattatgataacttagtcattctcaattcatttctcatctttacagaatcctaagtaactcctctaattattgctttatgtacttaggcctgatattcaaaatatctaacacctgatttattacctgcagtgataaacaaacagagtgccactagctatggttttgaggtccctgtggattctacatgaatttagaacaaaaattctgactttcagagttggcaaatcaggtaaatagcagccctatagaaataggtagtaagggtacttctttttgcctagttaacctagttcttcgaaagcagggaaatttagcagaagtggacatttaaggacaataacaaatttcctgtacatcagcgtgtgtgtgtgtgtgtgtgggcgcgcgtgagtgcatatgtgtgtgtgggggggcgcgcgcgtgcgtgtgtgtgtgcgcgcgtgagtgtgtctgggcatgcgtgtgtgtgcgcgcgcgtgcgtgcatgtgtgtgtgttggggtatgggtgctgcttttctctacctgcctcttccgcctaccttctttct

SEQ ID NO: 183025 - DNA, 521 bp, Homo sapiens
tcatcgagctcggtaccgattagctcctaacgtctgtgctgctagcacgtgatttccagataaggctgtgatcaggaatagagcaaagtcttgaatcttggtcacctcagcaccattctctaggtagttgtgactgatggtgataactggctgtaggttttgttaccagtaaataaggcagctaagctgtcatctgcacaatgcaaactgaaatcatcctgcagttttttaagtggatagtaggacattccctccattgcaagatgatttgctaggagagttttaaatagtgctgaagacacacgagaacaaagccttccctttttgagctcaggtccaaaaaagcagttttggcattaaagagaaaaggtttatgctcaagaacttcttgctttttcttctccctcttacttcttggactaagtgtcggtgataagatacaaaaccgttggtgtctgaagtacctctgaatccagcagccttctaaagaaatgttatcagaattatattgtgtaatataa

SEQ ID NO: 183026 - DNA, 310 bp, Homo sapiens
ggaagttctgatttttgctaaggggttattccgagttgcgaagtggtgtggtgttgggggaagaataccaccaactccaggccagctgctgcatctcctggaatctctgttttctcttctgtaagatgggagtcagggtggcctccatctgatcacactgaattgttgagtgactcaaaggagataatgtaccaaacactttgtaagccctatgacaccgttcaaagtctatttcctcccagctctgttttctaaaatcaggctgtatgttcgaatcacctgaggaacttaagactattaccagcgccac

SEQ ID NO: 183027 - DNA, 491 bp, Homo sapiens
tcactgaccacagcactcaagcctgcgaggagtggctggtggctgctctcctccgcttccatgggattgggtggccaacgtgggcagggcgccatcagggcatccccacctcctatccactgtgcttctgtcctggccctaggccaaggggtggggctgggctgcggccacaggctgcccttatcaatggtaaatgggacacctgggtaccctgagtgtaaacaggaccagtcaccccagccttcctggctctgcccaggacacctgctccttcttgccctgctctcagctagaattgcagggagtccctggaaagtgccacacatgctcttatctccaagctgtggtatgtgccatttcctctgtctacccctgcccaacccttactttttcttctggtcagcttaggtacccttcctccaggaagccttccctgtcccctccttccccctgccagaagagttaaggacccctgagctctcccaaacccc

SEQ ID NO: 183028 - DNA, 178 bp, Homo sapiens
acgaatgacatatggctccaccacgagatggcagtgtctacacacgtaagcaaatacttcccagtccaagaagtttcaaccattatagcatctgccacggaaagcaaaggaaaaaataaagaaaccaggatgtgaaattaagtcagcgcttctccctcccactctgtctctcctctga

SEQ ID NO: 183029 - DNA, 273 bp, Homo sapiens
gttacttgaagctgtgactcaactggtccttcactgccaaatatacctggggttggatcattggcctgatgtttgcaaattgaggaaccttagggcaaatcagtgaacttctgaactgctttcctcttcagttatatggggatttccccacttttgagatacttgtaaggattatatgagatgaagagatgagacaaggtatataaaagtcctagcacagagcgtgtcatataatatggcttcacaagtaccctcatctcctttccagtcctg

SEQ ID NO: 183030 - DNA, 463 bp, Homo sapiens
tgcgcacactatccatcagcactgaatacttatgtatttcttacaaacaaggacattctcctacaatatcacagtatagctattaagaacagaaaattaacactgctatattactaccatctagttttcaaatgccattcaagttttggcagttgtcaatgtttttggagatcacagcgtagttgttttggattttatttttcattactaaattcagattatgttttggggggcaggaattttatagaaattatctttgcagtgcatattatcaataacacataatcaggctttcccaatgtaaaggttttctttccccctttacaattagtaattattttgtggaataaattgtgacactatatgtaatattccattccccatcagattttcagtttatatcagtatgtgtttaaggattcctgtgggctataatttattattcatgatttattgtgatgct

SEQ ID NO: 183031 - DNA, 240 bp, Homo sapiens
ttaccattacggggaagttttgttttggaggaggtgcagaaatggggaggttactatgttctttggtagagaggagataatagctggtaaagaaccaggctgaagaatcaaacagctgtggtttatggtctgaacccttgcaccagaccactcgatctaccttaaatcctaaatggaaaacaggtaaggggatacttaaccccgccacacaatatcaacttgacatagcaacctctgcct

SEQ ID NO: 183032 - DNA, 446 bp, Homo sapiens
aaatcactttcatgtctggtttaatggtagaccagctgaattcttgttttctttttttaataagctttcttaggctgaatgattttttttttaaattctatcaaatggattcagacagaagaatgaattcttacatgtgcttctgcatttaatctgttacatgttattttgaagtctgtggaaaaaacctggtcttagaccaggaaaaaagaagagtattttaacactctttcctaaatattgggctttttttttaattacaccaaaattcaatgagtgatagtttttaaaacttaggtgaaatttctaatctaaaaccaaatgaatcaactttccatgtgctgttacagtaaaatcaactggtctatactgcattttaaatatatctttcacctgtccatgattttgtaacatcattcattggtcacctggaaaatactggtgca

SEQ ID NO: 183033 - DNA, 556 bp, Homo sapiens
ctcctgcaggatggagttctgcaactgtgaggcggggccttttctggaactgtctgcgttcgggtaatctccccccagaatgcattgcttctgatggggcgccgccttggctctgcaggtgtcagaaccctgagaaacgagatggtcttcttttcctgtcccctttcccatccatggtagtgatggcggtgatagcaataatgataggaattattactgacttacctattttgatatctgtcatctcagttcttccagcaaccaacctgtgaagctggcaaggccatgccttgcatgtagtagttgctcaagaaataccaggactgtgtggcacccccatgcagtcctgagcagaaacaaggttggataggattctaggaggacagcaggaggccgagccaggcagcccaggttttcacattgggtcaccatcagcagcatggccttccgcaaatcgcccacatctgtgaaacggactggaggtgcgagcgccgaatgtcagtgcgctaaggcctgggaagggctactggccacccctacatgggggtccaggcct

SEQ ID NO: 183034 - DNA, 436 bp, Homo sapiens
tggtcaagatcacacagtttaggctgggaatagtggctcaagcttataatcccagcacttcagaaggccaagggggttcatattgtacaaggttgattgctcattacaaattctcatcaacagaattcaagtaatataaattcttacatttaattcaacatgctgccgctatttggtgtcataaaaacacagacgataggagacatgcctgaaatgctttgcaaatataaaacaatttgcaaaataaaaaagcaatttcacatctcatttcatctttccatttgccccatgactcatggcccttttttaaaaatgagaaagctgaagctcagaaaagctgaatgcattgtctgatacctataaccaaacatggaaacacaagccaccatctgtggattctggtctcagtgacaacagcacctcaaacatagaaagt

SEQ ID NO: 183035 - DNA, 753 bp, Homo sapiens
tggcgcccattttacagatgtggaaaagcaagcacagaccagttaaggagcttgggcagagtgactgggagacagttcagctccgtatcagaaagggctttctaagcgtgcgtgctgtcacatgtaagcggctccctgtgggtggtgggcccccttccccaccaccaccctgacatcacaggtgtgagcagccaccgcacacactgggcatcacatgggccggggagcctggctctacagcacagtcctttggccatgaagagggggtggtagtgaagatacagagtccttggcttgataggaggtggggctgacagcctcccatcttccagcctgccccaagaccacgtgacctttcctgacctggtgcttctgtaagtcccacctcccgggtgcccctgggcgaccttggcccataaatctctttgatccccatctcatcttcaaatgaaggtttacagctcagcttttaaaaaaaataaaaataactagtaggttctggctgggcacggtggctcacgcctataatcccagcactttgggaggccaaggcaggtggatcacctgaggtcaggagtttgagaccagcctggccaacatggtaaaatcccatctctactaaaaatacaaaaaagtagccaggcgttgtggtgcatgcctgtagtcccagctactcaggaggctgaggcaggagaatcacttgcaccctggaggcggaggttgcagtgagtggagattgtgccactatactcc

SEQ ID NO: 183036 - DNA, 216 bp, Homo sapiens
ctctaatcctctactctgactcccgtgcagccaggatcctagacgtgaaccgagttccctcaaacagacacactcatgctactggcagggcaggggatggaggccgatttgagctgctgagggtgttggcactggcaggcacagctgcatcctgaagaaacacttctggcagaggctgctatgtcttgagcccaggcctctcctccctagaaaggg

SEQ ID NO: 183037 - DNA, 327 bp, Homo sapiens
aaaagctgggggggcagaggtgggataggtaggggtggagtgaggaggaaacaagctcgagagacttaggagagcaacattctgggactttgttccatggtggtgtggctaaaaggaaggtggctggtcttacacctgaaggaatagagatgggcaggagagggctcctggatggtgaagagtgtgagtgggtgtagatgtgtatataactgaggcgtctaggacttggggagaggagaaccccctcccctttccattacttcttgaccaagcttgcatgccaagcttgcatgccctgaccaagcttgcatgcctgaccaagttgca

SEQ ID NO: 183038 - DNA, 320 bp, Homo sapiens
ggtccaattaaaaatatactttgaaggctgaacaaaaagagtatgctgatggattagatgtaggatgtaacaggcatctagctggctcttttggaatcaagcaatagcaggaatggtgatgctattgactgaaatagagaacacagaaaaaaaagcaggattgagcatgtgaattcaagggttccattttgaacatggtaaacttagcagcccattgttatctgagtggaaatgcagctggatatgtgagtctagactttctggaagaggtcaggtctagaaatgtgatttgagagtcagcagtgtattggtccttttaa

SEQ ID NO: 183039 - DNA, 372 bp, Homo sapiens
tgaccttctaataaatttctcttttacttaagatagcaagccatgtttcagttgcaaacaaaagccctgataaaaacactgcaaccacaggaaatgaatgtgcaagtgccacaggaggctgggaggctgggatggaagagaaacgaatccaccaggccttcagtaaataaatttaaaatacttgcccctttaggaatggattgccagtattccctgcctatgaaaacaatggtggactttcacaattttttttcttacaatctaagaggatgtcaatggcccacttctgtgcctctgaaatcccatgtttgttttaccagagccaaagagaatgactcactaatgaggaccagatttgccttgtctgaaatg

SEQ ID NO: 183040 - DNA, 476 bp, Homo sapiens
ttggactaaagctgttacttggaggacactcaaggtgcaaatttaccaacacgtcagattttctgtaaacagatgcaggcactaggcaaacgttttttaagccagaaagctatatcaagagagacacagtccttaaaggaactgcaaagaaagcatttgtcataattccccactcagtatcctgaatgcataatttctaccgtgactcagcgcgtctttggggactgagaaactaacagtccctttcgtgcatacaagaaatactgagaggcattgagacggggcccttcgagtttgcagtctgccactgcctctttccagctgtgtgacctttggccaggttagctgacctctctgaaccccatttgtaaatggggatactggtacgtccttttgcaggatgggtgggaggactggagagaagagctcacccagcaccatgctcagcacattcagcacatagtaggtctacctga

SEQ ID NO: 183041 - DNA, 602 bp, Homo sapiens
tccaataacagaggagtggcccacctgctgttgcattctctggcatacagcttctggaagctgttggttcactggagcagaaggtctttggcaagtgattgtttttatttcccacaagttgctgggaaagtatttacttacttcctgaaacactgaaccacttcatcaggaaaaagagatgtgaactgactcctcagtgattacagtttggtcctgtttcttgtttatgtagcagaagtttctctgtttttgacatgaggatggaacctatttttcagaaatgatgcagatatccccatatttgtaatattttaaaatcattggtttttttttttgttgggtagggggagattgtgggtaagtttggagattggtgttcatgtggctatcttagaagaaacttccttttgttttgatggtgaattgtaggagtggcaggtgcttggaagtttaaaaaatttaacaaaattttgacataatttcagacttacaacacttccatctttccttgtctttattgactgtgacatttttactgagcacaggccagctattttacagaatgtacttcaatttagatttgttttctggtgtttcctcac

SEQ ID NO: 183042 - DNA, 538 bp, Homo sapiens
gtcattaatcaggtagaaaacagttagcttatctaaggtgctgccaattctagaatttaaatattcagatcaatggttttggcttttatataggcctatgtaataatacaggatatgttataagcactcataaaaagcaaagaagtaattctccacatcaaagcaatttagcttatttcctgacacttgattgaaattagggtattgatcaatctacagcaaatggcagggttcaattgagagaagtacagtataggcagtaattagggatgattatgaaatagaatagaataacactggaagagttagatatagaaccattagtggcactgataaacctgcattatgaatcttgtcacttcttccatgggggttattttaaaatgaaaagttgccacaattaaaaaatagtttcaatgatatactggaaaaataggcctgtgtttgcccaagttataacatattataaaaaattacagttggcccattgtttggtgagcgattctgaaactgctcttatatttcaaaaaaataaaac

SEQ ID NO: 183043 - DNA, 368 bp, Homo sapiens
agaggacccgctgatccgttagcaaacagaagagtctgtcccacagaaactctggagctccgggtcttctcttctctgtagaagtcctttggtattgcatcttcgttggggaatggcagcaattatgagtacctgaccaatattttgtatcggagaagctttgagcaccagttaaatctcattccttccctttttttttcaaaatgggcacatctcttttcagctgctttattttatgtattattcaacttatgcattattatgtatgcattattcaagttattatatatttatgcattattcaactttattattattcaacttattttcaacttaatctttttatgtagtattcttcctgcttaagc

SEQ ID NO: 183044 - DNA, 341 bp, Homo sapiens
tttggaaagttttttcttctaaaatcaattcatttataaattattactttctaaatcaaatttaaattgttctgtctgattttaagccatcactggcctctacttgtttctcttcaactaccagcaactcctgcctccctcccaccagtagaaacatcagctaatcctttgcctatcattttgcatctcttttcagctgctttattttatgtattattcaacttatgcattattatgtatgcattattcaagttattatatatttatgcattattcaactttattattattcaacttattttcaacttaatctttttatgtagtattcttcctgcttaagc

SEQ ID NO: 183045 - DNA, 688 bp, Homo sapiens
atttcttaacttaggtcccctaggaagtagaacctgaggcaaagatgaaagtattgttactttattagggagggacagatctaggggggtgagagtgtggaagaaaagggaaagcaaagcaaggaaaaacgtgatgcattgtgttactgcagtgaccaggcttcatgacaagctgtgacgagatacaggagccttccagcaagtgtgttcacttagagtgtggggcttctccagaaggtttataaggagaaactgcccctctgagcagtccattgaagggaggaaggagaagtaacttagtttcctaagttcttccatttcccgttgatcctagtttgcccacagggctgtgtcatctcgtcctttggtaactgctcaggaagccagatctcgtgctcagtggtgtggcattgcatctacttctagaaggatttctcaatactttataacttcctcatgtttctggtcatgtttgtgttcagctatatctctagaacggttggccaattcatagcatgaaatgatttcatgagtggtgacaaagaaagggtgcaatcagcccttggggagtgggttagtggaatcccagtcctgaggccattagtgggtggcagagtttaggagaaaaggtaagaagtttcagtccttgggccctgtagtaaggagaaaaagggtacaggaggttgtc

SEQ ID NO: 183046 - DNA, 290 bp, Homo sapiens
gaacaatttaaagactctgacctgtgacctgttgttccacatataattacttagtaaaaggctgggcacagtagcttatgcctataataccagtacgttgggaggccaaggcagaaggatcacttgtggtcaggagttcgagaccagcatgggtaacatagtgagatcgtgtctccacaaaaaatttaaaaattagctgggtgtaatggtgcacatctgtggtcccagctactcaggggactgaggctgccgtgggctgtgattgtgccactgcattccagcctgggtga

SEQ ID NO: 183047 - DNA, 431 bp, Homo sapiens
acaagtaacagcataaactattacagcataaactattacagcataaactattacagcataaactattacagcataaactattacagcataaactattacagcataaactattacagcataaactattacagcataaactattacagcataaactattacagcataaactatggaaaccttctggacttccaacagcataaactattggtagagtgacttctattcactaaaaccatgtgtctgaactgaagaagcttgggctcacttccacaaatgtaagtgctgattttttaaaaataatattcctttcactattgatatgtgctacacactaggaagttgtataatttccagaaaaatgtaacaaaccagctgcttaacaaatcaagccctgcttaaataaagggaaggtaactggtattctgtgggct

SEQ ID NO: 183048 - DNA, 479 bp, Homo sapiens
cagctggggtgcctgtcaaagaggaccttcagaagcctagcaaagggtgcctgcattttttctcagaaggtgagtccaaggttttattaataggctgggcaacttctggcctgattttactggatgcacataacttttaagatcttttaggacagtttctacaagaaaatggtctcctcggtccactgtcttcgcaactcatgagatgtctgctcaaaatgcagattcttaaattctgtcctaatcacattaaattaggaattctggagatggttcccaatatttgatgtttttacaagcgtaccaggtgagacatgttcctgtatcccaaaagcttgagaagcattcagtgagccattcatcccacaacccgtgaccctgaagttgtaacaaagctaaattctcaaagtataccaagatatcaggactatcagctcccatttctacagagttttatggcacacaaaaggggctctctc

SEQ ID NO: 183049 - DNA, 1467 bp, Homo sapiens
  misc_feature (377)..(377): n is a, c, g, or t
caaagtgggcagcccacgaaagagagtcagaggagagtgcaaggtccccacccaccatgggctcacctgggcccagaggaatccgttatttctaggtcaggcgcaaacagttccttggtttggagcaggagcccgggtctggacgatgggtgaggggaggtgattttggagcagggtctctgggcagggaggggccaggtttgctcagggcagaggcagcagtttagcctctgctggtggcagctctccccactccctgcaaggctgcggtgatcccctgtgaaaatgcattgtccccctcctccagggctccaaggtgctgtccccaagcagtcatcaccccagacctgggtctctgagtctcagtgtgggtgggnctgactctgccacccagggctccagctttgtgtcagacccacgggagtttcactcctgactccaccctggtactcctccacctttctaacctcggttttcctcatctggaaaatggggacagggacacctacagcagggggttccatggtgtgctctttccccttggctggtcacaagtaactccggtgactgcagggccaaggtgcaggaagcaacaaagctgagtccagcccgtccttcagtcccacatgcagcgctgggacctctgggaagtcactgagacagagccgcatggaggagcggggagatatctggctggccttgggagggttggccttggtaacctgtggggaggcgaattccaggcccctctgggtttcctcgtgggtccattctctcccccgagctctggcttgagcacctggctagagcccctctccagggagagctagggacccatgtccagcccaggaggaatggggggcacggggcatacattcttctttttctgcctcattctctgttcccctagaccgggagacaaaggactggatttgaatcctgtctttgcctttcaccagatataaggcattgggcaaggtattgaatctctccaagcctcagttttctcatctgtaaaatgggagtggctgggtgcagtggctcacacctgtaatcccagcactttgggaggtcgaggcggatggaccacctgaggtcgggagttcgagaccagcctggccaacgtggtgaaaccccgtctctactaaaaatacaaaaaattagccgagcgtcgtggcaggcacctgtaatcttagctactcgggaggctgaggcagaagaatcacttgaacctgggaagaggaggttttggtgagctgggatcgtgccactgcactccaaccttggtgacagagcaaaattccatctcaaaaaaaaacaaaactggtgtggtagtgtgcacttgtagtcccagctactcgggaggctgaggcaggaggatcacttgaacccaggaggttgaggctgcagtgagccaaagtcatgccactccacttcaacctgagtgacagagagagaccctgtctc

SEQ ID NO: 183050 - DNA, 582 bp, Homo sapiens
agaatcgggtgcttctctggatggatggtaacatgtgggattatcataatcccagaatttaagacattggagtaagaaaccagtaaatcaggatttctcaaccttcgcactattggccagtgtggactattgatttgggggccaaataagtctttcttgtcgggggctgccccaggcattgtagggtgtttgtcagcatcactggactctacccagtaggtagcagcagccacccttttcccaactgtgatgcacaaaaaagtctctggacattgctaaatgtcccctgggacacgaaatcactcctattgagaaacattcttaaattaagctaacatttatgaggaggggaaacagaaaatctgcactgaaaccctatcccttgtccatcagaaagtgttgttcaacgggaccttcaagaaacaccccagatcctcccacttttcacgttctcatcaacctccctgggtcccagcactgtcatctctcacctggacccctgcatccagcctctcgctaatttctgccttgtcccttggtccctatcctgaatagaatctccacaagcagccagagggatct

SEQ ID NO: 183051 - DNA, 162 bp, Homo sapiens
gcctcatccccagccaccagcacctacgccgcctgtagttcctgattcttcatcagggctatcttaatactgaccttcttgacctaatctaagcctgacatctgtggtaaaattctagagccttctctttttctacccgcaaaagctttttttggccccagc

SEQ ID NO: 183052 - DNA, 798 bp, Homo sapiens
agctcggtaccgattaagctcctagacggagtgtcactcattatttattttggagacggagtgtcactcactctgtcgcccaggctggagtgcagtggcacgatctcagctcactgcagcttccgcctcccaggttcaagcaattctcctgcctcggcctcctgagtagctgggattacaggcgtgagccaccatgcccggctaattttttgtaatttttgtatttttagtagagatggggtttcaccatgttggccaggctggtcttgaactcctgacctcaagtggtccgacctcggcctcccaaagtactgggattacatgtgtgagccactgcacctggccggtgttttgattgaagtttgcatttaccatgctgtaggagtatctttcttgatcagtgtttctcttccttggttatacatgaggagcttataaaagatctgaatatcctgaccctatcttcagagggtctgatttaactggcctgtgatagagcctcggtaccttttctaggaggtaaattcttaatatattgccaaggttgagaatcactgctctagacaacatgacagctatttggatgacaccgtgtaatggttagtatttccttgaagtattgtatcttactgtgtatacagctctaattgcatgtcttaataaggtcttgctgagcatgtagtttgtatgcatacaactgaggtatatatttaccttttcagtaagagtttgctgcctcttttgccactatttttcagaagagttagactggttaattgtgaataaaatagggccaat

SEQ ID NO: 183053 - DNA, 621 bp, Homo sapiens
ggcttaagcctacactcctgacctctctgatcatcctgagagccatcttgaagcccacagcctactcggaggcttataggaggtaccatgcttcttattctgggtcctgtccaggccaagcagtctcccagctcccaacagcctggggaagctctacacagagcatcctgagaccaagtacaggtctctcaatgtctgaccaggtacctgtagctcaatcaatgtcttttcaattacataagcagtaaggtcttaataaagtgttctagggtgtacagtggttcctacaaccacacacacacaaaagtgctactcatttccttagcacctgtctccaaatgccctatttcctatggcctaaacaatagaaagactggtcagtagtcaattggctgaagtcatatatccttcacaccacttttctgcctcatggatagcaaaaatgagagtctcttaactcagctaattccacagttcattcaaactcaagataaaactcttctctgaaaatacaaatgaggctcacattatgaacacctagatgtgttagatgtcctccttcagaaaagctgttatgaaaataaacataatagctagagtaataaataaaatttgctaaga

SEQ ID NO: 183054 - DNA, 850 bp, Homo sapiens
cttaggtgtgattggtgggagaggacagcagcggatgttaaggacagatgccaacctgatcctggagtgaggtgggccatgagaatcctagactatgcaaattagagggatgcttagccctccctggttcagcctctcttgggttacagatgggaaactgaggcccagagtggcagccactctctcaaggtcccagactctgggctgcccatcaaaaggtgatgggtaatgatgaattgctggggatgcagggtaaccccaaaggcagggagggccagactgcccacatacacacaagcacaagcacaaccatgatacgggtcaccctccccaccagcacacaggccgagatggtgtacgcatcatccctcctgccaacacagcaagagtgcttttccttctttctgctgctaagcaccctcaggaacgaggcctcgagggtgacgggaggtgggagaagcccaaggctgacccaggcccactctgttgggttcatccatcctccaaatccatctttggaggctgaattcacacacaaagccgttgtgagatgggagctctgaagatgcggacccagacccagaaacagactgtttctccagggccaactttgtgccaggaattttcaccccatgtcgtttcacttacactctcctctggtcacgacgtccctgcaagagaggtattatcaacccatcttacagacgaggaaactgaggcccagagatgtagcatgagggtcacccttggcaagttattctcctccccagtatcccagaatggcccatctggctgctgccttctagaggaaaagtcctagctggggtcctttacactccaggagactccc

SEQ ID NO: 183055 - DNA, 470 bp, Homo sapiens
ctaggcacaaatgccttatcaggatatctttaaattcaagtttccctttggaaacttgatgggacagtgtgtcctcagccacactgcttttttttaagtcttgagttttagagctctcttgggataacccaagatacacacaacagccataccttttggaaggtttggtgaatatcagccccttggtcatctccttccagaggacacactgatgtatggaaatggagcttctcaggagagcagctgaatgtcctgaggctgagagaaatatcctggtttacccttcccataaaaagaacctttggggatcttaagattttctttccccagccccagttcttcctggtcagccaattggatggttgtatttaggggaaaagacaaaaataatgcctgtcttctgaattatctcatatttgtgaaggggggagaactgttttaaaagacaaaaaaaacaaacaaacaacaac

SEQ ID NO: 183056 - DNA, 204 bp, Homo sapiens
tttttttatagattataaagcttccttttagagtttcaaataagtgggagcaaatataaggatgcataagcctgcagaggattaaagaagaaataggatatctttgaaattagtttgaatgccagagtttaaaattttaaagaatagctcagatgtaccagttaagtaacaaaacaagcattttaaacctaccatgtgaatgat

SEQ ID NO: 183057 - DNA, 300 bp, Homo sapiens
tcttaaaaggagatacagataattcattcaagaatgaaatttcatttcgtttgtgtattattcacagtctgctgtatattatttctttgcatgaactgtgaatcaaaaagacaatcttctcacaacatgggttgtgttatctcaactaattcttttattgtccttgtaaagcctctgagtaaagtactctgtcaattattggggaagttattatactacattatatacagtggttacaaatgtaagctcagaatttagacacatctgcttttaaattccagctcagtcatttaatggctg

SEQ ID NO: 183058 - DNA, 219 bp, Homo sapiens
tttcctcacggtggcagtagtgcttcagattttcaaggacgccctgtcttggagcagtcttctcccgcccttcctgtctgaaaaaacgccacccagagacaaatgcgccaggagacatggctgccttgcattttgcacagtttggggcaacctgtgcaaattcctgtacttttgcttttcttttccatgtgaaatcaagtcaaagcctaaacgacccat

SEQ ID NO: 183059 - DNA, 211 bp, Homo sapiens
agatgctttgaacaacaatgcacctcaagatgcataggtttgttaggttcacggaaggtttatagaggcagcttctactgcaaacatgaagtagagggagtgctggttgcaggtttgccttaccagtgacctcagctaacccaacgtcataacagcatgatataggagcatctgaggattcaactgagtccggaaataaaatatgacatag

SEQ ID NO: 183060 - DNA, 228 bp, Homo sapiens
tgtgccccccgaattcatgtcctctccaaacctcagaatgtgaccttatttggaaagagggtctttgcagatgtaatcggttaagatgaggtcaaactgggttagggtggcccctaaatccagactggtgtccatacaagacagacacataggccgggcgtggtggctcatgcctgtaatcccagcactttgggaggccgaggcaggtggatcacctgaggtcaggag

SEQ ID NO: 183061 - DNA, 280 bp, Homo sapiens
acgtgaacaggtgggtcctagaaggagacataaaaaactaaatatcaaccaataagtgaatggataaactgagacatactaatacaatggaatattaaacaatgaaaatcaatgaatcagagttacatatataccaagacggatgaatctcacagttgagaggaaagatagcaacttgcagaagaatgtgcaacatacagtaaaactgtaatattaattacatatcatcttttttttttttttttttttgaggcagagtctcactctgttgcccaggctg

SEQ ID NO: 183062 - DNA, 378 bp, Homo sapiens
tccttcttaagggagaaggtattgaaatgaagcaggactctcaccattcatctgctttttaattaactcactctgctgccttaagtgattccctgctcacgctcattcttttgaaaattccaaagtgctacttctgacctgtgatttactattgctgtacgtctctataagcagtgttttagcttaagtggcagttgcatattaattacaaagttaattatgtgctgtgtaatcatgctgtaattcattagtttatactctgagagcctcatgctaatagcaagatctgacaggatttcgggaatcaacaagaaagacccgctggaaatcccaaatggggctaaaaaacactggaggccccaccaagccccttcctgc

SEQ ID NO: 183063 - DNA, 532 bp, Homo sapiens
aaaacaaggcagtgatgtttgaaactgattttgctagtgatttggccagtgaagaatttttttcaactgaaaaaacttaaaaattgaaatttttattgtaaaagctttgtaagttatattttagccctgttagaatctcaagtagtaacttcatttgccaggttatattttactgctctttcagaagtaacaatttactttcatggtatttggagatttactgaacttttatgatgataccctttgaacatccatagtctcttcaaatttactatagataaactcagtaaatcctaacggattttaaggtattatgccgggtattacaagtgcttacttgttcactcactgtttcttgatgtcatcctgggctgccttataaatgttgctatacagtggaacttataaagcccttgattgcctttcctgtcagaatctgatattttcagagaactcagcaaagaacctttcggttcaaatctgagtcacagccccaaaataaaataaataaataaataagtaatttttttta

SEQ ID NO: 183064 - DNA, 517 bp, Homo sapiens
tttttataatatgggatgcatgttttgagtatatactgaaaaaactctgcttaaaaccacggctacgattttacatgcatacagcttatgatacatctcatgaacagatgcaaaggtgtttatcattatctttgtgctacacagtttctaattttacatatgaaaaccaaggcatcattcagtataaagtacattatttgcatgatatatttgcatttgtaaaacacccacatttacttttactgcttaatgggccctgatttaaatgggccactctatataaatggagcacactggttctccactcaatggtgttgataagaaaactactccttttagatgcaaatgagcctactaatcacaattagaatggtggagttaagggaggcagagcagctgggccaagagctcccagtctagtagggccagtttggttctagcttcatctctgaagcagcaacttgggacttccccagaggacatctgcccaggggccccagggataaactcaacattt

SEQ ID NO: 183065 - DNA, 141 bp, Homo sapiens
tttctccccagtgaaacggaaataatcaacaccttctcctcacagggctgttgaaaggatcagttaatgacacagcagagcgactggcacatagtaagcacttaacacacgttatcttttattattgttgttggtattaat

SEQ ID NO: 183066 - DNA, 789 bp, Homo sapiens
ctatgattaaaaacccaagagagtgcagaggagtacaaggcatgcatgttgggaaaggagggaataagctagtctctgcaggaggcttcagagacccgtctgggaagtagggctgagactaggctttggagggccttgaagggcagctgagggttgattttaatccttggaaatgaccagtgcagatcaaacatggagctcctgctgccctggtcctcaggagtctggtgactcagtcatgttctgtaggtttgtgctccattttgcataaatcttgcaaacataccaggtggcaggtttgcacagtaacacaaaagcttaaacatgtcaagcaagtggggcattcagcagccacagaaatgtgttcatttttagtccctaatggatgtgattaagcagggctgatgtgtacagatttaaaaacacacacacgtgctggattaaaaacagccactggtttcagtgccagggccagcaaggcctacctgagccaggcggaagcagcagcttgcaaatagaaactgccacctgcgagcgcttcttgggtcatgtgcagctccacctcagctggtccctgagccgtggtcatgtgggggttttgaagggctaagttgaagcaagtaattgcaaaagaacaggtggcactctgagggcaggggaaggagacagaagtttgactgcgtttgaaattatttcagtcagggaaacatctgcgttgtcttgttaagcagcttgtaggcccacccctggctaactgaactttgtgagcagttggggcagttatttgaa

SEQ ID NO: 183067 - DNA, 246 bp, Homo sapiens
aggtaagtagtctgttacatacattcaagagaatttgtatctggagggaaccttcggattgtctgttccagcttattgccatgtatatgacgaaactaaggcacagagaaggaaggaacttgctccaaatcacacagcccaactagagcttccatctcccagccagccctagtcctcacttacaagctcctacaactcatgcaaggattaagctctgtgtgtttcagctatttgcctagttaacag

SEQ ID NO: 183068 - DNA, 224 bp, Homo sapiens
gggggctggatacagcctcagtgatgagcacctctggttgtcatcttagtgccttgccctgccaggaccagtcagcaatgttacccctgtgccagggactgcagcagtttatgcagttgatgcatagtgggagctatgaggtacaaatggagtgaaccggaactcacagattcccacccactgagactcagagggggctgggtcagtcccttctccagcacatg

SEQ ID NO: 183069 - DNA, 458 bp, Homo sapiens
agctacaattatcatcattcccgttttacaggtaaggaaaccgagacacagacacagatctagacagcgacagagctgggaactgaatctaggcaatctagctcacagtccatgttcttcatcgccatgctatgctgcctctcagtggattttgttttccttgttgtaatggttgagggaggggaggtaccagaacgccaacttcttcttgtacagtaataaacatgaaagacacagcaaaccaacagcgctgtcttctagcataatcgagcacattctctcctctaaagtccaagttataggacaggccaaatctcaaccaggaacatgttattgatttactctaagaaagccctgtcacaacagcataaacaaaatgtccatgtggtcagcctattctttctatcaccatccaggaggttgtttcacaggagtaaaaagtcaagtcaaagtctcag

SEQ ID NO: 183070 - DNA, 507 bp, Homo sapiens
tacttttagtagagacagggttttgccatgttggccgggctgatcttgaactcctgggctcagtggtctgcccgtcttggagtcccaaagtgctgggattataggcgtgagcaaccacactgggcaacatttttaataactcagttaaaatatgctaatgtaggccaagtatgatggctcacaactttaatcccagcactttgggaggctgaagcagaaggactgcctgaacctgggtgttggaagtgcagtgagctgtgattgcatcactgcattccagtctgggcaaaagagcaagaccctgtctcacacacacaaaaaaaaaaaagaaaagaaaaaagcaacaaattactgccaggcacagtgtctcatgcctgtagtcccaactactcgggaggctgaggtaggaggattgcttgaggccgggaggcagaggttgcagtgagctgagattgcatcactgcatgagattaccccagcataggtgacagagcctgaccctgtctc

SEQ ID NO: 183071 - DNA, 455 bp, Homo sapiens
agctttcatcctgtcaccatgaagtagagtatttgctataggtttttttggtaaagattgtcaggttaaggatgtttcttcctttctcttcctactaaggatttttaatcataaaaggatgttaaaatttatcaaaagctttttttccagttcctgaggtaatcatgatttttttgcatcatcattctaatactgttttgtaaacatctgtaaggatgcctgctaaagcagtaaagtaattccagttccagccattttattggatgtggcttttagaaggaaataaaaggccataaaaatgttgttcttcctcatatgtcttatcttcagataagttccataaagtattttgctgccactgcaaattttttttacagtttatgaaactatgtatttttgttgttcatgcagtattaggaaataactgttcatatctcctgagatttttgaaaaca

SEQ ID NO: 183072 - DNA, 577 bp, Homo sapiens
tcctggggaatgtagcctgagttgtgtgtggggcttgcagcgtcaaatctgttgccagctcctgcttccttagtgttctccagcctaggatgggtgtcttggccagtaggagcaggtccatccttcagtgccgccttttttccacagcttccagcgaccgtagcctctgtgagtggtcaggctgtgtgaggctctcacggagaccctccgtggagtaccatgttcctgataagtgtgcctgggaggcttgctaatgaaagaagtaatataccaaacataatactttacataagaaaagtgatggtaactttatggtggaagggagaggtaagtgttgaagtgggcaaattttggagacaaggatcagatgcacagagacaggaagaatagtgcagtcatcacttccaagactggtgagggctgctgcatcgctttgtgtggggtataacattaatgtgatgagaacaatctcatagaatcagtggaacttctgtgtggtattaacattatgtccttattttccagttgcatatgagataatttgatttacagaaataagcttttagcaaaaaccatg

SEQ ID NO: 183073 - DNA, 387 bp, Homo sapiens
agattgcagtgagccaagatcacagcattgcacttcagcctgggcgacagagcaagactctgtctcaaaaagaaaaaaaaatttagtgcacacctgtggtcccagctacttgggaggctgaggcaggaggatctcttgagcctaggaattggaggctgcagtgagatatgattgcaccactgcactccagcctgggtgaccaagcaggagcctgtgtcaaaaaaaaaacaaaaacaaaaaaacccgcccctatgggaacagggtgacagactctttggctttgagcatctgagtgggacatgacatctgctcactctgaacgaccgtcaggatctgagcctgagaggggtcagcatcctcctcccacaaagtgcatcacccttacgc

SEQ ID NO: 183074 - DNA, 386 bp, Homo sapiens
agtggatcagttcctagactctaccattctgttggttcatttgtctatccccacacccataccagaattttaacattattatagctaaagagcaagtcttaatagctggtgtggtgtttgcccttattttttttgttttagctcacatttgtttttgttttcattagtctttcctcttccagtattttaggatctgattgtggattcctgtgaaaaatgctattggaattgataaaggaagtgtacctaaataggttaatttggaaaaattttgccacttgtactatagttatctatggtacacgtggcaaaaattagtgaaatagaaaacaattaagcaactgacatggccaacgaaggtctaagattagaagaaaaagaaaaat

SEQ ID NO: 183075 - DNA, 383 bp, Homo sapiens
gtgtatttgttgaatgaatgaataaatgataggatgggaatcccttttcccaagagtctggattcatttccagtttgccagggtggtgttgaggaggaatggctggatgtgctggtgggtggttccttcattagttagttggttagttcattcacttacacataatgggcacatagtgagcctgagggacccaggactgtgaagggcatggcagggaaacacagcagaactcatggttcctgccaaacaaaaatggattcttaagttggagcctctctgaaggagagggtagtgcctgtaatgtgattgagagccacgtggaacaaatggccacctatgaaggctctaggaggaagaagtcctgggaattgagagcaggttgg

SEQ ID NO: 183076 - DNA, 349 bp, Homo sapiens
ggttatcacccctccatactccagcattaatttctttttccttttatcaggaggcaattcttaattaattaaaggcaatcctgtattgtttcttcccatactctccccagctcttttacatctttttgaaatactcaggaagagaaacgctttctaggtgtggtctgtcactggagtcactgggaggaaacttcaactctccactccttggtatgatgtaagctttgcatactgtgtgaaaacattcagaaagtgctgactgcaatccgtttgcattaaattccttctgaaggaaaaacaaaacaagttaaataccttctactcaaaggaaagcagaattttaagtttg

SEQ ID NO: 183077 - DNA, 395 bp, Homo sapiens
tggcgcatgcctgtaatcccagctactaaggaggccgaggcaggagaatcacttgaacccgggaggtagaggttgcggtgagccgacatcgcgccattgcactccagcctgggcaacgggcgaaactccatctcaaaatcaaaacaaaacaaaacaaaattctcatcaccctaaaaagttctctcatgcccttttgagattgggactacccctatactccacttcaggcagcgtcgatgtgatttgtggccagatggacattttaaaacaaatctcaccatgtggctacctggctttaaaacttcaatgttctcccatgccttcaggatgaaatttagaatctcttgcatgactttcttgttcttcctgagctggcctgacctctgctgaccatt

SEQ ID NO: 183078 - DNA, 227 bp, Homo sapiens
ttgtagttttaagccactcattttttagatgatctgctacagagcaatgggtgactatcacctattgtagtagaatgagcttcctggtgatcaggaagttaaaaagaatgggtaagactttacacactgtcttttatagattctcatgcccacaatatctgatccaatgtttcatagtttgatacatctgattatcagctcctcctcctgtgggagaagtaagtaac

SEQ ID NO: 183079 - DNA, 324 bp, Homo sapiens
gagctaacctgcaaccggtcaattgtggtctttttagtataaaaacctaggtttgaatctttgttctgctgcccgtgactgtggacaagttgtttaacccttcagctttatttttatctgttatgtttgggttgttgtgaaggttaaattagactaaatgagctagttcacgtgtgaaattttcagcttcagtgttcagtggatattaattccacttcttcagtaaagagcccaactttacaggaatctaataaaaagcagtttcttggaaggtactggggtagttcctttcttcttggaaggagtgattggaccattcctttg

SEQ ID NO: 183080 - DNA, 155 bp, Homo sapiens
aattagttttaagaaactacctctggggagaggtaaaggattggcagatttttaaatttcatattccatccctctatggggctggaggaaagactttttaccatgtgtgcttattattagtgatttttaaaaataaggttaaatatttaggtggt

SEQ ID NO: 183081 - DNA, 259 bp, Homo sapiens
gctggattgggaggtgggagcgtggtaatttcagaccacacataatgctctatttcttcagtcaacgctccggctctgccagaggtggctccatatgcctatggatacataaacttttcctattaaaaccaaagattctgctttcagccaagatgcagtaccagggactggactgaacttaccgcctaatggtgactttcaagaccctggagacaggaaacaaggtgagccctacagctgccccaagttgctgccacag

SEQ ID NO: 183082 - DNA, 477 bp, Homo sapiens
cccaatggaatgtatagaggtgagaaataaaatacctggtatgaaaacttcattgtatagaacagtaagatttagacactgaagaagaaatgatatacagcaacaacaaaaaaatagcaataaaattatctaaaatatacatggacacacatggacaaacagagcatcaatgacttaaaatgtaaagtctaatatacatgtaataagagactcagataatagaaaaaaaatgaccaagtaagggaaaagttacaagaaataatggccaaaatttttctaattttgatgaaaaccataaacccacagatccaagaggcttataaactccaagatcagaataacagcagacttcttgtcaaaaactaggcaagctataagaaaatgcagaggtgtctctaaaatactgaggggggaaaaaaggaaactttcaaactagcattgctatattaggaaaaacagctttcaaaaacgaaggca

SEQ ID NO: 183083 - DNA, 280 bp, Homo sapiens
agccctaaaacatggtccgagagaaattaggcaaaatgaaaagttaacagacaaaatgactctgccattgctcaagttcctttgttctttcctttacagccttttattttatttctgatgttggtttatatccactgcatattaaaccagcatcccgactacatgcagagcatctcatttggcttaactgaatatcactccaaaaatggggtgcaaaattcagtttgttgtcattcctgagtttcccctctctaatttctctcggaccaatgttaaaaag

SEQ ID NO: 183084 - DNA, 420 bp, Homo sapiens
cacacaactgctattatgagctatttgttaatatgaaataaaaaactccttttcttcatgcttcatgtaatgggcagtgttttgctgtccaacctccccaaattcactgttttctttttacaacactcctgtcttgtccaggggaatcggttcttccctctgtgctcagccttggtgaaactgccagtcaagctgccctgccttctcctcgtcaaggcccaactgggcctctctcccaggactttgtatctggaggctttaaatggaaccaagggtttgggagatgagggtgatcagagtttcttccagtgacaggcctctaccatgacttggtttgtaccctctttgaacctgcttccataggtttcccctcaattctgtgactaccccagatccttggacaggctgtagtgcctaaga

SEQ ID NO: 183085 - DNA, 287 bp, Homo sapiens
acccaaactttgactaagaaactagaaatggatcaggcgaagtacaacagctgcagttagagttaggaggttaaaaattctggaagagaatgagaccaggatttactcttcaggagaagtttggagctgcttttttaaaaagcagaggttgggagagtggaggaaatgaaacaactagaatttgatggcaaaaccaatgctcttctcttgattctttttcaataaaaattaggatgaataagtaaattgctctaggctgggcattaggaattctgaggtcccttccc

SEQ ID NO: 183086 - DNA, 267 bp, Homo sapiens
aaatatgcctgcgtatccacagaactcacccaccgtgtgtggagtgaggactgccacgtgggcgtggtggggttgcatggatcgacttgggtgggcaagtggaggaaggcctgagatcctacgaacacagaggcagtcacgaagtggtctcgaggcagatgcctctgaaaataatgtggatccgccctttagaaaggtaattctggcttgattttgaaggataacacaatggttagtttgggcgtacggggagttaccgagctcgaa

SEQ ID NO: 183087 - DNA, 252 bp, Homo sapiens
actataattgtacataaactgcactataacattaatataaatctattgtaaattaaggagaggaacatggacctagagcaagatgaaactgtctcttactagttctctgacttttaccaataacttaactctggtttttgcttcctcaactctagattgaatgtaatgtttctactcttaggattctttggtgactaaatgttggtgatttaagtcatttaatagtatttccacattggtaagctgctacat

SEQ ID NO: 183088 - DNA, 312 bp, Homo sapiens
ccacctcgtccttgtagagatgagatttagttatgtcgtccaggctgatctcaaactcctgggctaaatcgattgtctcacctcagcctctcaagtatgttatgaaggttatatgttaggaagggtcccaggaggtagacccacacagatgggatttgggcataggtttggtttcccagggggcagtgctgagctctttgccagtgggaaatgggatgctggtgatttccagtaggtgacctcacagtgactcaagctaccacttactgttgattgtgacgaaatgccagctgaggcacatgccttgggagc

SEQ ID NO: 183089 - DNA, 462 bp, Homo sapiens
tgctaaggcttcattcacaggcccccctcaaagtgctccccactgcagggcactcagagttattacagaggtcaaagagaagagccaggccaacccgaaggagcccaccagacctggcaatgcctcctagtagagcccatcactgctggagacagcagcaagcttagacccttcatccaggggtgagtttgggcagaaagtggccgagacgccaaagctgcaaaggggaaggagaaaaaaattcaaagttcaaatggtccttagagatcatctgctgcaatctcctcattctacaggtttttatagaaaaagcaaatgatcaaaataccctgaggttagttatgtgggaaaaaaagattcagtaagcagggcaggaatacttcaccccactttcagtcacagattttagaaaagatatatgtaacgaatccaaaatgcacagccataaaaggtgcttattta

SEQ ID NO: 183090 - DNA, 218 bp, Homo sapiens
catctcaaagcctcagcatcctttcctagaagacataatatgactttatgaagattaaaagaaataaatctgtgcacagcatctatatatagtaggcattcaacaagtggtagtaattaccatgacaacaagctttaggtctctcccacactgacatcggtgtggctgctcagaaatgaatttcccattattcatcaaaacatatctgtaaaggatga

SEQ ID NO: 183091 - DNA, 133 bp, Homo sapiens
aacagggaatctattccccattgcttgtttttttgtcaggtttgtcaaagatgatgattgtaggtgtgcggtcttatttctgggttccctattctgttcccagtctgtgtgtgaaagaatcttttatctattt

SEQ ID NO: 183092 - DNA, 468 bp, Homo sapiens
attgaagtgtttgcaaatgcctcttaaaccaagcactacaaatattaagaaactgagtcagcttctcaattaagtgaaattactttaaaccaacacaccaatatcagtgtttttaaccatttttgagaaattgcagacccctttgaaagctaggggcccctctccaaaaaattctgcatgtaacttccaaaagttcattgtcctccccattccccaaaagtccatttactcctctggtcaaaatttcaaaaatgataaaaggataagctatagcaaggcaggaaaatgaagaaacaagcacacatgggattagagcatgttacaaaaaagtgcacaggttaaccagctttttcctttgcttgtatactcatggtctgtatctgtattaactctactaattaaaaaaggtaaataaaaaagaaataacatgtaaatattagatatgtgatctcaatatattaggagcca

SEQ ID NO: 183093 - DNA, 955 bp, Homo sapiens
acctcctgccttctaagacaaaaaattaacttctatctggttctggtaactaggcccctggctttctcttatttaactaagtctatgccctgatgcccacccagcatcctaactaagccactcctgggagcctctaaagaggaactggctatggcatcagggggaccctgcacacttccacataggccagatagccgaagcttaaatggcaggtgaggtaagtgttggcagaataccctgcagtccctggaacttgagaacttgggaagatttcgaggcacttctacaaggatgtttctcgcctacttccctctcttccaaagaggctgtcatgagatggtttttcattgccacccaggctctgatgaagtcttaggctttctgcctgttccctccttagggtacagaagcaggctatagaaccacttaactgctgcatggatcagctcctcaaaaacagagtaccccactgctcacattgcatcgccatctgacccttttgttttgattcgttttgttttgttttgagatggagtctcactctgtcgcccaggctggagtgtaagggtgcaatcttggctcactgcaacctccacctcccaggttcaagtgattctcgtgcctcagcctctcgagtagctgggactacaggtgtgtgccaccatgcctggctaatttttgtttctttagtagagatggggtttcaccatgttggccaggctggtctcaaactcctaacctcaggtgatatgcctgcctcagccttccaaagtgttgggattacaggtgtgaggcactgtgcccagccaggaagctcattgtttaatagactttatggtgaatccttatatgaaacaaataattattgtgtaaaagttgccttcagatgaacattgtagatcaatctatattttcacaaatcaggtttctaatttgccgttaaagcaagatatac

SEQ ID NO: 183094 - DNA, 269 bp, Homo sapiens
tgccctgactttggttagccacctggcagaggtgtggctggcagtgtcggagaacgtgcccttcgcccggaccatgctccacagcctgatgggccggctgcagtcacggctcagccccagaatcagtgccacctccaaggctgacatctggcgcctggctgcggtggaccccctgatgaccctgtgcaccatccaccttctcattcagaagctggatgagaatgacaagctcccggacttcctccctgacctcatctacaccctcctgc

SEQ ID NO: 183095 - DNA, 290 bp, Homo sapiens
aaataatatagagatacagaagaacacgaattctcattcactactgggagaaatacaaaatggtacagtcattttagaaaacagtttggtagtctcctgtaaagttaaaccataaagttaccaaacagcctagcaatcccactcttaggtatttactcaaatgaaatttcacactaaaacctgtacatgaatgtttacaatagctttctttataatcaccaaaaaccagaaacccagatgtcctttaataggtgaatagacaccaggcgcggtagctcacgcctgtaatc

SEQ ID NO: 183096 - DNA, 570 bp, Homo sapiens
gtgcgcttcttgctgccaacatgtgaagaaagacgtgtttgcttccccttccaccatgattgtaaaatcaacaaggaaggcgatgagcacagcagtgtgaagcaatgacaaggatgccctaagctctatgaaactgcgagataaacatctaccaggttgatatcatatcactcaaaagcaaaatttattcctcaggtctcttcacagcgtggcgcctgggttccaaggggaatcatcccaagagagaaccagggagaaactgtatccacctgcaagatctaacatcagaagtcatatagaacaccattccctactcttagctaaggaagtcacagagatctgactcccttccttcaagggagggaaccatagactctacttgtgggactggctgggttctgatagaatatggacatatgacttcagccatttttggaaattatactgtgccacaccttaacgtgtcagaagacgaggacactgtcataactttcagtcaattgctcaaaccaaatatcaaagtattatcctgaaaaacaaaaaaaacaaaaccaaaaactttttggccca

SEQ ID NO: 183097 - DNA, 131 bp, Homo sapiens
catttccaccaggcaatgggctgtctaaagccaagcggtggccacactctctaggtccctcaatcccactccagagtaagaatgtctccattccgggccaggcgtggtggctcaagcctgtaatcccagca

SEQ ID NO: 183098 - DNA, 310 bp, Homo sapiens
tgagccaccacacctggcctcttcacgtcttttgattctctaggttaatgatgtggaaatagttgtttcttcctgtctcatgatttaagggagtcaggcaagattatttgataagataaatgattatagagttcttgaacttggaagagaagaatagtatcacaccattttgaaccgaaaaggatcttggaaagtatgagtattagactggtgtagaaggagatctgggctctctttcctgatcctgtgaccttgagtaagttacttcctgaatccattgtccattggagatgatcttcattgaacaaat

SEQ ID NO: 183099 - DNA, 288 bp, Homo sapiens
ttattcaaaggggaaaacaattctttttagaatatactctttccctgtcctgttaaatgcctatgttctttctgaagagatacacagagtaaacacatattccttctaaaagaagtacacgagaataatgtagacaccgccagccaccccgctaatctgccacctcacagacttagggcactgtattcacaatcccaaggttagtttccaaagaacaatctttctgcattcattcaaattcatttattaaatgcatttgcatttggctcaaagaataatgttttaact

SEQ ID NO: 183100 - DNA, 444 bp, Homo sapiens
cccacagtcctccctctctcagtaaaaggaaactttattctttcagttgctctggtcaaaaaccttgaagtcatccttgacttttctctatcttcaaaacactgtatatccaaatacaccctctgtaatcaccatggtccaagtcaccatcgtgtcctgactgcactattctcataatctcccgactggcttctttgcttctgctcttgacactctacaatgtattttccacacagaagctataattaaaatgtaagccagagtcaaaacctaccaatgtcttcctaacccacttaaaataaaagtcagtccttaccaaggctttacatgatctggctctcagctacctctttaacttcatcttttaccactttctaccttgctcaatctgtttcaacaagggcttgcttccttgctgttcctcaaacactctaagcacactcc

SEQ ID NO: 183101 - DNA, 268 bp, Homo sapiens
aatgtacatcatttgaaactaatttttcaattaactttaagaacattttaaaaagattatttttgacaacttaaaaaatatttgatacatcattataaaaatgtattccaggcttatattgaaggttatttattcgtttatgtgaactttctgttcattatttttcattaaaaacaaaacaaaaacctgaagccaggcagtgccacattattacatcttaattttttttttttttttttttggactacaggcatgtgccaccatgccc

SEQ ID NO: 183102 - DNA, 532 bp, Homo sapiens
agggaagcaattgcaaaagagaaggacacgaggaatgggaaagacacagtttcaaccatttacttttcaatagttctattatagttccattaaaaatatttttattttgaaagtatggatatgtaatagctttttgatacgcatgtatatgaacagagaaaaacaacatgagtaaatctgcttcccgtgacaaatgttaattgttttattccaatggaatcacagcaggtataccttgtaaagtttcagtttcaaggatctgcctgcccttgcatgattagtttttctcctatctactgtatcatttaaagcaatatccatatatgtggcaaaacctttttatctcctattttttctctccttttgctataagtccttgaaagagttgtccgtaactcctctctccgattcttctcctcaccttctctttgaatccattgtgagcaggctttctttatcacctctgcagtccactctcttaagatcagggtaacctccacattgccagatctgatggctaattcttaatctc

SEQ ID NO: 183103 - DNA, 244 bp, Homo sapiens
gatgaggggatcggggtagcggatggtgcgggcatcatgagctcagcacattagggattccttttgtgcccacaaagatctttctcactttgcacaacttgtacttggcctcctcaggtgtaatacgatgtacagcaaagcgacccttggtgtcatagatcagacggaaattctctcccgtcttgtcaatgctgatgacatccatgaatccagcagagtaggttatatcagtacggaccttgcc

SEQ ID NO: 183104 - DNA, 151 bp, Homo sapiens
tcacataaaccaaatttatgttcaaattaatgttcaaaatcagcatgcctggtctttactccatttgactggtcagttcctctttttccaagtagaaaatgggcttgggaaaacagataaatatcggaaagttgcttgataggtacaaaag

SEQ ID NO: 183105 - DNA, 398 bp, Homo sapiens
gattacaggtgtgagccactgcgcctgggaccactcataaggtttgagttgagatagagaaactctggcaggactgaggaatttggccacagtctctgggaaatatgcacaatttctggaatcttctctacttccagagttcccactttctatctgtctcctatttattcaacaaacttgtatggaaccacagtgagtctagaacttgccaggtgtggaggataaaaagatgactgaggtcgagccactgcgcctgggtccacacgtaaggttccagttgagatagagaaactctggcaggactgaggaatttggccacagtctctgggaaatatgcacaatttctggaatcttctctacttccagatttcccaccttctatctgtctcctatttagt

SEQ ID NO: 183106 - DNA, 198 bp, Homo sapiens
catagttatgctgtaatagttatgcgtaatagtttatgctgtaatagtttatgctgtagagagaaatttttaaacaaatttttaaatagtaattactgagaaagaggaatccgtaaatactctacaagaccacaaatactgagtattaggtagtagggacctactacagaaaataattttacaaatagcttatacagg

SEQ ID NO: 183107 - DNA, 500 bp, Homo sapiens
atagcgacaccgtaccacgatcacacaccttattatcttccttcatgtattttcatgggcacataaacatacacatgtgcctctttttatcattgaagacagctgtggtcatcccatcctacctaggtatttcctcttgttcacattgccaataattataaaatacagctcgatttcagagatgaaaatatgaaaaaatacgaaaattttaaagtgccatcagtaacaagctgcagggaaactgtgctcacggaatcattgaaatgtggtagctgtgccttgccttgctcttttcttttctcttctaacaatctgacctggtgacctctcctgtgagcacaccaggactccttcaccttcacagcagcacagcacagtgtccatgccacacccgtggtctccatcgtaagaaggcactgtgggagatgctactcgttgtagtttcactttgatgctataagcagtgctgcattcaccatgactgtctgtacgtgttgttt

SEQ ID NO: 183108 - DNA, 327 bp, Homo sapiens
gggtcccatatatttcttgtctaatacaaaatcgcagaaggctgaaacacattaactagaaaagagaatgcaatttggattcaactacctgctgtcatgaaaggtaacagtagttaataatgtttgcaattcatgggatgttagagataaaagagtcctcaaatatcctccagcaaaatctctctccttttacaaatggacaaactaaggacaagagaagaaagatgagtcaagccttcagtcttatgctgtgatctgatggtgagctataaaatcactgtcaagagagcccttccaaccacctgtgctcctggaattcatgaggga

SEQ ID NO: 183109 - DNA, 494 bp, Homo sapiens
atctgcatcccctgcatcccctaccacagtacttggcacacagtaggaactcaaaaattcttgttgaataaatgaataacgaacatcaaaaaaaatcagcttcagcaattctagttctaagaatttaccctacagacacagtcatatatgcaaagagccaaatatatatgcttcttcactgcagcatagtttgtaatagcaaaagactggaaactgtgtatgtctatcagtgtaaggtaggtgccaagtatctttattgctgatagggagtaacagtcaaaagaggtataaaaatggccgggcgcggtggctcacgcctgtaatcccagcactttgggaggccgaggcgggcggatcacgaggtcaggagatcgagcccatcccggctaaaacggtgaaaccccgtctctactaaaaatacaaaaaattagccgggcgtagtggcgggcgcctgtagtcccagctacttgggaggctgaggcaggagaatggcg

SEQ ID NO: 183110 - DNA, 911 bp, Homo sapiens
gtggcctgcatgccagttagccagagcactgcaggtcactgtgacagaggaaaagcacagtgaggaaataatagactcttaaaacttctgcttggaagtgactcatacgacttaaactcatatatgattggtcaaaacaaatcacatggccacaactaacttccaaggagaaaggacatgcaatcatacgtacctggaagagaaaacagtatgcaaaagcatgaagacttgaaaacagtgtatcaggagattataaattgtacacctggagtatggaaagtataggtaggaagagtagaagcttgaaatgtaggtagagggcaggtaatagcaccctaaggagacaggacttcattctgttagcatttgcagggaaggtattgaagattttaagcaggtgagtcacatgatcagatttgcattttagtaagattactgtgccagcaaggtgaaaggtagactggagggtggtaagatgggaagagttagcaaactacatgtaacaacctagtagatatagaagagtgcacttcaaaagtgcactcttctatatctaaccgcacagctagctctgcgtgaattactctttctccactgcaagtcccctgtcctgatacatcggttctgtctaggcagcaggcaaggtgaacccattgggcggttacacttgcttggatacaggagggtcccaagtccagcattttgcccacttaaaattactcataaccattattgttggtagtatattccattattctaggagacacacaaggaattgcatttttcagttcctatgtaaaggtattaatatttcctccttgccttaattcaggactggatagctcaccaacaaagactggtctctttaggacgtctgtgcaccacgtctaacgataagatctaaagaaagg

SEQ ID NO: 183111 - DNA, 444 bp, Homo sapiens
ctttcccctcaaaagtcaagagacaccaaggctaagggtaattagagatcaggacactggctgctttcagtatagaagcacacagcaatctagtggcagactccgaaaactagctccaaagagcaccatcctctctccatctaaactggatattacatcacttctgataaaatgagtaaccaccataataatctctgtcagctatgagaaaatttaccctggcttctatgaaaggaaaaaaaaaaagcacttgatttctggagctgagaaattactttaaattacctccaagctcttggtaaatggacgtccattggtatcagaggtaattcgcttaataaagccattggaaataaaaagtatgggcagttgccaacctacacatacttgactttcaaaaataataaatggcctcattcctcctcacagtgctctcttggaggg

SEQ ID NO: 183112 - DNA, 459 bp, Homo sapiens
tttagcttgggaataaatcctgtgtttgccatgcaacgatgcatacaatgggaaaatataaggatgagcttataagaacacgagcttggttctcaaggagcccaaccagaagagtcttaaaatgttaccacatgtgtgtaatggacactgggtttcctgattagatcttatcatggttatttcaaatggcttctttcttctaccacttgctaaccttcccctctgcagagtgcatacacacacaaaagaaaaagacaaaggaccctttccactctgtcttggccccttccagaagtattcttagagccatgaatccacagaggcttttgaatttagataacttttatggtcaaagctaaaaacctttgctggtaataggaaatgtcatatggaatccactgggtagtcataatttccatttataaatagaaaatataaagtgggtgccttatctgggtg

SEQ ID NO: 183113 - DNA, 173 bp, Homo sapiens
gaggtcagcttggaaattaactgatcggttgtgagggtttggtagaaaatttttcccttatcttaaggctgaatgttgatcatgctttaaattaaatttgatacacactggtgacaggaaaattgtcaaataaatgaccttgattagtggacagatcagtccgttcgcatgtt

SEQ ID NO: 183114 - DNA, 357 bp, Homo sapiens
caaacagtgatgtatccccaacacctttgctgtgttctattggttagaagccagacacaggctgtgttcattcttaagtggaagggattgcacaagagcatgaatgccaggaggtggactcatggcagccactcgtatgagtattatgagtctatctgccacagtaaggaacagtctgcttctcatgccatgtttcgggtccagcagactccatccctctcaccttggctaagccaatcaccatattccattctctggccacagtgattggatcaaggttgggcataccaccaaggtcaagccaactggggcccatgtgactcaagtgctcagaaaataaagtgttgggcgataaca

SEQ ID NO: 183115 - DNA, 639 bp, Homo sapiens
ttcagactcaagccccagcccaaccccagatgaagggattttccgagcagctatcttgatccggtgcacaggcccctgttctgaccagggctgaacgcttggcccaggaaaaggacaagtcctagtatctaaaaatgatgacaaagacaaggcgcagagatgatggtgctgatgccactgggcactggaaccatcacatcacagggactggcaccaacatcccagcagggcaagccaacagtgtgagaaggcaggaatcaagagcacacagagggagctgggctgcaaagaggaggctagaacagatcctcagagaaaggcagagatgagtgtccacgtggccgcagaggaacagaggaggcacttccaatggccgtggacctgagatatgctttgttgctctctgacactgctcccgctccatgggactggctgttatgtttttgggacaagtacccttttgatgaaggaaaaggtgcattgatgaatttatagctatggcgacgtactgacatagttactttatgtcaacatagatgtaagtatttatttcaaagtacacaaaggaagaaattgcgtgtgggcgcaatgacgagggcagcgtccatttcatgctcatttcattccaccactgccacg

SEQ ID NO: 183116 - DNA, 308 bp, Homo sapiens
ttattttaggtggccaaaaagtgctaaaatttttaatttctcttcttccaagtgagtatctttctaagtatcactcttatcacttaagaaggaaaacttgactgggtgcagtggctcacacctgtaactccaacactttgggagaccaaggtgggagaaccacttgaagccaggagtacaagaccaacctgggcaacacagcgagacctctctctctcaaaaaaacaaaacaaaacaaaacaaaagaacaccgatgctttttcttaaaaaaatgacaacaacaacaacaaaacaactatatgctcaag

SEQ ID NO: 183117 - DNA, 309 bp, Homo sapiens
ttaaggcatattataatatctcacttatcttgaagtcagcctcaactaacaggaacagaaaacccacattttatgatacacacacaagtaaatccttaataccattcaagtcaaaacagctgtcatgatatccaagtattaaagcatctacacgtaacttcatggatcacagaaaagatcccggctcattcagagtgattcattttacatcccagtctgacaaattttattttctatctctcagcctccagcagattagaagcaacaatttagatgaaaggcgattggggtaggggatacaactgatag

SEQ ID NO: 183118 - DNA, 268 bp, Homo sapiens
taatatcaaaatggtcagtgacctgaaagaatttactgtctatccattcattaaagcagttttgcaacagtagtgttttactctacctatgattaagatttgaactttgggaaacttttttatttcttggtaaaagatgtaaattttttggaatgaaaagatttcagtctaaaccaacaatttatgatattgctctctatgaatctcttactagtgactaataaatattaaggcacttaatggattcactttagctgtattttttcat

SEQ ID NO: 183119 - DNA, 487 bp, Homo sapiens
ttgtcagtttcatgattgacaatgataatctctcttcacctagcacccatggagcctgctggacagaagcagctggctggatgtgatactggggttggcagagttagggtctacaattagggtctcttttctctgccagggcaagaagccaggtgctaagggcagaataccccatgagagataactagtatagcatgatgtttgagtatagcctctggagtcagactgcctgagtttgaatcccgggtttatgacttcttagctcttgaacaagttgcttgttctctccatgcctcagtttactccttttaaaagtgggaatactaacagtgtctcccccaagagtgatgtgaggattaaatgactaaatgtaggaaggcgcttagaagagtgttgggcatatatctaatgtgtgttatttttcacaggtgactcaatctgcctgttgtatttattcctgaaatgtttatattgaatcatactcaaa

SEQ ID NO: 183120 - DNA, 665 bp, Homo sapiens
gtgatccggcgagtcggagtcacgacgttgctgaaagagtccgagggacgaagcccgtaatgatgctcctagtatgcttcccgagatctctggctgcctggatcctcaggtcgctgttgataaaagtgtagagttggggtctcacggtctcaaactcttgggttcaagggatcctccagccctccaaagtcttgagattatgggcatgagccaacatacctagcctatatttttaattaaatttatgtctaggcacattatcttttttatgctattataaatgagataatttgctccattatattttatagctgaatactatttgtttactgaaatgccactgaatgtggatattcattgtgaaaccaatccacctaactgaactatcttctgctggtaacagaattcctccaattgattcttttgcagtttctaggtaaataactacattgtttgaaaacagtaataattttgcctccgtggttgaagtatttatgtctcattttttcccttatgtaattgcattgattagtactttcagaacaatgggttttaatttgagaggcttgcagaaaatagcatctattataaaaatgacttacagctaagaattatgtacataatatatataggcatgttaagactgagaaaaaatacaaagaact

SEQ ID NO: 183121 - DNA, 162 bp, Homo sapiens
tgtcagaggacgcctggagttccgacgcgtgtcttcgagctcatagagggagttcttctccctttgaagaatcccgagaactgtgtaaagctgtttggcaccttgagacataattctagccacgcaggtggctcagactgtctgatcttgtgatagacactt

SEQ ID NO: 183122 - DNA, 663 bp, Homo sapiens
aagctatgtaaacatcatacctgattgaaccaatctgtaatccctatgtaaatcagacgccgccgcctcaagcctgagtaaaatccagcacatctgccaccaactggtctgggagtcccctctctcacgagagagagctgttttactttctctttctttcttttttttttctttttttcctattaaacctttgctcctacactccttaaaaaaaaaaaaaagaaagaaattgaatttgtagtttcaaaaatctttcaacaaagaaaacttaaggtctagatggtggccttactagtaaattatagcaaacatttaaggaggaaataataccaattatacacacagtctttcagaaaatgggaggaagcacttaccagctcgttttatgaagccagcattatactaatatcaaaaccaaataaagacatgagaagcatagaaagttacagccccagtatccatcatgaacatagatgtaaaaatattctataaaacttaagcaagtttaagtcaagagatacataaaaagaataatacatcatgaacaaatggggttcacttgaaaatcagtgcagtccactatattagtagactaaaaaataaccacatgatctcaagatatagcagaaaaatcatttgtctaaattatcaaaaacctaggct

SEQ ID NO: 183123 - DNA, 267 bp, Homo sapiens
catgagttggatttaaccaggtatttactacagggcataataataaatcaaggttccacttacattattatcagagttaatcatctgtactttaagttctgcctttcttgatcataacagtctacagtgcatcctcttcagaaggaaagttgatttctgtattatgccttgtatctttagttatctttttacctgtcatgtttcatctccatacctctactgtaatgtttcttgaagacagacagtgggtcacataatcttttataa

SEQ ID NO: 183124 - DNA, 287 bp, Homo sapiens
acaattgtgatttactaatcagataccctagtatctatggaagataaatcatttaataagtcgctgaaataatttgctaatattttatttgggatttttgatttttcacatgtaaggagtagttttcttttttcagctattttaggttagctaacagaattctactagcttaaaagaatagatacctaatttaaaacaaagttcttatattacataaactcattagcaaaaccagctggccctatggatttttggtgagataagttaggctttttactttttgagtt

SEQ ID NO: 183125 - DNA, 657 bp, Homo sapiens
gtttaagtgattctcctgcctcagtttcccaagtaactggaattacaggtgtgtgccatcatgcctggctaatttttgtatttttagtagagacggggtttcaccatgttggctaggctggtcttgaactcctgacctcaagtgatctgcccgccttggcctccaggattatttattgaattttattgtcatatatttttagtctccttcaatctggaatacttcgtcagcctttctttgtcttaggacattgacaattttgaagaataaagtccccccgacttccctttttgaaaaaacagaatgtttctcatttggtgtttgatgttttctcatgattatatccaggttgtgaattcccagttgggatacatacataagtgatgtgtcctcacattaagaggcacacagtgtccatctgtcatcatttgtgatgttaattttgattacctggtcaaggtactatcagtttttctctactggatagttactatgttttctttttgtgtctaataagtagcctgtgggaacagatcttaagatcattcaagtaatttgtttctcttctttaaaatttcttctctatatttagcatgcattgatgattcttccctgaaccaatttttactaagatgattttgcaactctagcactttg

SEQ ID NO: 183126 - DNA, 191 bp, Homo sapiens
tgggaatggtctaccatagggagaactccaattacaggtgagttgagggaataaagtgagtatcagagaaatctgctgcatcttatttaagaactttaaaagctcagatattattttcacagggtagtgatttttaaaccatgcttctttaattctctgaaggttccaagagttttttctggaccaaactt

SEQ ID NO: 183127 - DNA, 319 bp, Homo sapiens
tccaccattgtatatttttatttccaaatcctgtttctaatactctggaagaaaaatctgttctcttttgtgggatacgtaagttaattcttggacggcagcacagcgatcgtttacaggttgttcagtttgaatagctattaatgctcgtgcaaaataaaccaaagagccacagaaacacatttttgctggtgaaaattgtgttcgccaacatcatttctcactccagcttatgatgtcaggcatcatatttctccattattaatgtactatgccagtggggggaggtcctcttggaaggagattaaaaagacaccac

SEQ ID NO: 183128 - DNA, 236 bp, Homo sapiens
tagccggaccaacatgcgaacggactgatcccaacaccgttttcaaggacttcgcacctctcatgttcgtcaaatattggacacgaattcatcgacaaactcaggacatttgatcagtccgttcgcatgaacatgcgcccggccgatctgggggaaaagactttctaagtgcggttgcatcttcagacctcgtctgtcacaatgacttaacagggagggggtaggaggggccctat

SEQ ID NO: 183129 - DNA, 382 bp, Homo sapiens
cttctttctgtactagtacatggcagagggcaaaagggcatcacatggcaaaaaggcaagagtgtttatgtcagctcaggcccctctttctcttcttatagaaccaccagtcccatcatgaaggcctcatcctgatgatctcatctaatcttaattacctccccaaagccccatcttcaatcagtgtatggattttgggactgtgttttcaatacatgaaatttgaaggagacgttcaaaccacagtaatactaaaacttgtaatctgtgatggatacaaagtcaaacacatggtaattcctggcataaatgaaggctagaaccaaggtttgctgactttaagtcacgctccttctcctgccaataatttttctttacagaa

SEQ ID NO: 183130 - DNA, 1419 bp, Homo sapiens
tgcctcagcctctcgagtagctgcgaccacaggcgtgcaccaccacacctggcaaattgttgcatttttggtagagacagggcttcaccatgttggccaggctggtctcgagttcctgacctcaagtgatctgcccgcctcggcctcccaaagtgctgggaatacaggcatgagccaccgtgcctggccaactttagttttcttaaaagcaaattggaaagatattgctatgattagataaaatattgtaaataaagtgttaaactgttgcatagtaagtgctcagtaggtagttgctctcatttttaatatcgatattacagattgatggtaatctgtggattctgagttaaagaactgatgtttgtgatttgttataagagtaggagaccacatagttaatataatacagatttttaaattgtagaaaatgaagatatttcaaccaaccaacaagccaacatttattgaacaccaactctatatccttggcactttgctttagatctagtgtgaaagacagatatatacactgacaattacaatataatgaaatgttgtaatcgcaaaatgagaagaatttaggaactactgtgagagcactgaatgctaacccctgcctagagggtgagtttatatgtttcaggaaaggcttcagcaagaagatattattttactttgattgaaatctgaaagagtttttaaagtgttcaatagtagatgtgagtctgggtgcagtggctcatgcctataatcccagcattttgggagcctgagatgagaggatcactcaggccaggagttggaggctgcagtgagctatgattgtgccactgcactgcagactaggcgagaccttgttaaaagaagaaagggtagatgtgcagaaaaacattaagagaacataatgcaaagttcctgtatctggcttctcagcttatttttacacttgatcatttgtattaggattttaccattagggaaattccaagataattttgtgcaagtagaaaacatggagtattacttaaagtgatgattctgtcaaatggtggttttgacgtacacgtttatatattgttgtggcagaccaagtagatggaaggcagatctaacacctgtgtaattatcagtttttctagctatggtactgaggattcattcttatgtgtgtatatgttttgagttcctatagataggtcagcagttgctaggttgatttcatattttataaattctaatttggtaaaataaggtcataggggagaatattaaatatgccagaataaaactggatcctctttcatatctatgttatatctgaatcaaataatgtttataaaatcattatacatttaatggttgtgtggtaagaatgttggctatttcagcctcaataaactcacatcctttttggat

SEQ ID NO: 183131 - DNA, 156 bp, Homo sapiens
aatctgtactttgaacagtactacaggtggtatttatgcctaggcaagtatgggaaacaactgtgcagaaggataaagacgttcttatctatgactagaccatctgaatgatttggcctttgaaggtgactcaaggttgagcctggatgttggaga

SEQ ID NO: 183132 - DNA, 286 bp, Homo sapiens
gtctgaggtcatctagaggatcccggctatcacattatccaaccaagatgttttaataggtgactagataaataaactgatatatccaattaatgtacaacaggtcctcaagtaataatgtcatttcgttacagtgttgatgattggggaatgttggttttgttgtacaattattttgcttaagtcagtttccaaaaacctatggaagatgttaaatgaagacttactatatatgacattctggagaaggcagaactatggaagcagtagaaagataagtggttac

SEQ ID NO: 183133 - DNA, 108 bp, Homo sapiens
tattgtatctcactgacttcctatacccctgccacagttttaaggattgtcactttataatcagtgattctcagcagggggcagtttttgcccccctagggagcattt

SEQ ID NO: 183134 - DNA, 478 bp, Homo sapiens
gtacccacgacacccactgtcaaataccactaacttaaatcaatccccattatcatacacaccatccccatcattcatatagtcacaccccaattactcaatccctacactacaccattacgcagtgtctagccacacccactatcatacacacagtccacatctccattatcaaacttgtatcatcctccaaatctccttccacacattctcataccacctccatttcatacatactcacaaccaataaccacatcaactctgctctcactcacatatattccccattcctcactggcactcagaaactctttgcattttcccatcatatactttattcaacaaccctattcagacactcatgattttcccactccaaattatcacattttcattgactgtgattacccatgctcactgtatccatctgtcctcacaaagagacacacttctcattttccccagcacacatagacac

SEQ ID NO: 183135 - DNA, 210 bp, Homo sapiens
ctggaggagaaggactgagaaaagacaggtggatcgctgatttaggaggtctctggtgaatagcaggagaattgttagaaaatggggttgaagctaggttacatattaaatgttaagttctaaacaaagttgtaagaacatagaggcaagtatgtacagacgatttttgaagagtgtaacagagaaggactggaaagaaacagaaaggtg

SEQ ID NO: 183136 - DNA, 514 bp, Homo sapiens
gcatgatgttcagtgatttcaaggactgtttcatccttaaacaggaaatcgataatttccatctgtcagaggcatttgaaccagagcaactccatcctgaatagaagctaggtaaaatgaggctgagacctactgggctgtgttcccagacgattaaggcattctaagtcacaggatgagataggaggtcagcacaagatacgggtcataaagaccttgctgataaaacaggtttcagtaaagaagctggccaaaatccaccaaaaccaagatggtgcatcctcactgctacactcccaccagcgccatgacagtttacaaatgccatggcaatgtcaggaagtcaccctatatggcctaaaataaggggaggcacgaataatccatcctttgtttagcatatcatcaagaaataaccataaaaatgggcaaccattttatggttgctgctctgtctatggaatagccattgttttattcctttagtttcgtaataaacttgctttcactttac

SEQ ID NO: 183137 - DNA, 455 bp, Homo sapiens
aaaaaccctaagaataactgtcctagactgtgtgtatatgtgtgtatgaattgggattttattttgtaaaggaccccaggtgattctaaagttcaactaagatggagagtcactgcaccaacccttttcttctcagctcactttgtcctgggcccatatctcatggttttgggtctactgtggaagtaccttctctacagaacaaagacaaagcaatagaacccaaattcttccaattccctttgggatctattcccttcttctcctgcctaccagtatgaacttctatgggattatgctgatgagaaaaaataaattacatttaagtgactgataccaaaaactggaattacttcacagatgagaaacctggtcccagatacagtgcaccttctggacctcagtatcttcaattttaaaatcattgttttgaatctgatttctaattgttaagc

SEQ ID NO: 183138 - DNA, 1600 bp, Homo sapiens
aatagggtagagacaagtttgagtgtcgttgcactcacgtggtgagctgcatgtgtcgtgggctgagtgctagtattggtctgtgatggattgggatcagacccttgtccatgaccataaaatcttgagcaatattgcagcaagccaaatggcaaagatgactatgtgccccaagaccacacttttttttcctatagtttttttaagagagacacggcctcgctctgttgcccaggctggtcttgaactcctaggctcaagcaatcctcccatctcggcttcccagagtgctgggattacaagcataagccactgtgccaagcctccctaaatgtttaaatcttgtcattgccaccattctgcaagatttacctttgaatctagaaaagaacttggagtctttctactaggcctatccccacaccacttcccatcatagaggtgaagaacctgaggccgggacacaccacaggactctcagaatgacacagccagtcagattttcctggcacaaaacccagtgttctttcaaagccaccattcttttcctgtaactaatgcaaaagcaaatcttagcccatgacagggaatcacagattccaaatgagtgccctcagaatgactggtttccttgaaagcagctgtttcataaacatgactttgcgggggcagctcaggccttccatgcagtggagtctgctggtcttggggctgctctgttaagcaaaggatgggaaccaaaggtactgacattttaatattagccacacagatgtcttggcttgtaatctggagaaaatcagtcagtgtcccagctgaatctgtaaataggaacgacaataagatttgctctctctcgggacatcctaagaatttttgtcaggctagaagaggcagcctggagagatttgtttgatctgggaaagcagaagtcaaacttggtttttcattcggtaagatccactgtggttaaaatgtggtcagagggctcattcagcctcctacttcaggtcgaactatacttaccttctcttacttttaaagaaggaagggagattctgtaaatgagtggcttttcttttagtcagtgctgtcatatgccatgacaatattgtatttaagtctgttctcacagtgctaataaagacatacctgagactgggtaatttataatggaaggaggtttaattgactcacagtttagcatggctggggaggtttcaggaaacttacaatcatggcagaaggggaagcaaacacatccttctttacatggcagcagcaaggagaagcgctgagcataaggggggaaaatctccttgtgattcatgcctgtaatcccagcactttaggaggttgagttgggtggatcgcttgaggtcaggagtttgagaccagcttggccaacatggtgaaaccccgtctctactaaaaatacaaaaaattagctgggcatggtggcaggcacctgtaatcccagctacttgggaggctgaggcaggagaactgctcgaacctgggaggcggaagttgcagtgagccgagatcacaccattgcactccagcctgggcaacaagagtgaaactccgtctcaaaaag

SEQ ID NO: 183139 - DNA, 365 bp, Homo sapiens
  misc_feature (34)..(34): n is a, c, g, or t
atctagaggatcccgtgtccatttactccatggncccccagggggtcagacgcaaaagtttagaggtcactggggaccatggaggtgcatctcactggacatcgtagtgttcattgtcttagttcattgttcacagtcatagcagtctgtttaatactgctagtgaagtaaccctggtctttctcgctcaacctatgatctagtgtttggctttattttagcgaccaatttgagaggttttttggttttttttttttttggtatgtgtgtggtaaaatagcaagtttttgcttgtagacttttgggaaacttaattcatccaagtattcattgaactcctgctgtgtattagatgtcatgagtat

SEQ ID NO: 183140 - DNA, 440 bp, Homo sapiens
actctagagttaccgctgatccgcttaagcatgtttccaggctgaggagaagtagtcactggagagagaaaactaggagatgagggagtgggaccaaggacataggtcacatcattctctcagattggagaaaggagataagtctgcaggtgagagaaagtaattgagagaaatcacactagctagcctccattttcttggtagtatagaaggccaagttaactgtggaaagttgaaggaaacagaagttgcaatgggactttgggagagtagagagggtttggaataacagtggaaaggagtaggagagggagctgtccagaggtgttaagtgccccgctgagtcaagtcagtgtcattactgtcatctctgatatccttgcactgagaccgtgaatgtgctgtggcatccagagacatggtttcttatctccttaagt

SEQ ID NO: 183141 - DNA, 177 bp, Homo sapiens
tgtgacagagactgtatgttgctctcaaagcccaaagtattaactgagcccttacagaagaagtctgaacccctgtcttaaatgttggcattttcatagggttggatggctgctgcccatcccccactcctcaacaattcccccggcaatcacataccacctctagggataacttcc

SEQ ID NO: 183142 - DNA, 253 bp, Homo sapiens
ccagttacacattcagcaaatacttattgtacatctactttatgccagtcactatgttaggtgtagttctttaactcttagctttagctgacaataggtagaaatgttatattctttatagcactgaaaatatatttgaaccactaacgaattttgttttactaagaaatttccagccaggcacagtgattcatgcctgtaaccacactcagataggtttttttttaaaaaaaaaatttggtagagatgggtt

SEQ ID NO: 183143 - DNA, 296 bp, Homo sapiens
taagtcccttctacatgccaggcactgtatgtgtgaaatagtcccaactctcaatgagtgtaggcagatacacaaacaaagccttaaggaggtcagttttctgagaccatactgctggacagtatatgaacctgggatacaaacccacctctatttgacctcaaatttgatgctggggtggttttaattttattctgggaatttcagtcattcaaccatgaaaaggtgaaaagtctctgtcagatgtgtgtgtagtggtctgtataataaggtagatatagaagagtgcacttttg

SEQ ID NO: 183144 - DNA, 422 bp, Homo sapiens
gccggatgcaaaactggaatactggatatgaagtgaaatgtataaaagacataaaatgtcacaaaatagtctgatcacaagtgttgattttcctggtgagttggggctgcgtgtttccatgttttctgaaggttcacataaacatgcagcctgccaattctctgtacattttttttttcaatgagtggtatttcggtattcacgtttagttgtaagacagaaattggagacttatatgtagctggagtggatgacttctttcttttgggggaagaatgagagatgcacatttcgttagtaaattgtgaacaacttgaaacaaacccaaatccaattttgaatttaagaagtagagttaaaatgaaaggtagccattcaaatactatgccttgctgccttcacttattaagttaggattttct

SEQ ID NO: 183145 - DNA, 532 bp, Homo sapiens
aggggaacaaaaaacatctgggccttcctgagggtggagggtgaaggataaagcaagtgagaaaaaataacagttgggtactaggcatagtatctgtgtgtcaaaataacttgtagaacaagttcccatgatacaagtttgcctatataacaaacctgcacctgtacctcaaacttaaaattaaagttaaataaatctagagaaggcagaaaaagaacaatgtaaatgcaccaaaaaaggtacaaatatagtagatatttatcaaaatatatcaataaaactttaaatgtgagtgaccaaaatataccaattaaaaatggagattgccaaagtgtccccctaaaaaagcaactacagtcatgtgctatataataactttttggttaatgatgtgcctaatatatgatggtgatcttataagattataatggagctgaaatattcctattgcccagtgacatcatagccagtctaatgttgtagtgcaattactttatttttatataaatttaatataacctaagttaaaaat

SEQ ID NO: 183146 - DNA, 280 bp, Homo sapiens
gccataactaggtggcaccgtgtccatttccccctcctcctctcatgccatggtgagacgcacactgagagcaggacactgggggcagcccttcctgctgcccgctgctgggccattaggccctgctgacacctagcagggcggaaggcctggcagtggagagaagggagcagatgttcccccaacactgacctcgcaccttggaaagaagcaagatgggaggagctgagagggaggacggtgctgagcatggctgaccccgagggctgggctgccgagg

SEQ ID NO: 183147 - DNA, 304 bp, Homo sapiens
acctttactccacgaacccccagacacatgctcattgtaacacatttgatgtgactgtaggcagtaaaccagtatctcacacaattctgaatcaccattttgacaatctagggatatatccttatttgcctttcctatttctatttttggcacatggattctaacaagataacatatatactaattgtcttctggataagcagaggtgttatgatatcacctagggttgcctcactgagcacccatagccattcaaaagacccagcttggccaggcgtggtggctcataccagaactttgggag

SEQ ID NO: 183148 - DNA, 357 bp, Homo sapiens
atggagactgaacttaacattaaaaacaaattaaaaaatgaaaagatagggatgtaaaagtatccacatgagctgataccaaggagttggagccaggctccagggaatgtaaattgggagaataactaagtttcttccatacctctaagaaacattggcaacactgaaatcagagactgcagtgccctccctcccaaacctaagaaggaaggctggaaaagatggcttacctggaaggaatgggcttctggaagtttcagagacaaagacacagcttcagaaccagaagctgagccatgctgctttcttggcccagggcctggatccgcagtatcgctgataccacaactgagcagg

SEQ ID NO: 183149 - DNA, 370 bp, Homo sapiens
caaataagagaatttagcaaggtcataggacacaagattaatatacaaaagtcaattaccttcttatatgccagtaataaacaaatagaattgtaaatttaataaactaaataccttttgaaatagcatcccccaagatgaactactgagatataaatcaaacaaaatatatacagcatctgtatgcagagaactaaaaaacaaaaacaaaagaaatcaaagatctaaatcatggagagaatgaagagacaactatggaatggaagaacatcctgcatttataaaccatacatctcataaggggttaatattcaaaacgtataagaaactcaaacaactaaatagcctggccaacgtggcaaaaccccct

SEQ ID NO: 183150 - DNA, 290 bp, Homo sapiens
ctgagggcagcccaggggtgggtagggcctgtttctaaagaagagaacccagcactcggcaaacatgcactgatgctggtgatgatctttggatgatgatggtgatggaaactgattccatctgtgcaccacagcctgacggcagggcgggctcaaacacaggggcggcagttaccctcctgggcatcgctcccacccaccccttcccgccaggaaagctgtccactcacaccctgtccttccctcgagaggaaaattcctgtagtagacctcatgggccagaggcagtg

SEQ ID NO: 183151 - DNA, 356 bp, Homo sapiens
ttggtgtttaatcattttccttttgatctaatttccttagagaaatattttgtacttgtgctctcaggccagattttcctgtcacactgcctgaactagatcagcggcttctctgccctttaatccttgccctgtttaccatcagtaacaattgtaaactagtgcctcatcattataaaggcagtaactatctttcccattgatgggaagtggtgattatttacttaggcttgtgttagtcacagatgcttcaaatagcttgatctttttctttaagcatttatacgtgatcagcaaataggaaacatggatgaaaccgcttattccttaaaatttgctaatagaatttatccgaa

SEQ ID NO: 183152 - DNA, 568 bp, Homo sapiens
acttttacccattgcttgtgagaacataaatgcttgaaagctatttcagcagtacttactatagcttaaaatcttgtacactttacaagccagctctacttctagaaatctgagagaatttctagcacgtgtaacctaggagatacatttcagtttattaattgcagggttgctcatagtattaatagcaagaaacaatccaaatataaatcagcagaaaaaactgaatatattcatacattgaaatacatcatacagtaatgttaagtaaaataagtcacacaaaaacataaaaagtatgattctatttatgcaaagttcaaaaacagaaaaaaatgaaacactatattatttggggggaaatagacaagtaatgaaataatgaagaaaaacaagggaataggttgacataaaactcagacgagtagttacctctgtggggaggattgtgattgaggagaggttcacagatgccttctaaattttgattttttaaatctgtgtaataagtatacaggtattcattttattttctttaaacttttcagttgttttaaaacactgttct

SEQ ID NO: 183153 - DNA, 109 bp, Homo sapiens
caagggaaacagtattccataattaatctattaggtggtattgcagacgttctcccattctctctcaccctcgcatcaggagagtttggtataatagccccagtttgct

SEQ ID NO: 183154 - DNA, 859 bp, Homo sapiens
ttctaagcacattttgattaggctaggctaagctatgatgtttgataggttagatgtattaaatgtgtattcaacataacaatactttcaacttactatgggtttatcaggatgtgaccttacgctaagttgaggagcatctgtactgtatttctaaaggaagctgggatatgaatatctggcattttcaagcttcttaatgaaaaataggtactccatcttattagtattgaagaatctcgagtgtttcccatcttaaaaagaaaacacaagctccctcaacctcactttcccatccagattctgccatgtttctgttttctcatctatagacaatattgactattctcaaccccatttcttgatgaactcttcaatccaccagaatctggtgtataccctcattaatctccaaaactctttttcacaatttcgctaaaattcatggacaaatttcagttttctggtttgatatttcagcagtttttgtcaatgatcattccttctttatgaaacacttgcttctgcggcttctttgatacttctgtgttttgggttttcttcttttggaggctgcttcttgcccttcaagttcctcagagctctgctccaggccctattcttgtctaaacatactccataagcaagctcatctacctttatagcctcatttaccacttacagactagcctaggcctctctgttgagttccagagagaactttatactagatatttcttttggggtgtttcaaagtcatctcaaagatgcctttttatgctttaaaaaacatacttaagttttctccacttctagtattgcttattgtaggaaatgacaccaacgatcaaacacctat

SEQ ID NO: 183155 - DNA, 507 bp, Homo sapiens
gaatataaaaataaataagacacagccgctttcctctttaaatgaataatccagctaggaaaactgaaaatgcccaaatactcgaaataccaaataacgctgtgatagaggagctacagtagaccttgtgcatcctgggcaggaaaccacaggctccatcagaggaaatcagggaggcctccctgaggaggttatgtatgaatgggtcctcgaagaatgactaagactctggagacaggacagagagaggaggcggcattccagacagaaggaaggtaatgccaagacacacagagagaggtgtgtgctcgggccagattacaggggcctggggaacagtgggcagaagacgcagctaggaaggaaccaggctctcttatgttacacaaaggaggatggccctaagtggttcttaagtaggagagtggtgagctcatactggcatgaaagaggccaagggacagggtaatcaaaagaccactgagatcagtgcagtgaggggtgacg

SEQ ID NO: 183156 - DNA, 556 bp, Homo sapiens
cctgcaaatctatgcagccataaaaaatgatgagtcatgtccttgtagggacatggatgaaatggaaaccatcattctcagtaaactatcgcaagaacaaaaaaccaaacaccgcatattctcactcataggtgggaatggaaccatgagatcacatggccactcaataccggtattgtgtggccatgtgaaaaatctgaacatgaacaatgaacatgaacaatataaaaaacataatattgagtgaaaaaggaaattgcaaagggataacctatcagtgtgttagcagtcattcagtcaaacatttttattctttttggagaatcttctatgtggcagctactatcctagacaataagcatgaaacagtaagcaaaaccattaatataaatttgaaataaatactgtatattatcatgggcacatattaatgtattaacattaaaggattcatatggcagggatatcactaaattcatttcacttttttaaatctaaagaaaacatggtaaaacatttacatatttggagctgggttcaccagtgactgttctac

SEQ ID NO: 183157 - DNA, 2110 bp, Homo sapiens
cgcgggggcttctcggggtccacgcacgccctgcgccgccaggacccgagcggagcctccccgcggcccggccgcgcctggtcctgagcggtaccatgatgtggggtgcaggcagccctctggcctggctctcagctggctcaggcaacgtgaatgtaagcagcgtgggcccagcagaggggcccacaggtccagccgcaccactgccctcgcctaaggcctgggatgtggtgctctgcatctcaggcaccctggtgtcctgcgagaatgcgctagtggtggccatcatcgtgggcactcctgccttccgtgcccccatgttcctgctggtgggcagcctggccgtggcagacctgctggcaggcctgggcctggtcctgcactttgctgctgtcttctgcatcggctcagcggagatgagcctggtgctggttggcgtgctggcaatggcctttaccgccagcatcggcagtctactggccatcactgtcgaccgctacctttctctgtacaatgccctcacctactattcagagacaacagtgacacggacctatgtgatgctggccttagtgtggggaggtgccctgggcctggggctgctgcctgtgctggcctggaactgcctggatggcctgaccacatgtggcgtggtttatccactctccaagaaccatctggtagttctggccattgccttcttcatggtgtttggcatcatgctgcagctctacgcccaaatctgccgcatcgtctgccgccatgcccagcagattgcccttcagcggcacctgctgcctgcctcccactatgtggccacccgcaagggcattgccacactggccgtggtgcttggagcctttgccgcctgctggttgcccttcactgtctactgcctgctgggtgatgcccactctccacctctctacacctatcttaccttgctccctgccacctacaactccatgatcaaccctatcatctacgccttccgcaaccaggatgtgcagaaagtgctgtgggctgtctgctgctgctgttcctcttccaagatccccttccgatcccgctcccccagtgatgtctagctgagtcttcatgacccttcaaccctgattactacagaattccagaatgttaggctctccagggcttctttccaaacccccagctccacaccccccagacccagctggttctggagttctaggacattgggtgtttcaaggttctgttcagatccctatgggggcccagctggctccacggttccagaatgttcaggtggtcagtgttctactcagaaatgtctcacagcccagctgggttgcaattccagaatgctgggagttttacagtgccattccaagtcccagatgtccctcttcccccaaacttgaccttgaccatgtcactttacgtttgaatttctgagctaaagagtcagagagattagtcacatagttgcctaaataggagagagaaagattatatatgcacatatacaaagacagtgtctatttatgattgatttatttatttataaatttacttatgggtggtaaggggcaaaaaagaggcccacaccttgatatccaggccataccagggtatcccttgtcccttcacccccatttctgacctcagttcctggaggggggaaagggtgaaagagaaaccacgtattttgttattattttggattattttttatcgaagagatcatagaaaccagagccttctccccaggcctgccctcctcgggtttggaaggggaacacaccagcctctggttttttatttttttaagaagccatcacctgagcaaccaaaaattcctctgcgctggggtccgactgccctctggtggccatttggggaaaactgcagcccggccaggcagctgggaccagaatgcaaccccagctccactccagcctggcgtccagggccacagccatggcctgggggccaagcctcaccctgcggtgccctaaaggagggggggcacgagccaacaccccacccctctgccaaccggggtatggcccccagtgcattccctgttcccgtctccaacccaactcaataaaaaatgattttgtcataa

SEQ ID NO: 183158 - DNA, 504 bp, Homo sapiens
aggggggtcagataccaccgagggtgaccagccccagggaaatggacgtgtgagctagggtgctgctacggactgaactgtgttgtccacccccctcaaattcatacattgaagccccagcctccaatatgatggtacttggaggtgtggcctttggaaggtcgtaaggatgagatgaggtcactagggtaaagccctcatgatgggattagtgtacttaaaacaagagataccagagagctggcttgcctgcctgcgcacactctctgctatgtggcaacacagcaaaaacgaggccatctgcaagccaggaaaagggcccgcaccaggaaccacgttggcccgtacccggatcatggactttccagcctccagaactatgagagataaatatgtgttgtgtaaatatgtgaagccaccccatctatggtattctgttacggcagtctggacagattaacacaggtcaattctgaaggtggattttttttttttgagacagcg

SEQ ID NO: 183159 - DNA, 351 bp, Homo sapiens
tcccttcatttatccaccagcccactcaacactgacactggatgccttacaacgtgtcagaaccagcatgtcagaaggcaagctcttcatttctctccatcccctgttcctcgcttgccccctatccccactagcctccttgtctctgaacagcattgcacacaccctactgaccaaagccctacggaggggtccctggtctcttcctgctactggatgtgcaacaccatgactgggcctgagggtgggtgacccctgcacctgatcctgaaactgggctttgagattggaaatccccagacctggggtgagcttgcatttagtccattagcagctctcattggctccacc

SEQ ID NO: 183160 - DNA, 677 bp, Homo sapiens
gtacccatctaccagtcctcaagtagtttctcaaactggagtctctagatattctcaggagtctgagaattctctgagatataaacagttttgtggttctctgtgtagatgcaaacaccatacatctggtgtctactggagggtggagttgaaaatgatcattgtgaaacaatgccagaatctttctgaaacttttgcaagcagcaaatttgaacagctggtttgtaactgaggtttttaaacttcattcagtctaactgtatgaagtgccttacgtggctgttatggtagctgagaggaaggatgaactggagactgaggacaccacccccattttaacctggttggccctacttttatttgtattatatattgtggctcagtgaagatttctcttgggagcttctctccatctaaaagttttgaaaaccactggactaacaggtttatggcttgtggttttggtaggggaatagggaaaagtagcaatgtatccttataaagaggctgtatgtggctaagttatttgtaaatagatttttcatagttaaccaaacaaagagtccttagaaatttttactgctaattgggaatgttattccagggttatcttagattggtagatagtagttctcaagtttttcggtctcagaaccccctcacagtctttatttatt

SEQ ID NO: 183161 - DNA, 205 bp, Homo sapiens
tcttgttttccttgttaaatgtccaagttgaagagatccctaatagatatctttattacttagctcttgtttccattataagattagtgatcaatagataataatggtacaataatatttaaattgcatcttacagtttaggaggctcgttcatgggcatttttcagtggggagagattgtcaccacaattcagtaattacgaca

SEQ ID NO: 183162 - DNA, 515 bp, Homo sapiens
cccatgattcagttccctcccaccatgcccctcccacgacacacagggattacagggattaagattcaagatgagtttggatgaggacccagcaaaaccatattaatttcataaagtgaggtagcatttgtgctttgaccctgcaagtccattaccaggaatccaccctggaaatgcatctgcacaaatacaacatgcatccagggttatccacagtggtattgtctgtaataaaagaatggaagcaacctaaatttcaaacaagaggaaattagttgaagaaactattgtacattgtcacaatggagtactatgcaaatgtaaaaaggatttttaaaatttctatttactgatttggaataatttcagcatatattcttggtaataattccagcatatatgtttggaataactccagcatatatatgcccaggtatagaacagtgtttatatgtgcactacatttcatgaaataagaaagagaaatgagaatatgtgtgtgtttacttttgatc

SEQ ID NO: 183163 - DNA, 341 bp, Homo sapiens
cctcctaccccacgaccacctcaaaacacagaaggcaaaaggaatggtaacttccatccctaattttgactttgggttatttgtacatttacagcaacagacaccaacttttatttgagatttggggtcattttggcatcgtttcagggtggagagaagacataaatgaagttaggacttcccagtccatctcaccaagctcaggatctcacagagctataagcaggcaaaggtgctccccaccagaaccatctggacaatgtgctttccagtgacttctttttttttgaggtttagctaggtctttttgttttgtcagtacatggtaactagattgatgg

SEQ ID NO: 183164 - DNA, 375 bp, Homo sapiens
agtatatcacacactttgagagcatactgtgactgtggtatgacattgtatacttgcttatctttggcctttccaactaaagtgcccataagccccagccatgattagctatgacctaaacaaactcttttgagccagttgtaagctataaagtttcggtattggcattatggaagacaaaggttaagccaactccttcataaactgataaagtataacacattgataatataagacaaattcctttcaaacaactaagggtatattggtttaggagaattaattttcttggaaaattctgtggtttcacaaaacagattgttaagttctaataatgtctaaatgtatctctgatccaaataaatgtgatataat

SEQ ID NO: 183165 - DNA, 3060 bp, Homo sapiens
cagctgtgaagatactataaaaagggaagagaaggaccgagacagaagcaacaacggaactgtcagtgcggagtagggctaaactcagttccattgttaagcaaggaaaaacaaacaatacattgaatttgacaacccactgaagttgcagataatgaggacttaccattatataccattattcatctggacctatatgttccatatagttgacaccatcctattacaagaaaaacctaacagttatttatcaagcaaaaagatagcgggtctgacaaaagatgacggtaaaatgctacgtcgcaccaagcgtggctggatgtggaatcagttcttcttattggaagagtacacaggtactgacacacaatatgtaggcaagcttcacactgaccaagataaaggagatggaaatttaaaatacatactaacaggagatggggctggcagtctatttgttatagatgaaaatacaggagacattcatgctgcaaagaaactagacagagaagaaaaatctctgtacattcttcgtgccaaggctatagacagaaaaactgggcggcaggtggaaccggaatcggaatttatcattaaaatacatgatatcaatgacaatgagccaaaatttacaaaagacttatacactgccagtgttcctgaaatgtctggagtcggtacatctgttatacaagtaactgcaacagatgcagatgacgccaactatggaaatagtgccaaagtggtctatagcatattgcaaggacagccatatttttcagtggacccagaatcaggcataataaaaactgcattaccagacatgagcagagaaaatagagagcagtaccaggttgttatacaggccaaagacatgggtggccagatgggaggcctttctggaaccaccacagtgaacatcacgctgacagatgtcaacaacaaccctcctcgatttccccagagtacgtatcaatttaattctcctgagtctgtacctcttggaactcatcttggaaggataaaagccaatgaccctgacgtgggggaaaatgcagaaatggagtatagcattgctgaaggagatggtgcagacatgttcgatgtcatcactgacaaggatacacaggaagggattataactgtcaaacagaatttagattttgaaaatcaaatgctctatactttaagagtggatgcaagtaacactcaccctgatccacgattcttacacctgggacctttcaaagatacagctgtggtcaaaatatctgtggaagatatagatgagcctcctgtgttcactaaagtctcttacttgatagaagtagatgaagatgtaaaggagggcagtatcattggacaggttacagcatacgatccagatgccaggaacaatttaataaagtactctgttgatcggcatactgatatggaccgtatttttggtattcactcagaaaatggttctattttcactttgaaagcccttgaccgggaatcatctccttggcataacatcactgttacagccacagaaataaataacccaaaacaaagtagccacatccctgtcttcatcagaattctagatataaatgaccatgctccggaatttgccatgtattatgaaacatttgtttgtgaaaatgcaaaacctgggcagttgattcagactgtcagtgtcatggataaggatgaccctccccgaggtcacaaattcttttttgaaccagtgccagaatttactctcaatccgaatttcaccattgtagataataaagataatacagcaggaatcatgactcggaaagatggctacagtcgcaacaaaatgagcacctacttattgccgattttaatctttgacaacgattatccaattcaaagcagcactggtacactcactatccgtgtgtgtgcctgcgataatcaaggaaacatgcaatcctgcaccgcagaagccctgatcctttcagccggcctgagcacgggagctctcgttgcgattctactctgtgtcctcatactgcttattttagtcgtgttgtttgctgcattgaagaggcaaagaaaaaaggaacctctgataatttcaaaagacgatgtccgggacaacattgtgacctacaacgatgaaggcggcggggaagaagatacccaagcttttgacattggcacattaaggaatccagaggcaagagaagacagtaaacttagacgggatgtaatgcctgaaactatttttcagataaggaggactgtgcctctgtgggaaaatattgatgtacaagattttatccatcgaagattaaaagaaaacgacgcagacccaagtgcacctccatatgattcgctggcaacgtatgcctatgaagggaatgattccatagcagattcgctcagttctttggaatctctcacagctgattgtaaccaagattatgattacctcagtgactgggggcctcgtttcaaaaaacttgccgatatgtatgggggtgatgatagtgaccgagactaagaggattgtttgacttaatcaatattagtggaagtactgtctatgttattagattgagtggcctgcattctcttcctgggaggaaatctttcaaaaattgaagttacaaacaatacgtagatgttgtcaagtagggatttgcttaatcagtaagtctttgtgaatgaatacgaatgatacagatttttaaaaaagtaataaccagttcaccctctttgcctaacaatctcggaaggaaaatatatcacatcaataatcaataaaaataagtaaaaggctttttgtgccttttcttaggtataataatttataaatgttttcttaactgactttcagtcacctttacaattaaactaaatattgtgcaaccgctttgtaaattaatatgaagaagatatatccctaatgaaataggaatgactattactgccatatttatttagttgaagaatgtctttgtgttaattcattcatatttttataaatgtatatttatatttttgtatttttatgaaataaactagtatttataaaac

SEQ ID NO: 183166 - DNA, 827 bp, Homo sapiens
tctcagccttgatgtcctgcgcagcccaaacccagcccctgcttctgtgtcttccatcgagacgtacgggatttggggacatgttctcagttccatatcctgctgtgagctaggaaggtgcctggtattcacctgcctcattttctcctccttgggcaagacaaagcagagctctcttaggaaccagatgagtacagatttcaaggaagtatctagaaccttgatatcattgctgaaatcaagagctgaatatagagaacatcttggcttatagatttttttttaaatcctgctctgtttgagttgttcagtgccataccctattacagaacaaattatgtgtggattattagttataccggcaggtaaaccagtgactaaggccccatcctttaccctgggagctattatttttctgcctgtggcatggttcatttgctaattatggttgttcctcagagtcagtaacaggaaatgacaacagtaaaccatccatggtggggggtgcgcctgagtgtgagagaacgaaggagggattgagaccagtggatttcttgagggcctcccccacttcctcaagtgatttaacttctctaggttgcagtttccttatctcaaaaaccgggatgatgacccacagcttccagggtgttgagaggattggacataacttgtgggtcctgttgccattactcatgtgtgttgacatgggaaacagcaagagcaacatgctcttcaaatacccagagcagattcctggagagacagtccatgaaccaaaggaagcagtttttttttaacccttttattttgtgagtcagtgacca

SEQ ID NO: 183167 - DNA, 109 bp, Homo sapiens
tccccaaatagtgtgtctgttttcttgatcattgtcctattgcttgtcttctctgatgtgtctgtgtcagtaagtcacctctgtgaaatgcaagaacattttaaaattt

SEQ ID NO: 183168 - DNA, 153 bp, Homo sapiens
ctacaagtaattttgcaaaagtgaaaagttgaaaacaacccaaatgtacaaaaataggggagataattatggtacatttgtataatagtatgccacttggtcattaaaaatgccatagaagtatatttttcataaacttatttctagctgctg

SEQ ID NO: 183169 - DNA, 856 bp, Homo sapiens
aactcaaaatgtagcaggtgagagaccagccagggctgagctttggaggccctgagtgacacagtagctgtggagttaataggagtgatcctgattcgttacttaggatccatttctttgtaaagcacatgcatgcatggcccctctggcccccgaccctgagtcctgggggacactgcagtacacggcttgctgtcatgttctttagtcagagggacgacactaaaaagagggtttctgctagtgatggatgctgtagagaaaatagaacagggttggggcagggcaagtgtgtcctctctgtgttaggtgattagggaagagtttggagagagtgccatttgggctgagatttgatcatgaagagccagttgtgtgaatatcattgatgagcatgagggccaaggaagcaccgggaagtcccaaggcagggaccggcttggaaaggaacaccaagaaggccagtaaaagaaagaaagccaagaaggccagtaaaagaagagccccaagaaggggctcgctagtgtccagtcttgtaaagtttcattctgagtgaattagaaagccactggagggtttatgcaggaaaaggaggtgggtagctggggttctgtaagttaacacataaaataatttattttgactcatctgcaagtgtgtgttctaggtaatttcgctttaaaatggtactgtgattcctctgaagtcatttattatgcaaattaaggacagcttgtcagaacctctgggtttcttgtgtcttgcattactagctgcaattcgtatttttcccatatttaaacattttctttttagttatgttctgtgatatatggaagggaaatgttcatgtagt

SEQ ID NO: 183170 - DNA, 439 bp, Homo sapiens
agggagggaaggaaaagaagggggagggggaggaggaggaggaggaggtggtggtgtaaggtcttttcaacaaccaattcttgctggaactaagagtgagaacttgctcccaggagaatggcaccaaggcattcatgagggatccaccctcatgacccaagcacctcccaccaggccccatctccaacaatgaaacttcagtgagatttggcagagccaaaaaacccacatccaaaccacagcaggtacacccatgggaagcgctcaatggatgatggctatgacaacatcactaactcccaagacgaacaaagtatttcatctttacacagttctaattgtgaaaaatgtattccttagactgtgttagcatctatttccctttaccttccactcctgggtcctatttccagcctgggagtaaacataggataaaccc

SEQ ID NO: 183171 - DNA, 479 bp, Homo sapiens
gtggtaaatagagaccattcccctccagtcataactgctgaactgcttaatgtttcagactaatcataggtctacttgcaagcatggaagggataggatctggttcaataggatggtaccactggaggttcacatatttcagagcggcccttccctgaagctcaagaactgaaatttcctccaggctaattgcagtgttgagacttctgcttcccccatggggaataaagaaggtgtaaaccaaaaagtgtctgagactcaatccatttagaagtttattttgccaaggttaaggacacatgcccgggagacagggagacaagtctgtgcctttctacaaagatgattttgagggcttcaatatttaaaggggaaagggcagacactggggaaagagggagaaatgtttaaaaggtgtggggaggtaagaggcaagaggtcgcattcttctgagtttttgatcagtccgttcgcatgtt

SEQ ID NO: 183172 - DNA, 460 bp, Homo sapiens
cattcaaagcagtgagcacgttcaagtggctgctttacagtgctttggggataccagccacagtataggttcggtttcagaacacttaggcatctaggatgggaaagaacaggacttgaagaggccaggagcgagaaacccctggttcaaaacaagagtgcatccaaggtccagaaagtgtcagtaaaatcggctagcaggctttgtttctgcaggcaccacaaactctattccaggagtcttcttgggacaccctattatgaacaaggcatcgctgcttcagagccagggtccccatctcttactgtcagccatgcaacaaaagatcagaccagaaagggctcacctggattgatcacagaagacatttaggccaaaaagtttcagatttacctcccactgcagctatgaccagaccctcatcccctaggcacctggtatctgcccaactgaacttcac

SEQ ID NO: 183173 - DNA, 540 bp, Homo sapiens
aaatgaaagaaatctgtcaaaatgctattccaggaaaacaaagctcagtggcagaatattttcatgctcctctgcttgttgagatggtcactaatcttttcaacaacttccattaaattgcacagggaaagaatctaatttaatgtgcatactcaaattgaggatgctttcccatggtagtcatttcagacctttaacattgcaagtgttaagtttatgtgggtaaaactgataactgacatggttccgaggaagcactatgtaagccaagccttaaaagttttgttctaaataggctatttgtgaaagcaactttctatgtgacatgacttcacaaaacaaccccttaaatggctctgattctcttaggtactaaatttatatcccataaattgatgtagatgataaacaatcttcattttttaggctaatgacaaccaatcaaaggatcagtgataatcatcttacacttgttaatgaatttaccaactgacttttattcagaaacatttctggtatttctgcagaaatggtatttct

SEQ ID NO: 183174 - DNA, 466 bp, Homo sapiens
ggctgcagtgaaccattatcatgccactgcagtccagcctgggtgatacagcgagaccctttctcaaaaaaaaaaaaaagactagaaacaagatattcatcaataagataactcattaaataaagtgtgataggtccctccagtgggcttctatgtagaagtggaaaagaatgcagtaaatcgaggctgggcgcggtggctcatgcctgtaatcccagcactttgggaggctgaggcgggcggatcacgaggtcaggagattgagaccagcctggccaacatggtgaagcctggtctctactaaaaatacaaaaaaattagccgagcgtggtggtgggtgcctgtagtcccagctactcgggaggctgaggcaggagaatggcatgaacctgggaggcggagcttgcagtgagtcaatatcgtgccactgcactccagcctgggtgacagagcgaaactccttctc

SEQ ID NO: 183175 - DNA, 318 bp, Homo sapiens
cctctatccaaccctccttcccacaagtaaccactatttgaagttggtgcacatcatttgcatggtttcatatttttctacatagatgtgtccttaaatattgtgatctgtttagtttgttttaaagacttacacaaatagaatcattcacatatttttttttttttctgcaagttgctctttacactcatcattgttttcgaaatttatctgagctggtagttacagatctagttcagttattttaattttaactgtgcatagtatcccattatgtataaatcatatttcacttacccatgtcccttctgatggcta

SEQ ID NO: 183176 - DNA, 537 bp, Homo sapiens
gaggatcagttgatcccaggagctcgaggctgcagtgaaccatgatggtgccactacactccagcctaggtgacagtgagaacctatgtctaaaaaacatatatatttggtatacgggcaagaaccccaatttgaaggaaaggtggagaatatactgtaattttgacttattttgtaatgatcatgatcagactcataatgttatctgctatttggtgtaatactggtatatctggtaaaattaatttgatgtgttctgatatggtttggatgtaagttccttgcaaatctcatgttgaaatgtgaccttcaacgttggaggtgggcctagtcagaggtctttgggtcatgggggtggatccctcatgaatgggttggtgctgtcctcatggtagtgagtgagttctcactgagttcatgcaagatctggttgtttagaaaagcctggcccctcctgcctacctctcttgctccctccctcaccatgtgacacgctggctctccttcactttttgccaaaattgtaagcttcctgag

SEQ ID NO: 183177 - DNA, 176 bp, Homo sapiens
agaaaaagcaggaggaggaggaaaagaattcagagactaatttcttttcccagtccaatttaataagtgagactgctcatatgagggtccacagcctgaatctgagaaacttctgtagctgtccacagtgtttaattatcaccgcccctcagttgcttctcctatttctcaggaga

SEQ ID NO: 183178 - DNA, 287 bp, Homo sapiens
tcctgtattccacggctcagggcccagcaccactccaaactctgcttttatcatcgcatttccttctctgactttgattcttctgcctctctcttccctttactaacaccctgggagcaaacccagaaaatccaggataatcttcccatctcaagatccttatcttaatgacatctgcaaagtcccttggttacataagctaacatatttagaggttctaaggattaggatatggacaactttgttgggccattattctgcctatcacagatggttatgggcaccat

SEQ ID NO: 183179 - DNA, 436 bp, Homo sapiens
agggaggcctaattaagcaacaggatgctggattctggtttttggccctgtctcttccctgctgtgtgactctcccttctgaggcttggattcttcacttgtaaagtgagagttaggggcagatgagccaggagcggtgaggacactttgtgctctgtaacttactaaggtggtaccttgggccgtctgacagccctcgagagagagtttgctcagccgtggagtgggaatgagaacagtgccctctgaccacccctcgggctgctgagtgggctgtggccacctttgcagtggatccagtactgtgcggatgtggttgagtgaccaaggagggctccagtttccttaaccctgtagacgtgtatctttccccatggactcttgggtgtcccacagttgggcagagattgcagggagagggcagctaaaccctagg

SEQ ID NO: 183180 - DNA, 577 bp, Homo sapiens
agaagacggggtttcaccatgtcggtcaggctggtctcaaactcctgacctcaagtgatccacctgcctcagcctcccacagtgctgggattacaggcgtgagccactgctcctggctgtctttgaagggatcggtccatttcatctagtttatcgcttttgtgggcatggagttgttgtttttaagagttgtttgtattattcctttaaagtgggtggatccgtaatgatgtcctgtctttcatttctgatattagtacagtcatatctttcttaatgacaaggattaaatattctgagaagtgcgttccatggttcatcattgtgagaacattatagagtgtgcttaacaaacctgggtggtatagccatgtgggctgtatggtagagcccattgctcctaggctccacacctgtacagcatgttactgtgctgaatactataggcagttgcaacacagtgggcccctaaatatttgtgtacgtaaacatagaaaaggtacagtaaaaatacagtataaaagataaaaaataacacttgatacggtttggatgtgtggcacgtccaaatctcatg

SEQ ID NO: 183181 - DNA, 546 bp, Homo sapiens
ggtgtcccaccatgcagttcaattgtgacactagaagtttgcaaatttggaggctgccatgagccccaccctcaggttcaataatttgctagaatgactcacagaactcagtaaaacactatttatacttaacaactatcatttattataaaggatagaaatgaacagcggctgaagaggcacaggaccaggtctggaagtgccctgagtgctggagtgtctgtcctcctggagtcagggttgtggagttagggtgcaccatgttctggcacacagttgttagaaacaagtgcttggtgccgtaaagaaaaactagcacttagaagatttctcaggaaggcacatttacttctgcagaaaggtgctgcctgcgtccgaccgaccgatcgtaagagcacaccgaaaaaaggagataaagatttttatccctaacacagctcctgttgctgtatcctctcgccattggctggagtcagactgcacaatctaactaactcaattggctaagacttaaagttttctaactatgataaacatgcagtttgc

SEQ ID NO: 183182 - DNA, 352 bp, Homo sapiens
gcaaagcagccagcccggcaggggtgggagggctggacagcagaggggaggcaggataaccactgagccaggaaccaggaggggaggagccatcttatccacccaaggacaccagaggagtgttctctccaggaggctccaggccttatagccctgggtcttaacccctgccgcagccctcgctccagtgtctctctccccagtcttttcatccctctccatccctttcttgatctccgtacacactcataccacccaccctccctccctctcttctcccacttcccctctctcctttctcaccatctctcctcattatgccttctctactcgatcacccctttgcagagaa

SEQ ID NO: 183183 - DNA, 314 bp, Homo sapiens
ctccccatgtgtacagcaagaggaggtggacagcacacaggaggggaggagccatcttatccacccaaggacaccagaggagtgttctctccaggaggctccaggccttatagccctgggtcttaacccctgccgcagccctcgctccagtgtctctctccccagtcttttcatccctctccatccctttcttgatctccgtacacactcataccacccaccctccctccctctcttctcccacttcccctctctcctttctcaccatctctcctcattatgccttctctactcgatcacccctttgcagagaa

SEQ ID NO: 183184 - DNA, 245 bp, Homo sapiens
agatccacggacgcattcaaaggaggggtgaagactgcagactggactgctaaggagaagagatattttgccacaacttgagacttctccaggtcaggatgaagtaactgttttcctctcagaaatgtcagagcttctgcctgtaagacaaggcagtggttcaaatgtgtccaccaaagttcatatcttagaggcttgatctccagtgtgatggtgttgaatgtgggaggtgggaggtgctgagg

SEQ ID NO: 183185 - DNA, 836 bp, Homo sapiens
gagaatggtgtgaacccgggaggtggagcttgtggtgagccaagattgcgccactgcactccagcctgggtgacagagcgagactccatctcagaaaaaaaaaaaaaaaaaacctgcagtcaggaatatctcctgctccggtctgtgcgctctgtgccctcgagctcccaggtgatctgaacaggaagctgcactggcccctgtctctaggtaaggaggataggacccaagcattccacaggccacacccagacagttgccagccttccccatctacaaaacctcagccgtggaagttttgcgagctcattcattcattccaggattttatgaaagcatttactcagtggacgtgctgcatctaggccagccgttggtgtctggttaatcaggattcctggtaagtgagttggtatttggagtatctactcagaggtggacgttccagcttccaggaatctaggatatgacagagtacttcaggctggtgcctccagattagcggagaccctgggctccagccacactctctgtagcagctttcagagtccttttcctttgtcccttctctgtcatcctagcgctgagagagctgggcaggcccaggttcttagccccattctaggaatgcagcaacccaggctcagagagcctcaacagcctgccctaggtggcagtacccggattccatcccgtttcctgactcaattccactgctgcctctgtgctaccacaaatagcaagacttgtcttagctatgcccgagtgctggagtgtgcagctgactgctgggaagaaccagcttggaccctttggagaggggctctgtccctgcc

SEQ ID NO: 183186 - DNA, 147 bp, Homo sapiens
agctgatgggtgctatgaatataaactacgataccattgcttaatagagagatgtttagtcagaggtaacattttatttttattatctagtcttctgtcttaatttatttctatcttattcactctatttattgaatgaaattaagt

SEQ ID NO: 183187 - DNA, 799 bp, Homo sapiens
cgctcaaccccacccttgataatccctaaagaaatccacctgcatatttctccaatactgcccacccctctgttggcacaaagcattgttcaaattgagaagggtgcaacaggagaaagaggaaaatgaaaaatagtaatgaccttgatacattttataaaacaatttgaggaagttgcctataactctcttgctttcaattcagaagaaggcagatacaccaagaaatgctggaaaaccccagccaagaacttcaaaatgtgtatattttcttgtagctactgaaatgcctgtcctgccatggggtgactgtcagggcctgagaaagagccccttttcttggggatttgggaagaggaagttcttcatatcagccaaatgggcaaaatcacaagcttctgctgggataaagcattgtgatgatacatgctttctgggcctcacatccccaagaaaaagagtcctagagattaaacaagctcccaagcccatattcctgaaatgaattaagagctggaaaaatcaccttgacctggtagcagtgggggagggtgtgcgtgtgtgcacaactctgtcctggtcacgttcaagtctgaagccctttttctctgttgttctgctttgttgagtagttccagagtttaggtggggtttcccgaaggatttaggataaggctgacttggggatgagtaggatgatgataattattgccaccagatggtgaaacaaaagacaaaaataaaaccaccgtggccaggtgcagtggctcaagcctgtaatcccagcactttgggaggc

SEQ ID NO: 183188 - DNA, 469 bp, Homo sapiens
gataatgtcgtgctgaaatgagagctttaatgagatgcattgtgttttgattctgcgttttagatatctgtggttcactttcagccagcctacattgcaggtcttactgcttctttcttcgcagactggctatcgtggggcaaacatgtcttccgcttttagtaaaactccttatatgtttggccagggtacagtctctttttgggagaacaaattgtttaaaacactgtttgcctggcttaaagcatacttgagtggtttattaccttgttcataaaatctatataacattaaacaaataatctgattgtgtagagaaggaggtaggctgaaatagcagcaaattatgctaatttttgataagacagatggcagcctaagatagtgatgacaggaaaagggagtcagaagacaggccccagggaaaattacctccttgtagtattgcttagaatggactcagcaaact

SEQ ID NO: 183189 - DNA, 339 bp, Homo sapiens
atagcgacaccgtacatcttgttgagtggtctttcccgtgtgctcagaacagtgcctggtgtgtaataggaattcagcaaatgctgctttcgtagcgagtaaatgagactgtgtgtgtgtgatgtgtgtgaacgtgtgtgtatgtgatgtatgtacgtgtgtgggaatgtgtattgtgtgatgtacgtatgtgtttgaatgtgtgtgatgtgtgtaagtgtgtatgtgtgtatgagtgtgagtatagtgtgtgatgtatgcgtgtatgtgtatgtgtggtgtatgtgtatgtgtgtgatgtgtgatgtacatgtgtatcaatgtgtgtgtacttgtctg

SEQ ID NO: 183190 - DNA, 787 bp, Homo sapiens
gtggggggaatccgggggaggtgagatttgagttgtgctctaaaggctagattaaataactggaatttgaaaggaggacagaggagcctccgctggagctagggggctccgttacagatccttttggcagaagttgacaattgggtatcaaaacagtgcaaggtgtttcgggaggtaggatggattcagactctgaaggggtttgaactaaaatgtttatgttttattctgtcagtggggagccactcgacttagagcagcagagcattacagtaatgacgttaaataacaacatttgatgaggcttattatctgccaggcattctcctaagtggcttgcaattcacttaatccccccaaggctggtagtaggagcctcattttacagatgaggaaaactgagactccacaagattaactttctccttaggtaacgcggctaaaacccagtagccagaattaagtctgattctacgctgtgtggtctctgtcctgaaaatgagtttgttgaaatagcagtgttatctgctgctagcttttccaggtcatttgtggcagatgaaatagaaaggattggacaaatagattaagaaataatggacggaatagatgtagattggctaatctgggaccagagaatctccgagagattctgagcccctctactagaaatttcttgataccgatgaagggcagactaatacagtcagcatgtgttagggaagttcagtaaaaatgatctgcagttacaggtagtttatgtggtaatgtgacatcctagtaggtt

SEQ ID NO: 183191 - DNA, 185 bp, Homo sapiens
catgaatctgcattcctaagtttctgggtcagggacaacaccctgagatacactgctctaagacatctaaaagtggtttcagtgttttcttgaatccaaaactgtttgcagcactaaagttgaacgtgccttttgttcaggggacactgtagccactaccagattttcaaaggtgaccattccac

SEQ ID NO: 183192 - DNA, 490 bp, Homo sapiens
gggaaccatgttatcgcccaacacagtacctaataatgagaataattttctgtattcaaaggttcttagtggttgttaatgtcttaaaagagaccatttaactggaatggaagtgttttctttggagaaaagcaggaaacattggatagatcttaattatacagaccttgatacttaggcagaaagtagagattctacttaggaaactagaaattacttttttttttttttttttgagacagggttttgctctgtcacctgggctggagtggagttcagtgcagtggcatgattatggctcagtgctgcatcaaactcctgggctcaagtgattcctcccacttcagctcctgagtagctggtattacagatgcccagctgatttttaaattttttgtgtgggggtggctaaatgatgagagcacatggacacatagaggggaacaacgcacactgtggccttttggaggatagagggtgggaggatgga

SEQ ID NO: 183193 - DNA, 315 bp, Homo sapiens
  misc_feature (270)..(270): n is a, c, g, or t
  misc_feature (275)..(275): n is a, c, g, or t
  misc_feature (282)..(282): n is a, c, g, or t
gggaaccatgttatcgcccaacacagtacctaataatgagaataattttctgtattcaaaggttcttagtggttgttaatgtcttaaaagagaccatttaactggaatggaagtgttttctttggagaaaagcaggaaacattggatagatcttaattatacagaccttgatacttaggcagaaagtagagattctacttaggaaactagaaattacttttttttttttttttttgagacagggtttgggcccgtgcccccgggccgggnggggngtccggngcggggcatgtgataagggcctcaggtgcgtgc

SEQ ID NO: 183194 - DNA, 411 bp, Homo sapiens
tgtgctgtgtgagtatgccatgaaaagacataaaaaggctttgttcgtgatgttccatagacaatgcttggcgtctactcacaagccttctctaaaacttagagcctttgtgtcaaactctaaaaccccaaacgatggtgcttatctacacaggccacttgccctgtgcagaggggagggacttgggaacccagcctcccatgcacacgaggatgctccattaatattaattgatattgaatcaatgttagaagatctgagctgtgttagtgactcaaccattaactctgtgtgtgacctgggtgcaatccttcgtttgtcgcgcctcatttctcaaaatcgagataaccattgtccttttctatttttcaggatttcatgaagattaattagatacgtccataaaaacag

SEQ ID NO: 183195 - DNA, 318 bp, Homo sapiens
taggtggatcacacgaggagtttgagaccagcttggccaacatggtgaaaccccatctctgctataaatataaaattagccgggtgtggtggctgtaatcccagctactcggaggttgaggcaggagaatcgcttgaacccaggaggcggaggttgcagtgagccgagactgcgccactgcactccagcctgggcaacaagacccaaaaaactcggtctcaaaaaaaacaaaatgaaactactgtttttcgagttttggtgtagtagcaacaaatacccataattatctgaaaaggctacaacaacaaccctcccttc

SEQ ID NO: 183196 - DNA, 370 bp, Homo sapiens
catttctgcacactgtttctttctttctttttttctttttgagatagagtcacgctctgtcacccaggctggagtgcagtggtgcgatctcggcttactgcaacctccgcctcctgggttcaagagattctcctccctcagcctcccaagtagctgggattacaggcacccgccaccacacctagctaatttttgtatttttttagtagagagggggtctcaccgtgttggccaagctggtcttgaactcctggcctcaaatgatccacctgccttaacctcccaaagtgctgggattacaggcataagccacaacacccagcctctgcacactatttctgactgtgtcacacccaccctgcaatcatac

SEQ ID NO: 183197 - DNA, 457 bp, Homo sapiens
gtcctatgtaacagttgagactatattatgaataaattggtttaaatacatactaatgtttaaaaatctcttgtgtagtcttattggatcttccagaccttttgccctctcaaaagattggacagagccgctttcaactttgtttttatgagatgagatgacaaaatgtggactatacaactgtggactatggtctacttcttaaatgcagaggctatttagtttgtggattatccacatgccatattttaccccaaggattaagataaaaggaatataaatctgaagatagcaagcttcattttttaatacaaggaaaaagataagttgaaattcatgataaatatagattgtgttttgaaactttgattattttcctgttgtccctttaacatgttcctggggaagtttataataatgatttaggagaagaggtgggaaactgataaattagctg

SEQ ID NO: 183198 - DNA, 610 bp, Homo sapiens
gattcactaaattgattttatgcctcattaataaacagttacccacaatttgaaaaactgtattgttaagagttcccacccccatatgttcaaacttttctggaagctggaggaagaaaaataatgagaacatcattcttgagtggactatagtctgtggggaagctatatatagataatacatgataagcctagtaataaaggcacattacatcatctctggagggagaaaatgctaataatttcctaggggagcacagaaacatcttagagaggtagtacttgaacagattcttcaagaagagctaggagtttactatgtaggaaaactgggcaagtagagggaaaagcatctatcacgacatagaggcataaatatagactgcaaagaaagtgacgtgtcacttagtgaggccaccatggagggtaggtgcggccaaggctagacaggcagaaggggcatatcggaggttaacatataccagactaaagtgcttgaacattattctggaggaaattgaaaggcatcacttaaaagaagggaaggacacaactagactttcacatcagaaagttaactgtttcctggaactatctcaatgtcgactga

SEQ ID NO: 183199 - DNA, 465 bp, Homo sapiens
attgtgttaacaggagggctgggggctttccagagccacattccacacacacagaacccctctctccagttcttcctcccatttctattttttcatggatttagagaacgaggaggagagtagggaacttcaaaatgacacgcagggcgataaacctttcagatgaatgatgtcacttcataaggggtcagggggccaatttattttcacgtttcgaaacatagtttatgagcctgataaaatttaaaacacttctagggcaaaatggatgtgcaagtgacactgagttttgaactctttccctgccttctttttatttttctgacttactcttgaaacacatcagtcaacaaccagcttatactgagggtcctttgcatacaagccctttgctgggcgctgtgaaaaataatttttttatggccaacacctggtttcttccctcaaggagccttatgcctctgt

SEQ ID NO: 183200 - DNA, 339 bp, Homo sapiens
aaatcagtttacacaatgacatggaagacagtaagtactaaacaaagggaaaaaaggctatcatcatcttctttatgataccatcatcatctccagaattggtcgctatgcaaaggcaggacaggacgagtcctgctactctttcaacctgcccaggttaagcagccaccaccaagatagaaaagacatggtataaggggcaaaaaagtacaaaaggcaaaaaccagaagaggatatgacaatacaaataaaatcagctcttgattaaccatgctaatgaggttgagggaagactattattttattttaatttgtgtaaactgattgggtaccgagctc

SEQ ID NO: 183201 - DNA, 215 bp, Homo sapiens
caggacaggacgagtcctgctactctttcaacctgcccaggttaagcagccaccaccaagatagaaaagacatggtataaggggcaaaaaagtacaaaaggcaaaaaccagaagaggatatgacaatacaaataaaatcagctcttgattaaccatgctaatgaggttgagggaagactattattttattttaattgacagaatacaaacataga

SEQ ID NO: 183202 - DNA, 841 bp, Homo sapiens
caacattcagccactcaggtgaggcatggagtgggtagatggttgagtttaatctgggttggcattttcccaggtaagtgcaacagagggagagagggacataggtgaaagggtaaatataaggagaataaatataaatgatggactatataagcaaagctgggtaggaagggaaaagcccatggaagcataatggaaaatgaacaagttgttgcgtgacgaggttgaagaaatgctggagcgagagtatcagaagtgacctggaagaatatgaggtagtggtggtgaaatggacacttcagaggtgtgcagcttctagtgttgacaagacctagggcatgaccatggaccaggtggctgaggtgggataactgtaaaattgtgaggagagaggaggctgtggtattgggtgggtcatctacattcttgttgaagtcaccttgaatggtacagctgtggtggagagggagacagggagccactgatgatgacggatagtgcccaggatactggaagattgaagcaacaaggaggggggagtccggtggctaagcatgatgccatgaacttcaaggaccagggtttatgaaggataaaggaggggaaatggtttggcagtgagctgaatgagtggatggaaggatggacagatggaaatgtaggcttttattaggcagctttcagtgaaagttaaaaatctctaactgctggactcagtcctaccctttaaagccccatctttttaaggaacagacactggcaaaccaccgcctgccccgtccagcccactgcctgtttctgtgctttcgaaacatagccgtgcccattcatctgcaccaca

SEQ ID NO: 183203 - DNA, 482 bp, Homo sapiens
tcacgaatcgagctcgtaccgggagtggagagaggaggctgtggtattgggtgggtcatctacattcttgttgaagtcaccttgaatggtacagctgtggtggagagggagacagggagccactgatgatgacggatagtgcccaggatactggaagattgaagcaacaaggaggggggagtccggtggctaagcatgatgccatgaacttcaaggaccagggtttatgaaggataaaggaggggaaatggtttggcagtgagctgaatgagtggatggaaggatggacagatggaaatgtaggcttttattaggcagctttcagtgaaagttaaaaatctctaactgctggactcagtcctaccctttaaagccccatctttttaaggaacagacactggcaaaccaccgcctgccccgtccagcccactgcctgtttctgtgctttcgaaacatagccgtgcccattcatctgcaccaca

SEQ ID NO: 183204 - DNA, 363 bp, Homo sapiens
catatgccagtgctgggattgaacagcataaatcaagactagtcaggcgagagctcctggaagacacagtatttagttaaatgttgagagaaacgatgtatgtggttgacagagaagtgtatggctgtctctggtcttttccaaaatgatagactacagaaaagtatctgtgtcattattacttgaaaactggaaattacttatattccagcaattttcctttggtgtttgcatttctggagtgagagcacagttcacctagtaggccaaggaaatctattcttttagtctatttatcgaaaatataaaagtggggccaggcacagtggctcaagtctgtaatctcagcagttttggaggctg

SEQ ID NO: 183205 - DNA, 144 bp, Homo sapiens
ttctggctattatgaataatgttgttatgaacactcatgtacaagtttttatgtggacatacattttcatttgctagagtacatacctagaagtggaaaatatatggtaactccatatttaatattttcaggatttgccatact

SEQ ID NO: 183206 - DNA, 131 bp, Homo sapiens
caaattttctcaaatggaaaagagaagcagagcagcctctagtagagctgtggtctgggttggcactcgggcaccagtgctccgtggctcaagtgcatccatccatcctcatgtttcttttgtcccaaatg

SEQ ID NO: 183207 - DNA, 164 bp, Homo sapiens
tcactgtgaactgggaggggagatttttcaggagtgccacagggctctccctttaatcacatacactccctgctttcattggaaagtgtataatgatgtcagagtgccccagaatggagctagagagagagtgagagagagagagagagccagtgtggagagag

SEQ ID NO: 183208 - DNA, 350 bp, Homo sapiens
cagcctcccaaagtgttgggattacaggcgtgagccaccgcccccagccaagatttatttttaaacatgtcaccaactgtatgctttagagaaggttgaaagttaaaatttaagcttgctgttcagaaatagttgtccagtagattttcatccagtagtgacattgatatttctgtttgatggggttggggtgatttttttttttttttggtctgttctgaaaatctgtgctgtttccacatagcttatatatagttaaaagtataaatggagtgcttactatgtggcaaggactgtcccagatgctttatattaatttaattttcataagaactctatgaactaagtgc

SEQ ID NO: 183209 - DNA, 613 bp, Homo sapiens
gagagactggaattctggttggtgagattgtgtcccgcccagtttcctggcctcctgactgcaagatccttgtgtgcctgtgtcccctccagtggggaacagagagcttgagtgtggctcacactctcccctagcagcaaggccagtatatctctgccttggcttgtctaatccaaggcaagttgcagggtctggggtactgcagagtcaagaggtaatggggccccaccacttggctggtccaaggggtggggggcagggtgtatacacactgcgtgaaggaggattaaggcctctaagagctgcctcggcgcacggccactggcccggctccaggcggcgcagtctggctgatgacacgagcgctgttctcaccagctgcctgagccagtcagatggaaaagtaatcctatttgtgcttccccactgacacagattgcacaattaaagaagccgctgtcaggaatttgaagtagatgccactctagcacctaggaggggaacagaccttctgatattgatgttgtgtaatcagcatttcagcaaagatgtttctaggacaagataagatgtaaattgctgtaaattgaattgtattgagaaattaccaggt

SEQ ID NO: 183210 - DNA, 668 bp, Homo sapiens
gttgagtgttcaaggattattcggcagtatgttgatctgcatatatagagaggggggggacctggggccctgttgtggagggaagggcatggatgaggccaggaggcaggaggcaggcacatttgcaagagggagatgggtcctggggtgtgcagtacacagggaaggagcagagggggatgggctgaaaaggttctggtccatggagtgagcttctgcctgaggcaggtttctctgggacactgagattgtggaccagcaggagaggctggaagccaaggaggggtctgggtggccaggcctgggccagggcaggagcagtggccctagggaggaggggaggcaggttcatgggacattagaggctgtaactgggcaggggagagcaggagggacggagccgtcggggctcagctgtggatgcctggtggccaggtgaagaggaggtggggaggcaggatgctgacttctgacagtatgtcctgggcagaggtgcctgagagagccctggaaaggctgggggctgtgtctgtgtcttgagatgtggacatctttggcagtggtgaggtgggcgccccaggatggtgaagagggagagggtggagagcaggcagagaggactgaggcctgaaggagggaagggtttatgggagaagaggaggaggcgc

SEQ ID NO: 183211 - DNA, 461 bp, Homo sapiens
catgtctgtaatcccagaactttgggaggccgaggtgggtttatcacctgaggtcaggagtttgagaccagcctgaccaacatggagaaaccccgtctctactaaaagtacaaaaattagccaggcgtggtggcgggtgcctgtaatcccagctactcggcctacgtaggacatgatggaggcttggaccagggggcagtggaagtggaaagggggaagatttggggtatatctggaaggaggtcaaattgactggatgtggaatgtgaggaaagaaatctagggtggctcctaagtagaatgacaaaccaacccagattgcctgagactgaggggtttcctgggacatgggattttcagggctaaaaccaggacaagtcccagacaaaccaggataattggtcacattacttttaggtttttgggccaaacaatggggtgagtagctggtgccatataca

SEQ ID NO: 183212 - DNA, 699 bp, Homo sapiens
gcaaaacccaccccttgaatcttacccaggactatggagctccattaattgctgtcaacacgctggaacctatttcacatgaagctcagaccaattacaattaatgccacagtcatgactacaaactagaaaccaatgccagaggaagcttaagttaaagaaagcaacgatcacgcacatatattatgttagcaattaggcttaatcctagaatcgtgaagccaaagagaatatattaaagagagaacagtgccctcctgggaagaagagcaatttcaaatagactttttagtggctttctacattacttacttgaatatattatgctcccctagaattactatattacaattactcacgccacattttatttatttcagcaaggaaatgggatggtgcaatgagctcagtgggcagacggtttggttatttcaatgaataatttgaatgtcaacaagttggtggatgctaagatgaaaggggaagtagtaaatagcaaaggtctcaatgcctgactctgagatggagtaaggatgagctatcaggactggcacttcacttctaaatgttgagcactcaggttttgctaaatttataaaagcacatgaactaactaacatcgcatatttccttaacgagaagaccagtttatctctgtttaaaacagttctgatctactcaaatacacatttttaattt

SEQ ID NO: 183213 - DNA, 591 bp, Homo sapiens
tctagaggatcccatttcgacgaccattcaggctactttgggaagttggtatgaatgcattaccacgttaaagaggaaccagagcttctgcccaactgtcaacctgtacaaattgtggactgtgctccgtgaacaaacacgggtgaatgcgtccgtcgaagttgcaacttcgacggacgcattcactcaagacagtagaactagtccacagcaagcaaataatgttttaggtgtagtaaagtatctgcctttttgcaaagtaacttttgttgttcagttgcagtcctggtgttagctacccaagctggctggacattgtgtcatctgagtttctttctaattcacttgttcttggttggagtgttgtgtagttagtaaagctcgcaggtgtttctgatacagccaggattgagaaccaccatgtattccctcattcccttttgagatagattgacactagatattgtgcccccccaagggtagatttttacgatgaataacactactcctcacagttgaggaagtagggactgttgtgaaaatcctggcttatcagaatggcaacgaatacttagcagtgactgaatgcct

SEQ ID NO: 183214 - DNA, 494 bp, Homo sapiens
ctcgggtcccagaatgaccactgggcagtgcacgcccaggagatctgaccaggaaatggcacgggggctttaaaaactgacgtgatgctcatggcctacaggttggggattggaacttgtggcctgaaagtaagattggctgttggctaaaacaaaaatatcaatatttcccatatagcttaaataagacctagagtatcaccacataatgctcaaaaagtccaggatgcaatccaaaattactcagcatacaaacaaccacgaaaatgtcaacttgcctggaaaacccaatcaaccactgtcaacacttcacagatgttgggattatctgatgaagactttaaacagctatttttaaaattgcaaatgcttgcaacaaatgttaaaatagaaagtctcagcaaagaaacagatgataaagaagaatcaaccaggagttcgagactagcctgggcaacacagcaagtcctggtctctacaaaataaaaaataaa

SEQ ID NO: 183215 - DNA, 282 bp, Homo sapiens
cactgcactcccgcctgggcaacagagtgaggatctgtctcaaaaaaaaaaaacaactatataaatggaatcatttagtttgatttggtttgtagccttttgggattgctcttttcagtcagcataacttcttggggattcatccaagttggtatgtgtatcacctttttattgctaagtagtattccacgatttggatataccacagtttgtttaaccagcattcaagaacatctggattgttttcaatctttggccattataaataaagttgctatgaat

SEQ ID NO: 183216 - DNA, 550 bp, Homo sapiens
cacatattccagagagataggcaccatggaagtaattacattgggagcattgggagaagatgggaacatataaatatctcatcacacaaatcaaaaattaggaaatgtagtagcatatttcacatgatcttttgtaacaataaatattccattttaatagtatgttaaaaatcactcataagcctttcctttctgcagtattttatctgtttatttcactctaaagttacagaaacgtaacgtataatcaagttccttattggctgcctcttaacataatttttgttattcttcctcctcagtattggttagtgatggaatgcgagaataaagctgaatttatctattttcacttatgattaaaaaaagataaattctaagtaggtattttaaaagatagtttgacatatacactcccagtgttggacttgaaattaagaggtcagctggtattggtatgaacattaacaaagacctacaggctaaacaagaaatagtttagcctatttctcatttgcctgtgtataaagattatggatattctcacata

SEQ ID NO: 183217 - DNA, 119 bp, Homo sapiens
aaggatcctgatatatggggattatcctggatcatccgggtattctctaaacccagtcatgagtgtcccttataagagaaaggcagagtgagatttgatacacactaaaggcaacgtga

SEQ ID NO: 183218 - DNA, 305 bp, Homo sapiens
tgtgcactatgggatattttaggtcaatgggcactgtaactatgggaaatttagttaaggcaatagtatcagtggtaaaggagagacatgaataattgtcatcaaagatagtgagcaagctaagagcaagaaaagaaagactcctaggtggtggtggtcctcaactagacaatgcagttgagtctaccagttgctttttggttgccctgtggatggcaggatcatcatctactcatgactcccaccaaagtggtttgaattttaagtttgagaatgatacacacacacacaccaagagggtatga

SEQ ID NO: 183219 - DNA, 490 bp, Homo sapiens
caagaaccagctggagattcagaatctacaggggactgggatcactttgagcctctgttgagttcccttctgaggaggatgccagaattagagactctggagatcatgaagttggtgaactgcccagagaccttcgcatcagacatgaggtgcatcatgggcgagtctcctgcagtgtagggctactttgtcctggcaggaatgaactctgctggcctttcatttggtggaggagccggaaagtaccttgccgaatggatggtacatggttatccctcagaaaacgtttgggaattggacctgaaacgttttggagccctccagagcagccgcacctttctgcgccaccgggtcatggaagtcatgcctttgatgtatgatctgaaggttccccactgggacttccagaccggtaggcagttacgcacctctcctctctacgaccggctggatgcacagggagccaggtggatggagaaacatggatttg

SEQ ID NO: 183220 - DNA, 303 bp, Homo sapiens
agtgagagagagagaaagagcgagcctgggagagcgaatgcaagaacaaaactaccaaaagtattgcctcagacaaataaacatatttacattttcaagctgaaaaaaatcaagaaactatcctttattctcccaaaagaaatttttttgtatcactatttgtaaaacttactatttttccaaggcaagcagtagaaactagagtgctttgacatgctgccagcattcacagtgatttaaaagcacggccatggcattgctacaaaccataatttaaaagggttggaagctgcccttttgtaa

SEQ ID NO: 183221 - DNA, 261 bp, Homo sapiens
gaggttaaaggggaatgggtaagtgttgcctaactgtcaggaagtctgcatcttattcaatgttttgtccttttaagtcacttgaattctgtgtaagtacacgtatctctgggtgttgttgcggcagtaaaaatgtgtttgagtctgtgtagtaggttgtgctttttaaaaaaaaagtaagtcgtaagtcttctcagtttgtgtactgggtttctttttgttagattccttttaaggactaacttgaatgctctgtgtttg

SEQ ID NO: 183222 - DNA, 193 bp, Homo sapiens
ggcccctactttctattgaaaaatatttaaaatctatgcacttattctacaaagtcaaagatttttaaaatgcaattattctattgcatgtttaaattaccatctttcctttaaaaatattcagaaattcaattgtaataacatttgctctcacttcaaatgcttattctaagacaaccatggattagagagc

SEQ ID NO: 183223 - DNA, 232 bp, Homo sapiens
gtgctcttgagcaaggctagagattcacccttggagggttggggccatgctggctgtgcttatttccactggagagcagaactgtgagtggcttgtggggaggagtttttctttggtggaatgttcagccttaacctacccattatgttctagagatggagaaattgaggctcagagagccccaaggactcaaattacatgtgatggagcggtgacatgctcctagtcctcc

SEQ ID NO: 183224 - DNA, 947 bp, Homo sapiens
ggcgaagtacatcgaacgaacagcagagacgaaggaccgtcgatcgcggtgggctagagacactggcatccagaggacacttggcatccagagacacttggcatccagagacacttggcatccagagacacttggcatccagagacacttggcatcagagacacttggcatccagagacacttggcatccagagacacttggcatcgagagctctggatgcaaagtgtcagattctatctatgggagcaatgggggagcaggtggtcagtgtgctgcatgaccctcgattagttagcagctgcagggaaatgagtcagagcacaccagtgcatgctggttgatgcctgactacaatacaagcctaaagcctggcttgtaattctcattaaccctgtgagggtgggttttcccttgggcttttgccccattctaagcaacacttctatggatatttttgactacatgttttttgtagtgcacactggaaaatattctgtgtgctcaaattaatttttttccaagactgtttctcattttaatatcccagagcttctcttgcattttaggctgcaatgggtgaagaaagttatatcttcattcctttgtcaaaaatttactgagtgcctgggcactcaagtgctgtaatcccagcactttgggaggctgaagcaggaggatagcttgaacccaggagttcaagaccagcctggacaggaggatcacttgagcccaggaactggaggctgcagcgagccatgattgcaccactgcactccagcatgggcaacgcagcaataccctgtctcaaaaacaaaaaaaaccatttattgagtgcttactcaatggtagttaggcactggcctgggcactggaaaacagagaaatataacatgtccccatctttctcagcataaagcttatcagactgtgtccattgtgtttattt

SEQ ID NO: 183225 - DNA, 549 bp, Homo sapiens
ggtggcgtctagaggatcccggctcggatgcaagtgtctctggatgcaagtgtctttttcttttccaagtctctcattccaccttacgagaaacacccacaggtgtggaggggcaacccaccccttcatatgcaaagtgtaatatcccagagcttctcttgcattttaggctgcaatgggtgaagaaagttatatcttcattcctttgtcaaaaatttactgagtgcctgggcactcaagtgctgtaatcccagcactttgggaggctgaagcaggaggatagcttgaacccaggagttcaagaccagcctggacaggaggatcacttgagcccaggaactggaggctgcagcgagccatgattgcaccactgcactccagcatgggcaacgcagcaataccctgtctcaaaaacaaaaaaaaccatttattgagtgcttactcaatggtagttaggcactggcctgggcactggaaaacagagaaatataacatgtccccatctttctcagcataaagcttatcagactgtgtccattgtgtttattt

SEQ ID NO: 183226 - DNA, 407 bp, Homo sapiens
gcatcagccattctgctggaattcaggatctgaaaaacaccttaagcaattcttgggtaaaatgtccagtgtcagattctatctatgggagcaatgggggagcaggtggtcagtgtgctgcatgaccctcgattagttagcagctgcagggaaatgagtcagagcacaccagtgcatgctggttgatgcctgactacaatacaagcctaaagcctggcttgtaattctcattaaccctgtgagggtgggttttcccttgggcttttgccccattctaagcaacacttctatggatatttttgactacatgttttttgtagtgcacactggaaaatattctgtgtgctcaaattaatttttttcgcagcttgcatgccctgggtataaagctcggattcgtatcatgt

SEQ ID NO: 183227 - DNA, 228 bp, Homo sapiens
accaagtagaagaagcgatgaatttttaatgtcccattcgaactccagctcctactcaccagtctctccgcatggagaagtggccgtcatggtcgacctgttcccaagggtggccttgtgagtgcaggctctcctcaccagagctgagggctttgtgaacctctgatgtcaatagatgcccctcatcttccaggaggacaaaacagggcaaagcaagacatggggtta

SEQ ID NO: 183228 - DNA, 398 bp, Homo sapiens
tcttgcagtgtctcccagggtggagtgcagtggcgagatcacagtttactgcagcctccaactcctgggctcaagcgatcctcccgcctcagccttccgagtagctcagactacaggcaagagctaccatgcctggctaaagggaccaagtttttgtacggacattgaagaccttgcttctttccatcacaatggcctgcacgcttctacttacattcccacgttctggaatctggcttcccccagaattcccattcaaatccgattttgaatccccaatccaggaatcccagctgtctcctcaccccagcttcatcctcttattcccaggcccctccatccttcacagctctggatggctaaactgcatggcttgggcccagcccatcacctggggg

SEQ ID NO: 183229 - DNA, 644 bp, Homo sapiens
catcactgggatccgctctggggctgggcagctccttgccgggggcctgggtcttagtcagacttgcctttctttctaggcctctccattgacttctggccatgccgatgtgagtcagatgcattgtttctctctggctcctagggcgctcagtagcttcctccaccttcaggctgtagcccagtgcggggcaggctggtgggcagctgggggctgaggcagggaaacctgagccctaggccacgaggtcctgggccgctaattttagaaagcacatgtcactggaaactctccttctctgccaggaatcaacggcctggctctcctggtgctgccaggggcccctgggagcctctccccaaaccaggaacctcaggggtgtctcctggcccgggtgggtactttctgtcctgagtacatctggaaaggggctctgccgaggccctggagagccatggcttgggccagggaggtagctcaccttgtctgctctttactttctccagcccttccgggctgcccctggccatgagcagaggctgtgaagtgtgaaggcctggctggggcaggaggccacttcgactcttctgagtaagctgttgttgaagcactctggactaagcagatttgtctcttccttcccc

SEQ ID NO: 183230 - DNA, 709 bp, Homo sapiens
gggcatagactataacagcataactattacagcataaactattacagcataaactattacagcataaactattacagcataaactatgacagcataaactattacagcataaactattacagcataaactattacagcataaaccatggaagtccagaaggtttccatagtttatactgtaatacagcatcatctattaaaaacatgtgctttacaaagtcaggcactgagccagtttttatttaccattgtgtgtgtgtcccttccctacaagtcccaagcatactgtcagtgaacataagacaaatggctaagtttggagataattttaagggctaatttttaaaaagatttattttcttttgaaataaggaaagtgatttttttccatggtcccttctgtcagtaagctcattttccaaacttgtaatatgacacatatgccaaatatagaagcataaagggtaacttcaaaatctgccctcaatgtttgagtacagagacttgccccacccctgctcatcagagactccatgggagtcagtatctttatctcttgccagaataacagagatccagtcatggcatacaaatttggaaatgaaactgtaagtattaattgtaagtggacctttgagcaatacagggattatgggcacctgccctccacatagtcaaaaatccacatgtaacttcagactccccaaaa

SEQ ID NO: 183231 - DNA, 533 bp, Homo sapiens
tgaggtgtcccttctgcttgttggacgtggaccgagagatgaggccgatgaagatttcctggagatagatggtggtgatggttgcacgacaatgtgaatttccctaacggtacctaaaattgttagaataataaatttgatgttaggcatattttaccacagtttttttttttttaaaggtttctaggtttcctctgagctttacactggctgactcttttccaggactcattatggttctttcatcttggtcttgtggctaatctgctttagggcccagggaatatggggaccccagagttcaccatccaccagagtgactgcaggtagcagtttgcattggactttctttgacggagagagtgctactgcagtcctgatgtggactgtggccttatcagaggagaatttcttcatttaatgacagctgctaatgagccttctccaggcactcttggtttggccaccttgttggcaaataaacccagcatgggttctggcccagtggaaattatttaataggcaagacaggg

SEQ ID NO: 183232 - DNA, 406 bp, Homo sapiens
tgaagctgatctgatgccagcctcgttcctagttatgagattaatgcatccatatagctccccaatcagggcactatttgcattacatgcagaggctcctttacctgtctctgtcttccactatcacagagagagcctgtcattccgtttttcattccactaatattaattcacaaactctgtgtcgcacctgcaaagaatgagaatacatagaagacacctaggccacatttgaaattttagtgtttgtggaattgtggaatcaaagatgttccaagccgcctgtgtaaaggcctggaggcagaacaatgtggtaaaggagcaactgaaaggaggtcagtatgaacaagcttctcatatacgcaaaagtacctggcatcttttcattaattaaaaaaaaaaaagc

SEQ ID NO: 183233 - DNA, 281 bp, Homo sapiens
ccatggcacatagtaagtgctctagaaataacagctgttcttgctatcaatattattagagcaattctctattctacaatgctcctcactttgggaatattataatagcccttttctttttatttggtctaggtcatacaaccaaatagttataacaaataacctgatcattggattatcactaatttatgtcctacacatgacagactctggtcgctaataaaagatagacttttttttttttttttggagacaaggtcttgttttgtggcccaggctgg

SEQ ID NO: 183234 - DNA, 329 bp, Homo sapiens
cagctaaagatctactgcaagaatgatagccctgaagccctgttccagtcagctcattcatggtcagggaattttcaacagcttcccattgctttgcataaaaggcaaacaccaccacctagcaggcaagggcctcagatctacttttccagatttttatttcaatagtttcctttatactgtttattttgtaaagcaggactatatgttgtccccaaatttcttttctttcctttcctttcttctcctttcatcaccattgcctcttacctgctgacatcaaatcacatcctaactgacctcattgcctaagcctttggtacctctca

SEQ ID NO: 183235 - DNA, 429 bp, Homo sapiens
ccaaataaccagaattgacacacatctttaatagacatggactctgggactctaggtctaattgcatacccaaagtcattccaatcagatgtacattcaccattcaggagggattatttttccacatcctgcattgaacaattacttaacctgcctgaaaaatggcaataggccaggtgcggtggctcactcctgtaatcccagcactttgggaggccgaggcaggtggatcatttaaggtcaggagtttcagaccagcctggccatcacggtgaaaccctgtctctactaaaaaaaaaaatacaaaaattagctgggcatgatggcaggtgcctgtaatcccaggtactcggcaggctgaggcaggagaattgccggaacctgggaggcggaggttgcagtgagccgagattgccctactgcactcca

SEQ ID NO: 183236 - DNA, 255 bp, Homo sapiens
ttctcagtctcctcatctgtaaaatgggtatgtctgccctccttggctacttcacagggctgcggcacatgcatctgcccgaatgagtgggcatggaagcaccctgtttatggcatggtggtatgtactccatgtgaggcctgaggacggaagcagtgtggagaggctgtatcatctttataatgactaggaggccaagacattagtacctaaagcaaaaaagtaatttcaaattgcagcagaatcacctgaagt

SEQ ID NO: 183237 - DNA, 229 bp, Homo sapiens
caccagggcggacaaggctaggtggaagtggggggtcaggatggcactctttcagcacagcgcacactagcctgccaaaacaaagctgaatgtagatgtggaattttggaactggaaggggatttagttccacttaccactccacaaaagactcatcctagcacattctgataagtgggcacccagcctcctcctgaatactccaaagataggaagctcactacttttc

SEQ ID NO: 183238 - DNA, 479 bp, Homo sapiens
aaacttagctgggcgtgatggcagacgcctgtggtcccagctgctcggggggctgaggcaggagaatcatttaaacccaggagacagagggtgcagtgagccgagatcacaccactgcacacccacctgggcaataagagtgaaactcttgtctcaaaacaagcaaacaaaaaggattaaatatatataaaaaaatctagaaggaaatatatggataaagaagtttctaagcttgatagaatagaaggtatcacaagagaaaatatagacaggtttgactacataaaaattaaactctgtatatcagaaaacatttgtacgttgacaaaatcaaagggcaggcgacaatctgcagagaatgtaaaaaattacaacgaagcatgaatatctttaatatagaatttttaatacaaattgctaatgtcaacattaagaccgcagtagtttaagggacaaaggcagttgaactgactttgcaa

SEQ ID NO: 183239 - DNA, 549 bp, Homo sapiens
tgcaatggcgccatctcggctcaccgcaacctccgcctcctgggttcaagcgattctcttgcctcagcctcctgagtagctgggattacaggcatgtgccacaacgcctggctaactttgtgtttttagtagagacggggtttctccatgttggtcagggtggtctcgaactcccaacctcggatgatccgcccacctcggcctcccaaagtgctgggattacaggcgtgagccaccatgcccggcgtaaagttttcaaatgtttaagtaacacgttaaattttgttatcgggctcagcacagaaaattgaaaaagagaacttaaaaggcgcccatactcagtccccaggttaacagacaaatagaaacttttaaacgtaatctaagagtgaatacatacatttctttttttttttttaagacggtatggttctgttgcctgggctggagtgatttcttggcaacctccgcctcctgggctcaagccatcctcccaccccagcctcctgagaagctgggattacaagcatgcgcccagctttctgtatt

SEQ ID NO: 183240 - DNA, 300 bp, Homo sapiens
tccaaggattgcaggcgtgacccactgtgccagccaatcaattgatttctcattcattttcagctggctctgttcccttaagccaggggattttcgtttgtttgtttccccttcaaggaaatgattctagctacagttttgatttccttgtacaactgttttcagtagcacagggaaagaaaacatcgaaagcattcaccacctcatttgtgtgctgggggaaaaagcagaaatgtgtattctctttttttgtttcgatgaccttgttcctgacttgttactcgtgacttgagagatcag

SEQ ID NO: 183241 - DNA, 313 bp, Homo sapiens
tcgagccggtacccatgtttgaaggcagtgacaaaataaaattgataggacatttcattttgtcccagagttttgaggattgtgtgaaattgtatgttaacatctgaagctaaataagcttttttttatctttgaagtacacaccatcactttttaattgtacaaaagaaacctttatttgtatccctttctgtctaaaactcaagagaactgtcaacttagataattttcaagaagtattgaatttttctccttggtttttgtgcctttaaagtaatgaaagtagttctataaaggcaaatgggaaagccat

SEQ ID NO: 183242 - DNA, 591 bp, Homo sapiens
ataaaaaaggaaccagctgtgttttctagtgatgctgtggccagcccagtgatgaaccacacttacatgttttccctcctttcttgcctcccttccctttcccccttattcttgctgtcttgagactgtaccccttaataaagcattagcacacaagctgtacttcagaggcttgattttctaggaaatccgcggtaagacaagaatatttttcagctccttatatatcacagtggagctactaaccctgctttcccactcatgggaatgggtatgccttcaatgagcaatgccatataatatcgcaagccatgatgggacactgatagagattttagattcagtggtatggagattgctgattactttaaatatcatgccattaatttaggtatgtagcatgtacatggtaatttaaaaataacacaatagggaatgatcaggtcggttctaaacagttatgatctgaggaaagagattactatgagtctttaagccactgcattgtacaataattgatataacttgtttatgaaacacttgaatgtattcatttaacaatacgagacaagattaataataaaactttgt

SEQ ID NO: 183243 - DNA, 346 bp, Homo sapiens
acagcacaaccatgtccagtagggggtcactagccacagagcaggcaggacacaggggctcgccctcgagcaagcatgtcgctgctggggaggacgatgagggagaagaggggaggccccaacagcaatgatgagaggggaggtcccgagatacacccacagagacggacgcgtcttgaggccgtctcagggacaatggtgcaagtgaggtcaccacagaaacaatggaaggaaaatataaggtcgccgctgtgaggatggagagaatggaagcgccagagggaaggccgtgccgtgagcagccaggagggagggcagcagagtcgaggcaggcagcagagagcac

SEQ ID NO: 183244 - DNA, 215 bp, Homo sapiens
ctaaaggtgatggagctggctcacgccatcagtgtgcatgtgagtatgtttatgtctgtatgtgtgtttctatgcttgtgaacagaaggggaaattgtcctttccaggaaggcaacatacaatagaatcagtattaattactactgatattattattgccactgggatcctacatgtctggcaggaatttaggacataatgtttaattgatccca

SEQ ID NO: 183245 - DNA, 558 bp, Homo sapiens
gtctttcattgttacggaaggttcttaaaaaagttttgctacaagatatagaaactaactataagctgaatgctttgagagagagtgaaatactgtcactgaatgaattcaggtagaagttgccaggcctctctatataagaagtcagtaaacttttctgtaaaaggccagagagtaaatatttttggctctgcaggccataagatctccagggcaactaccctaatatactattgtagtgagaaagcagccatagacaatatgtaaacaaataggtatgtccgtggtctaacaaaactttacttacaaaacaggtgtcagaccggacagccctagtttgccagcctctatattaaaaagagggctggaccatatgaccttcacaccacttctagctccaagtttccataaaaagtcattaagcaattcaacaatatgtagaaataagtgaaaaagacgtatttagattgatatagagacatatcatatgcagacatatatgtacatttataaaccatatagaaagaatattactataaacatatatgggacgggtca

SEQ ID NO: 183246 - DNA, 421 bp, Homo sapiens
cggaaaatcatctcagagggatttgacctggaaattaaaggataaatgtatttttgccaagctgccaaggtagtagaggggctaagtgtttggattttatcttgaatatgaaaaggaactttttaataataaacactcttcaacaaagactgaagtacttcatgaatttatagacctgaaggtgtttaatcagaggctggttgactatttttgcagaatttatggaagaaattcataaactctttggatgaaacctatgagaaacctgaaaattttaaatttatatgattcctatcataaaattctatgagggtaaagattaaacatgattagagaatttttattagctaaatacatattactttaaaaattaaaaccatttatttaactagtagagaaacatacattttattctgatttt

SEQ ID NO: 183247 - DNA, 260 bp, Homo sapiens
agggcatcctggacaagaaaggaaaaagagaccttgttggaacagttgaaacgtgaatcatgcctatggattggattgttggattgtagtgttgtatcaatgttgactcctgatttggaggtttgagtgctaattatataggaaaatatccttgtttacgggaaacattgactagaatgtttagaagttgtaggacactgcatctttagcttgtttttataggttgggaaaaaggtctaataataagtagggtgtgtgtg

SEQ ID NO: 183248 - DNA, 642 bp, Homo sapiens
gtagcaatatccttactcttacataggaccaggtgcagtggctcatgcctgtaatcccagcactttgggaggctgagaccagaggatcacttgagcctaggagttcgagaccagcctgggcaacatagggaaaccccatctctacaaaaaataaaaataaaaaaattagctgggtgtgttggcttacatctgtagtcccagctattcaggaggctgccgtagggtggaaggattgcttacgcccaagtggttgaggctggagtgtagtggctatttataggctctatcaaaagggcactgtaacctcaaactactggactcaagcagtcctcccgcttcagcctccggagtaggggggatcactacagggctactacatccagctaatagtttattcctttttattgccaagtagtattccatgatatggatgtaccacagtgtgtttaaccatccatataatagcaatttttgattaaacatcttaatttttttgtggtagtgttagtggggcaaaaacctgtaagtttattgccaaaatcacagtgctgaagatctattgataagttatatgtgagagaaatgtggaagtcactaaatgaaggaagagtaaaggagctaaaatgtccttattgttctcat

SEQ ID NO: 183249 - DNA, 398 bp, Homo sapiens
caagccggtccggttattgagtggcatgtgattttggctctatcaaaagggcactgtaacctcaaactactggactcaagcagtcctcccgcttcagcctccggagtaggggggatcactacagggctactacatccagctaatagtttattcctttttattgccaagtagtattccatgatatggatgtaccacagtgtgtttaaccatccatataatagcaatttttgattaaacatcttaatttttttgtggtagtgttagtggggcaaaaacctgtaagtttattgccaaaatcacagtgctgaagatctattgataagttatatgtgagagaaatgtggaagtcactaaatgaaggaagagtaaaggagctaaaatgtccttattgttctcat

SEQ ID NO: 183250 - DNA, 646 bp, Homo sapiens
cctataatcaagattgttgaggggaaaaaaacctaatgagaagtagaaggtatttttaaaaacttgtagaaatgaaaaatatatctgagtttttaaaatacactgaatagtatttacagcaggttagatattgcagaaggaaagatcaatgaacctgaagagtgaaacagaaacaattcaatatgcatcacagagagaataagactaaaagaaaaagaagagatcttcagcaacctgcagaacgatattagggtaataggatccacgtatctggagtctgcgaaggaggatggagaacagtatcaagcagcctgggatccacgtatttggagtctgtgaaggaggatgaagaacagtatcaagcagcctgggatccatgtatgtgcagtctgcaaaggaggatggagaacaatattaagcagcctgggatccacgtatttggagtctgcgaaggaggatggagatgggtgtggaaaggagtgttatagaaaaagtatgtgaagaaataatacccaaacattttccacatttgatgaaaactaaaacccacatttccaagaaaagcatgaagaaaaccatgcaaagccataccataatcaaattgctgaaaactaatgataaaaaacctcaaaaacagccagaggaa

SEQ ID NO: 183251 - DNA, 321 bp, Homo sapiens
ttcctcccacctcagactcccatgttgctgggactataggcatgtgccaccaccacacctggcacattttttaaatagagatgagggtctcactatgttgcccaggctggtctggaacttctggcttcccaaagtgctgggattacaggtgtgagcctctgcgcccagccaaggcttgtttttccaccttcagtttggttgatgtcattcaaatcacaacttttgttgtaagctcagctgttttcagacttgtcataattatcagggaatgtggttaaggtgccttccccttctctgcacagcctgggagagtatgttttc

SEQ ID NO: 183252 - DNA, 187 bp, Homo sapiens
gtgacagagcaagactccatctcaaaaaaaaaaaaaaaaaaaaaaaaattgcatatggctggagcttaatgctcatggaacaaagtggcaagtgatgaggttgaacagacaggcaaaactgagatcatatgggctttacaggacttggacagatctttggatttgactctgagtaaaatgagtggac

SEQ ID NO: 183253 - DNA, 149 bp, Homo sapiens
caagaatgggggcaggagtgtgggcctagccagggaaagaggagggttcagagagtagacacacacacacacacacacacacacacacacacacacacacacagttcaccatgaaggtgcagatgcctggctcagggagaaaagagggg

SEQ ID NO: 183254 - DNA, 130 bp, Homo sapiens
gtttattggctctttgttcttttgtaaatcatctttgactttcgcattaatttataagagatcactgtgaaacaaatgactttggcatttattttacaaatatttttcccaatttatcactcatttttca

SEQ ID NO: 183255 - DNA, 282 bp, Homo sapiens
agtctccctatgttatccaggcaggtctcaaactcctggcctcaagtggtcctcctgcctcagcctcaggcatgatccactgttcctggccttggctatgtttttgagagacagggtctcattctgttgctcaggttgggatgcagtggtgagatcatagctcactgcactcttgacctcttgggctaaagtggttctcccacctcagccccctgagtaactgggactacagggatgtgccagcatgcccagctaattttgaaaaagttttgtagaagtgag

SEQ ID NO: 183256 - DNA, 679 bp, Homo sapiens
gaagacagacggatagatagttcagaagtttgacgcatatatgacataggaagtcaccaagtctaaacttcagtttacccatgtaaagttgctgagaagcacaaaggttaaataacttgcaaaacttagatgctaagctagaaaccacactttaaagcattggattctagattactgctcatcatcatatgaataattttctagtcctgtatttctagaatatcatagattgcttgaaatgagctagcaaattagtagacttccaaatcctgtggtaatccaaagatacttattgtaatgataattttacgtatgtgatgttcagctatttcccagcatctctgcactcactgaaatcccaaatcactaatttccattcatgactgagagtattaggccttggcttggctgaaaatcagcagatacacaaagcaattcatcttgctctgagatccaaccctgcctatggtttaatctatttgttccaccagtgttgcttcactacaaaatgttaagtaatattatcaaaagaaagaagttgtaaaggacccacacaatttactccaaccaacattcacaaggcattcttgggaattctgtccaaaatgcaggaaatggggaccactgggtcagaaggcattcctgccgtctaggagcgtaatggtaccgagctcgatga

SEQ ID NO: 183257 - DNA, 276 bp, Homo sapiens
tgtgaacgattttgggaggacgggagcgtctgtgaacgattttgggaggacgggagcgtctgtgaacggattttgggaggacgggagcgtctgtgaacggattttgggaggacgggagcgtctgtgaacggattttgggaggacgggaaagtctgagaacggatggtggggatggatgcaccgaatgatcctgaatcgcgcacttcaaagcagataaaatggcaacaccggccccccaacagtcacgccacgctgaagctggagacgaactcgccc

SEQ ID NO: 183258 - DNA, 649 bp, Homo sapiens
gcagtggtaccatctcagctcactgcaacctctgccttgggggttcaagtgattctcctgcctcagcctcccgagtagctgggattacaggcacccgccaccgcgcccggctaatttttgtatttttagtagagacggggctttgccatgttgaccaggctggactcaaactcctgacctcaggtgatccgcccacctcggcctcccaaagcactgggattacaggaatgagccactgcactcggcctacttctgcattccttagagtacatcctagctaggatatattcacttgtctttagagctaacagcagaagaaaggtacctagatgcttatctagctctttatctttctagaaattctagaagatgagaggggcagtggtggctccaagggagtgattttaggatggactgggacagagaggggctgcttacacatactcacacagaggccattaatttagggagttcaaggtccaggaggttgacggcatctaggcctgtggcagagtgcactcctgctttggggaatgtatgggcagcttcttgcctgtagttggagggttagagagagggatcaataatttcatggttggacttgagtttgaattagctggagcttttgggccgctcccccccttttttt

SEQ ID NO: 183259 - DNA, 1189 bp, Homo sapiens
gcagtggtaccatctcagctcactgcaacctctgccttgggggttcaagtgattctcctgcctcagcctcccgagtagctgggattacaggcacccgccaccgcgcccggctaatttttgtatttttagtagagacggggctttgccatgttgaccaggctggactcaaactcctgacctcaggtgatccgcccacctcggcctcccaaagcactgggattacaggaatgagccactgcactcggcctacttctgcattccttagagtacatcctagctaggatatattcacttgtctttagagctaacagcagaagaaaggtacctagatgcttatctagctctttatctttctagaaattctagaagatgagaggggcagtggtggctccaagggagtgattttaggatggactgggacagagaggggctgcttacacatactcacacagaggccattaatttagggagttcaaggtccaggaggttgacggcatctaggcctgtggcagagtgcactcctgctttggggaatgtatgggcagcttcttgcctgtagttggagggttagagagagggatcaataatttcatggttggacttgagtttggagcgagtggagttagatacaaattctatgtttttggagaaagtatttgatcttcttggctgtgaggcaaagcgaggtttaaaaatatttttcacttaaaaatatatatatatgcatgtatatttaatactgtctatggattgtgccaatatctatttcatggttttgatattgtgtagttatacaaggagttaccactgaacgaaactgggggaagggtacacagaatctctgtactttttttgttgttgttgcaatttcctgtaaatctatgattattttaaaataaaaaagttaaagcatacgtatttacatttgattaaatgcagtgtgatatcctgggttggattttggaacaaaacaaggcatgagtgaaaaaactggtaaaatccaaaaaagcctttagttaaaagtaataccagtgttaatttcttagttttgacaaatgtgccatggctgtgtaagatgcaaatgttagaggaaactgggcgaagaatttgagggaactctctgtactattctttgcagcttttctgtaaatctacaattattccaaaataaaagtctattaaaaatgta

SEQ ID NO: 183260 - DNA, 1193 bp, Homo sapiens
agtggtgcaatcatagctcacatctagcctcaaactccgggactcaagcaatcctcctacttcagcctcctgagtacctgggacttacaggcacacaccatcatgtctgctaatttttttggttgctgtttttaagtagagatgaggtctcactatgcccaggctggactcaaactcctgacctcaggtgatccgcccacctcggcctcccaaagcactgggattacaggaatgagccactgcactcggcctacttctgcattccttagagtacatcctagctaggatatattcacttgtctttagagctaacagcagaagaaaggtacctagatgcttatctagctctttatctttctagaaattctagaagatgagaggggcagtggtggctccaagggagtgattttaggatggactgggacagagaggggctgcttacacatactcacacagaggccattaatttagggagttcaaggtccaggaggttgacggcatctaggcctgtggcagagtgcactcctgctttggggaatgtatgggcagcttcttgcctgtagttggagggttagagagagggatcaataatttcatggttggacttgagtttggagcgagtggagttagatacaaattctatgtttttggagaaagtatttgatcttcttggctgtgaggcaaagcgaggtttaaaaatatttttcacttaaaaatatatatatatgcatgtatatttaatactgtctatggattgtgccaatatctatttcatggttttgatattgtgtagttatacaaggagttaccactgaacgaaactgggggaagggtacacagaatctctgtactttttttgttgttgttgcaatttcctgtaaatctatgattattttaaaataaaaaagttaaagcatacgtatttacatttgattaaatgcagtgtgatatcctgggttggattttggaacaaaacaaggcatgagtgaaaaaactggtaaaatccaaaaaagcctttagttaaaagtaataccagtgttaatttcttagttttgacaaatgtgccatggctgtgtaagatgcaaatgttagaggaaactgggcgaagaatttgagggaactctctgtactattctttgcagcttttctgtaaatctacaattattccaaaataaaagtctattaaaaatgta

SEQ ID NO: 183261 - DNA, 1158 bp, Homo sapiens
agtggtgcaatcatagctcacatctagcctcaaactccgggactcaagcaatcctcctacttcagcctcctgagtacctgggacttacaggcacacaccatcatgtctgctaatttttttggttgctgtttttaagtagagatgaggtctcactatgcccaggctggactcaaactcctgacctcaggtgatccgcccacctcggcctcccaaagcactgggattacaggaatgagccactgcactcggcgatatattcacttgtctttagagctaacagcagaagaaaggtacctagatgcttatctagctctttatctttctagaaattctagaagatgagaggggcagtggtggctccaagggagtgattttaggatggactgggacagagaggggctgcttacacatactcacacagaggccattaatttagggagttcaaggtccaggaggttgacggcatctaggcctgtggcagagtgcactcctgctttggggaatgtatgggcagcttcttgcctgtagttggagggttagagagagggatcaataatttcatggttggacttgagtttggagcgagtggagttagatacaaattctatgtttttggagaaagtatttgatcttcttggctgtgaggcaaagcgaggtttaaaaatatttttcacttaaaaatatatatatatgcatgtatatttaatactgtctatggattgtgccaatatctatttcatggttttgatattgtgtagttatacaaggagttaccactgaacgaaactgggggaagggtacacagaatctctgtactttttttgttgttgttgcaatttcctgtaaatctatgattattttaaaataaaaaagttaaagcatacgtatttacatttgattaaatgcagtgtgatatcctgggttggattttggaacaaaacaaggcatgagtgaaaaaactggtaaaatccaaaaaagcctttagttaaaagtaataccagtgttaatttcttagttttgacaaatgtgccatggctgtgtaagatgcaaatgttagaggaaactgggcgaagaatttgagggaactctctgtactattctttgcagcttttctgtaaatctacaattattccaaaataaaagtctattaaaaatgta

SEQ ID NO: 183262 - DNA, 374 bp, Homo sapiens
tataaattacttcttgaggcaacattaaactgtaatcataaagaatgcttttgggggattgtgtaaaggaagggaacctaatggaaggtaagggccttcattctctttagatttacattactcacatgcagaaacctattttgtctctaagattcataaatacccagtaaaataaatacaggcacattgtacttctatactgtggaatactttctagacagatcaaccctgttactgggaataactactcatattcacatgtttgaaattcatgatatacctcccttcccccaccccaagaagaaaaatagctcctcttactgtgtttaactccgtgggtagcatcactatccattcctttgtatagaagttga

SEQ ID NO: 183263 - DNA, 1035 bp, Homo sapiens
aaggtggcgttttcatgcgtaatgacgaaaaccttattggacacaaagcgttcctttattagcaaaatatagatctttctgatgaaagaacaggcccgcgataccagcccctgaggtaagccggaagaggggccgccagcgtacgtggtcatggagcgatccttccagccacacacagttcgggtggcttagagacctgaacgcgtacagcaaatccagaacttgtaggaaataacgttctagaatatcttcaggacttatgggtgggaatatatgatacaaaaacaactaacttgaagcaattgatttgactgggttacgacaaaaataatctgaccttcaaaatacataactccatgatgaacccaaaatgccaagtatatgactgaacttacaagtgataccatcttacgactgaagagtgggaaataaaatacatcataagagagaagccacacagtagaaatttgttacacatatgattgacaaaggcaattatccagaatatataggatctaaacagacaacccaatcgaaaaatggataaaattactgaacaggtgctttggcaatgacaaaatccagatagtcaacaaacatgtaaggtgcgcaagcgcattacgaatcggggaaatgcattaaaaccacgattagtttcaattgattggtttttaaaccacactcactagattggcaaaaattaagaactctggccgggcgtggtggtggctcacgcctgtaatcccagcattttgggaagccgaggcaggcagattatttgacctcctgactcccgacttgaggtcaggagtttgagacaagcctggccaacacaatgagaccccgtctccactaaaagtaaaaaaaaaaaagattggccaagagtggtggcaggcgcctgtgatcccagctactgggaaggcagaggcaggagaattgcttgaatccgggaggcggaggttacaggttacagtgagtggagatcgtgccactgcagtccagcaacctcgatgacagagtgagactccgtctcaa

SEQ ID NO: 183264 - DNA, 416 bp, Homo sapiens
tttcgttcttccaggctatagtatattaaataggttcatctttttcattgggagctataaggttatattataatgaagacacaataactccattataagagttttgtaccacacttaaggttatgtgtttttttttttaagccaccagaatggttttatttttgtcattgacaacatgtacaaacctgcaattgtataattgttttgtttggtttttaaaatactaagtacacattaaaagtatgttttaagaaatatgatgcattaaagaagttcactgtaaacataattctcaatgtattttcctgccttgtttcatgcataaataacaatctaagtagtcataaataaaactatcaacttttgtggcccagaagtatatacaaattttgaagtttggcagaaggtgttctgta

SEQ ID NO: 183265 - DNA, 461 bp, Homo sapiens
tctgacttttatctgaggtgcatttggaatggggtcaccagaaaaggttgttatcaaaatgcaatttgtttttagggtttccaaaaagtagtttttatcgatatttaaaatgtggatctagcaaccttgttgatagaggccttccatgtttttcttaatagagccatttagtttcttccacttttcctttgatctgatcctatagacaagccaaaatttgaaagcacaatataatattaagaattaattgtggccgggcacagtggctcacgcctgtaatctcaacactttgggaggccaaggtgagtggatcagttgaggtcaggagttcgagagcagcctgaccaacatggtgaaaccccatctctactaaaaatacagaaattagctgggtgtggcaatgtgcgcctgtaatcccagctactatgaggcaggagaatcgcttgaacctgggaggcgga

SEQ ID NO: 183266 - DNA, 478 bp, Homo sapiens
acctaccttccgctataaaaactagtatagctttatgccaaatagattagtgctcattttggaaacaccaaagtttcagggctttctttagagccactagcctggataactgatccagcacaaaattgtcttgtccagcctttattaaaattcaacacagtattttcactcttggaggggcctaacactatcatgttgccctgatttgtgcctaacgctcattcataaaatgatcctgacttaaagtggtatgtttggtgctttctttttctgtttgctttttaaatcctttctaaatggcggcccatttcatttacatctctcatttcccctgaagtctttgaagccttttttgtaatgtgcctttaacaaataagtctctcttttttctccagcagtgtgaggcttctcaaatatttgtgttatgagttacggacaaggcatttcctgacctgtttccttaaaaaatccatttttt

SEQ ID NO: 183267 - DNA, 231 bp, Homo sapiens
agcttggttcccgcaaagtggaattttccataagtgggctggtggtgagtctcacagtagtaaatccaattattttgaattttctacctagttttataaaaagcatgagttaatcgtggtctctgagaaggaccacatctctccacaggggtctctgatggctccttggacactctggtgaggctgagtggtttacatggagcttaacttttatttactggtgtaaacttg

SEQ ID NO: 183268 - DNA, 526 bp, Homo sapiens
aacgttgggagcaagacaacaatgtgtgaaaatgacaatgtgttctcgatagtgaaaactgtgactaagatacattttcccaaaatgtaaaggtgtcaagccaaagaaattgaaagcacacttgagatatgtagctacctatctgatatggctgcattttttaaaaaggtatgggtcacattgagacttctcattaatcttaaattcatttatcacatggattatgttgagccctgtataacagttatctgtgaactaattcaacttgtacttggtttaaagccagtataatctttcgcctcctcatatgtaatattccatgtgataaatatttcaaactgagtttaagattatagttacctttccataggtatatatctgtttaaaatacactatgctcctcattccctaaattggttcatggaagtgaatcacaagtgtggaaatagtattatagtcaaataatttctaagtatcctagattgaaacaccaagtaggttggttaacatttttaaaacccatgca

SEQ ID NO: 183269 - DNA, 386 bp, Homo sapiens
tcctgggattacaggcgtgagccaccgcatctggcccttacccagatttttaaaaaatgtttttaaaaagtgtggtaaaatatacgtaacagaaaatttaccattttaaccattttaagtatacaattcagtgacattaagtatagccacgttgttgtgtaaccatcactaccatccatttccagaatgttctcatcttcctgagcagaaagtctacccacttaagcaataactcccatccccctgactcccaagagtctctatgtggctctatggatttgactcctctaggtcccttacatgtagtatcatacggtatttctctttttgtgtctggcttatttcacttaccataatatttccaaggttcatctgtgttgtggcat

SEQ ID NO: 183270 - DNA, 201 bp, Homo sapiens
tatctcctccagtcttgttcccttcaaatccatccaaaagctgccattaggctgagcgctctaaatcagtgtctaacaagacactcctctccctacaaaatagaagccaaactccttaacctggcattcaaggctgcccatgatggggccttatctcttgacaccttcttcttagtagatatagaagagtgcactttagga

SEQ ID NO: 183271 - DNA, 513 bp, Homo sapiens
taattacatggctaacaggtgtattcagatgattcagaatgtgttgatactgttttttagactattaaaaacatgaaagtaaaatattaaatttttagagaaatgtgaactccttgtgaacagaatcttagtttgagggaaattaatataggttaattcttctgttacatccttagttgaaataactaaaatggtttgcctggagtttcaggtggtactgcttatgtcaacatagattgtaactatttcagctgaatataattgaattttaataaggctccatgattttttaaaagatggcatttctttcctataaattccattacttttttctattttactagtaaagagccatcaatcaaaatatatcagactcactaatgtgactttttaccctgtttctttaatttctttagtcttcctagcaatatgctcttttatgcttagtttagtatcccaaatatagattactgctaattttgatctgctgtaaaatttttttctctgtgtgtg

SEQ ID NO: 183272 - DNA, 172 bp, Homo sapiens
tggaaagactgcataaagccaggagttcaagaccattctggacaatatagggaatccccatctttacaaaatattaaaaaaaaattatctgggcatggtggtgcatgcctgttgtcccaactactcaggcagttaaggtgggaggatctaagtggctttcttaatagtaatg

SEQ ID NO: 183273 - DNA, 532 bp, Homo sapiens
ccaattaggaggaatctagagaagtggtctggccacagccactttgccacgcccagcccagacttcccagcctcagcactgtcaggggaaaactgcctattcaagcctcagtaatggcggatgcccctcccgcaaccaagcttgatcatatcaggtggacttcagactgctgtgcttgcaccaaaatttcaagctagtggtccttagcttgctgggtttcatgggagttggacccgccgagcaagaccacttggctccctggcttcagccccctttccaggggagcaaacggttctgtctcactctcgttccaggcgccactggggtatgaaacagccacacagttttgtgcttgaaactcagggccctggtggtttaggcacacgggggaatctcctgatctacagattgcagaaaccgtgggaaaagcatagtaaccagtccctcacagctttccttggctgtgggagggagttccctgactccttgcacttcctgggtgaagcgacaccccaccctacttctgttcatc

SEQ ID NO: 183274 - DNA, 593 bp, Homo sapiens
gttgatctagagatccccgacatttgcactgggtgtcggggctcatgtctgtaatcccagcactttgagaggctgaggtgggaagattgcttgaatcgaggagttcaagtccagcctgggcaacagtgagactccatctcaaaaaaaaaaaattagacaatttatagcataagatgagatatccagttaccaatttaagtacagtaaggagtatctcaagtgaatacttcaaagtcaagtagatctgaatataaattctagcactttccagccctatggtcttgacccaactatgcaacctctctgaaccttgtttcctcatctttagaatgtaaatgacagtgaggtgcagtggctcacgcctgtagtcccaactgctcaggaggctaaggcgggagggtcacttgagtcctggagttggaggttacagtgagctatgattgtgccactgcactccagcctgggcaatagagtgagaaaccctgcctctaaaaaataaataagctaggtgaggtgactcacacctgtaatcccaacactttggggggctgaggtgggaggattgcttgagcccaggagtttgaggccagcct

SEQ ID NO: 183275 - DNA, 403 bp, Homo sapiens
cgccccgcagtgtggtcattgaaggcctctcccagctgtgccctgaccccgaggccttggtcaggtggtgcagcctcatgggacctcggctcactccccagtagtggcaaggaggttctgtcctgccagactactcggctccccactcctgaccacaggggtcacagccctgagctccaggcccagctacagggcctcgctttcaaagagagcattgaacaaggaatccacctcatctccggggcatgaggtgagcatcctggcttctccctacccccaaggcccacctgctcgtgaacagccttcctcctagtgaagcactttctcacgctttctggagctggggcttcccgctgggtatgcagcctctccaatgtctctagaaccatggcccaagtaggaa

SEQ ID NO: 183276 - DNA, 163 bp, Homo sapiens
cgaggcattcacacaagcacctgcctgtggtgtcaaatggatgtgtgaggcttggtctccagcagctctgcctggtgaagctgcagggttggccggtctgtgtgcttatgtgttaggcaggccgcctagttgcacactcttccgaggggcaccatttacttgg

SEQ ID NO: 183277 - DNA, 156 bp, Homo sapiens
gctggtttttatttgcagttcatattcttaaacactgctgtgtcttctcacaagtccggattaagaagaaagtgagagtatgaagatttgctctccccttatccagagcaaaccctaatgggtaggagtgaagatagtggggggtggggagagttt

SEQ ID NO: 183278 - DNA, 275 bp, Homo sapiens
aatgaaataataaacaggtgagcagataaataactaaataaacccagcctcaccaggaccaattctgatgttccaatattccagaattatcatggcatttgatggacggtttgagcctgtcctcattagatgttctcatgtcctgtgttaaggacttaagactcagaagatttttcatggattccaggcacgtgggagtggtacagacaggagcaggagtgggagcccgtgtacgggattcattagggaaacagaactttgctacgttgggaggg

SEQ ID NO: 183279 - DNA, 214 bp, Homo sapiens
gtgttccatttatgagctaattcagtcctcattttaaagttctccaatcgacggctagctaccgtgtcgctgcccctggctccccagttatggagatctgaggacactggggacacccagtaggtgctcgataaatgatagtgacaactcgtggagtcctgctatggcttacatcccagtccagctgctctccccaccccaccttctagcgggt

SEQ ID NO: 183280 - DNA, 719 bp, Homo sapiens
aagaaaatatttagataatttacaaactacgtaacattctataaaagtacaaagtgtgattaaatatagtggtcaagaaagaaactgagtaaataaactttgttatatatgtctaaaaaaaaaaagaaggggcagggggctccttgcttctagtgagcaaaggccttgagcttccacagccctttgtatttactggggagaaggagcagggaggaggtgctgttggtcagctgcttgatttgtcacaggttcacatgattgctaacaggctttagttgtgcctgtagataatcacaagaaacactgcgcctggggcatgactgccctcagcattcgttttaggcggcagatgcagtttgtcagtttgccaacaatctgctttcatgagaacagtttgctgtttgctcatatagcctccagtggtatactgagttggtcaccaccctcattcttttggcctccaacacttgggaggctgaggtgggaagatcttttgagccaggaggcgaaaggttgcagtgaagctgagatcacaccattgcactccagcctagggaacaaagtgagaccctgtgtcagaaaaaaaaaaaaaaaaaaaaaaggtttgattgatagtttgtgaccgtttgtgccacagcctgaaaataccattttcttaaatagtttgagggaagggaggatgctgtgatggaagacagatagggaaaatagttgatctt

SEQ ID NO: 183281 - DNA, 560 bp, Homo sapiens
tattgagtggtccatgtgatgatttaactctgtagaagttgtggatctgcgtgattctgcattgggagggatgaaagaaatgaaaagccatttgacaaggtgatagcaacctaaacaaacaggcttttaaagaaaaggatgtttatttgggatagagcattgcagtgaaaatacatgccacatgccatagtagactgtgtggatattcgcatattcagggaggtaaaggaaggcaagggttttgtttatgttttattttttgagacggaggcttgctctgtcacccaggctggagtgcaatggcacaatctcggctcactgcaacctccacctctcaggtccaggcgattctcctgcttcagcctcccgagtagctgggattacaggcgcccaccaccacatctggctaatttttttttttttattttttaagtgaagttggggttccaccttgttggccaggctggtctagagctcttgacctcaggtgatctacccgcttttgccttccaaagtgctgggattacaggcgtgagccactgagccccgcctggcaaagg

SEQ ID NO: 183282 - DNA, 335 bp, Homo sapiens
  misc_feature (203)..(203): n is a, c, g, or t
  misc_feature (221)..(221): n is a, c, g, or t
  misc_feature (232)..(232): n is a, c, g, or t
  misc_feature (276)..(276): n is a, c, g, or t
  misc_feature (292)..(293): n is a, c, g, or t
tattgagtggtccatgtgatgatttaactctgtagaagttgtggatctgcgtgattctgcattgggagggatgaaagaaatgaaaagccatttgacaaggtgatagcaacctaaacaaacaggcttttaaagaaaaggatgtttatttgggatggtattgagtggccatgtgaaatggtgcagcatctttgtaaacagttggnctgttcctcaactaatcnacgtagagtgnccgtatgacccaataattctactcataggtataagaacaggcanatctacagaatgtaannagatcagtgattgcctaatgctgaataggcagaggggaccgg

SEQ ID NO: 183283 - DNA, 480 bp, Homo sapiens
agcatgttagacatactgttctcattttgctttatttaataatgcatcttggattttgttccattaccactgcagaacttcttcattcttttaacaagttgcacagtatattccatggagtaccataatatactgattcagtctcctattgatgacaattaagttgtttccagtcctctgctattataagtattgatgcaataactatacttatgtcagtcattttgctcaaatgaaaaacacaaatgtaggaaaattccttaagtggaattgcttagtcaaaggatacatgcatttaagttttttttatagattggccttcacagaagttgtatctaacaatttatcattccaccaaaaagtataaaaccaactgctttctcaaaccctttatagccagttttgatcaagcttctttatcttcaataatatgatatatcatgttttccatttaattttcatcaggagggaagtctgata

SEQ ID NO: 183284 - DNA, 435 bp, Homo sapiens
cagcttggggaggaggaggaagagggaggaacttcatcagcttaggaaagcagaggcttctataactgccagatgccttaggtgtcctccaactgccagtgcaggacagaagctggcttgaaggcagggggaaggttgggccctaacacaatgacttcagattcatgcagaacattgtcctggagctaaacctcaaagccactcttagccaacagccataacacagctttcttctagccttcccaggggaaggacttaagtgctgcttaccaactatcaaggaggactttacaatactgccagtaactagcgtgtatggaacatttgctttgtgcttggcacttgcctgggataattccttacagcaccctagtgtgaggttagtaatagtagtatccccactttacagatgacctggtcaagatttgaacccaa

SEQ ID NO: 183285 - DNA, 549 bp, Homo sapiens
ttcttcttttgatttggattttgaaggatgaattagtttactagccagagataagaaagaacactaaagaataaggtgcaacgtatactgaaaggcagggaaccatacaattcagttctggatttcaagatcttcaagtgctagaaaggggccattaaaaatgactgtggacagggagaaagggcctattaatacaaggccttgactttatcccgttgaagggttttaagcaggcaagttatataatcagatacgacttttagaaactcaacactagctgcagtgaaggatggtacagattggataagaatgtgtaggcaaagattactgtgacagtccaagtaagagacgaaattatgctattatgaactaaagtaaaacaactcagtcattatcttcctattactatgtagtaatgctcagttaaattcattttgtcatactaattttagctctgaagcacaactgctttaatagaaaatgaagccttcggccgggagcggtggctcacgcctgtaaatcccaacactttgggaggccgaggcaggt

SEQ ID NO: 183286 - DNA, 390 bp, Homo sapiens
atatttgaacaatgacagggaaactctctaaccctaagggtcatcataagcctatggtcttctatgtggggtcccagaatccacagaccagcttacctttcatgatgggggcatcacctagggacaggatgttggctccccttcatctgcacagcctgcagagggaagggagcagccacccaagctgagggaggtcaaccccatggtccagcctgttcccaaggagacaatccctccacggcagaatatgcaggtgcaggttgctggggtgacagcttaagggcccgagccttctctgcaggaggaaggggctggaggtttaggttccgggggcaggactggccgcagtcctagcaggggtgaccgaggctgggccaggctctgggagaa

SEQ ID NO: 183287 - DNA, 604 bp, Homo sapiens
ggcaccaccatgaccctgatctgcagcccacattcaacgtggttgtgaaatcttggtgggtggatgatggccccaggttccagggcaaagtagcatggtctgtgtctagtttaggaacaagtgaatgggaatcctgggcatatcgttatgtggatttgctacagacagttgggacagaccaggcggcccctgatttctgcccggattcccctgtgttaggagctctggagaataagactttaaccagagccaaagatgatcatgattaggaagggcaggcccagagtgcattccaaaggcaaatttaaaggaaactgttatctgccatttagatcatttacgtgtgtttccatgtcctacacctggggagttgaaaagccgcagaggcagaacactagtgtgaaaaacatgagtcttacagcctccacctgctgtcaccctacagagcatttgatgcctgctagagaagcttctctagtgatttgagacagtgtgggacacatacccgatgaggggaccattatactgtctgacttatggttctggtttttattttttgatagctctcaggaccaaccccaaacaagaaaatgttttttacatt

SEQ ID NO: 183288 - DNA, 367 bp, Homo sapiens
ctcactagggctgcggtatgcaaacgtgctgaggtgaccccagggcactgaggagcatttaaatattcaagagaaacaaggtgcatgtgccagacaccaaaagaactggttcgggtggctgctggaccacagcaaactgcacagcgtctcttctgtcggcatcacatacatacaaagctgggttttccgtaacgctgtaataaacaagcagtactctctgaaaatcaacatggacaagaagtcagggctcccagggtctgaggagctcggaaaggcccaagaggcacaactgtcccagcagacagcagctgtgattaagaataaaatgaaagcttcagttttccatcattttatgtgtactattttt

SEQ ID NO: 183289 - DNA, 234 bp, Homo sapiens
gtttctttaaaagaatagaaatgatcatttctgaacctcacaggcatggcaatgagtaaatgaggtcatctgtgtatgaaattcattggaaactgaatgttttaaattcaaggttaaggtgagaatgtaccatattattactagtatttaaaaggtaagaatgtggaatattattacaggtatttaaggggtaaagatatatttcaaaaaatattaattcacatacaactcttg

SEQ ID NO: 183290 - DNA, 421 bp, Homo sapiens
catctagttttccttttgtatatcttctccttcatgttcccaagcgaaatgtgaatttccatatattgaaaaaaaccctagaagaaaacctaggcaataccattcagcacataggcatgggcaaggacttcatgtctaaaacaccaaaagcaatggcaacaaaagctaaaattgacaaatgggatctaattaaactaaagagcttctgcacagcaaaagaaactaccatcacagtgaacaggcaacctacagaatgggagaaaatttttgcaatctactcatctgacaaagggctaatatccagaatctacaatgaactccaacaaaaaagaaaaaaacaaacaaccccatcaaaaagtgggcaaaggacatgaacagacacttctcaaaagaagacatttatgcagccaaaagacacatg

SEQ ID NO: 183291 - DNA, 282 bp, Homo sapiens
ctctgacaagagaggacccctgccccctgctccccggactacagcgaggcaggaaccacactcctcccaggtcctcactatggcaactgtggacccccgccctggtacccatggactaagacactgaaggaccgtgaccccaccacgccgtgaactccagcattggaggaccactgccttactgcggactcaggcactggactatcgcagggcaggatccctgtcccgccatgccctacactatggcacgggaggacccagcctcactgtgctctggactcc

SEQ ID NO: 183292 - DNA, 786 bp, Homo sapiens
cattgtttcctgtctgaacaatttcagttgcctcctaactcattttcttgcctctattctcccactcctataatctatcctctaccctgctgacagggtgatcttgtatcacacaatttcatcattaaccttctctacttaaaacctttcaatagctccctgaatgccacaagatgaagttaaaacttctttgcatggcaatcagggtccaacatgattgttccctgcctgcatctacagcatcgtttctctgtactcccctactacacataagtgatagtgttccccagctctgccatgctatttctagttaactgcctttgcccctgctggctcccttactgaatgttcttcctccctctgaccatctgggaaaatccttccattcccagcacggatttatcagctcttctgtgaaacttcctctgatcccccactccaagatatgttcagctgaacactcactgtgcctccatggttccttgaacatccttcagttacggcacttagcataatggtattaccccaacttgtttccctatctgcctctcctctagtgagcaacttgagaccatgttgtattcatctttgtattgtaaatgacaaagccaatgccttcacaacagcatattagggcccatgtgatcagacacccttgtctcccttacttcatctcctactagtctcatgcttacccactcagattctgccacacagacttccttgttgtcactcaaactttccagatacattcatgtccaaggcctttgcacttgatggttccac

SEQ ID NO: 183293 - DNA, 382 bp, Homo sapiens
ggctgagggaatgtgtactgactgtcgtggttgctcatggagttgaagcaggataaagaaggaagtaaagttatgaggggaatgagaggacagtgaaaggcagtaagatgacagtagactacagtaggtgtgaatgactgactgagttgggctactagagagactgagcacctagacagagagggagatcgtggtgggaaataacatgggacagctattctctattaagcaccaacattaaactagttacttcttttatatcacctcatttaattatcagaatgactctgaaagatgggcattattatccatccctattgaaaagatgaagaagttaaagctaaggttaaataacttgtccaagaccaaaaagctgctaagt

SEQ ID NO: 183294 - DNA, 123 bp, Homo sapiens
aaaccggtccgtgatgtatcgcccaacactatagtaaggccttaggttttcacttcctgtaggacaaaaatcttgtaaatctcttaacttttcttaactatttgttcagtgttggggataaat

SEQ ID NO: 183295 - DNA, 391 bp, Homo sapiens
agaggtgtgaaatatgtaggtagaatagacagactttggcgatggaatggatgtggataggagagaggtcggtgtccaggattatttgcagactttggctgatgtacctaggcaagcagtgggatcatttactgagaagataaaacactggattggctgtgggaagatcaaaagttcagttttgaaagtgttaagtgagagagacaagtggagatgtcaagtaagcaattgcatgtatcagtgtgaaactcagaaggaaggtcttccagcatctttccagcttaagaaggaatatctttttttgaaagaaaactttgaagttgaaacatgtttacattttcttgggtattttagcaacaaacctacctatttcacaatcgagttatcagaa

SEQ ID NO: 183296 - DNA, 254 bp, Homo sapiens
cccagcactccggctgctgccagtggaggcaggagcctcgttaccacctttctgagaaattcaagtgccacacagtggtcaccagcattgtagctgccctgatgttccgggctcagctgcaatatagcacatctctaccaccatccccagagtgacctccagaactgtaagggacccccgcctttggtacagagatgggagttaaacacaggtgtccactggagtcatgattcctctattccctggacaaatat

SEQ ID NO: 183297 - DNA, 171 bp, Homo sapiens
ctacaaaagccgctcgcaagagtgtgccctctactggaggggtgaagaaacctcatcgttacaggcctggtactgtggcgctccgtgaaattagatgttatcagaagtccactgaacttctgattcgctaacttcccttccagcgtctggtgcgagaaattgctcaggact

SEQ ID NO: 183298 - DNA, 438 bp, Homo sapiens
ctatgagcagtaaaccagttacacatttagatattatgctaacttaatagttgctttgcctgtatctacaaatatgtatctttgattctgaagtagaagtcttatgatacctgccctcttgacataagttactaaatccttggataggtgatcacttcaaaattttgtttcttcagtttttctatattttcttccttcctttccggtttcaatttgtgactttttgtacctttatttttattctctttctcaacatactcatttcccttctttattctcttatgtgccaattcacttactctttctgcttccaattttcttcctacttttgttctttttaaattttctcctatttatctctctctaaactgcatcttcattctgtatctgttattatttgtgttactcattctctcactttttctctctaggccttta

SEQ ID NO: 183299 - DNA, 369 bp, Homo sapiens
gatgtgtaagagcatacctgttgtaaggaattataattttaaaatcattctaaagaagcaccattgtttctaaggtgatttctactgaacaagcagttcaaacaaagtagacagggaagagaaatggctatcagtgatgtatggctcaacaggtaaaacttcctgccttctaaaatggctctacttgtaagattctgaagattccattagaaatacttgtatttaaagggtaataatgtgggaaaatgaatatgttgatttgcttgattataagaaccacttcactagaaataattatatcaaaacataatgttgtactccttaatgtaggtgaagaaaactaaaataaacaaaaaaaatctaggaata

SEQ ID NO: 183300 - DNA, 408 bp, Homo sapiens
cacctcggcctccctgagtgctgggattataggcgtgagccactgcacctggcctcatttccttcttttcagtggataggacatcacaataatccagaaaatactaagtcatctagaaaagtatttcccattttgtatacttgttttacttgtttccctgttcaaagttgcaaagagatattccattactccttgcataacttattgtgtaataaggtcaatttcagcttttcagaatagtgaaatagctctgtttttatcttcctatggaaacagtaagcaagtagttctgtcttcggtttcagtttcaggattgcagcaatctcttttcacggttatatttctaattttctattatgttctttgttatgttgattagtgacccaaatctgttgatttgagataagt

SEQ ID NO: 183301 - DNA, 486 bp, Homo sapiens
gggtttgtgggtgtttgcacagaaatgacatttcacatccgaattttatgtcagaagcctaaaagtacagaattcagctgggcgcagtggctcacgcctgtaatcttgtcactttgggaggcccaggcaggaggattgcttgaggccaggaattggagaccaccctgggcaacacagcgatactccatctctagaaaaacattttttaggccggtgcagtggcacttgtaatcctagcactttaggaggttgaggtgggtggattgcttgagtccaggagttcaagaccagcctgggcaccatggcaaaatcccactggtttctacaaaagatggaaaaaattagccaggtatggtggtgtgtgccatgtagtcccagctactcaggtggctgaggtgggatgatcagctgagctttggaggttgaggttgcagggagccaaaatctactgcctttcagcctgggtgacacagtgagaccctgtct

SEQ ID NO: 183302 - DNA, 274 bp, Homo sapiens
agaggagaactgggtagcggggggacagggaagagaagactttttactctatacctttaatacattttgaattttgtactatatggatgtattacctactccaataatagcgactaagaaagtgaaaagcacaacataccaagaattgtgataaatgctaagaaggagaaatatagaacagttagaacaaacaatggggagccaatctagacttgtttggacagggaaatttttcctgggtaagagatgtttaaaatgagacctaaagggtaag

SEQ ID NO: 183303 - DNA, 345 bp, Homo sapiens
cagtaagagattggcaagagcagccctgctgatgagcctgtcacagaggtaccatgataatcctggaccagtgagttatctttgtagcacaaagaaggttggaggcacagattgctgtggactgaagtaggaggggagggagatgctctcgtaatctcatgttgcctgagtcagctttgccttgctattggcggatggggctggtggcctgtcatgtgtgcagatgagtcagaggaagtgggccctccctggctggtggcttgccccatgccttggggcatagctaagcagttgcatgtctactaaacagtcttatctggaagcaaatatggaaccaaacacctg

SEQ ID NO: 183304 - DNA, 194 bp, Homo sapiens
tgggtgacagagcaagactccatctcaaaaaaacaaagtcttttgcggtctttgattgattaataaatttgagagaagcagataactgagagagaaagagaaagagagcataaactaacaataaaatatcccctcagtctaaacaaactcaacattgatacagaacttttgattttggccaagtgttgaccaat

SEQ ID NO: 183305 - DNA, 355 bp, Homo sapiens
ctcccctaccccacaacccctgctttcttattacaaacttttgtgtctgacttcaccaaagtatgagctttttactcatttctcaacgtattgcaaacatggaggccaaaaccctcttttgattaacgtaacctcttttcaagatttccaatattcgagcttcctcctctctaacctgatcaaactctatttacatcttctttcctagttgatctgattacagtagagacttaatttttaaaaattatgtctgagtaaaactagtgttatctatcagtaggcattataatacaaaagtgctgggaagcactttaaataatgccgaagggaggaagggaagtgctgggtagaggag

SEQ ID NO: 183306 - DNA, 309 bp, Homo sapiens
aatgagaggacatttgcagagttaaaatggaatccggttgcattataatgctaataaggacaacgttatttgacaattctctaaaacagacaaagctgataaatggacaatttctagcatcaaatgttatctggttatctaagaacttgatgggatttttaaaatgagtttatcatatctttatgttagagggtctcaatgattttcaagttggattttcaaatacctgcatagttttaacaacactgaccccactgatcacagctttcctggtaacaatgataattaccatatattgagtgtaaacct

SEQ ID NO: 183307 - DNA, 184 bp, Homo sapiens
attacaggtgtgagccaccgctcctggccagagtgacactattctgatggcatgcttgtgataaacttcagtaaaaaacatatcttagggaaaaagaggcttggatttgagaaagttgagtaagaatttgaacatatttaacatgtttgcttatagtgttcaataaagttgggagcggtagtaa

SEQ ID NO: 183308 - DNA, 536 bp, Homo sapiens
cgcacgtccccctcaacctgaaatcaaagtgaaaaaagtaggctgggggcggtgattcataatcccagccctttgggaggccaaggcgggtggatcacctgaggcaaggagttccagactaccctgatcaacatgctgaaaccccgtcactactaaaaatacaaaagtagcagggcatggcagcgcacacctataatcccagctacctgacaggctgaggtgggagaatcccttgaatgcgggagacagagattgcagtgagccgagatcgcgccattgcactccagcctgggagacaagagcaaaagtccatctcaaaaaaaaaaaaaaaacgctacatgactacatgtaacagctactgggaacattttattgaaattttttaagccctttaaaatgttagggtagtgtcttaggaaatcagggatttccaaaggcaggacttcacgacgccaacttgagtgtgagaaggattcctttctacgtagaaggtgcatgcctgctctaggcttccacaaatccccgaaacctaataa

SEQ ID NO: 183309 - DNA, 404 bp, Homo sapiens
gaatagggactgttggaggagctaggatgctaaatggaaaactttacattgcattggtaacttaagtaaagcagagatgctgacccattttttaaacattccaaataaccaaggttttgctttaagagattctggttaaattgcatttagtgtcatcaaaagcggtagcttgattgaggtgaagatgtagtctgtgccaaggatgataagaagaaaagcaaggaaatagatggttgaagatagagagtagtgtgaagtcgttcttttagtaataacttgatggattgctatgtaagattacagacagttccatgaacaggatgaagtctttgatttgtgtatgtgtgtgtgtgtgcttgtttgagtacctttccttgtgaactcagcaggagacagtaaataca

SEQ ID NO: 183310 - DNA, 794 bp, Homo sapiens
ggccttcagcctccacttcctgccaaagtcaacaaggaacggccactcgtggctccccagtggtttgctgggacgtttaaatagcttgacagaattatctgattcactcaaaaatatgctaagagggcctgacttcatgaccaaatttatttaccctggctcagagaagacgccgaatagggtattttttttcccagccttgtgcgaggtatgaagccctcagtctgccaggctagtgaggttttatattaatttttataggttccagttgaagcaaaaatatttgatttaggaatcatttgcatgactcagaggaggagctccagaagatcttttttgccttttaaagggttcaggtagagcagcatagcctcaggcgtcatgtctgctgtggagagagttgtgttctgtttaatttcaccagctgtgaaggtggcaaatgtgaatttatggtggagtgagacaggaaaaacaaacttttgaaaacacatgttttttccccttcatatctggttcatcttaatcctgcaatgctgttaatctctgggatttgcaactgagaagattcagaaactccaaaaaagacaaagcaccaccgacgagcaacagcgccgcaacagcaagcaccacacgccacaacgcgagcaacacaagcgagacaccaacaacatcaggcgccaccgcacagcgaaaacaaccaacaaactggggggcgcaccccaagacaagcgatcacgtaaagcgaaggaggaatagggtggtcccaccaaaaacggggggcggggcacacacgc

SEQ ID NO: 183311 - DNA, 523 bp, Homo sapiens
gactggaccctttgaacacctctttagctgagcttctaggtcagccagcaggagagaaggaaagagggctttgagaggagagaggagcagctcgacaagaggagtgaaggcccctatcagctggctgctgagctccagtgtcaactggttgcagggatgacctacagggagggatttaatgaggagctgaagttgctggagcaaagttggaagatgctgcaccctttaaggcaagtgggcttccagtgacaaaggtgatggatgatgtcatggtgagtcaatcattactgatcatttgagttggccattattttaacagattggcaaataggtcatgggaatagggttcatgaagttggggttatttcttctgtgaaaatagcctggttaagaagagtggaggtgcaaataaaccttcacaatgagaatgcgtatgcatcggccattcctggtactggtaagctaaaccatgttttgagtaaaaaacattgtgtcactgatacccacatctgccaaggagaac

SEQ ID NO: 183312 - DNA, 221 bp, Homo sapiens
gatcccagggaatttacaatggagggcatattatcagtttctattggcaccataattctgcacaacaacgaactgaacctcaatgtggcaaacaaaaatacacatatttaagttcatgaatctgcagagttcagctgatctgggcaggcttgactgacctcactcaaggcttgcacacctgtctggtcaatctacagtggcttcagttggaatgactagga

SEQ ID NO: 183313 - DNA, 308 bp, Homo sapiens
tgtttcactatttcccaacagaactctcactcgatggcatcaattacaagaggaaaagatggttaatcactatctaaacttaaaacatctgtttaaaagtttttattacaagagctatccaaaaactgttagggcacagaaggaaaactagaaaatcactgaggaccgggaccgaatcttacctaccttggcagccctatggcacttagcgcaatccctgcatctaacagctccataatacagttgttaatggtttcacttagtgtaggaagtggatttttattttatctgtattaatttttttcaat

SEQ ID NO: 183314 - DNA, 454 bp, Homo sapiens
ctgacatggagaaggcaggaggaagggagaagcatttggagatggaggtcaagagtactgtgcaggcgtaaattagggatgtctattagatgttcaagtggagatgttgtataggccattgggatgacccaactgtagttaatttggttgaatgaatatgaataaatacatgctcagcagcaatatcattagaaatcttgaagtcaggagttgatgtgattatgttgcctttctctctagtttaaactttctatcaggtagacatcattttggtggcctgtgaactttgtcttttttcccacagttgcaggagagtggtagaaagcccgatgtgtcttctgtgccagtgctacagtgagacaggtccaggcctggagatcacactgtgggaaataggccagtttggccatggagtaaatggcaattagtttattttagtccatttctctccaat

SEQ ID NO: 183315 - DNA, 711 bp, Homo sapiens
gtggggagaggctggaggtgaggctgctgtgctaggagcttaaccaccagtgaagggttgaagaaaggaggtgggggcagggggaatgactgagtgggcaatgacagaggcactcacgtgactggccaagacttgtctgcaggagaccagggagctatagccaggcagctgcagggccattgatagaagctgccatggcttgagcacttgctctatgcatactcacgcaagcgcattcgtatatgatctcgctcatccctcacactgaggtcatttgtgggatgcaaatggccagccttatgcttctgccccatccacacaggtcaggggccatactctgtgccactgccagggggatcctttcataacctgcatcagatcatttcgctcctctgcttgaagctctcccaaggtttccttcttgcccagagtaaaaagccaaagtcctataaggccctgcatatctggctctagccatctctgtgtccccttctcttacactcccttcctccttccctccctctgcttcatccacacaggaccccttgtcattcttcaaactcttgctttagggcctttgctcttctccttcttccgggaacattcttccccagatgtgagttcttcttattagaaaggtcttccttcatcacctgagtaagacactaataacccgggccagcgcattccattttccctcactctgtgtta

SEQ ID NO: 183316 - DNA, 431 bp, Homo sapiens
gcgcctgccagagaggagcaactggctggttcccgcattcgtttgctctgattcccacactcactcactcgcttgcacactgcctcttgcaaggggtttgagtgtgtggtggccgagtaaacgagccacgctccgagccatgagggggtcaagggaattatccagtctcatctcaatccgacttccctcttcactgttttacttttgtaaaacccttgatgaacttcccattgtcaattcagggtctttttagctctcatcctgccagactgttgataacacctctgatttgtgctccacttttggcttctgtgtcatattgattcctgagttttcttccttctcctctattctcttaatctcgttttctggttttctcccatcacctgctggttaagcttaggggttatttacacttctctccttggtca

SEQ ID NO: 183317 - DNA, 475 bp, Homo sapiens
ggcaattataagagctataaatatttgtgtacaggtttaagcaagtgctttttgaatgaacaggtgaataaatgatcagtataatttcaaccatgtggttttatggactgctatacataagcaaaatttgtgataagcctcattggaggcacatagagaaatggacatatacataatatttatatatattttatggatacacaaagattatatataatgaatagttctaaaatagacatacaaacaatgtttttttcagatttcaaaaatggtggggttacttctggctagttgtggatgtgggtaaggtatcatcaacattatttggattctgaaatcaaacaattacttcccaaactcagaggcttgacactacaaaccaaagaaatgcatgaacctgcccaaagatttgtttattttgttatttatatagaattaattgactatttttaaaatgcttccaagaggtccaaaa

SEQ ID NO: 183318 - DNA, 394 bp, Homo sapiens
gtgagaaggaccgtctttggagtggtaaggactgtgttttcaagaaatctggcaaagggaagaaaaaggtcacaggatatttgactatgattataaagagaaagtgaagacacggcagagagaaatacctgatgaacataggtcccaaagaggcctgagaagccaagaataaagaagttatctggagcagggcatttcctaacatatctgagctggaagcaaaagtgaacaaggggagtgaaaaatatggagatttttcaggtagagaacgggcaagcagaggcaagttatgtcagagattttactttctttgtaaagtgtgagccaactttgagttaattccaaggcctgggaatcaaatacattagaaaagtttgaaattggcagattggag

SEQ ID NO: 183319 - DNA, 240 bp, Homo sapiens
accatgccgggaatcctcaagagataagcagcaggccttcaaccatggtatcggacgtggatatctacaagtgaacaaggggagtgaaaaatatggagatttttcaggtagagaacgggcaagcagaggcaagttatgtcagagattttactttctttgtaaagtgtgagccaactttgagttaattccaaggcctgggaatcaaatacattagaaaagtttgaaattggcagattggag

SEQ ID NO: 183320 - DNA, 520 bp, Homo sapiens
ggcttcagcaattattgagaaattcatcctcatcatattaaggggaagcattttcccctcacttggagtcataaggaaatcttgaggagcttgtccaatccaataaaaccaggccagggcctctgagtctcctgggacttatagtgaattgctttctgtgcagcctgtttgcatccaggtttatggggacctttgccaagtatcctaagtgtgagcacctggttccacccactctaagcatgtcacacatccatcttcccagttgtgggtcacttcttgcaaatggaatacaggtcttcccaatttgaagagcaccatcgccaccactgacaccaaaactgccaccctcttcttggctctgggaagtcatccactcccctcttcctgcgcaattaggaacttcctcctttccccttctggaggtaagtccagacgtcttttccagatacctttaccttctaaccccaatttagggagagagtcttcagagtggcctctgtagcatggggataccattaac

SEQ ID NO: 183321 - DNA, 291 bp, Homo sapiens
gggctgttggggacatgacagagtagccctgtccaagggagacatactactcggtatgtatttctaatttaatatagccctatattttcttaaaagaatccaccaaaatgacatttcagaagacacaaaaaaactaaggagaaaaactgcttgtgacagaaagtccagagttcaaagagctaaagtatatagtggtattcagagaactaaaccctaatgaagtcaaactctcaaacaatcttactataaaatacagaagcatgtgtggtaaattagaaatacataccgagt

SEQ ID NO: 183322 - DNA, 171 bp, Homo sapiens
tcggcttctgcagttatgcatgtgtgtagagaggacacagggtcgtatgttacagatgtatccagccgagccaatcctgggctgcagagacacatccacatgcaacatgtgcctccctgtgggtaaccgggacaggtgcacgggatgtgttagccaccaggagagaagaga

SEQ ID NO: 183323 - DNA, 457 bp, Homo sapiens
ctactctggcaaggaccagggttaccttcagacatacctattgaacctactcctatgtatggacactatactccacccaaaaagaggataattgtgactgaaacggacaactcaagatgtgactcttaaaaagctgcaagatatctattgagcacttactgtgtacacagcagcatgctaaactgtatttggtatctcatatttaaaaatgtaactgatgactaaatgcctgtgtaaatgtctcttacacaaaagagaggtgtctatgaaactatgaatttcaaatgttatttcaagggcagtagaggaaactgatattttagaaatccaggatatagaaatcctcttgcaaaatgaagagcttatataatgccagtaattgccctctgatttatctgatttgtccatgatgaaaataatacagtaattgtagaaaatatatcatttgtttattttt

SEQ ID NO: 183324 - DNA, 804 bp, Homo sapiens
caaggtgataaatggaaactgacactcagctctaacgtcaaggagacagtctgcagtgatgaggactggggaaattggagagttcatgctgtaactgaaatcagtagtcagaagctatttttatagtggcgattgtattgtacagtgtcaccatgatgtatattgttataatttacatatatattatctgttggattgtatcaataggaattttcatttcctgatattcattaagcatccttgaaatttgccccaaagtgttactgattcaaataatcaccctttccaccaaaaaaaaccctggtttcctgttaacagtgaaggaattttagggcttgatggggtgttatgttccttggtacagacagctgtggaagacttgagttctatgttgaaactggttttaacttgtaatggtgtggctgatgttacccgaccaacaccagatttcatttcagttaattaaataagtacttaatgagaggaagaaagaactgagcagtgttttatttaggacttggagaacatgggtgagtaaacagtaacaatgtcctaaatgggaaaggtgttctaatttcccaaaagtcttcttgtaattatatttgagacatcttacaatagtatctggctattaaggcagaatgtatttgcagatttaaatattttgcaactgcccaaagatatccattagtgtgggggataacatcacgcaccaaatgtaacaagtaaagaaagagaacagaaacatgaaaagtggctcaacagtcaaagacaagtttaacttctggagaataaacctgagag

SEQ ID NO: 183325 - DNA, 260 bp, Homo sapiens
caccttataagatcccaggcccacttcagtgcatgcaggcccccagatattccagtggaaggaggaaaccctctcaaacattcccagtcatgaagctgctcaccacacacctcaaacctacagagatccctcaatatcgccacagatgtcccaagtacaatgccccaaacatgctcagagcccccacatatgtgtctctggacactacaaccaaatctatagagacgttctgatattctaaccttaggaggcccttccaa

SEQ ID NO: 183326 - DNA, 264 bp, Homo sapiens
atactcaaacttaccaactgtggccactcttggcctagtcaaagacaaaatatatattcattttaaggatacaaaagctccagtttgggaaatcctagaccttccatggaaccagatgtatttctcttataataacagtaacgaggctgggtgcagtggctcacgtgtgtaatcccagcactttgggaggccaaggcaggtggatcatccgaggtcaggagttcaaaaccagcctggccaacatggtgaaatcccatctctatt

SEQ ID NO: 183327 - DNA, 557 bp, Homo sapiens
accaggatcttaggactggggagaacggtgggggcagagagcctgcagttggtgggcccaacctgtagatgagaggctgaccccaaggcagggcaatccagggccgtgacctgcagagaatgcggcgtatttgggaacaaagaccctcagtggagactggcagtgggaccctggcttcatgctccgcgttcctcacctgagtccccacctcctggtctcggacctccacctgtccccagaggctgttcagcactgagggggcaccgccaccctgcgttggccagatgcgcccagcttccccggcagctctcagggcggcctcacccatgcacacggttctagcggccatgtgtatcacaccacacgatgggacacaggccctggggcgtgctcaggcctttgggggccgcgcagacctcctcttgccctgtttgtgcctgatttctccatcagaaactaatgacacagccagattcccccggcatggtgccttccttatctgtcgcgagtgctgacagaggaccaccaagttgggcagcaggaattggagcgggcgg

SEQ ID NO: 183328 - DNA, 301 bp, Homo sapiens
gtctatagtctgaaaattcctgcttttgtgcctctgcttaactccttgcctgaaacactattttcttctctctccacctatccaatttccatttcctttgaggaccagctcaagcccctaattctttcacaaagctgggaaagcttgtctaccacagcccatagttatccttttctcctcacaaatccaaaagcactttcatgtggtcatttggttttaatactattgattagatacaatgaacacactactcaaatgcttatcttttttcctcttcagttatccttgaggaatagcttaa

SEQ ID NO: 183329 - DNA, 425 bp, Homo sapiens
accccctctatcatgcagaatgagttttcttctcaccacatgctcaccagcattcagtgctatcattgttaataatttaacaaattgactgggtgtggtggctcacacctgtaataccagcactgtgggaggctgaggcaggagattgtttgagcccaggagttttgagaccagcctgggcaacatagtgaaatctcatctctacaaaaataaaataaaataaaataagctaggatggtgacgcacgcctcagctactcaggaggctgagttgggaggactacctgagcacaggatgtcaaggctgcagtgagctgagaaggcaccactgcactttggcctgggcaacagagtaagatatgtcttcaaaaaacagtaagtaaaaaattagctgtgcatgataggagggggggggtaccgagctcg

SEQ ID NO: 183330 - DNA, 219 bp, Homo sapiens
tatctcagtgtctagttacttataacactgagttagtttggatgcccacagccatcatgtcctggtgattgaatggtgttccttttactctctttgagtcctatagtcatagcccttggaaggcaaaagtcacctcagagtttatgtagcccagtgacctcatgttacagatgaaggcttttggccttaggttaaatgagttgctgcctagtcgtgaac

SEQ ID NO: 183331 - DNA, 410 bp, Homo sapiens
gaataaccttgaagaagactcccttgcaatgagcaacaacagaagaagcaagggacctggaatctggcagacctgggtttgaattctggctctgtcactttctggtgaagtgacttgagtaatgaacatgagcctttctgggtagcgtttacagctcccggagcctccatctccctgagttcaggtatcttcccacctcagcctcctgagtaactgggactattttgggactacagggaaaaatttcaaaacactttgcaactttggggtaaaagttaaataaaacactgtagccccaagttaagttcccactgaaatgatacttttgctcctttttttaaaaaaaattccataaatagtaaataatgactgttttgagattaatttagaaacaatccctatttaagagc

SEQ ID NO: 183332 - DNA, 1462 bp, Homo sapiens
caccacgcctggctaatttttgtatttttagtagagacagggtttcaccatgttgaccacactggtcttgaacttctaaccatgtgatctgcctgcctcggcctcccaaagtgctgggattacaggcttgagccaccacgcccagcctaagattttatgattaaaaaaaattcaagctcaatacccacataaattataacgtttctcaggaagtagtcccttaaccaaaacgtctctgagaagtgatgcttaggtaatctctgggatccgattttcccacatgtctcactccacagtatgctaaagaagaaaaagtgagtgggcacaacactttgaccctctggctaagccctgggagtccctgacaggtccagaaacttctctgacacccattcaccagggtgctgagataggagaaagtgctcatttataatgtgtattctgtgcagctgttctcagacaagaccggatcttgtcatcttaccttttgctttacaaaaaaggcctgttgaagtcaatgctgtcttgccccttgctgtttcagcaggttagactttggtcttcactgcttatagctgcattggaggccaacgtagctgatgctcagggtcaggcctcgccccttcgccgcaggtctcaggatcggggataacatcgctcccaccctgctcatttagagatgggaaacaagcaagagcttgacttgcctcccatccctcagcctgtctgtggcagagcctgcaccaaaacccagagcttcttccctccgtgagggccacgctgtcaccacagtcctcccagatgggttttggattagcatcagtcctgtgtcaccaagtgccaaacagctgaggggtagaagtgggactcctttcccgagccccagcatgaggctgtggtgtcaggtttaggcctctctcaagtcagaaaaccccgggctgagacctccacagacaagggctccccatgctggccattggcaggggcccaagaagttcagtgaccaactggtccttccacaccacaccagctggtgctgcccatgtctgtcgaatcataacggaaaattccccagatcacgtttggatttaaaaactcatcccttgtcgtgcttcaatgcatgccatttgtcacttaccatacttcaccatggccgagcttcatgtcacatggcctggcgattgtgcttgttcacactggggccaggattttcatactaaaacgtcactgacaatggggctacttttctcctgaatagctcctctgggcttgttgcagttctagttttcccagtagttccatggcaggttcaacctctcagtgtcctgaaaaatggaaccacccactaaccatatgcactggctgccaggtggctgcactccggggatcacgtttcagtactgagttccttcacgcacttggttcaccaccatcactcttgagttttggacaaaagaggtgg

SEQ ID NO: 183333 - DNA, 413 bp, Homo sapiens
gggctgggggtaaaggagggcagatttgggaaaagagtcctggccctcggatcagccaccgatagctccttaggggagaggatcctggttgtgggaggaagtcaagattgacctcaggtgtggccatttgggaagaagatggggagaagttttcacagaggtgggcagcaccagctggtgtggtgtggaaggaccagttgctcactgaactcctctgggcttgttgcagttctagttttcccagtagttccatggcaggttcaacctctcagtgtcctgaaaaatggaaccacccactaaccatatgcactggctgccaggtggctgcactccggggatcacgtttcagtactgagttccttcacgcacttggttcaccaccatcactcttgagttttggacaaaagaggtgg

SEQ ID NO: 183334 - DNA, 619 bp, Homo sapiens
  misc_feature (589)..(589): n is a, c, g, or t
  misc_feature (591)..(591): n is a, c, g, or t
tggaattacaggcgcgcgccaacacgtccggctaattttcgtatttgtagtagagacgggggtttcgccaccttggccaggctggtctagaactcctgaccttaggtgatccacccgcctcggcctcctaaagtgctgggattacaggcgtgagccaccgcccctcacgcctggctagtttgtccttttcatggggactttttattgtacgcgggttactctgaaaaagatcgcgattcgtcccctcgccctgcaggcgccgctgccgcctcgcctcgggcgtggaccctgcggctcgggcctgcgcgtgtgcaccccgaggttgtctcacttcctgttcagggcgaccagcgctgcgccctccccactccacagatgaggaagctgaggttaaagtcacttgccccaggtcactccgcaagttgaagcgcaaccaggatactctggaacaggatgcctgacttcagaggagaggcgcgtaaccaccaggcaactggccccacgaaaacaagtcccgcaacttcccttctttggctcctacttgctcccggaagaaaagccttaaacgacagcagatcaggagcacgcngngcgcacgccggggggcaggaggagaggg

SEQ ID NO: 183335 - DNA, 1454 bp, Homo sapiens
tggaattacaggcgcgcgccaacacgtccggctaattttcgtatttgtagtagagacgggggtttcgccaccttggccaggctggtctagaactcctgaccttaggtgatccacccgcctcggcctcctaaagtgctgggattacaggcgtgagccaccgcccctcacgcctggctagtttgtccttttcatggggactttttattgtacgcgggttactctgaaaaagatcgcgattcgtcccctcgccctgcaggcgccgctgccgcctcgcctcgggcgtggaccctgcggctcgggcctgcgcgtgtgcaccccgaggttgtctcacttcctgttcagggcgaccagcgctgcgccctccccactccacagatgaggaagctgaggttaaagtcacttgccccaggtcactccgcaagttgaagcgcaaccaggatactctggaacaggatgcctgacttcagaggagaggcgcgtaaccaccaggcaactggccccacgaaaacaagtcccgcaacttcccttctttggctcctacttgctcccggaagaaaagccttaaacggtattcaagccctttaggatctgatgtcctaggactccactctgggcttccagcctggggtggtactggtccctaggcatggaagctcctcccactgccccttccttcacccggccacctcctcccacaggtgtcttcctggtactcttgcacaggcccgagtcccttaccaccacggccttagcctgctctcgtgctctcagtaatgttttctccatttgctgcctttcattctttccagagattcttgctcaacccaaccaggccagcccggggactagggacatgtagggacaatagtccctgcttcaggcagttcagggcagaccacagagatgtgacattacagaccattgtgagcagaggccttgtcccattctgtgttgcatccctaagccaggaacaaagtccagcccaggcctggctccaggggacacgcagtagtatcctctggcctgtgcaagtgtatctgtagcctcacatgccaccatgtgagtctgcaatctgtctgtgaatgccctggtgtagaagccaggagtttggaggtgggagggagccctacagaatgatagccagtgctaactcctgggaatgtccagccactaagacctgcccacagccctgccatgccaatgtcctccttttcacgggagcagcttgcacagactttcagcgcacagctggcattgtcttcccaggagccatcctgtaacccaggccaggtgaagggctcctccctgggaccccacagccccgttcccatcatccttttgtggtgatcaaggcacccatcacacagtattgccataaaccgggtcaggttaacctttcattcccttaggagctgggtgggggcagccaaaagtatttgtaggaggaagagaga

SEQ ID NO: 183336 - DNA, 1232 bp, Homo sapiens
cattccaggttgactccaccagcgagaatcacaggcgccgctgccgcctcgcctcgggcgtggaccctgcggctcgggcctgcgcgtgtgcaccccgaggttgtctcacttcctgttcagggcgaccagcgctgcgccctccccactccacagatgaggaagctgaggttaaagtcacttgccccaggtcactccgcaagttgaagcgcaaccaggatactctggaacaggatgcctgacttcagaggagaggcgcgtaaccaccaggcaactggccccacgaaaacaagtcccgcaacttcccttctttggctcctacttgctcccggaagaaaagccttaaacggtattcaagccctttaggatctgatgtcctaggactccactctgggcttccagcctggggtggtactggtccctaggcatggaagctcctcccactgccccttccttcacccggccacctcctcccacaggtgtcttcctggtactcttgcacaggcccgagtcccttaccaccacggccttagcctgctctcgtgctctcagtaatgttttctccatttgctgcctttcattctttccagagattcttgctcaacccaaccaggccagcccggggactagggacatgtagggacaatagtccctgcttcaggcagttcagggcagaccacagagatgtgacattacagaccattgtgagcagaggccttgtcccattctgtgttgcatccctaagccaggaacaaagtccagcccaggcctggctccaggggacacgcagtagtatcctctggcctgtgcaagtgtatctgtagcctcacatgccaccatgtgagtctgcaatctgtctgtgaatgccctggtgtagaagccaggagtttggaggtgggagggagccctacagaatgatagccagtgctaactcctgggaatgtccagccactaagacctgcccacagccctgccatgccaatgtcctccttttcacgggagcagcttgcacagactttcagcgcacagctggcattgtcttcccaggagccatcctgtaacccaggccaggtgaagggctcctccctgggaccccacagccccgttcccatcatccttttgtggtgatcaaggcacccatcacacagtattgccataaaccgggtcaggttaacctttcattcccttaggagctgggtgggggcagccaaaagtatttgtaggaggaagagaga

SEQ ID NO: 183337 - DNA, 406 bp, Homo sapiens
taataattccatctttcaaccctcactcctgttttcttctggttcctcaattatgttttcttcagcgtcagttaaaaaactttcttgtcatgcttcacattttccttagatggtaggtgatttttggatgcctttttatattaatgatgagacatttgggaggtttattcattaatacgcttctcctttatgtgagtagatagggagctggctcttacacttgagggtttttcattttttaaaatacagataaagcagactttaaaggataaaggtggtggttatcagtgttgattaatcaagttgggctcaaggatttcacaggtcttaaatgccatcacacagactgccatgccaagggcattctgaatgccaattacagattgaagttccttcagaaaccaag

SEQ ID NO: 183338 - DNA, 645 bp, Homo sapiens
ttaccagtaagcacaacaaataaaacagtgaagtcattcgtaggaagatgtgagaaagtgtttaaaacacaacttttgagagttagaaagacctagaaagagtatcactggttcccttggggatttcaccagtccttagctacaacacagtcagttgtatagagctttcggatgtgcgtatatgtacaatttcgaaaaagttcaattggttcaattgcagaaagctgccccaatctgcacatgggccaatttccatttggtgctgaaacagttttatagaaattgcaataatgtagcccactcgctgcatggacagaagctgcctatttcaagttaggtgttcattcaattttcttgtcctttatttctatatttagtttattcccttccaaagatgtgtaacgataagaaagagagaagaagtaaggaaggaagatattttcttttctctatatgtgtgttttatcaacacagcctcagcttgagatctcttgggaaaagcatttcaagacaggcagaatgatgtccttcctgccacaacataattttccagttgccaggggaaaactacatattgtacccaaaacaacaaccgagagaacagataataatcactccctaagagcacttgcttcagcttctctc

SEQ ID NO: 183339 - DNA, 202 bp, Homo sapiens
tttaaaggcagagccccagcctcagagacaaataggtttcatcatggaaacttttgagcagaacattgagtttgagaatcctgaaattgagcctatgagaaagagactcattttttaagaatgttttccaagtgacattttcagtgataatggaggtttccctgtgaagcatccccagcagatccttgttttgcccaaaaaa

SEQ ID NO: 183340 - DNA, 383 bp, Homo sapiens
cagtgagtaaattccaagttgtagctctttaccttggcttgaagtgattctgtggggtcttggtgtggcttctggttatcatggatacatttcctgtattctatgtagaattctattacagagtatagctaggtgacttggctttttcctttctttgtgaagcaaggcatggtgcagaatagtccattccaaatcaagctctattttttgcttgtaagaaattgttttaatgacttctgattaaatgtgttttcagtgaggttgaccttgtctctcattacagaatcatgtctttctcgactgtcttgattgaactttacataataaccggtggaagaaaaataagttagtagaacccaaatattcagtcttgggcatgcaca

SEQ ID NO: 183341 - DNA, 236 bp, Homo sapiens
tgagtaacgagagaaattagaaaggcatcattcatttaacaaagatggaaattcacatcaaacgttccttgaccaggcagctattccctgctattcccttagaacctttgttttaaagaaggaccctgaaatgtcactgcttccaccaaagtctatgaaaaggttactgaactgaagataagggtgcatggctgggtccaagtgggttctcacgctgatttctctcggtacaactt

SEQ ID NO: 183342 - DNA, 151 bp, Homo sapiens
ccagaaatatgccaatgatgaaatgttcaaaagaaagataatttgctatgttggaagcaccattaaataagtatgacccattaacacactttcttgtcctctaacttgcagccagatttaaagggccttgactctctcctctaggccctga

SEQ ID NO: 183343 - DNA, 302 bp, Homo sapiens
tggcacgaacaggactgagtagggacaggtatagccccaccattccggtcttgggtgcgtgccgcggttccactgtgcacggattggaacccggctgtttaggccaggcttgtgctgagaagtttaggtgggaaaagtgtcagcacagtgctgggaccgaacatcattttaaaaatggacttctatgtgtctttgtggaattatgcgagcaccatgttttgttccagaaattatatttccccagagttgcttgtttgcgtttaaggggatcctcatttacagagacttgtgttcgatcctat

SEQ ID NO: 183344 - DNA, 983 bp, Homo sapiens
  misc_feature (793)..(793): n is a, c, g, or t
  misc_feature (824)..(824): n is a, c, g, or t
agcgggcgcgcaagagaggcggggcagcgctcggcatggcggagccagatctggagtgcgagcagatccgtctgaagtgtattcctgggacgatgccggagtgtgaaggagtttgagaagctgaaccgcattggagagggtacctacggcattgtgtatcgggcccgggacacccagacagatgagattgtcgcactgaagaaggtgcggatggacaaggagaaggatggcatccccatcagcagcttgcgggagatcacgctgctgctccgcctgcgtcatccgaacatcgtggagctgaaggaggtggttgtggggaaccacctggagagcatcttcctggtgatgggttactgtgagcaggacctggccagcctcctggagaatatgccaacacccttctcggaggctcaggtcaagtgcatcgtgctgcaggtgctccggggcctccagtatctgcacaggaacttcattatccacagggacctgaaggtttccaacttgctcatgaccgacaagggttgtgtgaagacagcggatttcggcctggcccgggcctatggtgtcccagtaaagccaatgacccccaaggtggtcactctctggtaccgagcccctgaactgctgttgggaaccaccacgcagaccaccagcatcgacatgtgggctgtgggctgcatactggccgagctgctggcgcacaggcctcttctccccggcacttccgagatccaccagatcgacttgatcgtgcagctgctgggcacgcccagtgagaacatctggccggggnttaccaagctgcactggtcggccagtacagnctccgggaagcagcctacaacaacctgaaggcacaagtcccatgggtggcggaagccgggctttcgccttagctggcactatctggctcatgtaacgagcctaagaaaagggcatagcggtgaatgcctggaaaagtccttatatagcgggcacgccca

SEQ ID NO: 183345 - DNA, 948 bp, Homo sapiens
  misc_feature (758)..(758): n is a, c, g, or t
  misc_feature (789)..(789): n is a, c, g, or t
agcgggcgcgcaagagaggcggggcagcgctcggcatggcggagccagatctggagtgcgagcagatccgtctgaagtgtattcgtaaggagggcttcttcacggtgcctccggaacacaggatcgggcccgggacacccagacagatgagattgtcgcactgaagaaggtgcggatggacaaggagaaggatggcatccccatcagcagcttgcgggagatcacgctgctgctccgcctgcgtcatccgaacatcgtggagctgaaggaggtggttgtggggaaccacctggagagcatcttcctggtgatgggttactgtgagcaggacctggccagcctcctggagaatatgccaacacccttctcggaggctcaggtcaagtgcatcgtgctgcaggtgctccggggcctccagtatctgcacaggaacttcattatccacagggacctgaaggtttccaacttgctcatgaccgacaagggttgtgtgaagacagcggatttcggcctggcccgggcctatggtgtcccagtaaagccaatgacccccaaggtggtcactctctggtaccgagcccctgaactgctgttgggaaccaccacgcagaccaccagcatcgacatgtgggctgtgggctgcatactggccgagctgctggcgcacaggcctcttctccccggcacttccgagatccaccagatcgacttgatcgtgcagctgctgggcacgcccagtgagaacatctggccggggnttaccaagctgcactggtcggccagtacagnctccgggaagcagcctacaacaacctgaaggcacaagtcccatgggtggcggaagccgggctttcgccttagctggcactatctggctcatgtaacgagcctaagaaaagggcatagcggtgaatgcctggaaaagtccttatatagcgggcacgccca

SEQ ID NO: 183346 - DNA, 202 bp, Homo sapiens
agatagaggaatgctgtgcagtgattcaaaagaatgcagctgatctgtatgtatagacatgaaattgtgcacaaagcacagtgaccattgatttctttacttattcacttatcctacatgtataaatgctaccagctgtcatggtgacatgacattgtaagaagcaatgggaatgcaggaatacacaacacgtagcccctgc

SEQ ID NO: 183347 - DNA, 421 bp, Homo sapiens
tactcagtcctatgtggtctagacagtcaaaggcaaacaatggatccaaaatgataaatggttagacagctaatcacagcatctctcttctaggtgttaccaaattttggaaacttaatggaaacagccagagtaaatgactggggctaaaagtataatctaaagactaaaataaagctaaatataccctatctagtctatatcagcttaaagataacaaaatgtctcatcacacttttaatcgtatctttagagggtgaatattgttggggaaaaaagatgcttactcagagacaacaagatagacaatatcctgtcttcaagagagcttatcatagtaaaagaaatgttataaacaatcaatcaaaagtgaaaaaaattataaatttttataattgcttttcacaaaataaacagggtt

SEQ ID NO: 183348 - DNA, 465 bp, Homo sapiens
ctctctacagccctggccctggtggggaaacctgacattcttttattggatgagcccagctctgggatggatccctgctctaagcggtacctgtggcaaacaataatgaaggaggttcgggaaggctgtgctgcggtgctgacctcccacagcatggaggagtgtgaggctctttgcacaagactggccataatggttaacggcagcttcagatttaccttccaccagcttagcaaacaccacccactcccagcaagaaagaccctgtttccccatgctcccagcagatgtcttaggccatcctcgggcctcactgattctgtgagccagtgcccacggccaggagaatggaatacactgacctagaggggacagggactctagacaggcaaaactccactgtcagaagcagaatcctaaaatgtcagaactgaaagtaggcccggaaggatgcacaacccggaa

SEQ ID NO: 183349 - DNA, 525 bp, Homo sapiens
ctctctacagccctggccctggtggggaaacctgacattcttttattggatgagcccagctctgggatggatccctgctctaagcggtacctgtggcaaacaataatgaaggaggttcgggaaggctgtgctgcggtgctgacctcccacagcatggaggagtgtgaggctctttgcacaagactggccataatggttaacggcagcttcaaatgtcttggttctcctcagcacatcaaaaataggtttggtgatggttatacagtcaaagtttggctctgtaaggaagcaaatcaacattgcactgtttctgaccacttgaagctttattttccaggaattcagttcaagggacagcacctgaatttattagaatatcatgtgccaaaaagatggggatgcctagctgacttgttcaaagttatagagaacaataaaaccttcttgaatattaagcattattccattaaccaaaccactttggagcaggtatagtatcttgaatgattcaggaggttgaatttt

SEQ ID NO: 183350 - DNA, 426 bp, Homo sapiens
  misc_feature (13)..(13): n is a, c, g, or t
  misc_feature (96)..(96): n is a, c, g, or t
  misc_feature (100)..(100): n is a, c, g, or t
atttcgccatgtnggccaggcagttctcaaactgctggcctcaagtgatctgctcacttcagcctcccaaagtgctggtgttataggcgtgagctnctgntgcctagccagcaattgactaattttaaaatattaagtgcagtggctcaatcttggctcactgcaacctccacttcccaggttcaagcaattcccctgcctcagcctcccgggtagctgggactgctcaccacacacggctcaatttttttttggtattttagtaaagatgaggtttaaccatgttgaccgggatggtctcgatctctcgacatcgtgatccacctgtctccacctcccaaagtgctgggattataggcacgagccaccacacccggcctgccagtttttttaaatagggaggtttcacacagaatgtgctctttg

SEQ ID NO: 183351 - DNA, 246 bp, Homo sapiens
tattctcagatgacatcattatttagaaaatcctaaggaatctacaagaagatactagaaataataactgaatttagcaggatctcaatttacaaggccaatttacacaaattaactatatttttatataccacaaaggatcattggaattcaaacttttaaaaatactacttgcaatagcattgaaatcatttttttaaaatctaggcatcaatttaacaaaatgtacaagacctctactcggaa

SEQ ID NO: 183352 - DNA, 649 bp, Homo sapiens
gtaaatgttgcggtggaaaagtacatttgctttaggctttacctatttcttaagacaatcctcaatcaccccctcccagcatatggcacactggttgcttctctcattgatcatgtccacaagactctccagaacacacaagcttgatggctccatattcaataaatgtattatcgagacccactgaaggaagccgactgctcctgcaggacccaggagacaccccaaatactgtgagtgccccaactgcggaagtaggaaagggagaccctcctctctcaaacacacacccccgcactggagaagctgaaggtctgtttgctggagaagtttctcactttacccggagctgagtcaatttagagagccaagggaaatacaggggtagaggaagaagcagaaaggccctaggagctcactgcatcccctagcagcccatttctgcctggcaccacagggatccatcaggacagtggccagagaagcaggcggtaaatctccacagggagaaggaattctctagctaaagtttgtaacaacttgaacagggtgagaagcctcctggcgagaactcaggggagggcacaaatccggtgtgcagactccataggcaggggaagaaccaagcccttttctttctagcctgcaa

SEQ ID NO: 183353 - DNA, 395 bp, Homo sapiens
acaaagcatatggatgtatctttttatatacacagggagggcatcttcaccaggatattgggatgggtttattcctagtgttaagtaaatccatacaaaacttattttcaataataattcagttctatttttactgaataacacattttaatatttcaaaggtggcatcaggaacacttgtttaatcaatttccacagtggctactgtatacaaaaagacaatttgggagcattgctgggagaatctaaacccaggacccatctgaggaaatgacatattttcagatttacgaagttatgaatttttttttttttttttttttgagacaaaatcttgctctggtgctctgtcacccaaactggagttaggtggcaccatcatggctcactgcagc

SEQ ID NO: 183354 - DNA, 403 bp, Homo sapiens
gctgcaactggcaacgcactgctccagttccagggtggcgtccaccaagtagttgatgtcgggtgcattctgcaggtcctccgggaggtccttgtcgacttgcatgggctccacagccgcctcctcagagtagcgtacaggacgacaggctggagctcaagattaagttcctggccatgccaggcaggaggagactcatcagcaatcagaaggttgaggagagatgccatgctgatctgaactgcagcaggcttcactctgagcacgtccctgtggatgaggtcaccttagatgcctgctcgagcaatcatcctccaacctgtgactgaagcaggaactcaactggatgtctctcacccactattcacatcttcaatgactaacaggccattaactgcacaac

SEQ ID NO: 183355 - DNA, 294 bp, Homo sapiens
tttatcattaggaggtgagttttatcattaacagctctgattattagagtggatatttggcaaattgtgtaatgtgttcttgttttaaagaattctctatcatctagattcacagataggatttgtaagtaattgctattaaatagctaacttaatatcctgtgcaagggcatctaatgcccagcagtagagaagtttctaattggacaggccagtgagatacattgggtagtatctggagccactggtgttactttagataatacctacttaggtactacatttccaccataa

SEQ ID NO: 183356 - DNA, 251 bp, Homo sapiens
caggctggtctcaaactcctggtctcaagcaatcctcctgcctttgcctcccaaagtgctaggattacaggtgtgagccactgcacccagcctaaagtttaaatcttatctaagtggattcttaggacatttattactttactttcattttcttcatcttggttctcaccataactacttgaaaaggatgatatagacatgtacagtacattctttaggctttaagtttattcctttaacaagcatgaatt

SEQ ID NO: 183357 - DNA, 316 bp, Homo sapiens
ggataaggcaaataaggtaaaatgccaacagtagggaagcctcagcaaaggatatgcaggtgttctctgcactcactttactcttgcaacttttccgggagtttgaaattatttccaaataaaagttttctttttgtcaagaaaaaaaaggaaaattcattagctagtgaaggtagaaagtatattacatcactttccaactaaaaaaaatgaacctgttaacccaaaagccaaatctaccagtggacaaactctacaaagtgtcacagtactggctacagaggaaagcactccaaactcaggaggatttggcaag

SEQ ID NO: 183358 - DNA, 282 bp, Homo sapiens
agaataagtgtttagaaagttgtataggccaggcatggtggctcatgcctgtgatcccaacactttgggacactgaggtgggaggactgcttgagcccaggagttcaagactaacctgggcaaaatagcaagatgctgtctctgcttaaaaacaaacaaacaaacaaacaaacaaaacttttatacacattcaacaatgccatgacatgcaagtgcacgaccagtgatttgtcttgctgaacagagagtaataacctatctaggtgctgtcaagctcacatg

SEQ ID NO: 183359 - DNA, 444 bp, Homo sapiens
cctgacctcaggtgatccactcgcctcagcctcccaaagtgcagggattacaggcatgagccaccacgcctggcccaaagaatctttcttaacaatggaagccagctacttcgatagttttatttaactcaaaaccaacggccgcaagtagaaagagaaaggacatgttcacctgtgttctccaggatgggggtggggatggaaaaaaacaaacagaggggctgcttgcatacatcagtggtgaggctggaatagggcttccagtgtctgggctgaggccgctggggtgtctgaactgaagccttggcgtgcccaaggccattggagattggttaggtcaactcctggcagactgggcacagagaactcaaatggctcacccaaggtcacactcccaccttctttcttacttttagcacccagcaatttaggtcggaaggatgg

SEQ ID NO: 183360 - DNA, 595 bp, Homo sapiens
gcacgacactgagctgctgagcctttggaagcaaggatttggcccaggggtcgggcggcaggatgaggatgaactcctgcgagttacacaggcatgtgggtgtgtgtgcgtgtgcatgagtgtgtgtatgtgcatgagtgtgtgatgagtgtgtgcgcccatgcatgagtgtgcatgtgtgtgcgcatgggtgtgtgcccttgcatgagtgtgtgatcagtgtgtgtgcttgtgcataagtgtccgtgtgtgcatgtgtgtgcctgcgcatgtgtgtgatgagtgtgtgtgcccatgcatgagtgtgcatatgtgtgtgcatgggtgtgtgtgcccgtgcatgagtgtgtgcatgtgcatgaatgtgtgaggagtgtgtgacgagtgtgtgtgcccatgcattagtgtgcatatgtctgtgtgcacatggctgtgtgcccgtgcatgagtgtgtgatcagtgtgtgtgcccatgcatgaatgtccttgtgtgcatgagtgtgtgcctgagcatgagtgtgtgatgagtgtgtgtgcccgtgcatgacagtgcatgtgtgtgcatgagtgtgtgtgcatgagtgcgtgtgcccgtg

SEQ ID NO: 183361 - DNA, 837 bp, Homo sapiens
tcagctcgtaccccatttatgccgtgtgtgcgcccatgcatgaggtgcatgtgtgtgtgcatgggggtgtgtgcccatgcatgagtgtgtgatcagtgggtgcccgtgcatgagtgtgtgtgtgcatgagttatgaagtgatgagtgtgtgtgcccatgcatgagtgtacatgtgtgtgtgcatgggtgtgtgtgccctgcatgagtgtgatcagtgtgtgcatgtgtgtgaggagtgatgagtgtgtgcccatgcatgagtgtgcatatgtgtgtgtgcatgggtgtgtgcccgtgcatacgtgtgatcagtgtgtgccagtgcgtgtgatcagtgtgtgcccgtgcatgtgtgtgcttgtgcatgagtgtgtgaggagtgtgtgatgagtgtgcgtgcccatgcatgagtgtgcatgtgtgtgcgcatgggtgtgtgcccttgcatgagtgtgtgatcagtgtgtgtgcttgtgcataagtgtccgtgtgtgcatgtgtgtgcctgcgcatgtgtgtgatgagtgtgtgtgcccatgcatgagtgtgcatatgtgtgtgcatgggtgtgtgtgcccgtgcatgagtgtgtgcatgtgcatgaatgtgtgaggagtgtgtgacgagtgtgtgtgcccatgcattagtgtgcatatgtctgtgtgcacatggctgtgtgcccgtgcatgagtgtgtgatcagtgtgtgtgcccatgcatgaatgtccttgtgtgcatgagtgtgtgcctgagcatgagtgtgtgatgagtgtgtgtgcccgtgcatgacagtgcatgtgtgtgcatgagtgtgtgtgcatgagtgcgtgtgcccgtg

SEQ ID NO: 183362 - DNA, 776 bp, Homo sapiens
aagacaccggaccaacatgcgaacggactgatcagtgggtgcccgtgcatgagtgtgtgtgtgcatgagttatgaagtgatgagtgtgtgtgcccatgcatgagtgtacatgtgtgtgtgcatgggtgtgtgtgccctgcatgagtgtgatcagtgtgtgcatgtgtgtgaggagtgatgagtgtgtgcccatgcatgagtgtgcatatgtgtgtgtgcatgggtgtgtgcccgtgcatacgtgtgatcagtgtgtgccagtgcgtgtgatcagtgtgtgcccgtgcatgtgtgtgcttgtgcatgagtgtgtgaggagtgtgtgatgagtgtgcgtgcccatgcatgagtgtgcatgtgtgtgcgcatgggtgtgtgcccttgcatgagtgtgtgatcagtgtgtgtgcttgtgcataagtgtccgtgtgtgcatgtgtgtgcctgcgcatgtgtgtgatgagtgtgtgtgcccatgcatgagtgtgcatatgtgtgtgcatgggtgtgtgtgcccgtgcatgagtgtgtgcatgtgcatgaatgtgtgaggagtgtgtgacgagtgtgtgtgcccatgcattagtgtgcatatgtctgtgtgcacatggctgtgtgcccgtgcatgagtgtgtgatcagtgtgtgtgcccatgcatgaatgtccttgtgtgcatgagtgtgtgcctgagcatgagtgtgtgatgagtgtgtgtgcccgtgcatgacagtgcatgtgtgtgcatgagtgtgtgtgcatgagtgcgtgtgcccgtg

SEQ ID NO: 183363 - DNA, 351 bp, Homo sapiens
gaaagacacatgaaataattacgccattcattagcagattgtgctagatgcctcactggaaaaataaaggacatgatggaaaactctgtagggtcagagaaagggatcattagagaaggttctttgaagaaatattttttgaaatatgaaggataaataggaattaactaggtaccaataggttaggagtagagctttccagacagagggactagttcttgggaaggtctccagacagaaataagtgtggcttgtctgaggacctcttattcgcctattaaccttccctccccagtaaacactcctgggaacaacacacattgtagaaccacgttgtggtgctgttcagta

SEQ ID NO: 183364 - DNA, 336 bp, Homo sapiens
tatctatagtccagtgaattaaaacttttaggtaaatagagggcatgtattacttattcctagggcagttccttttgaatgatttcacttattgagaactgtcattttgaaatgtttcaaaccaattaggcatctttagatctaaatcttccagccttcagctttagggaatacatatttggatttgcaagaatgtgaagatttagccaggtagtcacttcctattagctgtgagaggtcttcggactcaattgactggtgcttgttaaatatctgtttttttggagaatttgtttccctcccgaagagagaaccctcatagtcagtggggcccat

SEQ ID NO: 183365 - DNA, 108 bp, Homo sapiens
cccaagctgcttttgttgggctaaaatcagcaaaaaatgaattgagaagtacaaagtaaatttcacttgcgatcaaattctacctacgtgtgtgtgccagctgcacca

SEQ ID NO: 183366 - DNA, 444 bp, Homo sapiens
acagagaggagaatggtggttgccagggactgggaggagaaggaatggagacttattatttaataggtacagagtctcagttttgcaagacgaaaagagttctggagatggatgatgctgacggttgcacagtaataagaaattaagcaatgccactcaactgtacccttaaaaatggctaagatggtaaacttcattaaaaaacatttaattttaaagctactactctgaaatcgttatttgtcagtgaagaatgaaaatgcattttccaaggtaagttttacaagattcaaggtgtgaaaatatcagtggctgacctgctgttaatgagcaccatctctttcacaggtaacagacatctattcatgcttctgttgaacagacatagaggcgaggcccagagatggtgggtggtttgcctagattgtcaaggagcctcagcat

SEQ ID NO: 183367 - DNA, 446 bp, Homo sapiens
tgctgggattacaggtgtgtgccactgcttaatccagtcttaaggcacgctggagagcacccaccttcccagcccaccccagcgtcgttcactgtttctcacaccgtgctcaggtgaagagctcttttctccctttctctctcctcttctcaccagtctatccattctttctctttctgtctcagtttcactacaaaactatgtaactaacctcttttagttataagatttcagctttatcatacagcttgtgggaaacaatgaagtcacatcactaggaggtgtgattatagtgactgtggcttttataataactgtggctggagttctctcccaataataagtaatggaataaattccacatcactcctgtttggcttctgttgtcagcatttacaaaagtctggtcctttgtaactgttctgaccatgaaaatgctgatcatg

SEQ ID NO: 183368 - DNA, 348 bp, Homo sapiens
atatttgcaggaaattcaagtgtctcccccatagattgcttattagttgcaagtagaaaaccagcaatttatacagtggagaaactgggatcaaattaacatcactaatgagagacaaacaatatcacgtgcctccaaatgtggtctcttggaaagaatataacctcatgtatgtaatattacaatcaggaatacataacctgaatctaatcatgaggaaacacgagacaaacccaaagtagggaagattctgtaaaataactggcccttaacacacacacacacacacacacacactcctaagagtggtgacaatgtgttaatttgattgttgtaatcatttcacaa

SEQ ID NO: 183369 - DNA, 379 bp, Homo sapiens
acatagaggatccgctggagtggcatataactcacttctaacttcatatcaaactagatcaccagaaaactatttagtcctatattttagtattgtttcctcatattctgtcaatttttgttagatgcatttgtatgaagaatatttctgcatctgcgatgaaactattgaatgcattgtctcttatgatactctgttccctttataagaattaatgtgataaattattcaagaatttagtttcagagaaaagtttctttccttatgatatggcatacttccttctatcagtcattaagaattatatattctgttgagtttttctgtttgctttggctgcaagaaagcttggagttatatgccactcaattatagtaac

SEQ ID NO: 183370 - DNA, 197 bp, Homo sapiens
aattgagtgtgtggaattgatgagaaaattgaggactctgagcagcctgttagttgaggtgtaactgttcacaccctcccttttggatcctggactgagaattgccatttggagttcccttctctgagacaaaggtagcatttatttagaaggggcggagctctgccctgtgaagcggagcctaaggctgtgaacac

SEQ ID NO: 183371 - DNA, 329 bp, Homo sapiens
ccagccctcccagtccagctctaccaggcaagtcctcctctcctacttaagcacagaccaagagctgacatgggattaggtgatatgtggggcctggttcctgccattgcagagcatgacagacagggagagggtgtggcttgaaacctgggaaccttgtttctggggatgagcaggatgtaggaagtcaggaaggcagggagcttttctggagtccctctcaaagcagccactccctttactggtctgcaggaccaggcagagtgggaagtgggaggtggctgctcagcactttgctacctgttgtctttctgaactgaagactcaga

SEQ ID NO: 183372 - DNA, 387 bp, Homo sapiens
atgtgaggtcttggagacccaagaggacatgggatgcctatgggaggagaaatatcatgttttacaagttgggagagtggagaataaagagggaagaaggtatagataaatctgtgctgactgagtagatgagattgcaatattcccaaagttgagggacttactaaacttttctgagaggtaagagacaagattttggctgactatgaaagctgaggtgttagggttaatgacttgagggtgtggtgaaggtttgaactactgtgaacaatacaaggagatattgcttaggaagaggcagaagggtagctggacaggttggcagctttgaatgagctgaaggaaactgtaaacttgttgtggcaccactctactcattctttgatg

SEQ ID NO: 183373 - DNA, 543 bp, Homo sapiens
cagagttaagatccgtatactgtgactgttcaaatgcctcttaaatctcttttattctatagagttttggggggaatttttgttgaacaaactgggttgctagccccataatgctggattttgccaattccatcccgctgtgttgtttaacaacgttcctccatgctttatatttccaataaattgacggttagaaacagaggtttaattagattttaatgttttttatttttatttttgccaaaccatttacaagtagatattcatgtttcaccacttttaacacattttgaagaaaagaaaaccaatttgagtataaaatagctttaaatttttttttccctgaaaagaaacacttcccttagtgtctttgctgtttagtgtacagtaactaaagtataagatttggtggttagtgtaaatttaaaattacaattaaaccaaatattttgaagcactgaggaatctttaaaaaaatactctttcaaatgtctttcctatcataaagcatatgcttatactaaattcctagtatcctagtcc

SEQ ID NO: 183374 - DNA, 709 bp, Homo sapiens
gcttccagacctcactagatttacctcctcatctggctcttcatttgtggtacttttaatgcctcagaaaaggtatgtttgagaccatgcgtattctgatgatgcatttgtattaagaagaaagaaagattatcaaccccacagcttgctctttcaggaggaagacattaattttcataagaaatatgacatttataagaattgaaaagtttaaaaggaagtgcacagaaattgcttgacagggaacattttaaaacagtgctcttgagaagagactatctcaatgaatatctacttgggacctcctcaaaggaaagtgagatgacaaaattggtgatgtatgtgactccatactctagtgacagagaagataattacggtgaggtatctggaatgatccaaaggcaaattggaattttccaagagagaatgaagatgtatttgtgaagagaaagacagttggaaggaaatgttattttagtatatattctggccatacatgacttaacaagtatgaatttcaagaggacaataaaagagaaattatagtaatcaagataggaaatgattaaagaatgggagaaaattttagctgagagggaatgtgaagattaaatacaaattctaacagcctggttgacaagttgatgagcacatttacagatgagaaatgaagaaggaacaaaagaatgacttcaacagttttgtg

SEQ ID NO: 183375 - DNA, 148 bp, Homo sapiens
ccccagaggcggcagcagatggctggcgggcacccctcactccagaagcctctttgttcaggccccgcctgccctgacctgcctccctgcccggggagaggtcctccaggaagtcggccaccctgtgaagcacatctcctagcaacgc

SEQ ID NO: 183376 - DNA, 537 bp, Homo sapiens
tgatctgcctgcctcagcctcccaaagtgctgggattataggtgtgacccaccgcgcccggccagctccatattttctgctgcctgaattgtaattattctattcctgattttatttgctgattccattgtttttactagttcatattaaatgctaatgacagatatctttacctaaaacattctatttctcttgtcatgagcattatgaaacaaacctacaattgttctccattacctagtttatgacaattaaactcttctttcaaagaaataaacaacatggccaaaatactttccagcacagttgtagcaattcccacctcctccatcagcagtatgagagttcttgcaccatattctcttcaacacttggtattatcagtctttttcatttaagactttctaggggttgatgtaatgctatcctttgtggttttaatttgtattccctggctactaagaaggttaaacctttttttatgtttattaaagctgatttcctcttttgtaaatgatgctctcccatttctattct

SEQ ID NO: 183377 - DNA, 131 bp, Homo sapiens
attctgtctgaatgacattggataagttaccatgctttctcatctgtaaaatgagaataacataatatctatcacagagggttgttttgagccatgtaacgctctcagaacagttcttggtgcatagtaaa

SEQ ID NO: 183378 - DNA, 710 bp, Homo sapiens
agagtggttaaaaacacatttgaaagactcacgtttagaagttatcaatcagcaggatagtaactttatcacagctcttgaattagcagtacgttttgggaaaacccttattatacaagagatggatggtgtagaacctgttctttatccattattgagacgagatctggttgctcaaggaccacgttatgtggtacaaataggtgacaaaattattgactacaatgaagaattccgcctctttttgtcaacaagaaacccaaatccttttattccaccggatgcagcttccattgttactgaggttaactttactacaacaagaagtggattacgagggcagcttttagctttaaccattcagcatgagaaacctgatttagaagaacagaaaacaaaactattacaacaggaagaagataagaaaatacagctagccaagctcgaagaatctcttctagagacacttgccacatctcaaggcaatatcttgggaaaataaggatttgattgagtctttgaatcagacaaaagcaagcagtgcacttattcaagagtcacttaaagaatcttacaaactccaaatttcccttgatcaagaacgggatgcctatctccccctggctgagagtgccagcaagatgtacttcattatttctgatttgtccaaaattaataacatgtaccgttttagtttggctgcttttctc

SEQ ID NO: 183379 - DNA, 930 bp, Homo sapiens
  misc_feature (529)..(529): n is a, c, g, or t
  misc_feature (561)..(561): n is a, c, g, or t
  misc_feature (585)..(585): n is a, c, g, or t
  misc_feature (597)..(598): n is a, c, g, or t
  misc_feature (895)..(895): n is a, c, g, or t
agagtggttaaaaacacatttgaaagactcacgtttagaagttatcaatcagcaggatagtaactttatcacagctcttgaattagcagtacgttttgggaaaacccttattatacaagagatggatggtgtagaacctgttctttatccattattgagacgagatctggttgctcaaggaccacgttatgtggtacaaataggtgacaaaattattgactacaatgaagaattccgcctctttttgtcaacaagaaacccaaatccttttattccaccggatgcagcttccattgttactgaggttaactttactacaacaagaagtggattacgagggcagcttttagctttaaccattcagcatgagaaacctgatttagaagaacagaaaacaaaactattacaacaggaagaagataagaaaatacagctagccaagctcgaagaatctcttctagagacacttgccacatctcaaggcaatatcttgggaaaataaggatttgattgagtctttgattagacntgatcatgaacggatgctatctcccctgctgnagtgcacgacacgtccgtcatatnctgattgtcaannatatacatgacccgttagttggctgctttttgacttttcacgagtctacaacaaccagatctgaaatctgacagggatccagcctattagtatttcacattgatatgaatttatgccgtgccattaagtgatagtatgtccttgcattgttaagatgctctgactcttagaaagatgggatcgttagggcggctgtggaaatgtcgaaggtccttaacacatacgagaagtccgctggatatagaataattggccggcacctaagatggttccaactttaaaccttgttagagcctnttggggcgttttaaatcaagtgggaaagtcctttt

SEQ ID NO: 183380 - DNA, 605 bp, Homo sapiens
gatattactgaaatcacttgcagtcttaagagtgtccgcttagtctaccactggagccgagacacccgcagcttaaggaaaacagaaagccctaactaattacatcgactcttcatgatgatcctatttttaaataaatgttatgaaatgcagggttgaagctgtacatttcaaatgttgaacagccacaggtttgaagtccgtgaatgggccctgactggcctatcagtgaataggattgagagacatcagctcctgcgcactcttcctctgttgtcctgtgattgaggggattgtttcgtgttttgctgagagtaattctttctttgaacatatctttacctccccaaatcaaacaagttatacatatgataacaccttgtatttaaacagagcaatgttataatattccagttaaaaatcagcttagtacagttcccatgacctatctcttaggtcccacgtctattaggaaacactgacttttaaaatttaaaattttagaatttttaaataaactttattttccaaaataagggatctcatgagtttttcacgaaagtcaatgggggaaactcttgagtaggtctttttcagtctcttgg

SEQ ID NO: 183381 - DNA, 187 bp, Homo sapiens
tttccccccataacaatgctttgaggcaggtatggcagtgtcctgttttgtagatgtgaaaaagattcagaagataaatgacttcttcaaagtcattgagcccagattgtatgcttcaaaattttattttatttttttaccttatcacaccactgtgtatgtatctatgtttataaacaaaaaatta

SEQ ID NO: 183382 - DNA, 633 bp, Homo sapiens
tccattttgacttaagttttgggacgggtataaaatctgtgcctagattaatttttttgcatgtgagtatccaggtgtttcagaattatttgttgaaaaaactatctttgctccattatattgcctttgttcctttatcaaagatcagttgactgtatttatatgggtctatttctgggctctctgttctgtttcactgatctttttgtctgttcttttaccaataccacactgtctagattattgtaactttagataagtcttgaagtcagacactgtcagtctcccacctttgttcttcaatattgtgttggttattctgggtctattgcctttccatataaataaaccttagaatcagtttaacagtatcccgaaaataatctgctgggattttgattggtattgcattgaatctatagatcaagttgagaagaactgacatctagaaaatattgagctttcttatccatggacatgaactatctttcagtttaattagttctttttgatatctttgatcagagttttgctttgctatgttctagagtctttttacaagatttgagatatcataaatattctaaatgaaacaaagaaattagatattttttttttggagaggatccctcg

SEQ ID NO: 183383 - DNA, 343 bp, Homo sapiens
gcaggcgtgagccaccgcacccagccaatactcaacaatttcttagctcattcatacattttcctctgccaggaatgctcttcctccccttctgctaatctgggttgcttttacttgtccttcagaactcagtcgaaatggcatcctcagagaagccttgccttatattctatttcatggcagctggtttttcttttttctagcacttatttcagtttgcaattatgtatttatctgtgtgattatttgtctcatgccttaatcccctctgcactcctacttctgaggaccagatctgattcatgctcttctgtagcagccccttacctggtgactggcacat

SEQ ID NO: 183384 - DNA, 511 bp, Homo sapiens
tgaacatcatgcacaattattttacctcataattgaacatctggttaatgtaagtattataagcttataaatattacaaaaacttgcataatactgtactctagactcatacatgtgtcagccaatgagctaaaaaaatcacaagtttcatacatgcattagcatgtatgcatctatagtacaatattatggtcactatctgccttcttggtggagagaaaaggaagagtcgggaacttttggttgtgaccaggaaatgggaagaatgggaatcagtattaaaactgtgcagtgtatggttagagtctttatgttctctaaggagcttgactatcaaacactttaagtgttttaagcctggtttttccttataatggacacgtaaaacaaggagaaaacataaaatctcagatctccagactatgtcttccttgagccttctacttgtctagcagttgggtggggtatataataggcttggtaatcacaaagcaagatagttctgtaaggg

SEQ ID NO: 183385 - DNA, 288 bp, Homo sapiens
tagagctgaccttagagactccaagaacacatcacctgtcactccctctgtctgcctcctcaggccttctaccctgatgacttctattgcagagatgggtgaagagtagatggtagatctggtggcagaaagctatgagcttatgtcaatccagcctagtgatgcccctggaaaaatatgttctttcctagcattcatctaaaaatcttaagaaatggttgtcattgacccaatttggataatgtattcattcctgaaccagtaactgaggcaaggggatgaagagct

SEQ ID NO: 183386 - DNA, 348 bp, Homo sapiens
agacaggttctcgctgtgttgcccaggctggagcgcagtggtgaaatcatggctcactgtagccttgacctgggctcaagagattttcccacctcactctcctgaggagcagagactataggtgaacaccactacacccagctaatttatatttttttttgtagagatgggatctcgccatgttgtccaggctggtatttatatcttatatataccacttaattgctttattttcatttccttcgtaaatgatatctaggtgaaattaaccagccttttttgaatgaatgatccctaagtttgaattggtggggtctgtgtaaatggatgagggccatttgaatagac

SEQ ID NO: 183387 - DNA, 535 bp, Homo sapiens
gagctaaatgtatagttggaaacaagagcctggaacagaacaacgtgtgtggtctggaggattggggaagactttctggagaaaaggacatcagagatgacacctgagggatgaataagagttcttcagggtaatcagaggtgggaatttcaggctcagggaaaggagagaagagcacttcttgaggaatgagaagcatgcagcggagagagggaagcaggacagaagacagataacaaggctctgcagactgtgttaaaggtttggggagaatggaaagccattaaggaagtcgcattttaccatctttattacactgtaaattccctagagcacagggattatgtcaaactaaaagaaaatagcctatcacccacaaaattctacctgcaagtaataattctaaaactttgcccaaggttctctaggatgcctaactggggttctctatttataaatcttttctaaaatgcctgatctcactttgcaattttgttcaggacaatagatcaaattccaccaaacctcttatttg

SEQ ID NO: 183388 - DNA, 457 bp, Homo sapiens
gttaggggccagcaatgaaattgctctgtcttccccaggctgtggttcctgccgcctccctcccttctgtcttcccgtctgtctagtcgaggatgcaggtctctaatctctgtcctcgctgtgcaggcttgaaggactcgtgttttttgagaaaggcaagggggagtaaggcttgcctcccctagagcttgcctcctgagtagtttccacatcagagagcagggtgtggggtgtgtttgtgaatgagagtgacccagcccctctgcgcccccaccccgttgatgcttagggggctgggaggaagctgcggcccagggcaggggcagctgccattggtgttgggtgtgaggtttgttttttcttctttctgtctgggcttccttttccctcctgaatgaccagtgggcagaagaagagattggaggcagtgcccagccccacacgctgctgaggtcag

SEQ ID NO: 183389 - DNA, 380 bp, Homo sapiens
acccataaatactttatctcttttctatttcacccataaatatactcatttctaactgataagcacactttaaaaatgttttaatagtattattactttttaagagacagagtcttgctacgttgcccaggctagcctcaaactcctgggctcaagtgatcctcctgcctcagcctcccaagtagctgggactccagactcacaccaccacacccagccagaaaacatgttttctaactagtcaacataccattatgccacctaacaaaatgaatggtaagtcctcagtatcatctgacatccagattgtatcttaattttcccagttgtttcaaattttctttgttgcagttggctctagatactatatttgcttacta

SEQ ID NO: 183390 - DNA, 2608 bp, Homo sapiens
  misc_feature (76)..(76): n is a, c, g, or t
  misc_feature (94)..(94): n is a, c, g, or t
  misc_feature (122)..(122): n is a, c, g, or t
  misc_feature (127)..(128): n is a, c, g, or t
  misc_feature (132)..(132): n is a, c, g, or t
  misc_feature (136)..(137): n is a, c, g, or t
  misc_feature (151)..(151): n is a, c, g, or t
  misc_feature (177)..(177): n is a, c, g, or t
  misc_feature (191)..(191): n is a, c, g, or t
  misc_feature (193)..(193): n is a, c, g, or t
  misc_feature (202)..(202): n is a, c, g, or t
  misc_feature (218)..(218): n is a, c, g, or t
  misc_feature (247)..(247): n is a, c, g, or t
  misc_feature (359)..(359): n is a, c, g, or t
  misc_feature (371)..(374): n is a, c, g, or t
  misc_feature (378)..(379): n is a, c, g, or t
  misc_feature (381)..(381): n is a, c, g, or t
  misc_feature (384)..(384): n is a, c, g, or t
  misc_feature (386)..(387): n is a, c, g, or t
  misc_feature (496)..(496): n is a, c, g, or t
  misc_feature (506)..(506): n is a, c, g, or t
  misc_feature (517)..(517): n is a, c, g, or t
  misc_feature (629)..(629): n is a, c, g, or t
  misc_feature (644)..(644): n is a, c, g, or t
  misc_feature (706)..(706): n is a, c, g, or t
  misc_feature (716)..(716): n is a, c, g, or t
  misc_feature (719)..(719): n is a, c, g, or t
  misc_feature (726)..(726): n is a, c, g, or t
  misc_feature (732)..(732): n is a, c, g, or t
  misc_feature (735)..(735): n is a, c, g, or t
  misc_feature (1889)..(1889): n is a, c, g, or t
  misc_feature (2543)..(2543): n is a, c, g, or t
gtggagctggtggccagcaccaagaacacttttcaaagtcaggagaaacttataaaggaaatggactatttatggnaaatcaatcaagagacangaaacaatctaaatcaggaaactagcanatttnnttcnttannggactatgtgtcantaaggaagaggataatcactattcantatcaaaagatgcntntatttctcnatgaggaggagcaacngcatctgcaggcactggaaagagaagcanaagagcttttccaacaactacaagacagtcaagtgagaatgacccaacatttagaaaggatgaaagacatgtacagagagctgtgggagacatgccacatgcctgacgtggngctgctccaggnnnngagnnangtntnngcaggactgatttggcacagatgcaaaagccccagccagtgaacccagagctcacttcatggtgcataactggagtcctagacatgctcaacaacttcagagtggatantgctctgagnacggaaatgantccttgctatataagcctttctgaggatgtgagatatgtgatatttggagatgaccatctcagtgctcccacggatccccagggagtggacagctttgctgtgtggggagcncaagcattcacctcnggcaagcattactgggaggtggatgtgaccctctcctccaactggattctgggagtctgtcnagattccagnacngcagatnccaatntcnttattgattctgatgaaagattttttttaatttcctcaaagaggagcaatcactatagtctctccaccaactctccacctttaattcagtatgtgcaaaggcctctgggtcgggttggggtgtttctggattatgataatggatctgtgagtttttttgatgtttctaaaggttctcttatctatggttttcctccttcctccttctcgtcccctctgaggcctttcttttgctttggttgtacatgaaaagttggtttcatgatgatttattgtgacctcccatatataaggcaaatactgtcctaagacactatgtgtgagagcctgtgagcgcactgtaacttcatggaatgtgattactttatggttataaatgggataaccaccttgaatgtatacattcattaattaagttattttaattaataaattattgtggaatctttactagaacatcaataatggctttttttgtacaagttttttgagattcattcacttactgtgaaagtcatgttctaatgtatttaattcagagattgttagtatatcacacttgagcagccatcagagctctcttctgcctgggcacttttatcacttccagaagaatcccaataccccttaacatttattctgcattcaccctcccccattccttcagaacacttaatctactttttatgtttttgcattcgggtaaataaaatcatacaacataagttctttttttaatctgatttatttttcagagagtatgttttcagtttgtgcacactgtaaaccatttgtcttacttgtatatttgaaccaggctggggtagaaaaatgaactggtggatatctcatcttacaaagaataaagaagtgtgcttattttctttctaagtctgaccaagttaagttgacctcacagactttattatttctcaacatcctagttattaatctcatttcagctcatacaaaagtttttcagtgctgggttgctctgctattacatcttctcaagtatattatatcagattataacattcagaaaactcttatacttattactaccagattgaaaagtccaagggggcaatggcagtatttgtcttctttgctaatatattaccattatcgaatgcgatttttagaatagattanacaataaataagatgaataaatggattaagtagaggagttagtatgtataaatattattctaacattgagaaacttttccaaaatgtacgtaacaaaataggatagaacatactaatgaatatctatcaaaagataagacataaattgattttcagattgatatcaaagataatactattatgttagggtttaaaataattgtagcataatttttatagggttgatttcaattgtcttaggttttttaatataaacctttgaaagatgaaggttcctatataagatgatggggtagaggagcaggacttagaatagtggagactggccttaaactgacatataaatttaattacttgctaagcataaagtggtataaaccttcctatgcagtagaaagaacaaaattagtttacactttaaataagaatccagatgggctgggcgcggtggctcacgcctgtaatcccagcactttgggaggccgaggcgggcggatcacaaggtcaggagatcgagaccatcttggctaacacggtgaaaccccgtctctactaaaaatacaaaaaaaattagccgggcgcggtggcgggcgcctgtagtcccagctactcgggaggctgaggcaggagaatggcgtgaacctgggaggcggngcttgcagtgagccaagattgtgccactgcaatccggcctgggctaaagagcgggactccgtctc

SEQ ID NO: 183391 - DNA, 184 bp, Homo sapiens
tattagtattcagtgatttgactccaataaggaagcaattgcaacagcccaggtgagatacagtgagggtctgaatttgggcagtgatcctcaagaggaaggggcacatgccaggtgcttattatatcaggcttcagtgggtagcaggaattactgtattgttactgattccttggactaactg

SEQ ID NO: 183392 - DNA, 195 bp, Homo sapiens
ataatcccagcactttgggaagccgaggtagaaggactacttgaggccaggagttccagatcaacctgggcaacatggcaagactccaacacaacaaaaaatttgtaaatgagatgggcatggcggcatgtgcctctagtcacagcacttggaaggctgacatggggtgttgcgggctacggtgagctatgactg

SEQ ID NO: 183393 - DNA, 313 bp, Homo sapiens
ttttttaaaaaacacattttataacataaactaggaaataaaattattttggaaatataaaggaaagattattagggtttgcttgcagtagttaggaggtttctgagaggggaagagtaaaagttgggaaagcgaggcagcagagtaaaaggtgatcaagctatgaaaacaacatgagccaggagtttactgaagcagagtttttcaaagtagaaagcagtagaatatacgagtgaaaagataaagggggctggaggatgaggataagccagacagaaatcagacctgactctacagtgatggacactcctga

SEQ ID NO: 183394 - DNA, 459 bp, Homo sapiens
gtttataaagagtgggtcctgtgtaacttagtcaagattaggatctgcggttagcaatgtgtaaactatatttttttgtcacctttatctcagaaacatcaacatgtattctctttgatttaattcaaagataattttaaattagaaatcaatgtctttatatcaagaggcttttgagagacaggcttgtattgtccaaactgctactttctaggtatgtcacccttggacaggttacttgaccactttgtcccttttttcctcctctgaaaatggggcatgaactagacctgactcagagggttattgtgaagattaaatggaataatccaagaaaaacacttagagtaggaactgcatataatagtcttcaataaatggcagctgtttttatgatgaagaacacacctgtgaaaaattttatattctgtaataagattaataaaagcaatgagcaaa

SEQ ID NO: 183395 - DNA, 577 bp, Homo sapiens
cgcctgcctttgcctcccaaagtgctcccagcctccttgcttctttaaactgctgaaggataaatgaatggtccagtgaatatgtgtctcttatcaccttcccagcactgaaataattattctttgaggcagtattaagcctttatgcctgaagcttaggctttgcgatgtctatgcttactgaaatctactttgacacttctatagttaaactgttttgaatagtatacaacagtaatatccttctactggagtctaggtgatcacttctccagagggatttcagtactacaagctacataaaattagcagctactttcccctcagtgctacttagaggtaacctctaggggaaggttaaaaagccaagggaaggcagggcacagtggcactatcttgggttactgcagactcaacttcctaagctcatgcaatccccttgcctcagcctccggagtagctgggactaccagagagtaccaccatgccctgctaatgtttgcattttttttgtagagacggggttttgccatgttgcccaggctgttctcaaactcctgggctccagtgatccact

SEQ ID NO: 183396 - DNA, 194 bp, Homo sapiens
gcacgatggcgtgcatctgtagtcccagctacttgggaggctgaggcaggagaatcacttgaacccaagaggcggaggttgcagaattaaaaaaataatacagccctagccaaaatgtatttctccactagaaaattttaaagctacctgtataaataatttttatattaaaaaggatatcggcctggtgaggt

SEQ ID NO: 183397 - DNA, 318 bp, Homo sapiens
ggagaaaagccagggccaagatctccctgttgctaggctccccatagtgggtatctgggaacaagtcctgcagtcagagtactttaattagtgcacaatacttgcacaggcaggcaggcatactcacatgcagaaaagaaaacatttcagccattcaggcaaaagtctgtatttcacctgaatcgtaaagactgtgcgttttcaactcgtttttgtgtcagttttcatctaaaacttagcccccccaaaaactcaaaaggctttatcataattaccttaaatgaatttttgtcaagaggatttttacctgaattatca

SEQ ID NO: 183398 - DNA, 600 bp, Homo sapiens
aaagtgcaagacaggaaattgttagagataagactagaaagagggaggaagcagcagatttaaggctagaatttagcttgggaatattttgtgctttatctggcagagtagggaaacactagagggttttaagcttgcacacagcaggtctgctttgggttgcatgttaggtggatcgcatggtgacaaggctgatggaagaaaggtcatttgtatggtgcagatgtccaagcaagagatgaaacatcacaagtagcagtagttctgaactacaacagtggtagtgatcgtgagccttgcagatggattcacgaaacgtttagtgtgaaaaattagcagttccctaatcccagcactttggaaggctgaggcgggcagatcacgaggtcagaagattgagaccatcctagctaacacggtgaaaccccgtctctactaaaaatacaaaaaaattagccaggcgtggtggtgggcgcctgtagtcccagctactcgggaggctgaggcaagagaatggcgtgaacccgcaggcagagcttgcagtgagccgagatcaggccactgcactctaacctgggtgacagagcgaaactctgtctc

SEQ ID NO: 183399 - DNA, 569 bp, Homo sapiens
taattcgttatcgccctacacctattttacatatacctaccctaccgaattggctttctacatcatcatgcccacctttcagtggtgcctttgctttagtctctctttgaatgcccacaaaccaatcagcatgccctcccctgttctgagcccataaaagcccaggactcagccacattgggagagaaaccaccccagcatcatcccctccactgacagctattccattgctcaataaaattattctccaccctcctcactctttattggggtgtgttggggataacatcacacaccagatttcatttcagttaattaaataagtacttaatgagaggaagaaagaactgagcagtgttttatttaggacttggagaacatgggtgagtaaacagtaacaatgtcctaaatgggaaaggtgttctaatttcccaaagtcttcttgtaattatatttgagacatcttacactagtatctggctattaaggcagaatgtatttgcagatttaaatattttgcgactgcccaagatatccattagtgttggggataaatcagggatcctctg

SEQ ID NO: 183400 - DNA, 558 bp, Homo sapiens
atatggaaaaaagactgaatgctatcaccctaagactaggaactaagcaaggacatatcctctagccacttctattcaacattgtactggaaatcctagagaaaaaaataataacaggcacacagattggaaaggaaataataaaactgtctttttgatagctggcatgattatttataattatttcaatgtaaggaatctacaaaaaagtaaaacagaaaacaacaacctaccaaactaataaatgagtttggcaaggtcatatgattcaaagtcaatgtacaaaaatcaattgtattgccatgttctaagaacaaataactggaaattataattcaaaagtcaatgcaatttacaatagcaaccaaaaaactggaaataattgggaataaatttaacaaactatgtaaaagatctgtacaatgaaaactataaaatgttgctgacaaacattaaagacatcccacatacatgaagagatgtactatgtttatggatcagaagatcccatactatttaaagatgttaattatcctcaagttaatctatagatttgat

SEQ ID NO: 183401 - DNA, 342 bp, Homo sapiens
aacaatgagatagtgaagaaagagagaaagagagagaacagcaacaaaagcaaatgagataaacaaatttgtaaatactcataagatacatcaattgtgatctgtgcaacattgggatcccaatttcaaagaactgtaaaacaaacaaattgaagttataacttttattaaaccattggaatttctaaactgactggatatttcctgatattagataactattattaatctattttatacataatgttaaacataattctgatattttaatgttataaaagattaagagatgaaaagatatagtttgaattagtgtctaagtaatataagggagtggatgat

SEQ ID NO: 183402 - DNA, 382 bp, Homo sapiens
ttgaggagttcctgaggatgggggtcagggtgaggtcttggtgagtgttttagtggggttagcgatggaggtaggattggtgctgtgggtgaaagagtatgatggggtggtggttgtggtaaactttaatacagcataaactattactaatgctataaaaatgctagaatattatagtgtgacagtgagggggaagccttgctctatattttcatggaaaagtaagtctccccatgaactccaaccaacactaaaacaggactactgtctcaaaaggaaattttttagtgaaagaatctcgacgtcctctggccctccagctttccttgtggaattaataaactgcagatgtcttcaaagtgaagaaaaagccagtcatgct

SEQ ID NO: 183403 - DNA, 878 bp, Homo sapiens
caaacgatgaagcagaacttttatggagaccactaacatttactttcagttcttcctgagaaaagtaccaaggcataggttccttaagtgatcttaaattgtctcgtaagcattttatatgtgggaagcacttaggaaataaatgttcaatgaatgaattaatgaaggaatgaatgcaaaaacagctatgaaaaaaagcttaaaaagattctgcctgcttatgcaagatgctaatcatagcattccagaatgctaatggagaattagcccattttgaattttgggaagaggaccagtctgaccatacatacacacttttctcagacatgaagacagtagcatcctagcagccatcctgtatttctgaagatgaatgagtgacaccaaggatgaagaaagtgagtgtggagtcctggacttcccatctccagacctcttaccaggaacagaggaaaaggaaacctgtgtcttcttaatgtcatgattattgggttttgttcagagaattctgcaaactaacactcatttaaaagcttatcaagcaattattataaatctattgagtgagcactttctattcttaaaattgggatttgcctttcattatagtagaaatatagaaattatcttgtcttttaaaattcttaagaatagtgactagccaatgtgtgtcacttcgtcgaatacctaactaataaatctacttttgggggccttccatgattccttaaaaacgcgaggtctgacacaacgggttctgcatgggtaaaagtagtggcacacaaaaaaaaatgcggcgccaatataattgggcgaaataattaatgaaggtgcaacggcgagagttggtgtatatgacactgtgtagaaaagaatac

SEQ ID NO: 183404 - DNA, 831 bp, Homo sapiens
attaagtggagagccgatagtgaataggtaggtagttactttggtcttgccataggtttttggctgtttctgatgagctactgattgaagacccctggggtaggggtgaggcctgcattctgggtccaagtctaagagtggcgactagaaatgagcaagttatttaaattgcctgggccttggtttcttcatatgtggaatggggtaaagcctgccttcctcatagggctgttggaagatgaaaaggaggaaggaaaagcaccgtgaaaatgttaacgatggttagaaggtgggctctgctggtgacagacagagccttgatatcacctgttggttggtcacctgcttccccaaggccacgccctgcagccttctccttgaccatcccagccctgctgatgttccttgtgatttcacaatggagtacttatataaaattggtaactgctttccgggaaattgacttcccttcccctcgtcctgaaaactcaggcatgggcatatttcttggagattttctagttgaatcagaacttcctcttggtttgcgtagattccatttagacctgcattgtccagtgtggtagccgcttattgagtaagccacgtggcttattgagtactggaactgtggcttgtccgaattgggactgctttaggtgtaaaatatacactagatttccaagacatagtatagcaaaaactctgtacaccatttcattaataattactatgttgataacatgttgaaatataacattttggatatattagattaagtaaaatgtgttcttaaatttcacctgcctgtttcctttttattcttttttt

SEQ ID NO: 183405 - DNA, 606 bp, Homo sapiens
tcggtcggtccacttctacccacgtagcaaatgcagaacttctataagttttgttattggccagatgcttccagcaactgagaataggacctgctttcatctggtgcttggctttggctgctatcactagccacccttttctccgtggctacctgggatctcagaagatgagggctttctccctgtgtgctgcctcatacactaggggcattgaaagatttgacagcccaccaggtgacaccatgtcctagccccctcaaccatgagtacaaagccatctgcttgtctatgtgatgcctatgaggacaatgggtaggtcatacctctaccctgaccgctcatcctggccctctgaactcctatgagacaaagccatcccttagtccctggaggagttgcttttccctgccctgacccagaacgacctgcctgtaggtgtagtcaggtatgggccataggctgaagtcaggaacacccaaagatggtgggggcaggcaggggagtgagaagtcttgctttcagtggtgtgccggatgctttgtttcacaggcgcataaaagaggaacttcatttaacagacctttccatgacactgttggtgagcta

SEQ ID NO: 183406 - DNA, 366 bp, Homo sapiens
acactccctccccacagccacttcagtgacagctgagttaaaagttaggcagaaaagtcctaaagagggaaagctggtatataagccaatgctgtactttcaatttgctttttaaaaatatggtttttttctttttttccttttttttggaagggtttgctatattccagtataactaaaaagtgctggaaaatcagttaacctattttctataaaattatccagtccttgcacagtagtatcgaacctgctattaatatggctttctgctcctaaacttccatacagaatacagactttttaaagcctgtattctttgtatgaaaactggcagtatattttatttatcttggacgtatcggaggt

SEQ ID NO: 183407 - DNA, 501 bp, Homo sapiens
acagtcttcattattgagtatgcacatatgaaaaatgaaggtggaatactggtttattaaaaagttacgcttgtttagaaactctatcagaatacagagccattcagaaatctgtgactatctgtgtatggccagaaacaacagccacagctattgaaagaattggttttcttcaatactcatccatccaaaagctattgcttttgaaatcagtcagtttaatgactggtcttgaaaagaaatatatttattctgtaaaattcctgtataacccaccatgtttgtttttctgtttttgtttgggttttttttttaagctattgaattttttctaactgagataacattcacgtaacataaaattcactatttttaaccattctagtgtacatttcagtggtttcagtatattcaaaatgttgtacagtcattaccaccatctaattccacagcattttcaccactccaaaaagaaatctcatgctcactaggcagtcactt

SEQ ID NO: 183408 - DNA, 142 bp, Homo sapiens
ctgtggttgttaagcagagttacctaaagaaggaacttcaagatacaagtttaaagcaacactctgtaattatttgtattatagtataaggttgttaagtttgtcttcaccctttgaaagagttctgaacagagttagtgtt

SEQ ID NO: 183409 - DNA, 235 bp, Homo sapiens
gacccaagcttcttccatccatggctcttccatctcccaaacgtgtcatgttggtctgcacccagtcagcaggaaagggtaagagtggaggatcttgcaggggagcctttgggaccaagcctgggatgctccccacttctgttcatagtccacaggcaggggtccagcaccagatcggggcatcggtcacaagagagaagcttggggcaaaatctgggaatttccaggaacacag

SEQ ID NO: 183410 - DNA, 440 bp, Homo sapiens
cctggattgtgagtagagtaaccagaagaaactgcagcctgtgaggggaagcttggcatggaagaaatatttcagaatttatgttcttaatacatatcagctccaccactttactaagctctctgcttcttcttgcttttccctctataccattatgagtggagcccttcaaatttaatgttaatttgaacattaaatctatatgcctcaaacaccaattcctttatatctataggaaaactagttgcaacatgccatcctgacatagacaaacagtaaatagacatttgcactccaactttataaccagctgcaagtttctttctttctttctttcttttttttgaaatggagtcttgctctgtcacccaggctggagtgcggtggtgcgatctcggctcactgcaacctccgcctcccgggttcaagtggttcgcctg

SEQ ID NO: 183411 - DNA, 438 bp, Homo sapiens
tggagtgcagtagtgaacacagctcactgcagcctcgacctcctgggctcaagctgtcctccttcagcctcctgtgtagccaggagcacaggcgtgtgccactgcacctggctaacttttggatatttttgtagagatggagtctcactttgttgcccagactggttttgaactccagggctaaagtgatcctccttggcctcccaaagtgttgggattacaggtgtatgccatgtgcctggcctctgtatcttttcaatgggcatagtcctcttgtatttatgtagtttactttcgcttgttgcagaaaggacataatgtggttaaatagggctatagtaataattcgtgtcctcagggttgttgtgaggatcaaagaaatgtatgagaaggtaaactgcaaggttcagaatagtaaaaataagcccccacttcatg

SEQ ID NO: 183412 - DNA, 642 bp, Homo sapiens
taggattctctaaaataccaacaaaattgacaaactcttagctagacagacagaagactcaaaataactaaaatcagaaataaaaggagacattgcaactgatgcttcggaaatagagatgataagagactgctatatacaattatatgccaacaaattgaatcacctagaagaagtggataaattcctagaaacacaaccttggtgttcagtcacagtcttggtgactgaattatggagaaatagaaaatctaaacatatctataaccattaaggatattgaatcagtaatcaaaaacctccccataaagaaaacctcccaataaagtaaaacccatgaccagatggcttcactagagaattctaccaagcatttaaagaagaattggtaccagttcttctcaaaatattccaaacacttgaagaagaaggaatacttccaaaataaatttattaggcaacattaccctgatacgaatagaaaaaatacaacaataaaaaagataactgataaaaaaaattgatgcaaaaatcctcaacaaaatactaggaaaccaaattggattatacacttcagccatgtgggatttatccctggaatgcaaggatcattcaatgcatgaaaatcaataaatgtaatgt

SEQ ID NO: 183413 - DNA, 168 bp, Homo sapiens
cagcatatgggtcaagtctagaaaattaaatcttttccgaactgcattaaaatttttaagccattttatctttatcaagaaacactttatctacacttacatgttttttgtttttagagtttaaatttcagcacctacataattttcatacccactgcaatatttcca

SEQ ID NO: 183414 - DNA, 157 bp, Homo sapiens
aatagaaaataaacattataggtaagtttagcaaactttcagcagttgattaagttagagagaggaatggaaggtcaacatagactcaaaaactatctggatatcgtcatggataatccagcactaatagtttttaaaggaactatggatgcattga

SEQ ID NO: 183415 - DNA, 370 bp, Homo sapiens
gtcccttcctacatgtgaggaggcagtgttcatcccctctggaggatgcagcaacaaggcaccatcttggaagcagtgagccctcaccagacaccaaatctgctggcacattgattttggaccttccaatctccagaactgtggtaaataaatttattttatgtataaattaccaggtctggggtattttgttataagagcaggaacagagtaagagatagacattatatagccattaaaatttaagtttttcaagaattctcaatcactacagaaaatatttgtataataatattaagtgtaaaaacaggacatagtatagttacactatcatttacattttattagaccgacacacatgccattcaac

SEQ ID NO: 183416 - DNA, 298 bp, Homo sapiens
caggggcggggcggggcgaggaggcggcagcgcgtttaagtgacgtcttggctgtccgcgccggcagaggcgagggttctggggtttctgggactgtctggtgtgttttctgtctattgaaccctttcctttcgacgtctcttctgaatattgactcatcgggttgtagaaatccagggacagagttgacatcactgggcattttagccaaaaagcagtgctcgggactgcatgtgccagaagtaaacttgtcaaaactcagattgtgtttcccctaaagtcagcttaaagtgcaatg

SEQ ID NO: 183417 - DNA, 323 bp, Homo sapiens
tcccctagtaaaagtttctgcaaaaagcttggccagccatgatgccattgagcattgacccccataatcaatctccctgtgactctcacggagaatgctgaagcaaattttctgtagtgagggatctgtagaccatggcatgcagcctccagtctcactgtgcagactgaggacagtgacacaggtcattgacacacggctgacctaggcagtgattctccctacactaatacagtgattctttctgtgagagactgcctgcccttaataagataacatgcccctttggccgggcacagtggctcacgcctgtaatcccagca

SEQ ID NO: 183418 - DNA, 743 bp, Homo sapiens
gtgtgctgtgatctagaggatttcctcctatctgcatacagagccattggaggcttccttgttgcttacctttgttgcttacccttgttgcttcctctttggaaaggggcaacatacatggcagatgccattctctgtctctttggaaaactttgtcagcacatttaaggtttttttctagccacagaaagccacctgcttcaaagtctcatcctccacaaatggcaagcacacaatcattaatggaggggaggggtacataggctttgccatttgattcagttgggacaaataggggaggatttcttagctctacagctctgtccgtgtggccaggtgacaatgtcaggctgcactgccattagacttgtccctttgcacataaggcttccctccaatcctttccacagatgtggatcctcacatcacttcctaataaacatcctgcacactaaacttcatctatatccagttccctgggaaccaaacctgtgacaaaagtgaaaagtttctagggaaaatagggtttccttatcagacaggaatcaaattctgctgagctagaaaataaagtaaagtctgatgccatctcatgattttttttattaagacattaccactgccagcaagaattatgtgcatcaatttgtggggacaaacatcatattggagtgggatgagattgctgtcggttgaggagaaatgctgatgaatggactttaccctcaacctggattcaggag

SEQ ID NO: 183419 - DNA, 405 bp, Homo sapiens
ctccctatgagcattctctgtcatgtgagaactgggaggcatttgggagtaagtgcagcagaagagaggcgaagaaaatccatcggcttttctatttctcttgggagaagactgaaacaagtgtacttagatccccagtcagtattaaaacttgtgatttctccagattgttctgaaaacttgtcgccagtccagtaaatacttttgtcttcacagatattaacaaggcaatgcagaaattctcttggattgtgttatttctgtgtctctctcaaccatttgagagtaacacagcaaaagttgggaaagctaacgttggcacacagatccccagcctggtcctgactcgctcaactacccaggagcacctgcttggcccagcgtcccctcatagtttcccttcat

SEQ ID NO: 183420 - DNA, 405 bp, Homo sapiens
tatgcagtaaacccctcttctccatccctcggactacagctctgctctcgtagcactcgaacacccagcctgtgggcaagagggctgcctgtgaaagcggggaaggctccagaaggaaggagttgaggggccatccatcgggacctcaggaagagaggagagctgactgctcttagagatagggagaagaagggaaccacacagccacatctctagggtcctcctgcccacctccccagacaaaggtctaagcccccagtgctgactagaccccactgctctccaggcatctccgcatcccaggactctaatcccagccattgcctctggaagggcaatgctggggtccttgttgccctgtccccctccctttcctgcagaaagagtttccttccagaggctgtt

SEQ ID NO: 183421 - DNA, 569 bp, Homo sapiens
atagttcaaaagtaaaattacatctacgaataggctttctacgcagtttccaatattgttattcctgttatctagcatttttatttttattggtgttaagaaacttacttaaaaccttattgaattttgctgcaatacttcttttgtgtacatgaatgaaatttccccagagccagttgcattgtgggaaaattatacaaaaacttccttagtgtgaggttcaagttccacattcactctattccctgttccctctgctttgtaaaaaactgacaagcacataccaacaccttactgatgaaagccataacccatttctattacattccttcagatttgattttatgaaaactttaatcactttatttgcttttcttttaacaatgagtttcttcacatccatctcaacacagagagaccctaactgtgaacaacattttaatgaaacttcccctgagtgaggatggagggaagtcgtcccaccaatgctactattaatacaaagaaatgaaacaggctccatgaaggcagcatgctttatcacacaggaagattgttctgggggctta

SEQ ID NO: 183422 - DNA, 208 bp, Homo sapiens
catgggaggatagggggtgttagctaaagggtatgaggtttctttttgaagtcatgaaatgttctaaacttgactggtaatgtttgcgtatatctccgaatatattaaaaaccattgaaatgtaaaaagtgcaaagaaaaaacagcccaagttgcaattttattcaacacttgattggctttaaaaatagattccaggctgggcatgg

SEQ ID NO: 183423 - DNA, 489 bp, Homo sapiens
acgttagtgaggggctgtaggcaagaagttgatagaaagaagctgttgtcagcagtcacttttttagaatatattgtattgtactaggtgtaatgccttgggttaaatgctgccttgcacacaagaatttataatctgtgagaagataaaaatagacgaatgctgattagaaacactgtcttgggtagcatcataaaaggatgattcattaggaaatcaggaagtctataatgcaattttgatcatttaggttgtatttttacaagtttttttttggatttctagtaattttgttgcaattccacttctgagatcatcactgatgaatattatttagaattatggggccaagcttagtggctcatgcctgtaatcttaacactttgaaaggctgaggcaggaggatcacttgaggacaagagttcaagcctggacaacatagtgagaccctgtctctacaaaaaataaaaattaaaaaaacttagctga

SEQ ID NO: 183424 - DNA, 570 bp, Homo sapiens
gatgatacgggatgatcctattggtgcgggggctttgtatattatgggcgttgattagtagtattactggttgaacattgtttgttggtgtatatgttgtaattgagattgctcgggggaatagtttatgctgtacagcaaaactattctaaaaggtttttttaaacattttaaaaagacttaggaaaccaaatgtttgagattcaaagcttgattctcataatttgaaattagacaacaaaaaagaacagacaaattataaagaaataattattatttctccatggttttacaacaaaattttttattaagatttcccacacgcaagagaactttcctgctaaaacaggagaattgagttcaagtaggaaataacctttttaaaatagaagaacaagtacactgggacaaagttcacagcaaaagacaggcctcgccatgaaatttcccacacctaatgaaattaggacttttatggtaaaacaaaacaaaacaaaacaaaaaacagttcttattttcagtttcccaaagaaatcattttcaaagccagacactctccctctccccacc

SEQ ID NO: 183425 - DNA, 328 bp, Homo sapiens
gccaccttcccttctgcattccaccaggaattgaagcagcataagaccctcaccagatacagatgcccaattttgaacttgccaaccaccagaatcatgagccaaataaagctctttgtttaaataaactgtccaatctcaggtattctgttacagcaacaaaaaaataactaagacattcatatagttagaatcatacactatgcagcctttcatattggctcctttcacttagtgatgtttatttaagtttctttgatgtcctttcatggcttgatagctcatttctatttggtgttggagaatactgctttgtctgaatgcccca

SEQ ID NO: 183426 - DNA, 519 bp, Homo sapiens
aaaaccaccccacgtagaaaactgatagaagtgggattgtttccactggagcagggctgggggctcagagctctgccctcctcctgtgcccctagacaccagcagggagcatagcttgaaaattcaccaatgaagaaaccaccccacgtagaaaactgatagaagtgggattgtttccactggagcagggctgggggctcagagctctgccctcctcctgtgcccctagacaccagcagggagcatagcttgaaaattctccaatgagaaagacccttttagggcctttatgcagggggcaggtgacatttattccggctcatttagggcttcctcctcgtttgggtttctcttcaagtctctcaaggaagaataaagtcacataattgccattgctgcatccaaggctcctggaaccagactgcccaggttcggatcatgaatctgtcactgaatagtctcacgagagcttgggctccttaccgaactcccccaatgcctctgatgcttcacctctaa

SEQ ID NO: 183427 - DNA, 450 bp, Homo sapiens
tgttatattagagatgcagtattgtttgggaaagctgtggagataacattcttaatgcagtggtttggaagaatcttaagtaattatgaagggttttgtgtgaaaatatctgttatgcttattacatggcagtacatgaaaaaatgcatttcaagtactaatttatttaattttatcacacttctacatggacgctatcatcactcatattttacaagttcagaaactgaggtggttaaacatttttcccagactattcagtaatctgtcagttgcttttctcagtagatatttctgtctgactgaaccaatgtctaaaaagaaagatctgggatcctcgtcgttttgccttcaaatagccctcttttggacaaatcacttgtgttaagtaagatgatattcaacttcacagaaaaaatgctgagacaataaatgcaattcagagaaaag

SEQ ID NO: 183428 - DNA, 268 bp, Homo sapiens
agtgagctgagatcatgccattgcactccagcctgggcaacaagagagaaactcaaaaaacgaacaaacaaaaaaaaccccaaaactgaggggtttaattcctgaatagaagaggataagaaaatacttagcccccactctagaaatataggactcccaaaagtataattgaaatcccatttcctaccagccaggctcaaaagagattgtgtgatttagagaagattattgtgaggattaactagagtgtgttcaagtggttggtaag

SEQ ID NO: 183429 - DNA, 351 bp, Homo sapiens
ccctcacacgcacttggtacacgcagctcggtgaaagaaccatgcacaaaaggtcacagggaatgatcccatagatatgacatgtctaggtcttatctgtagaatagatacatacactgagacaaaacacagattgtctttggtgaccagaggcagaggggaagggagaaggagggaaactggttaatgggtatgaggtttccttttgagatgcaaatgttttgaactggatagagttgtgggtgcacacaaagggaaagggtggatgccgaggggcaagggagtgaacggtactagacgtgttctgtttccttctccagattcgctctcttctcctcttccctctcctct

SEQ ID NO: 183430 - DNA, 699 bp, Homo sapiens
tagggcattcaactgcggttggacctcagtgccattgagcaatctttgtctttggtcagaaccctcttctataaacattcaccacttggttccaactgcttactcacccacgtgcctaatagataacctcacctcctaattcacagagggaggaaagttcaaaatgcaggaactttcacttcccactgtgagcctccaagggagtgtgtacatctgcatcctgctgcctcatgcatggagatagcctttctgttcaacctgtcatctgttatgatcccacttcatcccatcaatgggatcttactccttcagccacccccttggcacctgtactttcagctgctcagcctctactggtccgttgccctcagccaaaaaacgccccttcaaccctgcactcctggttattaccctattgtttctctctgtggacaatcttcttgaaagaattgtcactccccttcctcagcttagaaactggtttatctgattgcctgacttttggtgctgttggttaccctctcattttctgggataccactatcatcatcttctctttcatgtctttgctgtttttgtatcccctattggattgagcaaagtcatcagcctagtcaagtcaccccccaacaagatgaaacacaacagtcatcctagactccttcctcccatttatcttccatagccaattgccaaatc

SEQ ID NO: 183431 - DNA, 343 bp, Homo sapiens
ttttctatgggaagagctcaccaggtgtgtgctgtgtgccaaggaccacagcaagcagaggctgtccaaacatgaagaatgcctctgcacaggccaactgcatgttccgcaggaccatttaggttgcaccatctccctctcgacagcctggcacagtggcattccggtgtgtgctacccgtgcctggctggtgaagagcctttctcccactccacctggagctccacgagggaagggcttcaccctttttatctaacccaaagcaagtgctcaagtaacaagagaagacgacaagggaagggaagagaggaggtgctgtttgtgctggatcccgaggtggaga

SEQ ID NO: 183432 - DNA, 1102 bp, Homo sapiens
agcatccattccaggccgtggagggacgtgatgctgggctgtgtttactaaacccatgggttttcagcctcttaagcccagctccgatctccaattagttgagagcgctgggttgactaacctctggtatctgagcacagacagagggtgctgtgggtctgctgggtggcagaaatggttccttccggcttggcgttctctcctggccactcttcctgctgcctctgactactcagccttgttttcggtgtgtaggccccagctgcccactggaactgccggctaatgcttgctctcccaagatctttaactcctcctggctgcacctgggtagggatggtggcatcgatgcccctctgtctgctgaaggacctgttgctgcttctgtcttttcacccctccttggctgatgacccagagccctctgatgatggcattctcctggcaagagaaaaagacttaactagacttctgaacttgaacagtttcaggttatattttaatttttttttttttgtacaggttctgattctaatacatttcaacatgcttttgtcccccctcgtgtcaatatttgttatagactaatcgccggggatttttcacctggttggagggtgggggtggggtggggtgtgtgtgtgtgtgtgtgtgtgtgtgtgtgtgtgtgtgtgtgtgtgtgtttgtaggtcctggactgattaaagttcattgaggaaaaagcacattttacaacaaaaaaataaaagtgtagatttaatgtatgtgactggggtttggggttgcaaacctggtggatcttgaggggctgggattagggtggttcaggaaaatgtgatgctgtttccccatgtttagccatggtcaaaaaatggatttctcctttttctaaaatgtccagcaactgcctactgttgatcaaatgttgaagtattcttgtttcccttttaagccaatccatgtgcccacataacattatgcccaagtggagagttcactttaatttccaaagtatgtttcatgcagccccctgtcagctgctctgtggaaaaggggttctgttatgaaataaatgttgcactccctgcatcccatatcctca

SEQ ID NO: 183433 - DNA, 1072 bp, Homo sapiens
tgtcattgctcttatataataatactatatttattgtaataaattaaattagaacttgcaataattttatcaagaacaaagtctaaatgatttctccttcaaatttgagatgcaattaaatgtatgaaatcctaatatcagaagttaagatcttttgacataaatatatcaagaaaatccttcaatccctcacatgtcaaataagtaaactaaggttaagaattcagttaagtaaaaagattggttaagaatttatttccttgggcttttcaaaataaaatccctttataattgcatggaaaatgttttccaatttatttggcttctggggactctgaaattttacagttcagtagatgtttctgttggtttctttttgaagaagagtggaattttagtttctgaaatataaagtgggagcactggatcctaatttcagtgtgttcatttatgcgtgttcctgagtctaaatttatttttttaaaaaataaaggtaattatccctgatctgcccatctgagaagatgttgtatagggcaaacatgaaaacatatgtgacaaggactatgaaaactgtgtaaacttctagataagcatgtaacagatacttaggcattttttcttataaaatcaatttcaacacagatgacataaattatcaaattactttgatttcattgagttttatagctttccccctctagtataaaagtgctgattactcatgatattcatagcgtgttttcatagccccagtatattcacaagagattgactagatataaaaacacccaccactaaattaataagtacccaacagacatttggttttgcacattggttccttcttctggtcctccccatggggccggttccattaattataagtctccctagtggcacagacgggaatggtctgagaaaggattaaccctcgaagattttaactgtgccacaactctttactttaagctgcctgctcgtgacacaggtctcagggtttattggggactcctaatggtaaggccttactaacagaaatattggctttataacacaaaagtgttgaaat

SEQ ID NO: 183434 - DNA, 310 bp, Homo sapiens
tttcccttatgggatctttgcaacttagaacacaattattactcattgtatccgggtcatttaacatcttgtcagaatgctaacattaaataaaccaggccaggcgcggtggctcacgcctgtaatcccagcactttgggaggccaaggcgggtggatcacgaggtcaggagatcgagaccatcctggctaacacggtgaaaccccgtctctactaaaaatacaaaaaattagccaggtgaggtggccagcgcctgtagtcccagctactcaggaggctgaggcaggagaatggcgtgaacctgggaggt

SEQ ID NO: 183435 - DNA, 199 bp, Homo sapiens
tatggtgaagccctaacccccaatgtatttgcaggtacggcaagattaaacaaataacaagaaaagatagtctcttctcttctggttcaacagggattattcacttatcaccaacatatccaaagctgtcatgaaatcctatgagaaaattatcttattccttcctcaaaagaagtcatcccatatttccatcaagtcg

SEQ ID NO: 183436 - DNA, 463 bp, Homo sapiens
gagttggaatgaactgccccattcagccatatatctggaaaggctaaccaatgccatcttagactaatttttcaacatagacaatggctaaacaacctcctgaacttagtcttgcaatgtatctctctagagctaaccttagcattagatggtaactagtacacaatgaatgggagggtgggtgtgtgtgctggtactctaagctcccctcccatttggcttcaactttaaaagcttgtctcttgagggcacactgaggcagttgggaggagagagccaggttctccttaactctcgagtctgctgcataaatttgatgagtcctaagtggggcttggggagaggacatagggaagctacatttacccacaactgtgactgagccatattcctgctgtcatggcctcagatctaggttgaacatacctactacttgggcacagggaaccaagttataggtata

SEQ ID NO: 183437 - DNA, 145 bp, Homo sapiens
gtgggtagcggtcagggtgggccgcactgaggaggtgactttgagcagggacttagaggagcaagggaggcagctaagcaggtgcctgggggtgcattcctgtctggttcattctgtggagagggcttacccgttccctcactgt

SEQ ID NO: 183438 - DNA, 413 bp, Homo sapiens
gagtctcgctcttttgcctaggctggagtgcagtggtgcgaacagaactcattgcagcctcgaactcctgggctcaagtgatcctcctaccttagcctcttgaggagttaggactgtaggcatgtgccactaagccaggctaattaaaacaatttttttttttttgtaaagacaggatattgatatgttgtccaggctgatcttgaactcctggcctcaagcaatcctcctacctcagcctcccaaattgctgggattacaggagtaagctacagtgcctgaccaataattggcatttcttaggggttctctggtgatgtcactgcagctggcttgggcaccagactttgagaacgactattttagccaaactcagttcctgtaggtagacactccagatatttttaaaagac

SEQ ID NO: 183439 - DNA, 177 bp, Homo sapiens
ccacaccgctgtccctcccaaatctatacttaagtcagtcatatctgtacaagtcagctcctttttgaaattctcctctaccaggtcagcccagagagagtaagtgctctcacttctacacccacagaatatttacccaaatgctgctctgttatttgactaaactagcggtgaggg

SEQ ID NO: 183440 - DNA, 236 bp, Homo sapiens
cacatttgggcagacacgagacttcagcaaaggcagatttctacagctatccagtgttcagtaatggtcgtttacaactgttcttcttgttcagaaaaattccgttctttgccctgtgctcagaagatcacaataaaacttcaccacatcaagctgctgtgggatagggcaaaccgggatggttaagtccatgagtgcatgaagtttactgttggtgctactggttcagtaacagg

SEQ ID NO: 183441 - DNA, 251 bp, Homo sapiens
tacaacctcaaagagctcccagttccttggttcttatcttaactgtatgggtctcatgctttatcaaccatccaaaagtagcaggaactcccaacaaatgaagtgatgaagtgagatagtaccagggtaacaagttgtatctggccttcttagggatgaactattcaccagagggccagctctaagggaatgtcaaatagaggcactagaaaagaggcactctggcttccaggtaatgacagtataatgag

SEQ ID NO: 183442 - DNA, 812 bp, Homo sapiens
ttgctgagttgatctagaggatcccagaaaaggggaaaattgcatgacattggatttggtagtgatttgttggctatgatacaaaaagtaaaggcaatgtgagaaaaaaataaataaacagatctttaccaaaatgaaactttaaaaaaatcacttttaagttatgaagaacactatgaagagagcgaaaaggcaatctacagaatgggaaagcatatttacaaattatatgtctgataaggtattaatatccagaatctataaatgactcctaaaattcaacaagaaaatcaacatccattcagataaaacctctcaacaaactgataataaaagagaacatcctaaaaactgataagaaacatgtataagtagtatacaactaataacataattaatagtgaaagtctgaattacttcctcctaaaatcaagaaaaagactagcgtgtgtggtttcaccactaaggtcaacattgtattggaagttttatcaagtgcaataaagaaaaaaaaagaaagataaagaagaaaagagtaaaaataaaaagaaataagacatctagcatgaaagagaagtaaaactatatttggttcggtagaatgatttattttcctttgggtatatacccagcagggggattgctgggtctaacagtagctctgttttaagttcttttagaaacctccagactgctttctacaatggctgaaataatttacatttctaccaacagagtacatgttcccattactctgtagcctcactagcatctgttaatttttgactttataataatagccattctgactg

SEQ ID NO: 183443 - DNA, 405 bp, Homo sapiens
caaggatgtggcccaggtttgctgtctgtgggaatgtggaaatggagttattcttcagttctctggttaattagttaattgttagaggatggtgagcaatatacaggtatatcaaaacttggagaattttaaccagttttttttttaatgccattacttttaatggcaaaaaccacaattacttttgcaccaacctaatataaggttggaaacattctaggagctgcagttgaatattctgtagcatgacagtccatgaaagcagaaaatctttgttaaacaagggtggctgggcaggtatgtgaagatgaagtagatgaagtccctctcatattttggtttccaaaacagggcctttatttattcttttggagtacttgatacttgtgaaatggaaaagtgcta

SEQ ID NO: 183444 - DNA, 697 bp, Homo sapiens
  misc_feature (14)..(14): n is a, c, g, or t
  misc_feature (16)..(16): n is a, c, g, or t
gatctagaggatcncngattgtgaaataggtaggtgtaatgaagagaaacagagaaggaaagagaaggaaattttggtaaaaaatgatgaatactcctttttagacattcgaatttaataaatcagtttctgttgatgttcatcagtgaaactgtattaggcaaaaggtcaagtgtggagataaagttctcggtattgttcacacaaggtagacagctaaagatatgaatatataggagagtacttacaatagaaagctgctaaagtaatagcttttggaagttatgatgtaggaaggctatgcaaagcagaagagtggcagattctactaatttcttcccttttcccttagtaagagcccctattttgtgcggggaagtaatgtatccagctaaaaggctaaatttctttgccttccttgcacacagggtagccaacaagatgtaagcagaagtcttatggtgtggcttctgggaaacctctccaaaggtaacagactaagatgggaggcaggtgctttttctcttctaccttccttttctttcaagactggaaagtaaacatgatggctggagctacagaagcaattttacaataaagaagtaactttaaggagcctgaaacagtgattccattgcgatgtcatcataccagccctagactacttacctacctatttcacaatcgttctcttata

SEQ ID NO: 183445 - DNA, 509 bp, Homo sapiens
aaggcggaccgatgtgaataggtggcagctaaagatatgaatatataggagagtacttacaatagaaagctgctaaagtaatagcttttggaagttatgatgtaggaaggctatgcaaagcagaagagtggcagattctactaatttcttcccttttcccttagtaagagcccctattttgtgcggggaagtaatgtatccagctaaaaggctaaatttctttgccttccttgcacacagggtagccaacaagatgtaagcagaagtcttatggtgtggcttctgggaaacctctccaaaggtaacagactaagatgggaggcaggtgctttttctcttctaccttccttttctttcaagactggaaagtaaacatgatggctggagctacagaagcaattttacaataaagaagtaactttaaggagcctgaaacagtgattccattgcgatgtcatcataccagccctagactacttacctacctatttcacaatcgttctcttata

SEQ ID NO: 183446 - DNA, 447 bp, Homo sapiens
gcaattatttaatatggtaggtaaacataaactgccattgaaatttagtagaaagcatattatatgcagtgacgataataccttcatgaaattctttacttatcattttttcttttcaaatttgttttacattaaagtaggatgaatgtcttatcctttttactacattgcccaccataatggttctcaaatgcaacaacattttcatttttgatagaactgagtttcatcatttactttgtgttacacttttccctagaccaaggacctatgaagtgagttatccatacccttaccacataggcagaaacagcttcttttacagaaatcaatttcctgattctcaaactcgatttgatctccttcctaaaactgatctgccagagaaaacttcgaagctacaagcttccagctagttatccttttccacttctcttttcacaatct

SEQ ID NO: 183447 - DNA, 177 bp, Homo sapiens
  misc_feature (153)..(153): n is a, c, g, or t
cattgtaaactatacctggatgcagaaattatattaaaaaataaaactgactaggataaattaatgagccctcagtcagaggtccatttccctgtggactactcagtgccagaagaggctaaacccttaactttggccagcccctgggcacanacgaggtgatcgttctgcatggat

SEQ ID NO: 183448 - DNA, 484 bp, Homo sapiens
gctccttgtccaccagggatcaggcccagggccttctctcttggaggcaaataaacataaatgatgttcatttgagcagctcctctgtgcagagctgagatcaagtaattgtaaatattttgaggttaattcacaaacaacctcacagccaaatagcacttatcctacttattgaaaggaaattgaggcacagggagacagtcactaacaagggtcacacaggccataggtgtcagattgaagtcacatgaggtctgtctgtagccacagccccctcctctcctcaactgggggtgggtggggctgtttgttgttaggcatctgcatctgagaccagtcatgggcttgcgttcttttgtcttgggcatccacagctcagaagcggagattctggtctggagagtgataagtaaatggagaaataatcagttttactctagaactagatcacctcaacagtcagggtcagtgccgggattgtcca

SEQ ID NO: 183449 - DNA, 480 bp, Homo sapiens
gtgagcgctttctaaatttactactcacacacattgcttctcctaacttggcatcatttctccctttatgtaattgacacacctaagagttcctctctgaccggttctgcctctccctgagatccacagccccctcacatgacctcaaatcctgtgtttcccgatgtgtcagtgtcactcccacggaaggataaaggaaaggacttcgctttctctccccactcacaccctgtgccaacagaggcccaaagtgagacacacgcttgctcagtagctctctcatgaaggggggaatgagtgaaggaatgatccataacctctatagagactggatcctggatgcagaatcctgggaggttctgaccacacctgttccgtgtccatcaggggctgagatccatgtaccattcctctgaccccctgtcccgaaagccaccctatctcatgtgactctggggttccttggccatgggagggttt

SEQ ID NO: 183450 - DNA, 574 bp, Homo sapiens
aaagctgtctcttgtggggaaaatctacattctgtagcgaatcccatcccctttccacatcttttcctgttccaagagagatttaactaagagtctggcacctttactgtctaatctctctgaagcctgttacctggaggcttcatctgcataataaaaaccttggtctacacaaccccttatctcaacccagacattactttctatggattccacatctttagataataacttaactctttcaaccaattgctaatcagaaaacctttgaatgcacctgtattcaaaatctattccaaaatccctttctttgaatgcacttgcattcagagattttggaaatccctgcttcaaattgttctggctttctagaccaaaccaatgtacaccttaaatacgatattgactgatgtctgcctctaacttctgtccctctaaaatgtataaaaccaagctgcaccccaaccaccttgggcacatgttcacaggacgtcctggggctgtatcataggccttggtcattgatatttggctcagaagaaacctccttaaatattttacagagtttgactct

SEQ ID NO: 183451 - DNA, 351 bp, Homo sapiens
aggagagagaaagggatgtggtccgcctcgtgtcataggaaggccagaccttctgagtgtccaagagaagccaaaaatgtggaattttacatggaagttcaccattctcaaatgctgggccaacactctacaggacaaatgagacgcgtctgcagatgacatgaggcctggggcctaggcggtgaccatttgagcggagaggccttgcggagctggaagaggatgtggtccgcctcgtgtcataggaaggccagcctgggccagtggggagggcatgtgggttctcctaagactggagaaatgagcagcaggaaagggctgcagcgggaggggtctcgtcctcactccacc

SEQ ID NO: 183452 - DNA, 332 bp, Homo sapiens
ccagcaccaggcagaaaccttctctagaggaacacgctatgaacctcaaaaaaacatccaagaaggacggacataaagtcacaatcaagaaccatgggtagcgggagtaagtcccggaaagacctcagttgtaggaaaatcaggcactgacccaaaacacatacgaaggacactcgacaaaacaagagaggtcatccagggtcaggctggagctagaggcctccagatcctgtcacttagtgactgtacaaacctggtggcttcctcaacctccctgtgccttagcttcccatttgccaaaaagggggattagaagagcccacactctccct

SEQ ID NO: 183453 - DNA, 126 bp, Homo sapiens
cagtggccgctgtcacagccacatgctctcatcctcactgactgaatgacgagaaatgaaagctgaagtggtctacacagcagagagctgtggggtggggtcagccctggccacctcttactttgc

SEQ ID NO: 183454 - DNA, 436 bp, Homo sapiens
actaataagatggttcactaaatgaggagggaaagaactgcataatgggactggagatcggcgaggcttctctgaatgaaccttgttttacagttttgactttagaaccaaaaaaaaggttttaaaaacaataaaaagaaaaggcaacacctaaaaattgaaaacatactgaaataagtaaacctagttatcatgtggatggcataaccacacaggaaaaaaatatcattgcaagcgattttaataagagtagtctgttcacccctaatggaatatggtctaaggataaaaagcatcgccaaggaatgttaggctatactcagtgatcttaatgttagtagtaatacctgaattgttattttgaaatgattgcatgtatatggtaggataaagaaaataattgttaacgccaccaagattttcagtgtaaagaatt

SEQ ID NO: 183455 - DNA, 583 bp, Homo sapiens
ttttatcaagtgattattagccatttacatatcctctttggtgaaatgtctattcaaatgtttacttcattttaaaattagattattagtcttcttattactaagttatgagttctttgtatattttggatataagccctttatcacatacatcagttataaatattttctttcagtctacatcttttcaatttattatggatgtcttttaaacccaaaagttttaattttgataaaatccaatttgtcagctatttttgtgaactgtgcttttgatgtcatatttaagaactctgcctagcccaaggtcataaagattttctcctgtgttttcttttttaatatgaaactctatttttcttttttttttttgagacagagtctcgctctgtcgcgcccaggctggagtgcagtggcacgatctcagctctctgcaagctctgcctcccagggtcacaccattctcctgcctcagcctcctgagtagctgggactacaggcgcccgccaccacacctggctaattttttgtatttttagtagagacggggtttcaccatgttagccaggatggtcttgatctc

SEQ ID NO: 183456 - DNA, 397 bp, Homo sapiens
tgcagtgactacaggcttaggtcacaacactcaatctgctttgatttcctggaaagccccctggagagtgacaggaatgaacaaacccaaactgtgaagactagctcttcgatgcctagacatcaatgaatatccacaattatcaagaacatctaggaaaacaggacctcaccaaacagactaatcctggagcaataaagatacgtgaccttttagatgggaaattcaaaatagcggtcttgagaaagctcaatttaattcaagataaaagagataaaaaattcagaattatatcagagaaacttaacaaagagactaaaatgatgaacaagcagaaattctgaagctcgaaaattcaacaagctgaaaatgcatcagtctcaacagcagaagaata

SEQ ID NO: 183457 - DNA, 457 bp, Homo sapiens
gaaaaaaagaagagagagagagagaaagaaacgaaaagaaaggagaaaagaaaaagagagagaaagacagacagacatgttgcaacttcctttgtcacaggacatgctcaggaacaaacagacccgacccattgcttcactttcccatctgcactaacggtcagctccatcccaagccctgacctctgttctctcagctcctgagctgaaggacacaaacacggcctccctgtctccctgcatgcagtctgcccactccttcacctagaaggctaaactcaagaaggatgagattcttcagaccaaaagagaagccatatgagggcccaaaggaggataaaaagggctctgccacagctttagcccagccatttctttttcttgcctccttcgtgacttctcctggctctatgtgatgcgttggttcacaccaatctcaagcattgcctattaccag

SEQ ID NO: 183458 - DNA, 436 bp, Homo sapiens
cctattgatcagtgtcctgcagatttagaaaactatatgtctatgttagcgatgctctgagcttcagttttcattttggaacatgtcttgcatcataatggggtggccctcagttattctgggggtcttggtttgagctgtccgaccttctgtattttgagacaattggctcttcttagatacccttcttttttgagaggccaaggtgggcagatcatatgaggtcagcagttcaagaccagcctggacaacatggcgaaaccccgtgtctacaaaaaatacagaaattagctgggtgtggtggcgtgagcctgtaatcccagctacttgggaggctgagttaggagaatcgcttgagccctggaggttgaggttgcagtgagccaagattgagtcattgcactctagcctgggtgacagaacgagactccatctc

SEQ ID NO: 183459 - DNA, 195 bp, Homo sapiens
gggcaactccagcagatgaacagcttttgcaagacacctgtgtggagcatgtggcaccacctgagcgtcctccccaggtgcggctctaacacaggtgcaggttatgttgggagatagagagccagaactcaggagtgccttgggtgccttgctgtaagatttgggctttccctttatttctttttttttgagacg

SEQ ID NO: 183460 - DNA, 135 bp, Homo sapiens
aagtattgggaagctgtcgggctcacagtggtcaatacacgttttctaaatttgagttttctcttgaaagtttgatttttatcattggtaacatactgttggttcttttgtttgattttgtctgagatagcatct

SEQ ID NO: 183461 - DNA, 335 bp, Homo sapiens
tgggcagttgggccactcctgaaaggtgttctttcttcctttccttttctttctttcttttcttgaggcagagtctctctatgtcagtctggagtgcagtggcatgatctcggctcactgcaatctctgccttccaggttcaagcaattttccttgcctcagcctcccaagtagctgggaatacaggcgtgcgccaccatgcctggttaatttttttatttttagtagagatggggtttccccatgttggccaggctggtctcgaactcctggactcaagtgatccacccactttggcctcccaaagtgctgggattacaggggtgtgagccact

SEQ ID NO: 183462 - DNA, 590 bp, Homo sapiens
tatcattggattccactggactatgtttggggctgacttgtgaccaattctttatgatgtgggaaaatgctcatgatctagtattgggtaggaaaaaaaaattaaagatattgcttattagaagtctttatgttaagatttctaggctaatactaaaaaacttggtataatataacttccaaactagcagaggggaagaaaaatgaaaaggaaacacaaatgaaaatgatagaaaatgtgtcagttaaaaaaaaatttatggttgtgatatcgaagaaaataataaagattaccatttcttgagtagctcttgtattaatcactttgaatcattaatctttataatttcatgtaatatatgtcagaatgacaagcccaaagcaggtatttaaaaattatagtttctgccctgcctctagcacttttttccaaagggggacagaagcctgtgatctactgagaggagaaagtttcaaacaaagcaaccctagataatccttctacaagtacattagcaaaggagcaatgttccctgtaggttctagggagtggatatgggcagcattcgctggcagtctggagtaaggttc

SEQ ID NO: 183463 - DNA, 191 bp, Homo sapiens
tcaccgtgtgcctgcatctgtgctttctgtgaattatcgcatgcatgaggctctgcgaggcaggtccagtaagtcccttccaaggatgcagaagctgagtcaggaagtgtggaaatagaacttgaacctggtccttgcacttcatggcacgccctcttgtctgtgtagtgtgtgaagcctgtgtgtgttag

SEQ ID NO: 183464 - DNA, 363 bp, Homo sapiens
ggcaacttcaggaggatactcaaaaagctgcagtggaacaaggaagtagcaactggccacaaatgagaatatcccacaccagacatccagggccactctacccccagaacccactcattgagggcacgaaactattcaagcggatggttactacagagaggggtagggacaagcgaaagagttatctctttgcagactgcactacgtccaacacatccagacaataccagctttgctggctaactatttttcctgtgtacctatcatgtactgggcaccttgaatgactctctacatatctgttcattaaagcctcacaggagcccactgagatgggtacagttattccaacagtatagatcc

SEQ ID NO: 183465 - DNA, 215 bp, Homo sapiens
tggggggatcacttgaggtcaggagtttgagaccagcctgaccaacatgatgaaacctcgtctctactaaaaatacaaaaattagccagatgtggtggtgcacacctgtagtcccagctactggggatccagaggtgaaatgtccagatattaaagtgctctctggccctggatcatctctaatttatggagtgaggaaatggcatgtcccaaac

SEQ ID NO: 183466 - DNA, 374 bp, Homo sapiens
ggtctcactctgtcatccaggatggaatacagtggtgcagtcatagctcactgcagcctcaaattcctgggctcaagtgatcctccctcctcaacttcccgagttgttgggactaaagggacacaccgtcacgcctggctaatttttattttttgtagacataggatcttgctatgttgcccaggctggtctcgaactcctttcctcaagcaatcctcccaccttggcctctcaaagtactgagattacagaggtgagccaccatgctctgctggatgtatcttaattgtaaatttttcctccaaaatgcactttttaatggatatctaaggtctgaagaggaaaatggaagacttgacagaagaaggtgtacc

SEQ ID NO: 183467 - DNA, 450 bp, Homo sapiens
cgacggacgcattcacagtcagttctgggggatatggcctgaaatcctcattaagttaaataactactttcgtatcattcatgtctttcaccttgaaaaggttaatggcccggatcaatttgtttcatttaattcgttgctaccattagtttctgtaatgaagtcatgatcctcagtgatttcaagaatttctagttaagttctttaagattttcttgcatttgaggcataaaatgataaagaagacaggaattaggattcattagttctccagggaatagaggaaccattcttaatgaaaatggattatgcagaccttttttttattgaacttgtcaatatttgattaatgattaaagtgtgaactcaacataaattattgttaacactttttaaaaaccatgtgtatgtttaatttaggtgatgcgtccgtcgaagtggtaccggcta

SEQ ID NO: 183468 - DNA, 589 bp, Homo sapiens
gcacagcatggtgaccatatttaataatgcattgtatatttaaaagttgctaaaagagtagattttaaagattctcaccaccaaaaaatgataaataggtgaagtgatggatatgataattagcttatttaatctttccattaggtatacatatatcaaaatatcatactgtagcctataaatatatataattattgtcagtcaaaaacattttttaacatcatagtagcgtaaacccaaattaaaagtacagtaacagttcacaaatagctcttaaatgaaaagatgctcagtctcacttatgtgacatgcaaattaaaaatacaatgttatcaaaattactaacactgtattgttaaatgtattcactcatattcttggtaatttaaaatgcatacccttgacccagcaaccttcctaaagtataggatagcaatggcttgatatcctgagtacaagtgaagtgacaagtgcctgggagatttaagaagcagtcatgtccgggtctacttcagaccaactaaatggattgtaactgcatatatcacacgtctaaacaaacaggccaggcatggtggctcatgtctgt

SEQ ID NO: 183469 - DNA, 537 bp, Homo sapiens
tctcaggctttccagggcccgtggaggccggcaagggcggtcgatttctcccaggagcccctgactcacgcccaccttcagaggcccccgggagtgaagaagacagccttcccacccgtttccagcagggctggctgcatccaggaagacagcgctgctggtgagtggttcggctttgtttcagaccactcaaagaaatcatctagaacaacgtccgcaagactggcggtgcaactgtcccccttggaacctctcgggaacacagcctctgtctcctcaccgcagagcagctgcgtcagactcccagacggcggggcctagggatctgtgttttggttttgggatctgtgcaaatccacatgactcaataatccaaacatacagagagcctggaaacccttaccccgctctggcgccctatgtgtccgctttcattggcttcttgtatttccggcttgttttctttagggaggcagcaaatacaagatacggtccacttttatctttccccgcagaaaataaagataccacagccca

SEQ ID NO: 183470 - DNA, 245 bp, Homo sapiens
agagcattcatattttatagagatctatgtatatccattacataatcattttctagtcaaaaagacaatggtcttgctttaagaggacccagcgaatatttcaaatatatgtgatattttgtgataatatgcaagagcattcattataaaacattttaataatttgaagggaaaatcctaaaggctgtaatgttattatagaactcataatacatatgcataacataaactaaatattggtcaaa

SEQ ID NO: 183471 - DNA, 407 bp, Homo sapiens
ttatatatatgaaacaaacatatttgttttatttttaccaatatatgtctaactatccagattgatttgaaatttcctttctcttccacttaacaaagttatttaccaaactcttactatgtgccaggcaatgttaggtgctggaaattcatcatagtcactcacattattgaatactactgtataccttgtaatgggccacgtacattatgttcctgatttcattcccttaataaacttaggagggtaaattctccctaatctgggatgtaggaaagttgaatacattgactaaaattatataggccctgcaagtaaagtgctgaattagaatgtcatataatcactgtatttacattttaatattcttgaaggtaacaaccttttctttaaaaatctatcataca

SEQ ID NO: 183472 - DNA, 110 bp, Homo sapiens
actgaataaatacatgtgtagtactatgcctaaataaatatgcaacaagttttcttttagttaatgtggctcagctatagatttgctgcagtttggagccaattaaagat

SEQ ID NO: 183473 - DNA, 289 bp, Homo sapiens
gctgttctcaaacccttgagctcaagctatctgcccacctcaggcctcccaaagtgctgggattacaggcatgagccacagcacccggcctgaattttggattagtgatgctcaaccagtaagtataacacaaatgttccaaaatctgaaactgctggtcccaagcattttggataagggatactcaaccgctatcttaagctgggacaatcctgtgggtgcactcctggagtgccatatacatgtaatcaatccccaaggttgtgggaggatcttttgaggaaagaca

SEQ ID NO: 183474 - DNA, 356 bp, Homo sapiens
gtagctccagctcttataccttcctacgtctgattgtcagacaatgcgaacctaattaagttcttggagcatccaggataaaagctgctgtagctcgcagacatcactgaagtatgacacttttgttttttctttctatcccacttactctccctctatcagctgactccaagctcccagcttgtccttccctccatatttaatttattcagccacttttattaacctctgttgtctccaggggctgcagtcctcatccctctctgccctccttgagcccatttaacaaaataggcatcgtattgaaataaatgagccttgcagccagtcaacctcctcaggattaagggtcttaa

SEQ ID NO: 183475 - DNA, 608 bp, Homo sapiens
ctgaggcttcgcaaagcaggagccctccgtagcagggcttcggtgtcggggctccgaggctccggcctgacttctccacggggtacacaggaacgtctccggacgccaggacctgaaatgggccgactaggatgacgaaaccacaggcagagtccggggaagcagcgcggcatcccatcttcaggcctgcccggagggtgttcgggatcaagatgaccacactccagccaaggataaaagccccacaggagctcactgtcctgcaggagaggagcaggcccacgtccaagaagatggctgtatgttttcacggctcttctctgagaagtgaagccacaccacgatacagtcttgaagaggaagccaggaatgggagatggcaacaagccctgtcatggtggcctctctgaacaagttacccttttggcacccctccccttatgcccgtggcggtggcacagtgctgtatcctgcctgggctctggcccctgctctgtcctccctcttactctgtctcccttgtttctgaggggcctagatgcttctaggtctggctgaatgtcttcaaaaaagatcacttcccagtccatcagggagacagttggtgg

SEQ ID NO: 183476 - DNA, 456 bp, Homo sapiens
tccctttagttaaaaaagaaaacaacaaacccaaaaacctgaagataaattttataacatggcgtgaactggaatccctaataaaaataggcaatatcctctcctactgtttagtgtgcaaatcctctgacgtactttgaccagtttttagctccatgctgtgttttccatacattcaataaaattcatgggccacctattttctcattgtcaatttctgcatgtgctcggagaagatttctaatttttccataagtaaaatacaggtaaatgcaaatctaggatttttttccccccatgtgttttccatacattcaataaaattcatgggccacctattttctcattgtcaatttctgcatgtgctcggagaagatttctaatttttccataagtaaaatacaggtaaatgcaaatctaggatttttttccccccataatgtctaaatgcaatca

SEQ ID NO: 183477 - DNA, 418 bp, Homo sapiens
ggaggaacacaagagctctttgtcaaaaacagtcccagacttttttatggcatgttcccattgttgtccttcatcttttgaagggtgacagtcgactcagtcatttttctgggcacataagtgtaatgctctcagtgggtcaaactgaatgcccagctgactctaggaaagttacatcctgttgagactgcagaaagctcagggctttcttctccaacagaaaaagtcaaatctccctaaaagcagactttcggaattgggcacaagccaagagactacatgttagaacatttaaaaaggatgcatactgaagcaaacccaatatgcatttagcaatccagcctcctgcccacaaaggttaagagcatggcagagtaatctatatttaccagagattagacaagttggctttacttga

SEQ ID NO: 183478 - DNA, 545 bp, Homo sapiens
cattgtttgaagccgtgggtcaaagttccaggtctatgtccgagggtgaagtacatcaaactggggtgaaccaaaagcaggatgagggtcatagggatgactgacggccttcaccaagccttggcaactggtgagaaatggtcccagggaccaagcctggagaaacagtacagaaggggtgtgtgtgtgtgtgtgtgtgtgtatgtgtatatgtgtgtgtgtatatatatgtaaaaaccagccttagctcactggctgtacaaaaacaggtggtgggaagagtttggcccgcgggcctgtagttcgctaacccagcattcaagggcagttttgcccaagagaagtaccatgcacgctatgtctatcactttacgttttctagtgatcacatcgagaggtaaaaggaaacacgtaaaattaatgttaatgatagttttatttaatccagtatatccaaaatccaaaatgttaaacgtgtagatgacaagaattactactaagtttttttttgttcttttttttttttttttttttttacacaaaat

SEQ ID NO: 183479 - DNA, 475 bp, Homo sapiens
gccagcccattggtgggcgtgcggtgcggggaggcttaggcgggaagaggaggtcttgctcagatgagtgttattcctttgtttggacagaggaggttgggcaaattggagtgtaggatatttttgcctggagatttttacttgatgaaatcatcccatgaaaaaaatccccaatttttaaaagcatgctactttgacacattaaactcatcattttaacattgatagaaagtatttaaaatgggcctttgcctgaaaataaacgtcagtggattggaagcactgagggccttcgtccgttctgtcccaacctttatgggcgctgcacattttcactgtggaatctacagggacgaactctgtcttgtgtttactttctacttgtttctcttgaacacacacatgcattaacactgtaatgtatttattactttgtatgtcattaataagaatatatttagataatattgaaaca

SEQ ID NO: 183480 - DNA, 481 bp, Homo sapiens
tactcaggcgagtagtgtctaaactccctgactttggaagagggcaatcactactgatgggtttttttttctcatcttccctcccttctcccctgcccttcccctccgcctccaagggtagagagaaaggaaagggcactggggtgggaaagcaagacggactgagtgacattacaactagctttcctcctgacacttagaaggttgggaatcattctccatagagtctgaataatccaaactagtcaggcaggctgggattaaggacatccaaatggattaccccatcgtcataaacaaggtaaaccatgaaagcattctgtaaactgctaagcccttacagaaatgtgagtttttattgttgttattgtcattattaatgttttaacttgatccaaactgctcaagaatcttgggttgtttttggacaatgagtaagtactcaataattgttaactattttaattaaaacaaatatggc

SEQ ID NO: 183481 - DNA, 236 bp, Homo sapiens
cattgaactgctaacaatctctcccacccttcagggctgtccatcatccagccatcccacctctccagtctcatcccttgaccttccccctgccagcctcactcatcttcattcgattcctcaaggatggcatgactctctcatctctaggtctttgctcatgttggttagtccacctggagccctctctccctcactgttctagccattcacccagccagccagccatccactca

SEQ ID NO: 183482 - DNA, 114 bp, Homo sapiens
cagtcagcctctacagaccaagctcatgactctcaatggcctatttaggcccataccctacgtcacggcagcctccgcagatgaggctactcctcacaacagcctccacaggca

SEQ ID NO: 183483 - DNA, 462 bp, Homo sapiens
acaaactacatacccattaagatgactaaaatatacatgactgcaaacaactgattgttggtgagaatgtatagcaacacaacctcccatgtattgatggtgggcaggtaaaacagtacaaaaagctctagctgtttcttataaagttgcacctatcctattacccagtgattccaatcctaggtatttactcaagagaaataaaaacatatgcccacaaaaggcctcatacaataatgttctgctttattcctaatagtacgtatgtggacaagtgaaagaaaccatgtatattcataaaacagatcacttactacacagcaataaagagaaatgaaattctggtatgtacaacaacctagatgaatctcaaaaacattatcgtgagtaaaggatgtcaaggacatttatggtcacctaaatgtaaagttctaaagcaggtgacagtaatttatgtttatt

SEQ ID NO: 183484 - DNA, 732 bp, Homo sapiens
  misc_feature (566)..(566): n is a, c, g, or t
gaaattttcattactttcatttatttgctttcagtaacaatgctacaataattgtgagtgtccaaattactctttatatgaccatatgtgtgagagttcatatttttgccggattttattgatttaggtgttcaccttcatactcataccaaattgctttaattctttagctttgtatgttttttgaaatcaagaactgtagtgtttctgacattgttactctttttgaagattgttgagtgcttcattgtttcttgaaattccatataatttgggggttgctgtttctttttctggaagaatttaattagaaatttgacagggattgcatttaatctggagattgcattaaggaatttagacatcttctttttaggcaaaattgttttatactgctttcaagtcttctattcctttatgaatattctgtcttgtttcattattcattatagaaattggggtattgaaatatcctactacaattacattgctccctatatcttgctttaattctgtcagtatttgctttgtactccagcctgggcaacagagcaagactgtctcanaaaaaaacaatagttgggtgtggtggcacatgcttttagtaccagtcctcaagaggctgaggtgggaaggatggcttgagcctagaattttgaaagctgtgtgagctatgaatgtgcatgtatccagctggaaaaagagaagaccccatctcaaatatatatgtgg

SEQ ID NO: 183485 - DNA, 664 bp, Homo sapiens
gaaattttcattactttcatttatttgctttcagtaacaatgctacaataattgtgagtgtccaaattactctttatatgaccatatgtgtgagagttcatatttttgccggattttattgatttaggtgttcaccttcatactcataccaaattgctttaattctttagctttgtatgttttttgaaatcaagaactgtagtgtttctgacattgttactctttttgaagattgttgagtgcttcattgtttcttgaaattccatataatttgggggttgctgtttctttttctggaagaatttaattagaaatttgacagggattgcatttaatctggagattgcattaaggaatttagacatcttctttttaggcaaaattgttttatactgctttcaagtcttctattcctttatgaatattctgtcttgtttcattattcattatagaaattggggtattgaaatatcctactacaattacattgctccctatatcttgctttaattctgtcagtatttgctttgtatattttgaaccctagtgtaagatacacacacacacacacactcacacacacacattaatatatgtatacccacatttatcatgggttctaagtaaatgaacttgtttattattgtttaatgtcttcctttgc

SEQ ID NO: 183486 - DNA, 573 bp, Homo sapiens
tgggaggctgagcatgaaccttatttagggagcgggcttcaggagtgcatgtactcctggtcctcaactgcagcttgggttggaatgctcccctctagcaggccagggcacagtggagagagcaggccactgggaagagcttctgggaacaggactctcagaacattacatgggatgtcggtcatggctgggtctctcctcctctatgcaaagcgtggaccagtcctggctgtgggtcagctatccagctggcctgtggtctgtctacgccttctctgcttagcactctcttctagctcagtgggaagattcagctgagttttcagtccatctactttgtctcaaaggctcacctggattagagcagggatttttgtttcgtattattcaactttgttagggtcacagaccctttaagaatctgataaaagctatggaatctcttgccagaaagtacacaatgcacagtttttaaactgcaatttcaagtggctcagagaccctgtgagctatccatgagtcctctaagggtcccagaattccaggttgagagccccacattagagagacttt

SEQ ID NO: 183487 - DNA, 360 bp, Homo sapiens
tctcattaccccaaggtcatgttgcatgctattggaacatcttccctttagctccctcttcttttaacattccataggttgaccagtgaagtcatcgtttatttcaatgttccttcctattcccacaatccaggacaataattagtcaatggcacgtctgcacggtcatgttcatgacttcatgaaagatgttaagatggtttgaaaaaagttgattacaagtcctgtctcttggaccaatttcagattattgaaaaacatttggaagggaagtttgaattggccacagcttttatttctaacctcttgaattagctgatgtcaaatccagctccattgtcaagacaggaaatggtgtgg

SEQ ID NO: 183488 - DNA, 506 bp, Homo sapiens
gcccctcctagtctgccctcctctgcttctccttcacagacaacagtacctattgggaaagtcctagaaacctgaatcctgtcaccactctccactcattggtttcctgtagctctgggcttcagaggaattgtctctgtcccaccattttctcatttgctaagaagatgacagtgatctgttctgttgacctcataggtttgctgaagggataaaatgatgttgtggatgcaacagaactcctacaatgtaaaataatcgttcacatttgaggggttcttatccactttgcttatttcagccacaggggctaggaactcaaccagggtactcaggctaggccccagctccagtcgcaggttcacaagttgcgcaccctccaactcacctggtccctctgactgcacgcctcttcatgtgcccacacatggttctgctccagccaggtggggctggcccctccccacgtaagcacccacacctgcaggcagtcctccttctggtct

SEQ ID NO: 183489 - DNA, 140 bp, Homo sapiens
aacactgtctgtgtttgccttctgctgctactataacaaatcatcaaaatgtagtggctgaaacctacacagacttattctcttacagtgctggagtgcagaagtctgaagtgggtttcatggcctaaaatcaaggtgct

SEQ ID NO: 183490 - DNA, 654 bp, Homo sapiens
acacttgtcccccagttttctcttctccagatgcccctggctgagtctggcagatgtgcctcctttttgagccaacagatcctgaccgagggtcagggcagcttttagacaaaggacagctggtttctcccacccactgcttctctccagactcgcagatcagcccctgccccaggcagcaatactgccctgattaccaccactgaggcggctcccaggccactgagggaggccctaaaccctggctagacaggacaaaaccaagggtctggccaggcccctcacccctctggcctcagttcctcatctgtcaagttgggcaatgcttcattggctgcctcactaggctgctgtggggtctgcactctggaggggtgggggacactcacactgctcatgagagctgctggcgtcactcagctgtggacaggaatgggagatacccccatgtaccaccccagtcctggtgtggagtaagggccagagggacaggggcagaaaaggggggctcaagactgagagagacaggggcaccaagaagtagaaagggtaggtgctcagagggccctggggatctgggggacttgtgtttccttgggtgtagggcggagggctgagtcaatcgcatgcctcagtttctagccatgcacggcc

SEQ ID NO: 183491 - DNA, 247 bp, Homo sapiens
gagggagggagggaaggcaggcaggcaggcaggcaggcaggcaggcaggcaggaaggaagacatcctttaataccagaacaaagagccataatatcaagaagaacacaacccagaagattttattacattaatagcccagctaagagatttaggagtccatgcccacttacagcgtcatgtcattaaggctgatgaacacagggtagacagacgccttgctattttctatcctatgccctgctacaa

SEQ ID NO: 183492 - DNA, 256 bp, Homo sapiens
ccacacattgcatttcattaggtgtcttaagtcacttttgttttaaacagtttcgcctcctttttcctttaccctagcattgctttatcagaggatatgaatcagcaatgctttaattcctttttcaaaaataaatgtggtaaagtgtcaagatttgatgaagctgactggtgagacatgactggccattatatcatccattatgcttctttatattttcccccaattttttatcttgaaaattttcaatttttac

SEQ ID NO: 183493 - DNA, 538 bp, Homo sapiens
tgcaccattcagactctttgttcatagtgcatgcttaacccttatttaaaattgtttagcttatgtgatggaattttcatgaagattagattatggaaggagccatagtcccagagtctttattcttgtctaagttctgactttgagaaaaattggagggagctgccagggtggcagcagtcagattttaagctccttatgctcggcctaacatactcgtttttgccttttttgggagagtaaggttggggatggagaggctttggcagcaaccgtttcagactttcagtctctggcagcttagaggaaagtcagcttagaaagaaagggtccacgtgaagtttgtcttagactcttgggcatctgaaactgagccatgcagagctctgcaaggccagtaggggatacgtatggttcacgctaatggatacaaagactttgtgattttctgtttccagctgagcaatgtaaataaacatcagggttgtaatggaatgttggggtaatcagcatacttttcattgagtacagaggtatg

SEQ ID NO: 183494 - DNA, 129 bp, Homo sapiens
tcaatggcttctgggtttccaggccccagagtcaaagtttgcctcatagagcataattatcctggtagcttgtcctcctgacactggtggttgaagagaagacatgattctgagtgggatgacagcaca

SEQ ID NO: 183495 - DNA, 522 bp, Homo sapiens
ggccttcatctcctccacttccccacaggccagcttagcttccatgatgtctggattggatctctctctcactactacaggctctgatgctcttatgggggcaccccctggaagtggagctagttcagccaccctaagaatcagcttccaccagtctttgctcccaggctgaaggagggtcaggagagtctcacctagagagggaacactagggaggcttcaggagggacacaatgggagccaggtgtcaggatgtctagatcctcgtgacaaagagtttgcacggcaggtgtcatcccctggcatggatgggagagagtgctcattcctgggcttcagttcctctctgtctagttgtttcctagttcctcaaactgagactcggagggaaagtaagatcattctcccctgttggacaagaggagaccacggccaagagaagggcagggcctgccttcggatgccaccatgggagcaaagccactgacagtctctagcttcacttcttcatggttcctaggc

SEQ ID NO: 183496 - DNA, 342 bp, Homo sapiens
aaaatataggcaagggtttgttttggtttttgtttgttaatgatgaaaacatttaaggacgttgagttaactggagataaagcagcagcacgaggagtaatggggagaagggcctgatgagaaggtcagagaagccttttataagtgtctggcttgcactgaatgcccagaaatggaagcgcaaggaaagtgttgtgtgaggaccagggtaattatgcagtgtcaccactactcacagggattatggcctgagaaactaaaatgatacttcttaggtgaccagaggatgggagaacttcttaactggtttggaggtccacataaagaataattggggtctag

SEQ ID NO: 183497 - DNA, 238 bp, Homo sapiens
ccttctaccccatccatcctcccacttgggtgggaaactcacactgagcaaagtcttcagaccacctgaactgcaaagggaaaggtgctgccaggttccaaaagggctggattctaggacagtatcctctgcagctggaccagacagtgaagcagggttaggatgagggggcagggacaaggcttttggggtagcatccaagatgtagtagcaggtatcctgacaggtgggtagaatg

SEQ ID NO: 183498 - DNA, 623 bp, Homo sapiens
agctaccatcgaggacataagacaactgatttaaacagaataatggttgatctcaacactccagactctcagataatagaatgtgagcataaaatcctctcttgaagaaagagctaagacagaggtgtaatcaaatgtaaaaatacccattaagccaacttaacttttctgaatggccgtgagattgtttcaatggttttgaaatgaaaaggcacagaccaatctttccctttaacatgtgaggaacacctgccctccctaggtcagccgaatgcttctgaaggaaaaaaaaaaaaccgtctctagggaaggagagtgtggcttgctcaacagccccagaatgtggacctgctgctagagggcagggaggtggaaggactgcactgatgcactccaaaactcaaaatcatttcaaaattatctcctgttaccaagtgaaaagtgaagaaatgaaggcagtttcttgggcactagaataaaggtaccatttcctaatcattatttctacagggctctatgtagaaccccttttgaagataattaatggtataaaaataattgttgaaattctccagtggtaaaatgttgttgtttgttgatgaaatagtccaaacaaacttcct

SEQ ID NO: 183499 - DNA, 353 bp, Homo sapiens
ccactcttgctttcacacacaaagtgtggtaggtctgtgaattcaatcaccttatcacactgtatttctgctccaattctgctctatgaattgtcaactgtgctttggggcccagacatttttttctattttactatgagctgtttattgatatttttaggagagataaaagagtgtcaaaacctgaagctgctcatcttgatcaaaattctgctaaattttttaattaaaaagtaaaattcttgccttgttcaggagagaatatacttattcaattcagataatgatagaaagtatgttcaaaaatatataggcaatggccaggcatggtgtctcatgcctgtaatcccagc

SEQ ID NO: 183500 - DNA, 550 bp, Homo sapiens
ggtcttttgtgaatggcttttttcactcagtatgttttcaaagtttacacatgttgtagcatgtatcagtaattcatgtctttttatgacaggtaatattcccattatatgggtataccacattttatttatccattcatcagttgatggacatttgggttgtttctactcatatagtattatgaatagcctattcatatagtactgctctgaacattcatgtacaagtttttgtgtggatgactattgatactttgggcccaataattgcttgtgtggggctgtcccgtgctttgtaggatgtttaggatgtttagcagcatccgtagcctcaacccaatagatggcagtagcatttcccgagttgtgacaatccaaattgtctcaagacaccaccaaatgtcccaagtatacaaaattgttcctagttgagaatcaatgttaaagagttatgatttgttttctttcttctcctttttttttcttttttagagacagagtctcactctatccctcaggctagaggtagagtgcaatggcgtaatctcag

SEQ ID NO: 183501 - DNA, 650 bp, Homo sapiens
agatcaggagaagaggcaaagacagcaaagttttaaaagctagaaagcagatgaacaagtggtaactgacttagcagaaccaaagaactgacttggcagaagcaaaacttaagccagtaaggaaagctgagaagcaaaccaatgtatttatatgtatatcagaatccctataaggctcagaaagtagaagtaccatgtacctctggaacctgagatgaagacaaggctaaaaactggaagagaggttcaaagtctgtttaagaagcagttacactcccagaagactcctccctcttattgcaaagcctgaagagaggaaaacaaagttctctgggctgggagataccaggtgtggttagagggttccataatgaaaaacatgtagatgaattaaaggcttacatgtttggccctcagaacactgacatcaagccaaacatgtaccctcaggcagaaaagtagaagagttggtgctgcaaactgactacatctaaggtagaacaaaagactcaaaaggattctattaggcattctctaagtatatagcgcagccagatcaccatgtgataaatagcatagtcaattggccctgcccttgctcagagagcttgcattaagttttattgtacctcactcttgaatagaagcag

SEQ ID NO: 183502 - DNA, 195 bp, Homo sapiens
cgcttcatcatccactcccctccggcttccccaggggctccaggcacttccttctggtcactgacccaggacctttggcagggctgttcctaacacctgtatttagctgtctgccatcattagccctgcctgctcctccctccgcttcatcatccactcccctccggcttccccaggggagcggtggcgcaatca

SEQ ID NO: 183503 - DNA, 197 bp, Homo sapiens
cttttcccaccatcccaccattagagatactaagattgatccctggattagggagaccacttatacttccattgcgtatttacgcttttccctcatcactagaacatcatctcttttgcaccgtcaaaatatctagttttccattaagcattcacgtgatatttttaacccaattgataatctttcctaaatcagta

SEQ ID NO: 183504 - DNA, 371 bp, Homo sapiens
cctattccaaattctgcagtaggttgttttttctgtgttttatttggagggtaagggaaaggcttcatttttttcaagtcattccaaagcattccatttacttttcatagaaaaataatttttttcacactcatgtttgttggtttacataataattgaatttcctaattatagttacaagtagcataaacagattcagaactgacttttgttaagcatgcaactccactggtaggatcaaacatgagctggcttgctagaggaaaagcataactgacaagctgggacatcaggtgattttacagagggaatggaaggcatgggtgaatctgaagaggggaggttggtaaagagttctgctataaagaggg

SEQ ID NO: 183505 - DNA, 242 bp, Homo sapiens
agattttaaggggaaaaatgaccttagtgaaggatatatttcatttacaaatcatgaaccatatacacattttatacataattacatttttggcagatgtggataaaattctgttcgatctgatttaacaaataattattggccattatggcaagcggtatccccagatttggtggaacaattaagctgaatatttacagtgaaatacacagatgtatgcatttgtcctttaaaattgtaat

SEQ ID NO: 183506 - DNA, 330 bp, Homo sapiens
acagcacttagacaatttgaaattaccttacttaagtggcacatagcgcacttaagaggcacttcttatagtctcttcccaatatgtaagctccatgagacatcactgtagctaaaacagtgcctggttacctaataggcgctccatattttttttttttttttttttttggaaaggggtcaaaaggcacccacaaacgggccttttttccccgtggcattcagcatccccccaacttctgcaccctcccagattttggtggacaacaggaaattgcgcccaacaacacccacacgtgtgatttggcccataaactcacatgtgtcccct

SEQ ID NO: 183507 - DNA, 235 bp, Homo sapiens
caaaagtgcactcttctatatctaccactgtgaacttacatatccaaatagtaactcccctgagtatagaatatgaccagttctgtgtttatacacccctttcagaatttcttaagcatcaatagaaagtgatctcaattctgcacaccaaactgcacctgctgcactaaatgagggaatctcctggacatttagcctgtataaatgatacgtagatatagaagagtgcattgta

SEQ ID NO: 183508 - DNA, 682 bp, Homo sapiens
tttgaaggcagggagatgtggaagagggatcactaagcaaaggaagagaggaagggctacttccagagggcctgtataggggccttagaaggtctggaaattagaaccaggaggttgggtgttgggggaggtgagagtacagagtgacaataagacacatgcaggccatgcagctcttggaatgtcttcatgtcatggaagtgagcatgtccagtggaaggttacagagatgattctgaagcttgggagagacctaaggtctggagtttgagaccagcctggttaacatggtgaaaccctgtctctactaaaaacacaaaaaactagccaagcatggtggtggatgcctgtagtcccagctacttgggaggttgaggcatgagaatcgcttgaacccaggaagcggagattgcagagagctgagatcatgccactacactccagcctgggtgacagaggaagactctgtctcaaaaacaacaacaacacacacaattggagcctggattataggactatctatgaattagaacttttagaaatttgatttgttgctgctgtgttgagttgaaaagaggtataagactggaagtgtgcacattgttgtcataatgtaggtgtgaggagataatggcttaaactgagccttcaaacataatgctaacttcagttctcttacata

SEQ ID NO: 183509 - DNA, 473 bp, Homo sapiens
gcgtggtggctcacacctgcaatcccagcattttaggaggctgaggcgggcagatcacgacgtcgggagatcgagaccatggtgaaaccctgtctctactaaaaacacaaaaaactagccaagcatggtggtggatgcctgtagtcccagctacttgggaggttgaggcatgagaatcgcttgaacccaggaagcggagattgcagagagctgagatcatgccactacactccagcctgggtgacagaggaagactctgtctcaaaaacaacaacaacacacacaattggagcctggattataggactatctatgaattagaacttttagaaatttgatttgttgctgctgtgttgagttgaaaagaggtataagactggaagtgtgcacattgttgtcataatgtaggtgtgaggagataatggcttaaactgagccttcaaacataatgctaacttcagttctcttacata

SEQ ID NO: 183510 - DNA, 412 bp, Homo sapiens
cagaggaatgtcaagtattgtcctcagctcagcaggaccagatcagtgatgagcttgactttacctgtgaagtgcttcctatacacacctcttcttcctcataaagggtgcactcccttgtctccacatagtcattaattcttcccttcaattttcctcctgtaagttttggtcagaatttaagatgtttccaaaatattgaaaaatcaaatagcataatatgttaaggtttttaaacactttttctacatctttcttctggtactttgcaattaaaaaaaaagttcaagtcctattaactgggcaactgctagggtaaacaaagtctaaaagcggtctcgttgaatatctcatttagtcctcataacggtgctgtaaaggaggaatcgttatcctcattctataattcagg

SEQ ID NO: 183511 - DNA, 303 bp, Homo sapiens
agaggaaaaccattgaaaacttctcaatataccttatgttgggattacttctctagaaaagcaacacgtaaagagagcccagtgacaaagagggtgagagggagacagagagagaagagaacctagtggagagagtggaaatggggagaagagagagtgagaaaggagaaggaaaggaagagagagagagagagagagagagaaggaaagagagagctcagccagagaacatcctaccattctccccaaacactggaccaatatttttatctattgcttgattcatgtaaggggcaatttcac

SEQ ID NO: 183512 - DNA, 433 bp, Homo sapiens
gaactattattatccctggagttattttttaaaagatatgaactattattatccctggagtacttagctatcccaagccaaactgctaccctaataatcagcatccaattgcctgatacaggcacagtctagagaggaactgtcctcaaggtgacatcaaaacacccaaacgtggccagatgatgtgctgtggctccaccacccacaacccacagattcacatgaatgccacgaggatctcatctatgtcatctgtagccaaaatgttcccaaatctagctggacctgcttttttcttcttcccacagctgtccactgcccactcaccgtgaggaagctcggacccctcctctgagatctctgctgatctggggctctcttagcaggaacctgtgcttggtgctgactccggatagagggatagactgtccag

SEQ ID NO: 183513 - DNA, 713 bp, Homo sapiens
ctgtgaacaagttttcatttctcccaaagggtccacaggttctgatatgtggatttcagctcatgaacttttaacaggacaaacaagtcatacagattcatctgaacaactataacacaggacaagttctagggcttgtaaaatccattattttaattttcgatgcttgtcttgtaaatctaatggaaggatattttacctcagcttatgaataaaaataataattgtagctcccagtattaagtgactaacaatggctggtaatttactaacgtcatctcacttcacccttgcaaaaaactccaagaggaactaaatacctcattttacagacaaggaaatgaaagcccaagtaggttgagaagatttgcccttagctgcagagtgagacagacaaagcagaaatggatttaaggtctttcagattccacttccctatgtcatctagtagccccgtgacagagatgcctactgtgttctttcaccccagcttcatctgcccaatcctgggaaagctgaaagactggctattctattaccatgttattatggaagaggcagagaaagatgctgtcttgaaactcaaggcatgcactgcactgctggccaggccaatttccagcccctgaagcctttgcccgatttttgcatcccctcgccctcagtgatgtttaagcaagttttctgagttgcctcacatttctagttttcct

SEQ ID NO: 183514 - DNA, 968 bp, Homo sapiens
cactgcagagggaggcagggaagactgattctcgagggtttgcagcctggcaaggataacctgggccaccacttgacaaaggcctggctcagctaatccttgtcacaatcctcaagggtccaaaggagggtttattttgcagggtggacccttgggagtgctaccaggacacctggcagacgacctgcagcgtgttggaacaccaccgggacctcatgaagagggtgactggctgcatcctctccaatgtcaacacaccttccatgacacctgtgatcggacagccacaaaacgagaccccccagcccatttaccagaacagcaacgtggccaccaagcccactgcagccaagatcttggggaaggtgggagaaagcctcagccggatctgctgtgtccgcccgccggtggagcgtttcacctttgtagatgagaatgccaatctgggcacggtgatgcggtatgaagagattggtgagtgggactgcgaaagtgcggaaaatggggacatttggagctccctgccttcacgacaggcaacatggggagcagagaggcttgaaaacccagggactgttttgcagcagggtctcctctcggaagagggatcgttcccaggctaagattgcattcgtagttagctccctttaacatctcttaactggactccagccaactcccaagagataggactggatcatttggtgatttttccttcagagcctccactccctcctctaaaaaacatgaaagttgagctttggcaccagctggaaagacccttcttttgggcacagacactgcacacaaatgaggcagaagagcaccccggccttcctcattcagtgcttgtagatgaagaaacagagaggggactgaaagccacctccacacctcccttgcagccttgggcagaggctaaggcacttcactgtctgtgtgagggctgcctgcccaacccaatacca

SEQ ID NO: 183515 - DNA, 1130 bp, Homo sapiens
gacacaacgagacacaaaaagagaggcaacccctagaccaccgcgaaggacccatctgcaccatgaccgagaccaccaagacccacgttatcttgctcgcctgcggcagcttcaatcccatcaccaaagggcacattcagatgtttgaaagagccagggattatctgcacaaaactggaaggtttattgtgattggcgggattgtctcccctgtccacgactcctatggaaaacagggcctcgtgtcaagccggcaccgtctcatcatgtgtcagctggccgtccagaattctgattggatcagggtggacccttgggagtgctaccaggacacctggcagacgacctgcagcgtgttggaacaccaccgggacctcatgaagagggtgactggctgcatcctctccaatgtcaacacaccttccatgacacctgtgatcggacagccacaaaacgagaccccccagcccatttaccagaacagcaacgtggccaccaagcccactgcagccaagatcttggggaaggtgggagaaagcctcagccggatctgctgtgtccgcccgccggtggagcgtttcacctttgtagatgagaatgccaatctgggcacggtgatgcggtatgaagagattggtgagtgggactgcgaaagtgcggaaaatggggacatttggagctccctgccttcacgacaggcaacatggggagcagagaggcttgaaaacccagggactgttttgcagcagggtctcctctcggaagagggatcgttcccaggctaagattgcattcgtagttagctccctttaacatctcttaactggactccagccaactcccaagagataggactggatcatttggtgatttttccttcagagcctccactccctcctctaaaaaacatgaaagttgagctttggcaccagctggaaagacccttcttttgggcacagacactgcacacaaatgaggcagaagagcaccccggccttcctcattcagtgcttgtagatgaagaaacagagaggggactgaaagccacctccacacctcccttgcagccttgggcagaggctaaggcacttcactgtctgtgtgagggctgcctgcccaacccaatacca

SEQ ID NO: 183516 - DNA, 1187 bp, Homo sapiens
tcaaattctcccaagctggaggtagtggagcaaacaagatcagcaacaatgagggagcagctgcaccactttgtgttactctctgatggccagcacagggctgcaagtagtggctgcaaaaaccagacaaatagatggaaatccaggaactagaggaaattcaggcctgccaggggctctgggaagtgtttgttactctctcagaaagagccagggattatctgcacaaaactggaaggtttattgtgattggcgggattgtctcccctgtccacgactcctatggaaaacagggcctcgtgtcaagccggcaccgtctcatcatgtgtcagctggccgtccagaattctgattggatcagggtggacccttgggagtgctaccaggacacctggcagacgacctgcagcgtgttggaacaccaccgggacctcatgaagagggtgactggctgcatcctctccaatgtcaacacaccttccatgacacctgtgatcggacagccacaaaacgagaccccccagcccatttaccagaacagcaacgtggccaccaagcccactgcagccaagatcttggggaaggtgggagaaagcctcagccggatctgctgtgtccgcccgccggtggagcgtttcacctttgtagatgagaatgccaatctgggcacggtgatgcggtatgaagagattggtgagtgggactgcgaaagtgcggaaaatggggacatttggagctccctgccttcacgacaggcaacatggggagcagagaggcttgaaaacccagggactgttttgcagcagggtctcctctcggaagagggatcgttcccaggctaagattgcattcgtagttagctccctttaacatctcttaactggactccagccaactcccaagagataggactggatcatttggtgatttttccttcagagcctccactccctcctctaaaaaacatgaaagttgagctttggcaccagctggaaagacccttcttttgggcacagacactgcacacaaatgaggcagaagagcaccccggccttcctcattcagtgcttgtagatgaagaaacagagaggggactgaaagccacctccacacctcccttgcagccttgggcagaggctaaggcacttcactgtctgtgtgagggctgcctgcccaacccaatacca

SEQ ID NO: 183517 - DNA, 230 bp, Homo sapiens
gtgtgtttcacttccggcagagcatctcttgttttttatccacatcgcccctttgaatctttgccatgctactatctactgcccattgccactctctctggccttcctccaagctgcttttctttcctcctcattttgtcccctttccttaacccatcttcttttgttttaaactttcacaccagcagcttgtgtttttatagccactgacacacaatgagaggccctct

SEQ ID NO: 183518 - DNA, 465 bp, Homo sapiens
aaagcacagagctgggccccccactgcacagatcagacctattacttctggggagggaatgacatcccagtaacatgagtgcattcggggaggcgacatcctagccccagcggtcagcaaacattttccgtcaagggccaggcaagtaggtgtttcggctctgtggcccatatggtctctgtcacagctgctcagctctgacacctggcgtggaagccgccagggccaatacaaaccttgggcatggctgtgtcccaataagacttcatttacaaagaccagcagcgggatatggcccgtgggccatggtttgctaacctctggatgatctccaggaaatgaggccctcttggtctcctcagagaatcaccctctgtcagtaaagctctcatctgtgagtccaggactgtcccacaaagactggacagtcagcctactctcaggccagcaaacactcgaatgata

SEQ ID NO: 183519 - DNA, 654 bp, Homo sapiens
agaaatgttggaaaaccagtgccttaagagtaagggtatattcaggcttcctctttgtcagagctctaactctcctggggggcaggtaggctggggcaggtagggtgagaagactcaggtagttcaccgagataaaactttgttgaggttggctggggaagtgagccagttgtcttgggaagtgggaggtgaaaatgaaactccctgtgtgaccacttttctctatcaaaaataataaattatttcaaatgttctaaataaggaggctttggatagattttagtcagcttgttagctattcaattctggcaacaaccgtgtgtacatctagactagggagacgtttacaattaaattcactgggtcttgtggttggaagtaacctgaagggatatctatgcaagtttccatcctgtgtgtgcatcccttctgtaatacctctgcctggcagttcagcatctgcacttgcgtacgtctcctggaagggaattcatgaactctcttgggatcccagttcttgtcagcttcttcatgttgaaaccctcaggcttcatatatctcagggtttggattggcattagttatctatcgctgtgtaacaaattacctcatcattaaggggtatgctcttatcgggatcctctagacgacccc

SEQ ID NO: 183520 - DNA, 489 bp, Homo sapiens
tctcccttgtcacttaaaaactcacattctgttctccaggaaccgcttttgcaattcagttttcctatctgcaaaatgataggaataaagccattaggtgaatgaatagatactagtatctccatttaacagaagaggaatcaaaaccttataggattgttgtgatatcacattagattatttgtaaacagctttcaaaaggctgcaaaagaacaaaaaagaatgttgttgcctgctgagcccaggggaacactgtaggtgaatcagggtatttcaggcccctgggctgctttgagacaggtgctcttaccaaacaccatcaattgttgagtgtgaaccctggaatagagtgaagcttacactgaagccagtatttccacatcccatatgatctggtgcttatgtttttcatttccttacctccttgccatatactttactgttacttgttaagattatggcaaggaggtaaggaaatgaaaaaaaaaa

SEQ ID NO: 183521 - DNA, 144 bp, Homo sapiens
tgatctagaggatccacatgattggtccacgctcccactctaacatgacaagaagtgtctgtcccagaagtaatctgattgtgcacctagagtacctgttttctgcctggggaagaatgcacactgctggacctggagcggtgg

SEQ ID NO: 183522 - DNA, 488 bp, Homo sapiens
tgtattgagtctgtaatgtgagtcttgctatctggtcccctgaacactctgagtctgattttatttcagtgataacctccagcaagctctgtgctcataaggatctctgaaagtagacgtttcatcagcggaaagtgtgatagccattatgtcaccctaacctccagcgagctttatttagaatgccagccacacaagcccatgttctgattctcatagttggggcttaggctgccagtttcttctatgaagctaaactctagagcctcccttctttccatgcccgagtccatctccaaaacagtgcttctcagattcctcttttctggcctggatccacaggtagtgaccagagttaacagagttcttgggccaggcacagtgtctcaaactggtaatcccaatactttgggagactgaggatggaggatcacttgggcccaggagatccagaccagcctaggcaacatagtgagacccagtctcta

SEQ ID NO: 183523 - DNA, 414 bp, Homo sapiens
gtctagcccacctccctggctggccggtctggcctttgcaggtagcgctgtagggtctgctggggctgggggcttctggactctgagtggggaaatgctcagggaacgtccaagggtgggtggccactcagcttccccattccgggactgtgaggtgaagggctgggagcatgcagtggcttctcccctctagctcgcagtcttcaggagacaaccccgccctgcaaacgcctccttcctggacccagcccctctgttccccagtgagtgtcatctaggggtttgaccgggagaatgagcatctgctgggcctcttgccactaagccttggggtctggccctataccctggggacccaggaggcactaggctggctcctgagaggcagggtggctgccagagccacggtcccca

SEQ ID NO: 183524 - DNA, 507 bp, Homo sapiens
caaaggtcctgtggcaggaggaagcctaacatttacgagggcctggggaaaagccagtgtggctgaagagtagagagaaagggagatcctggtgaacaatgaggctggggaaataggaaggggcctggatgagcagggcattgtagaccatagacagatttatttattcatgcattcataaatcaaacatttattaatgtctccaggaggggcattgagctacgtactgataaggtgaaggttaccattattttcaaagctttttttattcaggtgaaattcacatgacattaatcactttaaagtgtaggatcaatgccatttagtatattcacattgttgtgcagccactacctccacctagttctaaaacattttcctcatctcagaagaaaacccctcatccattaaacagtcactattccgccctcctccaatctgttttttgtctttatggatttgcctattctggacactgcatataaataaaatcatatgatatgtggt

SEQ ID NO: 183525 - DNA, 261 bp, Homo sapiens
gggtcatctgaatcaatctgagctggggccggatggcagtggatcttaagcacttcccaggtggatctaatgggcagagccactgccccacatgatacatccctcctgccatgctgcctggctcactgtgccctggcctcactgcctctcactcattctcaagtacgttcacctcagggcctttgttggaatactctgtccctggctgtccacctggcccccttacacaacatagctcacttttttttttttttttttttt

SEQ ID NO: 183526 - DNA, 597 bp, Homo sapiens
ctgaggatgaaagaatgtctaaatcagaagaaagaaagtttatcattaaaatctcattagtttagaatttccagacatggtaggactgaaatttgcctagcaaattctttcttttatggtttagatgaatggtgttaagatgcctggcaaacatatactttgaaggccagctgttttcaggcatttttggaggacatgttcatggaagaaattgatacttaaattttacatcattatttatcataaaggtccccatgtcccatcagaagccacattctggggggttcacatgtctttcaccgcagcatcatgggcctaggtgaatggctgtgggttgttggcacacgtgggtcctgggccctgccagtgcctcctaaccccaagttgcctgaggtacctgggggaggacaggtattcagaagggtgtcttcgtccttccaggcaggctgagttgttgtgtggcttcagtaggaacaggttggctgtgaggggttgcacaggcctcagttggccctgtggtaatgcgcacagtcactgtaaagtggggtggactcctgagaccacatggtgagattcaccattttttgatacccctcc

SEQ ID NO: 183527 - DNA, 163 bp, Homo sapiens
atcttagctccaattgcctactgggcatcccactaaagttatggcctcatctaggatagaactcattattggaccatctgagcagattattgtcagtcttcattgtttcattactaagtcctatcattcttatattgattcttttcttttctttttttttttt

SEQ ID NO: 183528 - DNA, 341 bp, Homo sapiens
gcatgcatgggcccagacagacgatgctgttgaaaaggagatctgaacctcatctgctctccttagaggcctctggtgggggcagatctctgctctcagcccctgcttccagcagagcggggtttcaggccaccctctccctggccctctccccaggtgggcggtggagaccctctgctcgtgcccctccgctcgtgcccctccttggtctctgattccctctcctctcagggccaggtgttttagagctcaaagagggaaactgggatagaaaacgtgtgacagccttagcacctgctgagtgaattccagctctttccccttttccatcgcttcctcct

SEQ ID NO: 183529 - DNA, 131 bp, Homo sapiens
attgcttttgaaaaggagcatcagtagcttgtgttatttctaataaaatgctccaggtcaagaccagcggggtatttgaaacctagtcagagtaaggagcagacaccctggcctgtgagaatgacctctga

SEQ ID NO: 183530 - DNA, 165 bp, Homo sapiens
aaaaattttcctattctttgttaattgttgtaaaaaaaaaactaaaaattctatgatggaattctttgcaaataaaataattcaaaggaattgctccaatgcaaataaaaaatgaaatacccttttctatgcttagcacaataggtaagtccctaaggtttctct

SEQ ID NO: 183531 - DNA, 376 bp, Homo sapiens
aaaatggtggaaataaagattacactaaggtgcttatagcctagcaagggacataacattgccaagaagtataaagtctgaggtactccgagatagaaggaaaacaatccctttttggtggtaggaaagatttaccagttttaagctgagtgagaaagggcatgagtagagctttggcataatcctgaatttccatatttacatatagaatataaaagagaacagagtcaaggacgtccccaaggttttttggcataggaaactgaagaatgaagttgtcattcactgaatataaagacagaggagcagggtattttgtagccaggtaaagttgagagctctgtctcaggcatcttcaatttgagatgaatattgg

SEQ ID NO: 183532 - DNA, 474 bp, Homo sapiens
tcacagatacggagaacagcagattttaatattcatgcagactgtcacatgcaggaaagcttaatacgcagcaagaatagggacatacaaaagagaaacacctgatttttataacaaatatctcccttttcttctcctttctactgcagtgtttcccttcagcacttcctgcacagactgccttttctttctttctttctttcttttgagatggagtctcgttctgttgcccaggctggagtgcaatggcgcgatcttggttcactgcaacctccacctcccaggttcaagctattctccctgcctcagcttcctgagtagcaggcacctgtgatcccagccaccacgcccagctaatttttgtatttttagtagagatggggttttgccatttgtccaggttggtatcgaacccctgacctcaggtgatccacccgcctaggcctcccaaagtgctggaattacaggtgtgag

SEQ ID NO: 183533 - DNA, 330 bp, Homo sapiens
actatagacgatcccttttcttgtaagagacaggtcttgctatgtagcgtcaggctggttttgaactcctgggcaacatagcaagaccttgtctctacaagaaatacaaaaattagctgggattacaagtgtgtgccaccgcgcccagctaatttctgtatttttagtagagacaggtttccccatattggccagactggtatctcttttctttcatttcaaataagagtggaactttttttttaaggtctgtttatctacatggggttaaataagttatacttgttggacctattgaaagaactaggcctacataacaaatggagcagt

SEQ ID NO: 183534 - DNA, 712 bp, Homo sapiens
aaaaggttaaacatgttatcatatgacccaacaacttcaatcctagggtatatacaccaaagagaaatgcaaacatctcctcatatgaaaacttgtccatgaatgtttctatcacattactcatgatagccaaaaggtggaaataacctaaacgtccatcaaatgataaacggataaatcaaataagctatatccattcaacggaatcatattcagcaataaaaagaaataaagtactgacacatgccacaatatggacgaacctttaaaaagttatgctaagtaggccaggtgtggtggttcgcgcctataacaccagcactttggggggccaaggtgggtgaatcgcttgagcccaggagttccagaccagcctgggcgacagagcgaggctctgtctcaaaaaaaaaaaaaaaaaaaaaattcttgacccagctcaccagcatagttagtttacttttctgtgcttccttgcagaatagcttttaaaccaaaatgcttaattatgccttcaaattctgggattcttcatattgcagaagagcctacaataaggcttaaaagcaactgtgttttaacatcagtgggagatcaaggaaaatttcagagtttgcagtttggtaggaagactgaaaaactttgcatttgtactttaatagtgtggtttcatgatggtttttgaagaactgtaagttttaaaaatatcagacaa

SEQ ID NO: 183535 - DNA, 179 bp, Homo sapiens
gagaaatttatctgaagagcaatcagttagatggacatggaagaggccctctctggggttttacctggtctgtcttaaaaggaactcactcgagttttaatccctaggattataggctgtaaagcaatggtcagcttagatccatttcagggccaatacatctgtctaaaatattttga

SEQ ID NO: 183536 - DNA, 519 bp, Homo sapiens
tgttggtcccttgagggttagagatgccagtctgtccttgataaaactgcagctttcattagtcattgtgcaattactttttgtagccagaatcgataaagcttttaactcctggacaatgatgaagctgccttttgaatcgttttttctcttctttgtggtttttgcttttgaaaactgtagcttaaccagtgtctatttcctgctgtcaccaattaactattttttaatcatctgcttttacttcagttaatagatggttaaaaaaataatctcattaggcactagtgtctggccgcagacgtggctcagatgaggcctcgtggaaagagcagagggagggtctcaggatgacttctagggaaagtaggggaagaaagatacagcctaagtgctaagtaggagcataacactttgctgcgcatctttataaaggtcccttcattttatatcagctcctcagacagtagtaacagtattttcattttagagataaagtcagagttagagaaaattaag

SEQ ID NO: 183537 - DNA, 318 bp, Homo sapiens
tcccttccaaagcctcatgagtaaccttcagaccactttgcaacctgggaagcagttcacactcttcctcaccaggcatcagggtgaatttcatcaggcaagagtttacttgaagctggatatccgctgattttgcagattatgttaattggctactgtctagaacaaggtataaaacagataaatgggaggtcgaggcgggtggatcacctgaggtcaggagtttgagaccagcctggccaacatggtgaaacccagtctcttctaaaaatacaaaaattagctggacatgatgacaggcacctgtaatctcagcta

SEQ ID NO: 183538 - DNA, 782 bp, Homo sapiens
ggagccattgtggctccggccgattgagcctgccctcgggctctcaaggctaggcgagggtgtgagggactggagttcgaggtcaacctgggccccattggtaggaaaaaaaaaaaaaaaaaaatttttgtgggcggctgcccgaaaaaaggttcagacccaattcgttttggggcgctcggctgccccagttatggtaaggtcgaactggtggccatgagggtgttacaccagggaaagcccggggcagggcatagtggctgtggttctccccacaataaaaaagggccgggggaaacacgatgggtgtctgaaaacaatctcaaaaggaggatccgggagagacacatgcaggggggtccaccacaacggggggttccaagaggcgacggccagatattaaaaattaacgccccggcgcgtggaaaaaaagacaggacgaaagacgacgaagacgacgcaaggggccagaggagaagaaagagagagggaggcgaaggaggaacgaggtggagagagaggagcggcgaggcaacgagcaacgacagaaaggagactgcagaagacgacagacgaacgagcagagacggagacagagacggagggggagggagggagagcgcaaaacgagaggagagcagagcgggaggagagcgaaaaggaagagcggagcgacgaagacggacaggacgcgaggcgcaggagcagggcgagtgaggaacagagctgaagagcagaagagccccgagcgagaaggccggaggcgggagaagacagcagca

SEQ ID NO: 183539 - DNA, 172 bp, Homo sapiens
actctgaagcctgggcaacaagagcaagactccatctcataaaaacaaaaaattgaaaaataagaaaagagcctgggagactagttagactaggttatcgatgatgggagcctaaatcaatatcttctagttactggtctcccaggctcttttcttatttttcaattttttg

SEQ ID NO: 183540 - DNA, 674 bp, Homo sapiens
aagaagtctagatcagctgacattgccacaagaaacgcaggttagttcatcacactgtttcagttttagaacaggtctaaactcagataaaaagaatgaactatttagcccattctctttaaatgcagcatggcatagtttaattagtgcaatgtaataatctccaattgctcatagaaaggaactaattctgtcaaagtgttttcttagtttcccccaccatgaaatgcattttattcattttgaagcatctgaaaaataaataagcagctgatatccagaaatgaccataaaataactgtgtttaaagagtttaaaacaaaatacagtaaagcacacaaagacaatattcacaaaatgctaccaaataaacacattcaacttcccacaggtttcacacaggataacttttgatataacatcagcagctgtaaaaatataaaaatcctatgtaattggcatcgtattctagaaaaatagctaactgagcctatagggaacgtttttggtctccagattggaaagcatttggatctgatagagaggtgctcctgattagcagatgacataagcacagccaaagctttactcagaaattcccagtcaacatcactgtccttcactcaaccttagggctgctgcagaagctgcaaatgtcgtggggtctgaacaga

SEQ ID NO: 183541 - DNA, 322 bp, Homo sapiens
atgagagctgactgtgcgctggagactgttggacacttggtgtatattacctcacttaatcttcactgcaaccctgggaggaacatattgctttcccattttataaatgaagtaacagaggctctgagagattctcacttcctcaaattaaacacctagtgaatgggggaagttgggatttgaatccaggtgtgccttgttaaagagtaattgcggtagggagactttgaccttttaaaggctatgtaatcagagattattctttcagcattcagttaatcgtgtcctttacagaagaattttctccttgtagattgatgat

SEQ ID NO: 183542 - DNA, 596 bp, Homo sapiens
aatagctgaccagtactcctcaagactgtgaaataaagcttatttttttaaatcaaaaacaaaatagcacctcctacttgtcttattacatctaaagagttatttttacttgctaattgttaatgctgttttatctataaagtggtaaagtattcactaaaacttaatttttctaaaaataaagttattttacagcaccacagtttggatatctcggtgaaattcagcataatggaactttatttgtacagttataatgaaatcttaataacaagagcaaaaatattatcatctctatcctgcagaaaaggatagagataataacagatctaaacagaaaatgttttacagtcacacaaaaattagtgataaaagcagatttagaattccagattctcaatcaaaaagtgattactgcaatattcatttttcttccctcacacaaagaatctctttttcttcctcctatgtgaataagggtgctctcttgaactggagacttccatgactggctaatgtaagaagcaatgcctgttttcattaacgttttaatttttcatagagcatctcaggaagtccacagagcttgaatttgt

SEQ ID NO: 183543 - DNA, 295 bp, Homo sapiens
gaagcctgcccccaaagaaaagggtttgagttagccatgctctttgccaactgtgttaggtactaaagaggaaggcaggtcacttcaacagggagagaaacatttaggtctacagtggcaggagcttcactgaacaaacctctcataaacccactaactgtgcctcataacaggggggtgcgacaaggtggcaccagggagattttaccaacagttgaaatgttaaacttctctcctactagttggtaaagagctgcctccaaccccatcccattactctgattcctcctccaaa

SEQ ID NO: 183544 - DNA, 652 bp, Homo sapiens
cacagtggcctgagtttgaattctgactctgcctctttggaaggctctggaaggttaaaggagcttgtgtgttcaaatcttagcctggtacctggcatatactcagcatgtatttttttcccctttcctgacaatgttccttgccccgaacacttgaatagtggagagaggaatgtttgcttttcctctccattgaaccaacactcgcccatccactgagcccaagattcaccttaggattgtctgttggactcggctcttttgtgacctaacagtgcaggggccttgtgctgagctgcacatgctcgctctcgctggtgctccctctctctctctctctctgtctgcattatttatagtaaaccatattagaacagagtgttaaagaggaaggatgagtcattcccattgaaaccattgatgacataaataaaagcaaaatgcttactatgtgttttgtgcagtatttaaggccaggttgtgctaatttgaatgctcccaaactggatctgtgaaagcatacatatgtgggaaaaaattcaggtttaactagagggaagttatttattgaaaatccatttcagtatctgctttctcccttctatttacttcagatccatattcatatcatgcttgttgttctggctaacga

SEQ ID NO: 183545 - DNA, 167 bp, Homo sapiens
cttcctcctactttaacaaaatgtgactgaagaggaagccagatgtgttctaggacagaccagctgactaactcttactgtcaacatacactgtgcaattccaagacacaagggcaactgataaagaagattagcttggttttccagaaataagttctgctctgttc

SEQ ID NO: 183546 - DNA, 126 bp, Homo sapiens
catatgattaatttttaaaattagtttttttcttttcctgagaatgaacagccaggattaacccatctttagggattacagaaaatcagctggagatgacagaagacctaagtacactctggctct

SEQ ID NO: 183547 - DNA, 210 bp, Homo sapiens
tgggacccactcttagactgcagagccaagtctccagtctcgtcccacacaggtctgttctctgttcatgcctgccaaagggactggttttaataagactgaggaccaggacaatccttaccactgccaatcaaatcaggcagtctgggctttttttttttttttttttttttccttttttttttttgtttaaatgccaccgggggtccc

SEQ ID NO: 183548 - DNA, 480 bp, Homo sapiens
acatcacttaaatatattgctgattagaagaatgtctaattttcaggtcaacacacaatacatttataattaatatcacagtggactctttgaatttgggaaagcagtacaaaaaggagtcagactttgagatatttaacttagagttgtttatgcaatatctgaatttaggatagcagtacaaaaaggagtcagactttgagatatttaacttagagttgtttatacaatatctcagatcgtttctatgttaactttgtggagagacagaaccaatattttaccacaagtaccagtggttccaggattcagatgtcattgctatggtgagcagtaggtttaccactcatcaattggaccccaaaattatagtagtggactctcacaaaggaccttattcttccgagctccattttcagactaactgagagcagataaaatagattttaacaagtcctaaatgaaattatttacaatgac

SEQ ID NO: 183549 - DNA, 115 bp, Homo sapiens
cttaaccacgatgtccctgcctctcagtgcaaccacagacctaccaagacaccatgtacctttccagtggggtcacagacataaccttagcatcaagaagaacaaatacattctt

SEQ ID NO: 183550 - DNA, 495 bp, Homo sapiens
ctataaattcctctgcatacttggatgatcttcatttgatctaagttgttgaacacacttcaagtcttattttgcctatttaggtccggctaccctatcccacattactctctatctggtcaccatttttgtaccctgcttcctatggatcttattgctttcaactacttccctctggcctcttcagaggccaacaatgcctggaaaaatatgtgcattttaatttgctgaactgccaagaatcattagctcatttaatcaaaaacagtatctcaaggtaaatactgtgagagtaatctctgagaaaacagtaatacctggggatattactaagacattttcagcctatgaagaaacaaagttggctacttttagaacacattatgttaactgctatgtttaagtattagaactaagaatacctaagaccttgtacatcatggtgggaaaatgaataattcaatacatggtactactaggtagccatctttttca

SEQ ID NO: 183551 - DNA, 610 bp, Homo sapiens
gcatgagctggtaggttctactgtgggtagaattcccaacctccatatttccaagtggtttggttattccttatcatctcaccaccatcaacaggagttccatgccctttcagagatgatgagaggaagaatgtatgtgtatggaattcagaaatctggaaactattggcaatctgaggatatagccatataaatattgtacatctaaccatattttccttaggaaaaaaaggagacaataagcatttctttaaagagcaaaaaaagtaggttttttttctgtattccactgaaaatataaaatgtaaacaaatttttcattatcacattttatactctaatacaaataagctatgtctataataatgctaatagctatcattaactcaactcttactattcacctatgtatcagtaactatgtgtacctaggtactaactgtactcagcaccgttctgaatgttttaaatgtattaacctaattagccattataacaatccagtgaggagggggtggttatattacatctacattattaaaagctttagcaaatacgttatattacaactatgttatattaagaacctcagttagcctttcaatttaac

SEQ ID NO: 183552 - DNA, 560 bp, Homo sapiens
ttctcctacagatagatcctctttacattctagatgtcatttcgtgacagttggtgaataacagcagacaagcccaggccaggtggcagagtatctgtgtctgcattttgatgacacctgtcatcagagaatctaggcacacaggctggggcagcatccatggacgaggcagaggaagtgggtagcctagaaactccaccagctgaggagttgtttcgtggtctcaacagcttgtagagtgttgatgtaattttgcaggtagacccaaacctttaagcaacttgcattttaccaagagttgctcatcatttcaacctctcactcgctattctcaccatcagatgcagaatcctgttgcaataaaatcataaatgaaataaaagcacagtcaaaactgtgccatccctctgattaaccaatgttgttagctcagggtctagagtattaggtatatttttgttactttatggagcctaagcttgctgctacatgggagggagctctacttgctttacttcctgccaaaacacaagatgcactttatgacaatactgatttgg

SEQ ID NO: 183553 - DNA, 646 bp, Homo sapiens
  misc_feature (495)..(495): n is a, c, g, or t
  misc_feature (497)..(497): n is a, c, g, or t
  misc_feature (499)..(499): n is a, c, g, or t
  misc_feature (522)..(522): n is a, c, g, or t
  misc_feature (525)..(525): n is a, c, g, or t
  misc_feature (527)..(527): n is a, c, g, or t
  misc_feature (530)..(530): n is a, c, g, or t
  misc_feature (532)..(532): n is a, c, g, or t
  misc_feature (537)..(537): n is a, c, g, or t
  misc_feature (543)..(543): n is a, c, g, or t
  misc_feature (566)..(566): n is a, c, g, or t
  misc_feature (573)..(573): n is a, c, g, or t
  misc_feature (580)..(580): n is a, c, g, or t
  misc_feature (583)..(583): n is a, c, g, or t
ttctcctacagatagatcctctttacattctagatgtcatttcgtgacagttggtgaataacagcagacaagcccaggccaggtggcagagtatctgtgtctgcattttgatgacacctgtcatcagagaatctaggcacacaggctggggcagcatccatggacgaggcagaggaagtgggtagcctagaaactccaccagctgaggagttgtttcgtggtctcaacagcttgtagagtgttgatgtaattttgcaggtagacccaaacctttaagcaacttgcattttaccaagagttgctcatcatttcaacctctcactcgctattctcaccatcagatgcagaatcctgttgcaataaaatcataaatgaaataaaagcacagtcaaaactgtgccatccctctgattaaccaatgttgttagctcagggtctagagtattaggtatatgagagctgcactgttatatgatttattatacatcttaggtncncnacccttataggattattaggagnttncnatngntagtnacatanagggcttagtattgtacgtggcncgctgtnactcctnttnagcattggctctcctcctcatctgtttctattacactggttgcaatgtgtttctgtgctgaat

SEQ ID NO: 183554 - DNA, 731 bp, Homo sapiens
ttcttttaggtgtaacatcataagaaatcacaaacttgtattcaactcttttcagttttaggcaaattccatttttaggaataatagttaagcagtcacaagaccacaggttaatattgagtgctctctctcactttaccaatcccaacaatgtttaactcttatttattagtgtttgagtgttttatttgtgtacaaagttaaatattctaagttcttctgtatggctttactatttctaatgtaaatttactccattggaattctttggtttttggcagtaataggaattattctgtaatctgtgtgagaaatattaggaaatgaactgaaagtaattgaaagaggaggcacaagtaaaccatcagaaacgcttttgaccataagaaggggaaattaagggacagaacggaagaactgtgctcctatcagcaatctgagggttcgctctacctgcttaaaagcaagaaatatttttaatatttcttctctctactctgtactaattttatctgaaaaattgctgctgaaacttaggagccattttgaaagcaacggtagtaatcaaaggtataatcctcatgctatataatgttttagattaccaactgctttactatgtggagcgttttctgcccgttactgagggttagatggagaacactgttcccatcttagaggtgaggaacctacagatggcaagaatagcatatggctggctccaagtcaca

SEQ ID NO: 183555 - DNA, 372 bp, Homo sapiens
acagtgggggagagttgtgcatattgggggagtgaagaggggttttttgtgaaccctctatacttactgctcaatttcgctgtaaatcttaaacttcttttataataaaaggaatgaagtattaataaacaaacaacatgtatgaatctcaaatgcactgtgcttaataaaagaagccaggctaaaaaggttacatatcaaatgattccgtatgtatgacattctgagaaaagcagaaccacgaataagaaaacaggtcactgttgctaggacctgaggttcatgaaaggaatgatcaaaaagggtatgagggaaatgttaaaactcttctatattttgattctgttgatggttgcacaacggatgcacatg

SEQ ID NO: 183556 - DNA, 349 bp, Homo sapiens
ctcggccatcacctctggcacatgaacaggtaaagatgttccaaagcgtaccgtttttgtcagctgagaccatttcatgcttacttgactgcatcgacataactcttgaggattaagatagctgaaaattgaggggatctatctgcacgactcactctttttttttttttctgattctcaggttgattaatactgctaatgcaaatgctcaagtagatgtttaaaaactttacaaaatagattcaagtgatactttcttttaaaagtgaagagttgatgattacacatagtaaattcatgaactacagtaggtttgtatcaaacaattttttttaatgaaaatctgttg

SEQ ID NO: 183557 - DNA, 348 bp, Homo sapiens
aagatctcaaactgttcctattttcttagccagtgagtcagaataaaccccttttagtgacattgttttctctctgcccctgttgaggaatacattgtccaagatttaatgtgaattcaccttggggatgtttttcagaaatacttgttacaatattaaaatttaagtgatgatattgaccaactatttattataatctcatagtcctaaaacaagctgtcattttttaaatgtaaaacctttggagcatattgtcttattaagtaaaaattatttaaacatatttaagtatgcagtctctgcccttcaatgaccttttttctctcaagggaaattttgaaatatata

SEQ ID NO: 183558 - DNA, 164 bp, Homo sapiens
tcaatgacttactgttttcaaaccttaggtcaggggttttgttccctcctgatatgaggaagagaaagaggtggacttatagctggtagacagcagatgatgaagcggtgcataacccatagctaatcttagctcttttttttttttttttttttttttttttt

SEQ ID NO: 183559 - DNA, 334 bp, Homo sapiens
tacaagaatgtataaaacaaactactcagaaaagaattatggcccatgagataaaacaacactcacatcatgacagtggtatgtctgtgtaaaaatgcctctatgttgcagcaaccaagacatgcacaggaaacctgaatccaacaagagattaactttcaaaataatgtttactttcaataactgctgagatatatggtgagggcacccttggttttatatttttgaataagtggtagctatgatgtaatcatgctaactacttgtgggtacatagaagtacatttctgttcaagttctaataattgtccagtctccaaaaactggtaaaatt

SEQ ID NO: 183560 - DNA, 219 bp, Homo sapiens
aatcaataatccagaacagatttggttaaaatattgttagtaatttgtatcaatattttaaataatgttttaggctagtaacacatgaaaactaaatcatatcttgtttattcttccattaaaattagtttttcctctggtaatgtaacaggagaacttatgtatataagatctgtgaaattctgacaacaacatatagtgtgattgtcctctgcttat

SEQ ID NO: 183561 - DNA, 355 bp, Homo sapiens
ccaccttggcctcccaaagtgcttggattacaggtgtgtgcctgaattttatgttgttttatatgctttcctttatattccgaatttctcacaatgataaagaattacttttataatcataaaaaattaaagattgctgttattttaggcaccagcaatataaatatggtctaataatggaggccacagtactgctctactttgtaccacgcctagactgctgagttcatctgggtgtcatggtttctttttttttttttttttttttttttttttgagacggagtctcgctctgtcacccaggctggagtgcagtggcagaatctcggctcactgcaagctccgcctcccaggt

SEQ ID NO: 183562 - DNA, 550 bp, Homo sapiens
aaatttctgctcaagcgccaccccctcctggaggctttcactgctatcctcccctgtgctcctgcccttcccatctggcatctctgacactgtgggctccctggggctgggctgcccaatgtccataggagacatgggcttcagaggccatgtctgggtgcttggacgttgacttaagagcagtgggagtcctggaggtgtgctgcgttttagaagaatctttgcagttgttctgtgggggaaaatactggacggggcaagagtggaggcaggagaatagttgggaggtggtgcctgtggctcaggggagaattgatgatggcttgtggccatgctatccagtaaggtagccagtagccgtgtgtggctcttttcattgaaaatacaggaaaataaaacaaaatttagttcattcacactagccatatttcgagtactcgctagccacatgtgggtattttagcccctattgggcagcgcagatacagacatttccatccctgcagaaagttctgttggtccactctggcttggactgtggtggtggagt

SEQ ID NO: 183563 - DNA, 266 bp, Homo sapiens
ttcgttactgacacgataccctctgctgttgcccttctcctctcgcaggctgtgaggctgaggcagacacactgggtaggtcccacgtctccttgtggcatttagatccagtcttactgaagggcatgctgaagaggagatggccctgactcctggggtatggagggacactgctgccagcccaggctgcgtggcacatcctgccagctgcaggtgcctcccaggcatggggtaaagcttagcagtgttctgtctattctgataca

SEQ ID NO: 183564 - DNA, 341 bp, Homo sapiens
tgtgaggattgcttgagcctagaagttcaaggctatagtgacctacaaatgtgccactgaacttcagcctgggtgacagagcaagaccttatctccaaatttctcttttttcgttgttgagacggaatttcactcttgtcaccgaggctggagtgcaatgttgtgatcactgcaacctctgcctcgtgggttcaagcgattctccagcctcagcctcccaagtaactgggatacaggcgcccgccaccatgcccggctaatttttatacttttagtagaaatggggtttcgccatgttggccagggtgatctcaaactcctgacctcaagtgatccacctg

SEQ ID NO: 183565 - DNA, 199 bp, Homo sapiens
tttttactcacatatgcccaatagaagctgtgtgtaatgcaagcaataaaatgaatgactttctaccaaatggcactcttcatggctgcaaacgtgaccctaaactacagcagtctataatgtggcagactcaagagggacacaaagttaacactgccccatgctttcccctggaaacaccaatgccatgcatgaaggg

SEQ ID NO: 183566 - DNA, 207 bp, Homo sapiens
cagggggaagagggtgtgcaagaaagaaaacaacagtcatgttatacagcgagggccttgtgtagatagagtttatgtagtcataataatgcaagcactgaatgttgagctaaacaaataatataactgtaaggaggatgtgaggatggaagtatttctgttttgggaagccgcagggtgttaaatgatcagttaaattgtcatatt

SEQ ID NO: 183567 - DNA, 527 bp, Homo sapiens
gctccccaagtatccggcctatcctaagcttatcctgacgccagataccacttaacgcatgttataaaatgccaaagaccattcatggtcattatggtgtccacaaatatgttacacaaattcttgacactcccttcagaagggagaacctaatccctctctcctggagtgtggctggacttaaattattttgcttctaatgaatgaaacaatgaagaaacgaaggtgtgtgatttcgatagtatgtcatgaaatgaactgtggcttcctccttggtctctcttgaagctgactcaggggaagccagctgccatgtcatgagaaaacttaagcagccctgtggggaggtccatgtggtgaggaactgaggcctccagtcagcagccatgggagggagccacatatgaagtagagtctccagccccagtcaagccttcagatgactgcagcccacttgacagcttcacggtagccttatggaagagcctgagccataaccacccagctaagctgctcctgcattccct

SEQ ID NO: 183568 - DNA, 517 bp, Homo sapiens
tgcgttttacaagtgtatcatctacaaagccgtgtgaggatttactactgaggtgacacatcacaaaaaaaaaatgggtataaagatcaaaagttgtcatatttctaaagattggtgtcacttaagccacatttacttaggtgtttatgaaaatgctaaaattccctgatcctttttctgtgaagtctcacaaccatgtttaaatattacaaggtaaatgagaagtaaacaatacttacttgtaaagattcatttaaaagaagaatacatagcagaatgagagcatttgagaagataccaagagtacttgggaggtttaaaggatgattaataaattatgacaatgtctattttaagataatccacaatttggtttgtgtcagggattcaggcaagagaagataaatcttgcaagatgcatatgctgaaaaggggtgattttaatgccctagatttgagtgttttaatccaatgctaagtgtgagttctaaaaaacaagcagagaatgactgcattc

SEQ ID NO: 183569 - DNA, 515 bp, Homo sapiens
ctcaaggattgttttaagccttgaacgacaaaggctgtttagtctgggatgatttatttatttatttacttttaatgatagtagtggtagttgcttagttggtttgttgtggcttgaaggaagttgacagtaagttcactcaaaaatgtaaaaattgacttttgatctgtttgctttcagtcaggtccatgtgccagctataatacccaaagtagcattgtcttttcctctgcctttcaaatctcaagagaaatcctctcactggaagacatttaccagaatcccactggcagaagattctgggaaatacagtttctgggctttaagcctggcagtacaaagctatcttataaaaattatatgaaattatgtttcaaataagcagaataaaccatatgtgctgttaaattgattagagctggcttcatggaggagacagaatttaagtagaaaatttaaaaagaagaactggaaattggccagaggaaagatttcagttagaatgacataagcaa

SEQ ID NO: 183570 - DNA, 113 bp, Homo sapiens
tgaaaggcatgtgaggtttgggtaatggagatgatgggatatggggactgaaagggaacataacagcatagcccatcctgtaagtggcctggttgcctactaaagcatcccca

SEQ ID NO: 183571 - DNA, 190 bp, Homo sapiens
ctctcctatctgaatcagatctcctatctgaatcagatcgccatgatgacaaaaatgagacggatggccatgtactttttatacattattccatgtgaaaataaagatcatccatttctctcatttcttttcttattactcatgtaaaagcaaatgttctgagaaacatatatctggattaaacctaaga

SEQ ID NO: 183572 - DNA, 155 bp, Homo sapiens
ccctggttaagtctgttgattagccagaaagtcaagtcgatccagtctctaccaacttggtcattttccctctctaagtcatacgtcatgacatttggcatttacccactccagcttacattatgataatttatgaaataccctattaacggccc

SEQ ID NO: 183573 - DNA, 176 bp, Homo sapiens
acacggccaagtccgacagcccagcctgaatctcagtctcccacttgccagctgtcaattctggggcaagtgactgagcctacccttcccattcccccatctgtgaaatgcggatgaggacagcacctccttcgaacagggactgtgaggagtgagtgacataataaatgtacatg

SEQ ID NO: 183574 - DNA, 503 bp, Homo sapiens
aaccattgccaaaattgctcaacatcttaattttattttatttttaattgtattaatctttttaatgtgaaagttttggtcaagatcaaaacactaattctacagctttgggtgaaaaccatttttgctgggatctctgggagcacagtagcatagtttgtggcctgccttgctttctgggatgaaatgaaaggtttttccatttgatatttttagtgtctattttccaaatagtattttataatttttctttgtttctgtttaaaaataaaattttgggaggggtggggagaagaaacaacaacagtaaaacaaagaagaaaagccacttgattaagcatagttagggagctcagtgaagcatgtttcgtcctggtgccaaatgacgctcactaaaattgcagcaatttttgatgcacttgccaatgtttgtgttatttttactttaaagatgtaacagattgctccaaaataaataatttaagcctaatgtttcaaaagag

SEQ ID NO: 183575 - DNA, 295 bp, Homo sapiens
atcaatggattgttcaattatttaatcagcattacctctgtaggttcagtatccataattcatttgaagctgacaccagagagagaaggaaagtcatttctgcttcattattttagaaccagttaaagctgaatccagagacagagcctttcaactgacccctcagaatgccctgcctgcacccacacgtgcccatgcccacccccctactcccactcttaggtctccaggcatgctgcctttacaataaacactacctttagccattgaaacgtggaagcttttgttaattcta

SEQ ID NO: 183576 - DNA, 248 bp, Homo sapiens
ttgatacacggttggttgaatgcatggatgcggagggccaactgtacagatcagtgataggatgagatctaaagccaagttgcagagcactgagacgtgagggcggatatgagaaaagtaaacgcagacctcttgagagacatggtcatgaacagaggagttagagggtagtagctaagggtagagaaaaaaggccaagagaatattggtttattttaggtggtgagcatgtttcttgttgatgagaa

SEQ ID NO: 183577 - DNA, 349 bp, Homo sapiens
ctagaggactcgtgatgttatccccaacacaagaaaatcaattgatgaaatatatcacattaatggaagaaaaaacatatatatcatctcaactgatgcaaaaaatatatttgacaaaattcagcactctatcagaaaaacctttagaaaactttaagaaaatttggctgggcgtggtggctcacacctgtaatcccagcacttggagaggccaaggtgggtggatcaattgaggtcaagagtttgagatcagcctgaccaacatggtgaaaccccgtctctactgaaaatacaaaaattagccaggtgtggtgttgggcgataacatcaggatcctctagaacagcac

SEQ ID NO: 183578 - DNA, 419 bp, Homo sapiens
tctatgcagtgaaagaagctgggctacatcaagaatggcaaatagggtccccgttgcatgccaacaacaattgattattagtggctgtctctgagctcactgggaagactaattacgctagggttgattagcaatgtctaccacggtcaaggcaatgaggagtggcagcacatgtgtcacttatttgccatcccagaactagatgaacttcaagttctcttccaactatggctggctctgattctaattataaaaacaaaaaaagggggaaggggcaaatggagaaggaaaaataggctaacattttccaacatgggccatggctgaattcagtcaaatcaaggctgtctgcccagccagcccctcatgctccatgcacacagccctgccacatgggaggaagtggaaaacatcagatc

SEQ ID NO: 183579 - DNA, 537 bp, Homo sapiens
ataatggcaggggtgcagcaggacacaccctggcatggacaaggcaggtcctggacccagagtgagggacaaatgaggtcagcctcataggggcacaacagggctgctcccagtgcaggccagggttggccacgaggaggggatgtcctcaccaggcagtatcctggtaggcccctggctgggctctctaatgcccacgctggggcaggtgggaggacattctaagtaatgggagaatcagagccatgagcactgcattgattttgagtgtcccagtctctttttttttttttttttttttgagacgaagtctcactctgttgcccaagctggagtgcagtggtgcgatctcagctcacggcaacctccacctcccgggttcaagcaattctcctgcctcagcctcctgagtagctgggactacaggcacctgccaccatgcctggctaatttttgtatttttagtagagactgggtttcactatgttggccaggctggtcttgaactcctgaccttgagatcctcccgcttcagcc

SEQ ID NO: 183580 - DNA, 328 bp, Homo sapiens
ccttcttgcccctccctgagctcagcgtacagcccataccgaacagggtagaaggagtaccagcagcaaccccgatgctgggatgttgggcaatagtggagcacgattagtatgcccatgcctcactcactagggtggttttcagtagacctccagttctgactaagctcctctcaacaagattcagccaggcactgtggcacacgcctgtagtcccagctacttaggaggctgctgcaagaggatcgcctgaacccaggaattcgaggctgcagtgagctgtgagtgtgccactccagcctgaacgacattgcaagacaccagcctc

SEQ ID NO: 183581 - DNA, 451 bp, Homo sapiens
gggctgggtcgtctagatgatcctcacacgcacttggcttgggcatttttagcatgtgttttggtttttgtatttttgtccacttaggaccattagtttcttgagtatgttagataagaagcccttccagattgacagtttttcataattttcttctagtctgcaagatgccttttatttgggttcagtattttctgtcctgtgttgaagctgcgtgaagctctgaagttgtccttagtctcacatggtcacattagcttttgttagtggtgatttctgtgtccctttgagaagaaaagtgagatggcgaagccattgtatggtctatgggtatttggttcctatgtcttccttttctgtttgtggcttaggttcacaggttcaagtttacccacagtagacacacaccctacgtgttttccttggagattttggtttcaggattgaactt

SEQ ID NO: 183582 - DNA, 225 bp, Homo sapiens
tggtaataactgacttagcaggctgaggaatttgcactttaagtgaaccctaaactggggttaggacaggccaaggagtataatctatactgccaaatccctgaaaggtgctggcattaatagcctaagtacctctggaaatgagagtaaagctggggctgaaccccaggaggactagggtaagaagggcttaaatcctcaaatgtccttgcggccgggcgcagt

SEQ ID NO: 183583 - DNA, 267 bp, Homo sapiens
accttaggaaacattaacaaaagtatgtttgatttttaagggtctgcctatataaatgtacaggtcggttaatcagttcagcagtctttggggattcatttgactaatctttggttaatatgaatgcttatacatatcatgtcatgttcccactattttccatggctggtgttttcctcctgtgcctttgctctattccaattttattataaaatccaattataagttggaaacaatgtagtctgtgtttcttagtactagccattg

SEQ ID NO: 183584 - DNA, 550 bp, Homo sapiens
ataaagggccgtccttgtttttatataattaatttgaatacactgtgatttttattgtgaatgatctctagtaatcagtttcccttagtaaatggctatgtgttctctcttttctctgctttttaactggtaggcttgaatgttcttcctgttggttatctccagtctcagtctattcttttcttaaaatatacaagtaacattagattgaaacttgctaaaaatatggtagttcttatagagaaagactttgagagttgacttttctttcctgctaagtaaagagtattcgtggttgagtttccaggattgggttgagataaagatgtactttggaaagaacagattaaattttgttttaacaagtgtgaggttcaaccatgtacttcctgtactttattttaattggcactttgtgtgcagcgaccatttgtttttgtttaatccagaaaacttcctccaaattcatgattgtaggagaattttgttctgttgattgatttttaaaaagagctctcatgagtttgttttggaagcctttttttttaaa

SEQ ID NO: 183585 - DNA, 436 bp, Homo sapiens
aattctttctgagaaacattctatccatgaagatgcaaacaaattatgggaggctaagaacacggtacagctaaaatcagcatgcacgctcatctaaacatcataaattatccaaaatgcaccagaaatgtcagtctggagctcttgtgtgggaaagtgctccattcactttggcactggctcacactcatctgctgcagcccacggcctgcccggcgggcgggagacccacgcctgcctcggaagcacacagccaggtgtctagggtcccgggcccgcaccaagctctggtgctgccttgaggggagctgcgtggttgggttgtgagatggaaactgaggattccatggtcttccctgcccactcctcaggcctgctgggagccacagggatgtggtcgaagggtgtgcacgctgcccctcggtgtgtggctgtg

SEQ ID NO: 183586 - DNA, 232 bp, Homo sapiens
ttctgggcaaggggctaagaatacaaagatgggtagatggcattgtggacacgattcctgtccacggaaacgcgcattctagctgaagaagatgagcaatgcaccatgatagaacagggggagcagtgtgctagggaatccacacaaggcatgacgcttgcatagaccaggaccacgtggaagatacggcccatcctgtagtgcagcatggttctggggccaacagcaacct

SEQ ID NO: 183587 - DNA, 452 bp, Homo sapiens
ttcctctttttctttggaccctttaaaagtatttacttttaagaatgtgtattaagattgatttttttctgcctagtgttgcaaaatattgccttttaacttttggagggtacttttgattaatttatcatgtgttatggaactgatgatgattcacaaaaccaagtaaaattactgatgctaagagttcaataacacatgataaattaagatattttctgcaaagtacctgctgatgaataacacaatgaataaaccaccttacattttcacaggttttgtaaatttgtccaattattcttccgctgtacacatatttttaccaccaccagctgtaaaagatactagcagattacactttaggttgtactgaattagtgttttcttagctgaggactcaccgacagtcaggaaaaaccacatgaaatcggccttctttttgatgatgtctg

SEQ ID NO: 183588 - DNA, 376 bp, Homo sapiens
aacaagtctacaccaacattactggtgagagtcccaagaatctccccgattggacagctcaggtaccaggtgcccctctgaagactgtgactgtgctcaggagaatggactgtgccaaccagggaccaccccaggagctgagggtagggtccccttcccctgcagatgtggacatagaagatggataggctaccaacaatatccatggcacaatagttcctggcctgctcacacctgtaatcccagcaatgtgggaagctgtagtgggcagaaaaaggcttagctgtagcgggcagagaagattggatggcccaagaccagtctctacagagagactttagattcctcccacccatacccagagcccccaagggct

SEQ ID NO: 183589 - DNA, 565 bp, Homo sapiens
ccctgaggcagggagaactaggcaacatacagaagagaacagctggccaaggaaataaccaagccagacagatgacattcatttaacctatgtttttcactccctaactatgttccaaacttggtggaacacataagcatccctgggtatttgtagaaaaacttggggaagggaactctataaaagataggtcttcttttttttttaagatggagtcttgctctgtcacccaggctcccaggctggaatgcagtggcgcgatcttggctcactgcaacctccgcctcccaagttcaagcaacgattctcgtgcctcagccccctaagtagctgggactacaggtatgcaccaccacgcctggctaatttttgtatttttggtagagatgggggtttcgccatgttggtcaggctggtctcgaacttctgacctcaaatgatccacccgtctgggcctcccaaagtgctgggattacaggtgtaagccactgtgcccggcctaaagacaggccttcctacaggtcaaggaagcttgactaattgttattagggattaaattgaaaa

SEQ ID NO: 183590 - DNA, 412 bp, Homo sapiens
tgtttcatttttacttgtgcgtttgatgtgcatctggatggatggcaccgggcacacttaaaataaggagaaataaatagctctgagatgtgacagcatatgtatttgctcaagagtgaatggcagagatctgcatttcatttttacaggatttcatcagacatatggtaaaccatgataggtgatttttatttaaaagtcagtcatgccgaattcaaaacttattttattatttttttgagatggagttttgctctgtcacccaggctggagtgtactggtgcaatctcgactcactgcaacctctgcctccaggattcaagcaattctcctgcctcagcctccagagtagctgagattacaggcacaggacaccacacctggctaatttttgtatttttagtagagacga

SEQ ID NO: 183591 - DNA, 731 bp, Homo sapiens
agaagagccaggatggccacatccccagagttgcagcacaaaggtggcagatgaggggacctcagcatcccctggaggctaccgtgctcccgctgccctctggaggtcccagtctgccttctcaatcactggagaagaagccctgaagaccccctccagtggaggctccatcgaggcagccaagggaccaaggccaacacccgagagcagagtctgctctgcccagctggaagagtgtggacaggctggatgaaacaaacctggccccagttttgcagagccccgacgggaactgggtggccctgaaggatggcgctccaccccccacccgactactggcccctaagagcgggacgtttcaggccctggaggtggcctccagtgtggcatctgcctacgatgagatgggctccgatagcgaggaagactttgactggagtgaggccttgagcaagctgtgtcccaggtcccgggccctgcccaggaacccccagcctcagcccacacaggcccagagctctgaccaaggccccatagctgcctccccatcctctgcactctcccccccctgaggccatgtgctctgactcggagacctcctccgcaggctcttcccgagaagttgggcaccaggccagactgtcctggttgcagaggaaggcccccaggaaccctgcagctgagaagatgcgcttgcatggagagctggacgtgaacttcaacccccagtt

SEQ ID NO: 183592 - DNA, 467 bp, Homo sapiens
cacatctccattatttttgggtaaatatttaggaatggaatgttggtcagctgtaggctccattttacaagaaactgccaaactgtcttccattctacacttttgtttgcaatgtatgaaagttctggttgcttcctatcctaatcaacatttggtgtgggactacaggaacatgccactacacctgattaattaaagaaaattttttgtagagacagggttttgctctattgcccaggctggtcttgaattcctggcctcaagtgatcctcccacctcagccactcaaagctctaggattacaggtgtgagtcgccacgcccggccaaaatttattaattggtagttggcaattgttgatggaaaagaaaaagcaggttacaagcaatgtactttttgatgtctttggtattatcacaggcaaataaattatatatgtatatatatattatgtatattatattatg

SEQ ID NO: 183593 - DNA, 167 bp, Homo sapiens
aggaattgcattgcaaaaagatagtgatatgcctttaaatacttaaagacatcattcagaagttagacctcccaaattcaatcttgtctttctactagttcttccctttccaaagctactttgttatcaaataattttttctaacttagttcatatttatcaaagta

SEQ ID NO: 183594 - DNA, 692 bp, Homo sapiens
accatactcccactgtctgcctttcctctactttctgtgtggtttaagtacacctgaaaaaacaaaacaaaacaattacagctcagtttatgtaacttgcatatttaacaggagcatcttttttggttgttatgaatcttccattttgtcatcataggaacttagtttatgtaaacaacgatttgtgggtgtgtctagatgcatatggtttatgtgttgtaaagtaaaatacataaataagctgatcacgtaaaagtgattgtgactatagtagctctttggtgcaccctatcaaagcttttagagtggagtcattttagaaatcaaaagcacaatctctgcttttctgaaggcatttcagggagatgacatcgggagaagacagagtgctagtgtaaccctgaaaaccttgtgttttaggaaaatatcaatctttggtctcaggagatttctgggttctgcaaaatgtatgctttatttatagattacactcagccacattaatcaagaaaacaacatccagtctccccaaatcacgatatttgtctttggggatgctatatatttgtggttctcatgaacatggtggccctgcacgaagaccacagtgggttcctggtgggtgtacgctgaatgagcctcctgattgtgccttgcttcaatgaattgtcagttttgctcatattccctga

SEQ ID NO: 183595 - DNA, 652 bp, Homo sapiens
aaacctagaagaaactgatatattgctggacacatacaacttatcaagattgaattacgaagaaaagaaaacctgatgcaggtcaataatgagtaataaagagttttccatcaaagaaaagcccaggatgtgatggcttcactgctgaattctaccaaacttttaaagaagaactaataccaattctactcagattcttcaacaaaatgattcccaatgtgttctatgaagctggcattactctgatatcaacaccagataagaacacaacaaaaaaggaaaccactgactaatatccttgatgaacatagatgcaaaaattctgaatgtaatactagcaaactgaatttaacaagacattaaaaagatcattaaccatgatcaagtgggattcatcccagcaatgaaaggattgttcaacatatgcaaaacagtaaacacgatatatctcattaacaaaatctgggacaaataccaccttatcattactattgatgctgaaaaagcatttacaaaaatcagcatacctttataataaaaaaaaccttaaacaaactgggcataaaagggacatacatcaacacaataaagtgaatatacgacaaatccacagctaacatcatcctgaacaggaaaaagttgaaagcctttc

SEQ ID NO: 183596 - DNA, 356 bp, Homo sapiens
ggtctagggctgtcaccaaggttaaggttagaagagagcctagatggactgtgaattgaatctttggctctccagatgaagaaactgaggcagggctaatgaagcccttgtctgtggacatcctgagtaattctcatcccacgtgtagtgttctttccattgtactatattatgtctctttacatattatctctgtaatatgacctccatattctgaagacttgtatttaatatttaataccaaatccctatctcacattcattctttctcatactattgagacttacaaaatcctacgtaagaacttttaataatattcagcaaaccattacttttccttctacaacataaggac

SEQ ID NO: 183597 - DNA, 318 bp, Homo sapiens
ttctgggattataggcacaaaccagcctgactctttgcttgactctattgactaggctgtgagtttcctgaagccagggactctatcttttgtctctgtattcttaggacagtgtttgacacacagtacattcttgatatatttctgttgaatgattgaataatacagccatgtgtagtaaagtggaatgaatttgagccttatgtcagatagacatagacttgggttcagttctagctgtgctacttattggtatgtgagcctaatatctccaaattacagttcctacatttataagatgggagataatgtttccct

SEQ ID NO: 183598 - DNA, 624 bp, Homo sapiens
atagacttaaccacttcaagccattctcttactcttttttttagtgaattcttcagtcacctgtgaatactaagatattactatagatatatatatgtatatatatgtgtgtatatagtacatatttgaatcttgcagagttaattttaattgtagttatttctatctcacaagacattttagacaaagaaatagtgttgtaattgttggttatgatactacaacccacaaacatgatttaagtaagtagaagagtttaattagtgtattattgaaataaaaagaacagacatccattcccaaagccatcccctgtacttttttattacttggaaatgttaaagtcttaaattccagtatgccattatcccatgtgttttgatagatgttaattttatatgtgggttaacagttgtgtgaattgatgctgctataaatttatcatgtccagcttcagctggactctcagtgctgggaattcctttgtgtattcttggtcgacccctgcagtttaccacaatggctctttagcctctatatactcttacttctctctcagctgatgatcttgtcacctgcagaacagtgaaaatttaggctattgaaagtgaatattccacagca

SEQ ID NO: 183599 - DNA, 422 bp, Homo sapiens
tgtgagaatgttgggggtaattggttaaagtaagattgtttcataaaatgcagtaagtgtaattctgatgttttcggttgagcagaaactagatcaccagatttggtatggttttaaagatgttcttttctgttgtgaaaaacagaccttgagcaatgaaagcaaagagttgaccccagtgctctcagctgtaaggaggatttcacctaaatgtagcgtaattgttcctgttaaggagaaaaaaaggaattggtatctagagtgaggttgatcgcaagaaaatacgtatgcagttctgtgagtcagatgactttttttgtctagtattatccagaattatgtaagggacaccattgttggaaacaacgttattaggaatttcccttgagcatagtctaatcacttagcaaaataaatgggtt

SEQ ID NO: 183600 - DNA, 547 bp, Homo sapiens
aacggtttgcatattctgagcctataacatttatctttttaggttttaaagttgtcttttacatttaggtctttaatccactggaaatttttatgtttggcgtaaggcagggatacaaggtacaatttcatttttctcatgtggatattcacttgtctctccattctcctttcgccatttatctgcaatgtcttctgttttatattgcatttccaaacatgtgtgactacgattctaagccctttagtctgtttcactggttagtctattccacaccaatgccacactaaattttacttgccgtagtactgatatttggtagagcaggtcctcaaatctatcatctattctttccttctttattattattatttttttttttttgagacagagtattgctctgtggctcaggctggggtgcagtggcgcattctcagctcactgcaacctctgtctcctgggttcaagcgattctcctgcctcagcctcccaagtagctggggttacaggtgcccaccaccatgcccagtttttacattttttagga

SEQ ID NO: 183601 - DNA, 306 bp, Homo sapiens
cctgagaccagggaggttgaggctgcagtgagccgtgatggcactactacagcgtgagcaacagtgagaacccatttcaaaacaaacaaaaaaacttaaacatcaacaaaaagaacccaattttaaaatgggcaaaggcgtgagccaccgcgcctggcctccaaagttttttttttaaagttattatatgatcacgcaatcccacttaggatatacctaagagaaatgaactttgaaaatgtgaaatgtgaaatgtgaaagaagccagaccccaaagaccacatgttgtctgattccatttatatg

SEQ ID NO: 183602 - DNA, 279 bp, Homo sapiens
attgaaattaggtagcatgagttctccacttttttcttctgtgttgtgttgactatttgatatagtttggatgtttgtccttgcccaaatctcatgttgaattgtaatcccaatgctggaggtgaggtctggtaggaggtgattggatcatgggggcagattcttcatgggttggtgctgtcttggtgatagtgagttctcatgagatcaggtcatttaaaagtgtggcacctccccacaactctctgtcccttgttcctgctttttccatgtgaagtg

SEQ ID NO: 183603 - DNA, 370 bp, Homo sapiens
tgcaacatgataccctggtttaccaaggtcttcttggctcctagagaaaggatttgcgacaactttactgaattatgtttgcttaaagtgaactacaccttgatagcaatttaagattctcaacatgtaagatgttattagtattccataaaacttggatttatgagaaaccaaaaagtttaaagtattttagaagtatttttaaagctagtttcatatcctgcagcaagaaaaccataaatttctctctgacaaaggaatcagaatctgttaaaagcatttgtcagtgatacattaatattcacgatagctcatgcaatattgcttagtttttggtttgtttttccccccaagttgagactttgaatac

SEQ ID NO: 183604 - DNA, 174 bp, Homo sapiens
tatttccttctttcctgttcctcaccctgataacacttggtttattgatggcagttccaccaggcctaatcgccactcaccagcaaagggaggctatgctatagtatctttcacatctatcattgaggctaccactctgaccccctccaccacctcttcagcaagctaaactca

SEQ ID NO: 183605 - DNA, 168 bp, Homo sapiens
taagacaatcccccagcataattaccaaaaagtgtctcctttcacttttagtagtatctggttgtggacaacatattccatggtcaccccaattgttgctaatttattgaatctgaaagattctacacagtgccagggtaaagattttggattatgaatctaaataat

SEQ ID NO: 183606 - DNA, 444 bp, Homo sapiens
gaaatgatagaactgtaatgtgaccagttccccaccagactacttaagggtatatgtctgctgcttaaacttcaaaggccagctggcaagccaaagccatcatgcctagcagaggagcaggtcctgagaacccaaacattgcagggcatagctgggaacataccaaggaaaacagtgtcattgcatatacgcagtaggcaaagagccaaaaaattagcttactagcaacttaaatatgggaggtggggtggatttctagagctgtcctgatgctgcccaggagtgtcttgtctgtaagtcctaataaactcatctacttgccaagatagacctgtccgagtcattctttggtctctccgctccctcctagtttaatcctgggtttttctcataacaggacagagtgccatattttgccagaggtcagatctcaagcaccaacaa

SEQ ID NO: 183607 - DNA, 359 bp, Homo sapiens
atacctggcagggtggtccattgccatgagtgtgcaggtaactagttccagccctccccagcaaattccatccagatccaatcttagcaggatagagcacctctccttctcttggctcgtccagtattccatagcagcaccattcggtataagaacctagacttgggaagattacagtttgtttccccagagagattcaggaagtctgttgtctgtcctttccaccctaccaagccccatcccacccccagtggactgtcatcagccccatcttgcatttaaatgtctgtcactgccttctcctatggaaaagtgacttatcaatgccaggtccaagcctggtgtctctcccatactgt

SEQ ID NO: 183608 - DNA, 369 bp, Homo sapiens
tagcccttgcagtggcacataaaagtgagctaattctggacgtgtttagttggtgagggggatgcagcagggtaatctccacaattaattgcagtggaaagaacaaggaggctggaatcacacagagactccagtttttaccacatatccatgtgggctcatttctaagccagttttcctgatctgttaacaagcctccataaagcagctctgtaaaaacgggtggaggaggagatctagcacacctacttatgtgggggccaaggtatcttgttaagtgaaagattcactactgatgggataaagggtcagtatgtaaggaccacataagtggggtctgaatcccagttggagcggacctgaaacaag

SEQ ID NO: 183609 - DNA, 277 bp, Homo sapiens
cctactccatgctcctcatagcacacaccagcttctcatgcactgtgtgatctgcttctgttatgtttatggtctgtttgtccccactagaacatacgctccatgagatcagggatttctttctgtgtttttctctactgtattcccagcatctggcacccaacatggcacacagaaggctcccaacgagcactgctggaggaaaccaaagtagagaggaatatcttccgattatcccctgtcccctgcctccagcaaggcagagaattcaagaaca

SEQ ID NO: 183610 - DNA, 459 bp, Homo sapiens
cccaacacacaaataaattatgtgatacctaaattcccacatcacattcatcaatcaattcagcttcaaatcagtggctaccaaaggcagagtggtgggagagtactgctctcctgtgggtacaaaacaggtgtattttctgtagagaattttgaaacaataataaagatgactgaaaggtatacgcttgttatcctacacttagaaattctaaagcgtgtaagtgataaaatactcctcactacttccaccatttcaaggctcagcccctgctctcaagatatgaatgaacctaggcatggaacagggcattatgtttggggtgtgtgtgtgtgtgtgtgtgtgtgtgtgtgtgtgtgtgtgtgtgtggtttttttttttttttttttcttttttgagaccgagtctcactgtctcccaggctggagtgcagtggtgcaaactcagctcactgcaacc

SEQ ID NO: 183611 - DNA, 161 bp, Homo sapiens
attgcgcccggcctatctcattatttctgtggtttgggactctgagagtggtttaattagacagttttggctctgaggctctcatgagattgcagtcaagatgtaggctggggctgcagtcaatctgaaggcttgactaggcctggaagacccacctccaa

SEQ ID NO: 183612 - DNA, 517 bp, Homo sapiens
aataaggtgacagatatgcccaatttgatcattacacattgaatacatctatagaagtatcactgtatgccataaatatgtcaattaaaactaaatatatatatacatatataaagaggagaaaatcaacaatatggttaaacagaaaaaaggctctgcatattaaaaaagatacacaaatatgagttttacactttgttttaaaagacttgaattctagcattgaaatctagttttcttgcttgaaataaagataactgctttatgaatagaatattccaacaatgagtgcactgtcaattgcccagagtcaattaagtgcctgataagagtaacatttaggggccaggcacggtggctcacgcctgtaatcccactacttggggggccgaggcaggagaatcacttgaatccaggaggcagaggttgcggtgagccaagatcgtgccattgcactccagcctgggcaacaagagtgaaactccatctcaaaaaaaaaaaaaaaaagaagagtaac

SEQ ID NO: 183613 - DNA, 446 bp, Homo sapiens
cataaaccaaggaaagcatcagctccgtggtacactaaccatttgcaaataatagttcttcctataaaagtttgctctctctttttgaaggaaatttctgggcaaacaacattttgagaaagaaattcagatatgggaaagtaaagatcatggggagcaggaggctttaagaaacctggcttgtgcatgtggtttacacatgttgaaaagtatgaagattaatgaagccaagagcatagaagatagaacaatatcagatttgaattacagctgagttacccacttgggagtcagttttagattggagctggtatgagggaatagggccaaaatatgaaatcttgggtaatcaaaagctaaaataagattcatggatttatgaattgtgttttattttgaataaatgcttatctaacttcctttatgacacctgggggatcctctag

SEQ ID NO: 183614 - DNA, 367 bp, Homo sapiens
cctgaggtctcttccccgcccttgcttgggtgggtgcagtgagtggaatgtgtagtccctgatgcaccatctccggcccttacagtttatggctcctcactgggctgtgtccagcaacatctatcctgctgtttcccctactctgggccgtccctgctcttgccgctttcctggggagtgggtgaggactgagggacactcagccccagcctggggacccagggacgaggagacacctcgggagggctgggtcacttcaggcaattaccttcacctctctaagcctcttgaaaatgggcagaatgatccctaggtgtcagaggtatggagagcatcatgggagatgacatccctgaagtgaggcaca

SEQ ID NO: 183615 - DNA, 170 bp, Homo sapiens
accgcgcctggctcttgttctcttttgaaagaagttgagaaaagttccaagaggtggaaggggcacgaggaatgactgctgcgagctgacagtggctgtgcagccgacagcagcctcacaccagtggactcatcctgaggctggagattggctttctccagctcagttgt

SEQ ID NO: 183616 - DNA, 346 bp, Homo sapiens
aaatgaaaagaataatgttttgtgatgtgtaaaaattacatgaaattcaaatttcagtgtccataaaaaaagttttattggagcacagctatactcatttgtttgtttatgtatgtccatggctattttcacactagaaggtcaaagtgagtagttgtgcatgcctcaaatatttactgtttgttcctttagaaaaaattagctgatccctgaatgagactcttggttttctgtcaccatagtaatgctcttttttttttttttttttttttaaaaacggggtcccattttgaccctaaggggggggtgcaaaagggcattttgggcacacggaaatttcggcccc

SEQ ID NO: 183617 - DNA, 450 bp, Homo sapiens
tatcataatttgagtacccaagatcctaaaattccttgtccaaatagctccaagacactttcatgagtattctaccataaagacatgtgcacacatgaatgttcactgcagcactgttcacaatagcaaagacatgaaatcaacctaaatccccatccgtgacagactggataaagaaaatgtggtacatatataccatgtaatattatgcagccataataaagaacaagatcatgtcttttgtgagaacacagatggagctggaagctatcatccttagcaaactaatgcaggaacagaaaaccaaatactgtatgttctcacttataagtgggagctaaacattgtactcacagacataacaatggtaacacagacgctggggactactagacaggggagggaaagaggagcaagggctgaaaaattgttgggtactacgctttggca

SEQ ID NO: 183618 - DNA, 189 bp, Homo sapiens
cttctaagagtagactaaaaagaaaccatgtctgaggctttttctaagagaacagattggtccatgtcttagtccattttctgctgctgtaactgaataccttagactgagtaatttataaaatataaatattcctaacagttctagaagcttggaagtccaaggtctagggagtgtaccttgagagag

SEQ ID NO: 183619 - DNA, 161 bp, Homo sapiens
actcatagtaaacagaaacactgattactatttatcataaactgtgatgtacacagagggtgggagaaagggagacagaggttgtgtgagagctaaacagtatattattattgcgttttcttctttttacattttgtttttcctaaaacgaattgtttgcc

SEQ ID NO: 183620 - DNA, 638 bp, Homo sapiens
gtggggaattctcagaacctttacttaaaagggaaagaccttccagcactttccttaaccctcctgagccttggtttctctatctatataatgggcgtcataacacccctcaaaggtaagaattacctgagttggagaggtgatgccacggtaaataggattgctaataaaatgagacaagtaaatagtaatgctgacatgctggttactggtattttgactgttttcatttcagaggaggaaaaaggacaaaattgcagttccaaggaattatagtgagttgctcaaggcaagggtgactaagccagccctgaaatggggcctcaggctgccctcggctagacaacaccatgggtaatattgcagcctacatttcttctttttgtcagcaacatgatagaatctcttttttgcctggccagttcatggggccctgcaattcagaggaccagtggcacacagcaaacacaaagccacgaggtgtactggggtgcagccaaagacagttgccacataaaataaaggatacgcagtaaatctgaatatcagataagcaaccaataattttcatttgctaaatatagtaaccttagaccaacaagagtacaacgttccggtggagtacaacctgccggtgg

SEQ ID NO: 183621 - DNA, 918 bp, Homo sapiens
tctggagtcataatgcatggatagttgaaaagttgatactctttggaaaggtggggctatggccctagccagcacatgaaatcattctctttatttgtacaataagattgtctcatagcattaataatgatgaagtatgcttgattactagagcaaatataatataaaaggatacttctaaatttttactctgtgaatttcagtttctgtgacactcacatttgaagagggtgaacatcaatcagtctactccttgacatacactactataaatagccttggctaaaccgtaaaagaaaaatgaaggccgggtatggtggttcacgcctgtaatcccagcactttgggaggccgaggcaggcgcatcacccgaggtcaggagttcaagatcagcctggccaacatggcaaaaccccatctctaataaaatacaaaaattagccaggcatggtggcacatgcctgtaatcccagctattcgggaggctgaggcatgagaatcgcttgaacccgggaggcagaggttgcagtgagctgagatcatgccactgcactccagcctgggtgacagagcaagacttcgtctcaaaattgccaaagttaaggggatcaacctccctcagagattttgaaaaaatgtataatcattgtattttactaaatataggaacattatggtatgtaacactacatttacattaaatttaagacaaaacatgaagctaaaaagaattctagcttgggaccaagtttttaaggcaattgttcactcctctctgctactaaccatacttttgtggaaaagtttgaggtagagtgactttgatgactattcaagattggtatattaatacctctactagttacaaagatgaatggtggtgatggttacaacataatggatgtatttaataccact

SEQ ID NO: 183622 - DNA, 483 bp, Homo sapiens
gagtacaatggtgggatcattaacccggacagggacaattggaggaggctcatggcttttgagagagagagagagagagagagtgtgtgtgtgtgtgtgtgttatcatgccactgcactccagcctgggtgacagagcaagacttcgtctcaaaattgccaaagttaaggggatcaacctccctcagagattttgaaaaaatgtataatcattgtattttactaaatataggaacattatggtatgtaacactacatttacattaaatttaagacaaaacatgaagctaaaaagaattctagcttgggaccaagtttttaaggcaattgttcactcctctctgctactaaccatacttttgtggaaaagtttgaggtagagtgactttgatgactattcaagattggtatattaatacctctactagttacaaagatgaatggtggtgatggttacaacataatggatgtatttaataccact

SEQ ID NO: 183623 - DNA, 569 bp, Homo sapiens
ccaacccccacaaaaggtacagtaaatatatggtattgtagtcttgtgagacccctgtagcatatgcagtctgtcgttgactgaaacatcgttatgttgtgcatgacggtattagaaattatagaggttttactttctctaaatttacaacatagcttataaatagaaaatatttgttataacatctaaaaaatgtacataagccatgtatgaactctcagtgtatatgactaggggtaggttctttattcttcattgagaaaaattttatatgattttttttaatgaaataagtatggcataggatcctcttttcccttcttaactctggtaaatttctgtgagtagtgaaagatctattcactattggaagatctattcccaggatgctaagtgggaattttcctgtaggtactaagcactgcacaccctaaagagaaagctatcaatcatggagccagacacctagttcggggtttacaaggaggcagtgtgaatcctgccctgcccctgtcagctacctctccacataggcagaacattggttagtgctggagaaggacagggaa

SEQ ID NO: 183624 - DNA, 150 bp, Homo sapiens
cacaaggaacagcttactttttgccagatttcttaattccacctgtggccaagggccccttccccgcggccttcgcttttagctcctcgagtttcttctgctcctctttttgtttctgcttgaaagccttatcttcctcgtcatctcctt

SEQ ID NO: 183625 - DNA, 150 bp, Homo sapiens
cacaaggaacagcttactttttgccagatttcttaattccacctgtggccaagggccccttccccgcggccttcgcttttagctcctctttttgtttctgcttgaaagccttatcttctcgtccaacaatgggtgatccttagagtcgac

SEQ ID NO: 183626 - DNA, 591 bp, Homo sapiens
acaggtggagatatctgggggtggccatgttgggcagatctagtttttaatccacattagcatatcagtacttgctagcctagcccttcaagccgtttttctgctagaaaataaacatttctggagctgcttttattacaagaaaaaaacagcttgccaaagaccccttatcctatcgcctaaaataatttctgaataactcctataataggggcatgcacctgtaatcccagctactggggaagctgaggcaggagaatcgcttgaacctgggaggcagagtgtgcagtaagcccagataatgccactgcactccatactgggcaagagagtgagacttcgtctctctctatatatatatgtgtaataaaataaattcctctcaaagttaattcagccaacacccaggaataaacaaggacagcttggaggttagaagcaagatagagtcccttaggtcagatctctttcactgtcatgattttttcactgttataatttttgcaggagtggtttcaagacagagggaagagaattagtaattagtgaacttgaaaatagatcaatagaaattatccagtgtgcaaaaca

SEQ ID NO: 183627 - DNA, 263 bp, Homo sapiens
atccctcaatttataccaccaatctgactgtcttacatattcatttatccctgtagtttcattctttgctcatttaatacatgagcaagactgacatacaacacataaaatgagaacatctcaatatcatggttttttttgtttttttgtttttttttttttttttggagacaaagtctcactcagtcaggctggagtgcagtggcatgatttcagctcactgctacctccatctcctgtgctcaagcgatccacctgcctca

SEQ ID NO: 183628 - DNA, 459 bp, Homo sapiens
catactttgaagacagtggggggagatgggatatactgattgactttgaaagtctgagtcctttggcctggtaatggggtcaactaatccaggaccatatggattattaaaaagaggtatagaaataatgggaaaatgaaaggaaaagtggttgtcagaaagcaagcacatgtctgttactattacccggtacactcttgtgtttattgactggggtacagagtccaagtgagactcagagattccaaggaaaaaaatgcctgatgtcctctaaccttcagtccagagctctttctatcatgctgatttcttcacaatccttctgcttagtttcttctaaacctttctaataaaatcgtaggtcattttccattagagttgtaaaatagtagtaagtaatgaattcttagttgtattctactgctcattttcttgtgttaatcactgccttgcattaag

SEQ ID NO: 183629 - DNA, 469 bp, Homo sapiens
attttgtattttcattgcaaaatgccagcctcttaagtaactgtaactcatcatatgacaggtggaataaaatggctaccagtaatgcagagttaagctaggaaatagtttagcttttagtgttaattttacttcaaggaaattagagcattttatacatttataaccatcagtcttggctgaaatacttaatggaggcatgataacatatcttgtacctttatagatgttgtagctcaaaattatgtttaaaagttgcttttccaattaggagatcctaacttcgttggcaaagaaataatacacggtaaaacaaacaaaccaccaatataggcattatgaaagaggaaaaacttaataatcggcattgcaaatgggtaattatctaattatctacagaagaaaatgttaaatgacataataaacagaattagaaaaactgggcaagatacaaatattagcttttcag

SEQ ID NO: 183630 - DNA, 164 bp, Homo sapiens
ttgaattccgacaccagactcggaccgttcctgggactgggggaagccccatcgtcagtctatttatgacactcagtcgtaggaagctttgaccctggttggacaggaatgagctagagcacccaaagccactgggcatggtttcttgtgtgctgccctaggca

SEQ ID NO: 183631 - DNA, 343 bp, Homo sapiens
ctttgttgaatatagtgagttttcataaacttttgttgaatttgaaggtgtacctccaccagaaaacaggcagggtctgcaggaagagaaggatccatcctgcagaagcttcatacaaatgatgaacagtgtggcgagacatcaagatgtaggttttggctctctgtgataattcagctgatgggtgttgatttatacatatttgttagtttggtttatttattaaaagaggaacagaaagaaatatattagatcagggtacactttccttatgcctttcctgagacattcctgtcctttggcacttggactaatgacccatgtccccagcataatagccatg

SEQ ID NO: 183632 - DNA, 429 bp, Homo sapiens
tcagttcctcacttaggcacacaggattgttctcatgcttgaatgttcctttcagttttaaaattccatggtcttatgaaattaatgaaacgttcacatactaggaatctgaccattatccctagtttctatgctaacgactcaagagtgagaaatggggaaaattctaaccatttgtagcacataagaaggttttaactaaatttctactgatgctatccacccaggttcttaagggctggctgatcaggcttagattagctggaagcagcagtgtaaacagagagtccattggagggaaaagcatctgcaattgctttaaattccaacgcaatgagatggaattcccgcctagggtctttgccagcacaagaccagcaatgaactctgcagctctgggatccgtggcctcacacatgaagaacagca

SEQ ID NO: 183633 - DNA, 211 bp, Homo sapiens
tcacgtcagacgatgagcttcttgggagtccttgatctcatttctccctattctgatggacctttggcttctccttatcttatatatcccacagccaatatgggataaatatctcttaaggaccagagaccagggcagcaatccaccccttgctcaatgctcaaggtgcggaggtgtcagccccactgccaagcctggtctctggtcctta

SEQ ID NO: 183634 - DNA, 293 bp, Homo sapiens
acagggcaaaaaggcacaggcccaattcctgacatctcttatcttgttgagccacccagctccagatgtgcccagtggatgagctgaggcagcaagtgggctgtagttcaacttctgcccagtgctgcatcgctcccgccccacagctctcctcaatagcctcctgatgcaagtctcgacctcagagtgtttcccagggaatctgatctgcaacacccctcagttactattaacatgccaagtgcaggcctgttgctggcaagtggagaccagggtaactggtaacatccatg

SEQ ID NO: 183635 - DNA, 366 bp, Homo sapiens
tttgcagctcccatttgtatctggctgagacgaatgtgaactaaaaagaaaaacactcctgggcaagacggtgcaagggcctaagaattcccgagcgggagggggtggagcagctaccttggtataggactaacagggcccagcatcttgctgaggatggaagagtacagaggactggaggggtgggagtgtgcttggagaactgcctgccatatatgaaggaagccatggtcccaagagggagtgaaggccacatcatcctggaggagcagggaacatggggctcaaaggggaaagagcaaaacataaaggaagaatcctagagtgtcacaaatgccactctttccaagaggattcagtgtgata

SEQ ID NO: 183636 - DNA, 416 bp, Homo sapiens
tagcatagtaaaggactgactgcgtggttgtagctctgtagtttggtttcttctctgccactaatttggttatgtcagccttgccagattactaaacttgctgaaacatggcttgcttacctgtaaaatcgaggttaatagtaggttcatattgggttttgttttcaaatgcaagaaatcatccatgtaaagaaagtatttagcacagcttagggcatagactatgcactttacaatgttagagcaggtttctttatagtagtcttcgtcagacctggagacccaaacttttgtgtcccaagtagtgattctcagctttccaatatgaatagccccttgttaacataaagatctcactttttcttattagaatttgtacctttgtttgattaaggaaataaaagatgaatgacaaa

SEQ ID NO: 183637 - DNA, 379 bp, Homo sapiens
tctagagcgatccccagtactacctatgtagacattcactaacagccttctcaagttcttccagtttttactcactttccagctccaagcctcctccacattttaggcttttgttacagtagtatcccatttacagatactaaatctctattagtcacctattgctgtataaaaaattaccccaaaacttgagtagttaaagcaataagcacttattatcccacagtcttgttagtcaagaatttggggcatggtctaactaagtgattccagctcagcgtttctgataaggttgtaatcaagacatcacatggagctgcactcctctgaaggctcatctggtctggaagatccatctccaaaatacttacctacatgc

SEQ ID NO: 183638 - DNA, 402 bp, Homo sapiens
ttagagttagattgactgcccttcctttctttccttccatgtttacctcttaacatatacacatatgtagagagaatagtataaaccccttttctcaaccagtttcaacagtcaatcttgcttcatcatatccccgcagtcctagatatcctttaaccgttaaatagttcaatatgtatatcttaaagacttaaacaaaaggtaaacatgagtaccactatcacagaaaatgaataattccttaatactttcaaatatccagccagtgttaaaattgtcagaattctcattttttttcttaacaatttcaatcgatccacatgctatctatacagtgtgactcattttaattgatagtttcccctccatatttagttttctcttgtaatttatttatggatg

SEQ ID NO: 183639 - DNA, 596 bp, Homo sapiens
agctgctggttaaaaaacatatgttggcagagggaaaacggtttagctcaagaaaatttggcagaaagtgaaatgatagagcaatgattatctgcaaaggcagcataacgtaaaagatttggatgtgcataggcaggtgagaaggaaaataatttatacttcaaagagtttatacaatttttttaagaacagtaaaaataaaagaacaaatcattgaaataaatgatccaggatagcagataggctgaagcattaaagtatgtaaacgtctaaatcaaaatataataaaacagcatgggaaaaccaatgtgtgtgtgtgtgtgtgtgtatgtgtgtaatacacacagacacatacataaatgcacattgtttatatataaacacattttggtgataagataaaaatgtgaatgtttaaatacataatatatcaatatattttatgatacatctgggaagaaagaataaatataaaaatatgtattagatataaaaatacttgaaaagtttaaagtactgcaaatgtgattcttccccattcctcacatgatgaagtcaaagaaggaagagagttatattttctccactgtcatttc

SEQ ID NO: 183640 - DNA, 489 bp, Homo sapiens
tgactccctcatcctgccacacacacccccacgccaccccgcagctctgaaacggcttttctttcttagccagccgcacgctgttgccattccaggctcgtgtgggagaagattgttgtgcgcctgggtctgtccgcccgggcggctccagcctctggtttataaaaggtgcagatggttaaaacacaaacgtgtgacgtcagggtcggtttttaaaagtctcttctacccactacatcagttgtgtctcttgggatggactttagagaatcgattcgagcctaatggcagtctagagaaatggagatcttcgtcaggactatcagattattgtaatgctgcacttataacaaaaaacttagatttagccacgcaaaaaaaaaaaaaaaaagaaaatagagtgcaagataaaaaaacacacctgattaactgatagtacgacccttccaatattctttgagatatccatgctatggttccattgaaaca

SEQ ID NO: 183641 - DNA, 593 bp, Homo sapiens
agaggaccccgaacaatcacttagcgggggaacatcacttagcggggaacaatcacttataaatgagtcagataggtgatggggctcaggacacactaccccaaaatatgactgcaggagactagaacatgtcacctcaggatctatttctttggcatatattgagctgattattctgagaaactgcagacacaggagcagctctgaaaagctgccctttgatacaataaattgaaatctacaggttgattatcccaaatgtgaaaatccaaaatctgaaactttttgaacacagacatgatgctcaaaggaaatgctcattggagcattctggattttggatttttggattagagatgctgaaccagtaagtagaatgcagtatttcaaaatctgaaaaaaagatccaaaatctgaaacacttccggtcccaagcatttcagagaagagatacttgatctgtgtaaaggaaagtgactatcataggaccctcatcaaccagtgaagttttttttttttggagacggagtctcattctgtggcccaggctggcgtacagtggtgtgatctcagctcactgtaacctctgcctc

SEQ ID NO: 183642 - DNA, 489 bp, Homo sapiens
atgttgctcaggctagtctcaaactccttggtttaagccattttcgaatctcagcctctgtatctctgtgctccctgtaacctgggattacaggtgtataccgccatgcccaatttcatcctacaccctttactcatacacttttgatcaaaaaactcaactcttgacccatttttcagtctgaccacccatggtgagtgacagccagttctgagccaactcagaactgtcttttaggtccaagagacataatactcttaggtccaagtattagctcttcattatttctgtcctcagaatattacttccaaagacaaagcagagccaaaacaaaaataaatttagacagctagaaatagataaaggtagaaatacattctgtttctggcagcaaatatgcttaaagtcatcctgccatgattaccaccctcctataccgacaagaattctggccaattcctaaggtgtttttgccttgggaaaaggtgg

SEQ ID NO: 183643 - DNA, 905 bp, Homo sapiens
  misc_feature (834)..(835): n is a, c, g, or t
  misc_feature (847)..(847): n is a, c, g, or t
  misc_feature (853)..(854): n is a, c, g, or t
  misc_feature (866)..(866): n is a, c, g, or t
  misc_feature (876)..(876): n is a, c, g, or t
cccagcggccttgggagctgaggaagcagtgggggagagggaggagcgggtgccaccttggcagtgtcgtgagtttcagctggagtccgccagccctctgcttcactgtcataggcagtggtcgccatgtgggaaggggcaaaaagaagccgaagctcagagaggaacaatggatctgtgtgtgattgatctacccatggccactcgctctggtgggaccctcgtgcttgtggggctgggctctgagatgaccaccgtacccctactgcatgcagccatccgggaggtggatatcaagggcgtgtttcgatactgcaacacgtggccagtggcgatttcgatgcttgcgtccaagtctgtgaatgtaaaacccctcgtcacccataggtttcctctggagaaagctctggaggcctttgaaacatttaaaaagggattggggttgaaaatcatgctcaagtgtgaccccagtgaccagaatctctgatgttaatgggctctgccctcatccccacagtctcgggatctcagggcacaatggatggacacgagtgggctctgatgcagaactttctcttttgaatgttaagaataactaatacaattcattgtgaacagaagtccttaagcagaggaattggtgtgccttaaagatacaatctgcgatagtttgggggaacttgtagccagaatgccctgttcatgctgagcaaagttcagcaagtagagcagagtttggcaggcaggtgccaggaactccccttcttcctggagtgcttcttggggaaggaatctggccctgggtttcctggttccctgtactggccgggggannggggggtttaanaaatcnnggatatgcccanggtttgaatngccccgggggggggcgggtcccctaaccg

SEQ ID NO: 183644 - DNA, 255 bp, Homo sapiens
aagtctaaatgctatttgttgcttttatttcaatttaggcaaatcacaccgataaacagtgttatctattttttaaactatacaaattagtaatacattcttgtaaaaaatttcggcacagataaaatgaaatgttccctttgagcaccctacacaatcccaccccctttgggcaaagttaccaataaaattttgatgtacagatgctcaatttgtaacacagctgcatccagataatcctatcgtaaatataat

SEQ ID NO: 183645 - DNA, 235 bp, Homo sapiens
gaacagtacctttagagaacaatttgcaagattcataaagttaaatctgcatttactactcaactgatgacaattccacttattggtatatagcctagagaaatgctcatatgtatacacaaggcagtttgtgaaagtatattcaatgggatgatgtttgcagtaccaaattatggggaacagcctaaaccactatcatcactgtgtaaataaaatacagtctagtcataaaatg

SEQ ID NO: 183646 - DNA, 223 bp, Homo sapiens
atggtaaataaatatatgagaaattactctccatcttgcttctaataaatgcacattaaaccaactataaaatgccaattgttttgcctaagaagtgggcaaagtaaaggagtcaatgaaaatgcagagaaatgacactcttttatgctgtgggaagtgtaaactttcttttcttttttttttcctttttttttttttttttttaaggcagacagttctcagt

SEQ ID NO: 183647 - DNA, 711 bp, Homo sapiens
gaagatcccctggcttgatgtcctgctagaatccaggcaggtctgctgatccttgaccaccaaaaacaagcatccctcaccaccaaaaacaagcatgttacacgggatgtttacattatgctgttaatggaaaaaaacatagtaaatactgggtaaagaaaaccattaagcctacacacatacacacacacacgacttgccattgttatactctatcaaatctacatgaacactgtatcagtgaacactaaaccactgttcctaggggaaatgcagacgtaggttccttctagcctaacatcttcctcaactgatcaatacataattttgttttatgtatgcttctgttcagacatcatcttcaatatatattgctgattcactaacactgaactcacagctgacagcactgtaactcatgactgaagggaacttatctaacatgtacattttctccataaggcacattacggccttcttgcatttaaggaatactagactgcactttaacattatgcttgtgggccattttaaacagtgaaatcaccaacaaaaagcacaaaatgaaaacttataaaacatagagaacatcacagcaacactgacagtaatttctttccaaaggagacatgctgttttttccctgacaatgaagagttgttcctacccacagaccaatgaatcatccaacagtaatactgggatggccat

SEQ ID NO: 183648 - DNA, 356 bp, Homo sapiens
tgaatctgtaattatctcaaaataaaaatttttttcaaaatttcaaaacaactagtctagagctttgttaatcaaagttttctctgaggacctgtagcattttggttatcacctggatcttattaaaatgtagattctcaggctgcatattggaattcctgaattggaatccgcattttaacaagatttccaagtgattcatgtttaaagtttgagaagcactagtctacaacaatgacttttaacctttcaacctactctaacacacttgaaggccataacaaaattcacatcaataacagttgctcggttggacagtgactctcaacacaaatgagtgaggaaaggtggggact

SEQ ID NO: 183649 - DNA, 366 bp, Homo sapiens
tacaatgaatggtcagtctatcatgtaagataagatacatgtgtaatagcttgcactgtgtgatagaacccatcacatgcacagatggcttcatgcctgttatcccacacattgtggcgacggccaccacagagggaagatcacttgagcccaggagtttgaatctagtctggcctagacaatataacaagaccttgtctctttatttattttttatctttatttttaaaagtcttgatttaataagacttcaatgatcagttcaacttgaatttttaccatttaaaatgttaagacgtagtaaaagagaaaaatagaaaaagtcacttgacataaaagtataacttacgaggaattgtatataca

SEQ ID NO: 183650 - DNA, 420 bp, Homo sapiens
gtattttataggtttcatgcgctcgttgtaatagctaagattatatgcttatggagactacaagtaaatttaaaaagcacattatttgtgattttctatctgactttctaataaaaacatttagcacatacattttgccatgagagatcatttttgactatgaaatcaaatattgcttgaatttcaaaagtgtattgaatgtcagaaattcagcattttacaatttctcctatgttagagtgcatgtaagttcatcaacattttcatatatgaacacttgagatcagggtataagattctgagaccagtgagcttcaacctcataccccgcctcctgcaactggactgttcatgtatgtcacagacttcattatttacgtcttttatcacatatactgattcttggggaagaaagtgaga

SEQ ID NO: 183651 - DNA, 115 bp, Homo sapiens
aggcgtcatgctctttctccaaggctgcagttatttatctgcttgagctcttgttttttcccttgctttaaagtgaaatgcgcaaacactcccacttcaaagggaaaaatcctca

SEQ ID NO: 183652 - DNA, 273 bp, Homo sapiens
taccaagagcagtatttatttagaaaacagtctagttagatcgaaggccagtgcaactacaacattatctggaagacatatgggcaactgagaggagacacactgggaattgataatcttcgggttgggctagactaatggaggtgaaacagcagtgttgtgaaccagctcattgctttgtgacaactcagtgctatatgttatgctactataatatctaaggccacatcctcttttagacacctacctaagtaattcccaatagttgatggt

SEQ ID NO: 183653 - DNA, 362 bp, Homo sapiens
ttaaaagtagccaggtatgctggcatgagcctgtagtcccagctacttgggagactgaggcaggaggatcccctgaatccaggagttcaaggttgcccagcagctatgatttagccactgcactccagccttggtgactgagaccctgtcttaaaaaaaaaaaaaagaatcagcagtcatgttattataattgataaataaacttagcaaagtctctggttataagatcaatatataaaaataagttacattttatatccactaattaaaaaattagaaaatagaaattttagtctataccatttacaataaattcagaaacaccaaatatataagaataaacctatcaaaatatgtacaag

SEQ ID NO: 183654 - DNA, 851 bp, Homo sapiens
ctggcctcaacccgccttggcatcctaaagtgctgggattacaggcatgggccaccgtgtccagccaacaaagctttttttcagtgagtgattccagcccttgatgcataggagggtggggtccataggagtgtagccttaactgatgaattaaatctctgggtgatgtgagatatgtgccaggttcttggcttatgtctccctctagtactttaggaacttcccaactagatggaggcagtaaaaatgggccctgccaggatgtacctataacagagacgttcaaccatacccttgtgctgtctgcctttaatcacgaagattatgagctaagattcgtggatgcatttttattttttaaccaacatgtagcaatgatcactcagataggcatcttaaatccattagtttgggttggatttaagaccgttgtcattcctatgaaagggaagatagcccagattgctattgagaaggctttgtcagatgcattccagaaactgttgattgtggttctaggtaaaactttcttaatcgtcgttgaagtacttcagtttcagtgagcaaataaactcattttgaaaagttaattggataaaaatatcgatatctaaaacactccctaggatgctttcatttgctaagttctttcacagcgacaggctcaaatttgttctttgtgacatttgtagaaaaaatgacagcaaatattgtccctagtttatagctataaaaggacttgcctcaggtcacacagaaaatgtttgaggcaggtcttctttaattgcatgcctatcgtacagaatagtgattataagccctggacacatggatttgagtcctaactctgt

SEQ ID NO: 183655 - DNA, 383 bp, Homo sapiens
cttttcccagcccctaaagtaagtgctatcctgaacttgtttccatcttttctttttaaaataccacgaaatatgattgtttgatttgaatttcataatcatgtttgtaggctttttaaagcttgcacatatggtattttattatagaagaaaatctgatttacaaatctttatacatttcaaggaaaacatttaaacatcataaaagatgtttgagcagacataaaaatagacagaaatatctcagtaggcaaattcaaatttataaccagaaaataattgtggagacttatttttggactctgtagttattgctgtatcatagacaagtaaacatttctgtacactagtttctttattgtgtgcagaaatgtttccataag

SEQ ID NO: 183656 - DNA, 290 bp, Homo sapiens
aatattataaaactaattaggtctcagtcaggaggaaaaccaaatgctcaagtagagttaaaaccagaagcaatgtaaaagacttttttctttttttcagacttctaaataagtaaatgatttcaaaaggcaatttaaaagactgacagtactgtcacagttggataatcccatctatgaggttgcattcttttcccccacttcaaagttctctgcaattatccttcccacaatgaaaatgcctctcctcctaagatgaattgatttaatcaatgtttaaggccacttaa

SEQ ID NO: 183657 - DNA, 1847 bp, Homo sapiens
gtcagggatcctagggggttccgtgactctccccctaaacatctcagtagacacagagattgagaacgtcatctggattggtcccaaaaatgctcttgctttcgcacgtcccaaagaaaatgtaaccattatggtcaaaagctacctgggccgactagacatcaccaagtggagttactccctgtgcatcagcaatctgactctgaatgatgcaggatcctacaaagcccagataaaccaaaggaattttgaagtcaccactgaggaggaattcaccctgttcgtctatgagcagctgcaggagccccaagtcaccatgaagtctgtgaaggtgtctgagaacttctcctgtaacatcactctaatgtgctccgtgaagggggcagagaaaagtgttctgtacagctggaccccaagggaaccccatgcttctgagtccaatggaggctccattcttaccgtctcccgaacaccatgtgacccagacctgccatacatctgcacagcccagaaccccgtcagccagagaagctccctccctgtccatgttgggcagttctgtacagatccaggagcctccagaggaggaacaacgggggagactgtggtaggggtcctgggagagccagtcaccctgccacttgcactcccagcctgccgggacacagagaaggttgtctggttgtttaacacatccatcattagcaaagagagggaagaagcagcaacggcagatccactcattaaatccagggatccttacaagaacagggtgtgggtctccagccaggactgctccctgaagatcagccagctgaagatagaggacgccggcccctaccatgcctacgtgtgctcagaggcctccagcgtcaccagcatgacacatgtcaccctgctcatctaccgacctgagagaaacacaaagctttggattgggttgttcctgatggtttgccttctgtgcgttgggatcttcagctggtgcatttggaagcgaaaaggacggtgttcagtcccagccttctgttccagccaagctgaggccccagcggatacaccaggatatgagaagctggacactcccctcagacagcccatcagtggaagatatgaggtatttgaccaggtcactcaggagggcgctggacatgacccagcccctgagggccaagcagactatgatcccgtcactccatatgtcacggaagttgagtctgtggttggagagaacaccatgtatgcacaagtgttcaacttacagggaaagaccccagtttctcagaaggaagagagctcagccacaatctactgctccatacggaaacctcaggtggtgccaccaccacaacagaatgatcttgagattcctgaaagtcctacctatgaaaatttcacctgaaaggaaaagcagctgctgcctctctcctgggaccgtggggttggaaagtcagctggacctcatggggcctggggctcacagacagaagcacctcagaatttccttcagtgcctcagagatgcctggatgtggcccctccccctccttctcacccttaaggactcccaaacccattaatagttcagacacaggctccttcttggagcctatgggcttcagatgtctttgccccatttgtcacctcgcacacttatagcgtttcctcctcgaaattctaccaagactggtcaaatgttgctgaggggcctggaccagctgtcctttacaccaccttctcaacactgctgaaaagaacccaagagaattgtcacacatgacacaagatgtacataatatcatgctcactgcagtgttatttaaaataaaaggcaggaaataaacaaaa

SEQ ID NO: 183658 - DNA, 2118 bp, Homo sapiens
gtcagggatcctagggggttccgtgactctccccctaaacatctcagtagacacagagattgagaacgtcatctggattggtcccaaaaatgctcttgctttcgcacgtcccaaagaaaatgtaaccattatggtcaaaagctacctgggccgactagacatcaccaagtggagttactccctgtgcatcagcaatctgactctgaatgatgcaggatcctacaaagcccagataaaccaaaggaattttgaagtcaccactgaggaggaattcaccctgttcgtctatgagcagctgcaggagccccaagtcaccatgaagtctgtgaaggtgtctgagaacttctcctgtaacatcactctaatgtgctccgtgaagggggcagagaaaagtgttctgtacagctggaccccaagggaaccccatgcttctgagtccaatggaggctccattcttaccgtctcccgaacaccatgtgacccagacctgccatacatctgcacagcccagaaccccgtcagccagagaagctccctccctgtccatgttgggcagttctgtacagatccaggagcctccagaggaggaacaacgggggagactgtggtaggggtcctgggagagccagtcaccctgccacttgcactcccagcctgccgggacacagagaaggttgtctggttgtttaacacatccatcattagcaaagagagggaagaagcagcaacggcagatccactcattaaatccagggatccttacaagaacagggtgtgggtctccagccaggactgctccctgaagatcagccagctgaagatagaggacgccggcccctaccatgcctacgtgtgctcagaggcctccagcgtcaccagcatgacacatgtcaccctgctcatctaccgcaggctgaggaagcccaaaatcacgtggagcctcaggcacagtgaggatggcatctgcaggatcagcctgacctgctccgtggaggacgggggaaacactgtcatgtacacatggaccccgctgcagaaggaagctgttgtgtcccaaggggaatcacacctcaatgtctcatggagaagcagtgaaaatcaccccatactcacatgcacatgcagcaaccctgtcagcaggagttcccagcagttttctttctgagaacatctgttcaggacctgagagaaacacaaagctttggattgggttgttcctgatggtttgccttctgtgcgttgggatcttcagctggtgcatttggaagcgaaaaggacggtgttcagtcccagccttctgttccagccaagctgaggccccagcggatacaccaggatatgagaagctggacactcccctcagacagcccatcagtggaagatatgaggtatttgaccaggtcactcaggagggcgctggacatgacccagcccctgagggccaagcagactatgatcccgtcactccatatgtcacggaagttgagtctgtggttggagagaacaccatgtatgcacaagtgttcaacttacagggaaagaccccagtttctcagaaggaagagagctcagccacaatctactgctccatacggaaacctcaggtggtgccaccaccacaacagaatgatcttgagattcctgaaagtcctacctatgaaaatttcacctgaaaggaaaagcagctgctgcctctctcctgggaccgtggggttggaaagtcagctggacctcatggggcctggggctcacagacagaagcacctcagaatttccttcagtgcctcagagatgcctggatgtggcccctccccctccttctcacccttaaggactcccaaacccattaatagttcagacacaggctccttcttggagcctatgggcttcagatgtctttgccccatttgtcacctcgcacacttatagcgtttcctcctcgaaattctaccaagactggtcaaatgttgctgaggggcctggaccagctgtcctttacaccaccttctcaacactgctgaaaagaacccaagagaattgtcacacatgacacaagatgtacataatatcatgctcactgcagtgttatttaaaataaaaggcaggaaataaacaaaa

SEQ ID NO: 183659 - DNA, 127 bp, Homo sapiens
gtacccgttagacatccaagaggaattgtcaggtaggagctacatttatgagtctggcattccagagagaggtcagggctggagataaagataaataaagattttggaatcaataacgtataggtct

SEQ ID NO: 183660 - DNA, 229 bp, Homo sapiens
tgctttttcctttggtccagctcggtccagcccagccatgctctgctctgcaaatatatttctcacgcatattctggcacagggaaatagtgactctaagtggaaacacccagcccccaacaggtccgacctcatggactcctaggggaagtcaggcaacagaggccagtcgaggtaggtgactttgcaaataactcacggccccagacctcaaataactggctgtttg

SEQ ID NO: 183661 - DNA, 335 bp, Homo sapiens
ttgaccacagcatcaaaggcctttatctggggcgctttcgcatttacatggggtgtatagtgatatgatagattttctttcttttccacctctttttctcatgtggctccccctccctgcccccgttcacgataaccggtgcctgctccacacacaaacaaatccaggcacccaaaagaagaaaaagaaaaagaaaaagaaaaaaaatttgagtttgaggattaagatcttcatttttttttttttttttgcttgtgcattccaattgttcttaaaatatttggcaatgtcaattagtaactgagcagagttagctgatgaacacaattttccag

SEQ ID NO: 183662 - DNA, 815 bp, Homo sapiens
gtaaaatacaatatttccatggtatttagatcttggggataaaaaaggacaaatgatttcaaattagggccgtcatggaacatctgagatgtatagctggtctcgagctcctgacctcaggtggtccgcccacctcggcctcccaaagtgctgagattactggcgtgagccactacgcctgcctggcccctctttgccttctcttacactacttcttcaccctggaattcccttcctacctcattgccacattataacatttctctctttcattggcctagctccaagctgtctgtaagctgtctacttaataccgtaactggaacagatctttgcctctgaacttccctagactgttattgacgtccctgacttgaattttaattattggggtacatttgttatctcctctgctgatctgtacatttttttaaatcaggaagtatttagttgaaaacaagaactaaattatcttctttcactcagtcactcaaacgtgcctcatattgtctctgagcagggcccagtgctaggtgagtgctggggatagagcaatgaacaacacacaacctctgcctcaggaagctcagtctgtggtggggaagctgaaaaagaagcaggcacggtgcttccccacagtgttcgccttgaggtattacagttcacagctagttgaataagtgaacgacttcctccagccctcagagcctcctgtctggccttcccccagctctgcttagccactctgcctggtcaagtgcctgaaacagagccaggaccttccactcatccacgccaccaatgtgggagagcag

SEQ ID NO: 183663 - DNA, 152 bp, Homo sapiens
aaattagggccgtcatggaacatctgagatgtatagctggtatgattatatctttgggaaagatgacctcaggccagagcctcctcttgcccctgagtgagcaaggaaatatcaggtgaggctgcagagaaagcaggggcagatcataaagg

SEQ ID NO: 183664 - DNA, 453 bp, Homo sapiens
gttcaacagatgctgtcagaatagacgtcatagccttgttcctgatcttagataaaaaatgttccatgttccacctgtaagtatgatgttagctctgagagttttaaatatagatagccttcctcaggctgaagaagttccctttcgtttctattttgctgataatttgtatcatggatggacactgaatttcgtcataccctttgtctgcatttattgagatgatcatactattagctccttgagtctgatcattgatttcacatctttcttctttactaatatatgcatttagagcactaaacttccataagtcgtgctttagtagcatcctaaaaacttttgtgctaggttgttgtcttgttctattcaagctgctatattaaaatgccatcaactggctggcttataaacaatagaaattctcaccgttgtggaagctggggagtcaag

SEQ ID NO: 183665 - DNA, 274 bp, Homo sapiens
ttccccttgaaataatgacttcagcaccttgagcagtatgaactccaccaacattgccaggaaatgctttatatgtttcaggaataattagttgcttcaaatataacagagtcaaaggtttactgtaacctagggaaaataatattttgcaaaaatgcaaaaatgcaactaccctcaaaggtagtccaaataatatagttcatgagcaaagttttaaaggcttaagacaatagagtaaaattctgaagatcaagtacaatgcaaggtggtgaca

SEQ ID NO: 183666 - DNA, 549 bp, Homo sapiens
gggacatctgctctccaggtgggtccctctatataccgcctggctagagaatatagagttttcagagaacattcttttctgtgtagtgatacatgtggactacctcatctatggggtgtgtaagatgttttcctcaaggacatggaaaattaggttgactatggggtaagttttgtcctctaggattctaggagggagaggaccacctaataggtttgtttgccgggagttaagtttgaagagcctttggagaaagggaaaatgaggaacaaacattttctagggatgctgaatcaaatgttcaaaattgtaattccatatagctttaagactatataaccaattaccagctttctaatgagatgtggagggtagaaagggtgacaacacatacttgtttcaagtttatactgggatgaaaataggtatttgggttggttattcaaaatctgacatttgaaaaaattttaaaacagcagaatttggaaaatatagaaggaagagaaaatacattcaagaattgaggactagctcttaaggatgttctag

SEQ ID NO: 183667 - DNA, 340 bp, Homo sapiens
tgccaaaatcagaagaggagagagagaaggaagtaacaggagcgtggaggaaggaaagaaggaaagcagaggagaattcagtccactgggataatggaaaggcataagtgactgggaagcaggaggctgagaatccattccatgcttctgagcagttttctgtcaaataatccaggatagtattaatgtacttgtaagtctagggagaagactctggattgacctgctgcttctgttacatagtaattgtaactattaaactttgacgtcagtgtgatgatgaggattgttccctttgaaggcccagtgggtcggctgttcccttctcacctctgacctt

SEQ ID NO: 183668 - DNA, 322 bp, Homo sapiens
tcgagactcgcccccacgctcttgaacacacccaacatggtgaaaccccgtctctactaaaaaatacaaaaattagccaggcatgaggccaggcgcctgtagtcccagctactcgggaggctgaagcaggagaatcacttgaacccaggaggcagaggctgcagtgagccaagattgtgccactgcactccagactgggcaacagagtgagaccttgtcttggaaaaaaaaaaaagtgaaccagacatacttcctgcttacatgggttttgttgctgagtgagactcagggaagacaatttcagcaatttcaattcttggtg

SEQ ID NO: 183669 - DNA, 366 bp, Homo sapiens
aatgcatattagaaagcagggccttactttccctgaactgttacaatgcctagcccagagtactctggtaatagtgacttcatggagttttgtacacacacccatgtgagaaaggatacaagctaagctactcatccacacctcatgaaacctatgggagttagccctgactcatggttcatttacgaatacagaagccccagttaattaaattaacttggtctcccaatccatgatcttgagttttaattgataagtataaaataaatgacacacttgaaaatttctggattcacatcacaccaccagtacatggccttttccattaatgtccgcattgaccaacctttcatactatgttggttc

SEQ ID NO: 183670 - DNA, 348 bp, Homo sapiens
ccatgattctgaggcctccccagccatgtgaaattttaagtccaattaaacctcttttcttttccagtctcaggtatgtctttattagcagtgtgaaaatggactaatacacctggcaaaaatattttgagctcagattgggacatattgaatgtgcatgctctgagacaaatgtctcaagtaggcagttgcctatctaggtctggagctcaggtgagatatttgggcaagagatttaaattggaaagttattgggttatggacagcataaatgagattcattaagaagaaagcagccagtgagaagtggcctcggacctagacttgggaaatggggcagggaaggag

SEQ ID NO: 183671 - DNA, 171 bp, Homo sapiens
ggaggccagatgtacagcccacgggaaatgagggcaaatggcagctggcaagaggctgtgaccccctcttcagtgacatccccaacggagggaccagggagtgttcactctgatacctccaactgatcttgcccctcagggtcacaggggtgggggctctcacaaggcgac

SEQ ID NO: 183672 - DNA, 492 bp, Homo sapiens
actgggaagagccctttttggcagtgtagtttctcttttaatagctgtgatcagattatacctttaaatctctttaaacacttcccaccactgaagtctttggtttccttgatttgatagtttttaccaggctgttcaaaaagtcaagcagtgttcttttaggtcctttttggttctgtgcgacagttaatgaatagtcatgtgcatttgacccctaaaaggaaggtcttttgctttttaaagagactgtattaagaggaataatggaccaagtacaccaggagggaatgaacgagaaaaataaaagaaagaaaatcacacaagaccaaataactaattttgaatattttctgagacctttggtttagaatctaaactttgttgaggctgggcgcagtggagcacgcgtgtaattctagcacttagggaggccgaggcaaatggatcacttgagctcaggagttcgacaccagcctaggcaacatggcaaag

SEQ ID NO: 183673 - DNA, 149 bp, Homo sapiens
gaaatcttgtattcttggtattttagttcaggtttctttcctatttctcaaatcttgtgactctaggatgagatttagtttgcatagattgcaatttttattttaaattattgtaggtagccatggctactttttacagttggagagag

SEQ ID NO: 183674 - DNA, 231 bp, Homo sapiens
agccactgcgcccggtcccgtattgtcttttagaaaaactgtataactatttaaatattttcagtcaccaaactaaaaaacaaatactaaagttgaagtttattgctccccagaatgaaactacaaattacatctgatggccatttttacagtttaaccaataattagttctctatcatattatctttgtttcgttttcctttaacagaatacctaagactagtagttgtt

SEQ ID NO: 183675 - DNA, 335 bp, Homo sapiens
aaccctacccactgtgaagctgtgctgatggagaatgtatccaaaacagagcaaggaacttaggagggagaagaacagctgacctggtcaaggctccagaagtcaccatccctgtcgggccaagggtcagcactctgagctagctcctcagcagaggacaacacaggatttaggtaagagtgaatggtcttggttgttataaggaagaaagccaagtccagaacgttctcttttaagtagccaaaaatttcctttgagaagggaatacaggtgggaggggatttccttaaaactcagctaattttttcattgaacaaggggattgaatgtgatag

SEQ ID NO: 183676 - DNA, 319 bp, Homo sapiens
aacatctcggaaagcagggtaatcttctagtcagtggcacctaagacttgaggaaacacagacaccagcaacccaggtgattcttaggattaggtaagtttagcggaaaacaggtccctagggcagtacttcccaatctttaatgtctttagagtcacctgagatcttgttaaactgcggattctgaatcagaagttctggattaaagcctgagattctgcatgtctaatgagcttccgggtgatctgatgttgctggctcttgatccacattttgggcaacaaaattctaaaacatctccacctgaggaggctccgcc

SEQ ID NO: 183677 - DNA, 282 bp, Homo sapiens
tgtctgccaacaatcctccactcaaaaggaggaaatacaaggcagtaacatttctctggaatgcatttaggaatgctgggaagcatatatcaaatgtaggaaagaggcctgtgtccacaatgaggtcccttttaaacagattcacaatctgagtgaacacctaacccaggaagtaaggcagtctagtttcctggaaagaattaagaactgggaatcagaaaaatctagacttggctggctgcggtgactcacacctgtaatcccagcactttgggaggtcga

SEQ ID NO: 183678 - DNA, 435 bp, Homo sapiens
ggcaggcctctaaatatgaagatcacttttaatttgtgtgtgtgcttgagacacagtttcgctctgtgcccaggctggagtgcaatggcatgatctcagctcactgcaacctctgcctcttgtattctagcagggatggcaatatctttgatttctgttttcctccaacattttattaggaaagatttcaagcatacaaaaaagttgaaacaattgtacagtacagtgagacctatatgtccatcacctagattttacatttgttagcatttgcttaattgctttgtcacttctttccactaatcaactcattttacttttttcgtggtaaaatatgtataacataaaattttatcatcttaatcatttgtttttgtggctacatttcacaatttatttacattttaagataaaccttgagctcagaatgacata

SEQ ID NO: 183679 - DNA, 360 bp, Homo sapiens
aactcctaccccacgcttccaatcactctcgtgcctcagcctcccaagtagctgggattacaggcacccaccaccatgcccggccactttttatatttttagtagagacggggtttcaccatgttggccaggccagtctcgaactcctgacctcaggtgatccacccgcctcagcctccgaagtgctgggattacaggcatgagccactgcacccggccaattttttaagttttctacatcatctcgattgtgttcacttagtaactaagacttcagtgacatttaaataaaatgttctgaccttttctttagagctttatcctcttcatggtaagctgtcatacttgagactcttgagg

SEQ ID NO: 183680 - DNA, 662 bp, Homo sapiens
ataataaccctacaatctgtataataaagagagtacaactactatagcagggtgggaacccacaatctaaatggtatagaagagagtatcaataagataactatcactgaaaaagaagtttagaacatgaaggcacaaggtactgtagagggcagaagtgaggacccaatgaaaaaccagggatacagttcaaagtatctgcaagtaacagtcatcctctttttcccactcccagaacaccaatagcaaggtgttggcatactaggaaagaggcagaaagtttattatcagaagaaactgaacagaagaagcttgagactgtgagacactaagagtaatgagcaggaatgaagtacagctgtaacaagggaattaatataaaacggttagccccaccttactactcaatttcattttgggttatcccacaggtgagaaactaaaggattctttgctggagaaactcaattgctccaaaaaaaaaaaaaaatctccttgctgatagcactcccgcaaacatggtgaacattcctaaaacctgcaggactttctgtaagaagtgtggcaagcaccaaccctagaaagtgacacagtacaagaagggcaaggattctctgtatgcccagggaaagtgtcgatatgacaggaagcagagtggttat

SEQ ID NO: 183681 - DNA, 535 bp, Homo sapiens
atcttaaacatgctgttattcttcccataaaataaaaaattaaaccacactgcccctctaaaataaaaaaattaaaccacccggtccctctagttttgtcccatcgctttttttctccctatagcaaatcccttgaaaagagttgtctatatatgctctcaaacattgcctcccccatttttttctagaaccaactgcaatcaagctctggttccagcatgtcatggacactgacctctatgttgcttaacgcagtggtcaggtctcagtactcatcttatttgatacatcagcagcactagcaatggctttttccctcttgaagcacttctttcacttccatgtcacttgccttagctttcaagacattttatgtcccaggttttcctaccttactagctgttccttctcaatttcctgtgttgtctctatcttctctatgtttacatgaatggaaaaatgtctctggtctccatcttttggctatactcccttggtaatttgaatctcccggctttatttatttatttttttg

SEQ ID NO: 183682 - DNA, 611 bp, Homo sapiens
tctgtattcagtttatctcaatggcttacgattcctgattcttactgtcacaataagcaggatgtgacaaactataccgttgacaatttagtgctatttgaaggacactaccatcatttcatttaatacaatttccaattttcaaatcatcccccttttttctcccaatcttccacattctaccctatggctaaacatcctcctctttttcctgtctattcactcaggtcctgaaattccaactccttgatgctgcctttcaactcagaggaacaaatggttagaaagctatccaaaaccaacctgttagaacatgtgacttcagtgactcattttcctcattaaaataatccttgtaaatgatgtaagcgactaatgagtttgttcaacatcaatgttgagtataagttctgtttgcacctcctttaattcctgaatgaatccaatctttcaatgatttgttacacaacctaaataagaaagaaaaaggctaataaaaagtcaccacagccaggcatggtggctcacgcctgtaatcccaacactttgggaggccaacgtgcgcggatcaccatgtcatgagatcgctaccatactctccagataatgag

SEQ ID NO: 183683 - DNA, 146 bp, Homo sapiens
tgtccctctctctctgtcctcctcgtattcttcagggtgtgttgttccgcatctttatttctatatgcttctgatgtttagcttgcacttataaatgagaacatgtggtatctggttttctatatctgtgttagttcgtttaggat

SEQ ID NO: 183684 - DNA, 616 bp, Homo sapiens
tggatagatgataaataaaacattaagaacaggtaagattaaatatttaacattccactcagacagaagattaagtaaattagagcagaggaaaatggaatgccaagggagtataatggaaaaagaaaggtgctagagggaaagcaatggctagcctttcatgagtctgggaaagataaagatataatctaccacactgttaagggaaggggaatatcaatccatatgctagatgccatgctaagtgctttatacatagtgtctcattattcactataatcttctgaagtaggaatccttattcccattttccagatagtgtagctgaggttcagggaagtaaaacatcaaggtctgatgacaaccaagtatttccgaagtccaaaagaccatacaaggtaagaattatgcctcttgataaaactcccaaaggaagatggtcattttcatattcacttatggttatggccagctaatctaaagtcattaattttacagtgatgggccagagacagcttctatcagctcataaaagctgactgttaaactttcgggaactttgcaacccaatttacttcgcaatggtagtctgaaatcagtcatggtgtgaatattt

SEQ ID NO: 183685 - DNA, 1625 bp, Homo sapiens
actcatcaccaagggattcatgaggacccagccccatgatccaacaccttccatgaggttccacctacaatgttggagtcacatttccacatgagatttggagagaacatacatccaaaccttatcaccacccaactaggaactcttagagagacgacttgagtgaggttcatctctgggctcccagacacacccatcccagggcctgctcccttgaacttcaccctgtcccccactgagaagcccatttcacttgatgtcccatttgccccagaagagagactggtgaggtgggggtgggggacaagagggtgctgggcccacctgagtgcaggaagcaggagcagctctcctctctaggaaggcatggcacctgccccccaccctcccagggacagggaacttttccccacagctgccaaaatggaaaagatgcagccagcccacggtccagcgcacatggtgctgggtgctcttcctgcctgccacctcagggccacactggacagttcctccacttctctccatgtctactgctcccatcctggacagccatttgtgacccttcccctgcctgctgccctggccctgtttctacccacctgccacttcacagcacagctggagttgcccctaagttggcaggtcctgcctcctgtcctctctgcatgcctggccttcctggctcccctctttccttgcattgagccttgaattctcacagtaaccccacatgggcggatgttagggggagccttgttttacacaggaggccaccgaggtacagagaggtgtggtcacttccagaggccctagaatcttgagtctgctggcgattgggattgagatcagcctccctgacctggctgcccgttctcccttagcgcccttctcccctccacgttcctgccacgccggcccctcagcctgtgcaggcctgaagttcattttctctctggacttccataaatgctcatctctcctgagaatgccattctttttttctctcctgtttttctttctaaacctacttgtcctccttcacattttacttcagatgtcatttcctagagagatcctctctgatcctttcaatctgaactataactcgccctgtctaattttctctgctggctctcaggatgtcttttagttgtgtatttgatgtgtatggttctgtgtgaggtagccaacaggataggggtagttaagagctcgggcactggagccatacacgtgaggtaaaattccagctctgccatttcctatctggtggccttaggcaggtgactcaacctgtgtgcctcaatttccccatctgcagaaagggaataataacagcatcacctgattgttgtggggacaatcaaaggggtcagcagatgtgaagtatgtagtaccgtgccagcctgtagtaaaagctataggcaggtgtcacctgttgtgattattttggggaggggtaaagcacgtgattgggtgctaagggtggagcagaggctcagagaagcctcgcctgctcctattgcctggtggcacctccctgtcttttccctgtgcaccatgatcatgttttccagctcagaggtgggagtgtgtggtctgctgaaggatttgctcatctg

SEQ ID NO: 183686 - DNA, 607 bp, Homo sapiens
  misc_feature (6)..(6): n is a, c, g, or t
tccggngttccttgttacgaagtgtgctttgtcgtacagtatcatttgaccatgactcaaatctgctttaaaaatgcaatgtccccttcttttacctaatatcatccttgcattaccaaaccttctgcctagaagtagaaatcattgtagtataagactgaggaggtcaaaatgaactagtcccatccctgtcccaaaggaaggcagctcaccagactgtggacatttgtgttatcccccaccccaagacaactcaccaacattcattcactatggaacaacagaaaggtttgtctgaaggttaaaaatactttctatttctatgtcagtgacagtttttttttaatttattttttacttatttatttttttgagatggagtcttgctctatcacccaggctcgagtgcagtggtgtgatctaggctcactgcagcctctgcctcccgggttcaagcgcctcagccttcctagtagctgggattacagacatgagccaccatacccggctaatttcgggccattggctcttctgtttttatgttgatagcccagaatggaagctatagactgtgagaaaaagactttgttactaatgataattttga

SEQ ID NO: 183687 - DNA, 129 bp, Homo sapiens
taaaagcaggtcattcacacaaagggtacacatttaagtataaagctcaagaaattttcagatagtgaacacactagtataaccacgacccagacaaagaaataaaaattaattagagtgtatgtgtcg

SEQ ID NO: 183688 - DNA, 427 bp, Homo sapiens
gataggaaaactgtgaaacatttggctctccttatgacatatatattttgatttaaaagcatgagagtttttttttcaaaaagacaaatattctttcaaatcgttttgttcatttttactaccttcactgaagcatgaatagcacagaagtaggcattagtctttggattgtgtgttattcaaccgactgttacttgcattccaattactcagccagcatgggatacagctgtgtccaaggagtatttcagcgtttcctaacaactctatatatcacaattgaatttatttagattgtatgttaactattacagtttggatctgaactctaggttattacatttaaagtcatagaatatctaaaaaattagcaaacaaaaatatttgttattatttttaaaaagtaatatatttaagattatcaggg

SEQ ID NO: 183689 - DNA, 466 bp, Homo sapiens
attggatcatattttccagtttccatgtgagattgtgattttttcatgtgttctatctaggactttatgaattatatgttttagagactctggattcctttatgttctttgaagagtattgatttttgataatagcaagtagttaacttagccattctcaaaccctcaactatgaaatttcagttcaattattttattcctaggtgaaattgtaataaaatttactgtgcatactctggttcagggatgaaccatagatttgggtggcatgtatccacaaaaaccaggagcctctctttagctctctccttcttggatattcctcctcaccttttagctgtggtagttgcttttcatactctacaccatttctccctatgtaggttttagtcatgccatatgatactgactgctgcatagtcttaagctataaaaaatttcctataaaacttacccagtatctgca

SEQ ID NO: 183690 - DNA, 150 bp, Homo sapiens
ctgtggcccctctcatgctgtttccattttgaccccattcacctgagcacaggaaagaaattcagcccttttgttttccttttccattgctagaccacacacattaaattgccacacctatctggaatatttacagagccagcatttagg

SEQ ID NO: 183691 - DNA, 509 bp, Homo sapiens
tctgtgtggtgagtgtcgctgggcctggggccgctgtgggcagggtggcccctcgcgcccgagggccaggcctgctccactgctcagcgttgcgtcaagtggcaggaattttcctcgggggagggcattgctgccccttcgagctctgcccgttctgcacctccagcacccctcgccctgcactcacgcaggtatgcggtccaccgtgtgcagcactcaggtccgctgcgagaggtaggtggtggtgctggagctcggttctggctagcaccctgcgccttcccctctcggagggttgctgctcggcaacaggcaccgggggaagggccgcttccttgggggtctccctgcctacctggagcagaaggaccctctcccgtgatgcgcccacgctggggctccggaccctgggtcctctgagcagacaagctcggggaactgccgggagaagcagaagggcacagcccaacccgaagactgcggtcatctgaacaaaactgaccaggaag

SEQ ID NO: 183692 - DNA, 325 bp, Homo sapiens
tacagagtggtggttaagaggctagacactaaatgcgggctaagtagagtcaaattctcactttgccaaatactggccatatcaccttgggcaagttattgaatctctctatgcttcagtttctttgtttgcaaaatggcaaaaagtatagtacctgtctactaggttgttctaaaaattaaatgacttaatatctataaagggcatagagcagtgcctggctcacaataagtgctatatgagttttcatttttcttaaaaattgctttatgaaactgttacccacagtccaaaataccagaactgagatcctatggcaactgga

SEQ ID NO: 183693 - DNA, 373 bp, Homo sapiens
catgaaggagatgatgaagtgagccagactgaagtttcctagtaattcttaacttgtaccgactatacacgtaatggcaaatgctttagcaaaagagttatgtatgagcaaatttataaacaacccagaggactaaaatagaagagagctgtgtgtaaatcccctccatttttgcagcttattttaccaagtgaaacttacaacttcaattaggtatgcttggtgtgtttttaccccaagtgttattttgaacaaaattcttacttctgtgattcattttcctcaaaattcaaaaataaatgtcccactattcatttgaaacataaaagagcaccagtgttggccgggcacagtggctcatgcctgtaatccc

SEQ ID NO: 183694 - DNA, 541 bp, Homo sapiens
tgcatttataccaaactgatgtgaggaaaagcacagtaaggtagcatcaccattccaggtggttggtttgaccttaacagttttaggggagcagagccagtgtctgggaagaactgaaatggaagcagagatggcagtcccttatgtggcagcagcccatgtaagaggtgatgttcctctatctgcaaagcagaacaaaaccttttaccctttctcccagaggccccctcagccaagcatccttcagtgagcagagaacaggcctcagaacaaactccttttgggacccccctctcattctttttgaattaaggtggacttttcctttacatactggtactgaagtctcagatctgtttattaagaagtatgaagggctcatgcctgtaatccgagcactttaggaggccaaggtggaaaaatcattaagctcaggagtttgagaccaggctgggtaggaaagtgagactctgtcgttgtacaaaaaatatgaagatgttgataaagttcttaaaaaactaaaaatcaattagttaaataa

SEQ ID NO: 183695 - DNA, 1145 bp, Homo sapiens
gagaaatggagataatgagagttcttacctcaaagggtgttatggggattgaaagaaattacattttttggctgcttatcacaaatcctggcacaccatatgccattctaaatggtagctgtttttattaaacattggggttgcacgttgggctagccccaggtttgggctctgaggtggaggccagcccagcacccaggccctctggcacccagggttcctgggctcctgggctcctgcctgctctgtcccctctcaccaagcattgcctgccagacctgttaaagaaactgtccgtcaagggtcttcctgtttcttcaggccagtcagtcatgggcatgtcactgcaggaaaggcatcttgggcctaattactgttggcaggagcaagcccagggttttaccgttcatgccccaggactggatttccacatgtccaaggccagctggggcaaaaccagtccctgtggaacgtcctcaaatgttgggtgggggttggtgacaactaggcccttcctccacggaaggggctcatgatcagcttagggctgatggcatgggtccacatccacagatgccctgggcaccacatgccattgtgaacatgtgtccacccaactctggggaacagggaatgtaaggcaggcagtggccagagggtcctgaggaagctgcctctctgtgccctggccccttctgatggagaaaaaaaatctcttcctctaacgtctgcctggacacctgcaatgcctgggagctcactacctcctaagacaacccagccaggtcagctccccactgggaagttctccaccatcactaagaacagcagacacctgcacccaaaatcctccccgcagaccctactgctggtgacaaatctctcactggcctatagcagtgtacaactctgagcgttgtggtgagttctcttacctcgaaatgtattcagagtggaggatcccctgccattttacaacctcatccttcctacttttgggctgttcaaggaaagacactctgacattaccgtgctaggagatgtttacttttcctttttgtcctaacttggcagaatttaaaaattaaacattggcaattctatattgacatttcccctaaatatatatacatattttttttgag

SEQ ID NO: 183696 - DNA, 463 bp, Homo sapiens
aactgcggaaaacttttgtggggttttgctgcagagagaagcagagaaatgaagcagttgttggtggaagaaatggaatcaaaaggttttgagatagagaacagagggaagagctgttggaataaagtccaggaagagtggatggtgtctagtgagcaagtgatgtgtggccctgagtagaggcacgtacaaatcacctgtgcctgagctgcccttagaactttctgtgatcatggagatgcacgtctgtgcttcccaatattgtaacattggccgcaggttgatatggaccacttccagtgtgactagtgtgattgaggaactgcattttaaatattatgtaattgtaattaattttaatttaaatagccacacgtagctcctctataggccaggtcagagctctgataaggctggatatgggaggaaaccctggtagagggttgactgtagaggttctttt

SEQ ID NO: 183697 - DNA, 315 bp, Homo sapiens
atttgttgatttaatgaatttattcatcgggaatagattttgctatctctagacataagaagttagaaattaactctgtagtctaaataagataattctgtagtgcaagtgtgatgattttgaaggatgtggttaaaaagaaaatattctaaaaaatattttattttttgatctcgctatgttgcccaggttggtcttgaacttctggcctcaagtgatcctactgccttggcctgttaaagcactgggattacaggtgtgagccaccattcctagccttgtttttcttaagtagttaaatagttaatattatgt

SEQ ID NO: 183698 - DNA, 378 bp, Homo sapiens
tgtagatgatgctgaccgtaagaaagcatatagagttgagaatcttggaagttatctagggtgcaaaaagagaatagatcaatctaaccagaaaagaggccagaagcagatgctgaaagctagggtatagaaccagaagttagaagatgcaggcaatgaaatcaccaaatagttcattaattcagccagttagtcaaatatttattgaatgctaccatgtaccaagcacagtgttctgtggtaagcaaggcactattccttacagatgttagactctactgatggaagcagatgaggaaataggcaattacaatcttaaggggtaagtgcagtgtgttctaggaacacaaatcaggggtatctaacctgaacttaggg

SEQ ID NO: 183699 - DNA, 1517 bp, Homo sapiens
  misc_feature (324)..(324): n is a, c, g, or t
  misc_feature (734)..(734): n is a, c, g, or t
  misc_feature (1225)..(1225): n is a, c, g, or t
aatttctcttattttttctttggctcttgagttctttggaggtgtgttggtcaatttccaaatatttagggggtttctagttatctttttgttatgtcagtaaattgatttctaattaatttcattgtactttgagaacatactctatatgagttcagttcttttgaatttcttaggacttgttttacggttcagagtgttgtctatcctgctcaatgttctgtgttcactaaagaggttgttttctgcagttattggatgtagcatttcacaagtgacaactaggtcaaattgattgtgttctttgtttcttctctattcttnttatttttttttttgccttttctattaattactgaggaatttttaaatctcccaactataattgtggatttgtctcatttttttaaaaaaaagttttgacagtttttgcttcatgtatcttctggaagctatattattaggtacatacacatttaggattgttattgcctcctggcgtgaaatgcttgccttttttttgagacagagttttgctctgtcactcagactgaagcgtaggagcacagtcacagcccactgcagccttgacctcctgggcccacgtgatcctcctagctcaacctcctgagtagttgcgaccacaggcacacctggccacacctggctatgtgttcttttttttatttttcattttgtagagatggtgtctccgtatgttgcccaggctggtnttgaacttctgggctcaagagatcctcccaccttggcctcccaaagtgctgggattataggcatgagccaccacaccagaaatgcttgtctttatctctgctaatatcccttgccttgaaatctaccttgtctggtattaatgtagccatataagctttcttatacatgtgtgtctcagtatgaagttggatcttgtttattttggaaaattatggtttttaaggaatttgttcatttatctgaggtgtcaaatttgttggcataaagttgtttaaaatctcaccttattatccgtttagtgactgtagaatatgaacttatgattcctttttcatttctgatattgataatttgtctttttttagctttctttttcattgctggggtttatcaagtttattaaacttttcaagaaaacgactttgcctgtgttgattttctctgctcttctgttttctgtcaaatgacagagagtttgacagtctcttcntttttattagaatgtttagttatttacattaatataattgatatggctgtgtttgaatctctcatcttgctatttgttttctatttctcctctattctttattttctttttcctttcctgccttcttttggattaataaatttttagtgtcccatttttagctcttttgttggctttttaatctatttaatttcatctagcgattacactatatataaattaacatgataaattacaaattaatagtataccactttatgtatactgtaagatgcttacaatagtataattt

SEQ ID NO: 183700 - DNA, 272 bp, Homo sapiens
taccagtgttaaaaggagtttaaaaccatctccacaaaaatgctctgcacaaaggctataaagatatatactcaacgagcagtaaataagagaacctgcctcctcaaaacctttcccaaaacgggcataatgaactttttaaaaaagcttttaaaactttttaattacttaaaatggtctatatttggtgtaatttttatttcttagctcactattaagactgcaaaacctcatttctacaaaaaaacagaaaaactagccaagtgtggtgg

SEQ ID NO: 183701 - DNA, 321 bp, Homo sapiens
tgttatgctggtgtccttagggtagattttgtggagaaacccagcagactgaattactacctctctctcttggtgttgtgcatattaaataaacagaagtatgccgtggcctttatagagggttggacttgtaatcaactcccaacactcgttcatgcattttttgtttccatagactcttaatgggtccccagggcagtaactggacatgccaaattggggttgatcaaagtaagtaggagaataccatggttttatatatcagtgtatacaaattggatacttctgcttattcttgagttagtgggagttatctactga

SEQ ID NO: 183702 - DNA, 487 bp, Homo sapiens
tgaatgaaggaaggcaatggaaattatccagacatggatcttgaagtgggagataccctaatatatgtagtcaagtggaatgatgacagaaagggtcagatttggccattgaaaatcaaattaccgatgactttggagagagcaggatcaggaaagtgggtgcttgagatccattttggaggagttgcggaaagaatgaaatagggagaacgggaagccggcaagtataggtgacttgtgtagcccatcccctgatatcctctatattcgtttgctagagttactgtaacaaagtaccacaaactggcttaaatgacagaaattggttgtctcacaattctggaggttagaagttccagatcaaggtgtcatgagagttgtgtgagaaccgtgaggaagaatctgttccatgcctctctcctggcttctggtggtggtttgccggcaatctttgtcattccttggcttatagaagaatcgccctgtt

SEQ ID NO: 183703 - DNA, 541 bp, Homo sapiens
atgctcccttccccacctgcaagattagagattcagatctctgaggggagggtgtgtttcctaccacaggaacatgcagtccacccactgatgaggccgagaagttgcgggagggtgtgggcctctgttgagcagccagtgggagccttttagtggtgcctcctttatccttttgacatgtccatatgattttttgaggaattctttactttcaggcacataagatgttccgattttatcttgtagcattcagcatgaatggacctggaggacatcatgctgagtgaaataagacacacacagaaagaaaaatatgatatgatatcggttgtatgtggagtcttgaaaaaaatcaccatagaaacagtgtaggaagatggttaccaggggcggggtaggggaaatgggaagatgtaggtcaaaaggtacgaagttgcggttagattctaatgttctagtgtgtaacataaggactatagttaatattgtattgtatactggtactttgccaggagagtagattttaggtactcttaccacc

SEQ ID NO: 183704 - DNA, 330 bp, Homo sapiens
caatggagccagcttttcaatatttgcagagacgaaagttttctgaccactggtccagtgttctttccaaaccggatcactggcagagcactagtgatgtcatggcaactgttattgcagggcacgttgaaatccattagcaggcattcaaggctcctcatgagtaaagtaggggcaatgtaaaaaagttagtttggcttccccaacttccttaatcccaagaccccgtgccaggtacttgtattttctatttgctaaatgttagttgaaacaaagggctgttttgttgggtttgtgtttccctgtggaaaagattactctaggcaaatt

SEQ ID NO: 183705 - DNA, 328 bp, Homo sapiens
gcatcacagttcaatgagaataagagaggcaatatttaattctaatttgggggaacactgtgcaaaaaaagagtccttttagatctttgtatcataccattcagcaaattaaattagtgatggttttacattaagtatgaaaggttaatgttttaatattaagtatgaaatgttaatttgcataagctaagaaaatacctggacaactttagtaacaatcaatgaaatccaatttaaaataataaagacatctaatttttcacctcttaaattgtgaaagattaaaaattatgatgttgaatgccggtaaaattgaagtttggtgagc

SEQ ID NO: 183706 - DNA, 2791 bp, Homo sapiens
gtctgcgctttgcaaagcatgcagttagggagagcagctcttggtgagctcagtgaacctgcctggcgcgcacttctacccgctggagagtgcgcgaggcggcagcggcgggagcgctggccacctccccagcgcggccccctctcctcagaagttggacttaggcaaagcgtccaagaagttttccggcagtctctcctgcgaggcggtgagcggggagcctgcagccgccagcgcaggggcccccgcggccatgcttagtgacaccgacgccggggacgcatttgccagcgctgcggcagtggccaagccggggcccccggacggccgcaagggctccccctgcggggaggaggagctgccctccgccgctgcagccgccgccgccgccgccgccgcggctgcggccactgcgcgctactccatggacagcctgagctccgtgcggtactacctccagtcccccggtcctcaggggtcggagctggctgcgccctgctcactcttcccgtaccaggcggcggctggggcgccccacggacctgtgtacccggctcctaacggggcgcgctacccctacggctccatgctgccccccggcggcttccccgcggctgcgtgcccacccgggagggcgcagttcggcccaggagccggtgcgggcagtggcgcgggcggtatcaacggcgggggcggcggcccgggcacctatcagtacagccagggggctccgctctacgggccgtaccctggagccgcagcggcgggatcttgcggaggactggggggcctgggggttccaagttctggcttccgtgcccacgtctacctgtgcaaccggcctctgtggctcaaattccaccggcaccaaactgagatgatcatcaccaaacagggcaggcgcatgtttcctttcttgagcttcaacataaacggactcaatcccactgcccactacaatgtgttcgtagaggtggtgctggcggaccccaaccactggcgcttccaggggggcaaatgggtgacctgtggcaaagccgacaataacatgcagggcaacaaaatgtatgttcacccagagtctcctaatactggttcccactggatgagacaggagatttcattcgggaaattaaaactcaccaataacaaaggcgcaaataacaacaacacccagatgatagtcttacaatccttacacaaataccaaccccgactgcatattgttgaagttacagaggatggcgtggaggacttgaatgagccctcaaagacccagacttttaccttctcagaaacgcaattcattgcagtgactgcctaccaaaacaccgatattactcaactaaagattgatcataacccctttgcaaaaggcttcagagacaactatgattcatcccatcagattgtccctggaggtcggtacggcgttcaatccttcttcccggagccctttgtcaacactttacctcaagcccgctattataatggcgagagaaccgtgccacagaccaacggcctcctttcaccccaacagagcgaagaggtggccaaccctccccagcggtggcttgtcacgcctgtccagcaacctgggaccaacaaactagacatcagttcctatgaatctgaatatacttctagcacattgctcccatatggcattaaatccttgccccttcagacatcccatgccctggggtattacccagacccaacctttcctgcaatggcagggtggggaggtcgaggttcttaccagaggaagatggcagctggactaccatggacctccagaacaagccccactgtgttctctgaagatcagctctccaaggagaaagtgaaagaggaaattggctcttcttggatagagacacccccttccatcaaatctctagattccaatgattcaggagtatacaccagtgcttgtaagcgaaggcggctgtctcctagcaactccagtaatgaaaattcaccctccataaagtgtggggacattaatgctgaagagtatagtaaagacacctcaaaaggcatgggagggtattatgctttttacacaagtccctaaagagttattttaacctcaaaaattagctaactttttgcagatggacttggtggtgttttttgttgtcttctttgcctaggttgccaaaaagatgtttgccttccaccttgatgcatcctgttttgtgcaattctctaaaagaaggtgccaaagctttttgattgctgcaggtaactgaaacaaacctagcatttttaaaaaataagattaatggaagactttaaggtattttaaaattcgaagggtatccaaggttctgtatttatttattggggagacactaacaattcaaagaagcaggctgtgaacattgggtgcccagtgctatcagatgagttaaaacctttgattctcatttctatttgtaaattcttaagcaaatagaagccgagtgttaaggtgttttgcttctgaaagagggctgtgccttccgtttcagaaggagacattttgctgttacattctgccaggggcaaaagatactaggcccaggagtcaagaaaagcttttgtgaaagtgatagtttcacctgactttgattccttaacccccggcttttggaacaagccatgtttgccctagtccaggattgcctcacttgagacttgctaggcctctgctgtgtgctggggtggccagtgggactcaggagagagcaagctaaggagtcaccaaaaaaaaaaaaaaaaaaaagggagaatttaaaagtgt

SEQ ID NO: 183707 - DNA, 383 bp, Homo sapiens
gtgttttgtttcattttctcttaggcaacaaaatgtatgttcacccagagtctcctaatactggttcccactggatgagacaggagatttcattcgggaaattaaaactcaccaataacaaaggcgcaaataacaacaacacccaggtagagtgacagagcaggaggggatatcttctggctttgactataaggcttttttctaataagagtccctactcttttcactgtatttataatatttgcatttgtgacctgtttgctcgcctatttctaaccatttttgttcttttgacctttctcatcttcactttcttattggatttcgataacagtgagttgactattaagaacagaaatagcgaagtattttgggaatttagg

SEQ ID NO: 183708 - DNA, 585 bp, Homo sapiens
tgttttgtttcattttctcttaggcaacaaaatgtatgttcacccagagtctcctaatactggttcccactggatgagacaggagatttcattcgggaaattaaaactcaccaataacaaaggcgcaaataacaacaacacccaggtagagtgacagagcaggaggggatatcttctggctttgactataaggcttttttctaataagagtccctactcttttcactgtatttataatatttgcatttgtgacctgtttgctcgcctatttctaaccatttttgttcttttgacctttctcatcttcactttcttattggatttcgataacagtgagttgactattaagaacagaaatagcgaagtattttgggaatttaggaaaccaagaggaaagcatatctatcacaaccacatacccagctatgatttaaatttcaaaaaaaaagggggggggcaataatgagacctttaaacttgcaataaacaaagctgttagtgaggagcatttagaagtccaataccaaaatacataatttgtcaaaatctaattttgttgaaccactaagaggctttttagattta

SEQ ID NO: 183709 - DNA, 2848 bp, Homo sapiens
gtctgcgctttgcaaagcatgcagttagggagagcagctcttggtgagctcagtgaacctgcctggcgcgcacttctacccgctggagagtgcgcgaggcggcagcggcgggagcgctggccacctccccagcgcggccccctctcctcagaagttggacttaggcaaagcgtccaagaagttttccggcagtctctcctgcgaggcggtgagcggggagcctgcagccgccagcgcaggggcccccgcggccatgcttagtgacaccgacgccggggacgcatttgccagcgctgcggcagtggccaagccggggcccccggacggccgcaagggctccccctgcggggaggaggagctgccctccgccgctgcagccgccgccgccgccgccgccgcggctgcggccactgcgcgctactccatggacagcctgagctccgtgcggtactacctccagtcccccggtcctcaggggtcggagctggctgcgccctgctcactcttcccgtaccaggcggcggctggggcgccccacggacctgtgtacccggctcctaacggggcgcgctacccctacggctccatgctgccccccggcggcttccccgcggctgcgtgcccacccgggagggcgcagttcggcccaggagccggtgcgggcagtggcgcgggcggtatcaacggcgggggcggcggcccgggcacctatcagtacagccagggggctccgctctacgggccgtaccctggagccgcagcggcgggatcttgcggaggactggggggcctgggggttccaagttctggcttccgtgcccacgtctacctgtgcaaccggcctctgtggctcaaattccaccggcaccaaactgagatgatcatcaccaaacagggcaggcgcatgtttcctttcttgagcttcaacataaacggactcaatcccactgcccactacaatgtgttcgtagaggtggtgctggcggaccccaaccactggcgcttccaggggggcaaatgggtgacctgtggcaaagccgacaataacatgcagggcaacaaaatgtatgttcacccagagtctcctaatactggttcccactggatgagacaggagatttcattcgggaaattaaaactcaccaataacaaaggcgcaaataacaacaacacccagatgatagtcttacaatccttacacaaataccaaccccgactgcatattgttgaagttacagaggatggcgtggaggacttgaatgagccctcaaagacccagacttttaccttctcagaaacgcaattcattgcagtgactgcctaccaaaacaccgatattactcaactaaagattgatcataacccctttgcaaaaggcttcagagacaactatgattccatgtacaccgcttcagaaaatgacaggttaactccatctcccacggattctcctagatcccatcagattgtccctggaggtcggtacggcgttcaatccttcttcccggagccctttgtcaacactttacctcaagcccgctattataatggcgagagaaccgtgccacagaccaacggcctcctttcaccccaacagagcgaagaggtggccaaccctccccagcggtggcttgtcacgcctgtccagcaacctgggaccaacaaactagacatcagttcctatgaatctgaatatacttctagcacattgctcccatatggcattaaatccttgccccttcagacatcccatgccctggggtattacccagacccaacctttcctgcaatggcagggtggggaggtcgaggttcttaccagaggaagatggcagctggactaccatggacctccagaacaagccccactgtgttctctgaagatcagctctccaaggagaaagtgaaagaggaaattggctcttcttggatagagacacccccttccatcaaatctctagattccaatgattcaggagtatacaccagtgcttgtaagcgaaggcggctgtctcctagcaactccagtaatgaaaattcaccctccataaagtgtggggacattaatgctgaagagtatagtaaagacacctcaaaaggcatgggagggtattatgctttttacacaagtccctaaagagttattttaacctcaaaaattagctaactttttgcagatggacttggtggtgttttttgttgtcttctttgcctaggttgccaaaaagatgtttgccttccaccttgatgcatcctgttttgtgcaattctctaaaagaaggtgccaaagctttttgattgctgcaggtaactgaaacaaacctagcatttttaaaaaataagattaatggaagactttaaggtattttaaaattcgaagggtatccaaggttctgtatttatttattggggagacactaacaattcaaagaagcaggctgtgaacattgggtgcccagtgctatcagatgagttaaaacctttgattctcatttctatttgtaaattcttaagcaaatagaagccgagtgttaaggtgttttgcttctgaaagagggctgtgccttccgtttcagaaggagacattttgctgttacattctgccaggggcaaaagatactaggcccaggagtcaagaaaagcttttgtgaaagtgatagtttcacctgactttgattccttaacccccggcttttggaacaagccatgtttgccctagtccaggattgcctcacttgagacttgctaggcctctgctgtgtgctggggtggccagtgggactcaggagagagcaagctaaggagtcaccaaaaaaaaaaaaaaaaaaaagggagaatttaaaagtgt

SEQ ID NO: 183710 - DNA, 215 bp, Homo sapiens
aagagtcccttattctaaatttggctagaggataaaagatccctggatttgggggcaagaactcacgtgactaataacaataatgtgaaaatctgacttttaggctgctgcttccttttttttttttttttgagtcggagtctcactctgttgcccaggctggagtgcagtggcatgatcttggctcactgcaacctctgtctcccaggttcaag

SEQ ID NO: 183711 - DNA, 345 bp, Homo sapiens
ctctcagcccttttcattggagtcatactctttttccttatccctacattgttggccaaacatcttgattatttttcttcccagagtgattctaaatgcctttaggcaaagggattagaaatatagtcaacataaagaattagaaattaaaacaactcatctgttgatgagtgccctctgtttcttagtatgttattgcatgtagattatttcttgctcatcctctctaggccataagaactattcctctgctcatcacagctgtgactattctgttataagcactaaataactctaacaaacaaaatgtagtgaacagtgcacacagaagacctaaattccaat

SEQ ID NO: 183712 - DNA, 375 bp, Homo sapiens
agtctgtttaggcgtactcataaggagaaatattggttatcaagagaaagctttataaaaataaacagtttgacactctttaagaaagtaatagaaactgctagctaatgaacccaaagcacccacttacagctatagcatataaaaaaattacaaatctagaatgacattacaacaacacagaccaagggcattagggctgctgacctcaacagcaaccaccatgtggaaatgagtgggctgtgaaagtgatatctaagattcctatatagttatttaatttaatgaattcctaattgttatttaatttaatcagctattatgtactgtaacaactgaagaatcacagactaggtgtacagtaccttaatttta

SEQ ID NO: 183713 - DNA, 247 bp, Homo sapiens
taagatcaggaacaaaaagagggcatgaataccagtcttacagattaaaaggattaaaatggaatatgtttgtgtacaacaaattagataatatagtataatggaaaaattcctggaaagacagaaactattaaactgatacaagaagaaatataaaatgtaaggagacctgtagcaattaagagatcaaattgctaattacaaaacttcccataaagaaaatccctcacccagatagcggtgaggg

SEQ ID NO: 183714 - DNA, 563 bp, Homo sapiens
caaggcggaccaacaacggacgcatcaggggaaagcaacaggtaaacagaaaattatgtaaatgtaaaaggcaaattttaactccctgaaaaaacaaagttaaacaagaaaggaaacaagtatgatataccacatggctgatcagtaaacaatatttatttcattataatgaaaacaccaactattgatttaaaatttcaaaattggaatgttgcagggagggaaagtgggatgaaatagtgaagaaatacaaaataacaataaaaccaccagtaagtcccaccatccgaagatactcctattttaataacattattttttaaacaaaaattggttaatatggcagggcatggcggctcatgcctgtaattccagcactttggaaggctgaagtgggcagatcacctgaggtcaggagttcgagatcagcctgaccaacatggtgaaacccatctctactaaaaatacaaaaattagccaggcatgcatggtggcaggcgcctgtaatctcagccacatgggaggcagaggcgggaaaattgcttgaatgtgggaggcagagg

SEQ ID NO: 183715 - DNA, 386 bp, Homo sapiens
ccctcctctacccttcatacagctagacacatactgtaccctcaacttatccctgtagtagaccagtggcaccttcctctagagaacttaaaccagaggggctccagaatcagggacagcaggaatagcagaagctagggactgaaaacagcatgggggattacctgaagtaaacatcttccggctgaataagtaaacctaccatccccccagtcccttttcctcaccttttggcaatcaggcctatattccccaggcagatatctggagggaaataccgcatggtgaagataagaacagccaagattgagaatcactaaactaaaaatatataaggctctaaacagcccttggcatctcttcctacctgcagtactctcaactta

SEQ ID NO: 183716 - DNA, 573 bp, Homo sapiens
atatatcagagatattcactaactacttgttggtaaaaagtgaccaagtaaaacagcaatatatgactctacattatctgattagtagtattgaaaaactggcaacagaagtttaagaaaaaaaagctgatcatggaaaatgttcattccacacatgacttaagtttcatttgatagactatatatgctgagaacacacttgattttgtaaatgggtgtgcatgttaagtacattgtttgccatggtagtgtaatctttgaaactatgtacttttaagttatataaagatttttagcttcataacaccttttgtggggcaatttaatgtgggacagcttttgtgggacaattaatttaataaaatttaattccttatccaacttttaaatgtatgacatttcaaatttcaaatttagtaaggcctacgatatgccacacttgcttttccttcaggttatttacttggcattatttcccttgcaacttggctatacgagcaaatccatactaaagttgctaatatgctttcttaaaagcttagtcaacactaaaacatgcattggcgacacaca

SEQ ID NO: 183717 - DNA, 754 bp, Homo sapiens
tatgaaggtgtgtcttatggcccagatatggtatatcttagtgaatgtccacgtgagcttgacaagaaagtgtattcagcttctattggattaagccgtctaagtcaattatatcaagttgattgatggtgttgagctcaacgatgtccttactgattttttttgcttaccggatctgttcatttctgatagagcagtgctgaagattccacctataacagttaatttgtctgtttttccttggagttctaagagtttttaccttatgtattttggcactgtacagttaggtgcgtccacataaaggactgttgcctacttgaggaactgatcctgttctcattatgtaatgcccctctttattgctgataactttccttgctctaagtctgctctaaaataatatagctactcccagtttctttgattagcattagtatggtatacctttccccatcccttaacttttaattgatacctatctttatatttacagtaggtttcttgtagacaactgctgtggtttgaatgtggtctgttcctgccaaaactcgtgttgaaatttgatcctcaacgtgacactgttgggatgtggggactagtgggaggtaggtattagggtcataggagtagacccatcataaacagattaatgcccttctctgggggtgtgttcttgcttgggtgggaatagattagtttccttgagagtgggttgctgaaatctggcttccttagtttctctctcttgctt

SEQ ID NO: 183718 - DNA, 421 bp, Homo sapiens
acattttactagatattaaatctgtagcactgaatggaaatgcatatctagattcacatcctctacaaccatgaattcatttttccctgttctagtatacatggtcttattttgtctctctttacctcaacttgagaaatttggatctggcattagagtaaacagataattgaagactagaaagaggtagactgggtggaaataaaagtggaattttgacagaatagccttgggagggatgaagctgagtatacctgggcctcagagcaataatccattttttaggaggaaagggactgctaaagccagcttttgagtattctactctgacctgagtggccttggtctgaatagctcatgttcagaacagcataaactattggagttgtttgttaaaaatacagatgccaaaatgctaccc

SEQ ID NO: 183719 - DNA, 331 bp, Homo sapiens
aatgcaatggcgcgatctgagctcaccacaacctccgcctcctgggttcaagcaattctcctgcttcagccgcccaagtagctgggattacagacgtttgccaccacgcccagctaattttgtatttttagtagacacggggtttctccatgttggtcaggctggtctcaaactcctgacctcaggtgttctgcctgccctggcctcccaaagtgctgggattaacaggcatgagccaccacgcccggcatgatttgggaaatattttaaagaaaagaaaatgaatgctgacctaatagagagtggagagcaaagcgaaagagcagttatg

SEQ ID NO: 183720 - DNA, 309 bp, Homo sapiens
gagccaccgcacccagcctactatgtgaatttttaaaaatcctttcatttactgtatttctatggtctcttgttaaagcagctgttttactctaataaactcggtgaaatctggcattagttagtgccatttaccctaacttaaatcctctgtaacggtgcggtacaataggactttctcaatgatggaaatgttctatctgtgccacccatcaggtggtcacatgtggtagtggagaatgtagccagtgtcctggagaatgcaaagttaaatttcatttacacataactaatttaaatttaaaagcca

SEQ ID NO: 183721 - DNA, 390 bp, Homo sapiens
cgtgagccactgtgcctggccgaggtggaatctttctgtgttgcccaggctggtcttgatctcctgggctcaagagcccacctggcttgtagcggttccttagaggagccacaggaaagtagttcggtatgtgtcacgtgatttcagtgactacaactgggtgacccagaatgaggtgccttattgacctgtctgccttcacagcgccctgtggactgtggggatgagggaggaaggctcagaagtgagaccagagcccagcagcatctgggtcccaattccacacactgcactgccctttgtaacaactcgccaatcctgtctcttgctccattgcccaggctggagtgcagtgacacgatcacagctccctgcagcctcaacctccca

SEQ ID NO: 183722 - DNA, 582 bp, Homo sapiens
ggattacaggtgtgagccactgcgcctggccccgaagtcttcatattttagtcttctgtcttttgggaggtacttttaaaaaaagaaataggaaaggcatgcttacggggaacacgagtatgcctgtgcactcctgtgtgcacgtgtcatttgatcaaattccagagtgaaattaggcgtaaaagctaatttacccatttgcagtaaaggagaatagtagagttgatgttgaattttcttacagttttggagtgactgcacctctgagaattgttaagtgttgcttttggaaaaagaaaaaggttactaaagttgacagtgcttacaaccctagcgcttagtccactgcctggcacatggtccaataagtgtttattgtatgcatgactgatcagatcaatccatgtaattctagttagacacttgataacttaaaacagttgtactgatgctgatgtatattagttgctttctatgatagtactgctttgggaatatatttcagttcacctttagtgttttttaatcttaataaatgtgggtttgttttagagggtccagagagcctcattatatggggct

SEQ ID NO: 183723 - DNA, 486 bp, Homo sapiens
ctagaggattaggggcatagccttatgtcaaatcaaaaacaagtatcatctatggaaatactcttctacaaatagaacttctttgcataataagcaatcttcaatcacacatatggaattcctaaggtaacactggcttcaggtaactgattctattcaagattcagataacataataaccttccagatacctctatgtactaggatctagaatcagtcaaggagccattttttcagcctgtattcccttgttccatccctctagccctaggtagaattctctctctcttcccccaagactttccctaggccagagcctaaacctggttatgtgcttggttagtacagcagaggcttgctcttttggtaggattaaaaccagaaggaagcacctagtaatctgacagttcccaagtcagagcattcacagttttggcctgcaatttctctccttctccttcagctcatcccttgctaggatctgaa

SEQ ID NO: 183724 - DNA, 299 bp, Homo sapiens
ttcccactattatctcaaagaattatttaaatattttatcagcatttaaatcttcacttttgtcttgctccctcccctggaccgagtcttcctggaggtcagagagggggtcttgggcttctctagcaagcagcgttttgtggtggtcacctgtgcaggcttctgaaactgttgcccatgtttcacccttgctctgcctcttacttaaccctgtggccttaggaaagttttaatttctctcctcctgagttttctcacctatagaatgtggataaaagtcacacccaccttgtagagtt

SEQ ID NO: 183725 - DNA, 221 bp, Homo sapiens
ccggaatcatctgccttttcaactttggtcttgatatctttggttcgtggagtaggggaacagggcattcggaacagcctgcagacaagcaagtgaggagagacaagccagacaccaggcaggccccaacaaaagaaaagaggtctcccaggagagaggggccggaactataaggaactcaggaaagaggtctgccacaactccagcctggctgcccctag

SEQ ID NO: 183726 - DNA, 217 bp, Homo sapiens
gctctagatttcaaaactgatacattttaaaattacaattaattagcagaaggaaaaaagtgactgttgaacagaatggcaagatttatagctttaaaatctattccataagaagaaaaaattatctggcacttcccaaagcagaaacaaaagaaacaggagttttactgtcttcttcgtttctaaataacttaacagtcctttctttgtggaagca

SEQ ID NO: 183727 - DNA, 545 bp, Homo sapiens
tagctggaactacggcacctgccaccatgcccggctaattttttgtatttttaggagagatggggtttggccatgttggccaggatggtctcgaactcctgacctcagatgctccaccctccttggcctcccaaagtgctgggattacaggcgtgagccaccgcgcccagcccaagtggttattatttcaacacagaagtccttgtttacccgaagcagctgggaaatagggcttcgcataaaaccagagcagaagtagcagagaaagggacctgtgagtgagtcctgcctggttctcggctcacactagtccagccttgggaaagagctgggacaccacaggtaaccaccttaatttaccctttgcctgtctggcgaagacaaagtaaactgagtgccacttttattaatgggaaaccatcttacttatagcaaaaacaaatgctcaaacctcattcattctgcggttatctggatccttcatgctgtaggtagggaacagaatggggctctgagagctccctcctccgcgcctctgctgggag

SEQ ID NO: 183728 - DNA, 259 bp, Homo sapiens
gtcacattgaattaatttttaagttaactttgtgttgaagtataagatgcctatagaaaggcgcacactggtgtctgaatcctcacaaagtgaaagataacatacatccagtaccccagaagccctgcaccatagcccaccatcctcaaatgtcattactttcctaacttgtaatgccatagagtagctttactagtttatgaacttgttataaatgaaattacaacatgaactctcttggtttgggtttactgcatta

SEQ ID NO: 183729 - DNA, 152 bp, Homo sapiens
ttagtcccaagggtttgttgttgctgatttttccagattttctacatagacaatcatgccatctttaccacctttcttccttcccaatctgtatacttctatttctttttcttgtcttagcattagctaggacttccagcgtaatattgaaa

SEQ ID NO: 183730 - DNA, 227 bp, Homo sapiens
agatcgagatcggtaccgattacgctcctaacggggtttcaccaggttggccaggctggtcttgaactcctgacctcatgatccaaccgccttggcctcccaaagtgctgggattacatgcatgagccaccaagcctggccctggcctttctttctttaaaaggtagggcaggccaggcgcggaggctgaggcaggctgaggcaggagaatggcgtgaacccggaag

SEQ ID NO: 183731 - DNA, 250 bp, Homo sapiens
gggaggtagaggccacggcagggaaccactcagtgggtttatcttgggcattctgtgcatatgtaactgagaaaggtatgttgttacctaatgtatgcttttgataatttggaccaagagacatggtattctgaatagcagccaaatatatgaggtcaaggtgacttcctctagcaattaggacagctgtcatggaagagtaggccagacctgatttccttcttaagtccgtgggcctctatgatgataa

SEQ ID NO: 183732 - DNA, 243 bp, Homo sapiens
gtaacattacagttactcggtagccagctgtgtctagtggtgactatagtggtgcagacagagaacattttcatcatcgcagaatgctccgtcgggcagtgctatccgaaagtcttggtgtccctgtcatcacgtccccacgggcccaggagcatgcatgtttgcctctacccatcgatgctgaggtctagtatgtgtgtggcactgcgttcggcccgaggaaagggcccttgcctacctcct

SEQ ID NO: 183733 - DNA, 561 bp, Homo sapiens
gaggagcctccgaatgtgaaataggtaggtgatggtatcatagaatgataggtttgtaggatttatgatactgcattcagttttggcagtgttacattcaggtatccaaggaacattcatatggttaaccacccaagtcacagcctttggagtttttctctgtgtctcctttgctcctgttgataaccattccctgtatcattctgtcactatatttacataattactctgattgccataggtcacttttaaaaaattgtttcttttcaactgctctgatagatctccttttctcaacctctttcttcctttctccatcttctacattgctatcaggtagctttataaagtgcaaatcttacttcactaacaaaaacttgttcgtagctctactgtcatctacttgagtccagattctttagtttgcagagtttttccatgatctgaactctgctttatttcctaaattcttgttttcttcaaactcatgctttttcaagcattgcattcatttttacatattgtatccaacctacctatttcacaatcggggtaccgagg

SEQ ID NO: 183734 - DNA, 396 bp, Homo sapiens
tatgatgtaggcattttgtctttgtcatttcccattaattataacaggatactagaaactggataatttataaagaaaatgattttttttctcacatttcaggaagttagaaagtcccaggtcaaaagggtagatctggtgaaggcctttttttctagtgaatactatctgcagagtccagaggtgatgtagggcatcacagtgagaggggtgagcatgctagctcaggtgtctcttcctcttataaagtcaccaattccactttcatgataaaccattaattcattaacccatcagtacattaatctataaatagattaatccattcctgagggcagaacacttaggactcaatcacttcgtaaagaatccttcacaatgttgccacattgggga

SEQ ID NO: 183735 - DNA, 144 bp, Homo sapiens
cagcaattaggctttattggtgcactaaggagaagcagagaggagaagcaattcttggtaacttccttggaagttgcagctaactctgaaaagtctgggttgaactaggtaagtaactaattcctagaatcaataaactttgca

SEQ ID NO: 183736 - DNA, 801 bp, Homo sapiens
cgcggcgttttcctctggctcctgcgagggcttggtttagggcttcagctctctgcgttctcggctccgggaggcctcggtgattcagccacagcctctgcctcccgttgctctgtgacctgagggtattggacaatttgtagctaagactcccggataccctgaagtcgggaaatggaactcgtaacattcagggatgtggccatagaattctcccctgaagagtggaaatgtctggaccctgcccagcagaatttgtatagagatgtgatgttggagaactacaggaacctggtctccctgggttttgtgatctctaacccagacctggtcacctgtctggagcaaataaaagagccctgcaatttgaagatacatgagacagcagccaaacccccagctatatgttctcctttcagccaagacctttcaccagtgcaggggatagaagattcattccacaaacttatactgaaaagatacgagaaactgtggacactgagaatttacaattaacgaacaacggtcgtaaacgtgtgaatgacgtgtcaggtgcagaacaggacgtacactactggagtttaccagtgcttgtcaactacccaggagcaaacactatctcacttgtcatacatgtgttacagtttcctagtacattttcaaattcaaacaaacataacgataacgacatactggacgagaaaccctttacactgttcagaactgtggccagactcgtctaacatggtcacaccttaacttcaaccatacagcgaactccatgcctggaggacgcaaccg

SEQ ID NO: 183737 - DNA, 745 bp, Homo sapiens
cgcggcgttttcctctggctcctgcgagggcttggtttagggcttcagctctctgcgttctcggctccgggaggcctcggtgattcagccacagcctctgcctcccgttgctctgtgacctgagggtattggacaatttgtagctaagactcccggataccctgaagtcgggaaatggtgagtgtgcggggcagggcgtccggaggctggggaggcctcatcggaaccggcgggaaatggcggcggcgggaccgagtctgcgaacggagtccccgctgccgcctctcagccctcagtcccctccggtgacggaccgggctcctgtcggtccccgcacggcggctctggcccagcctgcggccctccttgtgcagttctgcgcccgcagccccgcaccttccctgggccgtggggtgaggaggagctcatctggaagacgccggcgcccgcgtgcgaggtgcccgcctgggaggagctgtggtccgggggtccggtccctactttaccctgttcggaatgagatcgaggccccatcgaaacaaagttcatgtgagcaaacggggtctcattaatgggacagcgtcggccgcggctcctggtttggggactgccagcgggtcttgaaggaaaggcttttgtgaggtgtgtgagcaagcgaagcaaatcacccgcccgctccaactattccaccagtccctttgccctgtgcacctcctccgcgtggctgttcctgagtaacatcttt

SEQ ID NO: 183738 - DNA, 131 bp, Homo sapiens
atatattaaaggttattcattatacgctgggcaattctagaaacctattaaaaaatagcctaatgaatgaaagtcacagaaaagcctcctttataaccaggaaataatttagacagaagaacgttatggaa

SEQ ID NO: 183739 - DNA, 482 bp, Homo sapiens
atagtttttctactaagtattcttccctaacagtattaagtcttttgtgtctgacatctttcatttaatatcatatgtgagattcattcatgcagttatacgtagttgtagatcatttattcttgttgtgtaatattctattgtggggatatataatttgtgttatttacagttttaggctattaagacctgttacagtgatataaaaacataccagtgttggagacctgagtatagggtatcccaggctttgtgtggctgagcaggatgacatcccatctttcctctccaggtccagatggttttagtgtgatagtttacagctgagcttttcagactatggcttgcaggccaaacctggccttccgcctgtttttacacatacaattttattggaacacagccacacccattcatttatgtattatctatggctgctttcccattataacagcagagttgagtaattgctacggggatca

SEQ ID NO: 183740 - DNA, 407 bp, Homo sapiens
tttttaaatatgagaaaactgaggcttagaaaggtaacttggctgtgagctgtggctcacacctgtaatcataacactttgagaggctgaggcaagctgaaccctttgagctcagtagttcaagaccagcctgggcaatggggcaaaacactgacactaacaaaaatacaaaaattagccaggtgtgattgcgaacctgtagtcccagctactcaggaggctgaggtaagaggatcccctgagcccaggagacagagactacagtgagccaagattgtgccattgcactccaggctgggtgacagagtgagacctcattcccccccacaaaaaacgattaactttcttataattctgaaataataaaggtaaaaatttaaaatataatctaagtctagccaatatgc

SEQ ID NO: 183741 - DNA, 263 bp, Homo sapiens
tcaggattagttgagtgatgccttaaagaaagaaagtcagatgataggtcttcctgctgcccgcaccacatcatgagtgttattcctatagaggaggagtaaagagtgggaagaaaatgaaatctgtcaatactgtgaatatataaataataaaagtagcagtaggactgattaattctgaatcatctttatgaaatgactggagccgtgaaaatgctcagtctgcacagctgattgagaaatgtatgcaatctgttgatcgg

SEQ ID NO: 183742 - DNA, 284 bp, Homo sapiens
actatttgaggaaataatggcaggaaactccaaatttagtgaaagacataaatatacagattctaaacgcttaataaaccccagacagggtttaaaccaaaaaaaaaaaacaagtgattacttcctgcagacttttccttagtgactcattcaagcttctcataaatgccccaattcctaagctattaattcattgttgccttcagtgaatatatactttcatttcattgaaaacaccactgatgataataaaaaataaataaataaataaataaaaagaaaac

SEQ ID NO: 183743 - DNA, 261 bp, Homo sapiens
agagataattcttgaatgctagaggtggtgtagagtgtagacagtgccagcaggagggccaggactgtggctgattccagttttgctgtgtgactgtgagcgaggcctcagattgctactctttaattggaggagttggaacagatgctgtgtggcctgttctggggctaacactgtacatgaggcttgagttctcatggagattcctttgtccagaatagtttgaaaggtctgctcctctggtcagcatccattgaagag

SEQ ID NO: 183744 - DNA, 164 bp, Homo sapiens
tctcgtgggggagggaatcacttccaaggaaatgatataataaactcactctccctttttaatgaactatcgatttcttcaattaactggatactgagaatgtaggtagtactagtagtagtagtagtagtaattgtcttcctcaagacatcaaacacacaact

SEQ ID NO: 183745 - DNA, 625 bp, Homo sapiens
cacataattgctcaccagctcccttttgtgcttaattggtctttcgaaatgtttttattaaattcagccagtatttatttaataaatgctggctgaatttaataaaaacatttcaaaagaccaattaacacaatggggaaatttaaagtaaatcattgaaaactctcatttatattctaatctgcaaatttaacatattctagcaggccttctctttttcagaaacacgtctgactttttaaattcatcaaaagtccctcaaagtgcctgggctggagaagtcccaaggcctacccttcccaaacccctcatcgaagggtcgtcgcctcgtccagtctctctgggtggccatgcttggttttatgtaactctggcctagggcatcccactgactctatgaggagtgaccccctgacccaaaaggcagccaaatcttgagcagacaaaaacacatacattacaggataaaaagataagctggcccaaattctgtcagtaacttgaaataatggtaactaagtaatatcaggaaagaagaaataaggatgcaagatgccaaacaaaatctttatgaaatacttttgatcatgaacttatctgctaaatcatccctcaagtagaaaca

SEQ ID NO: 183746 - DNA, 760 bp, Homo sapiens
tgcgtgcagatgccgtatcttactcatattcttacattcaacaaacacacattaagttcccactatgtgccatgcactgtaaagcctgaagccacagcagtaaacaaaacaagcagatgtctctcccttcatggagctggccattcttgataggcagactaattcatttcttttccctcctgcgcaatggactgttcttcatgcagtatttatttaataaatgctggctgaatttaataaaaacatttcaaaagaccaattaacacaatggggaaatttaaagtaaatcattgaaaactctcatttatattctaatctgcaaatttaacatattctagcaggccttctctttttcagaaacacgtctgactttttaaattcatcaaaagtccctcaaagtgcctgggctggagaagtcccaaggcctacccttcccaaacccctcatcgaagggtcgtcgcctcgtccagtctctctgggtggccatgcttggttttatgtaactctggcctagggcatcccactgactctatgaggagtgaccccctgacccaaaaggcagccaaatcttgagcagacaaaaacacatacattacaggataaaaagataagctggcccaaattctgtcagtaacttgaaataatggtaactaagtaatatcaggaaagaagaaataaggatgcaagatgccaaacaaaatctttatgaaatacttttgatcatgaacttatctgctaaatcatccctcaagtagaaaca

SEQ ID NO: 183747 - DNA, 614 bp, Homo sapiens
tggccctgggttgataattgttgatactgggttatgaacatgacatgggggttcattacactgttttctcctcttttaaataggtttgcaatttcctatgattaaaaagaaagttacagaaaaagacttaacaggtggggccactcccaattaagaggggagtgtaattaaagaggaggcaagaggcagcttgctgtgggcaagaaacagcccgcaagtcagtgtggctggagcatcccactcaaggcaaaaaaaaggaggtggccagacatgaggctggggaccaggaaaggtaataccctgccaagtcccattgggcatatgaacccacatacatctttgagtgatggggagacatttggatattctgaacattgcaaagaaagaattagacttggccaggtgcggtggctcacacctgtaatcccagcactttgtggggctgaggcgggtggatcacgagctcaggagatcgagaccatcctggctaacatggtgaaaccctgtctgtattaaaaatacaaaaaattagcctgacatggtggcacatgcctgtaatcccagctactcaggaggctgaggcaggagaatcgcttgaacccggaaggcggagg

SEQ ID NO: 183748 - DNA, 859 bp, Homo sapiens
ccacagagacatggaggaacgttaactgcatagtacttaaagaaaggagccaatatgcaaaggctacataccgtatggttccaactatatggtcctctggaaaagacagaactatggagacaataaaaagatcagttgttgccagggcttagggtaggggagtgatgaataggtggggcacagatttttagggcagtggaactttcactagagttctcatttggtggagacatgtcattatacatttgtcaaaacccagtgtacaccaccaagagtgaactcggatgtaaactatggactttgggtgatactgatggataataatgtgttaatgttggttcatcagttgatgttgatggtgggggaggctgtgtgcatgtgtctgtggggaggggctatgtgggaactctgtactttcccctcagttttgctgtgaatcacaaatgtctctcaacaacatatcctattatttttttttaaatgttcacaattgcctacttgctaggcacaaagtagccaaatattcttggtctaaaaaacaatatcagcttagtggggtagaaaaacaggtatatgagcaaaaactggaaaggtgagaagtatactcagaatccttgcggaatgaacccaaccaaaaacacccaggccccttgtttccctgaaccctgtggtccattgccgtcccctggtgactccatttctgccacttccttccaatgggctcaccctgcatcttatcctctcacagaaagtcttccacctctgacattataatcctgtctctgctcatcctttgtatctctctctaacttcctcagatgttcctcagtcctctccagcaatttgccccaccatattt

SEQ ID NO: 183749 - DNA, 553 bp, Homo sapiens
tcaaaaagaaaagctaattcaaagtcacttaacagtgcacaaaatccagcaagtaacagtataaaatttacattgcacaatatctgatttttaaaaaattacaaggtatgaaaagaagcaagaaaatgtgttctatagcaatagaaaatcaatacatggaaacaagcaaagaaataacagaaatgatgggactaacagacaagagtgttaaaaccaataaataataataaaaattggaaatgtatagctactaagttaaaagtaaagatgaaatgaaaccataaaaaaattaatctaggctgggcgtggtggctcacacctgtaatcccagcactttgggtggctgagatgggaggattgcttgaagcagtttgaaaccagcctgggcagaaaagggagatcctgtctctcaaaaaaaaaaaaaaaagaaagaaagaaagaaagaaagaaagaaagaaatacaaaaaaagttagctgagcatggtggcggctacctgtggtttcagctcgggaggctaaggtgggaggatcacttaagccaaggatgtcaaag

SEQ ID NO: 183750 - DNA, 371 bp, Homo sapiens
aacaactgaatgtaaacagcatattgtttaggttacgtattcaggctacacacacaaacatatatgcacatatatacaaacataacacatatccatacatacgtaagtatacacacaaatgcacacatttatagaactattaaaactaccaaaaaggcaagagaataatcagcacaaaggggtaaggaaagagggacaggaatacaggctggggagaagatgcacagaggtaagtactaacactgttcttgttctctggttgaatgacatcatcataaatgatcattctattgttaaacaattattaaaagaaagccccagcctgggcaacacagtgagatctgtctctatttgaaaaaaattttttttta

SEQ ID NO: 183751 - DNA, 374 bp, Homo sapiens
taatgcaatcttaccaatcccaggagccccttccatgctccttgcccataagtacccaacgtgctcaaaaccgcaccctgacttctaacactgtaggctggtctggttcatttttgaactttgtataaattatgctgtattgtatgtattcttttgcttctggcttcctttgatcaatggtaagtttatgagatttatccatgttgctgtatataggaattggttcattttcattgcttatatggtattccattgtacaaatataccacaattcatttatccattctcttgatggacattcagtttcaggctattatgaataatgctgctatgaatatttttgtacacgttgttggtacacgtgtgtacatatt

SEQ ID NO: 183752 - DNA, 748 bp, Homo sapiens
tcttcctgcctttaagattatatccctgtaattgtcatgttagcaattggtaacttgaactgcttaagtatctttcacttctgaggcaggggttggggtgggaggttggaggtcggggcgtcatcttgtggactaatggcacaagtgactaaattagttagcagtagtagaatttacaaattagattcatttgtttatttaacagatatttattgattattaccgagaatcttagtaatacagatactaagtaaacagcaaaataacaaaacaaaaaatcttgccctcatggatcttactttctcctgggaagacataactaccaaacaaataaatatatacatgctatgaagagtaaggatagagaattagataattctgtgtgtggcatgataagaaatacatatttggtctttgtctctggttcctggcttctggcttctaaaatccttggactctaaccagtgatgagtgccatcttgctatgtttcccaggctggttttgaactcccagcctcaagcaatcctccctttccgcctcagcctcccaagtggctggggttatgggcctgagccactacacagctaagagtgtcttgtatgtgctaatgagatggctggtgtctgagagcccctagagagcttcaagatgggggctagtctttagaaagtccaagcaatggctaggtatggtggccactgcctgtaatcccaggagtttgggaggccaaggtggacagatcaccta

SEQ ID NO: 183753 - DNA, 374 bp, Homo sapiens
aatgtggtcatgtccccctttctcctctaattccaaagaacttcgctctcctccagcatcccccacctctaattctaaagaactttgcttcatataagctccactcctccaggaaggctcctcggagcagcctgggaggccttcctgggagggatgcaggaaaacaggctcaggaggcagcggggagcagcctgcaggtttgcttcactccctaggacccacacatgctcccctcagctgtctgggcatgtagagtgggtgcgtatctgcggtccaggcatttttgagagggctcagatccttggcatcagctgccctttcaacatcctccttccaaccacttcagactcagtaaggcctttggaaaaaatacc

SEQ ID NO: 183754 - DNA, 465 bp, Homo sapiens
gtgtgtgtgtgtttagttttctctctgtcaatgaattggcaacttcgtagggaggtaaaattactcaacaatattatctcttttaattcatgcaacactatgaaatgagtgtcttatttctcactctctaagttctgataatttgagtaattttttcaaggttagatagatagtaagtgtccaggaatcagagccctattgccttaccccttctgggaagccatattgctccctataactttcattcaatattctccaaaggactaacttttcttaaatactcctcctcacattccttctgaagataggccgcctattctttctctgaatggaggaagctggaaggagctatagataatttgactggaaagagcgagataaatcctggaacctggtgagggtgcataggatttctgtgtaaggaacaagctgcgtcttctgttatgttgcctgttttatggatga

SEQ ID NO: 183755 - DNA, 508 bp, Homo sapiens
aacactaatgctttgcaaaaagaatcagtttgggggtcaacagacttgagctgggattctacctccattacttataagccaggtaattgtcaagttatctaggctaaactgtaaaatgagtctgacataagcagcctcatagggtgttacatattaaataagaaatattaagaaaatgatacgacctgccacatagttggtgacaataaatttgagtttttttatagctctgactccaaccctgtcatttttattgataaagacaaaaaggtattagccaagcatggtggctcatgcctgtaatcctagcactttgggaggccaaggaagcaggattgcttgaacccaggagatcaagaccagccatggcagtttcttagattaaatatacacttactatataacccatccattccaatcctagctgtttccaagtttgggtgattacaaaaaaacagctactgtaaacattctcatacaagattttatgagatcacatgttttcatt

SEQ ID NO: 183756 - DNA, 537 bp, Homo sapiens
aggcggaggttgcagtgagccgagatcccatcagtcactccagcctgtgtgacaagagcgagactccgtctcaaaaaaaagaaaaaaaaaagaaaaattaacattgaaacttcctgaaatcattagagttttagaattcctggttcaatagaattcacaaatttcaaataattgagcaaatacaaagtctcctctttatcctagtggcattttttcctggaaacatcagaaactattttaaagtttgttgctttatttatagtctttgcggttatcacccagcttttatgtgagaaacgtttatttttaaataacttgctctaatagttttatgtttcaaaactaatagaaggcttcttttttaattggctcttacaatgaaaatactaataaaatggtttggtggaaactaaatttttcttaaaatatgagatggaatattcacaactgatttggttgaatatttgagtcttaacatttctcatgtaatataagtggaaaattttgtggagaaaaatctaacttcatgacctcatg

SEQ ID NO: 183757 - DNA, 280 bp, Homo sapiens
aaccccaggcaacactgcttctctgcagtgaaactacattaatgctgatctcatgaactcagctaataatacagttttatgatcactgagatagaagtggggctgagctcaccacttttccaaggagaagaataaagtaaacaggatttcatgaggaacatcaacacttgcctaagagaacaagcttgtaacaacactcttgagcaacctcatctgcatgtaaacgagctggagcttccacaggactcctgggttggatgaaccctcaggctctcctgac

SEQ ID NO: 183758 - DNA, 440 bp, Homo sapiens
tgttcagcctaattcaatcatgtatctgtaattacttttctatagttttatacatagtttataatctcattatgttttagtacttttctatattaccttcgtctaatgctattgttatttccatatatccatatccttaaacaactataatggtttaaaatgttccaaaaaaactaagtaataaatttggttttagtacaaactgtttcagtcaaccaaataaacaaattaccattttgataacaaatagattaaaactcatgtcatcattaccttgtatcttgtcctaagtaaatagattaccattttcaatttaacattgtaggaaacgctactcagtgtaaacaactcccccctccccactttctacctttaaacacccacttaaacatagacaaattatatacacttatgaatttttttttttttttttttttttt

SEQ ID NO: 183759 - DNA, 245 bp, Homo sapiens
tttgaggcaattcgccaagcattgtggttaatcactgtgttattattagaaatgaggcttttcttaaaaaaatttttgagtgtttctaaaactctaaggatttagatcatgttaggtatataattcaggttattgtgtatagactagctctataataagctgaatcctccttgtactttaaaggattcctggctgggtgcagtgtttcacgcctgtaatcccagcagtttgggaagctgaggtgg

SEQ ID NO: 183760 - DNA, 387 bp, Homo sapiens
caaagattttcaaatgtacaaggttggttcccctaaccccccacccccagttgttcaagggtcaactgtatttactggttgataaaactgaagccaccttcaatcttgaatccattcaagcacatgggctgatccattaccagactgaattctctcaacatacacaaattgtcagctttgctgacatcagtgggcaatggttttctaactgaaaaataatgtttccaaaatattgtagacttggtcaaaagcagaatttaaaagctaatgggaaacaaaacagtcctcccaccccaaagccaatctcagctgatgaagattcttgccccccttagttgaggcaggcagatcacgagtttaagaccagcctgaccaacatggtgaaac

SEQ ID NO: 183761 - DNA, 285 bp, Homo sapiens
ctcctttgggtggacagataatgtattaagctttgaactatggagtctgaggtacctgtggtacatcctggtggctagatatgtggtcagggtctggtggccaggaaagtgctaggctaaaatttctccttgaatacatgtcttatgtttgataacttagattctaaaaggctggtggccaggcgtggtggctcatgcctgtaatcccacaactttgggaggccgaggtgggcggatcacgaggtcaagagatcgaggccatcctggccaacatggtgaaaccct

SEQ ID NO: 183762 - DNA, 676 bp, Homo sapiens
ttatccttaggcattcttcctgccccatgaccttttattaacaaataatgattcaggtcaatagacaatcaggcactggaataaaataatgaaaagagagatacacagctcttgctctgatggagcatagtcttctaagaattattatagggaatgctgccaactcatcagcatttcctcaaataaatgtgtcttcctttttgaaaaataggtatatctacttagaatatctatgagcattaccatgtggcctgtcttctgtactgtttgtcacttataaaaatagcattaaaataggacttttatctacaatctactttcaaatggtatatccaagaaaaagaaaaaggtggcaaatcagccaccttttgggttatcaagttgaaaaatatatgaatgtttattgtgttcatcttgtctgtaggcttcaattttaagaaagaaggtcagggagaaaaacatcaagaaagaattatctcaccaagtgtaattatttaataccatcttaattaaaaataaattcctcaattcgggaagtttgaatatggactggctattagatactaagaaattactataaattttcttaggtataaaatgttatggttttgtgagaaatgcccttattctaaagagatgtatgttgaagcatctgaaggttttgtttctttgagac

SEQ ID NO: 183763 - DNA, 296 bp, Homo sapiens
agtcaaccttatcaggcaagtcctggaaccaggatggcgaaaataacagtccagagcccttactccgcgctgggcactgggaatagagcagtgaaaaggtagatgaggtctccgctcccatagcacttctatttgttctagtgatggagacaggtgataggaaagccttccagtagaggagataattgtggatcatggtacctgctatggaggaatgaagagtgtgatggagggatactggtcacggcccacatgatgttgggtgaccagggaaggtgtccctgaagaagcagtgc

SEQ ID NO: 183764 - DNA, 439 bp, Homo sapiens
ttcggaaccgagtgcggtgggctaggactatacgtttgcaagtttaagagataagcgagaagaccagacagagcaaacaataaaaggctttttgttgagaactgtataaatgtaagggagtaccaaatcccctattttgaatgacagtatcacggactttattacatatgtaattttattctgattatgaaagcatcagtaatttcactattgaggaataaccacaatgtttatgaatatttcctttgcttctaaatatgcggtctttttaaatcatgtattttatttcatttgtatatatagtttttcgctgtgtaaacttcctttttgcaaaattctacgtcacaaattgaacaaggcaattagatgtctagggaagtactgatgcacgagaaagcatattgcagcattggttaataaaacgaaaaaatagaaacct

SEQ ID NO: 183765 - DNA, 275 bp, Homo sapiens
tcagaggcagagcaggtcagtttcctcggggaagtggtttcattcccagaagagagagggaagggatcctgagtggaggcgatgggctcaatttcgcatgtttgtggcctctggcgatgtccggcgagggatcggaaagctctccttgaggggcacagagaagtagtggtgcttaggtcagtggtaggtttcttttttaaaggcagacaggaatcaaggaacagaagcccttgagagaccttaaaaatcattcctttgaattcctccccctcccc

SEQ ID NO: 183766 - DNA, 394 bp, Homo sapiens
aggatgtcttcttcgtgtgtttatggagagacaccccactggcgagatgtctctcaaggcgcttgccggatgatgagtatgctgactcagcctgtatgagctcctcagggctggaacccgactgcaaagcacagcaggtgctcagtaaagctgctgaatgaaaaaccagcagccctccacaatctcaaccttgctaatgtattcccaaaacaccgaacttaccttcctaagtgcaaaagcgccagactaccccttacctcacagaagaccttcctgaacctttctacccgcctcactcctgtgagcaacagctgtctgctgtgtacaacattccgtgatttactcaaaaagcaacttcagggaatcccttgggtttttgctccttttcttactc

SEQ ID NO: 183767 - DNA, 242 bp, Homo sapiens
taagacgctgtctgcctctcgcacatatctgggcgccgcacctgctttcccacaggctctgcgccaggtgttggggtgatggacgtgacttacagagcttctgctctctccctgcagcacacgtggtggtgggtgggtgcagtgagtgggaacatccacataggttgagtgcagctcacagtgggagaggcactgtgggaggcccttccccttgtcttgcaaagcagaaatgcctgttccga

SEQ ID NO: 183768 - DNA, 297 bp, Homo sapiens
gtgaaaaagaagtctacctgtgtcaggggtgttccctgtcaaagtgatgggtgagcttcagctgggttgcagtggaacggtgtgctggatggattgaggaggcgagagggtgcaagacagcccatttaggaggcagttcctgcaatgtgggcatgaagtgttacagcccaaactaggatgctagaatccgagggcagagggcagtagaaaagaacaacctggcggaattgtgtaggactagaggatgacagccgagtggcagataccagggtcaagcttgcggggagaagggggacg

SEQ ID NO: 183769 - DNA, 606 bp, Homo sapiens
atggacacatacactatttgcattcagtttttccagtaaataaatgttattgctgcataaaagaaagattaataaattgccagtttgaagtaaataattgactaaatcagacttagcaaatatccatcacttaaaaccctccagcgttaaatgtgcgacaaatgtctcagatggtcttatggcataaaataaatcaaaacactgtgacaaagtgggacgttcacaaggtaatatgtttcttattattatcaattagacttaagattttccattttaatacttttctttgaaatatcctattcaggtgggccgaaattaacataacattgaagaacatattgtcacttaagacaagtgttctcatcataatcaaagcgttatgaatgaataatgaatatatttgtagtagaaagtattggttttatttatttattttatttatttttggacagggtctcactctatcacccaggctagagtacaatggcacactcatgtctcactgcagcctccacctctcaagctcaagtaattctcccaccctggcctcctcagtaggtgggatttcaggtgcacaccatcacagctggcttttttttttttttt

SEQ ID NO: 183770 - DNA, 501 bp, Homo sapiens
aggaacagcaatttactcgaagcttcatggggaagtgggagcaagttagagccgagacctgggtctttcgtttcctacattaatgatgtttatgtaacattccactcttgggtttgccaagccttggtgctttaaaagtttttttctaccaatacccagtatgtttggctaaagttgaaaagcatcaaagagaaccagtaaagcccttttatcctccctaagggtctgcttttatcactctgctctggtaacttcatgaactgggatctaaacagcatagccatgggccacaggggagcaggccttcttcagaggataaagcccagatttcttggaagcccctaacccttggaggcctctgactccctgaaaaagactcagtgcataaacagggcctaccccaaagtagtaaaataggactgaaagtgtattgatatctttaaaccatttctaagaaaataacattgtcttggataaatatgagtgccatgaacttgtgca

SEQ ID NO: 183771 - DNA, 367 bp, Homo sapiens
tgggaaggaaagccatgggagcttgcacagtggatgcgaacaccccaggaagtatgtggagggagggaaggagagcagacacggctggctgtccaacaggtacccatcctccctttcttcctcagaactctggttctgattgagaattgctgcctggaaaaagtctaaactgcgaacctccctaagctagaagaggctagacaaagagcttccagccattgagatgcagaagtgtcgcaggaaaagctttaggagggctcattacaacagagggaggagcccttcttcctgccctctggtcgcctggaatacagatcatgactgcaggcccaggaggcctcttgtaccatgaggtgagcttgaagac

SEQ ID NO: 183772 - DNA, 137 bp, Homo sapiens
tagcaagagaccgccactcctcaccactctgggtcagggccaactgcagtttcagagggacagaaataggaggtgacccaaagagggtgcctaagcacaggtcagaggtgaaaagtcagactcaacctttcctgagg

SEQ ID NO: 183773 - DNA, 265 bp, Homo sapiens
gggccaccgctgatagtgcctgtcctcttggtactgcctctgcctccctccgctaaggaggcaccttgcctgcctgctgtcccatagtgcccagccccagccccagccccagctccagcccatagaggagggaggaacactggaagggccctgagcaccagggggcaaggccgggaagaagatgggtatgagctcaggattccacagttagtgcttcaaagaaatgctcatgggaccctgcaggagctttcagagtcccccacat

SEQ ID NO: 183774 - DNA, 381 bp, Homo sapiens
ggaagaaggctgttgtgaagctttatatgattatttaataggataccataatcttatcaatataataaagaaggccaggacatcagaaagtttgctgtgacagtaatagctatagcatagttaataagtagctaggaatccttgactagaagccccctttgaagaaagagtcacaggtggagcttcaaacacactagctgcagagattcattccaggaaggctcaagctgttgttacttttgggtaataaggcacctttacctactgtaggtagcaaaactaatgcctatgattgcactaaaggaactggcaggagtggagtgttactgagtcctgtgggggcttaatttgggaagggacaactagcatgtgagtttcctg

SEQ ID NO: 183775 - DNA, 296 bp, Homo sapiens
gttggtgaagttaagaggatctcgtgccttccccggtgaggacattcatctttcaagagaggggagaccatgacactcactcctagagggaggagcacaggagagaaatggtcccccgggcctcactaggaaccattgggggcacctctcaggtcctctccttccagtgggaacgccagtttccctcagatacactgagccataaaattagcctcagttacgctgaagctagatatacttggtatggggtagttattagtaatgacagaattttctagacccccacttgcatattt

SEQ ID NO: 183776 - DNA, 262 bp, Homo sapiens
acagagacgaggaggaaggctgcgtggttttagttgtctgtttgtggttttgagcactcaatgtgtgaaccatagcaatagcacctgtgccagagtcagcacctggcacaaacttctcaatgcgccaatcagtcttaactcggggactctcttatcagctgaaatacaacactattgcctttcgacgttcacagagatcttaggtatgcgtgtcctgcagagtggttagctaaggatgatggctttctgcccatttctcaca

SEQ ID NO: 183777 - DNA, 139 bp, Homo sapiens
tgtaagtgaaatttgctgaaattaaccctggaatgtttacttcaccatgtaatatattcaaaaatggtgaaatgtcacaattgacatataaagaaaaatggctataaatatatgtatggggtaaaaaatatccaatata

SEQ ID NO: 183778 - DNA, 213 bp, Homo sapiens
agtttccacatttgcttttctaagaatgttcctagctgtcaggtctgacaaaatggctttttgagaaaacgcagttgttgtctgtgggtcacatgtgtgggggcagatgcctggggctcccctgagctgacagtcacagcaaagcaaggagggggtgcacatgccagcctggggcactgagcgccacgctgagcagtgaggaggaaacgccaa

SEQ ID NO: 183779 - DNA, 126 bp, Homo sapiens
gtgtgcctgtagcgtccttcccttacctccccactgtgaacttcgcagggtgaggactgggagccttttaaaaaacaaaacagaacagtttggccagcatggtggctcacacctataattccggca

SEQ ID NO: 183780 - DNA, 547 bp, Homo sapiens
ggcagagcagggactagagtgaggccagagagggacccaaggcacaaagggaaggaggctgtcaccctcagggctgtgtacttgctgtttgtgcccttcatttgtgccctacgtggctctctgtcctcatcctagtcctggcccttgcttatggggacagacgggtccaagggaggagggtggcgaagtgctcttctccacacctgtggggacagatgctgagaatggaattctacagagacagtggacaggcttggtagtgaactttccaacaacctagagctctcattcctggtgtgggggccagaagactcccgaaggacaacagttttgtcaggtgcccttggtctgggccagggactcagcattagaactgggcatctgggtagaagacggtctgtggggccatagggtgccacgtgggccccttaacttgatagggaaggagggctccctgcctggtttatgcagggtgtagtgggaaaaggcctgaagggcgccctctcccatttcccacacacttatttgagggtctaacccgaggcag

SEQ ID NO: 183781 - DNA, 234 bp, Homo sapiens
ggtggagtgtaggaacagaagtccagccacagagggggtgaggaaaggagggggcaggcatgggtggccctttcaggaggtgttattgtgaagaggagcagagaagggcaaccactggagaagacgcagagtcaaaggagagatgttgcctaaacataggagatactaaagtccacccctatactgatgggaagaagacactgagttcagagagataactgcagaatggaagtc

SEQ ID NO: 183782 - DNA, 403 bp, Homo sapiens
ggtgaacgagtgagactccatctcaaacaaacaaacaaaaacagctaaaatctgcttggtgctttgcactcttagttgccattttcttctaagtgagatcttcatttttaaatttcattatttgagtgttgcaaatctcacattggacttacctgcatgaaattcccaatttctcctcaatcaggtctccacagtttaaattttgttatttagagtgttataaattttacgttggcctcgttcatgagaaagtgcattttaaaattaaatacaagtagctttcaagtttacccactgttcttaattctctaccccatttatgaagttgaacaatcaagaggtagccacatttaaaaaagtggttcctttttgcttttgcttttgtttttaatagagacaggat

SEQ ID NO: 183783 - DNA, 287 bp, Homo sapiens
ttgaccgtggcttgtgggtggcttgaaagctacttgtatttaattttaaaatgcactttctcaatcaggtctccacagtttaaattttgttatttagagtgttataaattttacgttggcctcgttcatgagaaagtgcattttaaaattaaatacaagtagctttcaagtttacccactgttcttaattctctaccccatttatgaagttgaacaatcaagaggtagccacatttaaaaaagtggttcctttttgcttttgcttttgtttttaatagagacaggat

SEQ ID NO: 183784 - DNA, 139 bp, Homo sapiens
actctattcattcatttattcaacaaatatgtattgagttcctgctaggtaccaggcactatgctagactcgggagacagtgtaaacaaaacagacaggctctcgtggagcatacagttcagaatggagacaaatgtta

SEQ ID NO: 183785 - DNA, 612 bp, Homo sapiens
ctctgatcagtgtgtactggtaattcactgtggtttcattcagcattttttgatgacgaatatggctgaacactgctagaagctttagttttttttaacctttcgcattgagatctacaattagcctataatttatttttgtaagtgatggcaagcaaggaccaaaattagttttctttttcttttcatacagataggcaattgacgtaggatcatttatcgaaagatctttctttccacattgctgtaaagtgccattttaatcataaattagtatctacatatatgggtctgattcagggctctattctgttccattatccattcatttattccacactgtatattcaatagtgtgaatcctacaactttgttcttccttaatattaccttgactattcttgccatttgcactgccatatgaattttagaatcaacttatataaacttctgtaaaagtttcaggtatctttcttagatttattaccagcatttgatattttttgatgctattataaacagcatctaaacatttcattttctgattactgttatatagaaatataggttttgtataataacctcacatccagtaatcttactaaatttatg

SEQ ID NO: 183786 - DNA, 445 bp, Homo sapiens
ctctgatcagtgtgtactggtaattcactgtggtttcattcagcattttttgatgacgaatatggctgaacactgctagaagctttagttttttttaacctttcgcattgagatctacaattagcctataatttatttttgtaagtgatggcaagcaaggaccaaaattagttttctttttcttttcatacagataggcaattgacgtaggatcatttatcgaaagatctttctttccacattgctgtaaagtgccattttaatcataaattagtatctacatatatgggtctgattcagggctctattctgttccattatccattcatttattccacactgtatattcaatagtgtgaatcctacaactttgttcttccttaatattaccttgactattcttgccatttgcactctaacctgggcaacaaggaaactgtcttcc

SEQ ID NO: 183787 - DNA, 290 bp, Homo sapiens
caaaagcttctctgaaccaatgtgcttgtctttgaacagaatttttaggaagcctccctccatttccatgctgaggctccttgtggactgggcatttccgtgaggtgggatgtaacatagtgtgcgaacgccgagagccaggttcttgtcttcatgcttgtcgtttattctttttgattgtgttaatggctccgagtacgtcaaaacatctcatgaccaagtagttagttacgcatttgatgttttggtggcatgggctgcgtaaggcgggagagcagctccgggagaag

SEQ ID NO: 183788 - DNA, 187 bp, Homo sapiens
gttgctctcacgctataacaaaactgaatagttttttgtgcaacacctaaaattatctactatctggttcttcaagaaaaagtttgatgactcctggtttatgccagtaaatattcttataaaataccatgttaatggctgcctaatattctaattaaatgctcagcagaatttccctagcggtgag

SEQ ID NO: 183789 - DNA, 379 bp, Homo sapiens
agctgacccgcttaggggctgaaaaagtataagatagggtacctgctggcaaattaccatctattatggactgaattgcattcctccaaaattcttacgttgaagctgtagcccctaatgtgatggtatttggagatggggcctttgggaggcaattagaattagatgaggtcatgagagaagcgcccaagggaccctcataatgggattagtgccctcataagaagagactccagaggacttgctgtcttcctctctccctctctcccacctttcccccctcaccctgtgaagacactgcaagaaagtggccttctgcaagccagaaagagagaccttgtaccagggaaccaagtcagctggcatcttgatcttaagc

SEQ ID NO: 183790 - DNA, 196 bp, Homo sapiens
aattacattcatacataatatggacttcagagccagtcactatttgaccctcaaaagcacagattgagtcatatataatcttcaaaacatagtccagcatcgtttgtcgaaggtatgtatggcatctcttttgtaagttaagtatgccatgtcttgcagattacttgtaaaattcttacctaaaaagctgttaatt

SEQ ID NO: 183791 - DNA, 700 bp, Homo sapiens
tcttgtttatattgcagaaaacatctgcgagagtaaatgactgagatgaaagatcttggcaaagggctatttttctttgcttggcttaaagggggacagatgaagactttagcctcatcctcgccttccccagcgtgactccctcccccagcttccagagaggagagaaatgggatctgaatgaagacagaccagaaggtggcccagccggccccagggcctcacgtccccaggcaggggagattgtttttcctgtggaacaggctggcctggaggaaaaggctccgtgggtggagaggaggggtgcagattagcatgcttctgcagggctttcccccagcgctgtccactctctgccctccctccaggccacacggtcacccttgccagcagcagacctttgtcttgggcttggtggcatgttatggaggagagaccatcccgccagcctttcctccctcccgcccctctctcctgagtggttgtgctgtgcagggagtgacatcctgggctgtacagcctctctcttactccagggagctgtgtggctttagacaagttaataacttcttgggtcctcagtttctccctttgtaaactggggataaatatacctgcttcacagagttgtagtgaggatgaaatgatgtaacaatgcatgctccacacaaaatcaggcacttaataaatggtgatgaca

SEQ ID NO: 183792 - DNA, 1597 bp, Homo sapiens
cagaattttctcacataaatactgaggaagaccctgccctctcctcactcctctggacttggccctgagctggacctggtccactggggtaggcagggcgatggggaacctgtttatgctctgggcagctctgggcatatgctgtgctgcattcagtgcctctgcctggtcagtgaacaatttcctgataacaggtcccaaggcctatctgacctacacgactagtgtggccttgggtgcccagagtggcatcgaggagtgcaagttccagtttgcttgggaacgctggaactgccctgaaaatgctcttcagctctccacccacaacaggctgagaagtgctaccagagagacttccttcatacatgctatcagctctgctggagtcatgtacatcatcaccaagaactgtagcatgggtgacttcgaaaactgtggctgtgatgggtcaaacaatggaaaaacaggaggccatggctggatctggggaggctgcagcgacaatgtggaatttggggaaaggatctccaaactctttgtggacagtttggagaaggggaaggatgccagagccctgatgaatcttcacaacaacagggccggcagactggcagtgagagccaccatgaaaaggacatgcaaatgtcatggcatctctgggagctgcagcatacagacatgctggctgcagctggctgaattccgggagatgggagactacctaaaggccaagtatgaccaggcgctgaaaattgaaatggataagcggcagctgagagctgggaacagcgccgagggccactgggtgcccgctgaggccttccttcctagcgcagaggcggaactgatctttttagaggaatcaccagattactgtacctgcaattccagcctgggcatctatggcacagagggtcgtgagtgcctacagaacagccacaacacatccaggtgggagcgacgtagctgtgggcgcctgtgcactgagtgtgggctgcaggtggaagagaggaaaactgaggtcataagcagctgtaactgcaaattccagtggtgctgtacggtcaagtgtgaccagtgtaggcatgtggtgagcaagtattactgcgcacgctccccaggcagtgcccagtccctggggagagtttggtttggggtctatatctagagggaccttcaaagtatttgttcctttaaatttcagaccatgtccaacccagctgtgctgctgggaatcaggagaatagaagcaaaaaacgaaagagttctgttcagacttctgaagagcagcctgtggctacaaatctatgctgataaatgagattgagaactcaactgtattttgccataaatgcttctaagatatatccagctgggacttctattactccctttggaaaccttaagatcaaaaagggaataagaaacccttcttctgtatcccaataatccaccaggataaaggagaaactagaaatatgcaactcccttgatttcagtgtttggcaggtaacaaaaaattgagacccagacactggtcaacaggaaaacaatacagactcccagaattagaaagtgttattttaatgcaacctag

SEQ ID NO: 183793 - DNA, 1899 bp, Homo sapiens
cagaattttctcacataaatactgaggaagaccctgccctctcctcactcctctggacttggccctgagctggacctggtccactggggtaggcagggcgatggggaacctgtttatgctctgggcagctctgggcatatgctgtgctgcattcagtgcctctgcctggtcagtgaacaatttcctgataacaggtcccaaggcctatctgacctacacgactagtgtggccttgggtgcccagagtggcatcgaggagtgcaagttccagtttgcttgggaacgctggaactgccctgaaaatgctcttcagctctccacccacaacaggctgagaagtgctaccagagagacttccttcatacatgctatcagctctgctggagtcatgtacatcatcaccaagaactgtagcatgggtgacttcgaaaactgtggctgtgatgggtcaaacaatggaaaaacaggaggccatggctggatctggggaggctgcagcgacaatgtggaatttggggaaaggatctccaaactctttgtggacagtttggagaaggggaaggatgccagagccctgatgaatcttcacaacaacagggccggcagactggcagtgagagccaccatgaaaaggacatgcaaatgtcatggcatctctgggagctgcagcatacagacatgctggctgcagctggctgaattccgggagatgggagactacctaaaggccaagtatgaccaggcgctgaaaattgaaatggataagcggcagctgagagctgggaacagcgccgagggccactgggtgcccgctgaggccttccttcctagcgcagaggcggaactgatctttttagaggaatcaccagattactgtacctgcaattccagcctgggcatctatggcacagagggtcgtgagtgcctacagaacagccacaacacatccaggtgggagcgacgtagctgtgggcgcctgtgcactgagtgtgggctgcaggtggaagagaggaaaactgaggtcataagcagctgtaactgcaaattccagtggtgctgtacggtcaagtgtgaccagtgtaggcatgtggtgagcaagtattactgcgcacgctccccaggcagtgcccagtccctgggtaagggcagtgcctgataataccccacacaagttcacttgattaattgcatcagtggaaggggacatagcttctctcttagagagaacagattggaaagcaatcggaaaattgcagttttggtctgtagtcctcatgatatctgctatcagtggggaaaatggaggcccaagattctacagcatattcctggcggggctgaaattggaacctgggcctcctgactttggcagacccccatttcatctttcctgcaaactactttcccatctttgtgcctgtacttatgcagctttctacagggagagtttggtttggggtctatatctagagggaccttcaaagtatttgttcctttaaatttcagaccatgtccaacccagctgtgctgctgggaatcaggagaatagaagcaaaaaacgaaagagttctgttcagacttctgaagagcagcctgtggctacaaatctatgctgataaatgagattgagaactcaactgtattttgccataaatgcttctaagatatatccagctgggacttctattactccctttggaaaccttaagatcaaaaagggaataagaaacccttcttctgtatcccaataatccaccaggataaaggagaaactagaaatatgcaactcccttgatttcagtgtttggcaggtaacaaaaaattgagacccagacactggtcaacaggaaaacaatacagactcccagaattagaaagtgttattttaatgcaacctag

SEQ ID NO: 183794 - DNA, 791 bp, Homo sapiens
ttatatttttcctaacatacattcacatgagtacggaactattaaattttaaatgaccatccacgtgccatctccagttttctcatgtgctaccgtttgcttcgggtttatagatttcttggaactgacatgggagggtggctaggacacagatgggtgcagtgggctggacatccagtggggccaattacgagtcatgcacccttgggcaattgacttctgccctctgagcctcagtctatttatctgtaaaacaggtctagtagctcttggagggttgcatgtagcgccatgtaagacaagtctagtagctcttgcagggctgcatgtggtgctgtgcctggcacatggtaggcattcaggaaataaggggaggggggtccatgctgccctcacaacaggaggaagtcaggactgcttcccagcacttctatctctagatgaaaaataggcctgagagccacaaagccggtaagtgaggctgccatgactgtgacctggtatcccggtgccacagccacactgctcttttcttcttcttcttcagagcatgctagagtcaaggggagagggaccactgcctgtcagcccatctcactccaatgaggcccttcaaacacccacctcagcagccatgccccaagcccaggacacgaagctccacactgaggtccacgctgtctgggaggaaggcagcctcggcgtttgccgcctctgagtaaccacctccccaagacatgattcatacctgtctggggtcacccacatcctcattccctgcaaaggaatgc

SEQ ID NO: 183795 - DNA, 739 bp, Homo sapiens
ttatatttttcctaacatacattcacatgagtacggaactattaaattttaaatgaccatccacgtgccatctccagttttctcatgtgctaccgtttgcttcgggtttatagatttcttggaactgacatgggagggtggctaggacacagatgggcaattgacttctgccctctgagcctcagtctatttatctgtaaaacaggtctagtagctcttggagggttgcatgtagcgccatgtaagacaagtctagtagctcttgcagggctgcatgtggtgctgtgcctggcacatggtaggcattcaggaaataaggggaggggggtccatgctgccctcacaacaggaggaagtcaggactgcttcccagcacttctatctctagatgaaaaataggcctgagagccacaaagccggtaagtgaggctgccatgactgtgacctggtatcccggtgccacagccacactgctcttttcttcttcttcttcagagcatgctagagtcaaggggagagggaccactgcctgtcagcccatctcactccaatgaggcccttcaaacacccacctcagcagccatgccccaagcccaggacacgaagctccacactgaggtccacgctgtctgggaggaaggcagcctcggcgtttgccgcctctgagtaaccacctccccaagacatgattcatacctgtctggggtcacccacatcctcattccctgcaaaggaatgc

SEQ ID NO: 183796 - DNA, 438 bp, Homo sapiens
agccagtgtataatgttataaaatggaattctaagttattaattgtaatctgtaggtgacctcggtattaacgtgaaaaacattcaaaacaagcaaaaaaagggacaaaatggaaaaaaattagactatgcgcgcattgtacttatcaggtttagagattaaatatattggaaactcgggatgaatcctgcccacctgcccctcttgcctgcggctggtctgtccctaaggagccgtcaaggtgcgcactgaagcaggaacagagcgacgtgtgactgagccagaaccgcccgctcgcgggcccatcctcgcctcccgggactcgccaaacgccctgactgaagggcccgcagcggaaaacgctgctgcagagcagcactttgtgctttcctttgcatagatatgagctagaaataaatgttattttctaagaaaaca

SEQ ID NO: 183797 - DNA, 310 bp, Homo sapiens
gtcccaaaaacaaacaatatttcattgcaattgcacttcaaatcccacatgtagagaaattctgtttacaggcagttttccaaatattataaactccattacagagctgttaaccaaagtcctagtatcttatcatttttaactctgtactatttgtaataaaaacaaccaattaaaaaaattttaatgagaattccaagtttaactcagataaagcttttttgtaattgcattcctgtaaatgtgctatttgttcgtatggcttgtagaaactaaatgctgctgagctttctcatggtgcaagcagact

SEQ ID NO: 183798 - DNA, 1005 bp, Homo sapiens
tgggtctggagctggttttggaaaagatcaacaaaattgatagacactagcaagactaataaagaagaaaagagagaagaatcacatagacgcaagtaaaaaatgataaaggggatatcaccaccgatcccacggaaatacaaactaccatcagagaatactataaacacctctatgtaaataaactagaaaaccaaaattaatgggaaaaatatgagcatctgtcctacttgccccggacagacaggtttgggttgactgaatagtcccaaattgataagaatttcttcttctttcagaaaagtcagccaataaatataaaaaatgactgtttaaaatatcactcccaacagattattttataatggtaaagggaaaaacaaaacctaagattagaggcccaggttgatatcagctgaatccagtgataaaagtggataatccaacatcatgtatctcagctcctcacatatactattaataggcacagtgtgaccagtgatggatttgtcccagatgtattcaacctgaatctaataaggcccttagatctgacttccagtttaagagaaatatgggagacaaaggataaaggcagaggacatccaggaagcagatggacagatgtaaaacatgacatgctgcaagaacagttaacctaatcccagcaacaaatcaatggccaaatagggtgagttgggggaagcaaagagaagagtactctagattaaaagactaataacttataacttaacaactaaaagtaatatgtggaccttatttgggtcttcattcaaagaaaccaactgcaaaatggtatgtaagggacaacccagagagtttgaatatgatggattattaggaaataccaaattctagtaattttgtaaggtgagataatggcattatagctaagtatgaaagtatttttaaaacctttatagcaagagaatttttatagtcttctttttcctcaagtctttctggctaaattttacttcattc

SEQ ID NO: 183799 - DNA, 536 bp, Homo sapiens
tcctttgggattttggctggcttacccatacgtctacacaggctattagaagccaaaatgaccctatactacgggtgaaggggggaaacagtcacaggggtttcagccagccactcttcccagggaaaatcaatcccacagagagggaggctgggccagaagccttgcagagaggccccatctacagggagagagctcagaatcagggttgggcctcccagaaaaacaacagcaagatcgtggcagagacagcaacagtgatgaatgctggaggaaagcaggaggctgggaggctgggtccagtcggcttcaggctggaggactggggagcagcagggaaggaaaggagcacagaggggacagtggaagacaactggacaggcatgccccagagcaactgtgggatgctcgactgggacctgggagaggaaagagcgacctgcagggatgccagtctgatcctgtagggtcctggccaagaggaaagcagatagagatttcacaggatgacagcctggctgagatggacagagagg

SEQ ID NO: 183800 - DNA, 881 bp, Homo sapiens
ccccaccagcccccaagaaaaagatggaccttgagcagatatggcagctgctgatgacagcagacaggaaggactacgagaagatctgcttgaagtatggcatcgtcgactaccgtggcatgttgcgcaggctgcaggagatgaagaaggaacaggaggacaagatgcgacagtacatcaacaccatctccagcttaagacacatcagggtcaccaaggatgggaatgcaaagtttgacttggagctggatctcaaggattctcagagcaagatttacctgtataaggatggtgagatgatcccctatggcttcaacaaccaaaccaagcactgtctgcgccggctggggaagcgctatgagttccagattcaagacctgaggcctgaggactctggcatttaccaggtcaaggtggaggatgctgtggtcttctccacagaactggaggccagtgccatccccccaagagtggtggtcccactggcggagacccactgtgaggagcagggtgacgcagtctttgaatgtaccctctccagcccctgccctagtgcagcctggcatttccggcaccggctactccaccccagtgacaaatatgaagtgtatgtgtcccctgacgggctgacccaccggctggtggtgaggggggcacgtttctcagacatgggcccctattcgctgggcaccgggctctacacttccagcgcctggctggtggttgaagctgggaaggataaagaacttcagtccacaagtgctgaccacaaactgcagaggcaaggagcccaggcatcaggagcagaagagtctgggagcatcgagagccagggagagaaatccagagcccttcgccccgagccatcccccgcgcatacc

SEQ ID NO: 183801 - DNA, 1464 bp, Homo sapiens
ccccaccagcccccaagaaaaagatggaccttgagcagatatggcagctgctgatgacagcagacaggaaggactacgagaagatctgcttgaagtatggcatcgtcgactaccgtggcatgttgcgcaggctgcaggagatgaagaaggaacaggaggacaagatgcgacagtacatcaacaccatctccagcttaagacacatcagggtcaccaaggatgggaatgcaaagtttgacttggagctggatctcaaggattctcagagcaagatttacctgtataaggatggtgagatgatcccctatggcttcaacaaccaaaccaagcactgtctgcgccggctggggaagcgctatgagttccagattcaagacctgaggcctgaggactctggcatttaccaggtcaaggtggaggatgctgtggtcttctccacagaactggaggccagtgccatccccccaagagtggtggtcccactggcggagacccactgtgaggagcagggtgacgcagtctttgaatgtaccctctccagcccctgccctagtgcagcctggcatttccggcaccggctactccaccccagtgacaaatatgaagtgtatgtgtcccctgacgggctgacccaccggctggtggtgaggggggcacgtttctcagacatgggcccctattcgctgggcaccgggctctacacttccagcgcctggctggtggttgaagctgggaaggataaagaacttcagtccacaagtgctgaccacaaactgcagaggcaaggagcccaggcatcaggagcagaagagtctgggagcatcgagagccagggagagaaatccagagagcagggccccagggggggctcccttgaaggggctgggccggcttctgggctccagcacatagccagcccagacagggatggccttggcagacatggctactccttgatgggggacaaagggacagctgactcagcctggggccctggacaggagggcgagggctttccagtagcagagggaagcagagccactcttcccagggaaaatcaatcccacagagagggaggctgggccagaagccttgcagagaggccccatctacagggagagagctcagaatcagggttgggcctcccagaaaaacaacagcaagatcgtggcagagacagcaacagtgatgaatgctggaggaaagcaggaggctgggaggctgggtccagtcggcttcaggctggaggactggggagcagcagggaaggaaaggagcacagaggggacagtggaagacaactggacaggcatgccccagagcaactgtgggatgctcgactgggacctgggagaggaaagagcgacctgcagggatgccagtctgatcctgtagggtcctggccaagaggaaagcagatagagatttcacaggatgacagcctggctgagatggacagagagg

SEQ ID NO: 183802 - DNA, 106 bp, Homo sapiens
ctgagtctcaactagcttaaaacacccttgactagaaatgcccaaggtcaccggtaggctctgtagccagctgagaagaaggatatttgatgtctgtgcctcatgc

SEQ ID NO: 183803 - DNA, 466 bp, Homo sapiens
gaaggcagtgactatgtcatatttatatttgtaccccaagtgcagtgcctgaaatgtgttagacattagatgctaaatgcatgatgctaaatgcatgttggatgattaaacaagtatagagcatctgcaatataccaggcatcatgttaaggcccggggatggtccctgggagttcactcacagtcttgtagaaatgagtaaatgaatatattggtaagtttgctgcattcaagtagactgaataattgttactaacaaaacaaggaatggcaacaattaggtcactacagtaattgctcaaagcacaattaacagactggagcattcaattatgtggcaaccatatggttatgcatttcaccatgttgacatcatactgtaaaattcacacattatatgaaaagaaattacgccaggaaagtacaggctaccacaaagtaaagtgaaaaacacattactgaaatt

SEQ ID NO: 183804 - DNA, 431 bp, Homo sapiens
tgagtaaactgaggaaaaccaaagaatttggctgcaaagtgacaatgatatcaaatcatctacagcatagttcatatgaaaaaggaaaatcaaatcagagttttgtatttctaactgtattctgcaacagtcagctaatcagaaaaagaagtccctaaaatctccatccaaatttgaaacaaataaaatttccaaggggggcatctatagggcaagatgcaacaaattaagtgcagactttgcactactgtaatccttacttgaggggcactcctgaatagaatgaaaaagaacagtgtggcctacggagggcatgcattactagtgtgaagaccttatctttggaagtacgtaaaagcacagcctggccatgacaaatgcccaaaacgccagacacggctgcagatcaagttgtggctttactcattgac

SEQ ID NO: 183805 - DNA, 310 bp, Homo sapiens
ttcttacaatgcagaacagacgatgcactgtctcaggtcacgcttagcctcctacgggggcacgacagaagaagaggaacatttagagaggcacagctcctacatccttggatggggagagtggggagcaaacaggccagttcacacttctttcctctgtgaagccttccttctcccagcattccctcccctcaccctactgtgttgtggccaccactctgcctgggactacagccatttgtccttctgcctctcctctgcctgagagcaaggtgagaggatcccgttcctgttctccatctcctgcccg

SEQ ID NO: 183806 - DNA, 383 bp, Homo sapiens
aaaacgtctttaaatgttttattgtttttacaatcagaatatgaatgttgtaataacacaatctaaattttctgacaaactgcacttattataaggcaggattttcaaacaatttaccacaaagccattttacatggtatatatgccacaagaaaaaagtgtcaggcgaaaaacatgtctacatacaaacagaatacaaaatgagaaattatatatttctgatgacagaaccaaaaatcatgtatttatggtaataacagtttatgatattaggtacataatgtgactgatatttgtcctataaggacacaaaagctatttattatagggtaggaagtgtaactttgcttggattcatgcacagaaaggtaccgataatatat

SEQ ID NO: 183807 - DNA, 492 bp, Homo sapiens
gcaagacagtggctaaagcaacagcccacagtctagtacagataaagaatgaaatgaaaacagacatgatgaacagggagaaaatgaagaggctaaaacactaaagaaactgaagaattggtagaatttgaaaaagggagaagtgaaagtttaagacattcattcatttaatcaacaagtattaataccttctaacatggtttagatctgtggccccacccaaatctcttgtcagatggtaatccccagtgttggaggtggggcctggtgggaggtgactggatcatgagggtggtttctaatggtttagcaccatccccctcttggtactgaatagtgagttagttctcaggagctccggttgtttaaaactgtgtagcacctcccccttctctttcttcctcctggccatgtgaagctcctcactctcactttgtgttccatcgtgagtaaaagctccctgaggcctccccagaagcagaagccgatgtg

SEQ ID NO: 183808 - DNA, 270 bp, Homo sapiens
aaatgaaccataggaaagacgtggggagaaacaggaagactcattgagaataaaacagaattataaaactagtaacaactgaacccattaatatagttattgaaaatacagtaaagaaaagccatgcaataaccataacttccctattattatgttatcaaaatatctgagactaaaatgaacatttaatcacattggttagcacgacggatagcctttttgataaaatatgctactgaccagagggttccatactttctaagttatacg

SEQ ID NO: 183809 - DNA, 305 bp, Homo sapiens
gtgtccatcttggtagagaaacatcagcgatttgaagaaaagataaacaggtgaaaatggaaagaaatttcaaggtactgggtctagcactgctctcatgttcctgccccaaaggaccttggcagcttatagcttgttaatgctgtctgcctaggattttcccatgagtcaccctacaccagggagcattaccctgtgaaaactgtcagtctgccagaaccacatgacatcataaaatgtagctcttattcacaactgaaaggcaaacaaatccactcaacacaacgtcacttaggaagtcgttg

SEQ ID NO: 183810 - DNA, 558 bp, Homo sapiens
ccccttccttagtccagagcagcccacttgtggctcctggccctgacctgtatgaaccggaaactcaggccccctcttcctgaggaggctgccatggctccagctgttgactcgctctcccctctcgtgtggaatgagtgccctctgctggccgtccctggcacagccgctcctgtcaccttggcttcccaggaaggagctcccccttcacccacccacccccagctgcctcctcctgcaaggtcagctgtgcctggataaggaggagctttgggccgggcacagtggctcatgcctgtcatcccagcactttgggaggctgaggcaggcgaatcacctgaggtcaagagtttgagaccagcctggccaacatggcaaaactctgtctctactaaaaaatacaaaacttggccgggcgtggtggcgggcacctgtaatcccagctactcaggaggctgaggcaggagaatcgcttgaacctgggaggcggaggctgcagcgagccgagatcgcgccattgcactccagcctgggcgacacagcaagactctgtctcaa

SEQ ID NO: 183811 - DNA, 228 bp, Homo sapiens
tgcaggggatgggaaaagacgctattaaaactgaaaggatgaaaagaacaggactcctcaggtataactaatatgtttcagagtcagagattatttcagatttggaagaagtcaaataatttatttcacttaaagacacacaagacccagtgttgtaaatgatctggaagataaacatagaggaacatcattaagtagagtattatcactcagctttccaggaaataa

SEQ ID NO: 183812 - DNA, 718 bp, Homo sapiens
agggggacactcttcaacccagtatctccaccagctgaagctagccctgcctaccttggattcacgttgcggggatgccccgggccgacgcagcagcaggtgcctttggctcagtatgtgggtctgctccctgtccttctctcacagccagaagctgagatggacaaactatgaacccgtgctccatcctaagcggtgggatggcaggatcttctgaaactgtgactgggcaggtggtttgaatatctgaaatcaggaccatctcagaaaagctggggtgcatcatttcctctagtttgtggctcttcacaggcagaaggtttgatattaggttgtgtgtgtagttttgaaaaccagccagctgagagtttcaccctgatttgttctcatccagtggcgaggaaagattgctttagaagcacagccgacctaaatagggatgtgcattctcctgggtgcacacacagcttccttgttgctgtttggcctgcaggaaagtaaagagtccaagttgctcatctccacgggtctcgatttttctcatctgtgaagtggctaaaatgaaggccgctgtctccaagcctgtgatggggattgactgccttgcggagaagcgtgtgtgtcaactgcacgttgccgtgtaggagctttgctgggtacgagctcgattcgcaatcagtctagtgttctggtgatgttccgacacaaaacgagaatc

SEQ ID NO: 183813 - DNA, 191 bp, Homo sapiens
tcacttagactatacaaccaataatacatccttccaaaaatttaatagattaaaatttgaatttccaagatcagactctcaaatcaatggctgtagataatgggatcgactttacctcacaagccaaaaccaacagagctctgacttactgaacatccttcatgaccacatacaaattgactcaaagcaaa

SEQ ID NO: 183814 - DNA, 416 bp, Homo sapiens
ggaggctgaggcatgagaataactagaacttgggaggcagaggctgcagtgagctgagatcgcaccattgcactccaacctgggcaacaagagtgagactccgtctcaaaaaaaaaaaaaatttagctgggcatagtggcacacacctatcgtcctaactacttgggaggttgaggcatgagaactgcaggagtttgaggttatactgagctctgattgcaccactacactccagcctgggttacagaatgagaccctgtctctggaaagagaaaaaaacaaagaattaggagacaaaaatttagcagaaagtttggcagtgtcttataaagttaaacatatagttcccataaaattcagcaattccattattaggtatttacccaaaataaatgaaaacatgttcacataatgac

SEQ ID NO: 183815 - DNA, 239 bp, Homo sapiens
caggagcaatacacgctggtaataaataatttaattaaactagtagtttactgattttaaaagtaaaagtctcttttcacatgctctcacttgctcttatcccattcttctctccatggataacgctattaacagtacattgtgtattctttaatgctgagagcttgtcatcagaacatacagaattaccttatactgtggtaggaatatatcataatttatgtaattacactgttgtg

SEQ ID NO: 183816 - DNA, 240 bp, Homo sapiens
tttgtgcaaccattcagccaggtttcggtactcatctggaggcttgacatggtgattgatctgcttcccatcatcatctgattgttggcagcattcagttccttgcaggctgttggacacagggccccagattacttgctgccctcagcttcttgccatatgggcctctccatctggccgctcatgacatggcagctcacatcttcaaagccagcaagacagacagcctcctagcaagat

SEQ ID NO: 183817 - DNA, 151 bp, Homo sapiens
tagtgctggctctaccactttgcagcccgatgacctcatacaagtcactttataacttgtgttgcatgaaacgacaacaaaagtaccctaatgtgtgtacatcagtgcaccatattgtcgctggcttgcttccactggacactgaaaatga

SEQ ID NO: 183818 - DNA, 307 bp, Homo sapiens
gccatagcatctcttatgtcagagtggccttgcctatagtgtgactgaaatgttcagatgtgggttaggagggaggaccctcttcctagtcttagagtcccagctcaccagggaaacatttctccaggaggagtgttgatggtgggaagacagggcacttagatttccgtgctctgtgtcctcttggatggaactattatggctgactgctggattagacactcaaaagttggttggcttgttctagattcctctccaccaggtagtgcttgataggcaatgaacaagtttgcttctgcaatgctac

SEQ ID NO: 183819 - DNA, 330 bp, Homo sapiens
tgagtgccaagagccaggcagagcccaaatacacatttcttaattatatcacaaagagcctttttgaaaaacactatcagggcagagaccggcacttaaactaggagactggagaatatacaagctcctgaaacaacttttttttttctttgtaaagagacagggtcttgttatgctgcccaggctagcctggaactcctgggctctagcaatcctcctgcctcagcctcccaagtagcagggactacaggtgggagctgccacccccactgagattaaataacagtatttttttcttagtggtaggtgaagctgttcttgatgtgatga

SEQ ID NO: 183820 - DNA, 312 bp, Homo sapiens
tgtatatgttccccataaacataaagtttgagaataagtgtcagcaattcacaagtatttgataaagatttgttttgaaaaattatagcaattgcaaggattaaaaacaactttagtagttgcctttatctctgctgcttatagatcaaaactaaatcaaatacaggtcaaatcagctttttcatcagaatcataatttagtgtgtagttagaaagtagaagtagaaagtttcaaaagccctttgaaaaaaataggtcagtaggctaagtataactttatcaacctaatttatacccctgggataatatcag

SEQ ID NO: 183821 - DNA, 215 bp, Homo sapiens
acttgtccactggtaaccttgagtgttatggaggcgtcagttacaaagctgatgacccactctgagccaggatattctttaatgccagggacagtgattgtcctgcttacagagggtcaagatgatcacaatatgtgagtaattactatttttggcaaggtcaggggaggggtaggggacagtggtgaaatcaaaaatgttcagtttaccacaat

SEQ ID NO: 183822 - DNA, 242 bp, Homo sapiens
ctatcactttcattgatctatctttggttgtgtggcttgctctaaagcttcccagccagcttgctccctgatttggcccaaatcactcccaagccactgagcttctggtgaaggtagtaggaaccttgccttggtcagcagaggccacacagaatagccctttcttaaatattcaagatcctctgtctgaagttgttcttttcctggatggtcaaagatcctgaggaattctctgacagcag

SEQ ID NO: 183823 - DNA, 209 bp, Homo sapiens
tcccttgagtaattcataaaatccactcttttaacctctgaatcatcccttcatttcttgctctaagtaaaatctagctccctgaggatgccttttcctttcgcagccatctcaaatgatagatgtttcctcttttctcctccacacacttcatatcactgtacctactggagatgtggggaagaaatcttccctgctctggctggcgc

SEQ ID NO: 183824 - DNA, 340 bp, Homo sapiens
tttgccctgtcagtgtacacccttaaccattaccccacgctacctctccgggtgggatggatggatggatggggaaaaacgttggtgataaactgcctccctgagggacccaggccttgtcccaggaagtctcagagcaagccctggatgggagctcacacataggtgtggcagtggggccagagccatttacactaagaagacctctcctagctctctgctccctgccagcctcccctggctggacttagaagggcatgagaccacatctccagtagattggaagtatccccattaggggacacctgatagagacactagagaagagggcacagaatgg

SEQ ID NO: 183825 - DNA, 423 bp, Homo sapiens
atctggtatgcctaggtatatgtcgtgcgtgtgtgtgtgtcatatctctttacttaacagccaaaacaatctcctatgttaccttcagccattgtttcccctcccctataaatacatcttcattgcaagcagtttgtgggtgagaaaatgcctccattttacctatgttcaccagttagttacaacctgttgggcatacagtaggtgctaaataaatgactgacttttaagcctcaaaacttaactatagataagtgttccgaacacaagaagtagaaaactcaagcgatatgggcagccgatgaaaattaactgtgcacttatataggcagatgtaattaaaaatgaggggaggagaagagaggaataaacaaaaccaccccaaaaactcatatcgtgtgcacgacatatactgaaagtgtc

SEQ ID NO: 183826 - DNA, 291 bp, Homo sapiens
taaaaatctgcgtaaacccatgaatcaataatttacaaataatcaatgcatgatattgcaaagtcatgcataaagatccatttaaagatagactagtgaattttaacacaacagaatatgaaaagttaatatataaggtttcagattccacactgcaactaacctttaagaatctgccatttcttgagttttggtgtcttatcaaggaagaacagttacgatagctgaaatggttatggaaactttccttcttttcccaactgtgtataagagtgaggccagattttcctc

SEQ ID NO: 183827 - DNA, 760 bp, Homo sapiens
gtgtcataggagtagggagaatgaaacagggagatggatcagaggttgatgttggagaaggggttatcagtttggtttgagcaatggaaaatgttgtgaaccatgctttgtgacatggttcggggtcacgatgtcaataggttgctgaagtggaattgaggggaaagctgttggaatacagatgaacaaccaaacctcaaggctgagatgttggtgattcatcttcagggacattgaaatcacctagaatcaggtagatggttgggtaaaactgtgagtcctgcagcaactcacccaaaatgcaacagtccaccatgatttacaatttatcctcatcttgatgagatggactgactcatcttactccagggcattctgtaacttgattgagctttctaaacattttaatcaaatcatttccctactctccaatcatcagttattctatgtgccatcagacgaaactctataaattccagatgagtattgacaaccctctagcagtcaacctataatatcaatttatctgtagcagtccctatactgatcctccatgactcccgtcaagccagtctccttcccctccatcagacaggtgttccttttgctttgactcacgttgatccctcagcctggaatactcctcctctctgagaggccaatccagatccttcccttgtagctcaacttgagatgcctctctaagtggacaaatcccccttacctacctccacctcctaatcccatcttgtactactct

SEQ ID NO: 183828 - DNA, 218 bp, Homo sapiens
ttctcatctgcaaaatcagggtgattcttacctttgcttggagattggatttttgggtgggtcaaataatataactatgagaaagcacattgataatggaaaaatgcttttcaaacatgaactattattttgaaaacctacgtttgtacatttcctgttttgattccccctgtatgtgtatattctgtaggactttcttgtgtgcacatatttgattc

SEQ ID NO: 183829 - DNA, 597 bp, Homo sapiens
ccaccggtaaaatatgccctggtcccagctgcctccactcagactttggggcatggaccagagttcctttgatgtcaatgaatccaattctctagaaataccttttccagtttggagtaccccatcctcccatgcccagaccttgaaggtccaaagtgctccctggagggcctttgtccctccatacactgttgtctggagcctttgatgaagccggttattgggctggctcaggatcaagtcccaacctgaaaggtcatgggagacagtttcatcatagcttggaatgggtccgttgggaaataacttgccctcggtgtttataggaacagcatcagcatgatctggataggaagtgagtgccacaccccttcctgggtctttctcttgctatctcgtagtctcccaaatttcagattttggcctcaaatttttggaattttgccattgtcacgtactccctgcactccaagttacttggcatttttctttgagttgctttacattgtaaacttaaatagatataagttaaacagagagctttctaaaaaagtcataggctttaataaaaaaatgaaaatcacagccaggtgtgat

SEQ ID NO: 183830 - DNA, 436 bp, Homo sapiens
agacggcttcaggaggagggctagcgcagagaaagcaacacttttttttaaagcaaccgtttttttttttataaacggagtctggctcttatagcccaggcgggagtgcaagggcacaatctcagctcacggcaacctccacctcccgggttcaagcaattctcctgcctcagcctcccaagtagctggaattacaggaatgtgccacaacgcccagctaatggtggtcatttctagtacaaacggggtttcaccatgtgggtcaggcgggtctcaaattccctgtatctttaacctatcccccacttttagctccttcccatcatcatttaaattactcaaacttcttctgttttaaaaacctctccctaaactcagtgagaggtctcctgcacacccattgagccatctgctctccctggtgccttctctacag

SEQ ID NO: 183831 - DNA, 345 bp, Homo sapiens
tggagtgtcactgtgtggacgccctgctagaatctctctctcctggtcattctcctttcctctgtgcccctagagccccttgccctacattggaatcccccaggaatggggcccaggctcccttgcctctgccccctggtacagatgggcatggcctggatcagctaatgcccagattccctttcctgtggggctgcccctgccagctgtcttgaccaacctcagtgagtatcagcaactgctcctgcagacggactgtgtcctgagcctgggcaggggtctcagctgctggcatggagactctgggtcccgaagctcctgggccctgcctccatcccagctctg

SEQ ID NO: 183832 - DNA, 410 bp, Homo sapiens
agacgcgacagcctctatcatacgtgcaatgcttccgtcacagtggataccgagcgcaaaatttgtagtcatgcacatagttagttatcctgaatttctatattgtgcattcttagtgtttacacaattgatctttagctggagtaatgaggttgggaatccttgccagttttttgattttaggaagaaaccattcagtcttttaacattaaacatgatgtttgctgcaggtttttcatagataccccttctcaggttgaagaaattcccttctattctgagtttgctgaaaattttattaagggtaaatgtaggtttttgccgaatgttatttcagcatccattgagataatcatacagtttttcttttttaattggttaatatggtgaatgacagtacttgagctttg

SEQ ID NO: 183833 - DNA, 426 bp, Homo sapiens
taaagacatacccgagactgggcaatttacaaaagaaagaagtttattggacttacagttccacgtggctggggaggcttcacaatcatggcagaaggcaaggagcagcaagtcacatcttacatggatggcagcaggcaaagagagcttgtgcaggaaaactccccccttataataaccattagatctcatgagacttactacttactatcatgagaacagcacaggaaagacctgccctcatgattcagttacctcccactgggtccctcccacaacatatgggaattcaagatgagatttgtttgggggcacagccacaccatatcaccatgtatgtctctggctacacttaggaatgtctcatctatttaagttttttttaagctctacatattagcttcagaaagtacaaataaaaataag

SEQ ID NO: 183834 - DNA, 562 bp, Homo sapiens
gcagtgatgacggtgatttgttgagcacagttcacatgtgaggtgtgtgctaagcctttttacaactttcttaagtttcctaacaactcatacagcagctactaaagtgatctccatttcagagataagaaaattgaggtaagtaacagctcaaagtcataaaggtaataccctgagcaaagagaatcagagaggctggcccttgctggaggaatctagcctggggaatctggtgctgggaaggcctctgacatgctctgatatcatctccttgatttaaagcaatggtgaaggtcatggccaaaggtatcctgctgatgagtggtggagctgcagctagggcccaggagacccaaaggtcaggaaaaaggcaagtgtagtgtttggagagtaaatggcacccccttccagcttttccagtcccactaactgaattatccagaaaggagagctgattgcctccctgtaacagctgactcacatcaggttaagtttggattcttattgacaggacctaaaagcaaatcatccctcacttctttattgtacatggtcttctctt

SEQ ID NO: 183835 - DNA, 497 bp, Homo sapiens
gttcaagagtttggctctatgggtaaatctgcaccattaaagccaaagttcataaagcaactatggaaagcttctatcttagtgctcccaactgaaaaagagtgactgatggcttaagtatttttataactaaaggaaaagtgattagtggattgagtcagagtcacataaaagaaaatttgagctctgtaccgcttgcttgtgatttatttatttctatcatgcagttgccagtgctattaaaataatgtcaaagacataaagatgaatttaataagctattgatggtggatctgacagtgggttagtgcctaaagtagtgaaatgtcagggtaaagtgcattatgtgctgacttgcatcgttaaagtgactccaggcaaaccgagaagcagccgttagacttccttcagatgcactaaacggctgctcttccgctaaaagctccccagctcttatcctgggataatggatcagaactgaaacatctatgtctaag

SEQ ID NO: 183836 - DNA, 183 bp, Homo sapiens
actctgatgatagcatggacacataattaagcatgatggatttttttcttgagtagatacattcgctttttatgtaaagagttaagagaacaaccaataagctgatggcataattcttaaacatcttgcacacttaaaaatattattaaattggtaagtctaggattctcagatccttttgat

SEQ ID NO: 183837 - DNA, 507 bp, Homo sapiens
gaaagccttgaatgtatagctcagcttgaaagtgagaaaagacacccttacatgctaaaaacaaaacaaaacaaaaaacaaaagcaacagccagaattcagagtgttgcagagtagaagcagaacaggacctaagtaggtggcgggaaaggagacattttcagcaggatgaattgcaagtgagtttatatccatagaaccttacaggacaggcagccattctatgtacctgagctttgttttatatctggatgcaaggccctggaactagggcataaaaagttgcttaatgactgcatgcttttggaaccccttcttttgtggacctccaaggtgccacataagctgctttggctttatatattttggagggtaactgatggtagagaccatccagtaagtcagtgaaggacaggggtccctgaagtcactttaaactactgtggtctctacaggaaacaaaggaaaaaccaaaaattagccaacaggctgtttaataaaccaagtg

SEQ ID NO: 183838 - DNA, 466 bp, Homo sapiens
gaaatgaccacagatgatagacagccacaaaattttggacatggcaacccaagaggagagagggatgaggctacaggaggaggagtcaaccagaagaagcaaaccaatttatagctcagaatccccagaaagtgtcaggaattgaggatgccagctgcctctgaaggcaaattgaaaacaagacaatcaattaaaaatctttgtaaggagtaggcaaattctgaggtctcctaatcaaccctttgtggccaggtagccaactctccctactccagcagagcaccaaagatgtcctccctggagatgtggatgaataggtattccagacttgggaacaccagacacagctgaggtaccacaattaaatggagaaactaagcaaaaaatcacattataaacaaaaaatctgacccaactccacgcccttctttatgtcaattctcagaaatactgcattgtcattaaa

SEQ ID NO: 183839 - DNA, 431 bp, Homo sapiens
aggctagggtgcaatggcacaatcacagcttactgcaacctccacctcccaggctcaagtgatcctctcacttcagcctcctcagtagctgggactacaggtgcatgccaccatgcctggctaatttttaaaaaaaatttgtagagatggtggtctcgccatgttgcccaggctgatcttgaactcctgggcttaagggatcctcctgcctcggcctcccaaagtgctgggattagaagcataagccaccgtgtctgccccaccccttgcatttatctgtggaagaaacctacctgattgctgggttgtttcccgtcgtctgaattttgtgctcgcctctctgtagtgtgtcattggaggaactctcaaatgccaatacatgtagttcttttctcatgagactttaggattccccagtgaagagtcttcag

SEQ ID NO: 183840 - DNA, 365 bp, Homo sapiens
ggaggcaggaagggaggaataaagcaaatgtgacaaaatgttaaaaatgggtgaatcagaataaaaagtacataggagttctttgaactattcttccaactcttctgttagttcatatttatttcaaaatttaaacatttaaacacgaaagggggaaagcaaaagctctttattacagaaaacagttaatgaatataaacaaataacaaaattagaaaacccccaataaatgactcagctaataatcatcaatcattaagtgaaaaatattttgagaagtgaggtactcacatgatgctaaagttatcaccccacagatcaagtataactgcaaagggaaaaatatacctctttgatgaagaaat

SEQ ID NO: 183841 - DNA, 467 bp, Homo sapiens
atttccttccccaaatctctagactttttggccagtgctccttttatcatcactttataggctgtatgttttttcgtttgtcacctgtatttattgtattatggtttatattattctgtcattaaagtgtttctggaagaggtatttgctattgaagcaaaagaatagcataatgtagctaagttacaacaaatggaaaccccatagccataaataatttctaattatgtgccttgacctcccactgtatgggcattaagcatttcaaataagagttgctttgtgtgtgtgaccaagtttttaactgatgagaatggaaaccaagcatcctgcatactctgttggagtcagtgtgaatggcattggcttttaatttctattggaaatgtctgtatcctaaatttcaaacgtggatgtgagtactggatgaagattttaagtggttattaaaatattaattttcagtg

SEQ ID NO: 183842 - DNA, 233 bp, Homo sapiens
gtgccctagttgtacattcaagttaatacaacagattttaattagaaaggaaaagcacacaaaatgaaaggtcttactgaattcaaatctcattaaaatgcaattctagaacttgccattaaaaacaggtacaggctgggtatggtggctcacacctgtaatcctagcacttttgtgaagtatgctaggggtaccgagcttccgaaattttccggtacattcattggtcatta

SEQ ID NO: 183843 - DNA, 427 bp, Homo sapiens
aagagactcgaaatccatttcagtcacaaacagagtcgtaggagtacctctaaagaaagaaaatactttcacaaggaactgtagaagaggagtagggacatagatctgagctttgggaattacttataaataaaagtggaaagcaggtggggagagagcaattaaaaagacagagaaggggccaacttacaatttcatgaatagagaaagcttccaggctttccaaatgctcgtgttacacctcacacccaatggcttgccccatgacttcaataatgtgttggtttctctgtgtcttttctcacaaggttactgagatactaaatcagaagggtttgtgccaaacttgtgctgaaggctgataatgtagggagcattatgaattgtttcccagcttacattttggtctttgtgtagagtttgcatg

SEQ ID NO: 183844 - DNA, 307 bp, Homo sapiens
cttttcctacccccatgtttaaggcttttaagtctccttttaaatcatctccctccaggcaattccctctcaacatcctctcaccagcttagggaagccctcccgatgagatttaggagatagacaggtcacatgactatctctatgtggattatttctacataagaaaaacatccagtttggattgattcttaacagcattaatcttggagtttcaatttttcaaaataacgtatcaaattttgccattgttctagcatatggtgcaatataaaatggtcgaatgatatttatgcagggaagaaag

SEQ ID NO: 183845 - DNA, 2048 bp, Homo sapiens
ctcacagatggttcacatcagaggattctgtgcagacaacctccagtaccagcccagagcctggtagacttgctgggttgctagatccagaagagagataacaatctttacagcttggctctcaggaagccacatccctaggaaaagggggagagtactacatcaagggaacactccatgggacaaaacaatttgaacaacagcctttggccttagacctctgtgacaaatgagaagaaaccagaaaaccaactctggcaatatgacaaaacaatgttcttcaccacccaagaaaaaatcacactagcccaccagcaatggattccaaccaagaagaagtccctgatttacctgaaaaagaattcaggaggttagttgttaagctaatcagggaggcaacagagaaaggtgaagcccaatctaaggaaataaaaaaaaaagatacaagaagtgatgggagaaatactcaatgaaatagatagcataaataaaaaatcaaaatttcaggaaacaatagacacacttatagaaatgctaaatgttctggaaagtctcagcaatagaattcaacaagcagaagaaagaacttcagagcttgaagacaagttctttgaattaaccaaatccaacaaagacaaagaagaaagaataagaaaaattgaacaaagcctccatgaggtctgggttcacgttaaactaccaaccctaagaataattggcattcctgaggaagaagaggaacctagaagtttggaaaacatatttgggagaaaaattgaggaaaacttccctagccttgctagagacctaggcatccaaatacaagaagcacaaagaacacctgggaaattcattgcacaaagatcatcacctagacacattgtcatcagattacctaaagttaagatgaaggaaagaatcttaagaactgtgagtcaaaagcgccaggaaacctataaaggaaaacctatcagattaacagcagatttctcagcagaaatcctacaagctagaagacattggggacctatcttcagcctcctcaaacaaaacaattatcagccaagaatttgtatccagtgaaactaatcttcataaatgaaggaaaaatggtattttttagacaaacaaatgctgaaagaattcgccactaccaagccagcactacaagaacagctaaaaggagctctaaatcttgaaacaaatcctggaaacacatgaaaacagaacccctttagagcataaatctcataggacctataaaacaaaaaggcaatataaaaaaaaaaccctcaaaaaacaaaaaaaccaaggtatacagggaacaaatagtatgatgaatgaaatggtaactcccatctcaatactaatgttgaatgtaaatggcctaaatgctccccttaaaagatacagaattgcagaatggataagaactcaccaaccatctgctgccttcaagagactcacctaacacataaggactcacataaacttaaagggatggaaaaagacattccatgcaaatggacaccaaaagtgagcaagagtagctattcctatatcagacagaacaaactttaaagcaacagcagttaaaaaagacaaagagggacattatataaatgataaaatgtcttgttcaacaggaaaatattacaatcctaaatatatatgcacctaacactggaagtccctaatttataaaacaattactaatagacttaagaaatgagatagcaacacaataatagttggggacttcagtactccactgacagcactagacaggtcatcaagacagaaattcaacaaagaaacaatcagtgtaaactataccctggaacaaatggatttgacagatttatacagaacattctacccaacaaccacagaatatacattttattcaacagcacatggaactttctccaagatagaccatataataggccataaaatgagtctcaataaatttaagaaaaacactctctcagaccatagtggaataaaactagaaatcaactccaaaaggaaccaccttcaaaacc

SEQ ID NO: 183846 - DNA, 511 bp, Homo sapiens
tgttggccaggctggtcttgaactcctgacctcaggtgtttcacctgccttggcctcccaaagtgctgagattacaggcatgagccaccgcgcccagccttggagtgatcttattctctgcccaacattatttcctctgttgcctcaccaaagagttctggttaacatttcctatttcagcgtctctcttaaatagcaaacagtccagaaaagacctttttgttcttcaagatgttttagtccttgtatggagcagtttggagaaggataaatttgtataactaagggtaggtgagggctctaggagcttagaagagggaaagtgctcataagttctctcataattattttggcatcagcgctgaaaagttttctcatctgtaaacctaatttgaattattttggcagtttcctctattaacttctgattaggggagaaaatattgggtataaaatattaaagacatagccagaaagtaaaaaatactgcaaagaatcagggctaggttag

SEQ ID NO: 183847 - DNA, 504 bp, Homo sapiens
tcatagctgtgtctcttacgctgttctggatggaactgatgaggattcctccccaagtaacactgagtctccagttctttatcctgacacacactgctcttgaaagcatcctagtaagggttaattagtatttaacccttcaatgctctgggatcatcagttgggaagcttgtccagataccatcgtgtgtatctcaggatgagaacatacgttatcaatgaccattctgtgtgtgtaaatttattcttctaatacatatttgtcatgttccaactatgtgccagcctaggcatgtaatgtacaagacagtcccaaatctccccctgctctccccacctcctactccctgcaacacacacatggtggaaaaagaaaggtaagtcatgcaaaattatgatagagtaggatgaacattatgacaggggtatgccagaggtgccaggagtgcacatagccgggacactgacccagccccagtgtgaaaagggcacccgtccagaagt

SEQ ID NO: 183848 - DNA, 444 bp, Homo sapiens
  misc_feature (86)..(86): n is a, c, g, or t
  misc_feature (88)..(90): n is a, c, g, or t
  misc_feature (93)..(94): n is a, c, g, or t
  misc_feature (96)..(96): n is a, c, g, or t
  misc_feature (101)..(101): n is a, c, g, or t
  misc_feature (104)..(104): n is a, c, g, or t
  misc_feature (106)..(106): n is a, c, g, or t
  misc_feature (108)..(109): n is a, c, g, or t
  misc_feature (111)..(111): n is a, c, g, or t
  misc_feature (116)..(116): n is a, c, g, or t
  misc_feature (158)..(158): n is a, c, g, or t
  misc_feature (185)..(185): n is a, c, g, or t
tattcaaggtggctatacagaaggctggaattgccagaattactgaaacagctgtcttttggggggtagatttgcatctgtagagnannntcnncnttaancancntnngnttgcnctgaggccctccaatatcaagatataggaaagatgaaccgantgtctgacacctttaaaggtctgaaanaaacatttaccatcaattctctctgagggctgctacctgtgaagtataaaatataatcccggttcataagtaactcatagtctagtggtagggggtttgaggtgggcatgaagatgtattagtataaggtggaagctattgccacaatagatgagttcatccttgaatattcatttatttgactggaagggaatggtgagttattttcacacggctcccgtaagatatagtgacccaaaaggtcagtctagactaatag

SEQ ID NO: 183849 - DNA, 432 bp, Homo sapiens
actaaagatagctttatttataatagtacaaaactgaaaacaaccaaagtgcctctcagtaggtgaaattgctaaacaaaccatggaatattatataatattatattcataccatggaattctacttagtaatgaggaggagtgaactattgatacttgcaataacttgaatgccttttaagggcattaagccatgtaaaaaaagtcaatttcaaaagacttgtatgtttccatgtaggtaacatggcaaaatttttcagctgaaaaacaaattagtgggtgttaggaatagcgagaggaaggaagctgagtgtgactataaatgggtagcatgagatctttattgtagtggaatggttctgcatcttgattttggtggcgattacagaaatgtacgtgtgataaaatggcatagaatgatacacattgtac

SEQ ID NO: 183850 - DNA, 305 bp, Homo sapiens
ccaggagaagcagacggaactgtaggagcaggcatttgacgagcccagtgtggccaggctgttccaccctcgctcatcagcttacccagtgcccacacacaatgcactagctcctgcctccatgccttttctcatgccctcccacccacctggaatgtcttcctccttcctatcatccgtatctcccaatctggacaaggtccagcttacatctaactttctgcaaacataactccaatcatgattgtgaggctattacttcagtatcaatataataaatttgcacaatgtcttcatatttgcac

SEQ ID NO: 183851 - DNA, 842 bp, Homo sapiens
tctactggggtggtatcagcaagctaaatggtgagctgttcttccatctctcagtcagaagaagtgggcagcattccaattctgctactgggtggtatcaacagagccgagtagaagctaaacttccagcccctgctcagctgaaacaagcagtacttcagttctaccagggtgatgtcaccactgccccacaaaatcagacgatactttaattttctagctggggtgttataaggagaggaagggagagtttggagctgaaaaaatatctgaagaaataatggttgaagtttccccaaagctgaaatggggaaaggcgtgaactcacagattcaagaagctgagtaagtcctacacaggataaattcaaatacgtctatgccaagtcatatcataattttttgaaaatgaaaaaataaaaaataaattctaaaagaaagctggagagaaacaacatattctcatagagaaatacgaagtttgttgacagctgatttctcatctgaaattatggtggccaataagaagaggcacatttttcaagtgctgtaaaagaactgtgagtcacaaattgtatatccagcaaaaatatccgttaggaacaaacagcaagtaaagacagtctcaaataaatgaaaacagattattttgcactggcaggcctacccttaaagaatggataaagcaagttatccaaggaaatgatgacaaaagaatgcttagaacttcagaaaggaagaaagatcaatggaatggataaaaacagaggtaaatatgacaggctatccttctcataagtctcttaaatcatatttgatggttgaagtaaaagttgtaacacc

SEQ ID NO: 183852 - DNA, 189 bp, Homo sapiens
cccctgtcatttgctgccactctgaagccagagggaacttagaaaaacaatccgcttagatctaccccacgctgaaaatcgtccaccgaagtcccattgtcgtctaagtccccaacttctcagcagggcttcctgttatcttccgccactaccttctccagcctctctctgcctctgttctccctccct

SEQ ID NO: 183853 - DNA, 243 bp, Homo sapiens
gagtcactgtgcccggctgctcacccagctatttttattttttggatggggtctcactatgttgccctgggtggtcttgaactcctgagctcaaggaatcttcccaccacggcctcccaaagtgctgggattacagccctgagcctggcctcactgtggtctgttttgagaagcctttgtttttaaacagaaccacatgttggtatttcagagccaactcttctgtcaagaatccaaatcagc

SEQ ID NO: 183854 - DNA, 1155 bp, Homo sapiens
accactgcgctccagcctgggtgacagagcgagactccatctcaaaaaaaataaaaataaaaataaaaaaagttttgaaagcctccaggaatgggtgtctggccattttgaggcaagaattttcccccatggaactctgcccatccacgtaagaacaggacttgttttacagatgtttgcatctgtcaatgcagggacccctggctagcacagcataccccatttggccccacaaacctgtccttgtctagctagagtggaaagaagggagacaatgagaccacttgtgatggagcactgcaggaagggattcatgcactcacagtggagtcaccgcctctacattgcaagagagatgggaggcactgatccctgccctggtgtcctgcactgttcagagctacaggagaaaaatgagcaaaatcgcaagtatggaccctttctgcctgccccctgcacaggcaccagactcggtaggttagcactagttcctgcaggggcgttcagtgctttctttaaaaaaataaaataaaataaataaaagacaaaaaaacccgctaatggcttgatatgaatttcactcattatcttcccatagcccttaaaacatcattaagtattaaattagcaagctgaacttcctaagaggagcaagaataatttgaactctggattttaattacttatcttataaacttctatcatgtgaggtagagtgaagagccctgtctacacccctgtggactttcaaagcagctatttaagatttcataagactatccattgtgactacagtgaataaattgtggtcaagggagtgtatcgatcaaacaccagaaggctcctctcagcttctgtcgcaatcttgcacaggagagaactagacctaaacaggaggaagagttgataagcagtaagcgaacgaatcttggttctgaaaagaacagcatcatatgtaaatttcaatttacatttattagaatttgctcagtaaattgtgctctacgatggagtcaaggccagattgggctctatttccacaaccccctaaggagtagctcaccagtgtcctaagtggctgtttcctgggtgaacatagtacatatttgctgtcacgctgggaataccagtgagaatctcatgcatggacagagg

SEQ ID NO: 183855 - DNA, 133 bp, Homo sapiens
cctcaagcatggccagagcggatgccaaggccgaggaggtgctgagagcgagcaagggctgctagcacgttgtcacctctcactatgattaatacgttaagagctctaatggaaaaagtagataacatgcaaa

SEQ ID NO: 183856 - DNA, 525 bp, Homo sapiens
cagtaagatgtgctgtctcagaagccacacaagcaaaaagaatcctcatctccattaggttctttgaggttcctgtgtgctgaaattgagtaatgtccttagaaaatccaattcaccacagtaagccaacattttgaatcaattctaaaccacgatgttgtaacagacggcactattttacctcattcctttgcaatgtttccattagtgaactgataccttcatatttcatcacttttaaaaccatacttgcagctctgctatttggaattccaagattgcatgcatgccctcactgcacaaaaattctctcactaagaaataatgtacaactccaacatcaccattttgggaataggagccttccctcagcctgttcattggagctcctccttttcaccctgcctgttcacataagttccagtaaagtggactcttctacccacaagttaatctactcgtgttccaagctgatggccatcttatctgtgagtcaatggaatggattcagatactctcttttta

SEQ ID NO: 183857 - DNA, 333 bp, Homo sapiens
gtcttgaaaagagtaattttctcttcactgtttattctttactgttggttctcattttgaattaaattttcctaaagcagcaagacagaaaacaatccgcccctcccccccatatctgcgggttccaagtgggaagattcacccaactgtgaatcgaaaatatttgggggaaaaaagcaataaaaataacaatacaacaattaaaagtataaatgaaaatacagtgtaataactgtttccacagtgtgtattatattaggtaatatcagtaatttagagatgatctaatgtgcatgggaggatgtatataggttatatgcaaatactacatca

SEQ ID NO: 183858 - DNA, 736 bp, Homo sapiens
tgttttaaaggtatattattcgttagtatttccaggaatatgctgagtatggtagtgtccaggagagcatttagcataaatgaaacaaatctatttagcctaaagtacttcctaaaagtaggctacagcatagtatggtgatcagaccaaaaccttgatttgaagatgtgcaaagaggtgggcagaacaagggaatgttatgcaaatgttattttggttaccattcccaatttagctaaagggctgtaaccatggcaactgggcccaaataaagggcaatgatggtcagctttcttcctgtggtgataaagctattgtcaacttttgtatggcatgaggagggaaagaaaaatctgtttattgatgccaggaacagccaaggtacttaaatatttcaatggctattacagattcagcaaaatctgagaaatacatttaaatgaaacctcacaaagtgacttctatatgttaatttgcacgttaaaacttacatacacaccccacaataaaaactatgattaagaaaatcgtttttctagttagaacattttcaatacttaatagtgtcatgtaacttttcaaaaacagaatgccatgttggcacctctgtcagtcttacagtagtgagaccagtacacatatcttttggctagtatttcattaaaatgacaaagaaatcactgaaagtggtagtgactcccaaatcattttaaagatgccaaaacttgttgacctg

SEQ ID NO: 183859 - DNA, 312 bp, Homo sapiens
tactcataatttcacacctctagactagaagcactgagatacagtggtgtgggagtctgtgaaggcattttcttagctattaccagatgaactaaattaagaaatgttaactgtaaaaactcagacaaaccaaacctgctgggtgagggaattcctgtctctaatgcttccagatagcccatttggcttgtaagagtggatttgagacctttataaatttaaattcaaaaagagaactaaggaatagaccccttgctttgcaactagacagatctgggctcaaatccagctcatgccatttggccaagtatt

SEQ ID NO: 183860 - DNA, 530 bp, Homo sapiens
atgtaacaaccctgataaggctctgtaatttagccctgctttacaggtgaggaaacttaagacacattaggggctaggcagcttcccaaggtcacctaggtaagtaagtagcagagccacccaggaagtactcaaaagaaagattgttggtttttcttccctagttggcctagggatgataaacatggcatgattagttatgaagctgcggtagcttgagagttagagctctttgcgttctctgtcatttcttcccatcccaggttgtctgtttggacagtgtagcccctggctacgtggaggtgtgtcatggagttagttggtgcatcctgctcatactactggtcattggtagaactggagggtaggggcactacttgaattaaaaaaaaatttcttttggcaggtcagctttctcaaatacaaaagcaatgactctgttttccttacattcacttgtatttgcttaatgggctttaaaggtgtgaatgaatccaagtcttattaatttgggggcctttaattcttga

SEQ ID NO: 183861 - DNA, 312 bp, Homo sapiens
aaaaattgaagattattttactttggggggatagtaggggagaaatgactagagaaattgtagtatacagtctgcttgcccataagagggttaatgtcagagcagcctctagttcagaggttagtgggttagcagactctttttgcaaagaggggacactatatattttagactccacaggccacaaggtctctgtaacatactgttttttgtttggctaatggtttttttgttttgtttgagacagagtctggctctgtcacccaggctggagtgcagtggcacaatctcgtctcattgcaacttctgcct

SEQ ID NO: 183862 - DNA, 496 bp, Homo sapiens
agattaaatattcctagagggcagggactggacctcattcaccttcgtatggaagcagtgtgggctagagcatcttgcccatagtagaggattaaaaatgaactgaatgcagtgttgtctcaggaaccttatcccaaatccactgcccaagttccaagttggggaatggatccatttcatagcaggaattctaatcgttgctacgaggtcccagtctaccaaaagaggctgggaatctttgttttcctattcccttgcaatccatatggaggttgcaagcaaatgaccaggactgggctgctggcagtgaagctaaaaatagccatgaagccaacagcgtggagttagcaggacttgttgctaaggagaccagtcgcagagagagcaactaagcagggggaaggtgtcagatgtgcacccggagagcagaggggtccaaaggctcgcacctagcggtgttctgccttctggcagctcctggctgatgctctaagtg

SEQ ID NO: 183863 - DNA, 438 bp, Homo sapiens
ccatctgaaaacaagacagggttttttaaagttttttttaacctcttcaattcatcttcagtgtaattcagcccacccactcatagtcataatgtataccttgtcaacacacaaaaaatttcatatatcctaatcaatttaccaacaattttagttctcccagctctcccccttacttctgctatacctgtttctcaaacccaaagaaaacccaaatacttttctttcatcatcccccatttctcttaatgttcttgtcttccaatccattcagctctgctaccagtttcatcccttcaagcactgtatgccaaaatctttgactctagagagtcctaaatgtgacagagattgtcggggaatggggggtgggcaggaactgcattaattcttcacatacttcctccactcctacatcaaagctactaatgctgctct

SEQ ID NO: 183864 - DNA, 434 bp, Homo sapiens
tccacaaaggctacatagggaaaataaaatgtccttaaagagaggattaagcaagtcaagagccatacttaggaatccaactgttcaagaataggtatcatggtcttcattgttgacttatgataaagatcttccctatcccactcaccctatgctagattaatggttttccttagaagtcttagaataaatttttcttctgtttttcttattgatttgaaaagttgggatatttttcaaataaaatatctatgtacacttgagtaaatggactctgggctctttctgttatgaaagttttctgaaggaaatagatgaacaaagaacgtatattttagtttccataagttttttggttgcatctttctaaacagagtccatttttaattcaaaacttttgaattttgagtgctcactttgtggattatttagat

SEQ ID NO: 183865 - DNA, 590 bp, Homo sapiens
aactttagactccatgccacacagtctattagtagatgttgcttgtgtgaagcataaaattaccacctgtttagttcttttaggcaacagatgcaatcaaataataatctaagcacatagttaatattttcaattatcacataaatcatctccataatgtctccatcactataaacgctgcatgttttttcttaccctgcactatttaagttcccaatagaagtaccatgacagtagacttaattttttcataccaagatacccagcaacacttttcaaaagatcaaattccttcatgttcctgcacaaatttaaattaatttttatattgttaatacacttcaaaaatatatttccataacatttttgttgagcacagtagaaagtaccattttaaaatacatttttcctaaaaagaaaaaaaaaaaaccaataaaacaaagtcacgaataaaagccctggatttataaatgtgccctttgagcacatctacgcagcattctcacttctgctgctcactcaactagcattctcccctctgctgaggctttgaagaatttaacacagtaattgctttaaaacaatggctt

SEQ ID NO: 183866 - DNA, 251 bp, Homo sapiens
atggtgaaaccatctctactaaaaatcaaaaattagccgggtgtggtggcacacgccatgtaatcccagctattcaggaggctgaggcaaaagaattgcttcaacctgggagacggaggatgcagtgagccgatatcacaccacgttggagtgccaacatgggcaaaaaagtaaaactcaaagaaaaaaagccataaaaattttaaattttttatgaaacacacaagaaagaagtgagaatggctgggtgt

SEQ ID NO: 183867 - DNA, 238 bp, Homo sapiens
caggagatcatacagcagaactcacatgaattcagttagcaggttttgttcattaaatctagtgacttgaacaaatttttattatcctttcacaaaagtgcaagcactggctcctacaaaaaacagttgttacctaacgaagtgtttcagcttgttcatataagttgatggcttcatatggctagattattgctgtatcagctatcagctactgataacacactcccatcttacttta

SEQ ID NO: 183868 - DNA, 341 bp, Homo sapiens
atcctttgagctgctgttttagtggagggttggccagcccctactgcaaatgctcatgtaagtagaaaagggagagaggggagtgagctagctggcagcggaggccaggagagctgggcattggaagcagggcccaaagtgaactgcatgggagttgtgctgtgttgttaacccagagaatgaaatccactttacaagacttaattcagcagccgttcttgactagtgaataaattaaaagatcttatagaaatgggaagagtcaccgaatgtacttgtatcattgaatctgtgttttagagaaacttgagcatttctgcaatgtggtttcagaagcagac

SEQ ID NO: 183869 - DNA, 506 bp, Homo sapiens
accaccgggaagggagaaagggagaagtggggaagggctccaatcccatctggattggcagagggtaaagctgaccctgtctctcctgggaacattcatgggctcctcggtggttccctgctgctttgtctcctgaagtccccttaactcaagcagatgtgccactgggtggatgcttacctggtggctgtggaggggaggggccctctgcccttcctgagggacttttggacaggacctaaatggatccatgggtcttgtgcttgctcatccacccagctcacatctgtcctcaggaaacactggcacactcctcgccccaacattagtgaacaggtgggtcccagcacagcagcatagctctgcctctgaaacagcacatgagcccttcctgccactgtgccctccaaattgagtgccaaatattgagctctctgagaaatcccttggaagccaccctcacaggcttaaagtgaaggaaggagtgcctgtcctctgtgtcccct

SEQ ID NO: 183870 - DNA, 365 bp, Homo sapiens
aaggtatactgatttgtttacatttccaaaatgacaaaacagattatcaacatagaaataggttggcaacattgcaaggggtgaaggattctgattcgggaaaaggtggataactacaagacatgttggttgttgaaaacatagttttgggggcctttaccatcttcaggtacagctacatgtcagagctggctgggttgtgccaagcagagaaacctggcaactctagggggcaggtgggcagtggagataaagggggttataaaaaggtagggaggtgtgggcataaaaatcaacaagcaagaaagcccagagagagctgcaggtcaagagtcaggccaggcaagcacagatccctggggcat

SEQ ID NO: 183871 - DNA, 623 bp, Homo sapiens
atctgctgaagtagcttctcacttttttcactgataaaataatcacagacatttattccctagttcagcacctcccagtgctattgtgggcatggaagatgaaagtgctttaaaaagttaggaaggtagtataaagataattgtcatcatatcctattgagtactagaaactcatatcattgagaaaatactatgattccatatcttagtaattgtaagcagagaatctaatcctcagcttctggagattagaatgcagacctccctgggggaccattgttctttttgaacagcgaaaaggattaaatttgcagatgaaattaagattgcttattagctgatataagagaattttcctggattattcaggtgggttcaaaataaccataaaatccatataagtggaagcaagagccagaatagagttcaagagagatttgaagatgctacatcgcttgatttgaaggtagaagatgggatgacaaaccaagcaacataggcagcctaaagaagccagaaaaggcaataaaactttttgttgcctaagccttcagaaaggagtatggccttgccaacactctgattttagcctagtgagacccacttggaacttctaacctcca

SEQ ID NO: 183872 - DNA, 162 bp, Homo sapiens
gcggcgaaagcattcttattgcatggtatctctgtcatccatgtggggaatctagccactggcccacagagttaaacagagctttggagtgtgagaggtggggggaaagaagggacagtctactccagcttcctgtttaatttcttcaaggggaggggccct

SEQ ID NO: 183873 - DNA, 514 bp, Homo sapiens
aatcaggtaactgcttctgtctaccaagttcctactcttaccagtggagcagttaaatctggacagtcactccttggcacagggcccttgagaccttttcatgaaagacagcatgaaatgttgggaatagggatagtaataaagaggtggattctagtttatgctccatgactattatgaaaacttaggggacaagtttctgaatttctatttctcttctgtgaaggggatgtggtaaaaactaccctgcctatatcacagcgttgttgtgagcacccaatgagataactataaactttataaacaataaaatgcaatgcaaatatagtcttattatgagattgtagttcctgtaatgattatggatggctcacgggcaaaggctggatttatttaaaaagtcagagaacttctttagaattttctgtggtggggagctcaaggagagatgagtatttccggcatggtgtggagtatctacttactggattaaaagtaaggagaaaaatacaga

SEQ ID NO: 183874 - DNA, 327 bp, Homo sapiens
attcatggcaaaagagagagaataaaaaggaaaggaataaaatccagagcatgctgtgccctaaccagctggagataacaaagtgctgtgttttgctccatagcccacagtagactttggaatatgactggggaacctgggaaggatctctgcctcagtcactgacatcactatcaaagataagcctgtagtaagaatcttctatgatggtatcaatgactaggatgaagaaacaaaaccgctaaaatgtgagtcacatttatttatttatttatttatattagtcatccttttttgtgtgtgacttttgaatgttttcggagattt

SEQ ID NO: 183875 - DNA, 527 bp, Homo sapiens
gtcagattccatgactaagacagccagggagcagagtgaaaatcccaggggctctctctccaggagacacctgctccatccagatcaaacccaaaatgtccccagccagtgatgcctggctctcctttcccctcggctcatcctgcctgcatcggtgcagtgccctgacgttcccagtccagagggtggaggttgcagtgaggggagatcacagactgtcagagccttcctctctccttgcctatgcatgggttaatattcacctgaagtcccagctactagggtacgcataggagcacagcccagtttagtctgggtgacacagtgagacccccatctctaaaatttaaaaattaaatcaaatgtgcaattttttgacctgttcatgcacactacatttcggctgcatttacccaataaaaactcagagcccatgcactccacctccgtgcgcttgctaagcagtgcacatcccatcagcaagggacactgaggtcccctccaactctacctcaacccaagaggtg

SEQ ID NO: 183876 - DNA, 519 bp, Homo sapiens
ctcaacacatgctcaagctgctcagaagatgagaaactagagcagtcatttatcttttctgggattctagaacgtgtattaaccacattgcaccccgtgccccactctccattaacctagaaggccatgaatagctgagtttgagaggcaagggaatgcttaatgttttagtccctccgtgtagctgacctacctagttattgttggttttggcttttttctctcacacaatatttatttccctatgttcctagtttttaaaaagaaacttctttattcctagttttctgtcattgcctgctttggcgctgtagcatttaacttccttatatggctgaataatgaatgcagcttttcttcgtacttgaaatagcagtttcttggtctgttttttttttttaatgtgttaccagacaatccaaattaatgacagcaaagaattagtatcaggggatgctattaccttgtgtcagcactaaaaagaggttaaaacatattctgtgaccctggaggtggtta

SEQ ID NO: 183877 - DNA, 315 bp, Homo sapiens
tttattaatctaaaattattactgtgaataatatatttccaaactttccagtagaagtatacatctctcagtatgcttctacccatcaaataatctatcagctttattttcttggagccattcttcctggattcttttttactctcaaatcttgactgggtgtattcttaaggtcacctgtcagtctggaaattccttttactgccatcattctgggaattccttggcctcttttccttgtggtaagtcttccttttacttggtttactctcattttggtgaaacatttcttctgctaatttcatgagaaagatg

SEQ ID NO: 183878 - DNA, 513 bp, Homo sapiens
accaaatatatcggcctatccaaagagatggtcattgtttctcttcctacgtgttaaagtatctgaatggagatagctccagaaaatagtcctggattgcatttcctgaaataaggagacattttcagtaggttaaccagaggattggatagtagccacataccaggttttgaaggtagtgattgttcctcaggggttatgctttacacagctcggatttcctaaaaggtaatcattacatgaagtactttaactcagtagcatctagttgtggcttagaaatgctgatatcatacactttatttttcggttctcttgtttcttactcccgtctctacttctccagctttagaatttgagtcatttaagtatgtgtttgcttcattcctgtttgggggctgatttgtactcttcaaagagttttgtcagctttagatctctgagggatagattgccagagaaggggaagtttcagtccaggcatatgtgcagagccttgatcaattgaggaaa

SEQ ID NO: 183879 - DNA, 208 bp, Homo sapiens
ctgttcaattcaggttgaagaagccagtgaaactttaccgcttttgatatttgcattcagcatataggagtctagaataagatacttccagatttggggggttgtattttttaggatgaaatgagcataaatggatgggttaaccatttgcagaatgctactatataaagatgtttacaaattttcattataaaggcttaacaatatg

SEQ ID NO: 183880 - DNA, 345 bp, Homo sapiens
aataaaatgggaacctatagctatagaaagaaagaaaagggaaggaagaaaagaaagaagaagagagggagggagggagagagggagggagggacggaggcagggaagaaggaagaagactttcttacagtagaatgccaatgaataaatacagagggaataatagaaaactccatttgcaaacatgatcataatagtttattcaaggaagaatcatcactgagtgaaaatttaggaaggtaaagtatgttttcattgtctcatagcacttccactcatatggtttattaattgcaaagagaaaaagtggtaacttaacagtagagaaacccagcaggtcctccc

SEQ ID NO: 183881 - DNA, 271 bp, Homo sapiens
tataaatccagtcatataatgataaacatctccacatcataacaaagtattccacattttaaatttaaaaattaaattaatttttaattaaaggggaagtgttaattaatttttaattagttaattaaattaaaggggaagtgttagatcacatttttagctttagaatttctactaccagaaaattagaattttttgtaggttattaaccttaccacttgaaatagtgttctttcctccctccctccagaataatgcttggaagagagta

SEQ ID NO: 183882 - DNA, 250 bp, Homo sapiens
gggtattgaaggatggttccactaagacttaatgcagaagtagacagtgggtcctcaaaggaaatagagttattgtcacagaagagagaagagataccatgtgggcaaaaacaacagacatcttctacaggtggtaatgtagttaataatggaaatgaaaaaatcatttggattcaggagtcctcttcccctcacccttcacttgcagatggtgagttaatagaatgactgggtgctgtttgtatggtta

SEQ ID NO: 183883 - DNA, 543 bp, Homo sapiens
tcgagctcggtaccgattacgctcctagacggctaggaaagttgcttcatcctgtgatcgtggctagtttgtgagtgattaaattccctggcctcctctttggaagcaatgaccagtcattctgttggtttattactatttcacaacataggaagcagagcacaccacctctacctaacagtttaacttgaaacacctcatcagagtatgtgagtgagacttcacatgtgcctgttgcatagtaaaaaggacgtttctttcaaagtcactgggctggctgagcaggacccccacagaaaaacagtgttcttgggcctcaggcatacctcagggcgatgctcagggatgtctgagcaatgtcaagcctgttagatgcatggcagggaggactggagcacagattgatctctcagatgggggtgaatggggaggtaaatcatcctttaaagggactctttttcaaggctgagaaaccatgtcctgagaaaagggagggctctgtttccagaggccacacgtctggttgacctccttccagtctcc

SEQ ID NO: 183884 - DNA, 271 bp, Homo sapiens
catggcctccagttccatccttgttgctgcaaaagacatgatttcaggactttttatatagctgagtagtatccacagcatgtgcgtatatacgctgttttggtcactatagccttgtagtttaatttgaagtcagtaatgtgatgcctccaactttgatcttttagctcaggatttctttgtgtatttgggctcctttttcgttccttttgaatttggggattgttttttctaattctggggaaaatgacattggtaatttgatagggat

SEQ ID NO: 183885 - DNA, 187 bp, Homo sapiens
ttgttcaaatcaaggggaaggtaattcagaggtgctgttgagactggtttgctttttaattttttttttcaaagaagacgggaagttcctgttttttggaaaggttgttcatttccaaagaagttacacagccagtcagctataggatgattcctggctgcattttttcggggtagtacacaataca

SEQ ID NO: 183886 - DNA, 356 bp, Homo sapiens
ctgtaccctgtggcctgggcagtgtttgctggaatggtgtagcccagtgagctgagtgtaagcacctcttcctagccccattttggtagctctacgctggccatagtgggagtattcattcattccatcctgccatgaaaatctaggccccactatgaaaatcagggtcttttttcctgggagctgatggttaaacattcatgaacacacctttggggttattctactactttttagatttgttgcatttccctccagggttcaggagacagaaactatccccacaaactaaacaccagccccaaagttaatattatgtccctttttcttttcttttcttttctttttttctccct

SEQ ID NO: 183887 - DNA, 212 bp, Homo sapiens
agggactagggattgacctcagttgacagaagccaatgggtacatgccattccctggccagtcactagtctgggtgggcatgtgacctcagcagtccacacagggtgggtcccggggctctgcagagagggctgggagcaacagcatcccctggtgtggccctggctgctatggtggcatcccatggccacagagacgccagagaaccaacg

SEQ ID NO: 183888 - DNA, 219 bp, Homo sapiens
gggctctaatccaataggactggcgtccttataagaaaagagaaagagacaccagggatgtgtgtgcccagaggaaaggccctgtgaggacacagggagaaggtggctgtccgcaaaccacagagagaggcctcaggaagagccagcccttctgacactttcatctcagacttccagcctctagaactgagataataaatttctgttatttaaatcact

SEQ ID NO: 183889 - DNA, 237 bp, Homo sapiens
tgacttgtggcttcccaaaaaagacatgtctaagtccttacccccagaacctgtgactgtggctttatctggaaacggggtcttggcagatgtcatgaaggtaagtattttgagatgaggtgatcccatgagagaaaggcaagggagattggacacacacaggggagaagaccaggtgacgacggagggagagggcagagtgatgcggccacaagcccagagctccaaggatggctg

SEQ ID NO: 183890 - DNA, 396 bp, Homo sapiens
acacgatcagtcactgtaaccttgaactcctggtctgaagcgatcctcccacgtgtgcctctaaagtgtcgggattacaggcatgagctactgtgctcagcctctactctgttttctaccttttatttgttgcaaaagcaacatgtttattttaacaaatactggtcttcctcatcttactcccctgagatttcaatgttaaaagttgatttgtgtgtttccacgtaagtctttataacaagcttctgctgacactccttggcccagctttccataaacacatccatccctacctattaggttgaactgtacaaaattgccatttttataggtccccactattctttaataccaagcctcaaatttagccagacactaaatgtcctgttttatata

SEQ ID NO: 183891 - DNA, 286 bp, Homo sapiens
cagacaggttgaaagtaaaaaaatcagtaaaagatacagcatgaaaacactaagcaaaagaaagctgatatggctatatgaatatcaaaaaagtagattttaagacaaaggatactaacacagataaaaatggtcattttattggggaaaaaaaggccaatttgtaacaaggcatgacaatcttaaaagggtataacaaagtagaatttcaaaatccaagaagaaaaaaatggcagaataaagtaaaaagcagagaaatccacaataattgttagagattttatca

SEQ ID NO: 183892 - DNA, 308 bp, Homo sapiens
cttatgtgttgtctatggctgctgtcttgttgctataaggacagagttgtagacttttgacagagatcatatggctcccagatcgtaacatattcactatctggccttatacagaaaaagtctgcatatcaatgcttgggattacaggcgtgagccaccaggcctggcccctgcacctctttttacatgtaactgctgtgatctcccacacgtgcctccttggcagactggggactggggccagggtctgtgtccttgtcactccctgtcctcggcgtggcatggggaaggcactgctgctgtcctcg

SEQ ID NO: 183893 - DNA, 124 bp, Homo sapiens
cgcctctgtgcatgcatctgtccatccatccccacctctgtgcatgcatctgtccgtacatccatccctgcctctgtgcatgcatctgtccattcatccctgcctctgtgcatgcatctgtcca

SEQ ID NO: 183894 - DNA, 789 bp, Homo sapiens
cgctaatagtgcccaaacctcttggtagtcagacttgtgaaatcccctcctcatttacttcagaaaacagtaacattgagaggatactacttctatgattaggttacaattgtgacttctgtcttgctaagactctactgcctcgtcagctttcatcttttgataactcaagctatcacactggaaagaccaaaagggcgaggaactgagagtggccaatagtcaggtagaaactgaggccctcagtcaaacaaccctccaggaaccgaatcctgccaaaactacatgagcttggaagcctattcctcccgtcaagccttcagctaaaaccccagttctgccaatattttgactgcaccttcagagaaaaggagacagggaacccatctgagctgtgtctggaccgctgacttacagaaactggcagataacaacaaattagtgtagttttaagctgctaaattttggggtaatttgttatacagcaatagatcatgactacaggacaacatagtaaaactgctgaaaatcaaagacaaaataaaaatcctaaaagcaaccagaccaaaaacaacattattttcaaaggagcaataagactgctaaatttccaacattaggaaggcataaggcagtagaacatctttactgtgccggaaaaaaaaaaaaaaggactatgaatcagaattccatagctactgaagtcactgtcaacaaacctttgttaaaaagctttgtgtgttttttttttttttttttttttttgagacagtcttgctccgtggtcca

SEQ ID NO: 183895 - DNA, 253 bp, Homo sapiens
aagcataagacaaaactgagatagagcaattattttaagcttcgggagcagggcaaacaaatcccatttttactaactacctttgctctcttaatagaagacaacactggaatttttttacttatctctgaaagtaattaactagtacaagacccttaagatgggcaattgcatttctttttttcttttttttgagaaggagttttgctcttgttgccctgctggagtgcaatggcatgatcttggctcactg

SEQ ID NO: 183896 - DNA, 456 bp, Homo sapiens
acactgtaataataataatgatatgaaacaattatacagctcaccatactgtagaatcagtgggaaccctgagcttattttcctgcaactagacagtcccatctgggggtgatgggagacagcaacagatcatcaggcattagattctcataagaagcgtgcaagctagattatgtacatatgcaattcataatagggtttgcactcctatgagaatctaatgccactagtgatctgataagaggcggggctcaggcagtaacactcaacgctgcttacctcctgctgtgcagcctggttcctaacaggccatggacctttactaactagtctgtggcccaggggttggagacccctgatctaagggtatgagacagtaagagacaaaggaaaatatgaccagttacccaaatttaacaataaaaaaactttaactccttttctcaaagtgctagt

SEQ ID NO: 183897 - DNA, 149 bp, Homo sapiens
aaccaattaacattgataaaagatttggcaagaatagtatacagaggcttgaatttttaatgtaattaatgtaattaaaggtttgttggaaatgtgagaccattttgttctcccagagaaaaagtgtgttaattgtctagctggcaggg

SEQ ID NO: 183898 - DNA, 465 bp, Homo sapiens
caggctccagaggatagcctaagacaatctagattctctattccaagtgtgggctgtggaccagcagaatcaacacctccaggagctcgttagaaatgcagagtcccaggtcccacccagccccactgaatcagaatctgcattttcataagacttccaggtagttcctatgcacattaaagcttgagaagcagtaattaagagcaaggtccaagagcaagaagggagaagacaggaaggaattgattatgtgaatttaccctcaagagatctagaaatctttatctttggaaaagataaagaattgctcaaggtattcatcctttcttctttccgtttctatttaggaagaggcatgtctaagcaatgccaaggcagtcattaatctgttgagtcctggctggtttgaaaaacagtgaccttgcttctcttacctgcttgtctcatgagggggtttggggaagg

SEQ ID NO: 183899 - DNA, 625 bp, Homo sapiens
tttatgatgccatgcaagagacactagaaagggatagctgacaaggaaaaaattaaaaattggataaaaagtaaatgaataatgtcatattactaaaaagatgagaggctaatttgtgccgactttttgctaattttgttcaagcctcaaaatgaggagctgtcacccgttctgtgtagcactgatgacagtgccaatgatccatgaaataagctgccgctggctttgttctgataagaatgaacaaatctgcaccatgttcggctcccagaatctcattttcatacttgcatgcaggctaaaagaaataagctgtttgcaggcttgattaatcagacattggaggggtttttgtctctttgatctctttcgtctcctaggtaacttgcttgacattaatgttgagcttgagtaaagacaatcaagaattgtcgaccaaactgatataaaaattaaagaccttaacactttaagtactccagtaatggttccgctttacttcagaaaacatctgttttcatttaattaaagaacaaaagagaatggcataaatatttttcatagagacctattattccataaaaagttaaagtatgataattggtatttttaaataagtgccttg

SEQ ID NO: 183900 - DNA, 699 bp, Homo sapiens
ctgtgactagctgcttggggttcttctaccatattgaatagacgcccggcggcgaaccgagacgttcgtgaatcgaaagtccagaatggagattcggaggttcactgactgggatctatctacaggagtgcatgcgagctcgatgatctaaatgtacgtcatccgcctctgaagatgagaggctaatttgtgccgactttttgctaattttgttcaagcctcaaaatgaggagctgtcacccgttctgtgtagcactgatgacagtgccaatgatccatgaaataagctgccgctggctttgttctgataagaatgaacaaatctgcaccatgttcggctcccagaatctcattttcatacttgcatgcaggctaaaagaaataagctgtttgcaggcttgattaatcagacattggaggggtttttgtctctttgatctctttcgtctcctaggtaacttgcttgacattaatgttgagcttgagtaaagacaatcaagaattgtcgaccaaactgatataaaaattaaagaccttaacactttaagtactccagtaatggttccgctttacttcagaaaacatctgttttcatttaattaaagaacaaaagagaatggcataaatatttttcatagagacctattattccataaaaagttaaagtatgataattggtatttttaaataagtgccttg

SEQ ID NO: 183901 - DNA, 298 bp, Homo sapiens
caagcaagggggtctgaatgctgggcaggctaaagccacagttaccaccgtggagctgatgcagtcagacatcccagcccaggacctggtacaagggagtggctccataaatgcttggttttgctggtagtgttttcacctgacctcctgcaaggcagcaattccagaccagtaaatcaccatgtaacagtacatctagaaatcctagctcagcattcttcgtaggcgtgtcatgttgtgatacacacagaagatggtatttgagcagcaaatatctgaggtaaactgacaaggtgct

SEQ ID NO: 183902 - DNA, 169 bp, Homo sapiens
aaaaaaaaagagagagacagtatggcctggaagcctcaattatttactatatggcccttttaagaaaaaatctgctggccaggtgctgccacacctgtaatcccaggcaggaggatctcttgaggagttctagaccagcctgggcaacacagtgagatcttgtctctac

SEQ ID NO: 183903 - DNA, 294 bp, Homo sapiens
tactgtctgccaaagctgatgccattttttatttccagaaaagcagctggcttctacattttgctgggcgatcttcatctactgtaaggaccctggagacaggagaaagggagtcaaagaccctttcaagaaactgacatctatttttaagctttagagaaacaaaggaaaagagacataattcaggaacaacagcctttatatcctcacatagaaacaaaacattgggtaatagagggaatgttttcctataagaaaaactggtaaagatgcaggaaaaataagatgaaaaaa

SEQ ID NO: 183904 - DNA, 416 bp, Homo sapiens
agaccttctgaagccacttgacaggcttcctgcctcaatttcatagattgagtctcataaacaaaaacaaatgccaagcacaaaaatctcttggcaataaaggggcctgcattagttctcctcaggtaaggattaacttcaatatttagcttagaaataaggcattttaaattcgcattttcagaaacactgggcaaatttgcagaaaagaaaaaaacacgtctggatggggaggggagatctcactgcattaaatgtttctataataaataattccctgaggtaccaattttaatcacttgacattttgtttccttttaatgcaaacatacagaacacaatactaccatttccaattttatttgtaaggatctagctcttaggtaggaattagggacatttcatggggtgggggg

SEQ ID NO: 183905 - DNA, 526 bp, Homo sapiens
gccctgctgtggctttctaggaaaattatgcttccatgagagaggattgccccttcatgttttcagcttcttctgctttcaacatgagcttgaacctggaggtagaatatccatgcatcttgtgaccaagagggaacaaacatgaagataaaagtcagcatgctaagggtggtgaagtgaaaagataaaaaatgtttgagttttcttttacttgtaaccaaacacattcctgagctaatagaccacagaaacttgagttgggaaggaattaagcccagcctgacctcatcgaagacttttccaacgtttctggtgacataatccactgctttgggagggagtctaattttgttgcagatctatatccattccaacagttctctcttacagtgagtgaaatttgacccccaaagcttctgcttatagacccagtgtgatgctgacctgagagtcacctggacagtcactcccacactttcatagatgtcagtgaaaagtcatcctgatcaagctggcgagtctactg

SEQ ID NO: 183906 - DNA, 557 bp, Homo sapiens
tgatcctaagcgattgtgtgtgaggcaactgcaggaatcaaggcattcaaaccaggctgtggctccaagaatgaaaacacaaccctcaggcctccgattccttggggtctgatgtgcatgacatgtgtgtgatgtaagggtggctgagtcagaaagtctgcagaagtgggtcttgggagggaaggatgtcagtcaatgcaatctccttttgagaatgaatcccccaagctggagtgtagtggtgcaatctcagctcactgcaaccccaactcatgggatcaagccatcctcccacttcagcctcctgagtagctgggactacaagcatgcaccatcacatccggctaatttttatagagacagggtttcaccatgttgcccaggctggtctcaaactcctggactcaagccatcctcccaccttgacctctcaaagtgctgggattacaggcatgagccactgcacctggcccaaggacatttctaatcagacggctcatgtttccagcatctccaaggcatggggccatgggcagacaatgacgtttactcttgat

SEQ ID NO: 183907 - DNA, 648 bp, Homo sapiens
gaaaacaggctgtgggtttggaagaagtcaggctgtgggtgggaggggaacagaactagaagcaagcagtcaagtgagttgagggtggacgggacaggcccagtcaggcgcagaggcaactgcaggaatcaaggcattcaaaccaggctgtggctccaagaatgaaaacacaaccctcaggcctccgattccttggggtctgatgtgcatgacatgtgtgtgatgtaagggtggctgagtcagaaagtctgcagaagtgggtcttgggagggaaggatgtcagtcaatgcaatctccttttgagaatgaatcccccaagctggagtgtagtggtgcaatctcagctcactgcaaccccaactcatgggatcaagccatcctcccacttcagcctcctgagtagctgggactacaagcatgcaccatcacatccggctaatttttatagagacagggtttcaccatgttgcccaggctggtctcaaactcctggactcaagccatcctcccaccttgacctctcaaagtgctgggattacaggcatgagccactgcacctggcccaaggacatttctaatcagacggctcatgtttccagcatctccaaggcatggggccatgggcagacaatgacgtttactcttgat

SEQ ID NO: 183908 - DNA, 714 bp, Homo sapiens
aacattatggatgaatctcaagagattaagctgagttttaaaaaacccaatctcaaaaatttacatatttgttctggtccaccccatagtgttggggtgaaccctcctacccccaatgtttggtttggatatcaaaactggtaatgatattaagagtgtaaaaaggagtttattagttatagagacaggtttctagggagactagagaaggctcctaaggagatctaaatgtgggttgagaaagaagggagaagaatggctgcttgtcagtaggaatttggggtggggtaagcgcacacaaaagggatggagtttgtgtggtttgagtttcctactggcattgagggagtgaccacctaggctttattattggcttgcccaaatgtagggtaagaggggagatgggtgggatttgaaatctattagcagccaattaccacaaatgcagttaggctgtttatcataatacctcatgattttatttggataacacttttgaaatgacaacatagagatggagaactgattcgtggttgccagtgttaggaaggcagagagggtgggagatggctgtagttaccatgtgtggcatccttgtgatgggactgttctgtatcaccaatgttgtgattttcacaaaaatctatacctgtggcaaaatttatagaactaaatatacacaactaatgcatgtgaaacttgtgaaatctgaat

SEQ ID NO: 183909 - DNA, 339 bp, Homo sapiens
aacattatggatgaatctcaagagattaagctgagttttaaaaaacccaatctcaaaaatttacatatttgttctggtccaccccatagtgttggggtgaaccctcctacccccaatgtttggtttggatatcaaaactggtaatgatattaagagtgtaaaaaggagtttattagttatagagacaggtttctagggagactagagaaggctcctaaggagatctaaatgtgggttgagaaagaaggcctcctatctgaatccagatcgccatgaagacaaaaatgagacggatggccttgtactatttgtcgtcgcatctggattcagataggatga

SEQ ID NO: 183910 - DNA, 682 bp, Homo sapiens
ataaaataagacactaatgaacattaaataagccagtcacaaaaggacaaataccgtgtggttccacttatatgaagttgctagagttgtcacatcatagagacagaaagtacaatggtggttgccagaggcgggggaggggagctattcttgaatgagcacagagttccagaaatgcaagaggaaaagagttctaggatggatggtggtgaaggttacaccgcagtgtgaatgtacccactgccactgaactgaatacttacaaatgggtaagatggtagccacgatgaaaagtttattttaaatttatgagaccagttctcttgagtgatttgtagaatggctctgaaaacagttacagaagaggagttagaaaaatgtttggagcaaaggagatgtggtcacgtaactgtataatctttaggtgacagaaaaaaacccattggatatttagagtatatttgtatgtgttttagtcttatttcttcatagatgaggcttataacttttttgaaacaagatcttactctcacccaggctggatccccaagtgccactagtgctgacatcttttaactgtgttcattgtgacttgtttatttctaaaagtaaccactggcgccttggtgcagatggaactccaggtgcatgcggtgagttaaccatggtctggggagctttg

SEQ ID NO: 183911 - DNA, 495 bp, Homo sapiens
ttgtcacttgccattcctctataatagccccctttattcatttaacactttatatactttctctgtcttcctcacaagtggtcctctgaagtacatgttagtctgctttaagaatgggaaactgaggttcaggatgttcagtaacctctctgaggacattcggctggtaaatgttagatttgggatttgaactcaagtccatttgactccagaactcctgttctgtctactactcgagtgatcttcaaacttttttgcctgtgaaaccccttacagaatttagaaaaactataaagtccatcaaacattttaaatcggcatgtaaaaatttttcatcttgaatttatgtacttgccaagaatataattcctggcatgttgtaaatattgacatttttaaataaaactgttaacatcattcttttaaatgtacccaatgagaaataataatgatttagttatccattaaaaatatgtaagtaaactcttaacagtc

SEQ ID NO: 183912 - DNA, 495 bp, Homo sapiens
ctacttttaaaaaaatttcaattcaagcataacaattcagtgatatgcacacattttaactgtacagctcaatgaaattttacatatgtaaactgtataattttgcttcctgcaattttcacttaacgtagtgaacattttccctcatcattcagtattcacaaatggaatgatctggggccacttttggctttgtaaatggaacagatgtcagtgtgttaattttttagttgtgagtgtgagcctgcctgtctgtttctgtttcttccattctatcttggtcactcctgtttggccaggataaagaaaaaaatctgtgcttgggttctgggcaccatggctcctgattacaactgaacgatggggcatataggggttgattttaattgtctgcgttggtgtccttagggtacactgaggcggcgcacaatggcagctgccagatgccttcagattaaacatgactatgagggcagcgtagaatactatctgcac

SEQ ID NO: 183913 - DNA, 404 bp, Homo sapiens
agtcagagaactcacatgaactgattttaagatttattataaagctacagtaagcaagacagtgtggtattggcttaaggatagacacagaaacagacggagcagacagaatcaagaagtgaacccgccaatttagggtcaattgatttttaataaaggggccaagctaactcaatggggcaagttcagcaatctgcaaaatgtcacagaactaataaggagctgaggcagagtttacatcctgctggacagcaggtgggctcaccagcaagtttccttcactctcatgtctgtctcaacacagaggagtgaccctgctagaggggactcggacatggtcctatcagctctgcagggaccttccatagcttcccctcatccttttaacaccagtgtcaggtcta

SEQ ID NO: 183914 - DNA, 348 bp, Homo sapiens
agcctccgtgaggggtcctaggattgctgagggctgagaccaccttcccaaagttggggaaggggtaactgaggctgtcatctggcctgtctcacctgtcttacctgcaggcccatcattcctgcacagtcatttattaggcaccaactgtaagccaggcccaggaggttggatggttcaggtggggccctggccttgcagaactcatggacttgcacatagactcctcctgacaggcccctcatgagtagctgggtccttacgatttttctggtcagcagtggggagccgtgggaggcattaggctctggggaagccaagcaacatcacatgtacacagcatagaga

SEQ ID NO: 183915 - DNA, 238 bp, Homo sapiens
tcttgctcctgaccacatgatgttgaattcaaccattatccgtctgctttagactgaaagttcctggatggtagggactatggctgctgcatctgttttcctagtggccatatgaaatggaagcaattggtttacctatcagtatgagtctccagaactcctccttgtatttcacccacacattagaaaactggagcaactcccacttggataccaaataaggagattccttctgtta

SEQ ID NO: 183916 - DNA, 388 bp, Homo sapiens
tagacaggcaaagctcctacggagccaggtgtcagggagcactgctgagagtatcacaataggatctgtcacggggttcatatcagatgaagcgccgtatccactgcttcacagagcaaaacattcaatcccataaccaggcacaggggaactaacttggactaactaaccagaaaaccttgttaacgtataacttgttccagtactacatctctgcctgctggctcatgacaattgctcagcacattttcccctcttgaagaaaggttgcaagaagaactaaattatcctcaaaagatttctgcttcattagtaaagagtcagtgatggaatagggtgactctgcagaatagtggcctctagggtaggagcttgtgcctgtgttgtc

SEQ ID NO: 183917 - DNA, 892 bp, Homo sapiens
gggccacagcttcttgaaaacatagattttcatagtgagctcctgaaaagatgaaaagattatttgaaaatccaatttccatgtgcagaaacaacatgtagactttggaggaaacacgatgggctccttgctcatacagcctatgagggctgcctctcaccttcgttgtcctcatttagctgttcaagactcaagcaggggcctgtcaatcatctgtgcatccctgttcgtacatagatgacacccacatacccgaatagagggaagagatgagaacgaacattcatgaagggctcttgtgtgtcgggccatctttcatgtttgttatttcacttatttttagcaacaatccctggaaatacttgtcattattctcatttcactgatgagcaaactggcatttagagaggataaatgaattatttaattgcatacaatcagtaaagaacagagctgggactggagtccaagtttgttggtttgtttttcttttttctgacctcaaagtccagtacttgaatcctctacaccaggattttgggagcattgattatatgttatatctggagcccttgtgccacagagcaaatgtccaaagattttggtttctttttgtcggtacggaagctagtgtgttcttaaacggcattttgggatctgcatggtgagtattaggaccaaattttgaaattccaagtttcttaacactgggaaccagactttcttctcatccctaaggagaatctcactcagatgttcctttatgtgctgggatataagaaggctttgcatttttccagacaatttacctgtggtttattcacgtgatgcatgatgttattaagggttgatgctttttctccttcagaatatgcttactttacttgttcct

SEQ ID NO: 183918 - DNA, 417 bp, Homo sapiens
aatcgctctagaccaatccacagtacgaatgcaccatggaatatttaaccattcccctactgatgatggatgtttagattacagatgctccttgacttaagatggggttacattccaataaaatcgtcgtaagttgaaaatatcagaagtcaaaaatacactgaatatacctaatctaccaaacatcatagtttagcttaccctacttcaaatgtgctcagaacacttacattagcctacagttgggcaatatcatccaacacaaagcctattttataataaagtattgaatatctcatgtaatttattgaatactatactgaaagtgaaaaacagtatgggtatcatatgaagttgaatcattttaagtttgagacgacctgtatttctttttttttttttttgctgcctctaaca

SEQ ID NO: 183919 - DNA, 430 bp, Homo sapiens
tctgcctgaccccacccaccaggacctaacctcaagccatgttctctcctgatccactctcccataccggccccatctggcaaactcctagacatcccccaacaccccagctctaatgcccacctccttcaagatgtgccccaacaggccaggcatggtggctcacgcctgtaatcccagcactttgggaggccaaggctggcagatcacttgaggtcaggagtttgagaccagcctggccaatgtggtgaaaccctgtctctaccaaaaacataaaaattagccaggtgtggtggcgcgcgcctgcagtcccagcccctggggaggccgaggaaagagaatcacctgaacctcggaggccgaagttgcagtgagccaaaatcgcaccactgcactccagcctgggtgacagagcgaggctccatctcag

SEQ ID NO: 183920 - DNA, 581 bp, Homo sapiens
tggatgaataacttcagactggagttgaaggcctggccctcaaaattgactcaaggtcctgtctgtttgacatagttaagaaaaatgtagaatgttgtgctcattctggttatctgaagctctgcacctgggttgggattggggctgtttctctgggtcaagggacccgcatgctgctgaggcaagactgggatgttccatcttccaggcaagagtggcttgttccattctcactgatgtgacttcaaacagcaaacttgtcatggcctttgattttagcagccaaggtttccccgttctatgtccttaatgttaatgaacagagccacatttttatgtgttcacagatgaaaagcaggtcagacaataagcaggtggtttcatcaggctatcagtatggggtatcaggctattattattccctctagacttctatttcttcttatgtttgtagagaagaagcagatacagctaggagggctgaggagaatgcgggtgtgggggcaggctggcatgacatgaatttgccaacttgtctgtcatgtttcagagagattctttaatcttcccctttattgtac

SEQ ID NO: 183921 - DNA, 273 bp, Homo sapiens
cttttcccctcaaatcaaaatcatcctcgaaagagcaagatttgtcatctctgctgtgttcaagaggatattctccaactatgaaagtaccaagtaaaacatatctgataacatttccaatgacagctgcatgttagagttaacagtgccttccaatgtcagtgattctgaccacgatccattggaagttttccttacagaatcagtcaaattactttatcatcattccccagacagagagggataggcactctttgaggggaaaagaccctg

SEQ ID NO: 183922 - DNA, 718 bp, Homo sapiens
ttcctggtggctaagagggcagagtctggaatctgccaccaccacttaccaagtgggtaactttggtcagagttatttaagttttgtctcagttcctccaacaataaaaaggggatgttgacaatacttaatacatagcgagtgcttaaaattgtgtgtgacacacagaaaacttcattctgttcaggtcaccctgtgagcattgttgggtatggtgggaaaagaaagacactaagatcttagagatgacttcaaggttccttttctggtccaagacgatgtacgatgaatagtcacaggaaatgactcttttctgcgatagaatctggacccaccatttaccttgtggttctgctcactgtttagtgctgagttgctaattttaatgattcttcctgttttaagaagcatggctctgagtcgtattctctctctctgcctgtctttctctctgtccacaaacacacactttttgagtacaacagcacagaagacgatttagagatacatgtgctcaagacttacctctctctgtataaaagtttgaatctcaattactcccatttcctctttctttctttctttctttctttctttctttctttctttctttcaatcgtactgctatgtcttactgcttcctaagtgaaaggggaaaagaatcaaagttagggaaatcaaaggtttcagaaatgaaaaactggatttctaaagcact

SEQ ID NO: 183923 - DNA, 558 bp, Homo sapiens
taattttgtggttttagcagagatggggtttcatcacgttgaccaggctggtcttgaactcctgaccttgggtgatcacctgccttagcctcccagagtgctgggattacaggcgtgagcccccatgcccggctaaatctgcctttctttgcctacaactgtctaaattcttaccaccggggccaccagcccagatagacactgatcatctgcaacacccgtctgatggacaagattgccctgcagagttcaagtctgagagttcccctagagctaaactctcctatcaaagtaagtcgagtctagaggcatggcagtccctggctgtgctccattacagaatgctcctgcagcaaaccctctggtctccacatcaggtggcttgctgcccttaccactcctctgagcatctctctgccaactcaagtgtccagagtctctctctgttgcccaggctggagtgcagtggcacgatcacagctcatggcaacctccacctcccgggttcaagtaattcttctgcctcagcctcccaagtagctgggattacaggtgaac

SEQ ID NO: 183924 - DNA, 449 bp, Homo sapiens
acactcacatagacacactcatatagacacacataggcacacacacatatgcatgcactcaaacacactctcacatacacacactcacatagacactctcacatacactctcgcatagacacatacactcatatagatacactcgcataaacacacacatagacacacacactctcgcatagacacactctcactcacatagagacacactctcacagacacatacactcacatagacatacatacacactctcacacagacacacacacactctctctctcacgtagacacacaagccattgcctcttctgtcttctgcttagatccctagtccttgcttcagtacctgcagctggagaaccccttctttgctttctcatccatgcatttatgatgaaaatttgtggattttccttacgaacagtgcgaggaaatattttatgtattt

SEQ ID NO: 183925 - DNA, 309 bp, Homo sapiens
ggtttctaccctcatatcttaatcacctcccaaaagctccttctccagataccaccacattagagattaggtttcaacatatgaattctgaggagaaacaaacattcagtctatagcactcagtattttaaatatatcaattatccccaaattggtctctgggctttagaacaattccaaatcattaactgactggggtaatctatactggctagtttaccacctacttccttcctctttctagtggccacaaagcaagatatatgcttttgaaagtctgtcaaagcaatacagaattatgctgtgcat

SEQ ID NO: 183926 - DNA, 198 bp, Homo sapiens
tgaaacacagaagctccggtgatggtgacagagaggaacgtgtactggctgcgatgcagggctgtcccatcacggtggcatccctgatacttatctggagataggaaggcgacggactgtagagaaagacggaaagccaacctgtgatccgcagagtctgaggggagatgagtgatccatgttctcaacttcccatgt

SEQ ID NO: 183927 - DNA, 207 bp, Homo sapiens
aaggagctgaggcattcaccatgaccccctgtgagggagcggaaggtggtatcaccagtggagacttggaagaggccggaggagcaggctgcaggaaggaagtgagttcagtcttgactgtgtctgctggacattccaaagctgctgtctgctaggcagtgaggagttaggcaggttcatctggagaccaaggagcagggttggtgg

SEQ ID NO: 183928 - DNA, 603 bp, Homo sapiens
cacgcaagcctgggcgacagggcgagactccatctcaaacaaagaaaaaattaaaatcattcataccagttaaagacatctgtttaataaaactcagcctgtaccacgcatcctgcttggtaacaagcgcttgtcgatgttgacgcattatggcagtccctcacgtcaatgtcaacagcagcacagagcccatcacctgcagctacaactctaaccaagctcccactgttggtctgtttcacaaatcccactcctgagacaatgatgcggcaatgagcaccctcatcaccatcaggctttgaatactttcctgattgcgcccttggaggaaatcgacatttttaaggtactgggataaacagtattgccaaaaggccttccagaaaaaaaatggatctaatttaagtgcccccagctgagctgactggttgcatcttcctgtggtgtttctgccatctctacctgaggtgaatgtcccctcaggacagcccccatcaccatagcagctgaaatgggcctgcagcagtactcaggaaactggcactggacagatctaggaatccccctgctacagcagtcctgagaggcaggaaatgattgatt

SEQ ID NO: 183929 - DNA, 521 bp, Homo sapiens
ctaggattaaaggtgtgagccaacgtgcccagccaacccaagacttcttttacttttgctgtataacattcaagggagctaaaaggaaaatgagatttcacacccacatactctcttagaatagtgtctactgactagttcctctggaaccagtgtgaaatgtctggagaaacaggacagaacaaagcaatgagataaaaaaaaatttcccacattgactcagatgcagacggaggaacaacgacttagctttggattttgtgtctacatcaagaggagcttctaaagtgcttgggaaagaccccaagagggatggctgaggctcagggagggcaaactgttaaggacagtgctacccaccatgggaaccactgactggagaggcggtcacaagcacacattgtcccagctcatcttctggtacctgcctgtgctgcagtcccgactccagctgcctgaccttgaacaaagtacaaactgtcagtctccatcccgttttgaatgggggtattaagaagact

SEQ ID NO: 183930 - DNA, 527 bp, Homo sapiens
ctgactatagagacctgatcaaggctccagttttagtaataagacttcaaggtgaatacagattcaaagggccgagttgtttttcttgaagtgcacaaagcagacaccctatgaaaaccctcgcccaaaaatgtgaacactttagaacaagaactaatacagataaacgatttctgacttaatgaaccacagtggccagaaacctgctgatcctgctttccccttccaaaacttgctgctctcagctctggccccgagggtggcctataatttacattaaaataaaatattggaaagattagtaaaatttggttaatttgtccatcttttttcataagcaacacataaaagaattaagattagaaatatacataatacattacacagttgagtggtagcctcttgctactttatagtgacttagattttcttgagaaggaggactcagagcatgatttctgacagttacaccatagcaactgcatgcctctgaaaagaactgctgtttcaacttttaggggaagaga

SEQ ID NO: 183931 - DNA, 526 bp, Homo sapiens
agggaaagaagaaactgtcaaataaaccacggatatggtctccaaatggaaagggcccatttggggcccaacacatgaatgaaaaactcttaccaaccaacatcattgtgaaatttcagaacacctgaatggttgaagggaggatcaccccatttaatactacagtctgcatcccctacctctcctttccccaacattcctgaacttcccaccccagcctgctcttttttctcttttctaaagcagttatttactttacaaactcccaatgttttgtataatttatttattatatttgctgttgaacaactcctccctccctgaatttaagctctataaggacatgaatcttgtatttttgttcacctatatattcaaaatgtcttgaccagtgcccggcacataaaatgtgctcaatacatacttgctgaataaatataaacgcttccaaagagatataacaggtcacaatcaaaggattggttatcataaatgtgagggttaaataaaaaaatggttgaccatg

SEQ ID NO: 183932 - DNA, 390 bp, Homo sapiens
agaaggatgttgaagtcctgagctataattgtggaattacctattcctcctttaagttctatcagtttttgctccacataatttaaagctctgttgtttggtatatacacatgtaggtttgcttagtattcttggtgtattgacccttttataattaagtaatgtccctttttgttcctgttaatactcttatcaatttttatctgatatttgtgtggtcagtcttacgttttggttaatgcttgcatgatttacacttcatcatttttttaaaccttatctatatcactatattgggagtaagtttcttgtgaatggcgtatatttgggctgtggttttatatccagtttgcgtatctttttttttttttttttttttttttgagacgg

SEQ ID NO: 183933 - DNA, 680 bp, Homo sapiens
tgccacctacttagaatctaaagtccttcaaggcttggcacaaacccgacaccctctatgaagccttccttgattgcactaatctcccctaaacttcttttcttctgaccttgacccacaattcagcatcaaatgttgtgttctggtacctaagtggcagtctcatctgttccattggacttgaaggttcagggccattatgtatacatctcctttaatttccagagtgtgcagttcaaggcagtgcttggcacggaatataaaccgagtaacaaatttatttacatgcaaattctggctatatctcatggcttcgagaacctaagtgcttcagagtaaaaacactgacacgggcactgcctgaggaagtgctgtacatgctgtttccaaaaacattcaaggagctgttgaacaaccactggcacagacagtatagagtggaatcatgtgtgaacagagaggggtaaagaaaatggtagcccagacaaggagggttgtcagcccatagtcacgcagtagatgagtggtcaaagtagcacttaaaccctggcattccagctcccagcctggactccttctaaagtgttcatggacaatcacatctgaagaatcactctgaacatactgcattttgtctgctacatggtatctagagaggtccaggtctcatgtggttacta

SEQ ID NO: 183934 - DNA, 519 bp, Homo sapiens
ccatcccattcatggcagacatcattaatcaatcaaagtctcagatttattcacacatggtgctgtagagagccactaccagttgttgaatgttgctgtgggagctgctgtgtatctgtctcctatgatgggatatgaattcacaagaggtgggttcaagtcttgccttggccactggaggtctgtatgaacttgagcaagtcattgaaactctcttgtattttcttcagttgtataaggattttttaattctaaagattttacaatatgagatttctggagtgatgaggcattggttacctcaactgcaaaactgccaaatactaaatgaggctatgttgagagagggggtaaaaaaaaaaagatactagacacacacagaaataggaaaataggatgggaaatgatcagaaaaagaaatagcacacataaagggcattttttttctttgaaaataaaggagcctcatgtagagaaaatgcagtagaagacttgaaagtcatcagcttgagcgacagc

SEQ ID NO: 183935 - DNA, 473 bp, Homo sapiens
ttaataagtgataaagctaggattcgaatccatgcttttaaccccccaggcttcatactatgtaccctttcccttatactgaggaattctagaaggcatagttgacaggttgttgtgtgtgatatcactctgtgttcctcatatgaacacaagagaattttctctctgagccacaagtcatgaaatatttggctacccttgagtaactgatgtgttttctctttataggcaatgtgaattatataactgcctgtttttcacttttcactttgccaagaagctctgagtaaatttgttggctcagcgtttgtaagtgggtgaattggcctgcatatctgtattctgttgctttgaaatttttaaaaataaatagttgagagaaaaataatgtaaattttctttattttccaaattgttgacaatgtacaatgataatttttataattagaaaaataaactttgttcttaaaaga

SEQ ID NO: 183936 - DNA, 365 bp, Homo sapiens
tctaaccctattatagcagtttctcaaactcttaaaaaatggaaaagatgcctgtagtgtttaatgttatgcctcaaaccttacttttcccccagttttcttttacatcagtgcaaagcactctttatgagcactaaatgtgggtaaaggtacaagtcagagagcacctgtttagtatatgtggcattttaaattgagtccttttggggtactagtctatcaagagagacacattttcttatccatgtcaattttgcttcctatctctctcccccatgcctttcacttggaatgacaacagttgacattaaaaagctgttggcaggtatggaataaccttattctgttaccaaatagcaaagacc

SEQ ID NO: 183937 - DNA, 214 bp, Homo sapiens
gcaactgtctgttctttctgcatttgctcagtgactgagtacccgccccatgcacagcatttggccagccactgcttgcgggggatattcagactggggctctgcatctggtggaggtggtgaccagagatcaaggtgggctgcaagaagccgctttcgcaggtggggactccctctaaagtctcgaccgtgcaggacttgcaagctttggcac

SEQ ID NO: 183938 - DNA, 182 bp, Homo sapiens
gcttcaatactcaatttttcaagttgctataaatggagccttctacttcacaacatttaacatctgattcattttcttgaaggcaaatcattcttggctagagacaccactagagaatgttgttttgaattctttctctactagagacagtgctagagaatgttgttttacttccttacatc

SEQ ID NO: 183939 - DNA, 441 bp, Homo sapiens
tgcagggagaaatgtctttgaaaaagtacaaaacaagtttagacaggagaaagggagggaagaagattcatgtgcctctcatggccttcctgtctgtgacctggaatatgacaacagtcgcagaattcaaaatgaggaagactcaaatggaaatacatcttaacacttctcgatctagaaagttaatgataaagaaagaaattgttttgagaaaggctatcacagatgctcatagaaaaatgcttaagacttaaaaagaaaaaggctatagacacagagacttatttgacttcagtttagcatcagagaggtcagtgataatgaatcaaaaaaatttgtaagaaagaattaacagaatccctaatttcttgacaggccaggtgtgagaaacaaagccgttcaaggagggccaaagaggattctataattaaatcgtagcta

SEQ ID NO: 183940 - DNA, 363 bp, Homo sapiens
catttttgccttgtattatatcctagtgaaaaactttccagttgtttcccattgattatagtaggtttttcatatatggcctttattatgttgaaggattttccttctatacctaaattgttaaaagttttcatcaagaaaggatgctgaattttgtcaaattatttttctgtatcaattgagatgataatgtgagttttatatttggtgaatgtaatgtatcacattgatttgcatatgttaatgcagccttgcatgctagacataagcctcaaataatcacaatgtataatgttttttatatattgaatttgatttgctaatatttcattgagaatttttgcatcaatgttcattaaatat

SEQ ID NO: 183941 - DNA, 414 bp, Homo sapiens
ttcgagaccagcctggccaacatggtaaaaccccgtccgtctctactaaaacgacaaaaattagccgggcaaggtggcgtgtgcctgtaatcccagctactcaggaggctgaggcagaagaatcacttgaacccacaaggtggaggttgcagtgagccgagatcatgccacaggactccagcctgggtgacagagtgagactccatctcaaaaaaaacaaaacaaaaaaaaaaacatctcacactgggagttgcaaggcaatggccgtcaaggccaagccaaagcagagaagtgggtaggggccagtgccactgctcaccaaggcagggaggaaagaatgggcaggcaactgtgggactaggcagggaaggatggggctccagcctgggaaggagaagctggaccagggagtgg

SEQ ID NO: 183942 - DNA, 115 bp, Homo sapiens
tatgaatgctgagcagctccatatgacaaatgttcctcacagcaataacccatggagctgagttgcaccttcccctgttacataaggcagttttccgggatatcccaatcccact

SEQ ID NO: 183943 - DNA, 386 bp, Homo sapiens
gaaaaatgaatccaaatttacttaagccactattatttgggttttctgttccacattgccaaattcaattcttgatacatacagaatcctgtaacttactgaggaatttgccaaatttaatagaaactcacgttagacagaatctgtaaaaagctatattaggtactttcaaaatgctatatcaagttactgagtctgactgccacatatttgtcatctatatgttgccccatgtctacttcaggcatggttaatcaattagggcactctctgccaataaactggaaataagtcaataaaaatgtctcaactccaagtctcaacagctacaattgatattaacctggcactcaataaagaacctattttcccttaagcggatcagc

SEQ ID NO: 183944 - DNA, 684 bp, Homo sapiens
cataaggagggcttgcagctggctgaatgagccttggttttccttgcagcctcaccttcagacagacttttctgacctgcatacctggtccaatgctgtcagttgactagtttgggttttttgtactgctcaaaggcacccagctgagatggttggggtggggttggaatccagtctcactgctggccaagccctggatgctggcctgaggtcacatcctttggggtgggggcacattttcaaattcatccactcagagggggcacatgtttctaactcacacacagtctccctgtgtgtggctgttctgagtaccattcccaacatcatctgctcagggaatttctaccccccatcaacctcgtgtaagacagagcttgagcttttgacctcctctgtgaagtctattttgctctcagtctcttagacagaattgctttttgtctaggagacagaagtttctaagtgcttactcttgagttctatacttactttgtggcagactagtgacaaaccatcagccgaccaggcccaggtctggaggccacacttcgagggctccaccttagaccagccctctgctgcacacagggtgaccttctacatgtttttatgatggaagcaagctatctctgtgaattgtaattatgtggacaagcacggagccacatggctggcagagca

SEQ ID NO: 183945 - DNA, 496 bp, Homo sapiens
tcttattgactgagaaatcttcaatgtggccccttgtcgtccataccactattggtactcttgttctcacttggttctgttaagcttcatttgagctttcccaatgctgctataatagtcttcctaaaaattaaagctgttcttattcccctgcttaaaaatttctctgctgttttatttcttatagaataaaacctaaataaaaggaaaatttttgagaatctagtccctttgatctagaactggtatatctctctacgcaccttcaaatcttttggcacataaatttctcattgataacttcagttttgtttttgtataccatgcagtgtttgtctttctatacatctttttctgttctccacaagttcctccatacctctcattcccctgccaaaaaaaaagccagaaagcagaactgagttaagacccggcttagatatgacctcctcagcgaaaccttttctctcacaaaacaaggtggtcatcttattca

SEQ ID NO: 183946 - DNA, 346 bp, Homo sapiens
atttgctgagagtaaaaatgcactgtatcatttgtcagggctctaaggaacttctaaccctagtttaaggaagaatcatggataccaagaataaatcacaaatactctaaaaaatcattccttgaaggggaagaagactttgctgaccttaattcctatcacagatttcactgaacccaaatggggtttggtttcattaatttaacctataaaagacagaaatagttgaagctgcagagaaaatagcaatggaacctgaaacaaagtctaattgtgattaattaaaaattagtgtcttctaaagactaccagaagatgaagaacaataaatttacaaatatcagaa

SEQ ID NO: 183947 - DNA, 338 bp, Homo sapiens
tggtcccagctacttggggggctgaggcaggattgcttgacgctgggaggcggaggttgcagtgggccgagatcgcaccactgcacgccagcctgggcaacagagtgagacactgtctaataaaaaaaagagaagattagtactgtgagaaacaggacaacaggcaaggttggaagggtggccctgtggcagtttgtgcatgtgagctttgcttgtgtttttaaaaccaactattgaggtgcaatttacttcagtttgctggtaatggcacacccaagtagcacgtgcaactggatgggtactggccgtcgttatatacctgtacacttacgtacatg

SEQ ID NO: 183948 - DNA, 377 bp, Homo sapiens
ctgcaggtgtgtgcccctactcccggctgtgaggtcttcctgatgccctagaatgcagtgtggaaaagctgtgcttctggtaagcactgagaaactcggtgtctgtggatttaccctcaagcacacagctaggcgccctgttcctcagtgctcatccctgggccggtgtcattccgtgacaggtgtcagcagatgagtgactgggcagatgcttttcagttgcatcattaatactgcttggtgataagaaatacctgggctgagactgagcctctctgagatatttggttagctgcattggcgattccctcctgcctgcctgagtgaccccatgcaatctgctttccctgtgcccacccgaccccgtcagtcatggt

SEQ ID NO: 183949 - DNA, 178 bp, Homo sapiens
gtgctgcagtattacaaacaaataaaataggccgaaaagaatcccccttccacttccataaaaagaaaaatgcatcttcatgctcaatgtaaacatcacaaaagcttggtcaatggtttaatatttaaaaaatggttttgggtcatcagataactatagcaacacaacgtggaaagaa

SEQ ID NO: 183950 - DNA, 597 bp, Homo sapiens
ggatacatagttaaatctcacagcgtgactgaaggcctttgctgcgtctgacgtcatcatggcagagggcgtaaggaatggaggaaatcaaccctggtgcagagcaatcgagtccacaaggtccgacggcgcaagcggacacgggtacccctgtgcgggatccacggggctctcctcacgcagctgtaaaggcgtgctgttggtgactcgctgtcagacacaggaaaggggcgctgcaaaagagggctcttatcatcatggaggctgatgcagccactgccgctaggcaggaacggggttctctgactaggaatgccagccctaatttactgtcttgaaacacacagattgtactggctacagcacgatactgtccttggggcgccaggcttacacaggacttccttgctagagtctcggctgtcaacactgatttcatcttcttttgcttgctgcctgtgtggactttgcacggtttcagaatcgtaccaggcttactgctttcccgtgatacttctagcgttaggtcttgttttgtgttcctgtcaaacattctgaaattattgttaagacccagtcacaacaccgtcagatcca

SEQ ID NO: 183951 - DNA, 443 bp, Homo sapiens
atagatgcattgtgaatttggcaggttctgctggttgcccttcacaaaggttgcacgattcatcccttaccagtagacagggtgtgagggtgctcttccctatctttgcaacactgggtatcaccaagctcttgagatgaaatgtgacttcctcttattttgatttccatttctgtgacagatttattaattcatttgggagtctccaactagtcttctttttctctcttcttttcctttttttttttttttttttaaagacagggtctcctctgttgcccaggctagagtgcagtggtagaatcttagttcactgactgcagcctccacttcccaggctcaagcaatcatcccacctcggcctccgagtagctggggctacagacgcatagcaccacacccagctaattaaaaaaaaattttttttttttgagacagagttt

SEQ ID NO: 183952 - DNA, 381 bp, Homo sapiens
gtacaagtagatatctatcctcctcctctggaggaatagactgtaacttactccactgttcccaagagaaactaaatcagacccactgccaaaattctgctgcactatctatttgaccctgaacaagtatcttaaatctctacaggtctcaatatccacagggctgctggaagcgcaaaataagataacctatgcttagttacgataggagacacaattatgctactattataatcatggtcatccgtgagtttccgggttttatttgtttttgtattagtttttttggagtctccctctgtcgcccaggctggagtgcagtagcgcgatctcggctcactggaacctccgcctcccgggttcaagcgactctcctgcctc

SEQ ID NO: 183953 - DNA, 296 bp, Homo sapiens
acatcccctggcagagggcagcacctggtaccccggggagttcaccgcagatcctggtctttgcggagggcaacagcaagacgccctgaattctgatgagctccccccaaacttcccaaagcaaatactctgagcagcatctccctgctgtgctttaagacacctgtacactaacagtgtggcacaatagatgctgagtcaggtgacagctcggggcagccacctctcccatcaggaaagcacaggattcctgcagcatcctggcgggaaaagccccccaagaggcagctaacaca

SEQ ID NO: 183954 - DNA, 473 bp, Homo sapiens
tgtacgcttactctcaaggcttttttcctccccttttctcataaacgtcttacgcaagtggctgtcacactattgtcgcttcagtcatttgcagggaggctattaaactgcccctgctgcaagacgtagcagccagcctcaatacaactcaaataactgatgctttccctctaagattaggaacaaggcaaagatgtctgttatcatgacttttattcaacatactgctgaaagttctagccaatataatacagtaagaaaaagaaataacaggcacacagataagaaaagaaaaaataaaaatggtccctatttgcagatgtcaaaggatcatccacatagaaaacccaagaaatctattttaaaagcctcccagaggatgggcgcagtggctcactgcactccagcctgggcaacagagcgagactccatcttaaaaaaacaaaggccaggcaggcgcagtggctcacacc

SEQ ID NO: 183955 - DNA, 269 bp, Homo sapiens
atatatatatatatatatacacacacacacacacacacacacacacacacatatacatatttatactatttttatacttttttaccatatatatatatatgaaccatagagccatcagaaaatagagataagtaaaaatgaaaaaagtaaaaatcatcaactacctagccacctcaaaataccaactgttaatttggggaagtgtccttctggtatattttctatacgtgtataatgtgtttttaaaataaaaatctcaatcttattgt

SEQ ID NO: 183956 - DNA, 211 bp, Homo sapiens
aaagaaatgagtgggagacaaaaaggaaaaaagagaaaggaggagagaccacctacaagagtttgaatgcttctagccaaagaaggtgaggcattgcagcatcttaccactagatagcatatcccagtatgttacaacagtatgttacccgcaggtgagtctgcagctatctctgtcctttttcttttccaaggaaagaattcaaaggaaa

SEQ ID NO: 183957 - DNA, 529 bp, Homo sapiens
agcctgctgaggacagtgattcctaggaatgggaaagaaacaaagggaacactaaagatgctccagattactgcttgaagaaagtttccaggcttaagtacagaaataggaaacccaaacttgaggagagagcatttgcaatttggggaggcaaggtagctagaatgtgtagggtgggtcagggatgttgctcccattactgaagcaatatcgttccgagggcttcacctcaggaggtctttctattctgaatagtgggaacacaaaatattctcagccctgtgagttctgaaaattgtttcacctattcccttttggtggttccttccccagtcttgggtagtttccttgtattctgcacatatcagtattcagccaaagactttagatgatccttctgttcatagctctctccctgtgcagctctctcctctctgttattccaccctacacattctagctaccttgcctccccaaattgcaaatgctctctcctcaagtttgggtttcctatttctgtacttaagcc

SEQ ID NO: 183958 - DNA, 434 bp, Homo sapiens
tttttttctgggatacagttcagctactactaagaatcagtttgattttctcaaggcttgcttttaagcttttttagggtgggtcagggatgttgctcccattactgaagcaatatcgttccgagggcttcacctcaggaggtctttctattctgaatagtgggaacacaaaatattctcagccctgtgagttctgaaaattgtttcacctattcccttttggtggttccttccccagtcttgggtagtttccttgtattctgcacatatcagtattcagccaaagactttagatgatccttctgttcatagctctctccctgtgcagctctctcctctctgttattccaccctacacattctagctaccttgcctccccaaattgcaaatgctctctcctcaagtttgggtttcctatttctgtacttaagcc

SEQ ID NO: 183959 - DNA, 357 bp, Homo sapiens
actacttgtatcatgttctaaaaatcccaccatgtccctggagctcaggatcttcaaggccaaggggaggccctaaaggtgaagttgggggtgaaccagagtgaaggagagcatctccagtgatgagggagtccaagacccatgatcctgggtgatgggggtggacaggaggagcgtgactgtcaagctgcccaggcccaggcccatgtgtgaacagcagccctgtgaatcttgctcttggcctctgagccttggctctggcttatgctccaaagatggtgacactgcatctcctgtggtctcagggatcagctgggtcatgcaggtttcagcaggggttgtggtcaccactattcc

SEQ ID NO: 183960 - DNA, 202 bp, Homo sapiens
tagctttccaagtcccttgaaattccctataaattgaagaatcagcttgtcaacttgtacaaagaaatcagcagagattctgatagtgattttgctgaatctgtaggtcagtttggggaagtattaccatctcgacaatgttgtcttctgatccatgaacaggggatgcttttccagtttcttagatcttaggtttctttca

SEQ ID NO: 183961 - DNA, 262 bp, Homo sapiens
gtgttcgccaagcaggaagctccaccacacttaggggcccagagctttctccatcaggatttcattatgtaggaatgattgatgacattactggacacctgattgaactccatctccagccccctcccctctcctgaggttgagccagtctgaagtcccagccctctaatcacaaagttggtgtctctggggccagctcccattctgaagctatcttatctaggggccaccaagagtcatctcataactttctaaagaccgt

SEQ ID NO: 183962 - DNA, 614 bp, Homo sapiens
aagcgattcttacacaacagcctctcgagtggctgggattacaggtgtatgccaccacacctggctaattttttgtatttttagtagagatgggatttttccatgttggccaggctagtctcaaactcctgacctcaggagcccacctcggcctcccaaagtgttgggattacagatatgagccaccacacccagcctagagtagagccatttcttgtagagtaggtctgctagtgatgaattatgtctttctgtttatctgggaatatctttttctcctttgtttttgaaggatagttttgctggattttgggaatgtttggtttacattattttagcttcagcatggtttctgatgaaaaatatgtgttatctcaaggatctcttgtgtgataagacacttgtgccgcttccaagattctctttgtctttgttttttaagagtttgattgtatgcctaggtgtagatctctgagtttttcctggttggaatttattgagcttcctggatgtatagatgagtgattttcatcaaatttgagcttttggccattattttactaaatattattcttgcctctttttctcctctcataggactcctagtatgtatt

SEQ ID NO: 183963 - DNA, 277 bp, Homo sapiens
tgagctggcaggaaggggctgggcagagcaggggcatgcatcctgacataggcagcagtcagtggctgtgaaataagaccaaccacaggtcaaaggcaaggtcacagtctagattggaaaactggggctaaggtccagagagctgagttgctccagatggcacaggacagaatggaaagcaggcataccggtattggttggacattcaagctaacctaaatctagcttccagaaaagacaggttcacacatgtctattcaggatgttactaaggtat

SEQ ID NO: 183964 - DNA, 796 bp, Homo sapiens
cacaaaactgcctcaatctatgagagactgtaaagctaaaagaaaactgcagagcctcagggctaggcggcctggcaggcacacactgacagtgcgctatcttgaatgtgacctggtcttggagattccatcagaataaatagagccacggccccatgccagtctgagcactccatttaattattcaggggaaactcggatatactcaggccttgaaatgaggcagaagcttgcaaggtttcagactgtgttcaaacttcccctgctagccagccgtgttggaagcatcaagcatcgaagcctcgtgaatcagcatttggagagggagatcagccgggctaaatttggagatttttgactcagccatcagtgaaattcagcagttcctcctgaagcttttggtgaccttttggtttcatccaagctcaaataccaaaggcactgtgaaagtggatagaattgtaaacccttgcgtgaagatggtgcagctggcgttctgagatgagttcatccaccacaggactaaacacatctctgtgcctctagcttttcctgtgaaggaatggaaatggggtggtggggaggggcaagaggtggaggcaaacaaagaggaggtggcaaggagatgcccctcgccatgcctggcgcagaacgcaggaggcacccgtctggacctcaccagtgccggcgccccgtagctgtctcccaccagctctccacggagctcagaagggcccaagtcaatgcatcctccaacacatcctcgtgtattgccaactgagcctttgagcgagtg

SEQ ID NO: 183965 - DNA, 294 bp, Homo sapiens
cctgctcgtccgacatcctgggacattggctttttacctgcctttgaacttgaactgaaacattggcccttcctgggtcccaagcttgctggccttcagatggaaactatactgccagctttcttggttcttaatgcttcagacttggactgaaactaaaccattggttctccaacttgctcccacaactctgcacatgttaggtcagcctccacaatcatgtgaactacttccttataataaaaaatctctacacacacacacacacacacacacacacacactcacacacat

SEQ ID NO: 183966 - DNA, 380 bp, Homo sapiens
cgagatacaatcaggtattaagtaccttgtggtaaacaatttcaccagtgaagtagtcttgcacaaagagaaaagaacacaaacctaattaagcttctggttctacctaccaatttacaggagatatacacgggacaggaaacatgttaaaggacaccatagggatgcagtcagcaaaattcaaactttgggaagctgaccttcttacttcaacaaattgtaataaaaatggagatttaaattaaacttttaggccgggtgcggtagctcacccctgtaatctcagcactttgggaggctgaggcgagtggatcacttgaggtcaggagttcgagaccagcctggccaacatggtgcaaccccatctctactcaaaatac

SEQ ID NO: 183967 - DNA, 271 bp, Homo sapiens
ccaatacccaaacttttccaatcggctccccaattcttctgacacaactaggtcaactgactccttttccataatttctaatctttcagcatgcaattctttccatatggtactatatttccacagacacagagaacaacattctaagcctcctaaaaagattgttttctaaaagtcaaaattatatatctaaaaaaaatagattgttttctaaataaaattggcatggtttgtatgtatatcttaagcactgcagggtaataaaaactgg

SEQ ID NO: 183968 - DNA, 159 bp, Homo sapiens
gagatatgcagtctttccatcagatacaaatggaaaattgtttgtttgtttggtttgttatgggtctgctagcctataaaccaaaggaaaattggtctgccctccatgtacaatagtggagaagaagcaggactaccataataagcgcccatttggaaa

SEQ ID NO: 183969 - DNA, 190 bp, Homo sapiens
caaaaccagccacagacaatgcatagacacgagcctggctgtgtgccaagaaaactatccatggacagacatttacatctcgtctaacttgaaatgttattcctgattttttgcccccaatcatttcaaaatgtcaaagtcaccctcagtttgtgggccctgtggtggtggtgatgatgatgatgattac

SEQ ID NO: 183970 - DNA, 377 bp, Homo sapiens
gatgtttatggaagtgggatttcccccacatggagggagctcaggatctctgggactcctccattagtccatggggtgagcgtgcaggacccttccctgaggctgaagggaagaaggggtgaaagggcttttcattctgggctctctgctcactgaggcccccagggtcaccatgagcatgcaggataagctgcagatgaggcaggggtgccaacttccatggaacacgttgggaactgtgtcccctgtggagggggagagaggagcaggtgtccctgctgcagctgacacagcctcatgctcagggccagcgtgtgagccagacaagtcaggccacagacggatttcagctccaacaaacacaatcctcacatatg

SEQ ID NO: 183971 - DNA, 261 bp, Homo sapiens
gacggtgcctgtacaatgctcttcgcggagttctgtggaacagcccgttcttgcctgggctgtcctgctccgggggaccctggcaatggctgaggacattgtggtgtcacgacttggggaagcccctggcatggagtgggtggaggccagggacgctgctcagtaccctgcagtacccaggatggccccacgccagagaatgatccggccccggtgtccacagcggccggaggaccctgggcttgcgcgagcgtagaccct

SEQ ID NO: 183972 - DNA, 167 bp, Homo sapiens
cccgccaccacattccagccacacgcctcccagccacctcccagccacgtgcctcccagccacacgcctcccaccactaccttccagccacgcgcctcccagccaccacctcccagccacacgcctcccagccatgcgcctcccaccacgtacaacttgcccttcac

SEQ ID NO: 183973 - DNA, 335 bp, Homo sapiens
aaaggcttctcttgtttctcagtctcatagcatcatctgtctcttttttgtgacttgaatataattaatattttatattttgtccttgttgcttgtttggttaatagatttccaccactagactgctcaatacgttagtagggcacctgacacatagttgcagctcttatttattgaatgaatgaatgattccttcccgtaccaccctagtcttgcccactgtcatttttattctgggtattatatttcccaaccagttgtctgactttctcctcagatctcatccccatgggtctgagtgagttgccttgaatataagattcagtgatggtgtc

SEQ ID NO: 183974 - DNA, 366 bp, Homo sapiens
atccccttctcccacattatctctaactcctggaatgacaggttaattttccaacactaattttttttcatttaagtaatactatataattggaatcatacagtatgtaacactttgagtttagctttttttttacttcgtgtgatgaacttaagatctacggaaactgttgactgtaccagtaatttattcttttacaaagcttggtattccattcgatagatatatcacagtttgtttatctattcacctgttgaaagttatctggattctttccagtttgaggcaattacaaattaagctgatgtaaatatttgtgtagcaagtttttacatatacataaatttccatttttctatgttaaat

SEQ ID NO: 183975 - DNA, 574 bp, Homo sapiens
accacttgaaaaagaaagatgtagttaaaaaattatttttgctttatcttctccattgtttaatgcctgaacatacttggattttttaacagcaggaacaagacagaagactttgttagctacccaggtaagatcatttgagtccaaagaccagattccagaacagaccgcagattcctgttgaggacatgggttgtcaggacagcctggaggcagaggggtagattctgttgtaggtgtcgtaagtgacattttggatcagatttttaaccctcttttgtttttgaaagtgagtaaatattcatagcagattattctcatgaaacaagactgacactatgacctcagggaaagagtgctttggggggaactgtgtatttaattaagcaaagaaagagctgatgaaaggggctgagtgtctcagagctgttgtttcttctgccgaatttttccaaataggagcacagaagtcctgagaacactgcctctctatatgttgtgctcagtccacacactgccaacaaatgtgcatacacacacacacacatacacacctcaaagacaacccctccag

SEQ ID NO: 183976 - DNA, 442 bp, Homo sapiens
cagtcatctgaaaagataaaataataatttctcctcttttgccctctaaggtgatttcatagtaggggaggttgctacaggtcagccagaattcattcctaggctcttgggttagtggttcacagttttctctgcatccttatttggagggccttctcctattgcccataagcataacccaaattatgggtcatcctcagtgattactgagaatcattcactgcagtctacttacaactccacccttcatctcccactcaagaaaacatctagaaacacaggcatgtgagagggaggctattatggagattgctttgaagcaactaaatttatatttaatgtaagtccactgtgaagcttcaggcttcattacttacaagcgacttggagctcatctggtgcctattcatagtgcccactgtgatatggtggcacgggtggg

SEQ ID NO: 183977 - DNA, 755 bp, Homo sapiens
  misc_feature (143)..(143): n is a, c, g, or t
  misc_feature (159)..(159): n is a, c, g, or t
  misc_feature (283)..(283): n is a, c, g, or t
  misc_feature (316)..(317): n is a, c, g, or t
  misc_feature (349)..(350): n is a, c, g, or t
gccggacggctccagagcctccagagcctccgggtctgggcggcgcttcggctcctcccgagccggctgctagccccgcgccgactccatccccacaggctggggacgggcccggtgcggctgtgtgggttcgggagcggagnttgcagaatccaaggnacccatttggttctttctccgcactgcgtttatgggaggcattatggcccccaaagacataatgacaaatactcatgcgtaaatccatcctcaattcaatgaactccctcaggaagagcaatancctctgtgatgtgacattgagagtagagcagannagacttccctgcccatcggattgtgctggctnnctgtagtgattacttctgtgccatgttcactagtgagctctcagagaaggggaaaccttatgttgacatccaaggtttgactgcctctaccatggaaattttattggactttgtgtacacagaaacagtacatgtgacagtggagaatgtacaagaactgcttcctgcagcctgtctgcttcagttgaaaggtgtgaaacaagcctgctgtgagttcttagaaagtcagttggacccttctaattgcctgggtattaggggatttggctgaaacccacaattgtgttgacctgatgcaagcagctgaggtttttagccagaagcatttcctgaagtggtacagcgatgaagagttcattcttctgagtcaaggagaggtggaaaagctaatcaagtgcgacgaaa

SEQ ID NO: 183978 - DNA, 293 bp, Homo sapiens
atgtatttcaggatttatcaaatacccatgattctgtccctcaatgtaggctgagtcatcccctcttagatgagaggttctctaccctagctacccataagaatcacctgggatctttaagaaatcctgatgttcagactgcatcccagaccaattaaatcacaatcgctggggaggggtctaggcatcagtgtctctaggaggctcctcagtgattctgaagagcaaccagggctgagaaccactgtgctggacagacctacatctgtgagccagttgaggcagttgctcac

SEQ ID NO: 183979 - DNA, 721 bp, Homo sapiens
tttttatcaggcatgaaggtaggattgtaaaagtcattaagaatttaaaagaaattaagaacaatgtcacctggaattattcccaagatcgtaaatgttcataacataaaactattttcttagtctttatttgcgactacaaagtattttaagactaaaagtctaaatacaatttagtatttgctactaaatagtcttttaagatactactacaaagtctttattgaaaacatcctttgtgccaacatgtatctgcttttccagggtgtcagggcaggcagtggttctagtttccacaaggttacaaccctgttcaaatttagaagcaatgtcagaagggtgacaaggcaccattgtgacagttagaggaaagaggactcagggtgaaagttaccctgggtgaagactcctgccttgattttatcttccaggtgggaaaagaggccttgagggaggaaataaactcattgatcagtcattgggagctttttgggtgctaggcaggttcttataaattgacattaatccaagtaatgtcatttaacgatgccttttcatgaaatctgaaactcacctaacagattttttttaaaagcctgtatgttctctgtgaaaaaggggggcaccctaccaattctgaaagatagaagtgaagccatcaggttctgagttttctgtaaatttttttccctcaaatttctgatataatctttcacttcta

SEQ ID NO: 183980 - DNA, 667 bp, Homo sapiens
tttttatcaggcatgaaggtaggattgtaaaagtcattaagaatttaaaagaaattaagaacaacttagtctttatttgcgactacaaagtattttaagactaaaagtctaaatacaatttagtatttgctactaaatagtcttttaagatactactacaaagtctttattgaaaacatcctttgtgccaacatgtatctgcttttccagggtgtcagggcaggcagtggttctagtttccacaaggttacaaccctgttcaaatttagaagcaatgtcagaagggtgacaaggcaccattgtgacagttagaggaaagaggactcagggtgaaagttaccctgggtgaagactcctgccttgattttatcttccaggtgggaaaagaggccttgagggaggaaataaactcattgatcagtcattgggagctttttgggtgctaggcaggttcttataaattgacattaatccaagtaatgtcatttaacgatgccttttcatgaaatctgaaactcacctaacagattttttttaaaagcctgtatgttctctgtgaaaaaggggggcaccctaccaattctgaaagatagaagtgaagccatcaggttctgagttttctgtaaatttttttccctcaaatttctgatataatctttcacttcta

SEQ ID NO: 183981 - DNA, 298 bp, Homo sapiens
tccccgcgattcactggtgactcctcacactcagatgcccgttccattactgaagttagagagaatatgagagctcatagtggcctgtgcaagatgggtcaaagtcagagtggtggtcatggtcctggaggtggcaagaaggatgacaagacaagaaaaagaaatatgaacctcctgtaccaactacagtggggaaaaagaagaagaaaacaaagggaccagatgctgccagcaaactgccactggtgacacctcacactcagtgccagttaaaattactgaagttagagagaattaa

SEQ ID NO: 183982 - DNA, 257 bp, Homo sapiens
tgggcagtgatgtgaagaagagaaagaggagaggagacgagtgagtccctccccagccatggtctggtctggtcagcacaaggagtggcagactccactgggtagcaagaagtcaggggtggccacggtgttcacacatgaggtggggtgggaagcagggtggtaagaaacgctgtggagcccaggcattcacgcctccccaacccaatcttctggtgaggacaggaaaatcccccacagttggcatcgtctcagca

SEQ ID NO: 183983 - DNA, 258 bp, Homo sapiens
ctctgaacttcagtttttccatgtgtaaaatgaggctaattagaaaggtaccgtctaccttaaggtcttactgcgtagatgggtaaagggccttgagatggtatacacagtacacctagcagtgagatcccacccagcaggtgggattttagttactatttttcttacccatctttccatatagtttgttggcctctggtatgtttcttcttgctagcctttctgcttccacccttaaccacataatagtaatcacat

SEQ ID NO: 183984 - DNA, 123 bp, Homo sapiens
ttggtagttgctggggctaaatgatggtgttcatgggattggttacactattctatttttgtggatgttcacaaatctccataatagaaaagttttttaaatctatactatacagatatacca

SEQ ID NO: 183985 - DNA, 405 bp, Homo sapiens
aatgcagcattcgttgaaggcaagtcatgccttatcaggtataaaaacactacagtggtcctcagccttgatgggtcaacccttcttagtgtgaattttgttaacggcctgtgtctgaagtacctttctaggcactgcaactttctgagtgtttcccttcaggactctatgttaaaacaaacaaacccaaacaaaaaaacacttctgtatttccatggaagtgatttttaagaaaaacaaataataaaaatgcatgacttttgggttgccatatcagggcaaaaataaaggaaatagtgcctagaaagggattgtgaaggcagtggcaccctctgcaaatggcacctgttgctacaggtgcaggatttctgggagaagaagaggatttcttcctgacaggcaggt

SEQ ID NO: 183986 - DNA, 854 bp, Homo sapiens
cagcctcccaagtactgggactacaggcgcccgccaccacgcctggctaattttttgtattttttagtagagacggtttcaccatgttagccaggatggtctcaatctcctgacctcatgatctgcctggcttggcctcccaaagtgctgggattacaggcgtgagccaccgcgcccagcctatttatttatttttaaattttttttttttgagatggagtctcactctgtcacccaggctggagcgcagtgatgcaacctcagctcactgcaacctccacctcctgggttcaagcaattctcctgcctcagtctcccaagtagctgggattacaggtgtgcaccaccacacctggctaattttgtattttgagtagagacggggtttcgctgtgttggtcaggctggcctcgaactcctgaccttgtgatccgcccacctcggcctcccaaagttctgggattgcaggcgtgagccaccgcacccaaccaagactcttcttttaaatgacattttggatctcgtattctgtcacagatggaatccccattagatgagcccgctcagtttaaacccaatgagtgagggaggcaaggaagtggtcatgagtagaatgatagttcccttcttgagaatgctagtgaccttgtggatggaaaatcattctgccacaatttgctgggtctcttgcaagccagaggaagtttcttgatagagaatggcccaaactggtaacagaacttttcgcctttgtttggcatttcttttctttaactctcccttgccttccagcaaaaagtgcacaactctgaaccagaatatatgtccctggaaactcttaattctgaagatac

SEQ ID NO: 183987 - DNA, 749 bp, Homo sapiens
atctctaataggcccttatttgtattgatgcttgtatctgaaatacagttggccctctgtaactgtgagttctacatctatggattcaaccaaccagagattgaaaatatttggaaaaaaatggatggttgcatccgtactgaacatgtacagactttttttggtcattaatccctaaacaacacagtataacacatatttacataatatttagatgatattaggtattataagtgatctagagagtacctacataggggaatgaacataggttatatgcaaatactatgccattttatatcagggacttgagcatccgtggatgttggtatccatcagagtccaggaatcaatcctccatggttattgagggacaactgttttgctaacctactgggctctgaatcttagatgaagccttaaggcagttatctttgactgcctttatcttacccttctggtttattcaataaacagttattaagcaacctccagtaaatttggccctaaggaatctgaaatgagtagaatggttctggcctaatgtcctatcttgaagaccaaccttaaacttaatttgatgagaatgaatagaagtgtccttttttggtcccaaaccagtacaacctttagcaaacaaaccattaattaaagtcagagcacccaagcacctcccttccctttttgtgacttttattcgggagtggttggttgatgctttttctcttttggggagaccattttatatg

SEQ ID NO: 183988 - DNA, 1284 bp, Homo sapiens
taaaaatgtgcttacagtggtaacaacaggtaaaagaatataaggatagtttcagccaagtattaatctataaagttaagcggaccaacataagatttgcttaatgggttggcctgtatgcatgtgttgaattttaaaatctaagaaggattattgcattaaatttgcagggactgcccaattttttttttgtcgttttttgttttgtttttttctgagatagcagtctcaccttgtcgtccaggctggagtgcagtggcacaatctcgcctcactgcagcctccaccttccgggttcaagcgattctccctcctcagcctcccaggtagctgggactacaggcgcccaccaccatgcctggctaatttttgtatttttagtagagacggggtttcgccatgttggccgggctggtcttgaactcctgacctcaggtgatccacccaccccggcctcccaaagtgctgggattacagtcgtgagccaccatacccggcctagaaatgttttttagtggcagttaatttctaacttgcaaacaatttttgggatctagagtttttaaaaattagcgttataccaaggaacccactggtatgcggaatgtttctcatctaagtgattaattacaaacgcttttctgagacagacctatttgttgatccaagacttatgaacactcagcttataatttttttgctccttaaacgtaataaacattgtccagtttagaatgacatacttggaccacattcaaccaagagacacttgatgaaaatattatgcaaaatacctacttaaaatgtgattctgtggaattgacagttgaaggtagtattatataggcaagctgtagttcttgcctagaacaggcaagttctcaattcaacaatttgatgcgtcctttagcattgtgttaggaagatgtttagaaataagacaactcaagcaatctgctttttgtaagagtaacgacttttccttcccagttgccctttgattgttgccatctaatggaggactagcatcaggctctttttctttaattggagcagagataaaactttaagcatatccctgtgtaacatttctaaaaataaaggatactaaagtgtatactaccttactttaagagaggtgataaaacttagcatgagccatgcagtctttttgaatttttgattcattgtgtgatttggggcaagttttactgcatttgtctgtgactctgtttccacatcttcaaaatgggaataatactatctacctctaggatgttttga

SEQ ID NO: 183989 - DNA, 845 bp, Homo sapiens
cgacggacgcattcatgaatggtgtgctgggattacagtcgtgagccaccatacccggcctagaaatgttttttagtggcagttaatttctaacttgcaaacaatttttgggatctagagtttttaaaaattagcgttataccaaggaacccactggtatgcggaatgtttctcatctaagtgattaattacaaacgcttttctgagacagacctatttgttgatccaagacttatgaacactcagcttataatttttttgctccttaaacgtaataaacattgtccagtttagaatgacatacttggaccacattcaaccaagagacacttgatgaaaatattatgcaaaatacctacttaaaatgtgattctgtggaattgacagttgaaggtagtattatataggcaagctgtagttcttgcctagaacaggcaagttctcaattcaacaatttgatgcgtcctttagcattgtgttaggaagatgtttagaaataagacaactcaagcaatctgctttttgtaagagtaacgacttttccttcccagttgccctttgattgttgccatctaatggaggactagcatcaggctctttttctttaattggagcagagataaaactttaagcatatccctgtgtaacatttctaaaaataaaggatactaaagtgtatactaccttactttaagagaggtgataaaacttagcatgagccatgcagtctttttgaatttttgattcattgtgtgatttggggcaagttttactgcatttgtctgtgactctgtttccacatcttcaaaatgggaataatactatctacctctaggatgttttga

SEQ ID NO: 183990 - DNA, 881 bp, Homo sapiens
gtaaatcacttcttggaggtgccctgcacgccggtcctgggagcaggcggcctcccgggggtgcgggagccccactcctccgtggtgtgttccatttgcttcccacatctggaggagctgacgtgccagcctcccccagcaccacccagggacgggaggcatgagccggtcaaggcacctgggcaaaatccggaagcgtctggaagatgtcaagagccagtgggtccggccagccagggctgactttagtgacaacgagagtgcccggctggccacggacgccctcttggatgggggttctgaagcctactggcgggtgctcagccaggaaggcgaggtggacttcttgtcctcggtggaggcccagtacatccaggcccaggccaggagcccccgtgtcccccagacaccctgggaggggcggaagcaggccctaagggactggactccagctccctacagtccggcacctacttccctgtggcctcagagggcagcgagccggccctactgcacagctgggcctcagctgagaagccctacctgaaggaaaaatccagcgccactgtgtacttccagaccgtcaagcacaacaacatcagagacctcgtccgccgctgcatcacccggactagccagaacatttccatccggagtgtggaaggagagatatactgtgccaagtcaggcaggaaattcgctggccaaatccgggagaagttcatcatctcggactggagatttgtcctgtctggatcttacaggcttcacctggctctgcaggacacgtgcaccggaacatcctctccaagttcacaggccaggcggtggagctgtttgacgaggtgttccgccacctctacgcctccgccaatatgtga

SEQ ID NO: 183991 - DNA, 1048 bp, Homo sapiens
gtaaatcacttcttggaggtgccctgcacgccggtcctgggagcaggcggcctcccgggggtgcgggagccccactcctccgtggtgtgttccatttgcttcccacatctggaggagctgacgtgccagcctcccccagcaccacccagggacgggaggcatgagccggtcaaggcacctgggcaaaatccggaagcgtctggaagatgtcaagagccagtgggtccggccagccagggctgactttagtgacaacgagagtgcccggctggccacggacgccctcttggatgggggttctgaagcctactggcgggtgctcagccaggaaggcgaggtggacttcttgtcctcggtggaggcccagtacatccaggcccaggccaggagcccccgtgtcccccagacaccctgggaggggcggaagcaggccctaagggactggactccagctccctacagtccggcacctacttccctgtggcctcagagggcagcgagccggccctactgcacagctgggcctcagctgagaagccctacctgaaggaaaaatccagcgccactgtgtacttccagaccgtcaagcacaacaacatcagagacctcgtccgccgctgcatcacccggactagccaggtcctggtcatcctgatggatgtgttcacggatgtggagatcttctgtgacattctagaggcagccaacaagcgtggggtgtccgttgtgtgctcctggaccagggaggtgtgaagctcttccaggagatgtgtgacaaagtccagatctctgacagtcacctcaagaacatttccatccggagtgtggaaggagagatatactgtgccaagtcaggcaggaaattcgctggccaaatccgggagaagttcatcatctcggactggagatttgtcctgtctggatcttacaggcttcacctggctctgcaggacacgtgcaccggaacatcctctccaagttcacaggccaggcggtggagctgtttgacgaggtgttccgccacctctacgcctccgccaatatgtga

SEQ ID NO: 183992 - DNA, 570 bp, Homo sapiens
agatattacgtaaataaccttgaaaaggtaaaaaggagtgtttgcagttatctaaaatatagaaaaatggtttactaaaattagcaatctttttgaatattagaacagcaaaaatttctcagcatgattttggatgaaaaaatgtcatcttggaactgtaaagtttagagatgggagaatccaagaagtcatttaatggtcaacacccatttctgggaatggttacaaatactttatgtgtaatcttttaagggactttgaaagcctctgcttaatcagtaaaagatcagcaaagagaattaacttgagaaacctgctcacggtggcaaccaagaggctctatgagtttgggaataaggctgtctatttgggtccaaagatatgagattaaggtccacctctcttaattctgtcacttggcaattgagtaattagtaattgggcctcaaatttctatatcccctaagtggagaatggggtagtactcttcctcctcttgccaccactactactattgttgccacctctatactactaatatccaaagacagggttgaagttcaaaataca

SEQ ID NO: 183993 - DNA, 165 bp, Homo sapiens
ttgaagcactggggtgctgtccctgccagtagactcagctagccttgccacgatttccggttcctcccagtgccattccagagtctgagtcctgttgcaactgagcctgtgttataaaaatcataaggtggccgggcgcagtggctcatgcctctaatcccagca

SEQ ID NO: 183994 - DNA, 337 bp, Homo sapiens
catcagtgctgtaccttcctctgtctctcaagcgcctttcatccttagaatctggcttaggtctcttcctctatgacactgccctggatactccagctcagtcacactatggcatctacaacacacttaatcatttatttgtcttctaattgtttcctggtgttcataatatccctcatcttctactccaagtgcctgaaagtacagtgccaagtagtatagcactgcagtcattgcatggtgttggtggagactgctgaggttcaaaaccctcttcttctactaactagctgtatgatctagtgcaagttatttaacatcacatggccactcaata

SEQ ID NO: 183995 - DNA, 406 bp, Homo sapiens
ctgcactaggatattggcattgacgatggagagaagtgaatggatttaggagtagctctctttagaaggaagaattgttatgacttgagtggttggttagatgtaaggttgagagaaaacccagacatgattctctggtcatggttggggcagatcgaagtctggagaagtagcagtatggggaaggggctggaggaacagagggaaaacatgagttaaagtttaaatttgctgagatggaaagtgtttgatgagacaggcaagttaagcacttagatatacagatgtaaccatattataagtctagcacttaggaaagagctttgaaccctatttgagatttatatatataaaatatttgagccactcttctataggggttaaattaagccatggaaggcagaag

SEQ ID NO: 183996 - DNA, 262 bp, Homo sapiens
taataaaagacatcaactcacagagttgcagcagcttggttaatctcaggaaggataaatatgaagtaaatcataggaaggaaaaacatactcagatgaaaaccaagattaaggaaaatctagaaagtggtcaaagaatgcaaagacaacatacaggaaacagtgatacaattaaattaatggttgatttttaatcagaaacactaggggcaagaagctaatgagaaaatttttttttttctttttttggtttttgagactg

SEQ ID NO: 183997 - DNA, 1320 bp, Homo sapiens
cactagaaaatacagagcatttttgcagaaattatgtttgaattatttaatgtaccaggattctacattgcagttcaggaggtactagccttggaagtatcttggacatctcaacaagtgggtgaatatatgttaatgagtatagtcattgacaaaggagatggagtcacccttgttctcccagttgtagaaggttatgtaattgggagctgcatcaatcacatcctgattgtaggtgatactgtgtatttcattcaacagctgctaagggagagggaggtaggaatccctcttgagcagtcactggagaacacaaaagccattaaggagaaatactgttacatttgccctgatatagtcaaggaatttgctaagtatgatgtggatccctggaagtggatcaaacagtacacaggtatcaatgtgatcaaccaggagaagttcataatagacgttggttacaaaaggttcctgcaacctgaaatatttttttacccagagtttgccaacccagactttatggaatccatcttgaatgttgttgatgaatacaaaactgtcccattgatgcgcattgtccactgtataagaatgttgttctttcaaggggtttgaccatattcagggatttgaatctcaactacagagagatttgaagagtggtacatgccagattaaaactcaataaggagctcagtggcaggagaatcaaacctaagcttacaaaggttcgggtggtaatcaatcacatgcagcactatgccttatggtttggaagcttaatgctagcctcaactctggagttatttcaggtctgtcacaccaagaaggactataaagaatatggccccagcgtctgccaccagagccttctctttggaataatgtcttagtgtctgccttgaaagcatcatttaatagtgtcatgttggggaacaagtgtccttcagaacccagagaagactaccatttctaaatgacatttggtgttgatgtctgagcagcatgcttgcaccacctagtgcatgaggcacagggcagagtcatttcagtaaaagccatttctttatgtgttgactgttgtatgcccactcctccttctctcactccctttcttcatgcttccccagtttccctcctccttttcacttgaacttttttgttgacaaataccattctgaaggaattcaaatgtgactctgaaaattgttaagaggaaaaaaaatttcaaaaatggcccaaaatagttctcccccaggaaagaatgcagtggtataaatccttttcccccagcttatttttataaataaaatgttataa

SEQ ID NO: 183998 - DNA, 202 bp, Homo sapiens
accaactgataaactaagcaccaccagtaatgagacaagctgaaattatttatctcctggtatctcacaagaagaaatatacaacatcccccatacagtattttttcttttcttttttctttttgagacagagtctcactctgtcacccaggctggacttttctgagacgaggtgatcttctgaggtgatcttctggacgat

SEQ ID NO: 183999 - DNA, 263 bp, Homo sapiens
tctttctttgctgagagctttctttttgcctaatgaatccatcctcctcacctttcaatgtgtccatgtgcctaatttttcttggttgtgagacaagaacccggattttagctgaactaaggagcaaaaattcctgtatcattaagctatgaatgatcaaaatttgcaaactcctgaaatgcacctctggtttgcctgttaaaagcaagggctgagaaaggactctcgcagtacttggagacagatagacaatactagctcca

SEQ ID NO: 184000 - DNA, 316 bp, Homo sapiens
atccttcccttccctcccgctaaaatccctggctttcaatctcatgcactgggcttgcgcatccattacctctcccgggttcagtcactgccccttaattcaagattttagctcctgagagtccaacacactctggtgataatttttggtgacatctgtagcacacagttgactgtcattctaccatcctggctgtccctcaactccaccttagctaccagttccttcagctctgtcctccaagtggcattaccggtaactaagcccctctgatcttagctctaaccaccgctacactgactccctgaaggacctc

SEQ ID NO: 184001 - DNA, 419 bp, Homo sapiens
tcccctgtccccagagaggagcttgaaaaggttctggaaccttcacattccagggtccttggataaatctttgtgctttctctactgggaaaccctgcctaggccttcctggatgattatcctctcatccccaggcaaatgggcaagtggactttggatgtaggagcatgtcctgctaggggcccaaggatgaagccttcgtggatgttcgtgtattctagtccttttggtacagggacagagtgggtgccaagatacatccctgggtttgcctggcctcggcagtcctcctgccccagctcagtctccagaggctccaggaggaccaggcccgcagcttcctgtgtcagggcagagtctttgtgcaggggtcagcaccttgtgcctgccggtcctcctgcactgtgagctggggatgg

SEQ ID NO: 184002 - DNA, 384 bp, Homo sapiens
gttttaacagttaggttttatattttctctttagatctcctcagtattggttttgtctattctgtttcacttaaattatatcttcatctataggggattttatattctatattgtgtgttcctttaaattgaccatgatgaattctgagtgtgtaggtatttgtaccatttaagtcgttaactctttagaaatgtatggacttatttatattttttataatattgacagtaaaaaatatgggaaatgtattaatatgttaaacatttgacaacacaagcaagttatgtgggctttttaattttttttaaagaaatgtaaaaagtctgggctacattatgtttcccaggctgaactcaaactcctggatttgaccgggtgcggtg

SEQ ID NO: 184003 - DNA, 498 bp, Homo sapiens
atactcctgcacaagttcctagctaagggtgagcaaggtgacgctctgcattcttttttcaggctaacatattgtaaacaagtgtctttttcagggtctatttactgccacatttctcttatttttctgccttttttttgaccagggtctcactcgctcacccaggctggagtgcagtggcacgatcacagctaactgcagccttgacctccccaggctcagatgatcctctcacctcagcctcccaagtaggtgggaccacaaccacatgctaccatgcccagctaatttttgtatttttttttgtagagacggggttgcacaacgttgcccaggctggtttcaaactcctgggcttaagcaatcctctcgtttcagtctcccaaagtgctgggattacaagtgtgaaccaccacatttggcctcatttttgtgctttttgctggtgatttttctatttaaaatggtcccaagcatagtgctacagtgctgtctaag

SEQ ID NO: 184004 - DNA, 478 bp, Homo sapiens
ttagtggcccttctgtggaccttcctttcactgagctctggcctgctgaagtcctttagcaatttagatctctaacttcggcttgaatacagaaagatgttcgacctagcacacaaatgaaaccctgaatacaaaatggaaacatactaaaccttggagcctctttgctgatagatcaaaatcaaatgtattggctgggcacgatggctcatgcctgtaatcccagcactttgggaggccaaggcgagcggatcacctgaagtcaggagttcaagaccagcctgaccaacatggctaaaccctgtccctactaaaaatataaaaattagccagacgtggtggcatgtgcctgtagtcccagctactcgggagggtgaggcatgagaatcgcttgaacctgggaggtggaggttgtggtgagctgaaattgcaccaccgtactccagcctgggtgacagagtggactctgtctcaaaaa

SEQ ID NO: 184005 - DNA, 265 bp, Homo sapiens
ctgtaatggttggtacgatctcaccataggcctgttttggaagcaaggtttgaattttcttaaagaaattttgaatgttattcttagaacagcttcttgtttctcacaaaaatcatttatgtaaagggaaggagcacactgatttatttaaaatttggggaaattgcgaaccaaaaaaaaaatgcattccaatttacaagttacttgattctgtcatatgaagtggcagtgtccttttcctttcctgcttaaaaaagcagctctg

SEQ ID NO: 184006 - DNA, 495 bp, Homo sapiens
tctctcactatagttttggtcaggaaacaaagtgtatgaaacttgcaaactctggagtcagactgcctagtttcaaatcccagctccagcacctacttgctgtgtaatcttggttcagtcacaagacttctctgttcctcagtgttctcatctgcaaaatgggcataataattatatctgcataattagtgtgtgtatctcacacggacctgtgcaagcacgtagtcaacactaaataaatgttattataactaaacacatttctattatttatttaaacaaattttgctagtgcccattaggactcaggactttgttcagtgctggagatacagtaatgaataagacacagttcctgccctcaaattgcttgcaatcttaagtgggtagaaagataagaaaatgggtagttattgtacagtggatgagtgctgggagaatagaagttggggatgtcttggaagcacatgcagtggcttctaacgtggttggtgg

SEQ ID NO: 184007 - DNA, 367 bp, Homo sapiens
acaacttttccaccaaaatgtgaaacctcagattatacccttgcataatactctatatttgcctatacattattttagtaagcagagattattcactggcagatactgttataactatgccaaatgaaaagttacttatgaaaagtaactaataagttatgttactttattaactatccttgtgctgtaaagttgtaaatatgtcatttgatttaaatattcagaagaaaatcttttagctttaatgatttttttcctgattgttaaaataatatgtgctcattttagaaaatatacaaaggtaaaaatgaccataatcacagagtacattttggtgtactttttccacccttttcctatgcatttt

SEQ ID NO: 184008 - DNA, 735 bp, Homo sapiens
caaattaaaagtatataagatgaaacttgatttgctatcaagccccaagcaatttttcaactgggcattgaattctaacttttctaagatagcaatttttgaagagacacgaacaaaaatctgaattagttcatgagccttaatgtaaatctcttgctgaaatagtttttaaaatcagaatttagttatctatcagactcaaaatcatttaaagactaacaaaacacaatcatgatattctaactgtggtcaaaccaggtacccaagccacctccctgcccaacgcctttccggcttttcccctccctcttgggctggtggttatgctcctccagctctagttcagctataattccttttatagagaaaccaacctgatacacactttcatgatgggagaaaaatgtgggagtgaaatgatatttagaaagcagcagtcaggcacggtggctcatgcctgtaatcccagcactttgggaggctgaggcaggcggatcacttgaggtcaggagctcgagaccagcctggccaacacggtgaaaccccatctctactaaaaaaaaatacaaaaattagccgggcgtggtggcaggcacctgtaatcccagctacttgggaggctgaggcaggagaaatcgcctgaacccagaaggcagaggttgcagtgagccaagatcacatcactgcactgcactccagccggggtgacagagcgaacctctgtctcaaaaaaaa

SEQ ID NO: 184009 - DNA, 918 bp, Homo sapiens
gataatgcccaacactatgagaaaaaggaaacgaatctgcttaaatgcgttaatagcaattataatgttttatttgtatatttttacgtaaactaaagaacttttgagaacaatcctttgagataaatggagcagattagatccattttatgaagaaagcaatgttttgtattcatgtcttgcttaggttcatactgatgagtgacagccaggaaaagaatgcactacgacttgaaagttctataatgctctttcattagtaatttcgagtctttcactcccaaatctgtgagtcctaagagaacatagtaccctctcatttatctgcatcagtggagatgtatgtaagaacatatttcaaatcatcacttagaggctgtgttttggtgggtacccctgagatcccctcacctcactccttgaagtttggctagagaaggacagttgatggaaggtaactagaaaaataacaaggcggtctgcatctgacttgctagtattggaagcagaattatagctgaatctatatacttaccccaaatgcccaagtgcttgcctctcccctacaaagtacattctcacaagttccttttgatatttacaatcaagattcaaagggactgttgactcagatctaactcctttcttattaacactgccaacttgtactcaaatgtgtatttgtagcccaccattaaatcaattggcagtttccaaagctagaaaggggactccaagtaatgaacttaatttctcatacataaagaagtcctttcaattccattttctgcctttatgattttcgatttttatcagtgctatatttgccctcagttttgcttttttttagctgttaaatcaggaattcgggctttcgatgagaaggaaattaagttgagtgttggtcgttttatcttg

SEQ ID NO: 184010 - DNA, 488 bp, Homo sapiens
taatatcacaaggaactgtgagaatgtactttgtaggggagaggcagcacttgggcattgggggtaagtatatagattcagctataattctgcttccaatactagcaagtcagatgcagaccgacttgtaatttttctagttacattctcacaagttccttttgatatttacaatcaagattcaaagggactgttgactcagatctaactcctttcttattaacactgccaacttgtactcaaatgtgtatttgtagcccaccattaaatcaattggcagtttccaaagctagaaaggggactccaagtaatgaacttaatttctcatacataaagaagtcctttcaattccattttctgcctttatgattttcgatttttatcagtgctatatttgccctcagttttgcttttttttagctgttaaatcaggaattcgggctttcgatgagaaggaaattaagttgagtgttggtcgttttatcttg

SEQ ID NO: 184011 - DNA, 646 bp, Homo sapiens
aatgacatgctgattgctgaacagcatattctaattaccttgtggatcccaggccattcttaaattgggttttgtctttattgccttagactgttaatgaattgtttcccagtctgattgaatgctccttgaagacggacccgggtccagccactgcagtaaatattgctaacttgggggtgtaattctgctgcttttgtggttgctgctttgcttatttttttatgtctgctgtttcctgtgagattgtttctgtgtttcatatgtggattgatgttcggtgaggtttatggaatttctgtgcagcttgggttaagagtatctcttcaaaaaggtttttgcatttgcttctgccaaccttgttatcagctcaagttgtttcttatgttgaattattggggatgacctcccccacactcaagtagtataaattagaacctcgctgggtgtggtggctcactcctgtaatcccaacaccttgggaggccaaggtgcgcagatctcttgagtccaggagctcaacaccagcctgggcaacatggcaaaaccctgtctctagaaaaaatgcaaaaattagccaggcatggtggcacatgcttgtagtcccagctattcgggagcctgaggtaggaggattgcttgagcc

SEQ ID NO: 184012 - DNA, 207 bp, Homo sapiens
cctatgagaacagagttttattatcatcttataaaacagaaaagaaaataattttagaagccagaggaggctgggaaatatagtccagctgtgtcagcagaaagaaaagaaaatagatttggtgaacagttagccaatctctgccacagcgtctctctccgaatattttactttatctgcaaattcatccagctcttctgtcccagg

SEQ ID NO: 184013 - DNA, 344 bp, Homo sapiens
gagggacttacgctgccacgatctctgctgtagttggggctgtaaaatgctttccccgtgagaaatgcaagcaggaagtggtggacagccggagagctgccagagccttctgcctccccgcatttttattttgatgacctgagaaaaggcatcacatttctggcttattgatttctttttttctttgtgtatgtggttggagtggggaagttggtgggggatgaaaagaaaggaaaataaagccattcatcattgcaactagctattttgtgtagaaaatgttttcttggtttctgttttatgtgaccaagcacttacttactctgcataataatgcaaagatg

SEQ ID NO: 184014 - DNA, 420 bp, Homo sapiens
cacctaagatcctgagtaacaaacctgatgccaaaagggcaggagcaccctaatgcagaagactttcaagtgctgatgggctgggtgtatctaacgcccatgaaatcaccacaggaacacacttccaacttgggggcaaaggctgcagctatagcactctttccacatttccaaataaccactctaactgcttattcaggaaatgtggattattaaaggtgagagagacagagcactggatagaaaggaaaactggagatataccatcttgtggacaggaacttcacttacataattcttggcagaaggttattctattaagaccagcttgagacatcaaattgtctagtctcctacattcccaggattctgcaaagaagactaggtctctattgtcatggcattaccttgggaccctag

SEQ ID NO: 184015 - DNA, 405 bp, Homo sapiens
ttttttaaaaagtcatcaaagacaatcgcttctgaaacaggataaaacaagataaagtcaaagactaagcagttagttatctttcaccaccagtttgacacaaaagaattctggcgattttttttttttttaatcagcaggactaggaaattcaaacgtgcctaaagctaaaatggtctacatgagttcagctaaagacacaaattaaatccccaaaagccggactcacgggctcacacctacaatcctagcactttgggaagtgtaggcaggtggatcccttgagttcaggagtttgggaccagcctaggcaacatggcaaaacgccgtatctacaaaaatacaaaaattagctgggaatagtggcatgcacctgtagtcacagctacttgggaggctgaggta

SEQ ID NO: 184016 - DNA, 209 bp, Homo sapiens
ctatatattttctcttgcacgtctttaagaacttactgtttttttcctgcacattgtgttctgctccttctccctccctcctttcttccttttgatgttacctgattataaaaatgagaaatcagttttagtgctattctcatgtttccctgcattcagatttttattcaggcctaaaagtcaaggttttggggaaagtgggaggatca

SEQ ID NO: 184017 - DNA, 377 bp, Homo sapiens
tcaagggattaaaaaaaagaacacaattgcaacacacagtcattcatgcccagcaaattcctaaatcaatatttcatgccccatgggacctcctgggcagaagacaataaataatttgccttgattgagtaacactagatgatgccaagcccgggttccattttcttgttttgcctgctcggtagataaatatgcctgtgatgtgatatttttccatttgttatccaacagcttagcaagtactggagtagccagtaaagaagtgttatacagagaaagaacaataatcctgaccaatattattaaaccaccctgcctaactaaaatgtcaggtactatcaggtatacattgaatgaagaatgataatatttaatct

SEQ ID NO: 184018 - DNA, 233 bp, Homo sapiens
atttcacttacttatcgtttgttccagacgagtggaggggaacgtggagggggaagggcagaaggatgggatggccagatgtggatatggaggcagtagataagcctcaggtcctctgaaaacaggggttacagcctgaggaataactcctttgaaggcttcgttgtgatgcactcattccatgtttagtctgtgtttagaaaactaataaaaaacttagaagttgaaactca

SEQ ID NO: 184019 - DNA, 545 bp, Homo sapiens
tggtggtcgcaggtgatggctaaagggtacagggtttctttggtggacatgaaaatgttctgaaattgactgtggtggctgtgcaactctgaatatactaaaaactctggaatcatactctttaagtgaattggtcctatggtatgggaattatatctcaataaagctgttccaaaaagggagggagccaactgcttcggcatgggccaccactcagggagcacagtggggatgccaagcacctgctgtctctggtatttttaccattaacattgcttttatgccagccaccaactctaggagttggtgctactttatcatcctcattttaaagatgaagaaactgaggcccaggcagattaagtaatttgcccaaagtcacatggccggtggtgaactccaactctctcaagcagccctgcggcctgtaaccactatgtgggccgctacaacctaatctaagtcagtagacagctgaaccaacatgcaagttaatgctgtagtaggttcacacttatcttaatagttctgggcctgggaattta

SEQ ID NO: 184020 - DNA, 208 bp, Homo sapiens
cgggcggatcacctgaggtcgggagttcaagaccagcctgaccaacatggagaaaccctgtctctactaaaaaataccaagaaaaaaaaaaaggctgttggaaacagtgcggcttgttgagtacaatttcttctttttacggagataagtcccagccctctgccctttccccagtaactcgcacatctcagtgaagagagtaaatggt

SEQ ID NO: 184021 - DNA, 400 bp, Homo sapiens
cacacacgcacacacacacacacacacagagagagagagagagagagagagctctacatttgcaaagataagtcctactctaaacactccatgcagaaaagacatttcagttcctgccaatattctggaggtacttacagcataagtggactgagctagggagtctttcattgcttcttcaacaccttttgtaacaactattttagcaatgtcaagttacagcaaggttaagaacactactttgaattaaacgactgagattaggaataagtaggtttccttttacaaataatcaaatacataactagtgttaacaaccaaatataatatctccccaagactcttaaggtttaaaataaatgaatctttaagatcattacttagctaattaacactaacc

SEQ ID NO: 184022 - DNA, 557 bp, Homo sapiens
tcccagcctcctgaccatgacacacacacctttcagctggttttttttggcggggtgaatgactctgggaaagtatttcattggaaagtgattattctcctccagaaatctgttcacaagtgtcttcttgtgaatatcatgtgtatctatctgtcttgtttagtgctttgcaaagaattatccagaagggatgcattcatatagtattaatataagtgaagaaggacttgaccaaattttaaaaaatatcttgttagaacaataaatatgtagcatattttctaggtaactgatacatttattcttctatcccaatgaagtttggtttattcttttctctggtcattgataatgaagtggatcagaaatataggctgggaagcacattcaacaggtaatgaggactgccataaagtttaattaattattgttaggctactcagtgattgggaatgaggcactttttttattccctcttgtttaagatctcaacagagaaatgagcgcataacccaaaacatagaaaagttaaaattttgtaaatgaaaagaattgtg

SEQ ID NO: 184023 - DNA, 449 bp, Homo sapiens
gagactgcttggcccggagcgccgcggcgggtggtggcgctcacactaactatagctatccagggcgcgggtcgagtggcgagaccagctcccctgggtatgagaacgcatctttgtgcggtcggctggctggggcctgaagagcttcctcctgtgtgttcaactgaacgcagcaaaagtcttgggcagattccatggagcagctgtggaagcactgtgcagggaatcgaagaaggaaacacctccagcgaccacaaaacaaaattgaagaactataaaacaatataggccgggcgtggtggctcacgtatgtaattctcagcgctttgggaggccgaagcgggaggatccctcgaagccaggagttggaggatcccatgttgccagactgggcaacatagcaagaccccatctctaaaaaataaaaataaaaaaatttaacaattagt

SEQ ID NO: 184024 - DNA, 667 bp, Homo sapiens
atgttttcaagaattctttaaataattgcgcttatgttttcaattgtgatgaactcagttgattctttgacttggcttggcagaaacctgattaggaagtatagttcacttcctggagggtggctcacatggtcaaagcttttgtttttaatgtctcactaaactgggcagactttttttttcttttgccaagacagtaggaaagctcttataagagatgcctctaagcacaaatcactgggaaatagaacttacatgaattatttttagtgtcctgtattcaaagctcaggattcttattacttcaatttgttctttggaattttatttatgtatttttaatttcttttgagatagggtcttgctctgtttgcccaggctggagtgcagtggctcaatcatggctcactgcagttttgacctccccggctcaagtgatcctcctacctcagccttccaagtagttgggactacaggaatttgccaccacacccagctaattatttaaaaaattttttgtggatactgggtctcactatgttgtccaaactggtcttgaactcctgggctcaagctatcctcccaccttggcctcctaaagtactgagattacaggcgtgaaccaccatgcccagtctatttatttatttatataatttaaaacatt

SEQ ID NO: 184025 - DNA, 215 bp, Homo sapiens
gacatatttgtttcccctttcattatgattgtaaatctcctgaggcctttccagccatgctgaattgtgagtcaaattaacctctttcctttgtaatttacctagccttgggtacatccctacaaaaatgtgagaatggactaatagacacagtaacttaataacaaaggtattattattcttaatttacaaagaaaaaaaacagagctagagag

SEQ ID NO: 184026 - DNA, 239 bp, Homo sapiens
  misc_feature (17)..(17): n is a, c, g, or t
  misc_feature (19)..(19): n is a, c, g, or t
gggtgatctgaggatcncngatgtatccccaacacaaacaaacaacaaactattcaaacgtaagctctagatttattttctaccatgatttatggttggttaagaggcattttgaggggaaagatctctttccagagacctagaaatctatatgaagaatggtttcctgtttgggaactatatatagaaaaagttttgattagtacatttttaaatttaggtgttgggcgataacatgc

SEQ ID NO: 184027 - DNA, 363 bp, Homo sapiens
tacagaatgaatgtgtgagactcttttaaatcagtatgtagtcttagctatgcagatttataactacagagtgaaaaaaactattatctagaaattagcttaaagaactaagagtgaaagaaattgaacatcttaatttagccttacctagaccctgtggaaacccacggccacagtatacataaaggtcctccaaaataatggacagaccattcctttttcacaaaggtcctactaaacaagcaggcaccacgtgggcctatgcttgtaatttaatcctatacaggaaggcacggtgttctgtctcacaggtctgacatacttcacccttttgatagaaatacctcacactgggataaccca

SEQ ID NO: 184028 - DNA, 349 bp, Homo sapiens
gatcttcagtcctacattggataagaagttggtttcaggtttaactcaggttagatgtggagggtacctgtgttcccaataatgtttgcaattttctccttatttcactaatattagtgccatcagcttaagtgatacatacacacgcagccctatatgagctcctggcagaaaatccttgccaaaactgtgctgacacactttcaacaggtgtgcagcacagagaccattacggaaggatttatgttcattaggtgtgatttgaagtattgctaataagttgtatttcctgcttttgcacaataagcctaaatgctgctttctgttttaaataaaaactacatatttt

SEQ ID NO: 184029 - DNA, 219 bp, Homo sapiens
gagacaaccccagaacatcctgcgcccagcgggacaatcccagagcctcctctcccagtagagctacacgagacaaccccacaacatcctgtgcccagcgggacaatcccagagcctccagaacctcctctcccaatagagccacacgagacaaccccagaacatcctgtgcccagcgggacaatcccagagcctcctctcccagtagagctacacgag

SEQ ID NO: 184030 - DNA, 372 bp, Homo sapiens
ggctgtcagaggttcccgaatctcgacaagatgtttatacttaacactactatactgtatatgtaaaaatgattaagataaatgttatgtgttttttaccacaataaaaaaggaatacaatatcaaacagattcaccttgaaaatattatgctaaatgaaaagagtgagacataagagatcgtatgtcatcatgctttcatttctacgaaatgacctgaacaaatatatctatacagcaagagagtagactgctggttgtcaaggactaacgtgggagaagggaaagtgactgctaacaggtatgggtttatttttaaagtgatgaaaacatttggaaattaacagtgatggctgcacaactggtcgagatt

SEQ ID NO: 184031 - DNA, 183 bp, Homo sapiens
cactctataacctgcttttaggtggcactaagaaactttctcatccaaacaaattcagataagattttcctgctttagtatcagtgagatcacagacacatgcttttgccgagctgatagctttgtcttatactatatgcagaagtttaaaagcatccatctaacagctagcgtcgttgtgta

SEQ ID NO: 184032 - DNA, 351 bp, Homo sapiens
tgcaagctttaaataaatcatagaggcttctgcttctgggaggactcaggaagcctcccaatcataccagaaaccaagcaggaatgggatgttttatatggcagaagtagaaacaaaacagagagaggaaaaaggtgccacacgttgtataaccctgttatacaaccagatttcctgataactcactatcacaaggtcagtatcaagaagatgttgcctaaccattggtgaaagttctgccccctaccacccacacccctcactgcttccaggcagaagcctgaggcagaggcagagccactaggaaaacctctaatagggcagagcagaaaaagtatatgggcttggagg

SEQ ID NO: 184033 - DNA, 851 bp, Homo sapiens
gggacggcgggacccttacagcccaaagaaccctgaggagcagccccctttcgcacgtggaggggccgggggcttgcagagtgtgacgcgtggtgttggtgaggaggcacgtgctgtgcagccgtggcccagggcagggcgaggctgacgcgggaaccagggagactgggattggtgatgtctctgcagctggatcgtcgaggacccggctattgctctgtgttaagcggcctcctgggggcacggctgcgtgttttagcttaagtgcacaagggttcactggacagctcagtaggctgggctctgcggggacgtggccaccatgttcaccgtgggaggtcctgctcctcacccgacggatgcctctggcaccaaaccctcccaccagccaggcctgccgcgcaaagcctcccaggcaggagctgagttaggttttcagccagggcccagaggccctgaaaagcccgggcagttacgaaacagcatttacgtaaaggattgattcaattacacagggcaggaagcatcagccaagtgggtgaaacccaaaattccaccccgtcgagaggctccctgagcctgggctgaccaagagccacgagctcagatggagcaggttctgtgtccaaatgtggagcccagccaagctcctgcacgcctgaggctttccagatgggcaagcacagtcacagtgccgtggtcttgagcagctgcaggagatccgagtggcttcccctcaggatccagagccgccctccccagccttcctgatgcagggaagagaaggcaaggagcttctgggaactcgcctgacccgggtgctctgctcggacatccaggaaaatgcaacg

SEQ ID NO: 184034 - DNA, 408 bp, Homo sapiens
ggaattcttttgtacatacattcaggttaggccagttcagctcccacccctgctggtggaatttagatcccgtgatgtgagtgtggtgttttcttctcctaccctctccccaccatcaatctatattttatcacttgcaaaggtggttgtaaactaagacaaaatgaccaaatatcacacattcagatttatgctaatgaaatgtttagatataatcttaccctttttttcttgtgaaatgattgatttctgagccttgggggtctggttccattgaaatacagcaggaccctcatatccttttggagagaatgaagatgaacccttgcagaatagaacatccttaaaattggtagctaaggccagggtttttatgtgttttagagcaaagtttcgcaaattgcttgc

SEQ ID NO: 184035 - DNA, 310 bp, Homo sapiens
aagatggggctagaaggtaaagaatcatcctttaggaaatgtggaacaatccaagaattttaagcaaaagaaagatgtgatcatattcacacttctgaaaggcaactgtggcagacaggcctggcagaagataactttagcagaaacatctaggagaaaacagactggggggctggagtaagagaggacaaagaagcacaaagaagctaccagacaggcccagggttgggaagccggcttctgcttccagccctcagcactggcaagaatcctcgcaacagaaagcagcactgggccattctctgcctag

SEQ ID NO: 184036 - DNA, 185 bp, Homo sapiens
gaggcatgaccacggtggggaaccggaggcagggatatggccaagacgggcctgggaatcccgggaatccgagaccctcctggcatcttgctggagacactaagctgcgttgctggggaaactgcctccggggcagcccgcccctcatgaatgattcatcagcagcgctggtcgctcccccaccg

SEQ ID NO: 184037 - DNA, 599 bp, Homo sapiens
tagcagcgtcatttagagccataggatcggatgagcccactccaggagaatgagtgtggataggcatagaagaggactcagaaccaaggctggcacatgccggtgttcaggggctgccagagatgacagaaacggacactgagtttgagcatttagggagggcagaggaaacatggagagccaagtggaaggtgttgcaggaaggtggttgtggtcactgttactgaaggatactgaagggtcagtggaatgaggacagggcagcagccatgaagtggaacatggtgtagggaggcgcttggctccagagacacactgtctgcctacatcactcaacaggtttgtaattgtcctagtccatttgtgctactataacagaataccttagactgagtaatttttaagcaacagatttattgctcacagttctagaggctgggaaatccaagatcaaagcaccagcagattcagtgtctggcaggggcttgctctctgttcccaagatggcaccttgttgccgtgtcctcacttggcagcaggaggaggagcccagcaggaggaggattgcccaggaggagagaatgggatctctagacacc

SEQ ID NO: 184038 - DNA, 614 bp, Homo sapiens
atagaaaacagactgacaaaaatgaacagagccttggagatatgtggaacaaagcatctgtcatgtcattggggtcatagaaagaagaaagaggatggagttgaagaaaatttaaggaagaagggctgacaatttcccaaatttgaccaaaaaaaaaaaaatcaaaatgctgagtaaccaccaaagaagataagcccaaagaaatacatgccaagatttatcatggttaaactgaaaattaaaggcaaagacatggtccctgaggctagccagagcagaatgacaccttacccctagggccaaagcaattatgagtggtagcaggtttctcagtggaaaccaccgaggccagaaataagtgacacaaatgctgaaagaaaactgttaattcagaattctatatccagcaaaaatgtccttcaagaatgaagtggaaatcaagacattctcagatgaaggcaaattatgagaaatgtaaatgagcagacctctaacgacagttaacaggaaacaaaggaatcttgtggcatcaagcaggaagacagaacatagaatgaaaatatcaataaatgcaataggcttacctttaccttgtaagtattctaaattatgtc

SEQ ID NO: 184039 - DNA, 444 bp, Homo sapiens
atagaaaacagactgacaaaaatgaacagagccttggagatatgtggaacaaagcatctgtcatgtcattggggtcatagaaagaagaaagaggatggagttgaagaaaatttaaggaagaagggctgacaatttcccaaatttgaccaaaaaaaaaaaaatcaaaatgctgagtaaccaccaaagaagataagcccaaagaaatacatgccaagatttatcatggttaaactgaaaattaaaggcaaagacatggtccctgaggctagccagagcagaatgacaccttacccctagggccaaagcaattatgagtggtagcaggtttctcagtggaaaccaccgaggccagaaataagtgacgttcctcatcccagtgacgttcctcatcccagtgacgttcctcatacccagtgacgttcctatcccagtgacgttaaatcc

SEQ ID NO: 184040 - DNA, 494 bp, Homo sapiens
atcctagggaagaagtgcacttcacagggattcagtacaggtgtagagaattccctgatagagaattggaacacatcaagagtttgcaaattgaaaaggtacttttatgtacttatccatggtggacaacctgtgtcctagggaagaagcgcatttcacagggattcagcacaggtgtagagaattccctgatagggaactggaacacatcaagattttgcaatctgaacaggtacttttatgtacttatccatggttgacaacctactgtgctagacatttgctgtagtaactccttgattttttcctcggttgtttataaaattaaacatttgaagtagcctattgaaaagtcttaaaagaagcatctcctctattcctttagaatacagtatattaaacaagtgataaagtccaaagaaaaatccttattcttttcttgctttaaaaaatgcactttattttattaagcattatatctatcttttaaaact

SEQ ID NO: 184041 - DNA, 216 bp, Homo sapiens
accttggaagttgaggaaacagcagaagcaagaggccacttgaaccttcccctcctcacattcctccctgaaacaggccataagacctaggttactgtgtaaccttctccctcccttctcccttgaagaatgtaatgtgacaggtgtcttgccctataccgggggcaaggaatgtcacacagggacaagaagaagaatctgaaaaaacagacattg

SEQ ID NO: 184042 - DNA, 563 bp, Homo sapiens
atatctatgatgaggactgaaaggcatcagcaatgggtcagctatcgcagagaagggaaggagggaaaggagcaaggatgacttccaaaagggtcaacaaaggagtgacagtgaaatggtgacaaatactgagaatttttaaagaggattttttttaaaaattgggaaagtgtgctatgacaaagtcaagggaggctcatttcaagaaggaaaatgtagctaaaagcctcaccattgtagagatggagtgagatgaaaactgtagactccactgaacacagttgtgaggatgtcagtctactgggaggtggaaacatttaggtttgggggaggcagcagagggagaaaggttaagggagaacagatgagattcttctttgaacagctcatcatgaaggagagcatggtggttcagcctctcttcaatgactttctcatgtctaccagcattttgtttcactgattttctctattgcttatctgtttttggtttcattggtttctgcttttatttgcttgctttgggtttactttgctttcctactgcacttgacaagtcttaa

SEQ ID NO: 184043 - DNA, 201 bp, Homo sapiens
tctcggagtttgagaccagcctaggcaacatagtgagaccccattcctccaaaaacatttttaaaacatagccaagcatggtggcatgcacatgtagtctcagctactcaagacgctgaggtgcggggattgctgggcatagcagtttgaggctgcaatgagctgtgatcatacccctgcactccagcctgggtgacagag

SEQ ID NO: 184044 - DNA, 332 bp, Homo sapiens
tcagaatcatggtcttggtgtggccagaagctccagggagagttatgtgcattttccagcttctagtgggtgtcctcaccttggctccaggtcaccttgttccatctttcaagccaacaatgtagcatttttcagtctctctctgactctgacctttctgcctccctcttataataacttttgtggctatactgggtccaagcaatcaattcaagataatctttcatctcaaggtctatacccttaatgcaaaataccttttctcatgtaaggcaacatagtcataggttatgaggattatgatgtggacatctttggtggggccattattc

SEQ ID NO: 184045 - DNA, 190 bp, Homo sapiens
ctgatgggatcattggtccgagagaaattagctcatcagttattgaagaagggggaaagttaatgaccacaagagggcttgcagtgaccctaaggcaactttcagagctattctgcaagaagatatttttatttcccaaaccaaggggtaatttccactgggcttttctttttttttttttttttggggt

SEQ ID NO: 184046 - DNA, 560 bp, Homo sapiens
atatgtctatcatgagtttatccttaaaccacctgaaatgtgatcttccctttttatttttttgagacaagagtgttactgtcccccaggctgaaatgcaggagtgcgatctcggctcactgcaacctctgcctctcgggttcaagtgattctcctctttgcctcttgagtagctgggattacaggtgcatgccaccatgcctggctctctcttttttttttttttttttttttgacagcaaggtgttagatggggtttggctgcagttggcagacatgaggctccccaggcctgccagacccaaagccaccgaactgacccctctcgcagtctcaggagagcagtgttcagtttccccagatgcagaatgggaacgtcccatcagctcacgggttctccaggctggcgtgttggtgtcctgggccgggggctgggagcaatgccctgtcgtcccagaatgggaaggaccagcagtggcttctacaggctgtttctgtttccttgagcgtgttgtgtttttgccaatgagggcccgggacagcacccatggacataccct

SEQ ID NO: 184047 - DNA, 351 bp, Homo sapiens
cgtgtggtgaaaggatattttggatatattcagttaaaatgtattattacaattaatttccctgttttttttacctttttaaaaaagatgtggctaccagaaaattaaaaatgacaaatatggcttgtattatgtttcaattggaagtgctgttctaaatgatctggaagaagagtcatcctggctgaggtgacagaggggtgtcgcagtcccagttcgggataactggaacccacattaaacaactcagagaatcagcagaggtcatctgaggcctggctctgagtgcagattcagtgggaccttattttaggccagggaaaggggcctgatggtttaggttgagggatc

SEQ ID NO: 184048 - DNA, 893 bp, Homo sapiens
ttgaggactcccgaggtcctgaagcactggggttcataacctgggaagaagatagaggaaaaagtaaactcttgagagctcactcagtgcccacagtttcacgttcaccttcagagcggcccctggggaaacagtaacggatggtaatgagacagggctcagagtgcatgttaaactttctaagctcagctctgcccaggggagctttccgacctgcagagccttctttccaccctatcccacgccaccttccacaggagaggccccacactcacccgttccacagacaaaagaaacgcacacctgccccaaggaggggacttaactaggacaacaggattcaatgtttaccaggctaacaagaaaaatgccgaacaagccaggaaccaataactaagtgtcaaacagacctgcaaggcccaatgtggcttgcttcacaggaagaggcacacaagcacctcttagaacccctgcattgaaacactcccacaaattcccccaggatgcagacgggagatgccctgcagtcactcctggcctccagaactgggaggggctcaagctctggcccagtgcgaaggcaagaggcctctattcctggctacgagaatcaatagaaactcatggacttctagagagccttgccaaagatctcgaaactcaggaaccacgtagggagccctactgttcaccactgtatgttgccctctgggcttggcagaaatgtacctaagtgcaataccaaggggcaaataagaagccaaactgtggaaaatgaacaggggagcagcggcagttcttggagttggggaaaagagagaaaacgtgttttttaacatgaaaatgtttgtctagaattgagaatgcaaagaaatgcccagaaagcactggcg

SEQ ID NO: 184049 - DNA, 894 bp, Homo sapiens
  misc_feature (58)..(58): n is a, c, g, or t
gaggagatttttaaagattatctggtcaggtacagagtggctcacacctgtaatcccnatactttgggaagctgaggcaggcggatcacctgaggtcagaagttcaagaccagcctggccaatatggggaaacagtaacggatggtaatgagacagggctcagagtgcatgttaaactttctaagctcagctctgcccaggggagctttccgacctgcagagccttctttccaccctatcccacgccaccttccacaggagaggccccacactcacccgttccacagacaaaagaaacgcacacctgccccaaggaggggacttaactaggacaacaggattcaatgtttaccaggctaacaagaaaaatgccgaacaagccaggaaccaataactaagtgtcaaacagacctgcaaggcccaatgtggcttgcttcacaggaagaggcacacaagcacctcttagaacccctgcattgaaacactcccacaaattcccccaggatgcagacgggagatgccctgcagtcactcctggcctccagaactgggaggggctcaagctctggcccagtgcgaaggcaagaggcctctattcctggctacgagaatcaatagaaactcatggacttctagagagccttgccaaagatctcgaaactcaggaaccacgtagggagccctactgttcaccactgtatgttgccctctgggcttggcagaaatgtacctaagtgcaataccaaggggcaaataagaagccaaactgtggaaaatgaacaggggagcagcggcagttcttggagttggggaaaagagagaaaacgtgttttttaacatgaaaatgtttgtctagaattgagaatgcaaagaaatgcccagaaagcactggcg

SEQ ID NO: 184050 - DNA, 568 bp, Homo sapiens
aaaaaatacaaatataaaagagccaaaacaaaaaatggggtttgtacttatacattatatttttccttttatgaggtcgcctggtcacagcatgaactgaagaatgtaacatcgggtgctcccatcatgctttctgtcctgataatgtttgctgtacatctctgcttaggcactcacgtctcataattattccaaaatataatgttttgcttaaaaaaaatgctcatttcacgtaaaaaaatcccccaaatatgctgcaaatgttactgtccatctgtgcatatttgcaggtgtcaaacaactggtgagtgctgacaatgcattattatgtacctagatgattcagggataatttattagtaatatttccccaatttatgattatctaaagtatgcacttacaaatgtgcaataccatttcagccattaatggcaaagttagccaaataaatgatcatttatcaaaacccagaaaccgacacaggcacaatctacttaacatttcaaaattaagttaccactaatagaagcactacaatttttccactggattataatgggaaatcat

SEQ ID NO: 184051 - DNA, 362 bp, Homo sapiens
tcaaatcgccataaacaaaacctaacaaacattccactaggcctaaagagtatacattcgcatttttttttcttaaagtctctcagaagtttcaccatacttatttccaatttgctaataaaactcattaaaaagaggttcagtatccaattctggcattctggaagtattacttcagcttaataaacacatgcaacacacatgctgatgttctaattcactataaaatttaattccgagggcagcttagaaaattaagcttagaacacagggacctgctgagaatgaggacaaaaatggtggatttactcttgagacaaagggtgtcttcctaacattttcatcatctttatgacaccgtg

SEQ ID NO: 184052 - DNA, 382 bp, Homo sapiens
gtcattggagccggcccgttgctgaactccgagtcatccatcagggacaagattaagaacacaattatttctgactgacagggaccaaatctgctagaatttttttttaaacaattcggggggaaaaaacccacaatatcatcatcttaaggtgtctcccaagagactgggaaccagattaatacgcttttaatgaagtagagatcattatgtatgaaggggaaaaaaaagaaaagaggtactattcaagctatttagttatggtggtggctagaaattaaaaaaaaatgcagacggcatatctttttcgacagctgtccagattttattcatactgttctaaagaaaaagacgacttttttttttttctgaaatcttttct

SEQ ID NO: 184053 - DNA, 581 bp, Homo sapiens
gtatctcactgttgttttgatttacaattccctggtagttagtgatgttgaacatcttttcatgtgcttattaaccatttgtgtatcttctttggagaaatgtatgtttagatccttcgtctactttttaattggatgtttcatcttttatgagagttgtgagttctttatatgctctagatacaagtcccttttcagacaagtgatctccaggtgtttccttctgttccatgggttgtcttttcactttcttgatagtgtcttttgaatcacaaaagttttaaactttgaagaagcacaacttacctgtttttttcttttgactcttgtgcttttagtgtgataacctcagaaatcattgcctaacctgaaatctcaaagctttactcctgtgttttcttctaagaattttatagttttagttataaaactagcatttaggtctgtggctcatttcattattttttatatatggtgtgggatagggaccattattttatctaatagtatttatctttttttgattatggaagcaatacatgcttattgtagaaaacctagataaagcagaaaaacataaa

SEQ ID NO: 184054 - DNA, 746 bp, Homo sapiens
gagggctttcattatactcttccaagtcctcaatactctaaaacaaaaagtctagttcactgacaaaccatcactttacatctcaggttttaaacagggtaaattagatgtcaaaggaaacagcttttaatattcaaaggatgctggttatttatttcaaatttaaaaactgtaatcaatacatggagctccaaatacttaaattttttaattccagatttcagtgaaatattattatagcaggtccaacagtcatgtagtttgcttgaataaaatggcttgatgaacatgttacagacaagatggaccaaagacagaaaaagactgtcagtcttatatcatggaataccatattttttcaccaggtagtgaccatttgttatcactaatagtccacataacgtggttttcattgaagggataaaatggtctgtgatatgacctaatcaagttggggaaaacataactacgtatgaaacatatactagtccctcaacaaatagttcagcagttcatagtccctaaaatgttgtatgttaatactgaggaagacgtaaaaaatgagtacacaatctcttccgtattcctgtgacatgagcaaatgcacgaataaaaaaaaaagtaatacaaaacttgtgttactgctatggaagagcaactcactcggacatgtagccaaaaatggagactgatgtcgacttagttggcacaagatttcaatcagtcaaaaaaaaaaaaagaaaaaa

SEQ ID NO: 184055 - DNA, 479 bp, Homo sapiens
ctctgaaagccagaatttcaagaccatactctcttctgtgaattaaaaataattacatatatatatatgtacttgtaaacacaaacatatagatacatacaattatatacatacagttatacggggtttcaccatgttggccaggctggtctcgaactcctgacctcgtgatccacccgcctcggcctcccgaagtgctgggattacagatgtgagccactgcacccagcaggcagttctcaaaaaactatacatatatttatatatagactttgttctcatctttatccttttcgcccttaataagaagtagcaaggactcaataggtggaagaacacagagcaagaagaaactcccgggaaagaaaactttattttttctcaaactattaccttgccacctaaattgtactatattttatcttgttacatgatgagacttccctttgtgaaatgttgagaataggcatcatatctta

SEQ ID NO: 184056 - DNA, 302 bp, Homo sapiens
catgaactcgttgcctaagccaacatctagaagagtttttttgatgttatcttctagaatttttatggtttctggtcttatatttaagtctttgatgcaaattcacattgaatttgtgagttgatttttgtataaggtgagaaataaggatcgagtttcattctcctacatgtggcttgccagttatcccagcaccatttgttgaataaggtgtcctttcccccactttatgtttttgtttgctttgtcgaagatcacttggctataagtatttggctttatttctgggctctctattctgt

SEQ ID NO: 184057 - DNA, 720 bp, Homo sapiens
gtgatctgcccgcgtcggcctcccaaaatgctgggattacaggtgtgagtcactgcagccggccaagattcaaattttttagaaacaattacatgcctacattcaacttcagtctgggagcagtggctcacgcctataatcccagcactttgggaggccgaggcaggtgaatcacctgaggtcaggagttcgagaccagcctggccaacatggtgaaaccctgactctactaaaagtgcaaaaaaagactgggcatggtggctcacgcctgtaatcctagcactttgggaggccaaggcgggcagatcatctgaggtcaggagttcaagaccagtctggtcaacatgacgaaaccccgtctctactaaaaatacaaaaattagccaggtgtggtggcgggcacctataatcccagctacttgggaggctgaggcaggagaatcacttgaacccgggaggcagaggttgcagtgagcccagatcacgccactgcactccaggctgggtgacagagtgagactctatctcaaaaaataaataaataaaataaataaataataaaaatgcaaaaattagctgggcagggtggtacatgcctgtagtcccaattactcaggaggctgaggcaggagaatcacttgaacctgggaggtggaggttgtagtgagccgagatatgccactgcactccagcctgggccacagagtgggactccgtctc

SEQ ID NO: 184058 - DNA, 421 bp, Homo sapiens
ttggaggacacctagctggtatccactgcagaattgcttgcttgcttgcttgctggtggggagaaatccccgcatatttaaagttggagaactttttttgagacagggtcttgctgtcacccaggctggagtacagtggtgcgatcatggctcactgcagccttgatctcacagggtgaagcaatcctcctgcctcagcctcccgactacaggcgtgtgccatcacacctggctatttttggtagagacgaggtttcaccatgttgcccagtcttggagaacactttaaaatgttactgcccagaacaaaggggaggtagaagagtctaacctgctcatctttagagccttcttcagaaagaaacccactcctctctgggtcttcatctgttttaagattttgttttttaaggaggtctcg

SEQ ID NO: 184059 - DNA, 486 bp, Homo sapiens
taagaatctaatgcctgatgatctgaggtggagcagtttcatcccgaaaccatcccccaccccctcatccatggaaaaactgtcttccatgaaaccggtccctggtgccaaaaaggctggggactgctgttatggagtaccaatggcccaaataacatacattgtgcccataagtaatttctcatcatctaccctctttgcaccccgccatcctttcaagtcttcgttgtctatcgttccacactctacagccatgagtacacattatttagctccgacttagaagtgagcacttgcaatacttgtctttctgtgtctgacttaagataacggcgtccagttccatctaggttgctgcagaagacatgatttcattcatttgcacaactgaatactattccattgtgtatatatatcacatttcctttatccagtcatctgttgatagacaccgaggtggattctgtatcgttgctactgtgaatc

SEQ ID NO: 184060 - DNA, 352 bp, Homo sapiens
tccagtcacctccaaaagttcccacctctcaacactgttgcattggggattaagtgtccagcacaagaactttgggagaacacattcaaaccatatcaccacatttgctgatgttcttcctaccttcacagccactcccaatagaaattccaactccacaaagacttccagtgacagttgaatttggagggttgagaccagctcatgacccagaaaggaaaacagaaagcttactttttgttttgttacaagtgcagtctcttaaaaataaccacaaaatgcccccccaaatggcatatggaaaacagcacagagatggtgtgttaatctacctgaaatgtctttctaagga

SEQ ID NO: 184061 - DNA, 315 bp, Homo sapiens
tgaaaattttttccagtttggtaaatttatctgtttcatggtttctgccatagagaaatttagggatttttatgtagctgaattgttaccaatctattctttcatggttcttggttactattatcacagactgtcattccccatgcagtttgtagaataattttccagtgatttcttcaaatatttttatgttttcagttttacctttcaatatttagagtctgtactttttttcctagatatatatccactagtcccaacacaaattgaataacctatcttttctcactgattggaaatgctacctttatcata

SEQ ID NO: 184062 - DNA, 171 bp, Homo sapiens
atataacttttgctaacagtgggggagagcggggagggttgatgatccccaccctcagaaataaaacctcaacaaggacttccagtaactttatgtaaaagactcaaaaagatacagaagaagccgcttcgcagtaagaagccgcttcgcagtaagaagccgcttcgcagt

SEQ ID NO: 184063 - DNA, 202 bp, Homo sapiens
gttaccacccccacccaccctcggccaggtgcccttcagagtgtggcctccagcggagcggcggtagaacctgcgcagctgctgctttccagcgtgtcgcccagacagggcaccccttccctttccctcagccccgcaacagtgaaatggacataattcccccgtccaggattatggggattaaattagaagtcaacttcta

SEQ ID NO: 184064 - DNA, 291 bp, Homo sapiens
ctcctgcagctcggcctcctcaacctgattggaaagtacagccagcacccagactcagggatgagtgacagcgtcaaggacaaattttccatcgcgttttccatcgtgggcatgtttgcctcccatgcggtggggagcctcagcgtgttcttctgtgcggagatcaccccgacggtgataaggtgtggcgggctggggctggtgctggccagcgcgggcttcggcatgctgacggcacccatcatcgagctgcacaaccagaaaggctacttcctgcaccacatcatcttt

SEQ ID NO: 184065 - DNA, 608 bp, Homo sapiens
agctccataaatcagggcacacctctgattcatattggtatccccagcacaatgcctgcatatagcggtagtcagtaaacgattgctgaaattccctgaccactttgaaaaagaaatctattaatacattacagagaacttcacagaaacttaacaaggctttgcacatagtatgtgcttaataaagggctgctgactctgaatgtagtaaaaatggtacatctcttaggtcaagtctatatatagcaattcttgctagtcccttcatgccacaatagtaggtaccaactctacacagacagacatccctgtgatgtttcaggcactgaatattacacttgccttaaaccatccacccctgccagcttaccaggtggcacaaatgtctcactattagtcacttcttggggttaaggcattagctacagaagtgccctactggactgctttcagatggaggaaaaaatacaccagaagccacctgaaagacttcacatctttcagaggacctggagatcattcatgcccctctccttccaactaaaatctgtactccagagagaactcagaacacaggaaaggatcccaaagagtcagtgttgagcaca

SEQ ID NO: 184066 - DNA, 277 bp, Homo sapiens
attcgctccttactcagcagtgcagatggcaaagccggtgccagcacagatgtcttttgggatcaaagacaagcttagcagagtcacataattcgagacaagagatgtgggaaggagtagtagtcattactctccatctctcagctctgattccagtgaccccaaatcacctgtcccatcatagttgactacatgctaatccctacttcaccccctaactggatcttataattcagccaagatctggctgtctaaaacgtatctttgtgcacatgca

SEQ ID NO: 184067 - DNA, 650 bp, Homo sapiens
agagctagcctcaccaaaaataaaaaatctaaaaacaactcaaactatctttttattttttgagacggagttttgctcttgttgtccaggctgtagtgcaatagcgcaatctcggctcactgcaacctccgcctcccgggttcaaacgattcttctgcctcagcctcccaagttgctgggattataggcgcccgccaccacgcccagctacttttttgtatttttagtagagacagggtttcaccctgttagccaggctggtctcgaactgctgacctcaggtgatccacctgcctcggcctcccaaagtgctgggattatagacgtgagccaccgcacccagacaactcaaactgtcttaattattaaaatcttgaatatagctcttaaaaattttaagaattcactaacaagaatttgtcctgaaagcaattttccaagcagcaaatgggaatttactaatgcagctaagctgtagtggaacaagctctcaatctgaaaccagacactctgggttttagactaggtctgacagtggctatgtgacctgaaatgaatcaggatgtcttcacctgtaaaatgggaacaatacctatttatctcattcagttcctaggaagcttgaatgagaccacagaaactctctgaaa

SEQ ID NO: 184068 - DNA, 797 bp, Homo sapiens
ctaaagacaggctaagaaagagatcgccttaataagaatatttttcaggtagtagaagccaaactcttaacagatgggaaaatgaatgaaagttgaagcccagactgctgtctcacaagccctcatgcctccagggccaggtatggtggcgcatgcctttaatcccagctactcgggaggctaaggtgggaggatcacttgagaccaggagtttgagaccagcctgggcaacatagtgagaccccaatctctaaaaaaaattaatttaaaaataaaaagtagtacatccagtaagtgggaagaggagagatgcgaaacgctattttgtgtctctcctaagtggagaggagagaagctattggagagctggctccaagtgagcacccaccaaagagaagggccaactgatggagcaaactgctgaagaagaggggaagtgctggaaccccgagcccaagtagcagagtctgccaggaaaggcacacctgctccttcctcttcaacaacaggaaggaccagcacgcttatagatgtctgcacagaggagatcaggagacctgatggcctcggcattttctgggaagtgagggggaaagtctttctgtacatagcaccaatacctggtacacagcaagtgctgttatcatttactgaaggaatgaatcctggggctacagcataacccacaaggagcctagaatctggtccctgcccaagtcaccactccaagctgttgcctttctcccctatacctttcatcaatctgtcctcatctcagatggaaacatgagctacca

SEQ ID NO: 184069 - DNA, 134 bp, Homo sapiens
gacagggagaaggatgactcctggagtttcggctgagctaggtcaatgcaggtgctgttgtggataaggggcttgggcagttcaccttgggtgtaggttcaccctgagctggttcttccatgctttcctggtgc

SEQ ID NO: 184070 - DNA, 209 bp, Homo sapiens
cgttagacaatgttactctttctgagagatgttcatgtgagagatgttccatattttcaattcaaacaatcttgtaattgctggctgctgctgttgttcacagcacttggctttgcatctgtgcctcttacaattccagtcttgccctttgtttgaggaaacttcctggttcttgtatacctcctgctttcttggtctaaatgcaatca

SEQ ID NO: 184071 - DNA, 341 bp, Homo sapiens
atcaaacaaatgatccctgagcacctagaaagagaactggagaacactgcaaggtgtgtggatttataaaggacatcatcatctaacatttattaaggcctaactctgcgtcaggtgcctatacacatctggttgttggccttgtggatattatggtcagttctgactgtgtgtgcacttggcaacaatttggtttttttagtatgcttgctggattattagtaaccttgaggggagtgccaaatataaatatcatttatttaaatgtgagctgtgggggttttttgtagtttctcatcccattgggcaaaaagagaaattagagctagtatacttctgtg

SEQ ID NO: 184072 - DNA, 283 bp, Homo sapiens
cagatctccctgtcacagcagaccacagctaaatgaacttctctgggtctcagtttcctcatccaaaaatggggtctaggcggggcgcagtggctcacacctgtaatcccagcaatttgggaggccgagacaggcagatcacttgaggtcaggagttcgaggttagcctagccaacgtggtgaaaccttctctactaaaaatacaaaaaatcagccgggcgtgatggtgggtgcctgtaatcccagctactcgggaggctgaggcaggaggattgcttgaacc

SEQ ID NO: 184073 - DNA, 430 bp, Homo sapiens
tgttttataaggatataacagttagataaaacctgagctcatttccagtgcttacattctgagatttcatggcatttcagctttctaaagccttttttaaaattttgaaacattctaagcataaagtataatacaaagaacaatacaacattttaacattcaatttcatttctatctcaaaataactgagataagcaaaggcacagagagaaggcaaagaccattttctgagtgtctactaagtaccaggcatttcagaaccctctgaggtcagcgccatcagactcatctacagatgaaaacaccccgaggcttagggagactgtcagtggtgcagggtcacaacattaggaagcatcagagctgggattctaaccctacatctgttagattctgaaacactgagttcttcccagcagtactactctgc

SEQ ID NO: 184074 - DNA, 430 bp, Homo sapiens
gggggttgacagagaaagcaaagtgtaagtttggaagaaggcatgtgcggtggtggcgagtgctgcgggctatggaaggtgacttggcttttcagttaggggtagtggagaaaggggtagttgcttgtaaacgagttaaaagcattcagtgtggaggtgttaaacccattttaggatcgcttggtttcctggtgggtagaatatgggaacagagccagaggcaggagctaaaccaaaaggagggacccatgaactctgcagctgaccaatcagagaatcaggcaggtgtagcctactgacctgggcagaggtgggcctcacgcagctggatccgaccctttaattctgcccttttggagtggaaggtctgattggtgtagctgctctgcataggcaggacagtgacagttcactaactcttgttaagtta

SEQ ID NO: 184075 - DNA, 927 bp, Homo sapiens
tgctgcaggtgactccaaggattcgattgcattgtcttccaaatgacacttgtttacatgattgaagctgaaacaagaaggcagcgtgtcaccttgtccagcgtcagctgggaatgtgtgttgggcaacttagaactttcactgctctgtgcatgtttgagaaagcaggaaagcaccatgcatattgattttggggttacacgtaaatttctgcaagttaggtgaatttgcaaatacagaatctgtaaacagtaaggtttgactctattaatgtcaataataaaacataatgagaaaaatatgagatattgcaatacacagaattcaaatagggcaatgggaaggtgcctggggcgggtgctacagattgggaggtcagctgaggtgtctctgaagaggtttcatctaaactgagatctggattacaaggaggagcctgtcctgtgaagatcagggggaagggcatttgaggtgggagtgagtacaggcagggcaaaggctccaagacagaatgagtttggtgtgaggaaacccaaagagaccactgtggctgccagaaatggagagctttggaggcaagtacaggcctggtcactagggccttgtcggctggagtgggggtaaggatttgtgctcagtgagtgattcttgctatatttctccgtaaatgttgcggcatttttttcattttccctgccacacttcctaagtggaggtgttgctttttacttctttgctcttttttggtgtcctagacacagtagcccctatatgtgctgagtgacaccaagctttcggcttctggtgctgtaacctttccttccttctgtgaccattgtgaatgaggatggagtatgaatgggtgatatcatgagagagagtctgcattgtattgtattggtgtggtgggggtgctgaggggtaggg

SEQ ID NO: 184076 - DNA, 569 bp, Homo sapiens
ttggcccaaagtgctggcttataggcatgagccaccacacttagccacccatttacacatttccatttctgcttatatgccttcaggtcttggagaatctcctattcatatttcaacgtgcaacttaatttaaatcacaaaaacatgaaaaactgttctctcctctcgcatcttcccaccctgctgcctggactaagtgcaccataacagcttgtgcaagtctaccacaatgtattacgattctctctcccactagactatatgcagttaagctgagaccatgtttcattcattcatttttgaatctttaatgcttaacaagttgtctggtacatactatatatgcaataaatctttgaactaaatgtccttctctgcttcaaaaacatctcaggttctgcttaatgatttccaatgattagtcaatgtatcttttcagattttcatcagcagaaaagaaatgcctgattgaagatattttaggttgggttttttctttaaccctaaaaatctgaaagatacttatatacctaaataccaactatacactttcattgagtagtgagaat

SEQ ID NO: 184077 - DNA, 269 bp, Homo sapiens
ccacaacgcatagacttgccccatatttcacagctagctcccataattcccagacttgttacacaatactcggaaggccttacaacacctagaaaaagcagcatgataggtatgctcactctagaacattcagattcacttcataagggacaaactcagtcagttacattgaatacccaacaccatattgtttgctccacagaatatgagagagggcctacatgctcacacagagctttgacaagtgacttcatttctttctttctttc

SEQ ID NO: 184078 - DNA, 557 bp, Homo sapiens
ttcagcctccagagtagctaggattacaggcatgctacaccacacctggctaactttgtttctttggtagagacagggtttctccatgttcatcaggttgatctcccaacctcaggtgatctgcccgccttgacctcccaaagtgctgggattagaggcgtgagccaccatgtccggccattttaaaaatgtttaattttaatttctgtgggtacaaagttggtgtgtatatttatggggtacgttcttttattttctttttatagctatgcggtatggatgcaccataggttatttagccagtccctgatagatagacactgggtagtgtcctatcttttaggagacagtatttcagacagtaacctgggatatacattttttttctacacattctggtgtatctggaagatgaatttccataggtgagcctgctgggtccaggtatgtgcatttgtaattttggcagatattgccttccacaaagactgtgatccatttgcacatcagcgtttagagacagtcggttcccactgtcccagtggaggttttgagaa

SEQ ID NO: 184079 - DNA, 490 bp, Homo sapiens
ttcagcctccagagtagctaggattacaggcatgctacaccacacctggctaactttgtttctttggtagagacagggtttctccatgttcatcaggttgatctcccaacctcaggtgatctgcccgccttgacctcccaaagtgctgggattagaggcgtgagccaccatgtccggccattttaaaaatgtttaattttaatttctgtgggtacaaagttggtgtgtatatttatggggtacgttcttttattttctttttatagctatgcggtatggatgcaccataggttatttagccagtccctgatagatagacactgggtagtgtcctatcttttaggagacagtatttcagacagtaacctgggatatacattttttttctacacattctggtgtatctggaagatgaatttccataggtgagcctgctgggatgagaaaatagaggaacaagaatcatttgtagctttggggctccaggggt

SEQ ID NO: 184080 - DNA, 274 bp, Homo sapiens
taattagaccagaaaagttaactagactaaaagacaccatcttttacatctcttccagttagttagctttgggtggcttcatgggtaagctagagatagagataggtggttaccaaatacctttctgatgataccacagaatttaataccatcatggaaccccaatctattcacactaactagaaagaccaggagggggaaaaaaaagacatctgagctagagaaatttctcttaattgctaagagaatcaaaattgaaaatgcctttcaatta

SEQ ID NO: 184081 - DNA, 1320 bp, Homo sapiens
atacactagaaaatacagaacatttttgcagaaattatgtttgaattatttaatgtaccaggattctacattgcagttcaggaggtactagccttggaagtatcttggacatctcaacaagtgggtgaatatatgttaatgagtatagtcattgacaaaggagatggagtcacccttgttctcccagttgtagaaggttatgtaattgggagctgcatcaatcacatcctgattgtaggtgatactgtgtatttcattcaacaactactaagggagagggaggtaggaatccctcttgagcagtcactggagaccacaaaagccattaaggagaaatactgttacatttgccctgatatagtcaaggaatttgctaagtatgatgtggatccctggaagtggatcaaacagtacacaggtatcaatgtgatcaaccaggagaagttcataatagatgttggttacaaaaggttcctgcaacctgaaatatttttttacccagagtttgccaacccagactttatggaatccgtcttgaatgttgttgatgaatacaaaactgtcccattgatgtgcattgtccactgtataagaatgttgttctttcaaggggtttgaccatattcagggatttgaatctcaactacagagagatttgaagagtggtacatgccagattaaaactcagtaaggagctcagtggcaggagaatcaaacctaagcttacagagtttcgggtggtaatccatcacatgcagcactatgccttatggtttggaagcttaatgctagcctcaactctggagttatttcaggtctgtcacaccaagaaggactataaagaatatggccccagcatctgccaccagagccttctctttggagtaatgtcttagtgtctgccttgaaagcatcatttaatagtgtcatgttggggaacaagtgtccttcagaacccagagaagactaccatttctaaatgacatttggtgttgacgtctgagcagtatgcttgcatcacctagtgcatgaggcacagggcagagtcatttcagtaaaagcctgtctttatgtgttgactgctgtatgcccactcctccttctctcactccctttcttcatgcttccccggtttccctcctccttttaacttcaacttttttgttgacaaataccattctgaaggaattcaaatgtgactctgaaaattgttaagaggaaaaaaaattacaaaaatggcccaaaatagttctcccccaggaaagaatgcagtggtataaatccttttcccccagcctatttttataaataaaacgttat

SEQ ID NO: 184082 - DNA, 482 bp, Homo sapiens
caccggcctccatcagatgagggattgtggaaccctgccccagaattcaagcaggttttaaattctgaacttcatagggaataagtaatgcctataagactgaagtaaaaatcatttcttcaaattcctactaggataataccagtatccacgtttgctttgttcttagaggtacatgttcttatttgaaagaatgaaacctgaggtcaggagttcgagaccagcctgaccaacatggcgaaaccctgtctctactaaaaatacaaaaaattagccaagcatggtagcacgtgcctgtaatcccagctacttgggagggtgaggcaggagaatcacgaggtcaggagatcgagaccatcttggctaacacggtgaaaccctgtgtctactaaaaatacaaaaaaaattagccgggcgtggtggcgggcacctgtggtcccagctactcgggaggctgaggcagcagagtggtgtgaacccag

SEQ ID NO: 184083 - DNA, 384 bp, Homo sapiens
tattctttgaatttctggctaagtcttcctgtacaccccccatatttctttgaaactcctctcagtgcagttttctgcacgttccaacctgccaggtaatctatccatttccttattttcccaaagatgcttcccagggcactgtgtactgctcagatctgacctggtcattctccaggcctctgctgcaacctggcctattagaacttccctctgtctttgttctgtgagtgtcctcatacttttttctttgttggatcccttgtttcctggatcctatgtctgtctctttcttgatttaccccttcattttgctggaacacattctgtagtatcccctaagaaaagggtaagtgggtaggaactcttttgtcttaggatgtc

SEQ ID NO: 184084 - DNA, 529 bp, Homo sapiens
tgctgcggtcgtctcgaggtccctgggcgatcgccaacctttgtgcaattcagcggcacagcttcaactttggaattacatagcagtgccacggagaattttaaaataccacatcctgttactcaggtgtttcatattgccaatctggttcccattctggttctgtctaaagggtaaaaaaccttatgtgtttggttagttacctaaaccttcctggccagtaagctttcgaatctttccagctggggaggtatgttctgatgagcattaggacaacttcaaaccccaggagggctcactctcagcagctttcccaagcatttcagcatcttggctttgtctttaagaagagcaataattaaatcctcaggtcaaaagaatgaggaagagaaacacgcagagccttcaaaattatccagatgaaatatcagtggtagcaaacttaggtttatggacatatgagggtagagttagaaatgaagcagcataagagcctatgtcacagcaaagcctcctgcttggccaggag

SEQ ID NO: 184085 - DNA, 241 bp, Homo sapiens
gattctgcagacagggctgcacgtatgggctttgtttgacttctcttttctcagttaacatctcagagctagaacattccacattccccagcagcgtgtgggggctgactaaagtttacaattccaactaaaaatcaccctgcttctggcttatctgaatcccttacccaccccaccccaccaccccactcctatttattcagcaccgcactacccaggaaatacactagcaaattgtgaa

SEQ ID NO: 184086 - DNA, 326 bp, Homo sapiens
cacggccggaggatgtgcagaattcccactcccaggccccgcctttctcctgagcacctgtgcaaaccgcccactcccaccatctgtccccagagccctgcaggctcctcaaggtccaaattttcatgggtccaccaccaagctgctcctgccccagccttgcccactcagagcatgtcccaatcatccttctaggatctcggccaggagtcctctctgacccctccgccctgctcccccacatgaatcaatggccatctaaactccctttcccccactccttctgcccacgccttatctgccctgccactgcctggaaaacccta

SEQ ID NO: 184087 - DNA, 614 bp, Homo sapiens
actatttttcttggttctccatcgggagggcatatagtagcctatctgaatctctgcctatatttgtatgtggtctgaagatcaccagctgatttctcttcctattcctatgattgaaggactaattgtatcagattcccagatccaaatggttgacttcttgaggatattttgagcagcagcttctggttttgtaggaaccataaaaagggctttgtaaaattcccttcagtgttggctacagtgggtgatggcaggagtgggagagaggctaagatccagatagcatctgactggcaaagcatcatcccttgatttctttatccacctttattcaattctgaacgctgaaaacaggacaatagtgtgtgatgtcagttgtactgagctttctaaatattccttttagttttctctgagtatataggatttatatacctaagtcttgtctgtttatccaactattcatctacccatctgtcaacaagagtttcaggtattcattctgtgccacatgctgtgccacatgttgaggatacagtaataagcagaaaataaatggtccttccctctcgagcttgccatctaacagaggggtcaggcactctgctgag

SEQ ID NO: 184088 - DNA, 425 bp, Homo sapiens
tctccatgcacaggtaaaatctttttgctaaaatagtgatgatcaaatgtcatatcttcttgtcttaccaactgtatttaagtcatgttagtgtacttattttttaaccaccaccacctaaaaaaaaaaacaaaaccccctcaaaagggcatttatttgaccaaaaccacctcagaatcataaatccactgatgttttacataattatagtttccattttggtgatgcatttattatcaacattcagatacaggcttctgcatcccgtttttattccagagccactggaactcagcttctcccactattctatctgacctgctcttagcaaacgccacctggaccttttatccttcacaaaccctttttacagccggaggatacaatccaaacaaacagccattacatctccattgcctcaacgg

SEQ ID NO: 184089 - DNA, 371 bp, Homo sapiens
attatagtggctggggaagtagcattgggggtgccaagaattggttggactctgggtatgttttaaaggaaaagccagcaggatttgctgattaactgtctatagggtttgagagaaagaggagctgccattacaggggtggaagagactgtggcagatagctcagctggggacatgttctgtttgaggtgtttttttatatacccaagtagtgatctagaaggggcagttggacacataagtctggagttcagggaggaaggcctggctgaagattcacatttggaaattatcagctcataaattctatcaaagtcatgagattgtgtgagaccaccaagagagtgaacgctgatggagaagccaagagg

SEQ ID NO: 184090 - DNA, 309 bp, Homo sapiens
gtcagaactgtatactgttcatacaattttaaaaataagaagtcagtacaaactatagtgggggctagccctccctacaagagaaaaaccagcaaagtttcctcagcaatgaagaaaagactatctgctctatctccctcacagggttaaatcagatagtgtatgggaaagaaagcccctgaatgtgaaaaaaactctatacatgggtaagattattctccttgaatcaactcactttaagatcgtattattggcatcacagaattgaagggggcagagcaatctcccatgggaagtataaataacaga

SEQ ID NO: 184091 - DNA, 615 bp, Homo sapiens
cgttccagctcatctccatccagactgtcaatccttctgtaattaggatacatggctaagccctgattccagtttctgaactcatatactgtcaaatttgtaatgaaagaaaacatcacagtctctgaacttaccatcttttgaagagaaggtggttgtcaattagtgtttactaagtgaggggtatttgttgaaatagctcaggcattggactacagcagtaaaatttgcaatgttgagatttcacctctcttccttcttcattagatacccaattctgatgggtttgcttttccctgttcttcatttcctaaacctttccctaaagggagaaaggaagaaggaggatggagaacttggttcctaaatttaatataaatcacagtcaccccaggagcctgctaactgtgcagattatcaggcccaaccccccgagattctgacccagcagctctgggggaagggtgaagagcctgcttgtttaacaagtgctccagatgagtctaatgcaagttgccagtggagggccaccctttgagaaacctctcagagtatttcataactcttgctgaagttatttcttccaagtgcagaaaatgaagcattttctttcta

SEQ ID NO: 184092 - DNA, 792 bp, Homo sapiens
cctgcctcagcctcccaaagtgctgggattacaggcatgagccaccgagcccagccaggattcatactttaaaatgggaaagtggaaatagacattatcctgtaaaatacagttagtgtggcagatcagcaccaaaaatgatttgtgaagcttgtatgtatgggtagtatattttaaggctattgaaattgagccgcaccaaggactgatattcttggcagtcatcacaaaaggaaaatgccatctgtattagtccattctcacactgctatagagaaataaccaagactgggtaatttataaagaaaagaggtttaattggctcacgtctgcaggctctatcataggaagcatggctgagggggcctcaggaaacttacagtcaggtgaaaggtgaagggaaagtgggtgcatcttccatcaccagagcagaaggaagagggaacattggggattacaattggacatgagatttgggaggcgacacacaccgaaaccatatcaccatccatgacatcgtttgcattgattataaggagaaaccagttttgttacttgtggatttaaaagattttctaggactttgaaaaatttcttcattcaagttggtataattgtggatagctttcctaacaacaaccattaaattgctgacttatggcttattcttggtgcttatgtaagcagagggcctgctgcccaaggagaacttggtgcatataatttttccagggacggaaatatcgtgatccaagtaaacaattctgtttttactgttgagtcctagatcat

SEQ ID NO: 184093 - DNA, 354 bp, Homo sapiens
tattgccatctattagtctgagaaggatctcccagcagccataaactaggcatagctccatctcatagcaatgcccagaaggaaacagacaccctctaatgctgggagcaagcaggagggggccagaaaaaggtaaggagctctcaggaggaaacagcagcacacacaacacttctctgaggacaaaggaagaaggaagaggaagaggtatcctgggcagagcactggccatggagtcaggagcaaggagtctggccctagctctgtaacaggtaactgcataacctgggaaaatcccttcctaagtttcattccaggtcttagtttctctatctggaaaatggggctttaaac

SEQ ID NO: 184094 - DNA, 256 bp, Homo sapiens
actaagccacacaccacgttatttatgtaaaaaatgaagatctggagccagtgtgtattacagatggacctagagataaatggaactaatgtggcctgtttctgtggcacagcagggcaaagcaaatccattcacctttctatctctgcacggggcataatcattatattgtgattagctcccaaatgctcctccctccttgtgacctttcttgaggtcatttcactttgttctagccacccaacacctggtgacg

SEQ ID NO: 184095 - DNA, 403 bp, Homo sapiens
ctggcacattctttgcattgcctagaggacagagtctgcattcttggcaggacaaataagagccttagcagccttcgcaagcccctctaccagctttattgcctgctgctctcctggcagaaaccctgtccctctctcaacgtcctaatgccctcagcacttcatccttagtatgcttccctcttccctagctccatcagaattctttacctacttcaaagtaaattgaaagcttagctttcaatctttccgtaaagttagccctattgatccctccctggagtacctgtcactgtcactcatacattaccagcacatgctgtcatgctccaaactaaactggagggttccactaggaccatgtttgatgtatttttgtggcatctggagcaaagaatcttcc

SEQ ID NO: 184096 - DNA, 354 bp, Homo sapiens
tttctcttccattgaacagctctgcagagtttatagaggactttctcacacatccccagtaatctccatgcagcctagcctggaccaggttttgctgttttccagtgaacgtcagtaggtttaagtggttttcttatgacctcatagctggtaggagaactagaatctaaacccgggtctcttgccatcctgccaagcccaggtcaaacctccctctctgaagccttcctcggagaacagaattattctggctttcttctgggctctagtacacaggtcacctaaactagattcctcaagtaaattccttattggctccctttcctccacatctagaatagcacctagcagtcc

SEQ ID NO: 184097 - DNA, 348 bp, Homo sapiens
gtggggtgaatggattaaaagagaaaaagaataaagaagagaaccaggagacaattacagtaagagactagtggcttgatttagaatggaggcagtacggataaaagcctaagtatgtgaaagatatcctggtgtgtaactcacaggtttaggtagaggcctagatgtggcagcaaagggagattaaagaacttacagtccagaggagacaagaaatagttaaaatagttcaaagtaagaggtgctgctttaagtatctgagaaaagttaaaactgctataggaattccaaatccataagaaaaagccaagatcacaggaaactgtgcaacccatcagaatcaagtac

SEQ ID NO: 184098 - DNA, 124 bp, Homo sapiens
tgcaatatttagacgcacgatatgaggcaattcctaaagcccttggaacttagacatcctgtgatttcacagaatccacaccatttcttcgtccctccaaagcttgagccaaaaccatcaatta

SEQ ID NO: 184099 - DNA, 562 bp, Homo sapiens
gctgacagacacagagctactcccacaaaacctagacaacccatccattcctgatgccgctgtaaagattaataacacggaagcgatggggcctgaagagactcaggaaaggaagagaaggcatttcctaaggggatggtataaactgaaactgcgtggtcaggtatttctcagaccctagcaggggcagcctcgctgggatggcgggagaaacacaagacaaaggaatgaatcggccaaggcaactggggaggagctggggaagccaaggccccaactgagcccggctgcccaggcttccctctagaggtcctgggaagacatccctctgacctctgcccaatcttcctctctctgaactacatccacctcctgtcctcacagaaagcatcctgaactggctaaccacagccaccaaggtgacaggaaagccatataattcccccaggtcacagttttcactgtaggatgtatcaccatctgaaagacatgaccaccccttccatacaccactcctgcaatgttatggtgacaacatgagatcctgagctcacgtgccctg

SEQ ID NO: 184100 - DNA, 486 bp, Homo sapiens
tcgcgtatctccacaatgatgtgcctggacgactcatccttatgccccctcttatactcatgcttcatggagttcactttactcagtcgtctcttctttatactccttggtacactctcacttcacagctatcatgccgccgtttcgttctctgcttctacacagctggcacttgtctggcacttgtcatcaattttacccacttcagctttctcagctctgatctcttgattctgaactcagtaaaactgctgtcttctcactggatttcccctccattgactgcaggttggaaattacctccaggcagacatccaagcagtggatggctcacctcctttgtttttgtcctttcatgcattatagtcctctgctgcctgttatccaaggtctgaaaattctcgtttgagaaggagcaactgtcagatactttcggatctttctctgaaattagctttctgttgtgcttgttgtgcttacctcttt

SEQ ID NO: 184101 - DNA, 375 bp, Homo sapiens
agtgtccctgagcatgacgatgagatcctttctggggactttaccccaccaggcagctctgtggagcttgtccagatcttctccatggacgtggtacctgggatccatgaaggcgctgtcatcgtagtctccccaagcgcccacgttgctcttgccgctccccctgcagcaggggaagcagtggcagcaccacttgcacctcttgctcccaagcgtcttcacagaggagtcgttgcggtctccagaagtgcccacgttgctcttgccgctccccctgtccatccagggaggaagaaatgcaggaaaggctctatgtaagatggggcatctgagcgggtctcaggaggggttataaattcttgcaggtgagaagag

SEQ ID NO: 184102 - DNA, 161 bp, Homo sapiens
tatctacacatcctggtggacctgatattctctccttaaacctatgttcactgggttactctccaatctaaaaaccttcatggctttccaatctccctgaggcccagatcctccagagtcaaatgtgtcctggtatttgttatttgctctatattccacct

SEQ ID NO: 184103 - DNA, 233 bp, Homo sapiens
gacaccactttgtttccattttttttaaatttaagaattaacgggctaccatctaatccagatcattttttaaacactttcaataaaaactttattcccaaacttgaaatcccccatttctgctaatgttattactttgggaacatttcttccaaaaaccagttaactgaattgatattagttctcaatataagaccttatcagaagtgggttttttgtttgtttgtttgttt

SEQ ID NO: 184104 - DNA, 828 bp, Homo sapiens
aacgagaaacgtgataagcctgacaatagagacatgcagtcagcaattcgcaggagccaggtagggagcaggtgaccctcacctggggattagacacatggtagtactggctgagttaggtacctctggtgaggtctctcagtactggtatttgtccattttggaagaacctcctggagcacaggttacagattttggcctcatctctttggatgcctctgagtggtcaccaaaacccagattatgaagcaaatctgtgcacatggattgatttaaaatgttaggaggttatgagagtgtaggctgaaaattgcctaaaatgtgagtcagagaaaaacacagacctatcatctctggagtttttttggactgttgtcagctgtccccatttccaaaatataaaattgagaacagcttactgtcttggaggcacttgttcagatttagctttacaaaataaatatctccagatgtgattgttttatgcaggcgtctccatggcaatgcagctgaggctggaatatgttgttaaaaatatacactttgcatgatcacaatactattagtggcatgattttattttcaggaaatgataatcacctgaagtagaatataagtaaacattttatatcagacttaaagcagagcctctaataaagcttattaacccgattattcatctcatacctctttacattctgtccacaatacctgtgtctgtcatggtttaaaattgggattcttctaaggaaattgcaagtgcgtgtatgtaccgacgtatttctatcttttcatgtgatgacaattttacataatggaaattgaagt

SEQ ID NO: 184105 - DNA, 392 bp, Homo sapiens
gtttgaagtatgtctagagtatggttttaatccatcgctgtcaggctcacataaaattccaggcttctgtaactctttaacttgaagtattacagggtgtcacctgctaaatggaagccaagagaagcaaggagtttttcatggttaaatcttgtaaagatgctttttaaagcatattaatccattagtaatccatttggatttgggaatacggtcatatactgtttggtacaatatgtactaaacctggtcctggaaaattaagtggaaatataggtttaaactactggaacttcaaaatagcttctcagtaattccttctcagcaatcattccaattcctagatttaaaaaaatgttgatatatcaaatttccatcaagaggaacataca

SEQ ID NO: 184106 - DNA, 524 bp, Homo sapiens
atggcaaaatagacattttcagatgagagaaaaaacactgttatgcgaagacatccactggaagaaataccagggagagctcttcaaactgaaagggaaattaccctaccccaactggaacacagagatgcagagagaccctggcccaaaatacaacttttatatccactgggtaacacaaaaatttgtgtgactcactttattacagtggtgcagaaccaaacccgtaatatctccaaagtatgcctgtaatattttacagcagccctgggggaaaaatataccatccaataagaattgttgtaaactctacaaataattagaagaaatgagttttccacaaatttacatcgaactctgggttcacagcaacacctgttctttacaaataggacaatcatacaccccagttagcaagcaacagtcctggcctaaaagcaccccctttgattctcaaaagtgaccacctgtggataataagttacatgtcatcctatttataaacacaggtgttacgctgtgac

SEQ ID NO: 184107 - DNA, 403 bp, Homo sapiens
taaacacccatgagacgtgtatgtccgagagaacgttatgactctggcacacacatctagctcccgaggaagaaatggaatctgaggaggggcatcataaaagactaaggattcacctcccttctccctcttcaatatcatactatcaatcttttttgtaaatggtagaaattccacaagctcctttcccctcatcagtttcatgtactctctagtatatatagaatccattatgcttattcctatctttctatctataatctgctgcatgttgactaaagaactgaaaactgtctttcagatacttccctcatactcttgaaaaatctgtggttaatgtgatactaagacatagaaacagtagtcacaaagactaatctcacaatcataatctatcttttgg

SEQ ID NO: 184108 - DNA, 369 bp, Homo sapiens
taaagatcaaaaaagctaaggatggaatattcaacaaggcatcacattcaacaacacaccactggtcacacacatactggctgaattccagactccctctctatggtaaaagagttctgcaggctctgatgttggctggaaaaaaactagacacctgctcttcccagcactgaaatatggccaaaaaaaaatcaaataaacagattaaaaaataggcaaatgacttgaatagtcatttctccaaagatgataaaccaatggtcaagacacatttgaaaagatgttcaacatcactaatcatcagagagatccaaatcaaaaccacaatgagatatcacctcacatccattaggatggctactattaaaa

SEQ ID NO: 184109 - DNA, 651 bp, Homo sapiens
cggctgagtaatgggggaggaggggggtgcagatacacaatccctgccctatctcacgatcaggaaaggagagggctcataaggacgccccaattcgcgagcgcccttgagtctggccggtgccacggtcggttcgcgcgaagtgggcaccggtctcccgagccgacttcgtgtactccggacctgtactgcgctccggtagaggacccttccctttctcttagcttcttaaatcttttcttttaaggtgtaaatgtgtgtgtgtgccgatgaatgtttctgtttttcatctgctgactttatttttttttattggtataacttctcccttctctctccctgctcgtccgttttccaccttttctcttacttatcttctgccctcgctcactccctaacacacacattcacaccctctccgcctcgctctcccgttctcgccaggtcctgatgggtacagtagattttgatagtttccataggtggtgcttcaaatgccattatttctcactgaatatttaaagagatccctcggcaaagatggatctgcgcactcctggggtgtgagcggctcgcatctcccagaccccggggaacgtgtacgggagcacgtgtaaatcccgcacccgcctccatctcacaaacaggggt

SEQ ID NO: 184110 - DNA, 282 bp, Homo sapiens
gttttattatggtgggtttttaatacttcattaatttttctggttttatctttattaatgttttcctccgacgttctttattttgttcatttctggcttctggaatttaatgcttcaacatttatcaactcattggccgatctcatttcatctatacctgtacccactgccctcttcctgttttccttcaaagctaatcccagataccatataatttctcctgtaaatatttcagaatgcatctctaaaacataagtacacttttttagaaaagcattacct

SEQ ID NO: 184111 - DNA, 308 bp, Homo sapiens
caataaaacagtgaatgaaaataatctgatgaaatgaaaattgattattagaatctcagttacctcttaatttgcaacagaggaaaattgaaaatcagatgagctgaatgaccaatgtagtgatttgtaaaaatgtagaccttattttccagattgccatattttgttatattcattttgctaggtgaagggaatatttttctgtaccatcaaatatatttgaactagctaattttcagtggtttgcataaccatgaaaacctttgagccgtccataaaaaccttttgtattccatttggtcacaatt

SEQ ID NO: 184112 - DNA, 676 bp, Homo sapiens
ctaagcaaagtgagtccagcaccatggaggcctcctttggggtgctgaacaagggtatgggtgaactgtagggaacttgcccaagctcacacagctgccttgaacacagacagactcctaaggcggcaccgttgccctccacgttagagacctgtgtctgatctctgcaggagcaggagcagctgctgctcattccatttatcaagcacttgctgtatgtggtgggtagtaggctaagcatgttacacataggactttacccaaatctcaacttgtaggtaataggtaacatggtgaattctaccttaaagaaactggggcttagagcagtgcagtgactttccctaggttattcatagagtaggaatagaattagaacagagactgagatctgcccagcaccaggctctgtgcttcccagcttctgcttttgcctggctccttctgcttgcctgtgggtgagcgctcacaaaagcagaagggaaaaaatcacacgctacagcataactgagccaatgctgagaattacaaaatttaaagggaaatttaaaagacatttaagccaacccctctcacaacaagagaatcttcaacatatttgaatactccagtgacagggagctcattacctcaatcttactcatcacagcaagataaccaatgcttccatcatctg

SEQ ID NO: 184113 - DNA, 472 bp, Homo sapiens
gaaaagtatatattttctgctttacttagttttattttaaatagttattacctaataaattatgaacattaagcccataatgagaaggcccatatttcccaggaaaaattctgaggggcatttgaacaaggttttttttggtaatcttggctgaagggggcactgctctcaccagccatcttattaacctcatctaaatgcacagagaaagttgtgactcaaaacaggcaactagataaggcagaacattaaagtaaaataaaaatgaatacctgcacaaataatttttcttgctactaagttttgtgcagtgttcaacagactgtccctttgccaaacctcccatgatcctatctcatgagcaggtgacaaatgtattaattgatgcccagctgtcatcacacttaacaattgcccccagggggcatccttgcatctgttgcagatttagggttattttggtattactgga

SEQ ID NO: 184114 - DNA, 253 bp, Homo sapiens
aaagaaagggaaaaaaagaaaaagacaccccctgtcattgcagaagtaatgtattatgatataatagaaaggttttttgaataattcagaaacagcaaagcaagtggtggtttgtctgtactgccgttattcagagagaacatcttaacagttcgatgtattgtctcccagtcccgtttcattcaactctgcatacactcgggttttaggacatctgagtaggcatattaactaggcctctgcttttctgtgg

SEQ ID NO: 184115 - DNA, 783 bp, Homo sapiens
gagtgctggcctgtcactgcggctggcattccaggcatttcattggccccacttcagcccacgcctggctccacggggctgggcagctgaggggagtttgtggcagagtgggcatggggcacggcccgtgcaatgtgcgttacaaaggggctctctctgaagcaagtcctctgcactccagtctatttgaggaagaaaaggacaattcccatagggagggggtttgctgaagcaaccagctgcctggtttcctctccagcattgagagggagggagggctggcttaactgggggacggccttctcatctggactgtgtcaaggccaaggttaggctccaaattccagaaaacctctctgcagggtcttctttcagagtggtgagaatggaagcaggctcccttcccctccagcactaggaagccccgcaattggtgaggtgcaaagaaagatgggcccaggcagggaggcgggagcaggggaggtgcccagggcagtggctggaagggcaacgggagaagcagcagaggctgggggtgggggtcgcagcaggtgctgtccctggcctgtgtgaaaggtactagaaggccccatccttggtgccacatggaccccagaggcttgtcttagtccatggggtccgaggtgtaagacacttacgtttggcgtcacctcttaggcttggatgaatttcagaaagtgctagactggagaacagtggaaaaaatcagtggaacaagatctggagcactcactgctcaatgtcaatgttagagagcacaac

SEQ ID NO: 184116 - DNA, 1125 bp, Homo sapiens
cccacctcggccccccaaggtgctggaattacaggtgtgagccactgcgcctggcctatcatatctaagtcttgatgtcacttttccagttactaatcatctggcccagtcttgcttaggtcatacactctttgatgtgctcttcagtttctgaggatcacgcctctgctgggtggagtagctttcctaggtcagaagcaatgctgtctgcatggcctcccaagtcttcttggtgcctgcacagtgcagagcacaggtggcaccatggttggttaacaccatacttgtggcccagactgtagtccccccagagggtgtctgctggaaagggctggtcctggctcttgctgtgggttcactgaggttaagtgaagatggcaaaagaaccacaggtgattctctcctctgctctgggttttgcaagactagagaggtcagtggctgtggctgagagcctgtaggagatggaactacctcaccttgaggaatgtgcttagggatgccacagagaatctttcccgaagagggaaatggctagggccctggccttgggagccagctggaatggagaagccatgggaagaggggctggcctctcctccaaacccagcaaagggagccatcctgcctgactgaagccagagtggggcccactgctgggtggacagaatacagccacaggcactacattgtcagagctccagatgggagacaaggagtacaaaacagaggtggaagactgattccagtatggaagcagggcaggcttcaggcatggccagatttgggcatgatgaaatagattcacaattgctaatgttctgggggcacttgtggctacatcaggtactattctaagtactttatatgttttaagacactgtagcgccaggactgtactcagaaagtctgcattcttaaccactacgctatgtgaaatgtagaaagaagaaagcttttagacatataaagggttagacctctattttatatgttaaatgccgtatgaaaaaaaaagcaaaggttttggagccactccaagcctatgtgatcttgggcagttacttagattctccaggtctcagtttcctcatttgtttgtaaatttgagagtacatttaccta

SEQ ID NO: 184117 - DNA, 231 bp, Homo sapiens
ctagtggtagaggcaggtaagttatagaaaatattgagggtaagtattaagtgctttaagaaagtatgcttgggctgcagggagcattgtagggttctcagaggaaatgatccttgctcctttttggaatcattccaagcagaaggaacagcaagttcatgtgtgtggctcacacctgtaatcccagcactttgggaggccgagacgggtggttcacatggccactcaata

SEQ ID NO: 184118 - DNA, 239 bp, Homo sapiens
acaatatacacaagtttccaaaaatgttttctagcatgatttctcagagcattcatgtagcacacaatgctatcaacaggcaggccaaacacataaaaacaaattccactgatataggtcctaattgcttgtaactaatgtacttattctcactaaatataaaataggaaacttcttcagaagtcacaaattacattttaacacgagatcctaagtgagaaggttgctggaaagggact

SEQ ID NO: 184119 - DNA, 428 bp, Homo sapiens
cagtagaagtttcttgctcacattctagatctgggaagtccaagatgaaggtgccggcagtctgggtgtctggtaggccctgctctacgcttcagcggtagtaacttccagccgtgtcctcacgtggttgaagagcaaaggggccccttcatgcctcttttgtaaggacacgaatcccatttataagggcagagtccccgtgaccgaatcacctcccaaagccctgcctcttcattcccacacatgagaggttagtggtcaacataggagttttggaggaacacagatgtccagaacacagtgagtgacggcattagaattgaacacttctcatcattaaaaaccaccacataaacatacaggccactcaccaggggaagatatttgtaatgtagacaaatttcaaatgatcactatccaggtttttt

SEQ ID NO: 184120 - DNA, 289 bp, Homo sapiens
cttgacctttcaaatctattttccatgctgcttacaaatgatctttctctgtgatcttcagaataaagtccaaactctcacactgaaaccttaactcagcacctaacccgatatccttaatgataccgctcctgtttaccactccaatttcacctctcatcatgacccccaaatctcccacattccaaatatactgagctgctggtcgtccccccgtggtaccctctatcgtcaccccgctagcgtgcctgcttttgctggtcagctgttgaacatggtcgccaatccg

SEQ ID NO: 184121 - DNA, 598 bp, Homo sapiens
gccccttttttttcctttgagacagagtctcactctgtcgcctaggctggagtgcagtagagcaatcttggctcactgcaacctccacctcctgggttcaagtgattctcctgcctcagccacctgagtagctggaactacatgcacacaacaccacacctggctaatttttgtatttttggtaaagatgaggtttcactgtgttggccaggctggtcttgaactcctgacctcaagtgatccacctacttcagcctcccaaagtactgggattacaggtgtgagcctccatgcccaaccagctctaccatctaagagctgtatctgtagcaattcccttcctctctttgagcttcagtctcatttgtaaaatgggactaattataccaaccccattgataaaagaatcaaatgagattacaggtgttcaaatttgccctcctcagagactttccatgtaaagtagttattacccctatctccactattaatacccagttttctgcattcacagcagttatcacaatctttattttgttcatttccttgtttactgaattttattattttagagaccaggtgctttgtcactcaggct

SEQ ID NO: 184122 - DNA, 362 bp, Homo sapiens
cgaccagtaaaggtttaaagacttcagcacattcttcagatctctctcaaaaacacaactttaacttctaaattagggaggaaaagctattttcttacaggactagaaaaaacaataaacctacaattacttatttttccctcacatcattattaatggaaaaagcatgttaaaaaagagaagagaaaaaagaagagaagagatgagaaaaaagaagagatgagaaaagagaagagaagagagaagagaagagaaatcagtttcctttcaggacaacctgaacatcaaaatagtcctttaaaattatacaagaaaagtatactatcaaaaggaatagagaaaggattctatttaaggcaatg

SEQ ID NO: 184123 - DNA, 243 bp, Homo sapiens
caatatccgagagaaaagagaaagtgtgaaagcagttcaggggcccatcagcagagagggaaagggcactccctggccatatgtgaatattttcataggcttttgaattggagatcatgaccctagagattacaaagtgtgtaagatttgggaaaatgtgaaatgcatatatgcaatcattttgcaactctcgcagatggtctacctgtttgtgttcacattgctacttattagagataactc

SEQ ID NO: 184124 - DNA, 140 bp, Homo sapiens
tttacccaacttgtccactctctttaacttcactgtcgttatctttgcctagggcactgctatcccagctgggctacagcagcagcctcctaactggtcttaactggtcctctgtacctactctcgatgctcagcaatcc

SEQ ID NO: 184125 - DNA, 380 bp, Homo sapiens
gttcctaagggggctgctttgtgaaatactgtgctgtgatatacacatcattagagatgagaaaactttagattcatcaacaatttagagaactatttctaaagataaatcctttgaagataatgtctttatgaacaggtttcttgggaaaaaaataaagttgtcaaatgccagtgtagcttttattatacatatatagagagacagcactgatgatttcaggaaataacacaaacacacatgcagtcagtgagaattctgtcttgtggaagatgatattgatgctgtgtgcagcccgctaataaaacactcagttgtgattagcagaagagctgaccagagtataaagtttcttacatgaatttttgtaaaaaactaaa

SEQ ID NO: 184126 - DNA, 523 bp, Homo sapiens
tagtagagacggggtttcactttgttagccaggatggtctccatctcctgacctcgtgatctgcccgcttcggcctcccaaagtgctgggattacaggtgtgagccactgcgcccggcctatattggctaattctaggtacctcatgtaaatggaatcatccagtatttgtccttttgtgttgatttcactttacatgtcttcatggttcatccctgttgtagcatgtatcagaattcttttctttttttgtggctaagttcatcttccattggatggatagaccacatttggtttacctattctgccatcgatggacacttgggtcatgtcccctttttgctattgtgaacgacgttgctgtgaacataggctctaagtatctgtttgactttttgccttcagtttgtttgggtttatatctaggagtggaattgctgggttgtatggtaatgatctgttctaacttttggaggagcagtggctacatcatttcacatttccacctgcagtgcacgtggttc

SEQ ID NO: 184127 - DNA, 442 bp, Homo sapiens
aatgagttttaatgataaagagtttttgctggcctgaaagtgtctgcaaggcagtcatcgattccctataagcgaggtggaccctccacttggaagaaggcatttcactgtaccttacttagatgaggatgcggggacaaaagtttacacctctcttaatgagtacagccttatggacacaagacagtctggatcataacaggccactaagtaggctgtacagtcagatgcagcaggttctcaggagccagtcagccttgctgagcactggtagtggtatctactgcagtggtactctgaaacagcagtaccagaaggtactagagggagaaagcagaggcagagagtgtgcaagggccaccatcagaaatgatccaggcctcttggactgaatcctaataattcattcagtcattcagtaaatgtttgaattcctgctata

SEQ ID NO: 184128 - DNA, 692 bp, Homo sapiens
  misc_feature (532)..(532): n is a, c, g, or t
  misc_feature (563)..(563): n is a, c, g, or t
  misc_feature (678)..(678): n is a, c, g, or t
  misc_feature (681)..(681): n is a, c, g, or t
  misc_feature (689)..(689): n is a, c, g, or t
ttcaggcagaatgtagactgagcgctcctgctactgctgcctgttgctgagaggaagaccgcagaaaattctggattcaaacatttattgctttttttgttttgctttgtttttgttttctttccttttgccttcagaagatgaacaatgaaaccacaaccctgatatccttgaaggaggcaatgaaaagagtagaccacaaactccaagcgttagaaacacagttcaaagaactagacttcaccaaggataacctgatgcagaaattcgaacatcatagtaaggctttggcaagccaagcagcccaagatgagatgtggacagcagttcgggcactccagctcacttcaatggaattgaatattttatacagctacgtcattgaagtacttatctgcttgcatactcgtgtgcttgagaagctgccagacctggtgagaggtcttccaaccttagcctctgtactcagaagaaaagttaagaacaagcgcgttagagttgtatgggagtccatactggaggagtgtgggcntgcaagaaggagacatcacagcactttgtanccttctttattgcacgtggtaacaagggcagaacactatactgctaaagtgagggcagatgtacatcagggatgtcacgttcctaattactaacatggtaaagaacaggtcgcanganagttgctnagg

SEQ ID NO: 184129 - DNA, 748 bp, Homo sapiens
  misc_feature (588)..(588): n is a, c, g, or t
  misc_feature (619)..(619): n is a, c, g, or t
  misc_feature (734)..(734): n is a, c, g, or t
  misc_feature (737)..(737): n is a, c, g, or t
  misc_feature (745)..(745): n is a, c, g, or t
ttcaggcagaatgtagactgagcgctcctgctactgctgcctgttgctgagaggaagaccgcagaaaattctggattcaaacatttattgctttttttgttttgctttgtttttgttttctttccttttgccttcagaagatgaacaatgaaaccacaaccctgatatccttgaaggaggcaatgaaaaggttgctgagggctatagggagggagcaagcatgggtctgctattctgggaagatggagtagaccacaaactccaagcgttagaaacacagttcaaagaactagacttcaccaaggataacctgatgcagaaattcgaacatcatagtaaggctttggcaagccaagcagcccaagatgagatgtggacagcagttcgggcactccagctcacttcaatggaattgaatattttatacagctacgtcattgaagtacttatctgcttgcatactcgtgtgcttgagaagctgccagacctggtgagaggtcttccaaccttagcctctgtactcagaagaaaagttaagaacaagcgcgttagagttgtatgggagtccatactggaggagtgtgggcntgcaagaaggagacatcacagcactttgtanccttctttattgcacgtggtaacaagggcagaacactatactgctaaagtgagggcagatgtacatcagggatgtcacgttcctaattactaacatggtaaagaacaggtcgcanganagttgctnagg

SEQ ID NO: 184130 - DNA, 454 bp, Homo sapiens
cgtaatttcaaaactatggtttttggagactacttaatatgccctgggaaatttttgtgatataatgttaagtgaaaaacgcagagtaaaaaaacgattaaaaagatcagtggttacctggggttggggaagtggggggaggaaggatgaataggtggagcacaaaggatgttaggccagtaaaaccattctgtatgatactttaacagtagatacttgacatgtatttgggaaaaaccataaaactgtagaatacaaagagtaaaccctaatgtaaactaaggacttgcgttaataataatgtatcaatgctggttcaattgttacaaatgtatcattccaaaacaagatgttattcataggggaatctgaactggggagagggaactctattctttctgcttactttttctggaaacctaaaactgctctaaaaaataaaagcctgttaatt

SEQ ID NO: 184131 - DNA, 315 bp, Homo sapiens
tccaagactgacacagaatgccaagtgtaatcaatagaaataccaattataaaccaactatgatccaaaaatataaagaagggcattacataatgctaaagggttcaattcaacaagaagacctatcctaaatatatatgcaccaaacacaggaggacccagattcataaaacaagtttttagagatctacaaagagacttagataatcacacactaatagtggaagacttcaacaccttgcttgacgttactggacaaatcattgatgtggaaaactaacaaagatattcaggacctgaactcaacacttgacc

SEQ ID NO: 184132 - DNA, 588 bp, Homo sapiens
ccgtgcctgttggagggaagcacctgccgtgagtctggccagggccttcttttccgacaggtaactcacatcccagaggatctgcgtgcctcccgtgagaaaatgggattcctctggagagtctctctgcagaagtgaggggcatggggcagggaacaggcggggagcgcagccactgggagccatgtcaaggccagcgccaagccctggagcccagaatcctcttcctccagcccgttctgtctccatagtccctccatgccctgataaagcagtcgctcttcctttagccacctgacaatgcgatgactacattttctgagctccatgcccttctcttttagggaattataaatacgctactaggtagttcactaagcacaaataaatctaagagaaaccacaaaacaaacagtggaattccgctgcacatcacagctaatctcaccctccaagggctggagaagcctctccctctccccttaggagcctgcatccacttgttcttagtctggccttccccaggggacagaggctcacccaggagctgccagggactagttgtcacatacacacagcagctctcct

SEQ ID NO: 184133 - DNA, 250 bp, Homo sapiens
tagaaataactcacatgtaattcaggtataccaaactttcctgccttcctactaaatggaactagaaaagcaaaatgctgattttttccaggtactccaaaaatacctttataattttaactgtaatttgtttagtctaaaaaggtactgctccaataccagaagctacaggtgaaaaacatatctctcaactgaagacaacttcttgaataactgtgtcactgacaagtttactctctgagcttcagtt

SEQ ID NO: 184134 - DNA, 397 bp, Homo sapiens
ccagagtgtttaagactcaaaccgttcactggtgaaggaaggcattccctgagactctaggtctgagaagagggatgggtggtggagagggggagggagtttattcgccctgcagttgtgcctgcaccacttactttcaagggcatatttggatctgttacttgtcaaagtggctatcagaatcaccttggacttcttgaagggtgagttcacaaccgagaaagcacatattcaaaattgttgaagtaataagtaaatcttctagaaccttaccctcagtgataacattccacttctagctcttaaatacccacttctgtttcctggatgagatactcagtgcaggaaggaacctgggttacatttgtcagagccccaaatctgagatgaactgtat

SEQ ID NO: 184135 - DNA, 268 bp, Homo sapiens
agagtatcccccttattccgggtgccataacatttattttaaggaagccaaaatgaccttagaactcttacgctttcatttttatttcttatggttgtttgctacataagtattatccattggcctattttttcctaatgaattgttaatttacaaattttacaaaataacttttaaaaataaactttcccagactaaatctggaatattaatagatttttaaaagcttatatctgtccttgctttaagaaaatatactgtagccagg

SEQ ID NO: 184136 - DNA, 265 bp, Homo sapiens
gaaatatctgtggatgacagatacagctaagaaactcattaaagtatgcaaaaatatatcaagaatcattatttatttttcaagcaatataaagatgtttttacttttgaaagcaaagatataaattttttgaaagaatattatttttaaaaatagtgtttcaatgtaattagtttgtaggtcagcaattatataaaactgtttaactggttagtaatatgtgtttcaaaaatcatataattttaataatttttggtacctgctt

SEQ ID NO: 184137 - DNA, 196 bp, Homo sapiens
aacttaagactgtctcaccagagcttaaaggtgttagctctggccacagcagcggcctcagtcactcttcttacatggattttgatgcaaattctgctccttttctatttctcaagatttctagccccttcgaggggcccaaccctcgaaggagtccagtaaatgtgtaactccactctgccttgcctgtgctgaa

SEQ ID NO: 184138 - DNA, 180 bp, Homo sapiens
cttagactagttcctcctatacactttaacaaggaagatagcacaggtccttttgaagtaaagcactgtcagaactttcatttaaattatcagaactccaggatgagtggagttgggtaaacaggctactcaactggtaggaataaaggaaagctatccaagaaagttagagagaataat

SEQ ID NO: 184139 - DNA, 242 bp, Homo sapiens
acctgcacttcccggaacataaattggttaacgccatctggttcttaaggctttggggctccattgagataagcacccagaaggggtagaattagccttttgcataagacattgtagggtgatccacccacgacagactgcagggggtgattcctaagaagctctttcctctaggccctcgtgggcagttgaagctttttcaggtggtgggtttgctgactggcgttagagaagaagaatgg

SEQ ID NO: 184140 - DNA, 542 bp, Homo sapiens
cgatccatatttaggccagaaaccacatggatctcgcatcacttcactgggctccaggacagaaaggggctcaagtcaggaagggaatgcttctaaccaatgattaattactcatcctctgtcaaatttcttgacaaagggacaaaaatgaacactcctaccagggagcaaaatcaatggaaactcacccttttcccactctgtatatttttaaacaaaaaggttttctcccactaacaggtagttttcctgatttttttaaaagcgtattgagaagaaagaagcagaacatcataaccctgctgcagccttttcaaaggtaatgaatgagccagtcccacaggagagggagctctgcttcagggtgggaaggattccttgagagctttcagagtccaatttcccaggaataaacgaggtccgcagtcaggctggggccgacaggctttttccaaggcagacaaaccccaagatccacgaaagcctatattaatcttaattcctagtgcgtcacaggcaggcaaatagaacacaggcctcat

SEQ ID NO: 184141 - DNA, 482 bp, Homo sapiens
ccatgaaaacaccataaccattattgagcattccttgggaggcagtttacgtgctcagtgacaaaacagtgataaagtgtgatattatgatatacatatattggttttcatccatggttcctagctcataactcccatagcccttcctaagtgactaaaacaatcacttgttaaggtatttgtccttggttctggaatcagctttggaacagcttcagagggacaaaggtgaaggtcttttgttgtattactggggcacttcaggcctcagaagcagcctcagaaacagaatctctctctctgaccttctcctgccctcctttcacctactcccttttctccccacagcaggactctaatctttccccacacctttctgtcttggaactggccataaagaaattctatgacctaccttgtctgattgcaggctgtaagacccccatttcagaagagatcgtaccccatacccaggaagaaga

SEQ ID NO: 184142 - DNA, 315 bp, Homo sapiens
gggagtcgttagtgaggtgagttcgaggcggtgcaggaagagtgttgctgggatcgctttcctgcgggctagaggcctggggtcttgagggagactggggcaagattttggattcccgattccctgtcaatcattattaatacagctgtccgggcgccccaagtttgaagctgaactacactctgctggaggtggccaaccgtccatcgggcagttctctctctctttgtctctctctctcactataaactcagtcaagtggtagctagcatcggccagttctcctgagagttacagttctgctgtagatgatgg

SEQ ID NO: 184143 - DNA, 116 bp, Homo sapiens
agatcaaactaatacagcatggcccagagacccatgcatccaaaaacaagagattcacttccacttatatggttagaatcatatatctgttgctgcccaagacctcaagtgagcta

SEQ ID NO: 184144 - DNA, 765 bp, Homo sapiens
ttctatgcaggtacacattcagatgaaaagctaaaagtgatcttttaaaacatagtcccataagtgattattaaaatgcttagagacaaaatgtatgtttgtgtgtagactggaaatacacattggattgtagtttcagattctgactgtcaaaagaccaactttccatactccagagaaaatagcccccaagagacgagcacaagttttccccattgttcagggccagacgataaaccatgtgagatttcataactaccagaccagacgctgggtcaccatgagtcaggggcggcctgactctgccaatatctgcacaactgaataaacaggaggagcgagggaatgccgcagaacgtatacacctgaaggtagagatgtcgcctgtcccatcctgatgtttccccagagcctagcagcccttgtcacacacagcagttgtaaaaaatatgtgtgtgtgtgtgtgtgtagaaataaatgaaagagcttcagtggacaacaaacaggaatagtgtgggggctttgatgaccccacagatgaggggtcgttattaacagtgccattttatccctttgtgagcttagatatcttggccataaatttgggccatgccagtcaaagccaaacttcttgaaagcatgatctccacgcctttgcctcccatttacgcaaccttctgcagccctcccagccccgtcactccaatgaatgcgtcgggggatctctagagcgactgaggatgaagtgacgcgggtttaaaaaaa

SEQ ID NO: 184145 - DNA, 1308 bp, Homo sapiens
agcagatcccttctcctatctgaatccagatgctgtggaagatatctgggcaaatctgaggaccccccagttgcagccatgtcaagactgatgctgaggaggaccccaactgtcacgagcaacacccatcgaacacagccacctacttggggaaagatcaagaagctgtcacagatggtggaagaaaacctgaggaaagcgggacaaccagtcacaatgagtaatttaatgatagctatgagagcggtgatcaccattgctgtgagtattccttcagcaagcactgacacagagaacaattatacttatagggcatatctatcaatcttggctggcaataatgcctggatgtaatcactctatgacccagttacacatgctttctgatctcagtatttgccataatgaatctgctcctataattaaggcataccaccctcaaaaacctatttgtaaacagaattgaacctggccagaaaaaatgaatgtacttgtttgcctcctatctgaatgccagatcacttcttgaaagatcgtttccagattcttcttcagttcaaactgattttcacaaacttgaatctgcacgccataattaggaagctactgcaggccaatttatttggttaatttgcatcagtctaaataatttttcctgacagattacttccgttctaagtaccaagtactttttaatcctagtcaggttattgctaaggataaatgatttcacatttctcataaagatgcctgtcattaagaatattaacacaaattccttccccttgaatagaaatgagctgtcattttagcaatcttgctgtgtcagcctttctattgtcaaacacaacaaatgatgggaaaatcaatttactctttagaattagtcaagtgaggaatcctttgaagtgggggtgcagagtttcgcctgaattctataatcacgtaacagcgagtactgtatgtatgttggtaaaatgttgtgaaatttaatgaggactatttgttgccataagaccttccagacagaatctatctctgaaaaagaattccccactcctaaaatagaggtctgatgagcaacagatgtggtttaaatgaacccttgttcaactgaaccaagaatatattgtgatctgtatgaggcacaattcagaagagaggggaggtggctacagcacagcctcagtgttgagtttggttgtggggtttaaacatatttatttatttcataaagtttctctcataaggcacaatgcaaatgagcttttaattaatacaatctaatgttcagaggatggtcttcat

SEQ ID NO: 184146 - DNA, 394 bp, Homo sapiens
aaagagcagcatgaaagaaaagctggaaagttcgctgaacttttcagtgattaaaatcaatgggcttttgaagaaatttgtcagatttggcatggtttctttgtaaaaatgtattttggtaattttccagaattctgttggaaaagttcaaaaattctgacatataccaaaatggcagcaacacagataaccctatgcaaaataggcaaagaggaaaaatttaacttcaacatcccctcaatcttcccttccttgcagccacccaatcttccaagattcctggtgcttttaggaggtcacagacccccagagttcattaatttgtcagcaaataaattaactaatcaattaatttaggtgtaagtaagtaaagggcaacttcatttagatttct

SEQ ID NO: 184147 - DNA, 110 bp, Homo sapiens
ctgtctcagcctcctgagtagctggggccacaggtatgccccaccacgtctggccccagtgtctagtttctaggcataggcccataatcctttgctgaaaactcctggcg

SEQ ID NO: 184148 - DNA, 255 bp, Homo sapiens
taggattcccccacaccaccctaagagaaaacaattttacgaactgaaatttaggccacatggatagcagaggtgagtgtgacattagataaccttgagttttaaggtaacttttatgggaaaacagattcttgagatgctaagtagattttaaacccttttagttttacaagtctgaattaccccagtgtagtatataaataagctggcatttttaaatattctacactagtgtgtgcattcttaggagtaatc

SEQ ID NO: 184149 - DNA, 456 bp, Homo sapiens
aactcttctgcttgctcaatgtttcaggagttagagaatgaattttaagtgtgacgtgcgtccctattaaatgtctacaaaattttcattaagcatatctagaaaatcacggcataacttgcctgcctttcttcaacatatattcttatataacctgtagtggaagatttgggtactgtctttaataaatcaatcaatcgactcttttatttcaaggagaaagttctatgttatatgttgaaggtgaacagatcatatttagaggatataacaattagaaatctagaaaataattatcatttttataaaatttttagtcaactgtacaaataattacataaaacatcaattaattatgcttaaaaatcactaatgttcataatatataatcactatttgtaatcaaaagtttaattttatgccaaaaaataaaaaatgcttacttggaatttgata

SEQ ID NO: 184150 - DNA, 340 bp, Homo sapiens
ccttggaaatggagtatgtgctggccgtgtgacttgaaccatcgctagcatttgcctgtgaagaggctgcccactgaaggaaggctttgggatgccaggtggctgtggaaatggaatattctggtgacaacaataaggacgacgtctgtggggggtgccatctgctccaggcagcaccagagagtttggagaagagaaaaaggcacggtgagggcctgacattcctggtccaaggcaagttcggagaactgagggatgtaaaataatctgtcatctcttacagctgtatccaaatagcaaataaaaaatcggatcccaagggctccgggttcacaacgcc

SEQ ID NO: 184151 - DNA, 412 bp, Homo sapiens
agggcaagtaccactggaggcagaaccaggacgtcaaaattccattgtcagtctctgctgttgtgacatccctggccaaggaagaggctctagcagccacagggagtctcagtttccacatctggaaaacggaggcagttactatggccttggccaatcccctctcactttcatcagaaataagaaatgagcaaaggatgcctcctaggaaatggaatgagctttcacaacccccctgctctggggctggcgtcccttcctggtagagcggtgggtgaacagcacaagtaactgcaggagatcgcagaggacacagctgtccttcttctccattccaattatatttggcagggaaagtggcttttccccactgatgccagtgtatcattttgtggtccagggaaagaatcca

SEQ ID NO: 184152 - DNA, 403 bp, Homo sapiens
gaagtttttgctatgccttcagttctgtcacagtctttagaggtgtttttgtctaactctccctcaggatcacaccaaaaagccttggtcattcagcatggtgcctgaccttcagcaaatattgggagcctccgattcctgctgcttctagtctgccatctttgccacacccccagaaaattctgactattcaatttctactataccaaaattagactcctcctcccgctaaggaaaagtggtgacaacatgggcatatggacattcattcccaccttcagcagagggaggatatgtgttttgagaaatggtactagagcaattcaacatagaagaaaagaagagaagatgaaggagaagaggaggaagaggaagaggaagaaggaggaggaggaggaagaag

SEQ ID NO: 184153 - DNA, 313 bp, Homo sapiens
tgggattatacgtatttttattcctgataagaaatattccttttatgaagaatctttaaaacttcaaaatgaaatatgataaacaaaatcttttatagtttgacagctaagagttggcaaaagcgacacaattcgtaaccacactagtagtttgctgtcagctaaaattactattaaaaagaaagctcatatctagttaataccagatcactgagccaaaaccacaagagattggggtaagggtagatgctgttgaaaataggcacagggatcttattctttggaatttggattggaaaaaaaacatgcatgt

SEQ ID NO: 184154 - DNA, 228 bp, Homo sapiens
tatatagacaagttctggctctgttgcccaggctccatggagcacagtggcacgatctcggctcactgcaacctccacctcctgagttcaagtgatcctcttacctcagcctcctcagtagctgggtctataggcctgtgccactttgcccagctaatttttgaaatacagttctttttaattacaggcgtagagcaccgaacccggctgtctaattctctggtaacc

SEQ ID NO: 184155 - DNA, 300 bp, Homo sapiens
tatatagacaagttctggctctgttgcccaggctccatggagcacagtggcacgatctcggctcactgcaacctccacctcctgagttcaagtgatcctcttacctcagcctcctcagtagctgggtctataggcctgtgccactttgcccagctaatttttgaaatacagttctttttaattacaggtagcttctgaatctcataaagaatgccacttcttctgggaaaccttccctgacttgcccaaagagagttagatacattttcttctttgccctcataatttttattaagttta

SEQ ID NO: 184156 - DNA, 157 bp, Homo sapiens
aagtaattgcggttttgccattgctttcaatgacaaaaccgcaattaattttcaccaacctaatatttggcacctgaggcacctccttgccattccatagtcccagccctgcagccaggccaactctgagctgtacaaaagggccccaaaggggccg

SEQ ID NO: 184157 - DNA, 155 bp, Homo sapiens
gatatagcaatacatatgctattttttatttcccaacaatttcaccgttttgttttaatggcaaccaaagctgaaaacatgatttggaaagatatgtgggaacaactggaattggagccagatgaggtagaactctaccttgtcaaaaaaactgt

SEQ ID NO: 184158 - DNA, 612 bp, Homo sapiens
cattacatgactatatgtgtgtgggtgtgcttctggactctgttccattccattgttctgcacgtctacacttgtacaaatactactgcttgattattatggctttatagtaagtcttgaaatcccatcatgtgacctctgactccttcaacatttttctactttttggtagaaaattattttggtgatttttgttcctttacttttccacatacactttagaatcagcctgtgaaattcggcaaaaaacttgctgagattttgattaggactgcattgactctaatgtaaatcaatttggggagaattgctgtgtttgtttatttgcattgctataaagaaatacctgaggccaggtaatttgtgaagaagaggctaattttggcttatggttctgcaggctgtgtaggaagcacggtgctggcatctgcctctagtgagggcatcaggaagcttataatcctagcggaaggcaaagtggagccggcatatcacatggtgagagagggagcaaaagagatgcagactcttttaaacaaccaactcttgcatgaactaacagtaaaaactcactaattaccatggcactaagccattcataagggatcttct

SEQ ID NO: 184159 - DNA, 404 bp, Homo sapiens
tctcactctcatccaggctggaatgcagctcactgcagcctctacctcctgggctcgagtgatcctcctacctcagccctctaacccccatccggtagctgggactataggcatacaccaccatgcccagctaattatttaaaatttttgtagagatgggatctcgctatgttgcccaggctggtcttgaactcctgggctcaagcaatcccaccttggcctcccaaagtgctgggattaatggtgtgagccactgtgcctggctgatgcatttggattttatcctcagggtactgaaggatatgaaattaacagatttgtgttttaaaaatatatctttggtaataggtaatagaatggtgaatggactggagaatctagtgagagattctggttaggaagct

SEQ ID NO: 184160 - DNA, 2591 bp, Homo sapiens
  misc_feature (243)..(243): n is a, c, g, or t
  misc_feature (246)..(246): n is a, c, g, or t
  misc_feature (250)..(251): n is a, c, g, or t
  misc_feature (253)..(253): n is a, c, g, or t
  misc_feature (257)..(257): n is a, c, g, or t
  misc_feature (264)..(264): n is a, c, g, or t
  misc_feature (266)..(266): n is a, c, g, or t
  misc_feature (271)..(271): n is a, c, g, or t
  misc_feature (285)..(285): n is a, c, g, or t
  misc_feature (293)..(293): n is a, c, g, or t
  misc_feature (304)..(305): n is a, c, g, or t
  misc_feature (312)..(312): n is a, c, g, or t
  misc_feature (314)..(315): n is a, c, g, or t
  misc_feature (323)..(323): n is a, c, g, or t
  misc_feature (347)..(347): n is a, c, g, or t
  misc_feature (349)..(349): n is a, c, g, or t
  misc_feature (356)..(357): n is a, c, g, or t
  misc_feature (359)..(359): n is a, c, g, or t
  misc_feature (368)..(369): n is a, c, g, or t
  misc_feature (372)..(372): n is a, c, g, or t
  misc_feature (377)..(378): n is a, c, g, or t
  misc_feature (396)..(396): n is a, c, g, or t
  misc_feature (399)..(399): n is a, c, g, or t
  misc_feature (401)..(401): n is a, c, g, or t
  misc_feature (408)..(409): n is a, c, g, or t
  misc_feature (417)..(417): n is a, c, g, or t
  misc_feature (424)..(424): n is a, c, g, or t
  misc_feature (427)..(427): n is a, c, g, or t
  misc_feature (431)..(432): n is a, c, g, or t
  misc_feature (434)..(434): n is a, c, g, or t
  misc_feature (854)..(854): n is a, c, g, or t
  misc_feature (969)..(969): n is a, c, g, or t
tggcggcggacggacagggtcttgctctgttgcccaggctggagtgcactggcgcaatcacagctcaccacagccacaaactcctggactctggtaatccttccaccttagcctccggagtagctgggactacaggcacgtgccacaatggctggctaatcctttaatttttgccgatacaagatctcgctgtttctcgggtcgacaatttcttttcttttttttttttgagacgaagtctcnctntgtnncncagnctggagngnagtgncgcgatctcggctnactgcaanctccgcctccnnggttcangnnattctccngcctcagcctcctgagtagctggnantacaggnncntgccaccannccnggctnntttttgtatttttagtanagncngggtttnnccatgttngccaggntgntctnnanctcctgacctcaggtgatccacccgcctcagcctcccaaagtgctgggattacaggcgtgagccaccgcacctggccgagacttaaactttcaacaatctgatgggtatgaaagagaaacttgtagtttttaatctgcatgtcctgtaaggataatcatgttctcagaaatgtttattgactatttgggccatctatttaaattttttaaactttcatgttcccttttattctgttatcactttctcatagtgattaatagtagaaactctagttttaaaagttaatacacataaagtgctcagaagagtcacagccatgttgttggagacagtattatttttatccttttaaatacgtatatattggctgggcatggtggctcacgcctgtaatcccggcactttgggaggctgaggcngacagatcacctgaggtcgggagttcgagaccagcctgaccaacatggcaaaacgccgtatctactaaaaatacaaaaattagccaggcatggtggcaggcgcctctactcccanctacttgggaggctgaggcagaagaactgcttgaacccaggagcgggaggttgcggtaagctgagaccatgtcgttgtattccagcctgggcaacagagtgagaccccatctcaatacatacatacatacatacgtatttattgagacaggggtctcgctgtgttgaagaagctggtctctagccccaggcctcaagctgtcctcctgtcttggcctcccaaattgctgagattataggcgtaatctcactgcacctgtccaccattttagatactaatcttgccaaagttatttttaaaatttaatctcatttctttgagtgtttctacttatattttctaatcttttatgataaattatttcagcaattttagcattcatgactttaatccttttgtttcttttctagtattagtttaaaatgttccatttctgttctctttgtgtatctcagttcttgcttcaatgacagcaaataaaaatcctggtcttgtggaacagctgagtagtacatcctttcccaaactgggggagggtggttgctttacccccagctgtcccagcagctgctcagccagattcccagatctagcatctttcaaaacatctcaaccttggtaactcagataaaagtctttctgaggcgtaggtcctcctgtgtcaatggcacatctgaattactaacaacgtgttcttttcttaagttatgttatctagtcagttgatcaggagttatatatactgtggaccctgaaaacattatccctgcattattgagtaaatcatgtaaatactgcgagaaggtaaaaaacaccacaaaagcaatgtggcataacactttgtgcattacataggcacccaatacatattggtgattgcctagtaaaaaatagagggctctcagtgctgcttacctgcctctaataaaaatgtaggtggtattaaaccacaagctagaccatcaggaaggaggtacaaggatagatccacaacctgctcttggcctttatctcagcaagctacctggcttctgtactcctactttgattcacctgctgttgcagcagggttttaggaggatcctatttgtgtatctaagattcaacattcatgaaggagcagaaatacttggatttgcctcttagctcttggagctggagagtggatgacttcctgcaaggcacgatttttggattggcttctcaattattacaggaatcctcaacttttagaattgccagcctattcatctgatcttgaaagtgtacaaacttaccttcaaacagtgtagaatatatgcaattctggacctagacagaggcaataacctaaagacatttgcagctcatttcttgtcagaacccattgagaatagtggtattgatggaagactgtcaagcccatccagttctctagtctaaatagtctcagtttatccatgacttgagccatctaaaagttgcataacaaattagccgggcgtggtggcgcatgcctatagtcccagctacccgagaggctaaggcaggagaatcacttgaacccagaaggcgaaggctgcagtgagccgagatcgcaccactgcactccagcctgggtgatcgagtgagactccgtctcc

SEQ ID NO: 184161 - DNA, 344 bp, Homo sapiens
gatttttagggcagtgaaactactctgtatgattctacaatggtggatacatgtcatacatttttccaaaaccatagaagtacaacactgtgagtgaactctaatgtagaatatggactctgggcaaaaatgtgacagtgtaggtccagtgtagttccatcagttgtcacaagtgtactggtctggtgaggtatgtcgataatgcagaaggctatgcatgttttagggcagggtattatgggatatctctgtaccttctgttagatttttctgtgaacctaagacttctctaaaacaaaaatctattgaaagcagaaacaaaacaaacacaacaaaacctagat

SEQ ID NO: 184162 - DNA, 242 bp, Homo sapiens
atttacctgaggaaactgagatatagagaaaccaataaatgtactaaaccccacatagttgggggtgggtatgaaggaattgggatttaaagacatgttgtctgtgacatctggcctcttggagaagggtgggatcccagaaccacttatgtctgttgttgattttgtccaagtgtgaaggtagcagtacagatgaaatataaattatacttttttcacacacagccagtgtgttattttcc

SEQ ID NO: 184163 - DNA, 573 bp, Homo sapiens
cgggactcccagctgaaccagtactgcccccacccattacccccgggctccatgagtggatcaatggactcagtggcctttaatctgagttagggtgcagtactagatgcttttgaagcttctcatgaagtagattctgagtcccaagttagaaagcctcccagaacctcaaagcagggcatgaagtattggcagggcacaatataaatattcatgacccttggataaattacatcaacatagcacccaaacctgaccatcgatctctaacatgagcaatacggcaaaccatgtttgaaaagactaacctgcttgtagtaagaacatactagaagcaagaaagcctagattctgatcgtggaaaacctgtgcaccattaacagtctccactttgtcacttgtaaaatgaatgcactgaggatagagtcaactatcctgattatatggcagtttgagttttcaaaaataccttgccaggacccaaaccaacaattcaaagctcaggaattagtgccagcaggaggcatttcctcacataattgcatccttctcagacagctggattctgtgtca

SEQ ID NO: 184164 - DNA, 184 bp, Homo sapiens
cgctgtctgctgggtggggtccaacaccacagcgcagtctagtggccggaggagccaaggaggcgcggggtggagactgggccgagcaggggatagagatgaactccagaaaggaacagcgacttgctgaaagtcacagggcaaaatgtggcgcgtctgtagtcaataaataatatatattgag

SEQ ID NO: 184165 - DNA, 342 bp, Homo sapiens
tgaactggcacaaattcatcaccacaaatgaacaaacagctcaagtctgtgctcttctgacagtatgatcatttgtttaaagtacctaatatgtagatgcctacacatcaccacatatgtatatattttgctaataagcttcctctttggacacagagaagcaacgcgtttatttatgctttgagtactttattatgtcaaggtactaacagtttggatgcagagacaaatagtttcaattgctaatgcattaaaaacattttttctaagttttatttttaatatcagctaaagaaaaaaatttttttctgggaaataacttgtaaaacatggtatcaatta

SEQ ID NO: 184166 - DNA, 347 bp, Homo sapiens
tgagggatacaatgataaataatacagctcttgatttcaagaagctaacaatgttctagaagggtagaaaaagaagtaggcaatctcacctctatgtagtaagtactaccaaaggggtgtacaaaaggctatggtacacagtggggggctacctaaattctcaggtggagtgagaatggcaagggatagaacctacatataacccactactgtgtgaataccagaaaacggagattagggttcatcttagggtctacttgttgcactacatttatggccaccttagtaatatactttctgacagactggacaatcctaatcacttcagtttactcattgtatcccta

SEQ ID NO: 184167 - DNA, 380 bp, Homo sapiens
atatacatgtatattttcttattcacattttccaacaaaaagatcacatcacttagaaatatgggagtctttccctatcagttcgtaggaagatttctcaattcttttgacaggcatctactccatttatgtggacatagcacagtttattcaaccgttcttttatgtatagacttttagattgtttctaatatttagcaattacaaacaatgctgcaatgaaaacctctgctaaccttgtgagtgtttatttgtatattgctataggagtaactttaggatagcatcctataagtgagattgccaggtcaaaaggtaagagcattttattttgttggatattgccaagttcctctccagaaggatgtatcaggttgaat

SEQ ID NO: 184168 - DNA, 719 bp, Homo sapiens
ccctgcacaaccgaggggaaaaggatatattaatggaatcctaagctgcaaacactgaagtgaaaattaaggaagtttatttcacattttatccttatgaaaacaaaagacggaaaatgaaaagttttctgttttttcatgcacagcaccagaggagcacatttacatttttaaaaaagtgattgtttccaaatgctgttatgtgagtgattaaaaaatctcctctgctctttttcttattttcaatatttaagagagtttgaagggcttagcatggtttcagtgttccttttctggaagaatgaacaaaggccattgttgacagtcgtcagcttctcctgcgagggcagccttccattcagctggactggctgggctgggagctgtccagtgatgaatgaatcttccttggactgacctccagctatcctggaacctggagacaagaggtgacctgagagctttgccctcatcaacggccctcaggaacctcatgtgtagggccactaccctgctctggccacctggctctgtccaccccagaccctgggctgaggtcacattggagctgcagaggtggcttatccttcttgcccttgatgttaccaatcaccatatgtcttcaacagagcatgccaagacagggtcttgctctattgcccaggctggagtgcagtggcacaatctcagctcattgcagcctcgacctcccaggctga

SEQ ID NO: 184169 - DNA, 418 bp, Homo sapiens
gtttttctgtaattatagagcacaagcaggatgaggagctgcagttaccccgggatctgaaagttctagagtcgtcacttgctcttctggtgactgtttcttctactaatgcaccagttcatgcatctccagggcctcccttcaccccatttgggacatggatgagcgagtgtcattccttcagctggtatcattctcagtagcagggcattgtaagggatggagagtggcagcagacagatgggcccattgacaagtgtgtccccttgtgagctcctgtcacaactgaattattctatcatttgtgctgtcactaaatcaggcagatcgaagaagtggaaagaatagcatttctagtgacaatcacagagaaatggctctgtagcgtgtgtgctttctgggaaggggactggcttta

SEQ ID NO: 184170 - DNA, 315 bp, Homo sapiens
gcattaggtatttgtgctaatgctctccctccccttttccgcaccccctgacaggccctggtgtgtgatgttcccaggagtgggagtctctaaggggtgaaaggagagagaaaacacgctgggctagcactctgctgagttctgcactgagttagtgcctaactttgtgctgtctgcagctgtctcccctactcctgccccagggttcacttcctagaacagagccccggggaacccgggagctgtggaaagccaggtctcccttgtggttcgggaaacacagaaattcagctgaccaagagacgaagagaagta

SEQ ID NO: 184171 - DNA, 488 bp, Homo sapiens
catatcttgctagtgtaagtgaccagaatttaaatctgtaaaggttcactttttcttgctaatgctgtgaggtgtttggaagttatctctgatcttcctggtacttactataggctcattcagtttactaattaactccatctgccaccttaaaaaccccaaagtgctgggattacaggcgtgagccaccacgcccggcccagaatgcacatttctgttgtgtattttgctgactccctatttggctagaagaggaaattctgctacccaagttcacggggtcaccagcagaccagcagcaagtgccccatggccatcccaacctcctagacagggtctcggggctctcactttcccccaaacttctggctacaactagactcaaacttcggcatcttccctctccttgcgttcctctttactcttttctaggatcttagtaatccctccatcctgtcctccacctgaccacagagcggcacggtgtg

SEQ ID NO: 184172 - DNA, 698 bp, Homo sapiens
ttgcttggaacttgcttccaaggcagatgcagagctatgcaggaacttgcttggaatgaaggcagcttccactgggtgctgagtgccttattcctttctgcccacagtgcctggcagagaggaataaaacaagtagctaccatttagttaagggcttcggtgggccatgtactccatgccaggcactgtaactacaatcacccctgtggaaggctttatgtgttccctatcttagagatggggaggacaagggccagaggggaaaagtctcttgcccatgttcacccatactagcaagaggttgagctgggctttaaactcaggactacatgaagaaatatatggtctttccaaagccatgctataaagatacacagcaaaatttgtggagtgagtaaatgattcactgaatgagttagcacatgaatgaatgataaatgaagaagtgatgaaatgagttagtgaaagaatacctcatcaaatgaagaagagtctccccgttgccacccattgcccttctcttatttcctcctcctttccctctggccttcctcttccctctcctctttactgcctcttttcttctcccttatccctcccttttcttctcttacctctcctttcttccttcttctcttccctcttgcctttctcctctcctcccttccttccttgttcctctcttatctccctacttt

SEQ ID NO: 184173 - DNA, 99 bp, Homo sapiens
agagggcagacgagtcgaagcttacactgtggttgaactggagaaagcagtgcattcatagaaaattctgagaaaattattttgtttaaagaccatttt

SEQ ID NO: 184174 - DNA, 458 bp, Homo sapiens
ctcagagataatgcattttcatttccaaactacctgaataaagcaaatatagccataaagtgaatcacatgaattgtttggttttccagtgtatataatagttatgtttacactatatcatagtctattcagtgtggaatagcctatgtctgagaaaacagtatatgtaccttaattaaaactatcatatttcattgttcaattcccacctatgagtgagaatatgcggtgtttggttttttgttcttgcaatagtttactgagaatgatggtttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatacatgtgcatgtgtctt

SEQ ID NO: 184175 - DNA, 383 bp, Homo sapiens
tgcctagcacctctaagctgttttctttagacataagttttataccgtatgttctgtgttgtaatctttttatttcatcatgaacatctttgtgtattacatagtttgcaatatttttaacagttgtgtgacattccattttaaaccagtcgtattttggacatttgatcttttttttagccttgtgatggaacagtaggtctttttcagtcttttactattatacatggtcatgcagtatggattcttgtggttaaatatttgtgtacatctttacgactttctttggattaattcctagaaatggaagttatcaggaaactgcagggctatggtgaatttttccatcctgagatgtgttgcaaacattgtacactcttatt

SEQ ID NO: 184176 - DNA, 313 bp, Homo sapiens
atgaccatgtctatgtcctaggatcactggaagggtaaatgaaatgatgtatgtgagatgctaagtgcagtgcctgccttaccaggtgctcaggaaatgctggccctcccctgtggttcaagcacccagagatattttctccatgagtcagctcccagtctccctcttgccctggagcaaaagaaccaatcctgtccactaggctgtttcagcttggcaaggagccatcgaagccccctgtcctgttagctgagaaaaggtgtgtcctgggagagagaggattttgacccaggttgagatgggaggtggctct

SEQ ID NO: 184177 - DNA, 341 bp, Homo sapiens
gactgctttccatttctcaacacgccaacatggtctccctctaaacattctaacttccagcaccttcggcctggaacacttggtgctctatcttcacacagccagctctaccttcttactcaacctcaccaccagtgtttctccttgactaccctatctaagaaaggtacccctccctcactttctatcctactaccctgtttttcagtacattttaccatctgaaattatcttgttcaaatttttgtctgattcctcccatttgtatgtaagtcccaagacataaggaccttgtctgttctattcatcactgtatttccccagtgcctgtgcatagtaga

SEQ ID NO: 184178 - DNA, 488 bp, Homo sapiens
cttcatatctattcattcttctttctttatttttgtctgattgggttacttagaaagccttgttttcgagctctgaaattcttttttcttcttggtctagtctactgttaagatttttcgctgcattttgtagttccctaaatgtgtctttcacttccaaaagttctggtttgtttttctttacaatgtctgtctctttagaacatttttcattcatgtcctgaattgtttcattaatttctttatgttggttttcacctttcctttttatctccttgaataatttaataatcaaccttttgaattttttatctggtatttcaaaaatttcatcttggtttggatccattgctggagagttagtgtgatcttttgggagtgttatagaactctgttctttcatattgccagaattatttttctagtttccttcttatttgggtagactgtttcttctaattatttttgaatttgtttttgattggaca

SEQ ID NO: 184179 - DNA, 359 bp, Homo sapiens
agataaaaatagactccatgctgctgatataattactagaggctataaaagccatgcaaaatctggagagggggcgtgggaatagtcaaggaaagaacataaacaagggagcagtgacataaactaggacttcatgccatccttaattccttcacagagctccacacagtcctacagcgttccaccatgtaaaatcaggccttcattttgaacttggaaatctccccactcgcaggcagtggcaatgccagcaagccacaggtgggcaccacatgagcaggtgagaaatgccactagtaaggggaggttgaggatctggtgcctctaaaagagcacatcaatcctaattatcctgcgtg

SEQ ID NO: 184180 - DNA, 288 bp, Homo sapiens
ggaaactgaggttacaggaggttaggggatggcccgggatacccagccggtacatggtggctgtgggctaggacccaggggccgttgccccaaggctgtcctccagcaccctcaccacatcgtcagatggtcacaggaggtcctttagggatcagtggtgcctcaggcagggagcatttggggaaggctctgttgaagctgagttttgggtgcaaaagcaggtaagggaaccgcacatgcagaggccaagaggcaagacagagcccgtactttcggggaacgatgagg

SEQ ID NO: 184181 - DNA, 659 bp, Homo sapiens
aaataaggcagataggtatccttaaaataattttttccgccaggcgcagtggctcacgcctgtaatcccagcactttgggaggccgaggcgggcggatcacgaggtcaggagatcaagaccatcctggctaacacggtgaaaacccgtctctactaaaaaatacaaaaaaattagccgggcgtggtggcgggtgcctgtagtcccagctactcaggaggctgaggcaggagaatggcgtgaacccgggaggcagagcttgcagtgagccgagatcacaccactgcactccagcctgggcgacagagcaagactctgtctcaaaaaaaaaataataataataattttttcccagtagaaattattttagacttcagaaacacatgaggaagaaggaagtttatagtacccattaacgtctaaggattaacgtctaaggatcctcttgttaacactgtagtgtacttcattccaatccatgtatgtgtattttgttttcctacagatttgaagtgaaacaggtttttcctccaacctcttccccccacccagcatcatatcataggcattttcccattccactaaattttcaaaattgtttttaacagctgcatggtattcctttcaatggatgaaccataatttaactatttcccagtcg

SEQ ID NO: 184182 - DNA, 417 bp, Homo sapiens
cagaaactgtttccttaatgttctaacgggcagcaaggtttcttccccaggcctctgagccactgatgacatatcctgcccttctgttttccgtgagattgctcacaggacctcactctccctcttgctcccattgtgtatctctaaagtctcttccaattttactattcctgttctgtgccaccaccatcccgttatcttccccagctgctctcatcaggaaatttcgtgggttgcactgaaacggccccttcagaccaaaggcaatgctatgtaggctaaaatgaaatacgcagctgatgcctcggacggggcttgtgattgaggtgactgaggcagcctttctcagcatggaggaagaaaggctttcccagggcttgcaccttcctgaagtctaacacccagggcccccagccc

SEQ ID NO: 184183 - DNA, 253 bp, Homo sapiens
atgtaaccacctcctcacaagatgtaaccattccatcacaatagaatgacgcacggtctgtgtctgaggatgttttcatttaatggcaacctaaaccaaacctaagacaatcctactccaagccacgacataaacagcgctgacacatgctttcagttcacaacttcatcatcagcattcgtattttctttttttctttcttttttttttttttgagacagtgtcttgctctgtcgtacaggctggagggcag

SEQ ID NO: 184184 - DNA, 386 bp, Homo sapiens
gatgggagggataggggtaaaagagtataaaggaatcacccccagaaacccagaatcccagggctaaagaaaagccacactaggagttggagcttgcaaaagagaagggtgcatgctcctgggccattttctggtggctgcaagctcatcctcactcattaaccatctgtgtttataaccatggccatcactgcacacctctgagctcctgctctcccacttaacaagacagctaataccgtatctacctccagtctgagattcctccagaaagagctctcagttcagcatctgggagcaaccgcctgcttaagaaacattactctccccactgcctttccatagaagagtggtgatgaatgacctaacggtgagaaacaagggca

SEQ ID NO: 184185 - DNA, 815 bp, Homo sapiens
agggccacttcctgagaaatggagcatcggacaaacaccagcggggtgggaatggcaagtgctcaaggtgagcacgatgcagctgcgacctgtagactggctgcaatggggagcctggccaggagaagccagagacggacaccaaggtcagatcctgaagcacagaagaccctcagtggggatagggacctggctgcagggagcaaggtggccagtgtggacccatcaggaaggcaggggcctggtctggggaccccacagctccagctgggcagagctaccccatgctgtgctgtgccatggaataccagccaagagaccaggagcagggagcgttctgataggaacatccagctttcaggtctgacgtggcccattttaccagaagaaggggacctgctctgagcatagcagccccctctgcctggaacctcacagggctcacctccaggctagcaccctgcccctgcggctgaccctggccaggaagacacatgttagacagctggctggacttggtgcctgctgtggctgcaactcccctgggaagacagttgagtgttctgacgttggctaaactgcatctttacaacagctggggccccagcgccacctggccctgtgcccaggcaaggccctgctggtcccagcatccttctctcccacagatcttaccccggctcccaccccagcactctggccagcaccgcctccctgtttcatagtcccatcaacccctcacacactggctcccagctgctgccaccaccttgagctgtctcggatagcctcctgcccatacccctttggcctga

SEQ ID NO: 184186 - DNA, 188 bp, Homo sapiens
cagtaatggtttccaaaagatgtccacatcctcatccctagaacctcgtgaatgttacttcacatggcaaaagaatttttacagatgtgaataaattaggaatcttgagatacagagattatcctggattatctgagtgggcccagtgtattcacaaggatacttaaatgtggaagaggaagatagaa

SEQ ID NO: 184187 - DNA, 189 bp, Homo sapiens
ttacaaaattaggcagcaagccacagtttgctgatccctgatctataggttccccttcccccgcaccttgtccctgtaatacatacattgaagaatgatgtgccttcctaacatcagcgaattattcctttccagagttacaaatcttgagtagcaaagagacttaactttaatggcatcgttttagct

SEQ ID NO: 184188 - DNA, 265 bp, Homo sapiens
tgagagcaggggctattttccgctctgtgttgcatatcccataccccacatgctgcttcacatgtagtagacagaagctcaatgaatgttgatgggagtaattaattaatgaattgaacattaacctaccacagatgaattcacaagatgattagtgctagagcagtctgctgaaattggactaccctagaaaccaagttgatcggatctgacaaatgcgaaccttatttatcatggctgatgcaatgcataatatgagggttta

SEQ ID NO: 184189 - DNA, 296 bp, Homo sapiens
cttgaccatgcaaagtctgagtcagactgccaggtctcctaggctgctgccctccatacggtgactcagcaattcagcctgcgtctatctcaacacaaggcttccagaatctccaccgtggcacagaatgagagctggggagtcctgcaagggctcttcatggcctcagcctggaagtgattctcctcactcacactcagagcacattggccagaatgagtcccaggccctcatctaactgcaagggggctgggaaaagcagttttcttgggtaactgggaaggaaaggcgagtac

SEQ ID NO: 184190 - DNA, 452 bp, Homo sapiens
cattagtcctaaatattaataatatgatttctcaatgagtctgaaacattttcaagatactagaaatttgtgacagatgccttttacatctgtgagaatccagaatattattctttaaaatgcattttctcataaatagctcattaactttctcattgttctcagttgtaaatctgtaaaaagcaattttgttcccttgtctgtaataagaaatcttttgcactcattaagataattaaagcattactagtgtgcatgctcactatattcaaaacattttctacttgatatgagttgtcatggcattatcaagaccggagggggcggaaagaaaaaaataaaatagcgtcagcctatggttatgctctttgaatttgaatatgattaagtgcatctttaatttgtttctgagtcatagtttaaaataaaaactggagagcattttgtaggag

SEQ ID NO: 184191 - DNA, 367 bp, Homo sapiens
agagtaatgttgaagaattgctttattttggttatgtcattgtcctactcattataaatatcacttcctttccttctacttttctattattctacactataaatatttcaggctgtttcatagttttaaagaagtttcttgtcaggggttatgagggaacagagacacttggccatcccattacctgtttcaaatatagaatttccattctaatctgtttcacacattggtattccttttaagtttacttttaaagggactccactgcattaccttaaaataaaaagcttgctcttattgacttggaaacattctgctttctcgcagacataattctataacaatatagcttatcagacaccattta

SEQ ID NO: 184192 - DNA, 321 bp, Homo sapiens
ctttcttcaaaatgcagaaacagtgacaaggaaattcattcaccattggtcaaaggtagacacaaagtcagaaatgggactagcttgtatttatatttaagctgcttttccttgtacctttcttatatgctttattcatctgcctctccagttaaacaaagaaataactgattattatttcttttctgacaacctcacagagcacattagcctcagaaaaacagaatcacagtagcctatacaagggattgctctggcagttcttttctgaggcatgatcataaggtgtgcacaaattaaataattaattccctaggtagc

SEQ ID NO: 184193 - DNA, 304 bp, Homo sapiens
gtcggtaccggtctttcacgggtggaagtagtataggtcttatgtgaactacatgtgttcgcattttctttatcttatagattttgtctggtttttctatcagttactgagagatgtatgataaaatctcccactatgattgtggatttttctatgaattttctataagtttttctgttcttttctactttaattgcattatggtcagaagacatattctgtatgatttaaattctttaaaatgtattgcaatttactctatgagccagtatatggtcagattttaagtatgctctgtgatttc

SEQ ID NO: 184194 - DNA, 281 bp, Homo sapiens
ctatcgcccaacactgcactttcatatccatcatgtcatttaattcccacaatggtctgtctggtgcagggattattattgcacctattttacagaagaggaaactgaggccccaaaagggggagtgtcacccagacagttattggcagagcaggctctcaaaccaaacccaggttctctagtctccctgtgtcagtcctgtctcctgctgtgaaagagcatggggtttggaacaggaggggagtgacagaccttcaggggctgggtgttggggataaatc

SEQ ID NO: 184195 - DNA, 707 bp, Homo sapiens
ccaggctaaagctcctaccccatttggtttacccacagatctaattttcttgttgagaacttccgtctttccacttatttcaagaatattaacagttaccacatgaagggggcttttaatagctgctttaaaaaccattgtctgatacttccaacatctaggctatctatggattggcaactgttgtggcttttcttgagaattgaccagattttccagatttttcatattgaatatcccgaacattttgaatattatgttatgaaactttgaatcctgttaaaatcttctggagaatgttgagagttttcttgtttgtttgttttgggctagcaatcaaccataagttctatctttcctgttgtaggtggcagtttcaatcttagctaaaatataaaatcttttgctatgatgtttgggtctgcctcactcagaggttactctcacaaacgaggggtgatttatatcatagttcaattcctgaagtttttggggttatctttctttggatctggtccacacacgcacagctctaggctgaacttgggacttacgtaattcatatactgaattagtccctgtgtctggctctctcctttccaggattccgcccatgccctttagcctacaagggtcccttttcctggctcttctggccagaaagactgggtgtcttttggagttctactgcccaaacagctttttaa

SEQ ID NO: 184196 - DNA, 382 bp, Homo sapiens
ggggtttgtttttaaaatgaatgccagtggaggctaagcagaagccagggtgtgtttttattttatgtctcaaataaaaataaagagctgggtatgaataatcaaaggggcaggcgcctccctggatacttctaaaccttccaaaagcagtcccaaggctcagcaaaacgtaatatagtcaaaacaaccatgaacagcattagtaccaagggtttgccccagaaaaataacataattgccatacagattcccttgcagccccaaactccagtgcctttcaactttatattaagttaaaatatcctttgtcggtgggtagcagtcctagaaagagtattcctagaagttagaatgattgcagataataggaagatgatatcat

SEQ ID NO: 184197 - DNA, 420 bp, Homo sapiens
tgacaaccccatagtttcgaaattttgtttctgcaatccgcagctttgggaagcactgaattacaaaacctgaaaaccctcatatatgtggcggcttagaggccggcctaggctggagcggaggtcttgggaagcgctgggccgctcgtaaagtcaatggtgagtctcccggctttcggctttcggctttcggcggcagccgggtgtgaggttccacgggcaaagccagccagagggttgacagaaataactggataaatctgtgcccctgcccctgccggctcacacggctgcagcccacggctggagccaaaaataaccgcgcagttgacgccacggtttctttagcgtcttgctggagacattgactttcagagcccctgtcccgccttccattccccactacttggcagcccaccg

SEQ ID NO: 184198 - DNA, 949 bp, Homo sapiens
cctttctttttctgtatatactgtgtttattatagtagcatataataaatctcgatatggggaagaagtcctcctttatttttcaagagtagtgactaatcttggcccattgtccttccagcaaggatcaacttttaaatttcctttttttttttttggattgtcaaatttgaaaacccccacaaactcatttgggttttgatgtcaactgtattaaatctgtatgtcaatttggaaagtacagtcatcttttgatgttcatgggggattgggttcacgaccccacttgtgtggacaccaaattctgtggacgttcaattcccttgtataaaatggtatagtattggcatatgtccaacacctatgcttcagtgtaccttaaatcatctctagattacttgccgtgcctaatagaatgtaaatgctgtgtacatagttgttacactgtacttttagaactttgtattatttttgattgtgtttctttcccagaatgaccctctatatttctagttatgttttttgcctcaatgtttatgttgtctggattaatatggctatcttcactttcttttgtttagacttttctctgtttgttttttatccttttgcttttagtcttgttcctatcattttaagttatgtttcctgcacaagactaaagtataaattttaagtccagactgattgcccttctttttacttggtacatttgattcatttatatgtattagatctaccattttctgttgccttttctttcccagcttatttatgctgctgcttctctcctttttgcctttttgaattgccttgcttgtgtgtgtatatatattttttcatacaattttttctcaagtagtttggaagttgtatttgcatgtatttttagtagttgccactgaaattttactcatacatatttaacataacaaaatctgaagttaca

SEQ ID NO: 184199 - DNA, 336 bp, Homo sapiens
ttgcactgtaaggtgtgagttgtcatggtgactgacatcctgtctcattctcaatcttaggaatagctttcaaaatttaaacattaagtatgatgtttgctgtaaatttttaaaatattctatatcagattaggaagttccattctgttaggctgctaagagtttttattatgtatggtgtttaattatattcactgttatttttgtatctactaagatgatctgatgatttttctctttagttatgttaatgtggtaagttatattgattggttttcaactattaaaccaaaacatatttctgaaataaatctagcttagtcatggtgcttaagc

SEQ ID NO: 184200 - DNA, 665 bp, Homo sapiens
ccttcctgaatgctattttccatatggctgtcagaatgctcttaatcttaaaatacaaatctcatcaaatccctttaatagacccaaattgcctgaggtattaatataatgacaaaactcaacatggcaaataaggactccatgacttctggaacctcatctttctgctctatggctaatctggccttctatcatttcctcaaaagggtcaaggtccttctcatctctagtctcacttgacgctgtcccctcttcactgaatgctgtttattgctactctctatctggttaaatcccacactggtactgcagggcccaagctaactgatacagctactagaaacacagaaatcatttggattaaaaaaaaagaatcccttgatataagcaatagataaaagggaactgggatgtagtaatcagagatccatagtagaaacacacccaagttatttatatacatgtttgtgtgtacataaatatttataaaatttaatgtcatatctaagacatttatttcatttattgtatatattctccttgctcaactctatcttaggtacactatgaaagcaggaagatgtggggaggggcagaggaggggagattaatttcttacatttatcttactcttctgccttagcctgctctttgagcctaaaaac

SEQ ID NO: 184201 - DNA, 300 bp, Homo sapiens
agaggcttccctcctttgtgctcccctaatgcttaacaggcattcactgagcacccgtgacatgcaaggcacccacaacacaagtcagtgtcccctgccctcccagagggcatatgaacaaataaacggcaagactctccaatactcatccatgccccacagaaagccacccacaggcatgggagggctgttttaactgcgggtgacagggaggcctctccaagatggcagcgcttcagcaagacctgaatgaggcggccaggaggtctagggagggactttccaggagggaacaagtga

SEQ ID NO: 184202 - DNA, 413 bp, Homo sapiens
gcgtgtcttggttcactgcaacctccgcctcccaggttcaagtgattctcttacctcagcctcctgcgtagctgggattacaggcacgtgccaccatgcccggctaatttttgtatttttagtagagacgggttttggccatgttgatcatgtggatcatgtggttgtattagcttctctaaaagttttccattttgtacaaataaactgcaatttacctacctatttccctcttgctagacagtgaggtcgttccaatctttccctcacacaacagtgctgtgacagacatgccactcattctccacacccaacagagactgcttgctcagcaaacaccttccacacctccaaggtcagtcgcaattcccaagcctcacctccttagggagtgttccctgtcccacttctct

SEQ ID NO: 184203 - DNA, 498 bp, Homo sapiens
cccttcgattggcgggcacttacaaataaccttttgtggctggattatttaggtaaccatggctcatgatgatgcttatgtcatttctggaaagtgatattcttgtcattcaaaataatgatgaccttgatacctctacagcttatgatggggggatcccaagtggggtctagtcagaccgtgaactcccaaagtcatctaaccctatgtgcatttttctggaagaagggttaccactttgatcatgatctccacaatgtctgactgcaggggacattaagaatatctgctgtggagaacaaggccaggaacagccaggctgtcttgcccagcccaggcgcagcctctgggggggccgagctcagcagtcccagaggagcccttaggagcacttttggggctatgtgccttgctcagacctggcagcggaattctgcactgctgaattgagcatggggacgtcctcatttctctgaggctagacctgacatactgact

SEQ ID NO: 184204 - DNA, 890 bp, Homo sapiens
tggacctggggtgtgcagttgaatgggggtactcatcaatttctcctttaaaacaaattttacaactgtctttatttattgcttctttggcctatggagctaaaagcctgcaagcagcggggaagtaagttagaaattttactgagtgaaaaatctttggtggtgtgtggattaaccttcaggggaagtctgttaggagctgatggttttcttacctgtgaatactactgctagaactagacatttagagcttgcactacggagaaagatacattttcatttttaactttgaccttcaggtgcctttgcatattttcattgcaggcagtcttaaagatttttgttgtgagctgtgtgattaaatacgacaatggaaggaatacatgctttatactataactctctttattcccacccatctgtacgtcatttgcttttgaaattttgttctttatttctacgttccatctatgttccatgagctgtgcaactgctattctttaaaaaatactggttatgaaattgcattaacattttcatcctacaatgtgtttttttcactgcctgtgtcctacaagcctgcttttagaaattgaatcacttttataagtcatttttaattttgaaattttatgatctagctatttaatctatttctatccaggactttcccagttaccttcaacatggtcttgaaatggccctaaaaaattcccgtcttcagtgttcaaacattttgcccggtggttgtatgttttcttcccaccgctgaggcctgggtatatgtgccctatagtatttttgtgacttctgtagatatatgagccatgtttttcctttatttttgaatttttttttcctgtgctctaatggcggtaggagattgtgga

SEQ ID NO: 184205 - DNA, 672 bp, Homo sapiens
atccagaagcggcgggcatttgaaatgatgtaagccgggagtcgctctgcctgcccgtttctgcgctgcactggccgacacttaagcactggaagagaggcctggcaggaggcggcgcagtggacacgcggtccgaggacgggggcctcacccgccgccccacgcttgcctcttcctgggatgccgcaggcggggccctaactcacagcctcctcacccgggctcgtgtctgcgcccgcgacttcgactgggaggagcttctggcgccacctgcgccacggtgcgccgggccgccggcgaccgggtcgctgcgctcggcgactgccgcgctcctcggggaacgtgagggtctgagtccgggatccaggagagcagttggtgtcgggtctctgcgggggagcggggctgcgaggtggaggcgaggaccggggtgggcggaggcggggtaggtctggccgggaagtacccgaggccccgaggcatgagcgggggaaggtgaccaggacttggaatttcataaacgtccccgtcaggcgtgacgggtcgtcagggctgctatcaaagtcagtccgcccatctaccctcaaacaagccacctcctctccaccaaaacaggctgtgtaaaaagtccagctatagacgaccgccgtcgacttaatttcgaaaaagata

SEQ ID NO: 184206 - DNA, 588 bp, Homo sapiens
caccctattgagccactgcctcgatgtcctgcaaaatgtttgatctatttggcttacttaatgaacactcttggtatgagtgagtggaaaaactactgatcacaaaccccatgtatccaaatcagatgggacttaattacagaggagtctgggagtaacatcactgcacacctgatgtcttaacatgtcccaagagacaaaaggggactctcgaattaaacaaagattagttttgtttagcaagcaccttcttgcattggaagtaattagcgtcttaatccacacagatgctagacttcagaaaattggttaaaatcataactgagttagacaatcacaaggtggttttacaattttttacacacctttaacccactcagaaaaaatagtgcagctcgctgtcagcactcatttaattttacataaacatgctctttgaggctgaagtaaacctgactgattttcaacatgaaaataaaacataaaaactgttcttggagttatttctaaacagaacttgtctccaatcctaacgtaacagaaatgtatatgaggttacattaggattagagacaagagtattcttgg

SEQ ID NO: 184207 - DNA, 427 bp, Homo sapiens
ttaatcacttactaactagcatgctatatcagtgtgatggagaaacgggcaaggtattaattagttaggataacatgctaatgtgtgcattgtaacactcctgctatttaaagcaaggaagaccctgagtttgagtcttattcagaactgaagcctttttctagaatttttgttctctccaaattccatatctatgctaagctgacttgccttttgcctccctatggttgcatacttttctcctttcattatatttttcctttcagtctcggacccttgagatctagtcttctacatccatgacattctcaaaccacagaaaggaattttcccactataataataggtgtgcattacactttctttcttcgcagcaataagtgccattacttcattcaagtgttgagtacctgtgatgtgctgggca

SEQ ID NO: 184208 - DNA, 323 bp, Homo sapiens
agagggatcttgcagtagatcttaaaccctatagtattcttaagagcacaaggaaattcttatttgggttccatttacaacaaaggtggaaatttaaaactaggctgagaatttgaaatgctgttcacattaagcagtttattagggggttattttgaaatcgttcttaagtaattttaagatgtttccacatctcaaaaggatacatacatttttcttcagttttctttggagaatgtctgttcaggatgtttagcaggttgggtttcagaatttcagcggctttatggtgctgtcatccagttcgacagattgaatttgca

SEQ ID NO: 184209 - DNA, 402 bp, Homo sapiens
ccaggaaatggccagttggtggagccatcagaacacaaacaacacctactgattaagtgtgacatcttatatggctatggttcatgatgccccaaaacaattacaatagtaacattaaagatcactaattggaggcgatcataacagatatatattgagagaatctccaaaatgtgacacagagacacaaagcgagcacatgctattggaaaaatgggaccaacagacttgctcaatgcaggtttgccaaaaaccttccatttgttttaaaaaaataaaacacacaatatctgggaaatgcaatacagtgaagcacaatacaatgagatgtacttgtatgtatacttcatatttacataaaattaaaatatcagagaaataataaaatctacatagttgagt

SEQ ID NO: 184210 - DNA, 159 bp, Homo sapiens
accattcagcaagatgagccaagtctgacctcaaattagttaaacctagagtgtcttagttacccaaggtaaacagagaaactaagtaccatacatgggcagatgtatggacagttgaatgggcaggtaggctgacaaataaatgaatcaaccattcag

SEQ ID NO: 184211 - DNA, 753 bp, Homo sapiens
agccctatgacggggctccgatttgggaaggctaggcagtgattacatatggagagatgggccctgaactaatgactaagtaactgatgaaaaggaagatgtaaattttatcatccatccctttaagaaagtttcaggggctccacagaatgacaaaagtctgtaacagcctaatttacattaccatattcttttcctttgtgttcttatgaacaagatgccttctcatataataattcaacagtttctctccatttgttctattgctatttgccatgtttcctcctggccacctacgttgggtcttaaacaattcagttgataagacaaagggaggcagggttaagaacattcagacccagaaagccacacgcgcaaaggcacagaggtgcaggtctaagcctttagggaagctgaaatacttccgcatgggtggggcacagtgcaagtaggaaagagtgccttgtgcaggggtctgggtagatactccactgacccaaggctttaagcagggagagtactgcactgctatttgaattcagaataacctctctgacggtgatatggaagatacgtcagaatgtagatgatactggaggtatggaaacaaagtgggagagtgagcaataagctcataagaaaatgaaggcaggtagtacgggctgaattgtgtcccccaaaaactcatatgctgaagtcctaacctcccagcaccctagaatgtgactgtaattagagatagggttgttaaag

SEQ ID NO: 184212 - DNA, 357 bp, Homo sapiens
cgtgcagggggttaccttacttaacaaagctaccttaagaaaagcaaaggcagcacagctggcaacatttctaggtttgctcgagaacattttccaaatgctgtgagcacagcttttgctttactgagcaatatttgaggaaaagtgacaagagaacgccgggcatcccgacatgaaaaggccgaatgtcaaggcagagggacaagcctccttcaagaccacagcccagaagggagccgcggcaaaatgacaactggactctgcttgcagtttctgaccttaggtgaaaggtttcaacagggaagacaggcctcagcacccaggcaccatcccatcccatcaaagccacacacggct

SEQ ID NO: 184213 - DNA, 429 bp, Homo sapiens
tgtaggtgccttagagacatcagacaaagaaatgcatgccagctaggtaatcctttttgtggaagcgctagataagagattacgaatgctgaatggtgagctggggaaaaattaatgtttaaagttagagaaacagttgggctcagaaaaaaagaacatgaaaaagcagtatacctcagtggctaaagcactacctagctgagtggcctatttgtttctccacctgggaaaaaatggaggtagcaatactgaacaggattgttataaaggattacagagttaatattcatgaacagcttagaacacctggaatacagtaaatgctatctaagaacctgttacataaactagaggggtgacaataatggctgaagtgatacagaatggcctgttaggaagcctttgttgtagagaccagcaaagcggcct

SEQ ID NO: 184214 - DNA, 297 bp, Homo sapiens
atttaattgacattttttagttaataagggtgataagatttgaaattcaatacagaatttctgtggtggtggtaaataattgagatggcccagaacgtttaacacagtgattctaatgcaagggagaatttcatccaccctctgtgcaagccaagcctcacataggagacccaaagtgcatccacaccttggcttgtgccttgccaaccctatgcttaggctcagatctgcttcatctgtggccaggtcattcaggattacccttcctgtcaaaaccaccactgagggcaaaggtca

SEQ ID NO: 184215 - DNA, 554 bp, Homo sapiens
ccaaactgtgtgtcaatcctaacttcccacattatttaagcactggatttttctctggcattaactgaatggaacttcacctgaggacaaaattggctgttacatttgtaattatggagtaaaggttgattcttagccaaaccaggctggaaaactgaaagaattcaaaaagtaagtgtgtagatgtgacgctatcttgctgatgcaaagtttctcaagtcaaaacatttacttgaaactttggcttcctccaaagcaataattttttacattttaggagcagctttccttgtaaaagcctttacacttgtcaggccttctgccttaacaaagattgtgaattctcttctaggtgattaaaatcaattctgaattaaatacagttgccctgatcatgtcaaaaacgatgcagctgctttcctacaggttaacttatcttgcagatttaaaaatcagttgtttttaaaacttggtttgtactgccatctagtgatacatttcattgacagtttcaacatgctaaatttatatagatccacagggttatccttaag

SEQ ID NO: 184216 - DNA, 275 bp, Homo sapiens
agagcaagactctggctcaaaaacaacacacaaacaaacaaataaaaaaacattgaaaactgacttagttttcttttaaaaaaggagtaattggttttgtttatttctcccttcatattctgatatggagtcactctgtggtagtcccctccgattgatcagtattcaaggttaaacacagaacatgtcttgaaagaggcatggtgtaaaattttatagccatcttttgtgtatttggcataataaaaggaacaaaaacctaaataaaacaagaa

SEQ ID NO: 184217 - DNA, 253 bp, Homo sapiens
gacacataaatgactattcctcaaagattttaaataaacaactaggatgcgacctctaaagaaggttaatcccaactgctggccttccactgagaaatcttccctctccaaaaacagacttgtcattatacccactcacagtactctacacttcttcacagcatttatcccacctctggttaattaactaattgtgcaggcaatggattttttctctactaggatttaagtcacccctctagaagtgggcctg

SEQ ID NO: 184218 - DNA, 144 bp, Homo sapiens
aaacaatgttatttgaggacctatgtatatttatttggaactttagagtttattaaaactctcatattttcttaataaacctaagaggttaccaaggtaaatattatccacacttttataggtaaataaaaagttcagagtgat

SEQ ID NO: 184219 - DNA, 547 bp, Homo sapiens
acatctgcacagaggaatggcatgatccagctggagctataaaaaggtcactctgactgccgtgttgaggctcagccatagagggtccaggtagacagaggaggccaattaggaagttcctgtagtaatccagacggagatgacggtggctggcactggagtggagtggtggaaggtggtgagaagcagttgtattctagataaattttgaagatagaaactacaggatttgctgacagatacgatgacctcaaggtttctgggtctgaacacctggaaagatagagttgtcatttactgataatggggaaagctacattggaagcagattgggagagaaatcagttcagttttgtacatattaagtctggcaaacatcccactcatgctctcagaatagcaattgactgcatgagtctggagtttaggggaagttcgggctgtaaataaagacttggacggataggcaaatgtccgctcagcgaacattgcgagggtgtggtgttgcacacttgtggtccccagctactccggaggctgaggtggg

SEQ ID NO: 184220 - DNA, 389 bp, Homo sapiens
gtcaacaaattccattaataatttaactagctaattattatcaaacataatgatggatgtgagtaccttagattttttactttgtatcatatacctgcttctactctggaaaacagatacacataacttaaagcaaccttatggttaactctttaaaaatgaataaatcaggaatgcatcagtccagaaaacaatcacaattagcccaaagtttatggtcatgtttttcctcgttttaagagttcccattcaagatgaagcgtattcacttttcattatcactttcttataaagatcaattttttttctttgaattcaatatgtctaaaaggcttaacttcagatgtagaaattcccaaggtggggcaactctaggataaacagcagat

SEQ ID NO: 184221 - DNA, 455 bp, Homo sapiens
tatttgtgctaggcagtgtgagtagtggaaatagtgccgtcctgacagtcggggcacaagctctgcacctaataatgtgcatgaccttgaccaacttctttggacctcagtttctacgtcagtaaagtctggttacggtagatgatgtctgtgtctaaggtctaaggctctagctctcagagtccacgataacgaactttcctgggcaatttcattgcacttaatcgaggtaacgttgctgttgtcttggcatgtgatttacacagaggttcaccttaggaaggaggtgtggatggccatcggtttgccatcacagacgctaaggtctcaagtctgattgatgctgaggccaagggcaaatgcatttacaacagccagttccctttgagacctgccgcccagaagcatgactggggcaagaagattgttccattgttctggccctgtgcagcagg

SEQ ID NO: 184222 - DNA, 236 bp, Homo sapiens
tgccagcttcctttgcaggcttccttcatggtggagctttatttaaatgggactacagatatcatgtgattgttttctctgtaattcactgctaatttattgaatctgagtttctaagtattagctgtgggtattaataagtcatttagggggcaggtttatggcagcacaataaatgtatctaccttgcaggctttttgtagaaacgttcctatgttttagcagtattcagtgat

SEQ ID NO: 184223 - DNA, 617 bp, Homo sapiens
cagaggatgaggtagaagaattgcttgagcccaggagttcgaggctgcagtgagctgtgattgcgccactgcactccggcccgggcagcggtgagaccctgcctcataaggaaaaaaaaatgcccaagggaacaagggttaactgttcagtagtatttctcaaggtgtggtcttggaccacttgcagcatattgccggctcagtccagacctcctgtgcaatctctgggagggaatctgggaacctgcttttaaaaacactgtttttaagcaagggttctgaaactttagtgagaatcagaatcactgagtcctggaattgctaagagagagattgctgggtcccatccccagcttctcatctggcgggtctggagaggggctctataatctgcaagttcccagatgatgctgatgctgctggtcccagggccttactttgagaatcatcattgctggtggttgttcaccctgactgcacattagaatccaggaagacttcaaaaatccagatgccaggcagtatcctagacacattacattacaatcttaagacgtgtgggtggtaaatggagggcgaggcaatcaggcatccgagactctccaagtgtccccgga

SEQ ID NO: 184224 - DNA, 412 bp, Homo sapiens
ggtgagattggagctgctgcgtgtcaggaagggaaagtgtggctcattatgggaaaatactttattttccaaatgtgagagatgagaactgaagctgctgccgtctctcagcgggatgttttatgtggaataacagttgtctgggtttgtggtttgggttttataagaaacaagggcttgctgagtttttgatcgagtgaattaggcttaaaatggcaagatactttctaaccatgatggtgaacttgggatggaggcaggggtgactaccaagggaaagcccgaccacaggtggtcatcctgtatcactgaggcctcttgtttctgcttcctgactccattccagatgtagaatctgtggaatgaggtcaaggaaagagcaacacaaggtgcttaagatccccaagcagtt

SEQ ID NO: 184225 - DNA, 259 bp, Homo sapiens
aacattatcaacaaagtgaaaagttcccatggagtgggagaaaatatttgcaactcatatttgagttttaagtaacaaaaatgagataatgtgatacatactattctgcttctccctttctccatttcagagagaaattcagagaagctgacattttcattcgagaaatacttattgctgtctactatgttccaagcactagagaaaaagtaacgaaagaaataaccaaaacagacataatatctgctctccgatgctt

SEQ ID NO: 184226 - DNA, 245 bp, Homo sapiens
agcccacactcagaggagagctaagcctgattcctggagggaaatagggagatacttggaggctgcacaaatatcccatttctccttcaagtttacccacacattttagcattcatcagtggacccggtctgtagcagttattaccgtgatattataatgatgactttctgtttccctcatttctttacatttactatttagaattccatatggaagatttgtcccttctatcatacttcactta

SEQ ID NO: 184227 - DNA, 1055 bp, Homo sapiens
cataacacacctacccacacctcctcccctagatacggcaggacgaggctggtgtggctagggcttcctccccaggccgaggcctaggcatgaatgtggggagtgggctgtggggtttgagagaagggaggccttattcctctcctgctgctccccaccccctgccccacccaacccctccgctgagtgttttctgtgaagggctatccagagttaggatgcccttgcccaattccttcctgagacccagaaggtagggtgggagggcccaaatgggaaggtgacctaagcagaaagtctccagaaaggtcatgtcccctggccctgccttggcagaggtccccagtgacttatgctaggaggattccatctgggtagacagtctggccacaaaatcagctactggacctcagccatctctgctggaggctctgaggaggagtgagcatccctcacttgtgggggctctgtgaggaaatgtgccttccccattcccccggagtcctaggtctggagctccagggctgggagagggtgagggagatgggcaggggtgttttctctgaccttgggggcttagtctcagtcctgcctgaactttccactaggcttggaacccttccaagaaccatatttctctccttcccaccaattttcccttgatgaggctttagcagtttgctcccaccacccccagcccatttcacaactctgatcttagtccaaagcaggggacacgcccccccaccaccactttttctctctcccatctcagcctcctgtgcagttccttgcctgcccgtgcatttcctagagtctactgcctcccccctggctgggagggtgtctgggggggatctttcaggggccctggcacccagggcctgtgctggcctaggagtgctgaccagaaggctgctctgttcccccccacccccgttgctttctggccccctctttggagccagccacccacagggctttggtgcctcagaagcagtgggctgccgggtcacagccgcaggctgcaaaagaccctcggagggagcatggag

SEQ ID NO: 184228 - DNA, 690 bp, Homo sapiens
cataacacacctacccacacctcctcccctagatacggcaggacgaggctggtgtggctagggcttcctccccaggccgaggcctaggcatgaatgtggggagtgggctgtggggtttgagagaagggaggccttattcctctcctgctgctccccaccccctgccccacccaacccctccgctgagggtgttttctctgaccttgggggcttagtctcagtcctgcctgaactttccactaggcttggaacccttccaagaaccatatttctctccttcccaccaattttcccttgatgaggctttagcagtttgctcccaccacccccagcccatttcacaactctgatcttagtccaaagcaggggacacgcccccccaccaccactttttctctctcccatctcagcctcctgtgcagttccttgcctgcccgtgcatttcctagagtctactgcctcccccctggctgggagggtgtctgggggggatctttcaggggccctggcacccagggcctgtgctggcctaggagtgctgaccagaaggctgctctgttcccccccacccccgttgctttctggccccctctttggagccagccacccacagggctttggtgcctcagaagcagtgggctgccgggtcacagccgcaggctgcaaaagaccctcggagggagcatggag

SEQ ID NO: 184229 - DNA, 302 bp, Homo sapiens
tgttatatcctcttggtaaattgatccctttagcattatataatgaccttctttgtctcattttatagtttttgacttaaagtctgttttgtctaacttaaatacagctactcctgcttgcatttcttttccgcttgcatggaatgaatgactttctccatctcttcactttcagtttatatgtgtctttacaggtgaagtgaatttctcataggcagcatatatttggattgttaaaaaattcagtattttaaatataggaggtacatgtgagatttgttacatgggtatattacacccag

SEQ ID NO: 184230 - DNA, 181 bp, Homo sapiens
atttatgaagatccttgtttccgtagtaacactcacacttgtgcatttaatatattttgtgcaattaatataacctttatatactaacctaggagagcagtttgacttcctaataataactaagcactagatatgattctaaccccaaaatacagctcaattaaaatccttttttaaaagt

SEQ ID NO: 184231 - DNA, 458 bp, Homo sapiens
aacttagaaggcaagtgacttaccaaagaccacccaaccggaagtgtcagtatctggaattgaatcagggtctctgggaccaaagtccaaatctgttctactctatggattaggatgtttaaggcttgtgtgcacaaggctttcagaatcaacacatctaggctatttcaattttggatgctctctgataccttagacaagcgtatcatgaagctgcatcccttcagatcaccaggcttattactgagtctgagcttaagcaatggaccctaagaaagtgatatcatgtgtccaatattttagaaataatggcatcttagtccattctggctgctataacaaaacagcataacctgggtagcaaataagcaacaaatttacttctcacggttctagagtctgagaagtccaagatcaagggatcagcagatttcgtgtctagtgagggccctctctcc

SEQ ID NO: 184232 - DNA, 359 bp, Homo sapiens
ctattaaaattttttgtagagatgatgtcttgctatgttgcccaggctggtctcgaactcctggactcaagctatcctcttgccttgacctcccaaagtctgggattacagatgcgcgtgccaccacgcccagctaatttttgtatttttagtacagacggggttttgccgtgttggtcaggctggtcttgaactcctgacctcaggtgatccacctgcctcggcctcccaacttgctgggattacaggtgtgagccaccgtgcccagccaaagaagagattttaaaaggacatcagtattcttggtgtcactggatttttaaaaataaataatagaaacaaggagtataaaacaattt

SEQ ID NO: 184233 - DNA, 410 bp, Homo sapiens
acagccacggtgctttcagacatgaccccagagccactgcttagggagtgtggctcttccctcgcggctgccaggcttcacccgcttcctggccccagggcccaccattgctcaatcctcctgagtcacctggtgacctgggcctgacattgggtggttgtgacgtgctttagttggaaaggggctcttgtgcccccggactctggctgagcagtggcctgtgctcatgggctgggcgtgacaggtcgcaggtgcaggagcaggcactgcctctggtgccctgatgaccacagcggcctgccccgaacaactcacagcagaaggtgtgtttaggaccagcttaccttaaagtgacacagaattcgagtaaggtctttcagaggatctcaaatatttcattctgattaaaa

SEQ ID NO: 184234 - DNA, 409 bp, Homo sapiens
ctggtatttttttgagcttcgaataggcagccatggttgagagccactgacctaaatcttcttttctaggctctacctggcctcatgccaatggcatgcagaacctcttagccctcaacccttctaaacagccaggtcctttctaatgggcaccagctatagctcctggcatccagatcatagctactgtttgtgttctgaatttaatgactttctattataagctgattgtgagagctcctgtctggttacttccttttggtcatttttttcttaaaaagcatttacaaaagtaatgaatattaattcaacatttttgtatgtttcgtctagataggtatgtaaccaaattgtgattgtactttttgtaaccagccttttcacttaacagcatattgtgataatttcc

SEQ ID NO: 184235 - DNA, 647 bp, Homo sapiens
agaagcatcccaagagatagcaggagaaagttgtcttgccttttgaaaactggcttcgcaaggcccatagcagatcttcccctgtgctccactagttgagacagtcacgaagccccacccagtttcaaagaaggggacagagactccatttcctgatgtgtgagtggcaaggttctggaagagtatgtggaatggaaagcattattgcaaccatttggggaaaatacaacttgctgctggcaggaaggtcatttcaggcagagatcttcattgatggtaccttcagaaatgcatttttaggaaagaaagtggtttttacagacttggcattgctaagggaaaacataaggttttagaagtatttactgagccatcttcaccaagacttatgagaaacatttcttcgaagagaagatgctgaggaagaggaagatgacttttgaagtggactccaaggggcagacaggaggctgggatggatggcagctcacagctggcaaaggcagtggactagcaatcatgggtgaaggcctaccaagactgattcttagaggggggagaattgactttgtgttcttatagcaagtgaccaggaataaccagatgctgtgtccaagctgagtcctcaaaaacagtagtaggcaggg

SEQ ID NO: 184236 - DNA, 417 bp, Homo sapiens
ggccttttccatttcattgcaaatggtaagcacattttcacgttgcccaacccccatagttgatgggtgacttcccaatttcatcctctgctcagcctttgtcaatgtcttcagccattccttccaagaaactgttctggtttctgcaatgtgatctattcttagcccatgctggcgagtcttaagctctcaagttttcatcgaagtgacttagtagtctggtctcaataaataactgcaatttgtgtgtgtgtgtcttcccccaaggacacatcttaaccttacaaagacagaagctttcacaactgcagttgcattttcaggaagagcacttgagccccggagtttgaaactatagtgagccatgatcgcaccacttcactccagcatgggcagtgggatgagaagctgtctctt

SEQ ID NO: 184237 - DNA, 1261 bp, Homo sapiens
tttagaacccactttaggtaaatggaaacattttttggccatgttactccatgaagaaaagcaaataaccaaatggcagagagggcaaggatgagttaggcttcagaaacaattgggactggatattgaataccttcattattgtctttacttcttggtcttgcttacctctgttccagtggcttttgttgttgttgttgttttatggtgcagtttctcagtaaagcagtaaatatggctgttaacagcatttgaattttagaaacatctaccacttttctcatttctagtttaacaaaaaatcctagggaagatttctttgttccagcttggataaggtgtttcctcttgggctaacctgttacacttactaggagtgtttagagcaaggccaccagtgcacatctgcgggggagcatcatttacaataaatacaatgttgtgctctagaggcctgtttacgtatgcaggtcacatgctcctaagaaataaaaaggtatatcttacaatagcccatttatcaaatgcctggttctcatggagatctcttaacattgtgcattagcagttttccattttttttcaaatctgaaatcatggtgtttatcaatccttgcagttagtagtgaaatttggtgttgcccttcatgatgccaaataacgtttctaattttctgcttatttttgctttctgtttcattgactgtttctttgaaggcaccacattttggcattttaacgtgaaacatggtactctctgtcaacacttgtggcaccctcagaattgttacttgcatgccttttgtgagacaagagaggacaaagactaatagtaaagaagttggctgagtggctttatctgcgtggtaggagagatcagcagattgagtaccaggaaagcacagaatgacatgttagtttttatagctgaataaacaatcagcctcttctattaactacccattgtaataactgcattcttaagtaccaaagtgaatttatatattctgagacaaacagtgctctaacaaagcagtatcaaatgaggtatatgggtgtatgtctagaaaaataatgttagtggtagttttccctttgtgggaagattatagaatacttttttttctttcctgcatgttatagggtggtttttctttttggggggcggattttgaaactgtattgcttttttatgattagaaataaagttataaagtagatttacacttaatgtatctggtatatggaaagaacaccaatg

SEQ ID NO: 184238 - DNA, 1315 bp, Homo sapiens
tttagaacccactttaggtaaatggaaacattttttggccatgttactccatgaagaaaagcaaataaccaaatggcagagagggcaaggatgagttaggcttcagaaacaattgggactggatattgaataccttcattattgtctttacttcttggtcttgcttacctctgttccagtggcttttgttgttgttgttgttttatggtgcagtttctcagtaaagcagtaaatatggctgttaacagcatttgaattttagaaacatctaccacttttctcatttctagtttaacaaaaaatcctagggaagatttctttgttccagcttggataaggtgtttcctcttgggctaacctgttacacttactaggagtgtttagagcaaggccaccagtgcacatctgcgggggagcatcatttacaataaatacaatgttgtgctctagaggcctgtttacgtatgcaggtcacatgctcctaagaaataaaaaggtatatcttacaatagcccatttatcaaaaaatcattttcctgaaattggtaacaatattaaatcattgctatatgggattaatgcctggttctcatggagatctcttaacattgtgcattagcagttttccattttttttcaaatctgaaatcatggtgtttatcaatccttgcagttagtagtgaaatttggtgttgcccttcatgatgccaaataacgtttctaattttctgcttatttttgctttctgtttcattgactgtttctttgaaggcaccacattttggcattttaacgtgaaacatggtactctctgtcaacacttgtggcaccctcagaattgttacttgcatgccttttgtgagacaagagaggacaaagactaatagtaaagaagttggctgagtggctttatctgcgtggtaggagagatcagcagattgagtaccaggaaagcacagaatgacatgttagtttttatagctgaataaacaatcagcctcttctattaactacccattgtaataactgcattcttaagtaccaaagtgaatttatatattctgagacaaacagtgctctaacaaagcagtatcaaatgaggtatatgggtgtatgtctagaaaaataatgttagtggtagttttccctttgtgggaagattatagaatacttttttttctttcctgcatgttatagggtggtttttctttttggggggcggattttgaaactgtattgcttttttatgattagaaataaagttataaagtagatttacacttaatgtatctggtatatggaaagaacaccaatg

SEQ ID NO: 184239 - DNA, 326 bp, Homo sapiens
gcaagtgaggatgctgtggttgtgactatagtagcccaggacgaagtctccatggcccttggcagtgattcctcactgaatgttacctggtatgtattcccatccacatcttcatgtttggcccagacatatgccacatagtccttgcaatggcggaaacccacccggtataagccgatccagtcggtcgccttgtgaactaagatgcagatggagaagagcagacacagacacaggtcttggggcccctgcaggggtttctcactggctttttccccctggattcctatgggttctggggaacagagttaggtcggctggcaaga

SEQ ID NO: 184240 - DNA, 899 bp, Homo sapiens
gagggggatttggatatagttaatgtgaaggaggtttaccttatggtgatgagactaaaatttttgtcatttttaaggaaattagcatgtttaagtcactaatatgttgggaatgtggtaggaaaaaactatactgggcccaatctcctctgttaggttagagtcataaaatattaatgtttttgaaatttgtgtatgaggtgcaaatcactatggtggatgttgggagattagaaagataattactccacttctttttgggagtctaagtaatggcaactcttgagagtcttccttactttcagtagtaacagtattcacatgtagtttatgtattgctaaattttgtatttgtgacaattattctctttgttttgcaaatggtacattgtaacctgttctagagcagagacttcctgtagtctctagggaaactaacagcaggttgattcttaagtgcttaataaatacctgttgaatgactgatagaaagtagtgttcactgttagtgataatagtgggattgtatgaaatggtgattagtggttatatgtaccagacctgtactaaggccatgtattgccttatttcacttaatcacctcccagtaaatactttttatagcttggaaatgagaacccaaagaggtacgaacagttttcgacgagcggtcagatcccggtgtgagcactggccgagccaagaaggaccctttgttgttgctgtgggttgagaagggcgctctcggagcacgggactcaccggggcaagatcctcttttaaatcaaacatgggggcgtggcgctgtccacttgaggaggcgaaccaacccacgcggatgcggacaaccagacccgggcggagacgcaacaaaaaactggcacgcacaagggggaaga

SEQ ID NO: 184241 - DNA, 539 bp, Homo sapiens
gttcctttcagctatacaaatgatttagatgaagagcagaggatttagaatcaggtcaatctgtgttcaggttctgcgtcagccactttgtagttctgaggcttggggcaagtgaccgagctctgctgcctgacttccatcgcctgttattgaacagctgtgacaggcaggctgatatggtttggatttgttttggatttgtgtccctgcccaaatctcatgttgaactgtaatccccagtgttggcagcagggcctgctgggaggtgattggatcatgggaagtggtccttcatgaatggtttggcacccgttccttggtgctgttcgagatagttatcacaagatctgttgtttaaaagtgtgtagcaccttcccccctcactctctcttcctcctgctcttggccataagaagtgcttgttcccccttcaccttccatcatgattgtaagtttccagaagctgagcagaagccgctatgcttcccgtgcagcctgcagaactgtaagccaattaaacctcttttctttataaatta

SEQ ID NO: 184242 - DNA, 464 bp, Homo sapiens
aactgagtggactcatgactcacttgtaatcaacagaaagggctggaagtgacacattaccacttctaagtgcatgtcgtagaaggctatgaaactttttttttttgtcagctgggacacttgcttctggagccctcgccactttgtgagaggtctagtgtcctatgctgggatatcagacaggtctcccagttgacagctccagctgacgtcccagccaacagccaacatcaattgctagcctatgaataaagatgcctcaaggtggttccagcccataactctcaaattacccctggttgacgactctccccatttaagactttagacattgtgaacatgagacaagccattccctctgtgtcttatccaaatttatgatccatagagtccaaactttttttttctagctgttaaatttagcagtcagcagcagtaaccagaacacacttggacatcttttt

SEQ ID NO: 184243 - DNA, 283 bp, Homo sapiens
gtaaaacaaaaattaacttaaagcaaaacaatgttaattccagctagatccagttggaagacaaagccccagtgtaaaccctattctctctttgtcaaaaagagatagtagcaagtttagggagttgttaatgagaaaacaccaaactgagacttttcctttcacataatcaagaagataacgcagaagactgaaagagcattgaaaagggcataaatttccaccacatgactcaatactcttgaaggccatcacatccctgccacctaaatcatgccatgta

SEQ ID NO: 184244 - DNA, 552 bp, Homo sapiens
tatagactcttgcagaacttgaggtacctcaaacctcagcccctagaggaaacccagctcagctgcctggtgcagcggggaggaagtctgtcctgctctcacctcttcttgaccctgacctgcagtcctttaccaaatcctggtcactgaagtattcaaatacttgtctgtccttcccttcttgaatacggtcactgcccacaacatgggccgcgtggacaaggaccatagccaactgctcattggcttccagtaaatccagccttcagctatctaatccctggcctgctcacaaaccctccatgactccctatcaccccaagaaggaaagtcccagctcctccacctggcattcaaggctctgccaacctcacccttcctcccatcaatcaattttttttttttttttaggggcagtgtctctctctgtcacctgggctggaatgcagtggtgcaatcatagctgactgtaacctcaaattcctgggcttgaccaggctcagtggctcacacctataatcccagcactttgggaaactgaggcaggaggat

SEQ ID NO: 184245 - DNA, 614 bp, Homo sapiens
tatagactcttgcagaacttgaggtacctcaaacctcagcccctagaggaaacccagctcagctgcctggtgcagcggggaggaagtctgtcctgctctcacctcttcttgaccctgacctgcagtcctttaccaaatcctggtcactgaagtattcaaatacttgtctgtccttcccttcttgaatacggtcactgcccacaacatgggccgcgtggacaaggaccatagccaactgctcattggcttccagtaaatccagccttcagctatctaatccctggcctgctcacaaaccctccatgactccctatcaccccaagaaggaaagtcccagctcctccacctggcattcaaggctctgccaacctcacccttcctcccatcaatcaattttttttttttttttaggggcagtgtctctctctgtcacctgggctggaatgcagtggtgcaatcatagctgactgtaacctccgccaccggggttcaagtgagtctccgtgcctgggcttcctgagtagtggggattacaggtgtgcaccaccatgcccagctaattttggtatttttagtagagatggggtttcaccatgtgggccaggcggttcttg

SEQ ID NO: 184246 - DNA, 200 bp, Homo sapiens
atagaagaatgtattggtgcttcaaactgattattactttttacctccttgatgaactcaatatattattaagagagtggctcagtttcaaccctggaggcatcaaaaagaacaagttctaaataacatcctcctttagaatgcagcatattttaactgtgtctctccatcttgcacatcaccacttccaagctccatct

SEQ ID NO: 184247 - DNA, 492 bp, Homo sapiens
aagagaggccagaggtcagggatcagggaggcatgagaaggtgcagcttctggcccaccctcagaggtactcggacaggtggggcactgtgggatcagagagggaagggcatctggctgaggccacagagccagtctcggggagccgacagggggcagaggggctcatgcagggctatgggtgctgctgctgagctctcatggggcaccttcaggtcagacactgacgacttcaccagccctggggaagctcaggccacatcaagttgagagacagtagagatagaaatggttaattgtatgtcatgtgaatttcatctcaataaaatcaatcagttatttccgcctcccattcctcccaccagtgctgtgagtgctctcacagaggtggttagatgaagagacaagcagtcagggggctgtgtgcagtgctagaaggatgcttagaaataccttagtacatggctgggtgcagcggctcacatctgtaatc

SEQ ID NO: 184248 - DNA, 203 bp, Homo sapiens
cgatctagaggatcctcgaggtgccttagaatacattgagaaacatggtgactccacctcaaaagcatttagcagtgaaatgagcaccacgactgtcttatttttactgaagtcagaatcaacagtaaacttgtaagggccaccacagacgtgtgactacggggcacagagcatttgctccaagggccaaagtggcctcttcc

SEQ ID NO: 184249 - DNA, 472 bp, Homo sapiens
ccatttggaatttttcccttgagcatacacagatatagtcatgagtggcagctgtgatagcacagcttctgaaggagagaaagcaactaaggactgccttgaaaatatttaaggagttatttgagctgctgtgttgcaagttcgcctaattagagtggctactttcctttgtattctcttggcaatgtacagggattccgatgaattggattgagagtaagaggttgacatccaagctccatgtatttttgtgaagttaacattggcaatgatatctggaacttagttcttttctacagttggccatgtgggtttttttatttacatacatttatgaggtacatgtgcaatttgttacatgcgtagtaggtggcagtgttttaaacaatggatttcacctctcctttgaatgcttgtttgagaaaagtaattcaaatcctatctaaataaatacatttatataatcatgaca

SEQ ID NO: 184250 - DNA, 416 bp, Homo sapiens
tcactgcaacctctgcctcctgggttctgggttcaagcaattctcctgcctcagcctcctgagtagctggaataataggtgtgggccaccacacccagctgatttttgtaattttagtagagacagggttttaccatgttgcccaggctggtctcaaactcctgacctcaagtgatttgcccacttcggcctcccaaggtgctaggattacaggtgtgagccagcacacctggcctgtatttacttttttgacagtcatcactgtcttaaatgctaattttatgaatacatggacataggccaatgtaagatgggttgtggggtgaatttgtagttagacctttacaccagactgtgttggtttgtacagtgagggctttagtagtgggctatagggtaccagattgtttgcttgc

SEQ ID NO: 184251 - DNA, 169 bp, Homo sapiens
gtgtacagatgtggcaggcaaagcccagggagtctctagggcctgcagaagggaatgaagcattgtaagagctggatccctgtggtttacccttcgtgccaatgcttatagtgagctgaaaggctttggtcagaaatcttactagacatttcagcttttgcagcacaaa

SEQ ID NO: 184252 - DNA, 244 bp, Homo sapiens
taactcccactcacatctctacccagagatcaagaccagaccaattctccactaatatctccaaatgggcgaggtgcagtggttcacatctgtaatctcaacacttctagaggccgaggtgggaggattgcttgaagccaggaggtggaggctgcagtgagccaagatcacatcactgccctccagtccgggtgacagaatgaaatctcgtctcaaaaaaaaaaaaaaaaaaaatctccaactg

SEQ ID NO: 184253 - DNA, 314 bp, Homo sapiens
gcatattcctttcgaagcatagtttctgtagtttttcctggcctgtaaccaataagctagagtatgaaagcaaagtactgtggcccctaactcttaactttgtctttaagcagaatctagggaaaaagtgaaaaggaggaaaggattctagaaagactttgaatgttgatggaactaatgcaaattttgtagagagaaatagagttgttaaatacataaacttgtatatcgtcatgtatttttttatggcacctgaaaaatgcaatataccatttgatgtcatgatagttgtattgccaggtgtcatggctgat

SEQ ID NO: 184254 - DNA, 329 bp, Homo sapiens
ttggttgacgtggctttatatctccaatgcataagatggtactagcacataataagcattcaataaatatttgtcaaataaattaaatctactcaaccggttcttactcacaaaataaccagtaatggcctgtaacctaataaaactttgctaccctttcataagttattctttttcaaaaggtgttttaaatgattttgttttcaacaaattgaatagacaatatctaaaataattattccaggcacgctaagcctccacaagcaccattctctttggctctctccttttcctgggacattgattcatttcctttgttttaagcccca

SEQ ID NO: 184255 - DNA, 231 bp, Homo sapiens
tagagataggctacagcagatcttctggatcagaaggaggggctgccaagacttaagcttctcatcttgtgctgacccctggctgcaggtgaaggtggtgcacctggctgcaggtgtggtggataagggagggtttgatgcttggcctctgatctggactctggttgagactttggctcttcctagccatatgatttaggaccagatccctaacgtcatggagtcctaact

SEQ ID NO: 184256 - DNA, 366 bp, Homo sapiens
gtaaccagagacccttagagaaatggcaggctctaggactgggacagaggatgtacagaataaacctggagcgttttgcagtgctagaaagtaaggaagtgctcaaaacaagtaaacaagcaaactgccagtgatgggcgtatgtcaaaaggacaacagagccaactgaaagagctcccaggggccaaaggtggaagaatttgagcaacaaaataaataaagtggtattggatcatagcccaaagcagaaaacaaatatccatgagtctatactgatataagtaaatgattgaacaattgttaataaataagtgggaagaacggacaaatctcccatgatgcaggagagtaccaaataatttttat

SEQ ID NO: 184257 - DNA, 489 bp, Homo sapiens
  misc_feature (187)..(187): n is a, c, g, or t
  misc_feature (203)..(203): n is a, c, g, or t
tccctttcacgtaaaaatattcatttaaaagcaatagttaaatatagatgaaaaatgacctaaatcctcaaatgtagcgttgggtgtggtggtgtgtgcctgcaatttcaccttatctgggaggctgaggtgggaaaacccccccaggccaggtttccaagaccagcctgggcaacatagtgagaanctcatctctacaaagnaaaaaaattttaacaattagctgggaatggtggtgtgtgcctgagtcccagctactggagaggctgaggtggggcgatggtttgagcccaggagtttgaggctgtagtgagctaccattgtaccactgcactacagcctgggtgactaagcaagactctgctctgttagaactctctcaatgagtaaaccagaaaagttcagaataaatatttctgaactctgaagagcataacttaaaacattgtactgtgtttatatgtactataatatcaaggaacaataatt

SEQ ID NO: 184258 - DNA, 286 bp, Homo sapiens
gaactattgaaaggtttgaatagggcagaggcataatgagattggtgagactgttcctgcaattgagggggagggcagtagtgatgaggcttgtatcatttattgaggagggaacccaatatactctcaggttataaataacttctgtcattactttatggtatgactttcctggaagtacagacttctaggggataaagaaacatcttaaggcccaggcatggtggctcatgcctgtaatcccagcattttgggaggctgaggctggtagattccttgagctcag

SEQ ID NO: 184259 - DNA, 319 bp, Homo sapiens
gataagagtccccacaacaaagagtcttggccacctcttagcacaatcagctaaaccaagatttcccccattcacaaccttagattgagttggcaatggatatagtggtcatttcccttccaggactctgcacctgcttcccttgccccaactgcacagatacccagctccaagcagccctatttagacacccacacccagaaacgatgaaagaaatcatcactgtttacagagcccccagtccattatggtggtgtgatggtttctagcaaatacacacttaccaggccacttgggagtgaccgtgtgatttccagct

SEQ ID NO: 184260 - DNA, 552 bp, Homo sapiens
tgtagaggatccctggaataatactcaaccataaaaaggagtaaatgcaacaacatgggtaaatttcacggacatgacaccgagtaaaagaagccagacccaaaagagtccatcctgtatgaattcatttatataaaagtccattacaggcaaaactagtctacagtgggagaactctagaaatttccatggtgatcaaatcacacttctgtgtctatttgtcaaaattgtacgctaagatttgcatatttgaatgtacataaactttacctaaaaaatagaatttaaaagctccagtgggggatggggagaagatggagttagaaatgaaacaagaatggcagaatgatgataattgctgaagctgggtgatgagtacatgggactcattatactacgctgattattttgtatacgtttggaattttccacagtaattttttaaggtaaaatgtttaaggaatgtgttattgcctatgattctcagttttaaccaacttttttgatgaactgataaactccctgccccagtgtggagagaggggtaccgag

SEQ ID NO: 184261 - DNA, 558 bp, Homo sapiens
ccgatatcctaagctgacaacctaagaggatcgcacatactgttttggtctttctatcatcaaacagcatttcttatgctatcatcccatttttaaatattttccaatatactggtaagatcctatttttgttgttgttttatagtttttattcttataagctacctcaaaccatccatgaaacatggcgcagtatgaaaattaaaaatcaacacatacttggccaggcatggtgactcatgcctgtaatcccagcactttgggaggccaaggtgggaggattgtttgagcccaggagttcaagaaaagcctgggaaacatggcaaaatcctatctataaaaaatacaaaaattagccgggtgtggtggtgcctgtagtcccagctgctcaggaggctgagcctggggaggttgaggctgcagtgagccatgatcacaccactgcactccaagctgggtgacagaatgagactccatctcaaaaataagtgaaagtaacactattggattgcctgtggtgtgtacatttatataaaatcagatatagccacagattgt

SEQ ID NO: 184262 - DNA, 548 bp, Homo sapiens
agaggtagccggacactcgtgagcagggctcatatgtccagctgagcgagtgcaggcttcactgctcatactgaagccctactatgtgccagtaaagagagcaggcaaagctgtggacaacctggtccctactccccctgttgctgacagtgtgcaggacatgtcaccccaagacatagcacctcggaaatggagaaaacatcagaagcaggaaggccactgtctgcctttcccaggccttgctgtatgaccactggcgtgaaaggattctctgacccactcccctgaaagtagagaccctcatgtgacaggtgtcctgacctgtacccagaggaaaggaatgaagacacagaactgccaagacgcatctgaacaaacagggccttgctgagcacctccagtttaggaccctgagatcacaccccctctctccaatcacacgactgtccactctccagcaaacctaggcagaaaaatgcatcgttttcctgtgtctttgagtcttgatttctgaaggttcgcatgtcacataaaacttagatggaatc

SEQ ID NO: 184263 - DNA, 594 bp, Homo sapiens
gtgattgacaaggtgaagcaagtcacgtgatcacgggacagggtgcccttccctcttaggtagccgaagcagagacagaaggcagcatacgtcagtgttttcttctatgcacttctaagatcaaagactttaagactttcactatttcttctaccgctatctactatgaacttcaaagaggaaccaggagtatgggaggagaatgaaagtgaaggaggagtgtaagcattgaagcacagcaccacagggaggggtttaggcctcgggatgactgcgggcaggcctggataatatccagccttccacaagaagctggtggagcagagtgttccctgactcctccaaggaaaggagactccctttcgtggtctgctaagtaacgggtgccttcccagacactggcgttaccgcttgaccaaggacccctcaagcggccctgatgcgcgcgtgacagagggctcacctcttgccttctaggtcacttctcaccatgtcccttcagcacctgaccctatacctgccggttattcctagcttacattagtaatgcagcaaagagtaatattaaaagctaatgattaataatgtttataa

SEQ ID NO: 184264 - DNA, 300 bp, Homo sapiens
tcagctcactgaagtacagggggctgagactgagttgagacaggcaccttttctactttgcacaaaagcatcccttaggcaagcagttgtcctgcccaagagccttttcttctttcattctccaccatctcctgtcatgcctcccacccttctcccatgctcctcatctggttaacagcttcacactctatgaggaaggcatctggccccagagactcaatctgttttctctgttacatgctcataagagccatcttcccttccttcagaacagagctcttaatgtgccttgcccgctta

SEQ ID NO: 184265 - DNA, 492 bp, Homo sapiens
cccaatccattaatcttaggttgaactttaagaagggaaaaagtcatattcttaccaatttaaacttgctcagtatttaggattgaaaataaaacccaagcaaaaaaaacaataaaaccaatcacaacaaaactttctgtgctaatttgagaaataaaaatttagtcatcaatgacccaaagagataactctcagttgctttcacacttttatagaactattatacctgagaaatattttagacgacggaatcactgtttgtaaaatctaagtattataattcatggatctgaaacgtaaatgacatctcaaccatttttgtcttagtggtgcaaaagttgagggccaaaggtctgcagcccatatgtatttttgtgtatttaatcttacctcaggtttattatttccctgcctgcaccaagactccctcaattatctacctcattctttttatgtctatcagcaaaccagtctaaatcttttaagaaaatg

SEQ ID NO: 184266 - DNA, 426 bp, Homo sapiens
ataaataatgcttctgtgaacattcatgtacaggctttcattgcttttgtgtatacatctaggaatggaattgctgggtcatacagtaacttggtatttaacctcttgagcaacacatggtcttaatcactacacaggatatttcacacagtggatatgaagtcacaactgtctctcaagattttggggttgttattgcctcttacattctaaaaactttgtgtttttcttgttttgaaattcaacatactgttatttcagcataaaatggaacttggctaatttgaagcttgaggtcaacacattttaatgaatctatgatatgtgccaaggactattataagatctatgatggatacagggaaaaaaatatatttctatgaacagtctttatagctttaataaaccctcattgagcatccacca

SEQ ID NO: 184267 - DNA, 224 bp, Homo sapiens
caggacttgtgcaattacgatagtttcttacaaaagataaggaagaacaaaagagatcaggacctgaaatatcaacaaactcctgggaaaagcacaggaagaacatcttgagggaagtatggttaagagctatggtgctagaacagagacctggattcaaatcccaagaaaatggatgacttccttcgcttgtcttattccttatgtgtaaaacaaaatctata

SEQ ID NO: 184268 - DNA, 296 bp, Homo sapiens
cagtgtctagttgaggcccccatgtcctggccctgctgctgagtaaagggccagcctagaaggctgacaggtgctagagctccaataggagtggacccacagtggcctgtggcagagtctgggggcccaccagtgccataggtgaagctttgtgatgcggccagttcaccgttttgctctgaatccatggtggcgggtactagggaccctgctgcctgtctgggtcagaatctctggtgacagtgagtgctctagcacaaaaggaaaagagaaggagaaagaagacaccctgaagt

SEQ ID NO: 184269 - DNA, 254 bp, Homo sapiens
taatgcatatgatagtagtaatattataaacttgatactttaggcccttttggttcaaacctttgtgatacttttaatgatgcaaagtgcctatttgtaagcctggatattagtctctatctttttgcatctcatataaaagaattgattttttaaatgtgatgttcatttatattaattgctttggaaatttgctctgtgggcttcataataccaaagaccagaatagctcatggccgcttttgccaaaaatc

SEQ ID NO: 184270 - DNA, 385 bp, Homo sapiens
ctaagagagatgggagttgtgggagggcgtggagcagaggagggatgtttctgagcttcttaaagcaccactctgatggctcggtaagaacggactagagagatcagtcaggaagctgtcgctatagcctaggcgagaggcagtggtgggcccaagtagagtggttgccacagaggtggtggaagtggtcagtgcctgcctgaattttgaaggtaagtccaagaggctgtgctaacagattgggtatgggatgtcagtgaaggaaaaggagtgtgccaggtgtggtggtgcatgcccatagttgcagtcacttgggaagctgaggcaggaagattgagcccaggaatttgagtccagttttgggcaacatagtgagaccctgttt

SEQ ID NO: 184271 - DNA, 452 bp, Homo sapiens
ctggtcgcctggctcctccacgtgcacttgatgctccagccagatagactgtgcacacctgggcagagggagtgctggtgagtgcacatgtctacgtgtgtgtctgtgtgcggtgtgcacgcgttcctgcgcaggcaccctgtgggtgcatgcactagtgactgtcaatcctctgtctgtgggctggctcccataatccatgctacgtcctgaattccactgccggtttttctgttcaccaatctcaaggacctggcttcagtttctctggtaaccaacctcagcccttagcttcaacctctgagcacaggaagacagccagagtggggaggggtgttgtctcacccacagggcccctgccggagctgagcaccccaatgggatgagtggcagcacggttaccaagacaacagaactctcgacccctttccacctgcaaggctcttctccct

SEQ ID NO: 184272 - DNA, 175 bp, Homo sapiens
agggctgttggaacataattagtaaagtggcattaggttccctaactgccaaggagaaaaaacctgagttttgtgatatttttaggaagaaataatttaaagtctttgttgactctccaattttaaatagtgaaaggacaatttgatgttataattgttttaagtcactgcctgg

SEQ ID NO: 184273 - DNA, 531 bp, Homo sapiens
tacctagaggtatctatgcatacataattcctgacttattgtccctccctccccacctagatgctgagctctatgagtatccagtactgaatatccagcatgacctgagagttcagcataggtggggaggaagagacagagagcaggctcctgttcagcactcctcttcagcgctatagcccccaagagctagaaaaactgcctggcacacaaaaagtgtgcagtaaatatttgttaagtaaactgaataatggatgaataaactgaatctagtgtgcagttatgcaccatggaagattattaatataagttaaaaaacttaaatcatggccaggcacagtggctcatgcctataatcccagcactttgggaggctgaagcctgtggatcacctgaggtcaggagttcaaggccagcctggccaatatggtgaaatcccatctctactaaaaacacacaaattagccgggcgtggtggcggacgcctgtagtctcagccactcaggaggctgagacaggagactcacttga

SEQ ID NO: 184274 - DNA, 849 bp, Homo sapiens
ggaggactgaggcgggcctcaccccagacagagggcccccaataatccagcgctgcctctgctgccgggcctggaccaccctgcaggggaagacttctcaggctcagtcgccaccacctcaccccgccaccccccgccgctttaaccgcagggaactctggcgttctgagggggacaggctgacaagtaggacccgaggcactggaggagcattgaaggagaagatctgcctgtgggtcttcattgcccagctcctgcccgcactcctgcctgctgccctgaccagagtcatcatgcctcttgagcagaggagtcagcactgcaagcctgaagaaggccttgaggcccgaggagaggccctgggcctggtgggtgcgcaggctcctgctactgaggagcagcagaccgcttcttcctcttctactctagtggaagttaccctgggggaggtgcctgctgccgactcaccgagtcctccccacagtcctcagggagcctccagcttctcgactaccatcaactacactctttggagacaatccgatgagggctccagcaaccaagaagaggaggggccaagaatgtttcccgacctggagtccgagttccaagcagcaatcagtaggaagatggttgagttggttcattttctgctcctcaagtatcgagccaggagccggtcacaaaggcagaaatgctggagagtgtcctcagaaattgccaggacttctttcccgtgatcttcagcaaagcctccgagtacttgcagctggtctttggcatcgaggtggtggaagtggtccccatcagccacttgtacatccttgtcacctgcctgggcctctccta

SEQ ID NO: 184275 - DNA, 868 bp, Homo sapiens
ctcaggtcaacacaggggcccccatctggtcgacagatgcagtggttctaggatctgccaagcatccaggtggagagcctgaggaatcaggagctccaggaaccaggcagtgaggccttggtctgagtcagtgtcctcaggtcacagagcagaggggacgcagacagtgccaacactgaaggttctgagggggacaggctgacaagtaggacccgaggcactggaggagcattgaaggagaagatctgcctgtgggtcttcattgcccagctcctgcccgcactcctgcctgctgccctgaccagagtcatcatgcctcttgagcagaggagtcagcactgcaagcctgaagaaggccttgaggcccgaggagaggccctgggcctggtgggtgcgcaggctcctgctactgaggagcagcagaccgcttcttcctcttctactctagtggaagttaccctgggggaggtgcctgctgccgactcaccgagtcctccccacagtcctcagggagcctccagcttctcgactaccatcaactacactctttggagacaatccgatgagggctccagcaaccaagaagaggaggggccaagaatgtttcccgacctggagtccgagttccaagcagcaatcagtaggaagatggttgagttggttcattttctgctcctcaagtatcgagccaggagccggtcacaaaggcagaaatgctggagagtgtcctcagaaattgccaggacttctttcccgtgatcttcagcaaagcctccgagtacttgcagctggtctttggcatcgaggtggtggaagtggtccccatcagccacttgtacatccttgtcacctgcctgggcctctccta

SEQ ID NO: 184276 - DNA, 514 bp, Homo sapiens
cccaggttcaagcgattctcctgcctcagcctcctgagtagctgggacaacaggcatgcaccaccccacccagctaattttgtatttttagtagagacggtgtttcgccacggtggccaggctagtctcgaactcctgacctcacgtgacacaccaggttttgggattacaggtgtgagccaccacaccggactaaggtctctgttttaatgtgaatgctggtcagctgtgcctatgaggcatgttcggccacccacagtcatcatggcctcaacgagcttttcaggtttactttagaatgcatttggccaagaggtgcccattcagttggttggggttgcttagaattttactttgggtttaaaccagggagcaactccaggtagcaagggccctttttgggagcgttctctctattctcttttgggagaggccctgtgttgcctgcagccacttccaccctgccccttgggcacacaagggcacacagtgtaagcaggtgggcaggaggggt

SEQ ID NO: 184277 - DNA, 506 bp, Homo sapiens
aggggaaggtgttctcaagcggttagcagctgtcagggcccaggcagggtgtctgcttcagggaggttctgcagctcctgtggggagtcagagggctgatcaggcaactcaaggcagatgcctcattgagactgggcactatgggcctgcggaagacatggccttgggagactctatcagggtggctctggcctgggtaccaccaggctgagtccatcagcagcagagaggatggcactgtgtagagaattggatggggcatggacagggcagggcgagagccgcagctgtgtgtagagatttaggaacaggcttagctctgaatctgtaaccctggaagcttgggagcctgctcagtttcttttccctgggtcctctgcctgttacttgaggagctgctgagacccatggtacctggctttgtggcctaaacagttaaactccctacaggggtagattatgaagatcagaattaaaaagctttcaggaaaataatactttataaa

SEQ ID NO: 184278 - DNA, 486 bp, Homo sapiens
ccagggttaaggcagatcacagaaggtggtttaaattgtggcctctagtactttcgcagcactatgaactttctttttgtaaatcagaagaaatcaaaagtaagaccactaatttcttgaggcagagtttcatagttgcttgatgattgtgttggaagagtttgctcttatgaaggcctttggaagtcaggagatttccattaaggtttttctggtggcacagctcaactcatgttgagtgataactctgcttcccaaaagctcagagtgtgagcaaggttcgcttgggcacctttcattactgacaactaaagatagttctctaacaaaaagttagccactgggatcttcggtatatgttgtttcttaaggtaactaaacaagatgcctctttttcacttgtgctcatgttccaagccactctatctgtaacagtcaggagatttgcctgtgtgtgtgtgaatgtgacttactcttctgtttcag

SEQ ID NO: 184279 - DNA, 106 bp, Homo sapiens
tgggcaacagagagaaactctgtctcaaataaaataaaataaaaggaaactcttctcttaaaaaaaataattataaagttagtatcatagactgattattactgat

SEQ ID NO: 184280 - DNA, 446 bp, Homo sapiens
ctccctgaaggcagtgatcatgtctgtatatatcccttgtctacctagaatactacctggccacacagtagatgctcagtaaatgttagttgaattgaataagtagaattgaaattatgttccttatggtttcatatgcaatataagtcctgtttggcctttttagtaaaaaagattaaaaaacctattactatatcccatcatttggtcttacagagagtcattggctcaataatcacttgttaaataaatgaaacggtattacttagagttgtacaaggaagtcacaccttccaaaacttgagctccggtgacctctgatgtttcactgtgtgctatgttcctaacttgtgaatgggttgtcctgaagcctgtaataagtctgttgcacctggccaatatgtgtccttcatattggctttacactgatgactcagggtctgcgc

SEQ ID NO: 184281 - DNA, 369 bp, Homo sapiens
agcaggcgctcacctgagctgactcagaaattggaatgagttgtctgtggatcctgtaaggagcctggacatggtgaagagaatgccttgaccatcaggagacagcttagcttgttgaatcttgatcacttcttctgaccgctttggatcttaaaagaacaaggctcacagactaccatttaaggacatggtctccaaggatgtcgtggtgatgcaggatcaagtccctcatgggaggatgacaatcctggctctaaagctgaccccgggggagctcttggcagcatgttctttggaactgtttgtgcctcctccgaagatactagacaactatgagtcaaattaaaatgcttcctttgcaacatccaa

SEQ ID NO: 184282 - DNA, 229 bp, Homo sapiens
tcccacagttcttagatattctgatctgttgtgggtttttttttcccccagcactttttctctttgcttttttttcagttttggcagcttttgttgagatatcttgaagctcagagattctttccatagccatgtccggtctactaataagcccatcaaaggcattctgcatttctgttacagagttattgatctctatctacttcctcttttttttttttttttcctg

SEQ ID NO: 184283 - DNA, 336 bp, Homo sapiens
ggatcagtatgggtactctcaggcagggctgtttttccctactcatgcgcataggcaacttgtccctcttctgaatcttaagctgataaaaagttagcaccaacttcatcgccacttctccaagcttgatctgactctgcctctgcctctgagctcagtgggcttgcaagagaaggtcaccagtgggctaagccatccactccctctgggctcacttttacctggagctggcctggagccccatcgagtcagtagcatttcttcccataacagttggcggaccctggaggatgaagctgctccccaggacacatatgtagacgttactttccttaa

SEQ ID NO: 184284 - DNA, 169 bp, Homo sapiens
acccttgctcttccttctgacatgtcttcaaatggctggcccgtccctgggagcaaatctcagcaaaaacgtcaccatcctagcaaggccttttctttttctttttgtttgttgggttttttttctttttgagatggagtctcgctctgttgcccaggctggagtgcaa

SEQ ID NO: 184285 - DNA, 660 bp, Homo sapiens
atccttccagccttatgtcctgccttccctttcgtgccagacctcactgcccacagtctacctcagcctcgtgctaggcctctgttccttggtgcagtggcttcctctgccaggaatgtggctccccaaccccgctccctttcattggtccctgaggtgaacacatacctagttagccttccaggtagctctccagtcacctcttgtgaaaactgctctgcttcccatatgtattgttagctgcccctctttgtgccctcccataggccccttgcattgtaacatcacgatgtgtttgcatgcttgtcttttgagctgctttaaggcaaggagcctctcttactcatcattagctcctcactgcattggacagagcctgacaccaagggggccttccgtgctggcagaacaaagaaatgaatggatgcatggacagatagagagactaatgcagcttgttgagacaggggctacagcttcactgatgtaagaacaactccaccctcatgccccagcctttttcttggggcaggggcacatgataacctttctcccacactaaaccttgctcactaccagactagtaggccttaaactctgggagcaagaatggaactccttcctatctcaacaccccctgcccagagattttgattcaaa

SEQ ID NO: 184286 - DNA, 227 bp, Homo sapiens
gcagcatctcatattgtgtttattatgtttcacattttcctggtcgtgctgggtcctctcctgtcatttctccttcagagttctcaacacttggaatttgaaatctgctctgccttgtattgagatgacatttagctcctatttctccattcttagccaagatgttaaataaactgaggaccagcatgagcacctccccttacttaacatgttgcctcttttatagt

SEQ ID NO: 184287 - DNA, 837 bp, Homo sapiens
tctcatcctcctgagtatctgggattacaggcatgtgccaccacgcccggctaatttttgtattttttagtagagatggggtttcacaatgttggccaggctggtctcgaactgctgacctcagttgatccatctgctcggcctcccaaagtgctgggattacaggtgtgagccactgcgccgggcttattactattttttttttaacagtcatgtcttctctaactaaactaagtactttaaagacaaagaccacatcttattaatctttttgtctctggggtctaatagaatttcaggcatacaggaatacagtacatatttgatgatgttagtgaatgagtaaaacaaaatcccagattttatttggatttttatactcccctgtagtgtctgaaacagaaagtgcagccagttaaaaccctttaattactgttacaccttgctactttgaagtgatagtgccaggaattcccttaaaaaaaattaccacagtgtttttctcaggcctactgttctcttgaagtctaatgaacaataaaggttttatcaaagtttctatgctctgtgtcatgggtgtttgaattctgtaaatatgacgtagcagttctttatgaggaaattgtctttttaagactgtttgccttcttttcgggtgcaatcattgtttttttttgttttttttattccgttctactgggaactgtgtcgttttgattggagtaaattaagtgtcagagttacattttatttattttttttttggttgttataaatgccatttaggaaatttgcaaaatagggtgctcaagaaataatgaggtgcaaactgatcag

SEQ ID NO: 184288 - DNA, 571 bp, Homo sapiens
ctatacggctatctgtaataaaaatgctagaattagccggacatggtggcgggcgcctgtaatcccagctactcgggaggctgaggcaggagaatcacttgaacccaagaggtggaggttgcagtgagccgagatcatgccactgcactccagcctgggtgatggagcaagactccgtctcaaaaataataataataataataaaccacctggatataattattcctttgagaaaacaaactgttattttcctcctaacagttgtataaaacagctaatcaggctgggcacggtggctcacgcctgtaatcccaagagactcgaggtgcatccattatctccatctcttccacctccaagcaatggagttttaggaagccctgggtgggggcaggatgaggggacagggaggacaaaacctaccaggacaccacacgacccttaaccatccctcagacctacatcggctctgtgctcatctctgtaaaccccttcaagcagatgccctacttcaccgaccgtgagatcgacctctatcagggcgcggtgaggctggggctgggtgggaggc

SEQ ID NO: 184289 - DNA, 539 bp, Homo sapiens
aggtcgtgcgccttttaggatcctgagccgaggtgaatgtcccgccttacctctgacttcatcacgagagccgtgtcactctccccttcactgcactgagcctctcacactgattacacccagcacatttttatcctatctttctctcacatgtcccatgtctgtctggggatgagtcagtgcaactactcccgtctgatagtggttttaaaactaggaatgtcctcaaaagaccaaaacaaacaagagaaaaagatcacacacaaaaaaaaacatgaatccaacctaaacacaagttctgtgaacacaatatatgcactaaggtgaacatgtggtttcctctatacacctgagtggatcctttattgctgtgatcctgagaggtgagtatccttgccttgtacagaaggctacagagcagcacagatctgtgggaagtccaaaatactcaaggggctagagctttgttatatttcaacagataccaccatattttttccccatttttgccatgattctgaagccaagatggcaagcga

SEQ ID NO: 184290 - DNA, 448 bp, Homo sapiens
tgtgtatattctgtcccagcagtgccatttgcagttatataaaactcttttatatttgcttatggagtcaagaatattcattgcagtacttatttggattattgaaaaactgttcggagactgggcgtggtggctcatgcctgtactcttgacactttggaaggctgaggtgggaggattgcttgagcccaggagttggagaccaacactgacaatatagtgagaccctgtctctacaaaaaaattaaaagtagccaggcacagtgttgtgcatctgtagtcctagcgactcaggaggctgaggtgggagaattgcttgagcccaggaggtcaaggctgcagtgatctatgatctcatcactgcactgcagcctgggcaacagagcaataccctgtctcaaaaaagaaaagaaaagaaaagaaaagaaaaattgattggaaatgtcca

SEQ ID NO: 184291 - DNA, 496 bp, Homo sapiens
acataagaaaaagacagctatctacaagccagggagagaggcttcagaaggaacccacacagctgacaccttgatcaaaataactctgttgtttaagccccttagcacagccccacgtacttaattgtggcagcctgaacaaatgagtacggggactcctgtcttcttctttcgtcctgtctcctttgaggggaatgtcaggcttatgacagttgtcacaaacatattgtgtgtctttcttcaagacattaaaattgtgtttgtcaagctttccattcactttaatttgttttcatttcagcacatcagcttggtttcttagcattccaaggggaaagtttaaaacctttttgcatatagactccatttgcacggctacttttcttttcggcgattctcaagccccatcctcaaattcagcccgtggaagttgtttgacatctaactgagttaactgcatcctatcaagcgaagctcctattttcagcctgctgag

SEQ ID NO: 184292 - DNA, 619 bp, Homo sapiens
ttgtgtcttgaggacagctacacatgagaagcagatgtgttctgtcaatttctcaacctttaacaaaattcagccaaaacaatggacagaatacagttattcccctcatcagtttatctgcagagaatataaatactgttaactattaagactttgaaatcaaaaggaaggagaaagggagagaagcctcacagcctgggtttgttccgacttcacagccagggccagccttggagtgtggcctgtgctgagaactggagaagggggacagaaaacacgattcctgcaaaagtgtcagcgtggaaccagctcagccacagaaagcagcattcaaactgggctccaggatgaaatgaaaaagtctgggatgatgcataactcgagatgtcagaaaataaggaacgaaaaggcaaatgatgggggaaagcaccctaggaagggactgatgagtgctttaaatttgtgccagaagaacctagtaacacgcaaccctgcttgtaaaatgccctgagagcacagagtttgtatgccaaaagtctctcatgtgagaataaagcttatttgtgcactagaactgactatttgtgttggactgaaatggactggaagaaagaaagga

SEQ ID NO: 184293 - DNA, 668 bp, Homo sapiens
tgaggagggaggagatggggagttggaaaaataaaaattaaaaaagccagactctaagccctattaaatttagtttggggatctcgtttcattgaatgggtccatggccctttggtgcaattaattttgactgcactaaggcctgcggcattatagacttgattgtgggagttgctgaaattccattggtacaattttccagtttgtctctagggttgcttggcccccagtctgcaagtattagagccagttttaatagatggctgtggtcctctggcgaaagaagaagataaaatgttaaattctggtgtcttacaaaaaaaaaaaatgtgaaaatgggaccaaagaatgtctcttgtttttggactaaaaagcatatggtttctactatgtaaagaacctaaaaacatctttgattgcctttaattacaacactcaccaaaatatgctgcacatgtttctattgggcacaataggtatgcctggattttaagtcttttctccaaggcagctcagtgaaatacagcccatggagaccataccagcattaaaccactctcctccattacaaccccaggatagtttaaactaggagtttgtaagcactctctgccctgcccctcagcccaacaaagaagctactgaacctgcgtttcaaatcctcatga

SEQ ID NO: 184294 - DNA, 501 bp, Homo sapiens
gcatcaccagctggagactgacagccgcagagggcgggcacggcacagctgagatccatctactcccatgggagcctgaaagacctgcctccaacttagaaaactgctttgtgtttacagttagtttaggggagaagaggtagagaacctgccctggcctgtctccatgagcatctttgagtcagtactgagcaaacaggtgtaaacaggaccccaacaggcagaggtcttgtggctttcacaaaagttgtcctgcttccccttagatggaaaatatttaaaatgagacactgggaaaggaagctataacttttatctttagtttactggaaaaatttgactatttgttgaaggcatgaacctaatttttaacttgtaaggtttcttttgtttgatttagtacaagttcggtatcagtctccttccctgtaagaaaatgtgcccacacattctcacctttccttgcctaattataaactaattcatattttgagactctgc

SEQ ID NO: 184295 - DNA, 360 bp, Homo sapiens
gctgacttcaaagcaacattgatacaaggaataaaaattagaaaatacaaaagtaagtctgtctaatagagacatttcaacagcaaatactacatacattacggtaactaaaatgtggctctcaaaactacttcttacttttaacctctgaatccactggttttgtcttcaatacaacattttttgccaaagggagtcttatgggctctgttgtgggtgtgtctttgagtatataattatcatcacctctatgctcacacacctttctcttgcaaaaactctaatattgacatcagccggatgtcagcaaaatgacatctttctgaggctgaaggttttcatgttgcctttgggggaaaa

SEQ ID NO: 184296 - DNA, 303 bp, Homo sapiens
aaattttccactaacagtattacttttaaggtcagaaaaacataaaaaataacacatgaaaaaaagtagtttaatgaatcaccatttttagttggtttaaaatgtgtttctttggaagaaaccttttgcttgctgcaagttttcaagattattgattctgtgccaagagaaagacacattcaaatataaaaatgaaacaagcacattttcacaggggaaaaaatggtcaaaaatagttatttccttccttaaagttctaaagcctagctgattttaaaaccaaggaaataataaaatagagaa

SEQ ID NO: 184297 - DNA, 292 bp, Homo sapiens
tattatgtatttacagatgacacagtggtatgttcacaaagggaaaaaacatttaacatttaagatagataaactttctgagaaaaaaagttttattccttacttggagtaaaaaaaattcacaattttcagtaaaagattaaggaatctttaaactggtttaccaggttcaacataactagtactttttttttttttttttttgagacagcgtctcactctgtcacccaggctggagtgcactgggaggatcacagctcactgcaaccttggactcctggactcaaggaat

SEQ ID NO: 184298 - DNA, 439 bp, Homo sapiens
tatcccagttgcttataatgctccctagaactggaaactacaatgtcaaacattaaggaaatgggtcattataagattaaatattatgcagccattaaaaatgatcctaaattactactcatgaagagaaatgtagaggatagatgttaggcaaaaaagcaggatctacaattttaatgcagtgttagctaaaactatgtttaaaagaaggcagagattttgtacttgctaatttgccaaattcatttattagttccagtaggctttgttgtgaagtctttatggttttctaagtataagattatatcatctgtgaacagacacaattttacttctttctttccaatttaaatgctatttgtctttttctggtctaatttctggactataacttcaaatactatgttgagtggacatggcaaaagcagggatcccttgt

SEQ ID NO: 184299 - DNA, 498 bp, Homo sapiens
cagctagaaagtctggtaggtcccacatcataacagaacacaaaaaataggtggctaccgggttagggctcaagatctgtgaagatgagctgattccaaagactgaaacacaaatatgttgcagaatagagcacaggtcttgacaggtttgtggctttcactttgatcactttagaaatggaaccagacatccctgctgtgcagagtctgggtccttgaacctaagtaaccttacatgctgtagagataacctaactcaagcaatcacatcatatctcagacttattgagtaacatgctgttatttgtgctttgcttcttttcaattagcttcaaagctaagtagccctacctggtcctagcaactgaagccagaggatttgtagtaggtttcaacagaggttggtttatctgtgtttgggaggaaaaaagcagacacaagacagactcttttcggagaaaaaatctgaacctggcaactcctacccgcaaacaatct

SEQ ID NO: 184300 - DNA, 391 bp, Homo sapiens
gaaagaatgatgtcatagaaagcaaggcttttaaagaaaagttgagactcagtatgaaaaaataatacaaaaactaaaaataattaactggacttggaaatcaagggagatattagtgcccttcaaaagaactgttttaggggagaagtagaagtagaaagtatttggagtacatgagagaggaatgagaaaccattgtctgagttagtagaacagtggtttcaaaatacggctgcgtataagaatcacatgggaagggccaccgcgcccagccattagtaggttcttaaatgtgaatctgatgttatacagcaaaagtctgtacgggctacagaaacataatgtgtaataatggaaccctgcaagaggagggagtcatgagggtgcttac

SEQ ID NO: 184301 - DNA, 199 bp, Homo sapiens
tctcgatcaaaacactaatggcactctttagagaaatagaaaacacaatcctaaaatttatatggtaccacaaaatacctaaaatagccaaagctgtcctaacgaaaaacaacaaaactgaaggaatcataatacctgactacaaattatgcaaaatctatattaaccaaaacagcacagtaatggcaggaaaagacac

SEQ ID NO: 184302 - DNA, 257 bp, Homo sapiens
tgttacaataagttaatgttactggtgaaataaaaacaggttattaagaatcaatggcaaggctgagcgtggtggctcacgcctctaatctcagcactttgggaggccgaggtaggtggattactgaggtcagaagttcgagaccagcctgacccctagtgatctgcccttctcggtctcccaaagtgctaggattgcaggggtgagccaccgtgcctggccttccctgattttttagatgtggaaactgaaatgag

SEQ ID NO: 184303 - DNA, 1420 bp, Homo sapiens
gagggggcagagcaccggacgacaacagcagcagcaacaacgcggcagccgccaccatggccctgcaggctgattttgacagggctgcagaagatgtgaggaagctgaaagcaagaccagatgatggagaactgaaagaactctatgggctttacaaacaagcaatagttggagacattaatattgcgtgtccaggaatgctagatttaaaaggcaaagccaaatgggaagcatggaacctcaaaaaagggttgtcgacggaagatgcgacgagtgcctatatttctaaagcaaaggagctgatagaaaaatacggaatttagaatacagcatatgaggaatttttccttttgaagacttccaaatgctatcatgacctaacatttagagggagaggcatactgttaacttgatgtatcatgtatatttttgctattagcatgagctgtagtacttagaagtatactgaaactacatagttaactcaattgtacttgcttaaaccaggtgtctttaaaagttctttttaagaaaatgtggcacatatacaccatggaatactatggagccataaaaagggatgagttcatgtcctttgcagggacatggatgaagctggaaaccatcattctcagcaaactatcacaagatcagaaaaccaagcatgttctcactcataagtgggagttgaacaatgagaacacatggacacagggaagggaacatcacacactggggcctgtcggggactagggggttaggggagggataacattaggagacatacctgatgtaggtgaccggttgatgggtacagcaaaccaccatggcacatgtatacctatgtaacaaaactgcacgttctgcatatgtatcccagaacttaaagtataaaaaaaaaaattcttttagaaaagtattttttatttttatagagttagggagtacagttgcagtgagccaagatcacaccactgcactccagcctgggcgacaaaacaagactccgtctcaaaaaagaaaaaaaatttacaggtctgtccatagcagtttaaagaaatttaaaaagcccccataggaatatatctatcttttaattttcacattaagagactttaaagacaaaagggcaaactaaaatgtatctagtgataaactgtaccactactgtaccccatatgttcagttctatctgagtaaaaatagagtctggaatataatattggccccctactcagtctttctggatggtacacaggctctttgaaagaagacagtctcatgttaacaattcaaaaaattgtttgagatcccttaagataaatatcccccaaaacagtgtacctctattccctgcataaaaatttagatttggaatggtatgaccagaggaatagatccacttcatgttactacaaca

SEQ ID NO: 184304 - DNA, 1436 bp, Homo sapiens
gagggggcagagcaccggacgacaacagcagcagcaacaacgcggcagccgccaccatggccctgcaggctgattttgacagggctgcagaagatgtgaggaagctgaaagcaagaccagatgatggagaactgaaagaactctatgggctttacaaacaagcaatagttggagacattaatattgcgtgtccaggaatgctagatttaaaaggcaaagccaaatgggaagcatggaacctcaaaaaagggttgtcgacggaagatgcgacgagtgcctatatttctaaagcaaaggagctgatagaaaaatacggaatttagaatacagcatatgaggaatttttccttttgaagacttccaaatgctatcatgacctaacatttagagggagaggcatactgttaacttgatgtatcatgtatatttttgctattagcatgagctgtagtacttagaagtatactgaaactacatagttaactcaattgtacttgcttaaaccaggtgtctttaaaagttctttttaagaaaatgtggcacatatacaccatggaatactatggagccataaaaagggatgagttcatgtcctttgcagggacatggatgaagctggaaaccatcattctcagcaaactatcacaagatcagaaaaccaagcatgttctcactcataagtgggagttgaacaatgagaacacatggacacagggaagggaacatcacacactggggcctgtcggggactagggggttaggggagggataacattaggagacatacctgatgtaggtgaccggttgatgggtacagcaaaccaccatggcacatgtatacctatgtaacaaaactgcacgttctgcatatgtatcccagaacttaaagtataaaaaaaaaaattcttttagaaaagtattttttatttttatagagttagggagtacagttgcagtttttgtttgtttgtttgttttttcttgaggagtctcacttccagcctgggcgacaaaacaagactccgtctcaaaaaagaaaaaaaatttacaggtctgtccatagcagtttaaagaaatttaaaaagcccccataggaatatatctatcttttaattttcacattaagagactttaaagacaaaagggcaaactaaaatgtatctagtgataaactgtaccactactgtaccccatatgttcagttctatctgagtaaaaatagagtctggaatataatattggccccctactcagtctttctggatggtacacaggctctttgaaagaagacagtctcatgttaacaattcaaaaaattgtttgagatcccttaagataaatatcccccaaaacagtgtacctctattccctgcataaaaatttagatttggaatggtatgaccagaggaatagatccacttcatgttactacaaca

SEQ ID NO: 184305 - DNA, 1214 bp, Homo sapiens
gagggggcagagcaccggacgacaacagcagcagcaacaacgcggcagccgccaccatggccctgcaggctgattttgacagggctgcagaagatgtgaggaagctgaaagcaagaccagatgatggagaactgaaagaactctatgggctttacaaacaagcaatagttggagacattaatattgcgtgtccaggaatgctagatttaaaaggcaaagccaaatgggaagcatggaacctcaaaaaagggttgtcgacggaagatgcgacgagtgcctatatttctaaagcaaaggagctgatagaaaaatacggaatttagaatacagcatatgaggaatttttccttttgaagacttccaaatgctatcatgacctaacatttagagggagaggcatactgttaacttgatgtatcatgtatatttttgctattagcatgagctgtagtacttagaagtatactgaaactacatagttaactcaattgtacttgcttaaaccaggtgtctttaaaagttctttttaagaaaatgtggcacatatacaccatggaatactatggagccataaaaagggatgagttcatgtcctttgcagggacatggatgaagctggaaaccatcattctcagcaaactatcacaagatcagaaaaccaagcatgttctcactcataagtgggagttgaacaatgagaacacatggacacagggaagggaacatcacacactggggcctgtcggggactagggggttaggggagggataacattaggagacatacctgatgtaggtgaccggttgatgggtacagcaaaccaccatggcacatgtatacctatgtaacaaaactgcacgttctgcatatgtatcccagaacttaaagtataaaaaaaaaaattcttttagaaaagtattttttatttttatagagttagggagtacagttgcagtttttgtttgtttgtttgttttttcttgaggagtctcactctgtcacccaggctggagtgcagtcgtgtgatctcggttcactgcaacctccgcctcctgggttcaagtgattctcttgcctcagcctcccgagtagctgggattacaggtgcttgccaccatggctggctaatttttgtatttttagtagagacggggttttgccatgttggccaggctggtctcgaactcctgacctcaggtgatctgcccacctt

SEQ ID NO: 184306 - DNA, 607 bp, Homo sapiens
gtactaatttacattcccaccaatagtgtataagcattcccttttctccacatctgttgttttttgactttttagaaagtctagccctggtaatatgtgtacagatttgaacagctgtttgttcttttggctcatctgttctgttacaataagttaatgttactggtgaaataaaaacaggttattaagaatcaatggcaaggctgagcgtggtggctcacgcctctaatctcagcactttgggaggccgaggtaggtggattactgaggtcagaagttcgagaccagcctgaccaacattgcaaaaccccatctctactaaaaatacaaaaattagccagccattggtggtgcacacctgtaattccagctacttgggaggctgaggcaggagaattgcttttacccaggagatggaggttgcagtgagccaagatcacaccactgcactccagcctgggcgacaaaacaagactccgtctcaaaaaagaaaaaaaatttacaggtctgtccatagcagtttaaagaaatttaaaaagcccccataggaatatatctatcttttaattttcacattaagagactttaaagacaaaagggcaaacta

SEQ ID NO: 184307 - DNA, 205 bp, Homo sapiens
gtttggctgtttgtctagatactcagtggctcctacagtctgaatcagattatttttccaattccaggaaactcttctcgtctttaataatttcctcccttcatcatgttttatgcttttcagtaggcagttgctttctgtcttgatcttccttctctcatcttttatattttgtgggttttttttcccctttagtattgtgtct

SEQ ID NO: 184308 - DNA, 341 bp, Homo sapiens
tggtttcaccactgtggtacaacaggttccatgtactgagcacttaatatgtagcaggcaccaggctagtgttgactacatactgtcatcatacgaattgtccacttcttataatagctctgtaaagcaggtattttaagaaggaataaagaatgatactaccttcctacccttggttggtgtgttgtgtacactcttggctagaaagcattttgtgacgcagagcactttgaaataagggtatggtggctgacgcctgtaatctcaacactttgggaggccaaggtgggtggatcgcttgagtctcaggagttccagaccagctggggcaaccctgggtc

SEQ ID NO: 184309 - DNA, 448 bp, Homo sapiens
cccaacccaggaagacaccagctctaactcaccaccacaaaagggaaaaaccttatcacataaggtacagaaaatctccttatatgttaaagagccatttccattttcttttctgaacagttcagattcttagtcagttttctgttagactgtcttatcaatttgaagaaatctgccctttctttgatgaggagtttccccgatcttttgattttgtattgcttttttgccatgcagaaatttgtcttttttttttttttttttaaacaagtctagtcaactgcagtagtgagaaggtgaaaaagtagaacctggagttggatctgtgactgtgaacaatcaactgaggtaactcacactaccttcggaccaacctatcttcgttttcaatgttgtcaaatttaccatttacttgcctctgagttttgtgtcaaacttagaaaggctt

SEQ ID NO: 184310 - DNA, 1478 bp, Homo sapiens
atgacacgagaacaatacatactagcaacccaacagaataacctgccaaggactgagaatgcacaactttacccagtgggaatttatggatggcgaaagaggtgcttatacttctttgtccttctgctgttggttaccatgatagttaacttagccatgacaatatggatattgaaagttatgaatttcactgtggatggtatgggaaatctgagagtcaccaagaagggaatccgacttgaaggtatatctgagtttctacttccattgtatgtgaaagaaattcattctcgaaaggatagtccgctggtcttacagtctgacaggaatgtcacagtgaatgcaagaaatcacatggggcagttaaccggacagctgaccataggagctgatgctgtggaagctcagtgtaaaagatttgaagtgagagccagtgaagatggcagggtgctgttttctgcagatgaagatgagattaccattggggctgaaaagctgaaagttacaggcactgaaggagccgtatttgggcactctgtggagacgccgcacatcagagcagagccatcccaagatctcaggcttgaatcacccaccagatccttgatcatggaagctccccgtggggtccaggtgagtgctgctgcaggagacttcaaggccacctgcaggaaggagctccatctgcaatctacagaaggggagatatttttaaatgcagagacaatcaagctgggaaatctaccaactggctccttctcatcttcttcacccagctcctcaagttctcgacagacagtgtatgaactctgcgtctgccccaatggcaaactttacctttctccagcaggagtaggttccacttgtcagtccagtagcaacatctgcctgtggagctgaagtgactgatttctcctcacaccagaatagccttttgttcctgtccgtctgcttcacagttctgctcggtttcccttgtgatcagtccagagcttcttcgaatggtccacagagcaacttccagtgtgagcagggattcgccaccaccttctcttgtgatttactgtactgctcaacacagagggtgtgattgacacagcagtggaaaaagcgtcgtcagcaggaaaactggatcatgacttttgctcgaaagggagaataacataggtgcctttgctacgcgaagtgaagcacacagttttagatttttgcaggacctggatatgaactgcacatatatacattacataaatgaaattcccagtatccaatggcaagatgaaatggttaaccctgtaagaaaacttattctacattctgaaagcacaattttccattcatctttttggatgtaaacttttatccccgacttttaaaattttaaagcattatgtaatgcttgctttactaaaatttaaattcaatacatggtttttaacaaaacagaacaaaacaaaacaatacagaatctctccctg

SEQ ID NO: 184311 - DNA, 294 bp, Homo sapiens
tgcagagcaaaaacgaggtgacccttagaacaaggggtggtgtttagaaggaaaaccgaaaggaatagtagccagaattcaagagcgtcagatattctaagaggcagtgaggggttaacatagtccaaggactttcaggggtccgatcacacaaggatgaccttggccatcattgacgaccttggtcagagcaagttcaggtgagaagcagaggcagaaggcagatgagagtgaatgaaagagtgaacagaaagggagtggagatggcgagtgtggccagctctgtaaagcagc

SEQ ID NO: 184312 - DNA, 473 bp, Homo sapiens
ataatctttttttcatctctcaaatttccgttaaaatgagacctgcataagtgtaatctagtcaagaacgttatttaggtcttggtactactagcaggcaaaaaaacatgtatgtattagtcattgcaggctgactccattaaataaattttaaaaattgcagcatcaaatatattgtataaacaggtctagcttttgcgttgtatttcttgatgtttctaggaaataataaaagctcgcagcatatggtgttgtatcccaggactgatatattaacccgtaaaagtagttgctcaatagtgcatttgcaagaatcaatgaaaactaaatgtccagattcctttatggaaaggtgattttctctctaaaaaactgatattaaatattcttagtggaaatgtattaatgcagctgagagcacttgtgtgatatgaaagcagatcttcttatttaaatatgctaaaagttcagcc

SEQ ID NO: 184313 - DNA, 302 bp, Homo sapiens
taaaatagagagaaagcctggaggcagtgagggcagttaaaacaagttagtaagagccttgattatgataatgaccgtggaaacacaaaggaaatgataaatttaagaagcattacaaggaatatacagtaagacctaatatgtatctagatatagttagtaaaaaagatactatggtttggattctgggtgactgggatgatgatgtcacctctggaaaaaaattgggaaattataaggaagatttgattttattaagaggcagaatagtacagctattattcctctttcttaggttttct

SEQ ID NO: 184314 - DNA, 672 bp, Homo sapiens
accaccacacccagcttaattttatttttatggccaaatatgacacaggtgaaagccattacccagaccttcaaaggagtgtcacgatggggttggcaatgaggacaaggggtgatgaggaaaatacattgctggaaatcaagttgataataggtttggtggaagatctaagaaatgtagtgtggaacctctgaggtagggaaactgggaattcttttctttagaatatacatgtatattggcatgtatgtagaatatgcatgtctggaactccagaatacaatctgggctgcagccatcagtgtacaggttaaaggttcttaggctttctctgttcacggcattcctgtagactaaaagaaacagctaacagctccgtttattaagtagtaaagcccaaacaacttagtaattatttatgacctaacaatttagtggccaattgaaaatacaatcacatcaattcaaaagaaaagatgtattttttcatttttaggtgatggctggttttatgcatcaacgtgcgtagggcatggggcctagatatttggtcaaacccctgactgggtattgctgtgaaggtttgttttttagatgagattaacatttaaataggtaagttttctgggtgcagtggctcatgcctgcaatcccagcactttgggaagcgga

SEQ ID NO: 184315 - DNA, 111 bp, Homo sapiens
atgaatgttctgctattttctgtgtttgcttaaagtgtcaccaaactatagcagtgctgtttgaaatagccaatctgcaaactgtttatcagcacacaactatgagacact

SEQ ID NO: 184316 - DNA, 315 bp, Homo sapiens
tgaacagggaatagatttccattccatgctactgttgaaaggggtgattgggttttggtatatttttcactaacttagaaagtggactagaatctactaaacactaaatagaggtatttccagggatttctttcctcccattttataagacacaaatattagtcactgacaaaagtgtcgttgtactcctccttgtccctagtgtgttctcatgtagttttcatgatagccctgtcaagtaggaactgtgaccccttactgcagatgaggaaactgatgcatggagggattaagtaacttgtccaaggtcatcca

SEQ ID NO: 184317 - DNA, 435 bp, Homo sapiens
ggaagagggagagggacacagagatttgaaacatgattctgcctgttcctgagagctttctagtctcctggctcccccagggtcaagctcctataaggaccagctgtactcctataagttccaggaggcacccatgtatcattacagtccatctccttttcttgtttaagtttgtttgggttggtttctctttcttaaaatcaaaagacccttgactgaggaagtgcccgtatcttatcactgcaaaacatctccaggaaggaacctccccttccttcctgctgtgtacgttgtggtcacagcacaacagtgagatttctcagtaatccctgatttcaaagtaattacaggggaaaaggagtagctgaaaaattggctcatgcctccatctccatctagaatgcccagtgttaaggatgacctctttaataacaa

SEQ ID NO: 184318 - DNA, 420 bp, Homo sapiens
tgtaaaatggtatcagcctttgggaagattctgagcaaaaatggccacaaccattctattctccctacggtatccatattcctccaaaggtgactttgaagcccctcttatcaaggggtggggtctttttctccaccccttcaatgtgggctgattttgtgacttactttgagcaacagaatacagcaaaagtaaccttgtccttgcacacctgtgcctcacacactgctgctctctctcagaaacctgccaaactgccatgtaaacaagcctggactggcctgctagaggcagtgaccagccgttccggctaaggccattctaggccagcctgccctcagccaacttcagctgactgtaaatgcatgagtgacctcttggagatgagaaggactgcccagctgagcccagatcacactg

SEQ ID NO: 184319 - DNA, 239 bp, Homo sapiens
ctttcaaccctacctatgatgcattggaaaatggaggcccataaaggtaagtaacttcccaaggtaaactagttagtgactggcatggcaggaacttaaggagagtgaaggagtatggagggatttagtggaaagtggtgtacggatcagattttaattctgtgctaaggaatttaatttaatattctgggaataaggggagcttttgaaggtcttttgtttgtttgtggggtggagtg

SEQ ID NO: 184320 - DNA, 383 bp, Homo sapiens
tccttggtcatcactaggactcttatcccatccatgtcctacttcactccaaactatgccttttggaattcacagtgtactttctacaaatcgtctacaacctctgccccgcctgtgattattttcttcaccttcttgatccttttgaaactttgagcacactacttggccagaaacaatgttttccttcatgtctttccctccacctcgcttcacctaacctctcccaagatagacataattatagcaagtcaacaccaactcaaggaatcagatatacaaaaaaatatactcaatgttaatttttctacaaatattcctaatcatgacatttaccatcatagaactaattgtattctgtagtctctttggagcaactctaa

SEQ ID NO: 184321 - DNA, 229 bp, Homo sapiens
cccctccctatgagacatcaatgaacatacgtttaagaaataacattggtttggttcagaaagatggagcaactcaaagcagggtttccatactaaatatttaatgggaaatttatctaacagtctatggaattttataccaggtgttttaaaataggttatttcctttaatccccaaaaccgttcagttattaggtgatattatttccatttgtagataaatacttag

SEQ ID NO: 184322 - DNA, 356 bp, Homo sapiens
ccccctgtgcccttccaactgcatcacaacccaccttggtcttgtcttagttgccccaagataagggtattaatgtggtactgccgctaaggtctcatctgtattcttactcagcctgaaaagggttgaacatcagttgtcctttttctcactccacttccacccactgttagacttgcagacagtttcccaaagtttctggtatggggttgcctagtactgatggatgctttcttcatttttatttatttatttatttttagtcatttcaatgggaaactggaaggatagaagagaagcatatgcttaatgtcattctgattaaacaaatcaatgttagttttgttttcattttg

SEQ ID NO: 184323 - DNA, 324 bp, Homo sapiens
atttagaccaattaacttgattacatctatacatatctcactgcacttgctcatgttttctctctttacaaaactctccttccactgttataatttattaaaataattttctttctccctccctctctccagcactttctgcctttctttctaccttcattacactaatttttcttttgttaatttagtttttctttaatttttaagagtatatagtagacatatacgtatatgtatttatggggaatatgcaatgttttgatacagatggagaatgtgtaacggtcacaccagggtaagtgagatatccatcacctcaagcat

SEQ ID NO: 184324 - DNA, 441 bp, Homo sapiens
  misc_feature (135)..(135): n is a, c, g, or t
caggatccccgattatcccccaacagagtacatttattattgttatgcttagcgatacaaagataagactgtcactgccttggattaacttcctaatactaaactacacaaggacttccaagtaaagaagtaggntctttttacctacttctaaaatttcaagtacccaccttgaaattttgtaaacttagctcagcaggccaaacctgctacttccaaattagccacaatggcctaaacatgtttataatttctgcatctctacttcttcctgaagaagctaatgctggaatgtagatttcttggttgggctggtggaaagcagccttgggagaatctcactgacttcaactgcccaaagggtattagattgttaagcatcctactctgtatgggggatctcgggtatcgagcttaaattctttaatttgttcatagctg

SEQ ID NO: 184325 - DNA, 265 bp, Homo sapiens
tctgagagcagaaggaaggacttgcctttgcttgaagccaaaaccaatctgaaaccacagaacctcagcctgagggctagggctaggcagaaagcttgcttttgaaacctgagctctccttgcaacggtggtgggggtgggggtgttggtgtatgttccacttgtacaagcaaaccctctcataagtttgaccctgaaaaaattacataatcctttcatcacagcgggttacattttccaagggcagagctttgacttacaactg

SEQ ID NO: 184326 - DNA, 568 bp, Homo sapiens
atttctccttttttacaatcatgtgctaacgttgctcagtaatggcctatggatgaagagacagatgtactaccagtcattcgcgacacatttgcattaacaaatcatcatttaattaaagcccatccaacaagtttatgctacttaaataaagttcctttcaataaaagatgccacagtggcacacagttaactatgaggaaatttttttaactatatttatttttgtgtcaaaggcttaggtgtgcattagacaaccatttattaattttaattttgcttggaataaacaccctgacaaacagcatttcaattcaggctgctatacaacagaatcatttactttcagatacaatcatgcagtaacaccacaagctcctgcttcacaaattgctcaatccccaatccccaaatactatagaagatggcttatatataagttatacaagacatgcattctaatattcaagccaaagctctaatattcacataaacctaaaatcctgctataattaggaaggaatattattttaaaatatcacactaagtttcatgggtaaatatttat

SEQ ID NO: 184327 - DNA, 1336 bp, Homo sapiens
aattaggctagtgggctggttgtgaatcggccgacgcgttaagggaagtcctgctggtcgaatgcgacctggacatggcgtgggagcgccgagctgtccccttgtggatggggagctttcgttcactcagcagacgtttatggggcgcatgcgtgactctggggcgtttagctgagccggaggccccggctcttggggacgcggtgggctggcggcgtcggatcaccccgccatccatctcaccactcccagcgctgagcccggggggcggggagagtccctcatgggaaggggaggccgtgtgccccgcctggctcccaccacgttcgcaggccggccgggcgcccctcgcagccccctctccggcctcgcggtggcgccgctccccccttagcgcccagcggggtcccggccggaagactgaaggctgagtgggactgggcacggcgcgaaaccggcatcctgataactaggatttacagaataaggctgactcctgtcagctcgtgacccagccctgggcgtcctccacggggcagctgtcattccctaaccgccccccaccaaacccctgcacctccgagctgaatccgtgaggcggagagagggggctgcacttcccacgtggtagttccggtactcgttaatgttaaggaattagagtttgcttttcagtagacagctgctttcctgactgtggtggccaacctctagatccacctgcttgacttcgctttccagggaggtctcctatgtgaagaaacaaagctgcctcactagaaaagatcaggaaacagcagcgttctgtgaggtcctgtgcaataccaggttggaccttgcgggacaagtacagtgggttaaggatagtcataatgaaatctgccccaatggttagatgtattttggcgcctgcaatctctgcagtctttaaaaagaattaagtcagactatgtgctgatatgggaagatcatcaagggttattaagcacagaatgctgtatacatatagttgtatttgtataaaaaataggatctagatagaaaatttttgcaaagatccatcagaaaatgtctgtggcatttttgagacatgggtctaggaatttggggtggattggtgactcggtatgtcagtatgcattgtactctttggtactgtttaatttttttttcctatgtgcgtttaaaatataaatttaggccgggcgcgtggctcacgcctgtaatcccagcactctgggaggccgaggcgggcggatcacgaggtcaggagatcgagaccatcctggctaacagagtgaaaccccttattaaaaatacaaaaaaaaaaaaaaaa

SEQ ID NO: 184328 - DNA, 429 bp, Homo sapiens
ttacaggtgtgagccacgctcccggctgctggcatgattttagagtcagtgtcagatattgactttgtcttcctgttccagatataaccaaccatatgacgttagacaagtgacttaataattcttagcatcagcttctcctgaaaaattgggatagtgctgtctgtttcacaggactcttgagtttcatgaagattaagtaagaatatatagtcaaattagtagtatagtacctggcacactgaacctttggtaatggtgctggatattgtaggggataaatacactagtagaaatccctgcctttgaggagctcacgttctggaggggaagacaggcaaaaaaatcagtgatggtgatgtgtcatgccaggtgccgtaagaaagttaaccactcacaggttcctatgggagcatagaggagcggtgg

SEQ ID NO: 184329 - DNA, 113 bp, Homo sapiens
ttgctgtctctagcctggaagagtgccattacacattccccctgggtgtctcaggaaaggtcactttgggatggtctcctcctcgcagcttatgggactaacttgattaatag

SEQ ID NO: 184330 - DNA, 230 bp, Homo sapiens
gatgtaagcaatttgtactaaattccaaccctgaatcagtgctgaatgaaaacttactctgttgctgcatcaggctttgggaagatattaggaagagaaatggcccaggaggtggcaatgccgacccccaaatacttccctctccccaactccagctgccgatcccagagcagacaggcagtgagactttggaatcccagctcctccagagtctggctggcccatcttga

SEQ ID NO: 184331 - DNA, 177 bp, Homo sapiens
tagcaaaagatgccagtagcgactcaagccatttttttgtgcatctgatgaagagatgttggtatttttatatggcctataagatttcataagaggcaaaaagaactggttccctttcaccagggacaggattgctgcagattcatttctgaaataatatcctgttggctggcgaca

SEQ ID NO: 184332 - DNA, 470 bp, Homo sapiens
tgctgtggcatggggtctaagggcacaagataccaagtggtgtgtgtgtgtggtgacttgaggtctaggggggacactgagtcttgtcagcctagacagttaagagtctgtgacattggcacctgtgtgatccttgacggcaaaagttgtgggaggtctgcagaggctgcaagggctactggagtcctctgctgtgcctctgtgtccagcaacaaagggccatggctagcaacaatgaaggccagagccagtgaaatgcacatcctctggtgtagaggctggctgcagacatgcctctggcagcagatccagatgtagcctcatgcactggggtaagtgctggagacagaaacaggagatgggcaagactgtaagagcacatgtgggatggtcagggctggaagcttgcttatcctcaattgcagggaccagctagggttaggtgacaggaattagactatctgtgtata

SEQ ID NO: 184333 - DNA, 347 bp, Homo sapiens
attgccccaagcctgaatcccaaccccccacatctttgttacctgtctgtgggtggtggcccaattgtcacagcctcctcagccctgggagctcaccacactgtgccacaatgccccagcttgaagtgacatgggacactaagtgtatctgttgcaaatattagaacccaactcacactggcttaaggaaaaaaaaggaaaacgaagaagaaggagaccataatggcacatggaactgaactcaggggtggctgtggcttcaggcatggttgtatccagggagaacagtatggccaagatccttccctcatctctgctcttggggattcggcaccactctccaacag

SEQ ID NO: 184334 - DNA, 194 bp, Homo sapiens
gatttcccagggtgggggtgactccatccagagaggaagagaaaggagcgggggctttggtccagggcacgtgctggcctggggctgtggaagtcggatgcagggaattgtgaagggagctggtgagagaggctcagagaaaagaggcccaggctggaaagaggcagaacagggagaaaatggaggtgaaggct

SEQ ID NO: 184335 - DNA, 439 bp, Homo sapiens
gcacccgtcgtctgcatagtttctaagctcttggatgttttgatgctcagacacactgggaattctgttccggaggagagactgctccctgtgaggaaagccagggaggggatgggtttttgttgttgttgttgagacaaggtcttgctctgttgcccagactgaagtgcagtggcgtgatcatagctcactgcagcctccaactcctgggctcaagcgatcctcccacttcagcctcctgagtagctgggactacaggcatgcaccaccacacctggctaattttatttttttgtagagacagggtctcactacgttgcctaggctgatctcaaactcttaggctcaatgatccttggccttgacctcccaaagaactgggattactgtgcctggcccggggtgggttctgagcggactatcttacccgcagccagct

SEQ ID NO: 184336 - DNA, 331 bp, Homo sapiens
gaaaaaaacatttagcaaaacattgaaaaaataaaaataaaaacctgccagtcactgatctaaatgttaagggaggaaagcgcaccagtgccggctttgtggacattatattccagcataggcaataaatacaagagaaaatcaaatttcagattaagagtctatgaggatgaaaaacaaggcaaggacatagggaatggcagggggtgtggtgggcaggaggtgctattttgaccaggtcatgcctccctaaaaaggtgacatgtgagctgagcactgaatgttaccaaggagcagcatgggggcctctgaggatgtagataatgcaaag

SEQ ID NO: 184337 - DNA, 1020 bp, Homo sapiens
tcccaagaaagaagagcaggaggaggatctgccaactcaggagagcaggtgggggatggcaagtcttcggagtattcataaaccaaatgctaagggaaacttttgttgtttgtcttagaattttaaaaaataaagtctgttgcagtttatctgctttccttcctggagagtggctaaactagtgttctgttttacaatgtagaatgcaaaagcagaaaacattcaagaaaattctatactgtatttgaaaaacatcaccatttagttttaactgctctttgtttcttattataaaaattaatacctaactatgaaaagttagaaagcctggagaagtatggaggtgagttgtccaccattgggccactagagagtgccctatgagcctgtccctggtgtcctggactctggtggtgtgcactgcatttgctggcagtgagccagggggtgggccacatctgggcccgggcggggtggatctctgcagaagtttatccatctcttggttgacagggtgggcgagatgggagcagctctgagggtccctgttggcagagaatgtctttgattatcaacaacatgcctttttgttgtgggcttgtgatccttttctttcctaaatcagctgccgtgcataaccagttaggctctcctgtggcttcagattggagttagtttcccaagtgctaggatgtgggtgttaggtgatttctgtctttccgtttgaaagagatttcagatcattgtaacatttctggaatcctgtcgatctgaaggaatggctaggatgtagtagtttaagggaaatgaaaagtcgaatgtattttgatgtttctgcatcagacctgctcggtggagtccatttctcagcttcgggagccacgtgcttggctcttgagagcctagctccatcagcccatgtcacacactcacaggtctggctttagctggtttcgccatggtttctaacttttcatagttaggtattaatttttataataagacacgaagagcggttcc

SEQ ID NO: 184338 - DNA, 1338 bp, Homo sapiens
cagaacttccactgaatacactagaaaatacagaacatttttgcagaaattatgtttgaattatttaatgtaccaggattctacattgcagttcaggaggtactagccttggaagtatcttggacatctcaacaagtgggtgaatatatgttaatgagtatagtcattgacaaaggagatggagtcacccttgttctcccagttgtagaaggttatgtaattgggagctgcatcaatcacatcctgattgtaggtgatactgtgtatttcattcaacaactgctaagggagagggaggtaggaatccctcttgagcagtcactggagaccacaaaagtcattaaggagaaatactgttacatttgccctgatatagtcaaagaatttgctaagtatgatgtggatccctggaagtggatgaaacagtacacaggtatcaatgtgatcaaccaggagaagttcataataaacgttggttacaaaaggttcctgcaacctgaaatatttttttacccagagtttgccaacccagactttatggaatccatcttgaatgttgttgatgaatacaaaactgtcccactgatgtgcattgtccactgtataagaatgttgttctttcaaggggtttgaccatattcaggtatttgaatctcaactacagagagatttgaagagtggtacatgccagattaaaactcagtaaggagctcagtggcaggagaatcaaacctaagcttacagaggttcgggtggtaatccatcacatgcagcactatgccttatggtttggaagcttaatgctagcctcaactctggagttatttcaggtctgtcacaccaagaaggactataaagaatatggtcccagcatctgccaccagaaccttctctttggagtaatgtcttagtgtctgccttgaaagcaccatttaatagtgtcatgttggggaacaagtgtccttcagaacccagagaagactaccatttctaaatgacatttggtgttgatgtctgagcagcatgcttgcatcacctagtgcatgaggcacagggcagagtcatttcagtaaaagccatttctttatgtgttgactgttgtatgcccactcctccttctctcactccctttcttcatgcttccacagttttcctcccccttttcacttgaacttttttgttgacaaataccattctgaaggaattcaaatgtgactctgaaaattgttaagaggaaaaaaaatttcaaaaatggcccaaaatagttctcccccaggaaagaatgcagtggtataaatccttttcccccagcctatttttataaataaaatgttataa

SEQ ID NO: 184339 - DNA, 480 bp, Homo sapiens
caccacttcaaaattatggtgatcagacttgccattcaacgtgttgataatccaagcccaggcacagaacacatttaagaaaacattttggcccgggcacagtggctcacgcctgtaatcccagtactttgggaggccaagccggtcagttcatgaggtcagtagttccaggcccagcctggccaccatggtgaaacccagtctctactaaaaatccaaaaattatccgggcatggtggcgtgcgcctataatcccagatactcaggagtctgaggcagcagaatcgcttgaacatgagacgtggagggttccagtgagccaagattgcactactgctctccagcctgggtgacagagtaagactctgtctaaagagagaaagaaagaaaagaaaagaaaatagaaaagagctgagtcccaagcactgctggtggaatccagtttctgctgaatgtgttttgagtatgtgtgccaatatt

SEQ ID NO: 184340 - DNA, 722 bp, Homo sapiens
gccctcagaaataatactacacatctacaaccatctgatctttgacaaacctgacaaaaacaagaaaaggggaaaggattccctatttaataaatggtgctgggaaaactggctagccatatgtagaaagctgaaactggatcccttccttacaacttatacaaaaattaattcaagatggattaaagacttaaatgttagacctaaaaccataaaaaccctagaagaaaacctaggcaataccattcaggacataggcatgggcaaggacttcatgactaaaacaccaaaagcaatggcatcaaaagccaaaattgacagataggatctaattaaactaaggagcttctgcacagcaaaagaaacaaatattctttttacatcctactatgtgctggcattgaaaaatattcatgagattataaaaattaggaaaatatttaatcatttctgccctcatggagtttacattcttattattgttgcttaggtgataatgtttttctttcttcctcctcccctgcctttggccaggatttttagtaacatatgatttctaatgagaacatcctagaacttgaaaagatgaaataaatgattctgtttcatgttccaaatggcagctattctccaggggataaatatttgaaagatagagatgtaacagcttaagtttgtccatcatttttctctcttggtcattcatttttcaacttgagttc

SEQ ID NO: 184341 - DNA, 922 bp, Homo sapiens
ctgacaggcacattgcgggtccagccatcatgccaaggtgtcagaggctggttcagcctcttaaagattgaaggcaagacaatcatccacctccaccccaggaggaaaatgaggcagctgagcagtttcctcctgctctcttactctcatgtaaggcatcgtatctgaatgtagacagagtatttgcttgttttctctttcttaggaggcaggaccagggagagacccagcaaagagaaggtcccaagcctagctcaaatctcctggtcctggaacattcaggagccgccccacttcaatggtaattggcctatttccatctggtttccaagcaacatgacacaaaatccccaggaaccttatcacagagccagtgaactggaaggggctggagatcgctctggcccaaactccctgcgccaaagcatgcggggcgactcagacacaaaagggaggaaggcacagtctctgcccagagcccacggtggcaccaagaaactccttttaccactgaagaagaaaaggaggtccagtcttttggaggcaagacaaggtcacctacagagggcctcagccgagcaactcgctagaggttgttttctgcatgaccaccttccctgcaccgtggatccctggggtgggtggtttaggggctttccaggtaagagccagggtcagcgccaggaaatgatgacaagtctgtctgaaccctttccgcagacatacaattgacctcctccagccaagcgctgctccagttagaatctttctaaaactacataggcaaatgtctagcaattgtcattcaactctcacaatgaaagggtaaaaactcattttaatgtgtctcccttgtaccactttcttagtatgcctgaatccatttcatctcaaggaccatacatcaagcactgccttctca

SEQ ID NO: 184342 - DNA, 113 bp, Homo sapiens
tttctcctttggagataactggcatttctaatttttgtaattattttcctatagatacaattccccccctttcaatctgtatattattgttttttcttcttctttccctttct

SEQ ID NO: 184343 - DNA, 560 bp, Homo sapiens
aacagatctagcaacagagccaggatttttatgtaagcactctaattccaaaaaaaaaaaaaattgaatgggtaacatatttacattgttttttaaaaggtatgcagtgagagtctactatgtatgttctccatcaatctaactctcaccacttcttttcccacctctacaccaacagttaccaatgttattacttgtatatatccttccagggttttttgtgtatctataaagcaaatgcaagtgtgtatttttccttgtttaaaaaacccaaaatgtagctctctatacattactctctacaccttgctcattttacttaatgtatattagaaactgtctttaaaaaaagttaatacgtattactgtgtttttagaattttcctagctttttctttttccatatgaacttgagtatatatttgtctacttccctcaaaagccatttgacattttcattgagatcatactaaatttacaaattagagaaaattgacgggttgatgtggttgagtgtccctatccataaatgtggttttcatttgctcaagttttttgtg

SEQ ID NO: 184344 - DNA, 222 bp, Homo sapiens
aggcaggagaatggcatgaacctgggaggtgaagcttgcagtgagccgagattgcgccactgcactccagcctaggtgacagagcaagactccatctcaaaagaaaaaaaaaagaacagattctgtactcttctgacagtcatgctgccccagtgggtatatcatgctttctacttacatgccttgtacaggggaacacctccttttaaaaccatcagatct

SEQ ID NO: 184345 - DNA, 691 bp, Homo sapiens
aggagtatttgcctagatgccgcttgcccctgcctggtcctggcatatctaacagtcctgcctgggccaggactagtttgtcctgattgcagggtgaggtgcctggattggagggatggagcctgtgctggcttctagccgcagtcccctccagccctgtcaagtccccctgtggcttttggccataagctccactttggcgcaagtgtggatggtgatgacgccttgactgcaggggtgctgagggcgaacggagagctgcctgggaggacgaggcctccactgcagtggtacctgctgcctaggtttcccctcctggccagggcaaggatctgatggtcagtgctggctaacgcctctcactcaggagccaccctcatcagcaccccctgttcagtcttcagctgcggctaggtggcccatggccagagtactagaagcagctccaggaagcagctgcagtcctccagggctgctccaagggccggcaccctcttctagccactctgtccctgcatggccatgaagtgcactgctctgctcccagctctcctgccccccctcccacccccaaacctctgcctcattccacattcattcctcgccagtgacttgtgggcccctctgtgccaggcactggggcacggagataagcagcatgcagtcgtaggctctgtcagaagggggcaag

SEQ ID NO: 184346 - DNA, 314 bp, Homo sapiens
attgctcctaattgtctagagatctaataaatcaatgcaaagaaaaaaatcactaatctagccaaaagtgtaagacagctccagtgtatcaattctgtcttcaaaagtggaccccagttacaacaatcgtgggaaactgaacctgtattacataaactctgaaccattttaattaatatttatcaaagtgttgccaaaaaaaaaaatattcatccctttgggtactgtagctctttgctaatcaacattaagataaacctgctccaaacacgtttcgttgaaaatgcccatttaggccaggagcggtggagcaa

SEQ ID NO: 184347 - DNA, 494 bp, Homo sapiens
acaaacaatatcagatttttaaaaagtctttttaagaagcattgtaatcttataccaaaaatattcattgttcttcagtgatctgtcaaataattcaatgtaaattcaatttatgtaaacagcattcaaagaatatattgagtgttcaataaatatttgattagtaatatgttaaatttagaaccaccacaagttttattcctgaaccattcaggatattatctgagtacacctaattaactctacctgtgcacacccagcctagaaaacagaccccccatcccaaacaactgacaaaacacataaggtttttactttttatatctggcattgaaataagattcttaattagtgaattctcttgtgttctaaagctaaaagtaactaaattatcatggtttgagaaccccaaatttagaagagtcattttatcaatcctatgtcttcatagaacagtctttactcatgtaaataaattataaactatataaatt

SEQ ID NO: 184348 - DNA, 374 bp, Homo sapiens
aacatactgcctgaacacaatttgactcactaaaatccagcactataaacacaaaatacatttctcgagtgcattttaaaagacttattatcaagatttatgacataaggatagaaataatttgcaactaggcactgccaggagaatatcttaggttcctctcaaggtaattttaagtaaaatttacaaataaatcttaaggttagagtccactttgaacgcaggaatcttcacctctttcctttcaactgtatggaatttgaatctgacaaacaacctgtctgttgctagaatttataagtgatctgaaaaaaaatcaaaggccataaaagctatttgtcaaataaactgcagaacacgatatcagtctgcag

SEQ ID NO: 184349 - DNA, 405 bp, Homo sapiens
aaagcattctggagatggaaggtggcgatggctggacagcaaagcaaatgttccgaatgccactgactgtacactcaagatagtaatggttcagagatatgtttgttcagttgatgaaaatgtgggccgggcgctgtggctcacgcctataatcccagcactttgggaggccgaggcaggaggatcacctgaggtcaggagttcgagaccagcctggccaacatggtgaaaccctgtctctactaaagatacaaaaattagctaggcatggtggcatatgcctgtaatcccagctactcaggaggctgaggcaggagaatcacttgaacccaggaggcagaggttgcagtgagccgagatggtgccactgctctccagcttgatgacagagtgagaatccatctc

SEQ ID NO: 184350 - DNA, 702 bp, Homo sapiens
tcccttccacctccccatctcttctcaactcagcccacccccaatcttaggggatgttccaaaggaagcagacagttagacagaacaaatggtgggttcaagaatgaactagaaattgggcagaggatgaggctgaggagaaggcaagggatgcagacaaggacaaagttggggagaatatcaagcatgaggttagggaagatgatgaggtggggatggggatgacggtgagtcagcgatgagggtagggatgaaattgaggttggatgtggggtagaagatgaaactgaggttagggagaaagctgaggtcaagtcaggaatgaagtcaaggggatggcccgggtaaagagccaggtaggtgttgtagtcaagttgaagatcaaggcaaaggcagaggccaagtcaaggtccacatgaggagtgaagtcaagtgacatgaagtctggagttgcaatcaaggtcaaactgaaggccaggccaggagcggtggctcacgcctgtaatcccagcactttgggaggccgaggtgggtggatgacctgaggtcaggagttcaagaccagcctgggcaacatgatgaaaccccatctctactgaaaatacaaaaattagctgggcgcagtggcgcgtgcctatgatctcagctacatgggaggctgaggcaggggagtcgcttgagcccgggaggcggaggttgcag

SEQ ID NO: 184351 - DNA, 673 bp, Homo sapiens
ggaagtgactgctaatgggtaagggtgttctctctgttttggagtgatgggaaccctctggaattggatggtgctaactgctgctaactgatgctaaagccactgagctgcacactgtagaaggctgaaattttatgttatgcgggttgtaacttaaaaggaaaaatataaagttgttagaaggaaaaaaaggaacgtattgacagtggtgtgtcaaaggagtccacctgggtgcgggcaaccagagaatttaaggacaataatgaaactaacgacaggcggcttgcttttcataatcactgtgccccagcagtgctaaacatggcagtgaggaaggctcctctctgcagggtggactctccctctgtgccactatgagtacgtcaccgtgtgcagagggaaaacagagcatgtgttataattcattatgtacaacctcatgtttgacagtgccgtatcattcacaaagtgttgtcatagacaatatcatccccatcaccctctggaggaggaagacccaccaaggaggacgagaagcctccctgtggccatgaccgctagtggtggcctccacagagctctggagccgaatgctgatttcagtaaaggttctcccaccaccacactccccagggctggtggacaccactggtgtcctcatccctgaggcctc

SEQ ID NO: 184352 - DNA, 622 bp, Homo sapiens
tggcattgtttgagtccaggatgtccaggttgcactgagccaagattgcaccactgcactccagcctgggcaacagagcgagactccttctggaaaataacataaaattaagtagtgtacagtaaatggacaaaatgccatagtagttgagaatttaaagtcaattccccccagtctaagctccatgagggcagagactgttctgtactgtcaaattcctagatctgctagcaaagtatacagctcatagaaggtttataataaatattttggggaaaatgaatgaaaatagtgaattttatcaggaatgctgtcatagaaacatttacaatgccttttcctatctgttttcaccagaaagttaaatgaacatcagctaattaagaaagcagaatccttcccctgggaattcagttctcactgcctattataaggcagttttgacatgacagaaccacaactaaatggctgtaaatgtcacagtgtacattttaaacctcatagccttagagtttgatgagaccaggcacagtgactaacacctgtaatcccaacactttgaggggctaagatgggcaggaatttaagatcagcctgggcaatatagcaagaccccctctca

SEQ ID NO: 184353 - DNA, 443 bp, Homo sapiens
ggggagctgaggggaacacagatagtttgacttcagtcagacagaataaacatgatgaaccgataacctgtgattcccagcctggggttactactggagttttaggtgtcctggaaagttataataccggtcttcaaaaagtctacagaaagcatagatttccacataatgctgcacaggctaacgaattaatcaagtttctttggtttggcctggatttatatccattcagtttgtggacactactgaattatttatgtcatgttgatcaaaagttctgatatgatttgattaatgaaacattgaaaaaaatagtaaaaccaaccatttttaaccttacactactatcttgaggtatgattgacatacattaaaaccacctcttaataaatgcttcttgttaatcaaaaatttgaaaacgtatgtccactggaggaaaaaag

SEQ ID NO: 184354 - DNA, 377 bp, Homo sapiens
ctctcagacgtgtagcaaaatccagacagaaaaacagtagaaaaggcattggaaagtgtcaagcaccaaatgcacctaagaggtttgttgctttttcttgttctgagccttgctactgaggccttggaatagggtcgccaggattagcaaacaaaaacctgggaggcacaattaaattcgaacttgagacaaactgaataatttttaaacttttaaagtataagtatattccatgcaagatttgggatataagtaaatatactacaaggttatttgtattttacctggcaaccctatgttggagcctccttccctgctgcagccaacaggggtagaggatctgagctgcttatttgtaactgaaagtccatgggact

SEQ ID NO: 184355 - DNA, 230 bp, Homo sapiens
ttcccaaagtgctggattacagccgtgagccaccacgcctggccgagacagctctttttctttgctgcacatcaatcaacttgcatccccgaaagtgccttcaaaatagaaattctggagctgccactggtaaactcagacttaaaatttttaagattttccacctgaggttccttgtaacttactgactctggctttcagttttatagttagagagtaccaggaagaaa

SEQ ID NO: 184356 - DNA, 714 bp, Homo sapiens
tttttagtataatttacttctagcgtaaacttttactgtgcacaattctatatcaaaattgcacattattccaaaattttaaatactctttttagtgtaataaagtatctctaacacaaaatagcagttaatgtcaaagtcttacgaaactggatgattagaccgtgttcctcagaacatagttgtaagatctgagagctatagaatagtaaacaaaaaaatgaaaacagaacatgagcatctgcagggcttggtttatcaatgtcattttcattaaagtctcagaaatttcagagatataagcagtaagaaatacagatttaattatttcataaaatatgcagatttattgcatctacagtaacactacagtaatactattatgctcagtaaatgacaatgtttctttaaaaaacagtaattttatgccaagttaatattttgaaggatctctctcctttcaattcttgaagtatttgtgggttaatgacataccaactcagtgaatacacttaggacacttatccgataatttctaaggcagtgaaagtagctgaaaatgttgccttcagaattagaaggtgggggactgaatcctgtttctgccacccatttgctatgcaatcttgggcatgtggttgaacctttatgccccctctttttcccatctgttcaatgggggttcaaaagcaaaagtaagaaaagcactcacag

SEQ ID NO: 184357 - DNA, 351 bp, Homo sapiens
aaatcagagaagcttcaagcatttgaaagcgttagcccatagccccttcccaaattccagacacaaggcatccaaagactcaggtcaggatggcatcgtcagaatcatcttcatctcagtcaaccctcatagagaccccagtgttcatgttagctcttagcttctgcatagtgcccccataaatcggaagagactgagggttgtagcacttcagctaacagaaggaaattgcaccatttaggaagctaagtgatatttgaagggcatatgtagctatgatcaaaaataccaggtttggtgcaaaagtaattgccagttttgtcgttacttttaatggcaaaaatcacaatt

SEQ ID NO: 184358 - DNA, 653 bp, Homo sapiens
cctccgcatccataggatagaaatcatagtaggatcaacctcataagtttcctatgaggatgaaatgggagggtctgtgttaaaagctttgtgcagcctatgggatatagtgagcgtgctggaaatattggccagtagtagtattgctgtttactcagatgtttatggatccctagataatatatgggaaggcacatggtaaattacaaagtgctatgcaaatgtgttgttattcttcactgggttcctgttaagttgtggggtttggggatggataacttccagaccagagtggctgctgtgggaccgggctggtgaagcggtatttcaaaatacattttcaggtgtgtttgtccatgtggcatgaatgcgtccgtcgaagttgacggacgcatcataatcctgacctcaggtgatccacccaccccggcctcccaaagtgctgggattacagtcgtgagccaccatacccggcctagaaatgttttttagtggcagttaatttctaacttgcaaacaattttggggatctagagtttttaaaaattagcgttatccaaggaacccactggtatgcggaatgttctcatctaggtgattattacaaacgctttctgagacagacctattgttgatccagatttgacactcag

SEQ ID NO: 184359 - DNA, 225 bp, Homo sapiens
ctccttccttgaaatgcttttttcttgaggcttccatgccctgccttatcctgtttcttcctacttctctggttgtgctttttcctctgctcagtatttaacatgttggtgtgaccctggctctggcctgggcccccttctctatctacatgctttctctcgacgacctccatcggttgcatgggtttaactaccaaatctgtgattctagctccgacaccccag

SEQ ID NO: 184360 - DNA, 1761 bp, Homo sapiens
gtccccggcgggctggtgagggggccaccaaagacccctagcgcggcctggtgagcgggggcttggcccataggagccaagccgcacagacccgagaattcggaggccaccacacaacacacacacacacacatacacacacacacacacacacacgccaggagcaagggagctttcgggccacactcccagacgcctccctgagccctggaacccggactcgttgctcctggccttccataccccctggcagatcatcctgcggtcccaccccagatcccctcctcctcgccatcccattctgccccctccccaccctgggtacagaaagggactgaagtgttgggcagagagggggcttaaggcccctgggcacaggctgggatcagggcagtgagcgaagggcagctgtgtcctgccctcccttctggaggctggaggggagaggccaagcccttggaaaatgtagcaaatgtctggatgtcgcataagtgcgtgtatgtgcgggacaggccccgagaagctagtgactcctgcacacccccattgcacaaatgaaatcacagcccaggagggagggtagcttggcactggctgagaaatagagctctctccccgcccctccccctaaccacaagggattgtcctgacaacttgtggggatagaagggctcacagggcaggggtctcagctgcccccatccttagggcaggggagttagtgtggagccgagagcaggtcccagctccccctgccagccgcactgtcccaggcccagggacctctgccgggtcctcccagcccttgccacacagcctagacgtagtagcctgggcttccagcaggtggcgagctggttcgtgctggaaatttctcctgggtttcttggggtcaaacatgccaacctccaagaccccatcctcacgtctcccacttttctggcgctggagtgtgcagggcgtaggacctgcatgtgtgggtgtgagaatgggggcggtggacaccagggggcgagtgtgtgactaggtgtgtgtgcacatgtgtagggtgcagacgcatgggtgccatcctttgcgttcagtgactgtgcgtccagacccctcaccagcggccccccaccacaccctggtcctcccaggcagctgtcccagggcgcccaggcctgccttgcaccacagccctcaggaaatccggcaaggaggcccctgcaggttggttcaggcccccaggtagcaaaacagagacaacagcagccccgcctgaccccctgcccctctctgtggaggcccgggacccccgcaataagcaccacatgggtgaggctgtccctgtcagggtcccctgccagggtccctcctggggttctgggccatttgaggggctctttgatgggccaggccggccagagtgaactccgagcactttctggctggtgccccaacctctccactccccactcattcccaccttgaaaaagggctataggtcccctgccctgcccgggtccagtttacaaacagtgtggggtggccccagggcctggccccactctccctgctgtgcccactcctctccagactccacctccccagtgggtatgggccctccacatgccaggtaagtagcaaacccccactccctccaaggaccaggtctcagagaaggccctggtcactgcccccggcccacctggagcccatcggggctgcctctcccagccgcgacttctccttttgccttaggcctcgcgacatcctgat

SEQ ID NO: 184361 - DNA, 311 bp, Homo sapiens
agaaaatacttctaagtcattgaattgtagacttgcctgggcttgttcttgggccagtgaggtttttagaagaaagctcacttcctgcagtagccatggcaacttcaacaatacaggccctaccctgccagctccaatctgtccaacagattcccagggaggagaaatatgttatcacaataagagatgatttccaacttttaacatttttaagtaggatatttattgttattcaattcataaatccactcatcttcaatctcagctacctaccacctcaaaaacacatatacatgttgccagtggagggc

SEQ ID NO: 184362 - DNA, 284 bp, Homo sapiens
aggataaacagcggcagacgatgcctactgttttgtaaaaaacagtgttcagggtatgtattagctgccttctcaaaaaaactgcagtcgatgatgaaggaagaggccctgaacaagaccaatggggaggatgcaggggcagactgtagttccaaaagattcctacactatatcccttatccagaggctgcggggccgtgaggccgcaaggagaacccatgagaaccttcttcggctgtctgccctagtgagatccccacagacagctagcatcgactgccaca

SEQ ID NO: 184363 - DNA, 424 bp, Homo sapiens
ctccctgtttccacgtacgatcccatctgtacctctgtaattgtgcttaccacagtattgtaattattaaggcaacaagctccctgaaaaatttgtcttattcatcttttggccacttgcactatgtaagttgtttatagtaatctatatcaaaacaataacaaaaaattgttaagaaccaccaaaattaaaactgactttattgaagtgactaaaacaccatcagctcgaaagttcttagcttcagcttcctcatttgttctttagtttgacatttgtttaatattatttgttttactaatgagagcctgatttaagtcattttcgtttctaccatattatttctagctgtgtattacactgccttctatgtgtgtgtatactctaggccaagttctcagtatgtaacaatacttggaacttt

SEQ ID NO: 184364 - DNA, 625 bp, Homo sapiens
aagttgctggcctcttgtgaccaacatagctatggcaccaatctttctagaatatacccctgtggtagacacacatacccgccccacctgccctttaggcacaatgaggcttgtcagacttagaagcatatgtgacctctacctccggccacagacagaagactctctttggcattccagatacatctatcatcactccgttataggaagctaagtacaatataatcctttccagagcttatgtccacaacatacctcttgggcctgtcactgtgataagtctatgtttataaatatgcttttctcttcatttatgccctcctaaaattactcctttcttgcaatttcctcagatggcttaataaggtatctaaggtacaatgaaaccttaagcacagttttaagggaaaaaatgtttataaaacatttgtatgggagaggatcgaatcataactccgaacagatgttttcagcaatatttacatttattttatagattataattatcagtgatgtcaacttagtatagatttctcctcatttttaagcctgaaattgtcattctgtgtatgcacatccaatgaatccaacaggtgaggtgatatattggaatcagcttccttct

SEQ ID NO: 184365 - DNA, 638 bp, Homo sapiens
gcaattgaagacacagccagcacagtccaaggaagacaacacagtggtggatatagggtccagccctgaacggagggcagatctagaggaaacagacaaagtgggtatactgcaacatccagatggcacagttttgaaacagttacaaccacctccaaggggcccaagagagctggaattctataatatggtttatgctgctgactgttttgatggtgttcttctagagctacgaaaatatttgccaaaatattatggcatctggtcacctcccactgcaccaaacgatttatacctaaaactggaagatgtgacccataaatttaataagccctgtataatggatgtaaagatagggcaaaaaagctatgatccttttgcctcatctgagaagattcagcaacaggtcagcaagtacccattaatggaagagattgggttcttggtgcttggcatgagggtttatcatgttcattccgatagctatgagacagaaaaccagcattacggaagaagcttaacaaaagaaactataaaggatggagtctccagattttttcataatgggtactgcttaagaaaagatgctgttgctgccagtattcagaagattgagaaaattctgcagtggtttgaaa

SEQ ID NO: 184366 - DNA, 1022 bp, Homo sapiens
ggcgccgctgctgctgttcttcggctcggttctgtctaccgggcagcgccggggccggcggctgcggcggcagaggaacaggagccgggagccgcgttccgccgagagttgggcagaggagcgcccgcgccccggcggcgtcatgggccccctccccgcgcttcagagggcaccagccgcgggaacccccgggcctcctcgcgcccgagcctgagcgaccctcgggttctccggcgccccctccctcgccctattttttttcctactctcgctgccgttaccgcttctgctctccgttatggcaacagagccaccatcccccctccgggtcgaggcgccgggccccccagaaatgcggacctcaccggcgatcgagtccacccctgagggcaccccgcagccggcgggcggcagactccgcttcctcaacggctgcgtgcccctctcgcatcaggtggccgggcacatgtacgggaaggacaaagtgggtatactgcaacatccagatggcacagttttgaaacagttacaaccacctccaaggggcccaagagagctggaattctataatatggtttatgctgctgactgttttgatggtgttcttctagagctacgaaaatatttgccaaaatattatggcatctggtcacctcccactgcaccaaacgatttatacctaaaactggaagatgtgacccataaatttaataagccctgtataatggatgtaaagatagggcaaaaaagctatgatccttttgcctcatctgagaagattcagcaacaggtcagcaagtacccattaatggaagagattgggttcttggtgcttggcatgagggtttatcatgttcattccgatagctatgagacagaaaaccagcattacggaagaagcttaacaaaagaaactataaaggatggagtctccagattttttcataatgggtactgcttaagaaaagatgctgttgctgccagtattcagaagattgagaaaattctgcagtggtttgaaa

SEQ ID NO: 184367 - DNA, 403 bp, Homo sapiens
accttcaaaaccatgcaaataaatggaaattaaataacctcctgaattatcattgggtcaacagcaaaatcaagatggaaatttaaaattgaactgaacaataatagtgacacaacctatcaaaacctctgggatacagcaaaggcaatgctaaggggaaaggtcatagcctaaatgcctacatcaaaaagtatgaaagaacacaaatagacaatctaaggtcacacctcaaggaactagagaaacaagaacaaaccaaacccagcagaagaaaggaaataaccaagatgagagaataactaaatgaaattgaaggaaaaaaaatacaaaaaataaatgaaacaaaaagctggttgtttgaaaagataaataaaattgatatatcattaacaagattaaccaa

SEQ ID NO: 184368 - DNA, 449 bp, Homo sapiens
agaggcgaaacaggtgataaagggagaggcatcagtcagtcctatgcagagatctgagctctgccacttggggaaaaagcgagtcataaaatcctctctgagatgtctgtagacagcagaagctggttggtgaaagtcatgttagagtcacatgcagctgttaggaggcccctctgtgtctactaggagatttgccgctgcagtattaggttgcatttgcagacactttatttcattagccatcaatatttcctttcaccccacacttggcttgcagttctagtgactgccagcgggtaggcgatcaggagtctctgcctccattggcgcctgaccctctcccctgtgtgtcttgtaacttcttttcttataaggatgcaaatcatattagattagggcctcccctacttctatgtaaccttaactaattacgtgtgttcgttccattt

SEQ ID NO: 184369 - DNA, 511 bp, Homo sapiens
gtagaagtgcattctgggagttgcagattgtcatgccctagctctgttacagtatctgaaagccaagtagtggagacagggacacaacctgccttagcacaagagaagtgctccagacaaatgaccgccagacagggtactgtgcacataccctgccatccatctaaggagctgaaaaggggctttggtttctccttctggcttggcctctttcagcctcagagtgcatatatacagtccagagagatcttttcatatctgaactgcaacccagagctaaaattttctcccttggcattcctagagccaaggaaaataggaaatagctatttccacctctggcatggaaagtaaagtgattaggatcaatccagcttcctaggataactaaaaaatctggattaccttttaaagcatcaaacatcaaaacacactagtgagaaattactgagctctaatctaagagaggttaagaacctagagaggtaagcccagtgctcagaggtaagcc

SEQ ID NO: 184370 - DNA, 201 bp, Homo sapiens
gggtctgtccctcctgagccccaccattccccggggcccatcacttcctcgtggctcctgtccccagccctgcggcctcccttatccctctcctctcaccaagcccaggccttggggcacttcccacagtgcccaggctgtggcctcttacaattcccaccctagcccccggcagcagccaggctagttattccctcacat

SEQ ID NO: 184371 - DNA, 338 bp, Homo sapiens
acacttttcagctgggaagagtgaaacaagttaataggaaataaaaggccatattgtctattcagactagtacgttacttttccagagtcatggggctagcaaccactatatgtctgacttctaccaagaagggttgaatccctggttgatcctgtgaggcctgaggcatataaacaagaaacatgaaagggagaggaaaattaaatgaagtgggagtgttgcagaataataatacaattaagggagaaaataatagaggtagaggaagaggttatatacacttatttctcttactatgaacattttacttagaagtgtaaggttgtatgtcttgttt

SEQ ID NO: 184372 - DNA, 1313 bp, Homo sapiens
gcaagaccctgccacgccagcaggtcttcctgggggggccccaggcagtgtgtgttggtgtagagtgggaggtcgctggttctcctcggcgcctgctctggttcatcctccctactcgtcttctggacagtgtggggggccacattcgtacccagccacccgcgtgcaggatgtggagccggtgtggtcagctcctggctcctcctgcctgtgttgcaggtagtatccgggcgcgcacatccctgtacctcggtgcgctccctccgttagctgtccgtctgtctccctgctggccacgtgcacgtttgtcatcacaaagcctccgagtcctgttcccaagggtagtttctagcctcggaccatgttgtgacaactccatcggagatgttgctgaaagtccactcgggccagagaagtggcctaggttgtcttagccggccgggggtatctcgatgcccttcaggtgcttattgggtagaaatcacaaactctggaggtgtaaagtaaaggcagctgaaattctgaagagtgctcccgagtgctgggtagagagaagataaagccttgggatgaggtttggggaagctgaaggctgctgtgtgcattataagtgaccttgaaggtgaacctcgggcgattgctggagtctgtctgggtcaagaggctgggtccaagggcctccaagtggtgcatgggcctctgcctgggcttggggtgcccgtcagagaaaggcctccatagagggctctgtgggagtgagaggtgctggagcccggtttggagggacgcgagtgcaggtttgttggtggaggaaagattcagacagaagtgaccgtgttgttgtagctgctctcgtgtggaaaaggggaaccgtgagcacagagcagtggtggttctggcctcgtctccatggacggccagccggcccccagtagctggaggagagcacagctgggtggagagcaggcccttcagcaaggcaggcactctggactcagctcggcttttctgtttcttaggaattggccctgtattctgtgtgctgggaggtacccagctggtgcctgtggggcctctcttggcaccttgaggtagttgctcgtttcctccaccgggccttatctttcccttctgggcgtttccagccctgtgttttcacactcagggctctggctgagattctgtcagttggtgctttcatctctgcacagtcatggaggccctaagaccttgtcttggatctgggaacttctctcagaatcctcaaacatcaccctggctgtgcatgggagctcacacctgtaatcctaggg

SEQ ID NO: 184373 - DNA, 294 bp, Homo sapiens
ctgggactacaggcacgagccaccacagccggcccaggagaattctttacatccttctgaggaaaatggattactctcaggtagggtggcttcagctcttcagcactgtcctttctagggtctgaaccacagggtggctcaagggtctaggtaggtgcccataatctcttttgctcaaaaatataagccactcaagcaaacatactgtgcgcttgctatgcattgcatggcaacctgcagcctcccgcctcctggccaactagagggccactttcatgctcctcctagacagaa

SEQ ID NO: 184374 - DNA, 171 bp, Homo sapiens
ttgcatacagttcctgctcatggctgcagagaaaatgagatggcaatggggagaagacaggaagaagaaggcaaaatgagaaacaataatgacagatgctgcaatggtccaccttttcgttactgacatggttaattcttcatcttggattgaagtagaaagtactttttg

SEQ ID NO: 184375 - DNA, 1529 bp, Homo sapiens
ggcctgaataaaaggccgcacacgtgtgtcgggttttcttgggtgcgatagaggacctgcccttcagcagcggtggcgccctgctagggtcgtttgtttctttctgctgtgagttagtttagcgtgagattgcagatgttaccatcggctggaattatttcgtctgcgctggagaaccaggacatcagaggaagaaaatcagcagacagaaaaatactggggaaaaaaaaatgccacgtggttctgttcagctgagcttctgctccctccagcacccccacatgggacatttgtttaccccccacgatgctgctcttggagagtcccaggggacaggtttcaagcccttagggatgcagcctgtctaacttaatatgcacagccgttcacatccagggcacagaggcagcctggctttccctggaggcccacggggaccacaatgctgcatttgtctgtggaactgagatttagctgcacattcttgcctgaatgcagcgggcctccagccacagcctgctggcatgggggattccaggagggatgtgcttcatgagccggcaattgcccttctttccagtccccagacccagtcaagattacagatagatgcgttcatcgcgcgcaggtgctggggaagccagtgggacatcactggctacattcaccaacaggattttccaactgcagtatttatcggtttttcaaacgaattcaacatctgtattcctcacccatttactgagtggctacaatgtgtaaggaaatattctcagtcatggggagttagaaaaggtcaaaggcatataagatatggcatgtgctctgagagaactcatcatctatccagaacctactcatcacttttggaaagagaagagaaactagcattctatggagtacttaccatgtgccagatttggagtgagacatagtacgagtgttactcatttacgtctcatggccaacctccaatgtggacatttagcatctccatcttacaagtgagaaatttcactgtagagaggttaaatatcatgtgtcattgattctgtgacatgtattattttcacatttgaacatctgaaatatagatatgtctaaaagggcttttctttcttggtagtaagataactgtaggtctttgcagtagtgtcttagattatgtgaaatatggtattttggcaagtgtacatggctaagaacaagtggaatcagaattcaacttaagtttgcttgactccaaagcttatgtgttttccagtataatgtgctgcagtatcaatggtctgtatgaacaaaggccatatcatttttattgacaaagtatagaaacggggaaatggtgactgaactggaacttgcatcatctaattccataactgaggagacaatagcctggggactgcatgtatcccacaggatgttaaaaaattgagaaaatgttatttcatgatcttcacttctctgttgattataacttatttttgaagaggctaaaataaatggcaaactcttgtatggataag

SEQ ID NO: 184376 - DNA, 1422 bp, Homo sapiens
  misc_feature (2)..(2): n is a, c, g, or t
  misc_feature (6)..(6): n is a, c, g, or t
  misc_feature (8)..(8): n is a, c, g, or t
gncacnangtaagaagtgcttttcacctccccccatgattccgaggcctccccagccacatggaactaaccaggacatcagaggaagaaaatcagcagacagaaaaatactggggaaaaaaaaatgccacgtggttctgttcagctgagcttctgctccctccagcacccccacatgggacatttgtttaccccccacgatgctgctcttggagagtcccaggggacaggtttcaagcccttagggatgcagcctgtctaacttaatatgcacagccgttcacatccagggcacagaggcagcctggctttccctggaggcccacggggaccacaatgctgcatttgtctgtggaactgagatttagctgcacattcttgcctgaatgcagcgggcctccagccacagcctgctggcatgggggattccaggagggatgtgcttcatgagccggcaattgcccttctttccagtccccagacccagtcaagattacagatagatgcgttcatcgcgcgcaggtgctggggaagccagtgggacatcactggctacattcaccaacaggattttccaactgcagtatttatcggtttttcaaacgaattcaacatctgtattcctcacccatttactgagtggctacaatgtgtaaggaaatattctcagtcatggggagttagaaaaggtcaaaggcatataagatatggcatgtgctctgagagaactcatcatctatccagaacctactcatcacttttggaaagagaagagaaactagcattctatggagtacttaccatgtgccagatttggagtgagacatagtacgagtgttactcatttacgtctcatggccaacctccaatgtggacatttagcatctccatcttacaagtgagaaatttcactgtagagaggttaaatatcatgtgtcattgattctgtgacatgtattattttcacatttgaacatctgaaatatagatatgtctaaaagggcttttctttcttggtagtaagataactgtaggtctttgcagtagtgtcttagattatgtgaaatatggtattttggcaagtgtacatggctaagaacaagtggaatcagaattcaacttaagtttgcttgactccaaagcttatgtgttttccagtataatgtgctgcagtatcaatggtctgtatgaacaaaggccatatcatttttattgacaaagtatagaaacggggaaatggtgactgaactggaacttgcatcatctaattccataactgaggagacaatagcctggggactgcatgtatcccacaggatgttaaaaaattgagaaaatgttatttcatgatcttcacttctctgttgattataacttatttttgaagaggctaaaataaatggcaaactcttgtatggataag

SEQ ID NO: 184377 - DNA, 482 bp, Homo sapiens
aggaaggttgcaacctgacagtgataaaagccgacaaaaccaaccctaagctctgccgggtggcgaaagatctttgaacatacagcagagcagggccccgagggacagcggtgctattttcatcttttctttttttttttagagaacggggttccgctatattgcccagaaaggtctcaaaatcctgggctcaagctatcctcctgcctctgcctccctaacagctgggattacagactctttttttttattggtttagagacagggtctcattctgttgcccaggctggagtgcagtggtgcaatctcggctcactgaagccttgacctcccaggctcaagccatcctcccacctcagcctcctgagtagctaggattacaggcacgcgccacgacatccggctaattttcgtatttttatttttaacagagacgggatttcaccatgttgggtcaggctggtctcgaacttctgacctcg

SEQ ID NO: 184378 - DNA, 1557 bp, Homo sapiens
catttgctgaatggctggggatttcaggaggcaattccctttgctctgaatctgtgatatgtgaggagcctggtaacatgaatgatgacatgtctttatctctcatgacagaatcccaaatactgtttgcaattagctgcccacttttctcattcaatgtgtgatgttcactgggagcactgtccttggtatgctcatcagaggcagggagctcccaatctacctgatttgcttcctgatactccaagccccagggttccagctgtctcactgtaaatcgggtttccggctcggaaccttcagccatgtatccttctgtttgaccatcactggggattgccgcacccccactgcagtcatcccagtccaaatcattgtccatatctgagatcgttgcagtggactgagtatcctccaaaatcactctgttccacaagtcgagactgtcaggggccgtctgccgggagttggtgctgctgtgcaaaagtgtgagttgtcggtttgtttcattgtacagttgcatcatgctggggtcgtcgtaactggactggctgctttccccgacgtcatcctccatggagatattcttaccatctgtgtgctctgtcttgagttcattttcatccaggttgtgagtggtatttatttcagaactgttatctgtatgaggtgaagcccacatgtctaggttcccaggacctgaactgattcgatttcgagatgactgttgcagtgactgaggaggaatgtcagtctcctctgccgtggagttaccatcttttgactcaaaaccttcctctttagcaaatggcttgtgttcagtttccttttcgtctccagcaaatgttggtgatgtgtaagagtctgaggtggaataattggtatctaagggggaaggcaccgaatcttctcctaggttggatgcactgtaatcagaacatttgtaagataagaaggaatcttcccaaggaactaggacatctgaccctcctttcttcatattctcctcaaaaaggttccaggaatctaccttttcatataccttgcccctagttttaggatccactaaaccattctgatcttcttttggtggcttagaattagtccatgtgtgatccagatcagaactgggatttccaggtgcaaagatgtgatccctggagtcattgtttttcttgccccagatttctggagctgcttcattgtttatctcactgggtgaattgtccagtagttctgaagaagaaaaggcaaacccactttttgccatggcccactcattcgggtccctaacagaaggtgtcttgctgcttgttgggtgcaaattccaggtattttttaaagcttcatcatgatcttctttaccaaatgcactccaggctgggaatggcgccacagctgctggttcaccatcatctgtaggatttccccagggctcgggcatggctgtgggagagcgaccagaatgccacaaagaagcaaagtcttctatcaggtggtttgttccttggggagatgtatttggcaaaggtgacttctccatgggcaggttctgga

SEQ ID NO: 184379 - DNA, 839 bp, Homo sapiens
cagaataagatcttttcctttctgcccgtggacgccgccgaagaagcatcgttaaagtctctcttcaccctgccgtcatgtctaagtcagagtctcctaaagagcccgaacagctgaggaagctcttcattggagggttgagctttgaaacaactgatgagagcctgaggagccattttgagcaatggggaacgctcacggactgtgtggtaatgagagatccaaacaccaagcgctccaggggctttgggtttgtcacatatgccactgtggaggaggtggatgcagctatgaatgcaaggccacacaaggtggatggaagagttgtggaaccaaagagagctgtctccagagaagattctcaaagaccaggtgcccacttaactgtgaaaaagatatttgttggtggcattaaagaagacactgaagaacatcacctaagagattattttgaacagtatggaaaaattgaagtgattgaaatcatgactgaccgaggcagtggcaagaaaaggggctttgcctttgtaacctttgacgaccatgactccgtggataagattgtcattcagaaataccatactgtgaatggccacaactgtgaagttagaaaagccctgtcaaagcaagagatggctagtgcttcatccagccaaagaggtcgaagtggttctggaaactttggtggtggtcgtggaggtggttcggtgggaatgacaacttcggtcgtggaggaaacttcagtggtcgtggtggctttggtggcagccgtggtggtggtggatatggtggcggggggatgggtatactggattgggctgcggaccctggaggggggc

SEQ ID NO: 184380 - DNA, 948 bp, Homo sapiens
cagaataagatcttttcctttctgcccgtggacgccgccgaagaagcatcgttaaagtctctcttcaccctgccgtcatgtctaagtcagagtctcctaaagagcccgaacagctgaggaagctcttcattggagggttgagctttgaaacaactgatgagagcctgaggagccattttgagcaatggggaacgctcacggactgtgtggtaatgagagatccaaacaccaagcgctccaggggctttgggtttgtcacatatgccactgtggaggaggtggatgcagctatgaatgcaaggccacacaaggtggatggaagagttgtggaaccaaagagagctgtctccagagaagattctcaaagaccaggtgcccacttaactgtgaaaaagatatttgttggtggcattaaagaagacactgaagaacatcacctaagagattattttgaacagtatggaaaaattgaagtgattgaaatcatgactgaccgaggcagtggcaagaaaaggggctttgcctttgtaacctttgacgaccatgactccgtggataagattgtcattcagaaataccatactgtgaatggccacaactgtgaagttagaaaagccctgtcaaagcaagagatggctagtgcttcatccagccaaagaggtcgaagtggttctggaaactttggtggtggtcgtggaggtggttcggtgggaatgacaacttcggtcgtggaggaaacttcagtggtcgtggtggctttggtggcagccgtggtggtggtggatatggtggcggggggatggctataatggatctggtaatgatggaagcaattttggaggtggtggaagctacaatgattttgggcattacaacaatcagtcttcaaattttgtacccatgaagggaggcaattgtgggggcagaagctctggccctatggcggtg

SEQ ID NO: 184381 - DNA, 300 bp, Homo sapiens
aatggagagaatgtcagagaggttggagctgagagagggaggcacaccatgtctgtctatacccagaggccactgaaggacaggaagtgacagggtcagctccacagtctaggaaaaaatggtgcatagaatggatggaggtgaggagaagaatctggaagctcctctaatgctgcaggcaagagtatcacaatcctcgaccagaaggattgctattggaaaagagaaggaagacacaaaatcaaaacagggacagagagtgatgggagagcgcccacctccccgccccttcctccacct

SEQ ID NO: 184382 - DNA, 546 bp, Homo sapiens
gcgtcagcagattcgcattttaaaatgctacttcatttgcagtgtggagcatggactataggggtatggatggtgtatcaaggtgtaacagtggatgtgaagaagatcaattaaaagtcaaacattttgggttatattttaaaaatggtttacttctcccaagattcattctttctgttggtgttaactggaaaactaagtaagagagacaccgaacagaaaaaaacatttttacaaaatattattatagtctgttaaagaaaaaaagaaaaatgcatctgcctagactttatcaagtctcagggttaatttcagcattccaagttctctaccacttttgggactggagtcaggtcgcttgactaagttgggatggtcagtgaccagtagttgcagaacttttgtctatgaatggctgaggccctccatggtagatctatgttgaaagggaagctcaagatgataaatctgctaatctgcctttgaagcagctagatcagcctcaccctgcaggcctgtgctggcacaagtcagtcctactagcct

SEQ ID NO: 184383 - DNA, 438 bp, Homo sapiens
gaagtttaattttctgtgctgtagttacaaatgcatttttaagtacacggagaattttaaatgggcagaagagaatttaaaggtgctatttacataaatgtaaaagcccctaaagtggagaaatctctcataaggaatttcaaacatttgcttgactctggaggcctggcatactaaggaattaggattcctcctaagaattacacatctgaaggctgtcctgaaagactttccatactcgatgatgctcttttgggtaccactacctagatgcacatttagcttattttcttcctcactatccactaactcctgtggtctgcttagggctctgccaaaaccggtggttctcaaaggtagccatggattggaatgacctgggtagcttttaagaactcactgttcagatcacacttcaaaccaaataaatcaaaatct

SEQ ID NO: 184384 - DNA, 507 bp, Homo sapiens
ggtgacagagcaagactccatctcaaaaaaaaaaggatgatagggttagaaaaacaaaaaaacaccatttgcaagcccaaatgaaataactgattcaaagctcaccaagagactcaacacacaggtaaaaggctgctggaaaacaggatattcaaagggaaccaaaacgtcatctcactgatctgctgattgtcaaggggaaacccattgttataatggatagatctggtgaataccaccttaacaccaaatgatcacactttaggcaaaccacctgatgcctgtgttatgagtcaatataacgtacacaggagtaactaagccaaaaaaaaactaaatataatccagtctttaggctcaatcttctactttaggaaatacagtgggaattgagataaaagttaattgctacaagaaaatcagacaaatccaaaatatgggaaacattctatatgacaaatggcctggtctcttcaagaagccaatatcatgagtgtaaaaaaaaaa

SEQ ID NO: 184385 - DNA, 392 bp, Homo sapiens
caaaatgacttcgtagttcacctagccaaaccagttccttattagaataaaagggttgcaaccagcatgccctccaagtggtatatgcgcactgactggaagctgcatctcacatgcgtattgggctctcccacgcttatacacaccaaacactgacacactgaaactttctaacatacctgcaaacctgtcaaataccagctaatgcatgaaaactcccagttatcactcatatgacggcacggtgtgatacctgcttggatttcctagctagtaataacgcaagcgtattttgcagcataagacaaaaatcacaaaaaggcaaaaatcacatgttaaggggctggccaggcacggtggctcatgcctgtaattccagcactttgggaggt

SEQ ID NO: 184386 - DNA, 469 bp, Homo sapiens
tataatcccagctgctcgggaggctgaggcaggagaatcgcttgaacctgggaggtggaggttgcagtgagccgacgtcacgccactgcactccagcctgggcgacagagcgagaccctgtctcaaaaaacaagcaaacaaagaactgagaaccagagtggtctctgtggcccttgggtgggtggattagggagattgttgccagaactggtaactgggagccttgggtttcagcagctccaagggaacaggagatggggcctgggcccaacattgcagggaaagaaaggaaatgaatgaacaagagaagcatctgcctgctggccccagggcagggagcagggaggcagcactgatacttgtttccccagcatgagcctctggatcaggagtgggaggactgaagctggcctcacccaaggtcaggctttgaattgatgttaccagtttggtccgggaatccccaaag

SEQ ID NO: 184387 - DNA, 398 bp, Homo sapiens
tgaataatacactatttgcatatagacacatgttagtgactttcggccctctgatatcttccctcctcattaaattataagatcctttaaggaggttactctgcatcattcactgaaaacaacatttaataagcgctttgtgccaggccctggaatggaaatgattgagatccctcctttcatcttaggcagcagcaaagacaaggaaataaataatgtgaatagcgttatgaagacgctgtgatgggaagacaagaaggagtaactagggagtagatcattctatagaaagaacatgtgtaaagacatgtttgagaggcagaatgcattcagggaaatgtgtttctatggaaggcttggttcaggaacaagaggagactagagcccgatgagaaaag

SEQ ID NO: 184388 - DNA, 119 bp, Homo sapiens
atgtattctatgccacgccacgttcaaagtggttcccatgctttatctcagttaattttgtgaccataacccaacactgttcaattagtgttccccaaaacagtcagaaaaaggttaat

SEQ ID NO: 184389 - DNA, 767 bp, Homo sapiens
cctcccagactcaagcgattctcccgcctcagcctccagaatagctgggaccacaggcgtgcaccaccacgcctggctaatttttgtattttcagtagagatggggtttcaccgtgttggtcaggctggtctcgaactcctggcctcaagtgatccacctgccttggcctcccagagtgttgggattacaggcgtgagccactgcgccgggcctggatatgtttttttaaatcaactcattttattttctccttaacttgtccaaggtggtatctgtaaaatcagggggtgagttgcaaactctttttcctaatactcatgaaagcaagcatatatccatttaaaataaaacattttcctccccgcaccacccaaatcacctcaagcaccccattttgggaaatgctgtgccacactcaagcctggttgcctaggagaaaacttcaggaagcagctttaatgagcagataagaatgatttgcaattagcatcaattgtctgtatgcaaattaaagctcccaaccgcagggccctcttctgcagcgggctcctctcccatttcattgccttcatttctgggttcagcagatcctttccttagacacagggttatttcatacccaccctcccatctcagccacagtctactccaggcctggctgtctttatgtctcggatttcaaatcctcccagttgttcgggttcgctaaggtggtggtcccatgcctggaatgggggctactgcaatcgagacctgaggcccctgg

SEQ ID NO: 184390 - DNA, 233 bp, Homo sapiens
ttcaacatttaatactgctccaaatacagcttttaggttaattttagtatagccaattcttgcttcgtcccatttatagaaaaataggagtgagaagccagtgaataatcccccagatttttttttttttttttttacattgggttacatcagtgttttcattagattcttattagatgttcgtacttgattgctctgttttggtagattaggaaatcacattttattttccc

SEQ ID NO: 184391 - DNA, 734 bp, Homo sapiens
ttcaatcagtcacccaggctggaggaaaacttcatctccaaaaaaaaaaaaagaaagaaaagaaaagaaaatatagaaagaagagcagatgaagggatggagatgatgcatttgtttggggggtacatcatatttaaggtctgctccagttatccaatactgcataacaagccaccccagaacttagtggttttaaacaacagcatttattatggtcacactactgtagtttgggcatggcttggtcaggacagctattctctgctccactcagcctcagttggggggacttgaagactgaggctaggggcatctgaaggtgcacccgctcacatgaggggctactgacaccaggaagacctagcaactgaggtttcctggcacctgtctctgtctgcctggcctccagcatgcagactcagggtgtccaggcttcttacatgttcgctcagggttctcaaggcagcagttccaagagaggcaggtacaagctgtgtggctttttatggcctagccttagaagtcacatggtgtcacttccgtctcattctattagttagaaatgtgtcacaaaggccagcccatattcaaggagaggggaatcagaacaccttttggagggaggagtatcaacgaatgtgtgaacatgttttaaaaccatcaccaagtctttgtgggatgttgatgtgggtagattcaggagtgacatatggatttctaagagaaagagctgg

SEQ ID NO: 184392 - DNA, 217 bp, Homo sapiens
gggggcgacttagaggatccacaacgctgaccctgtcctcagcactaggctgtcatcatcgctgacactcctatgtgtgcctctcctggccctgtgaccctcactgcagaggcacctgttctcttggatttagagtttgtgtttccattgtaatccaggttccacaaactagtagctggtcttcccaaagtggaaggttcatgtacaaagtccactg

SEQ ID NO: 184393 - DNA, 368 bp, Homo sapiens
tttccaatttcagatttttttgtattttggaatatgtgcatatatatgaggtatcttgaggatgggacccaagtctaaaggcgaaattcatttacctttctgtttcagaaaaactgtttttcctctagattccacactaacacaataccaacccagaacactttcgtgtccaaatgtgtagatttcttcccgagagcgagcaagcaatcaattctgcagtgaacaccaattaggtatcctctaattcacttccaacaccatctttctggaaataatatcagatcctgcaggttgaggcctcagtccccaagactgcccccacccacacaccagtagcaagtttagggctccagaacttctgaccaacc

SEQ ID NO: 184394 - DNA, 397 bp, Homo sapiens
cctgctcctgtcattgggcggaagaggggaagtaatgaatgatacttccagacccaaggaatgttaacttcctcctcctctgcttctcacgctttgccaggaagttcagtattttgaatgctacaaatacgcaaggtgggtaaattactattaactttcttcatttcctgacttagggttttttaattaaatcggattccctccatgttcccccgtccccggtcatctagtcttttgtgggttattttcgaaggcttaaaaatgacattagtaccatttcaacatttgtcagacccaagtggaactccccttatcctgatctgcacaacagattcacattttcttgattcagctgttcctcacatcctgtcattgggaatagatgcttaaactgaat

SEQ ID NO: 184395 - DNA, 287 bp, Homo sapiens
gtacttgcaagtggggctgacacagccatggctctgaagttgagcaaaacttacttaaacccagtaagtggttcacttttacctctcttcttccactaacatttaaagcaatgtttcattctttctcagtttttaggacacttatatttggccattactatacaatcatagatatgtgtacttgggtataaaaagtagaatgtttaatctattcatgtctatcagtcacaacagactagaaaatgtgaatgccacttgactaaaattattctaaactttaaaggccg

SEQ ID NO: 184396 - DNA, 397 bp, Homo sapiens
atcctcatatatacccagtccttccttacattgactcaaatgcccctaaaacatgtacaggtactttgtcctaattagggtctaatttgggactttgctttgcatttggttatgccccgtaaccttcaagtagtgtccactatgactctttttttcaggagatcaagatagttgccctacaaaatattgtgccatctgaatctttctggtttcttctttgtggtggtgttaacttgttcttaaatccttgtatatggaaaagcaagatctaggcaacatagatttaagttaagtagatttcaactagaacatattgtaggtggggtcctgtgtgccaccatgcgtctcaccaggagacacagtgtctagaggggccaccattcatggggcacactct

SEQ ID NO: 184397 - DNA, 360 bp, Homo sapiens
cccagatataacttgaacccagtcttttacttgataaagaggagataattgtaattgttgttaatctatcaaacacctttcccttttcagaagggttttaaaaaataaagtagttcttaaggcatgttcactttctatctacctaaaagtgctaatctgtaagtgccctactatatataacactgagaaaatttctgccttatcagaggagggcatgcccaggattggtgccaggtgttgtgttatgctaggctgcctccaaaagttactctcaaaaactactcttcagttgggccctttgtggtcaggaaaaaaaaaaagtgatacagtataatgaaagagaggtcaaaacagttaagt

SEQ ID NO: 184398 - DNA, 210 bp, Homo sapiens
taaagtatcctttccaaatatgtacatttcttgaatttttaagttgacaaggccaaaggtaaattattccagatggaaattttccagaggaaataaaagtgctaaaaatgataaaaggagggataaacagaaaagataaattttctttcttttcttcggtcttttaaaaatgtcaaatcatggctttcggatggggaggtgggggcagca

SEQ ID NO: 184399 - DNA, 466 bp, Homo sapiens
cgatatttgtggttctggcaagaaaaccaaacaagaaagtaaaaggccatgagatgatgccaaagaaatagggggaactgaaaaagtgagaccacagtaataggaaggttaatgatccaaagacgaaacactcacctcatatgcacgcccttcctaagctgtcaagtataaagggaggaaattttctggagggatttatatttccagggtgttcaggaccctacctgctaccctcaattctgcccctaccgaggggttgtcctgataatcactgaacaggcctgtgggagaacctacctcaccccttcccctttccagaatcctcaaggaaacagtaaaggatcgaagtctagatgtgaaggaagtctatctttacaacaacaggcagagacagcaactttcaggcagaagagcagcttgtgcaaaggcctaagctaagagctatgcgtgggagacctccagggtg

SEQ ID NO: 184400 - DNA, 399 bp, Homo sapiens
tttaacattttaacaccattttgaaaggcagtgtgtgaggttgtaagtgtgttattgtactctcttgcttgccaggcattgatgggaaccttttatgtgcacgaactcactgaaatctcacaataatctttaggagagtagcagtagtgacatccccttttgcaaatgaggagaatgaggcttcaaaagatttattaacccgccgatgatcacaagcagtgggacaggctctgacgctaggtctgtgtgcctccaaagcctgcattctgaaggccacatgtgaaaatggacacctgttccaatatttctaaagagttgttttgtgccatcctgttcatcactggccttattgatgctgtcttcaacatctgccactttccattttttctactactgtcc

SEQ ID NO: 184401 - DNA, 496 bp, Homo sapiens
actaggcaataggagttttttcagttcctctataattttatgggaccactgttgcatatgtggtctgcccttgatgcaaacattgttacacatgactatatttgcatcatctttcaccctctagaaggctgctccactgcttatgtcatttacaaatataaaaatatatataattggctacatttttattgcacaactgtgaaaggaaaatatatctcgggaccccaaaatcactaagccaaaggaaaaagtcaagctgggaactgcatatggcaaacctgactcttattctatccctaaataagatacatacaaagattaaaaaaaaaaaaagctacatacctccctcaccatttgcccacaaggaaattccttgtggacaaaggacagacagaagacagaactcaaagttgtccctctgctcacatgagacaaacgcacatctgattgcttcctttgccctattgtttcactaagccagactaaggcataaatg

SEQ ID NO: 184402 - DNA, 752 bp, Homo sapiens
agaaaaatgggataatgtgatgaggagtggctgccggattggctggatctgagtcaggtgttcacccctgtgcatatgaggcattaaccccatggctcactacccacttggaggtgctgtagatccagcttatctgggtaggggtcacagaaggaacagtcaaatggctgatgtcatacgcagactgaaaggaaatgcattaagcaaatgaaaggaacgaatatggctggttagactgatatttaaatgaagctttgtagtgttgtgacatgtggcattttacatcattcttttaatacaaactctgcataaggttacatactattgatcatgaagaacttgatttttactccagatatatcatttaacccagcattcccattactgggtatatacccaaaggaatataaatcactctattatgaagatacatgcacaagtgtgtttattgcagcactattcacaatagcaaagacttggaaccaacccaaatgcccatcaatgatagactggataaagaaaatgtggcacatatacaccatggaataactatgcagccataaaaaggaatgagatcatgtcctttgcagggacatgaatgaagccggaaaccatcatcctcagcaaactaacacagaaacagaaaaccaaacaccacatgttctcacttataagtgggagctgaacaatgagaacgcatggacacagggagaggaaaaacacacatcggggcctatcgggaggggtggggg

SEQ ID NO: 184403 - DNA, 519 bp, Homo sapiens
  misc_feature (401)..(401): n is a, c, g, or t
  misc_feature (502)..(502): n is a, c, g, or t
gtgcatgttgaggacaggagcccaggcgtggtggacatggtgggaatcgctgtgtgcacttgcaggccggtggcatggctctgtaaggcgggtggggagtggccacaggaagaacccaaccccgatgcggagaatccaggatggcttctgccacttttgagccatgcaactgttggtgagccccttcgtgcccttgaacctcagtctccacctgtgagtaatgggagtgatgacagcatctggtcgcctccccacagcggggagaaggtgagggagaatgaacagggtttgctgagagaccggatgtgggatgtgagagaaagagaagaatcaggggcaactccaaggactctggtctgcgaagagagacaggaggaaggaactgccatccccgggccagncaggctagaaaggcagggacggccaagagctcagttctggacgtgttttgtatgacgtgtcccatagttgatgtcctagctcagggtctggagtgaaccanatagggagttaggggtg

SEQ ID NO: 184404 - DNA, 580 bp, Homo sapiens
gtctcaaaaaaaacaaaaacaaacaaacaaaaaaacagatatttctcacagttctggagactggaagtgcaagatcaaagtgttggcaaattgtgtttcttaaagagggcctgcttcctagattggaaatggccatcttctctcggtatcctcacatggtagggagaaaagcagctctagtgtctcttcttataaaggaagtaatgccaccataggggctctattctcatgacctcatctaaacctaattctctcctaaaggccacgcctcccagtatcctcaccttgggggttagggctttatcatatgaattttttttttttttttttttgagacagagtctcgctctgtctgtcacccaggctggagtgcagtggcacaatctcggctctctacaagctccgcctcctgggttcacgccgttctcctgcgtcagcctcctcagtagctgggactaaggcgcccgccactgcgcccggctaattttttgtattttcagtagagacggggttttaccatgttagccaggatgatctcgatctcctgacctcatgatccacccgcctcggcctcccaaag

SEQ ID NO: 184405 - DNA, 652 bp, Homo sapiens
atatactttatacctatactagttttttgtgattatatgttactgtaagtaccaagtgacacaaggagttattagacacttacagtaccattaaatctacatcagaggcttttcagctgttaagagttacacacttactactgttaagagttacagaattactggccctgcacagtggctcacactagtcccagctactggggggccaaggcaggaggattgcttgagtctgggagtttgagactgtagtaagctgtgatcatgcactgcactccaccctcggtgacagagcaagaccctgtctctagaaaagaatatatggccattaaaagttatgattataaaaactgcattgctacatagaaaaatggttctagtatgatgttaagtgcaactataacggctaccatttatcaagtacctagtgggtgccagtcaatagctgggactctttaacaactctaaaatggagttgccagcagatgttaaaaccaagacacaaattatgtactttcttaagatcactggactggaaagtaggtaagctagaatttgaatgttggtttttctggccccagacatatagtgccagaaagaggtgtccatgatgcttaaactatgtaaaaggggtaacagaggacatgaaaaaaga

SEQ ID NO: 184406 - DNA, 581 bp, Homo sapiens
cattgtttgaagggcagtggtacgacaaatgtttactaggtatttttatttttgcaagtttccactaagaaaattttagaaatgatggctgggtgtggtggctcacgcccgtaatagtcccagctactggggggccaaggcaggaggattgcttgagtctgggagtttgagactgtagtaagctgtgatcatgcactgcactccaccctcggtgacagagcaagaccctgtctctagaaaagaatatatggccattaaaagttatgattataaaaactgcattgctacatagaaaaatggttctagtatgatgttaagtgcaactataacggctaccatttatcaagtacctagtgggtgccagtcaatagctgggactctttaacaactctaaaatggagttgccagcagatgttaaaaccaagacacaaattatgtactttcttaagatcactggactggaaagtaggtaagctagaatttgaatgttggtttttctggccccagacatatagtgccagaaagaggtgtccatgatgcttaaactatgtaaaaggggtaacagaggacatgaaaaaaga

SEQ ID NO: 184407 - DNA, 307 bp, Homo sapiens
ccacattcttcatataacgtgttagcaaacacagacatatgcaggactgattggtgagagaagcaagcacagctttgggaagaggcaccctagttccagcagtctggtaggcaaggctgccgagtcaccagcatagacggctctgggtatattccacgtaaatggtgtgcagagggttaggctaggcacatggagcagttctataatcctaggtgttgtagggctaagggccaccaactctccagccctaacagttacgtctccagctgcaaagctatctcttagcaggggaaagggcaaggcaaag

SEQ ID NO: 184408 - DNA, 283 bp, Homo sapiens
caattccccttgtacagtgctcatgccaaaccagaattggaaccgaatcaatctgatgggttcaagaactgtgtgccgtgagacactacaactgtcctgaatgcttcaaaaatgtcactgacatgaaaaacaaaacacccgctaaccaaaccaaacaaaaagagagaaacgtgttctacaataaagaagatcagaaacatgaggacatgctaataaatgtgatttgcaatccttcctggagcttttattacttaagctgtgaagacactcagaggacagatgg

SEQ ID NO: 184409 - DNA, 482 bp, Homo sapiens
ggtttcccccagtggggctcgtgctgccaccacgtctgattatcccggtacggagccgccgcgctttctgtaggaatatccaggtcacgtgagtaataaggcaaattagtgagccaggcagagaacggcgttgtgcaaatagcacatctcccctggaaaacgcgcgtccccccaaacgttccccggttattcttagaaatcttctctcatctccctgtgagacagggttcaacagcccccacagacaggacaaaatgcataggaggctgttagaataacatggatgaggctaaaatacccctcagacacacacataaaaagccatatccaacaacagaacgagctaaaaatattccaggctttggcaaagagcacagagttaaataaattatacaagagccattcatgggagcaagttgactttctctcttacgggaacttggttcaagctaataaaaataataatttactagccactgagc

SEQ ID NO: 184410 - DNA, 319 bp, Homo sapiens
aggctcaggggccggtagagatgaggagctggtgcactggtgcagagctatgggtggtcaaagcgaatctgcctcggtgaaaaggcccaagaggccagctgtcccctcagctgagctcaggacagaccacccctccccagcagtaccaaccagctctcagaggacgctgggatgctcccagccctccttgggctagggctgtggggctgactcgttcctggaaggctggttaaacacacagtcacccagagagtcggtgaaaacctaggggctttgttcatgaaaggaggtgtttgttaggcctaagtcctccggccta

SEQ ID NO: 184411 - DNA, 454 bp, Homo sapiens
atttcccccattcatgcttctcaaatagtctcttaaatctacttttgcctaaaataccctacaccatagcttgaaaatagcataaatttttttgtagtcttttggcagatttctgtcacagtgtttaccttgtattacagttggtgggaaggaacattttttgagctattgccggtgtctttataatgtatacaattttggatgtaacacattaaatttgaactttggtattctgcaccacttcctttgctttatgttttttctttagctcacatagaaaaatattgcacacaagaaagaacatagtggatgctaaaagaaacaaaccctttttaagcctttagtaggactgtttgccagtctgtttttatgtagttttgttacatcacttaggtgagctctacgttagtaaggagaagatttgcagaggatgtcatttctggagaggaaagag

SEQ ID NO: 184412 - DNA, 347 bp, Homo sapiens
tacaaaaattagctaggtgtggtggcacgcgcctgtaatcccagctactcaggaggctgaggcaggagaatcgctagaacccgggaggtggaggttgcagtaagcagtgagattgtgccactgcactccagccggggtgacagagcgagactccatctcattaaaaaaaaaaagttaaataagcacttttgttgtatagtaaacataggagggaaagacagtgaaggataaacatagcttgcttgcttcactcaaaggtacttgtaaagacacccagattcagctttgatttttaagagactaccctgtgacaacttactttggaaaaaatatttgtgtaaatacag

SEQ ID NO: 184413 - DNA, 354 bp, Homo sapiens
cagttcttagattggcccacaaaagcctatttcatatataaatatatctaaagtcctttactaaactaataagtgctgtgtaatctatatatacacataatatttttgtggaaaaattgattctgatttccaatatgagatgccagtaaaacatctcttttctccttctccctgcttctccaccatagatctagtgacagaattagggacttccacaaatagttgtcttgactctgaacataatgggtcagcaaagagtgagtattgacgaaaaagaagagacgtggaagtaaaggagagattatgaatgaggagctagagagagaccaggaccttttcttaccagtttaattt

SEQ ID NO: 184414 - DNA, 524 bp, Homo sapiens
ccgaacgggcgctccataggggcctgtgcttgcagaatcctccagcccgctccccgcgccttttctttctttctttctctgtacgtctctggaagtcctgactgccagagcgtaatgtgtacttgaaactttggggggacaaaaccgcgaacgtaacatacagcccccgcttcctctcttttctttttaaccagactcttccggggcagccgaacctgaaatggtggggatggcgataatgcaagtgtgtctgtgtggggcagcattttctccaaatgtagttcaagaaaaccctgggaaaaggggtgtgtgtgtgtgtgtattctaaatgcagctctttctggggctttaatctcaaagaagaatgcattgggatttctacagcaacttgcacttcaatttggaaagcctcattcaatgcgctcaattgagagcgcattggggatgactttcacagcagttaatactgtaggtcgtccctctgtcagggtgagattattaaaagaagtgcttgtctacgtcag

SEQ ID NO: 184415 - DNA, 312 bp, Homo sapiens
acctgtcctcaccatcccaccccatacctccaagctcacagctagaactgaccaaaggcccagttatttatttacaaagtccatgtccagaactgtaccagcctcagcggtgtggaataaactggtgtggccaggtccattgtgctgatgcctcaagagatccaggctggtacagatgggtctggcacattctgtacctgccagccaagcagagcatccagcttacttctcactcgactccttacataacgctcgtcgggtactctccattccttgggcttaaattccatagtgtaatattagtaaaccagg

SEQ ID NO: 184416 - DNA, 279 bp, Homo sapiens
acccgggtaatttttctgattttcagtagagatgagggctcactatgttgcctaggctagtttcaagcttctgagatcaagcaaccctcctgccacagccttccaaagtgctgggattcgaagccaagcctggctggctttcatgtcttttctatgtagtttatgtttctggatgccattgagagtctggctggctttcacatatttgctatgtcgtttatatttcttgatgttattgtaaatgtttattaaaggaatcttttaaaaactttgttttgg

SEQ ID NO: 184417 - DNA, 445 bp, Homo sapiens
tgtgatgtgtgttgtatatgcgttgtgtgtgctgtgtgttttgtgtgtgtgttgtgtgtgtgctgtgtgtggtgtgtgtggtgtgtgctgtgctgtgtgtgtgttgtgtgtgtggtgtctgtgtgatgtgtgtgtgttgtatgtgtatggtgcatgtgtggtgtgctttgtgtggggtatgtctgtgtgtgtgtgtttgcttgttttcttcccactacaagaatctaaggcccctagggtaaaaatcatgtctgattctcctaaatctccaaagcctggcaacagtgcctggcacagagtagatatttagacaagggaaggaaggaaaaaacaatcttaagccaaactaccacgctgacattcagcagatgcgaaattggaaacacaggtcagctaaaagtccaaagtcaaactatgagtgtgtgatgaagccctagcataccct

SEQ ID NO: 184418 - DNA, 441 bp, Homo sapiens
acccgccttggcctcccaaagtgctaggattacaggcatgagccaccacacccggcctacagcagaatgagtcttattctggttagtatatttcattttctagaaaataaccaagataatatattttaggaatgagattaggatacaaagtatgagctcatttttcttttggtataattgcaaacttaacacagatagttgcaagaataatgcaagaattccctatgccttttagcgagatttaccaattgattatacttggttccatttgtttttcattctttttctatccctccttctcatactctcagatacacacacgtgtgcacacacacacgtttgcattgtgcttttcctaaatcctttgacagtaagtttgaaatctcaagcacccttaccataaaatgcttcagcatgtatttccttacaaggccgttattt

SEQ ID NO: 184419 - DNA, 285 bp, Homo sapiens
tgctaaatagtagtctcttttttggatatgccacaatttgctgttggctgtgaaaattaatgtactgctctttgtgtgggacatatgtttttatttctgtaaataactaggagtttcactttataaagaactgccaaacttgcaaaaaataaaatgtttgtatcatttaatatcccatgagttttataggagtcctaattgctctgcattcttgcagcatgtagtacaatgaatttttacaaatttcagccatccttgtggcgtgtagtacatgttgtgaatctt

SEQ ID NO: 184420 - DNA, 362 bp, Homo sapiens
tgctatcaggaacctttaagaaaagaatgctcaaggcttatgacagatcctgctaaattcaatcactgtcaatctctttcatgcaaatgaatatgtattcagcattatataattgtaacaagagtcaatatcaattatgtttccaatatgacaggtcctaggaaaacatcatattgtataagatgataacatcaataccataaattcttctaagcaaaagttataagttttaatacatcaattggtaagaatgttctcatatatagtccattgtactccaatatcaaagatggacgattagtagaaaagggattcccctgtccccttttgacagctgaaaaggctatctatattccttgagt

SEQ ID NO: 184421 - DNA, 186 bp, Homo sapiens
gtgtggtggaaacgtgtgttgcccatttatgtgtccacagaacaagtgcaaattgaactcagctgacttggaggggggtgggatgtatcctaacagccaaggccacaatccctagaaaccaatatgggccaggtgtagtgactcatacctgtcattcagcattttgaaaggccaaggcaaaaggat

SEQ ID NO: 184422 - DNA, 352 bp, Homo sapiens
gccaacatgttccttcctcaggatctcagcacatgtggttccctttttccctttgcttgaaatacccagatctttacttggctggtttcttgtcattcagattctgcccaaagtcactttctcagaagtagtgttacccttccacgagtaatactactcttacttctctttacagctctcaaattcttatgaagttttcctatttattcatttgtttgattattgtctgtctgcatcaggtaccgtgcaaacttggatgtaaactcagtgatagctgatttctgttcagcattgtttgttgctatagctccagtgcttttagtcatgttgggcacgtccctactaaatagta

SEQ ID NO: 184423 - DNA, 582 bp, Homo sapiens
agactcggcagagacacgtgcgcagatgatgcgatggaatcccagaggctgtggggacccgtgagagggtagggatgtgcgaagcctcaagaagaggtgaggagatgccccgatttccttatttcagagcagtacatgcgttcgtctcacgaaagctcttacaactaaaacaacagcaccaacaaaccaggatcaaaataatcgtgcattttccaggattccatgttggacttctcagtgctttggagatcaggaaataatcatgctgttgcagcagtatggttttgtgtctggattttattcatacaggcatgtgtttacaggcatgagaattctgtattgaaaagaaagtccttgtttttttctaacgtatctttctgttccatcaactgttaaaaccaaattgttaagaacattgagcttcttaggagagattacatgcagctacttaggaccacctcagcaaaatggagttgcctgggtagatagcagcagcagctcaccagccccacgctgccaggctgctggctgctgtccaccaggcagctgtggaacctccatgttctgcctaggtgttgtggc

SEQ ID NO: 184424 - DNA, 409 bp, Homo sapiens
ttttttttttttttagctcatcagctgtcaatagtgtcattgtattttatgtgtggcccaagacagttcttccagtatggcccagggaagccaaaagattgggcacccaaaccatttaaacagcatataaaacaactagatactgttttataactagttgccaaacttaaagttaatgctcttcaggggccattcatagaagctgtttaaatgtagagaaggtgggtgctctttgtcattgttgaattttcactttgagagctagattatgtgtctggtcttaaatctttatgtagactaaggaattgaaagatttctaaagctttattgcttggcagttgttgaggaatgaactaatagattattaagtattaattactttagggtcttcaatgaggaaaattaaaaa

SEQ ID NO: 184425 - DNA, 306 bp, Homo sapiens
agcccatggcccagacatcaccccacccactcctcttcccaggtgtgtcaagggggacacaggagtctgacctggggcctcgataagtgggcacagtgatccctgactagggaaacaggtgtatagttccccacccacctagaattggggcaaggacaggtatggcagggatccagcctccagggccagtccttgtctgtctggtcacctagcaggggtctaaaaccagtgaggtccctctaggtctgggccagggacatgtcaatctccagggagggcggctcctccttccccattgggcccatg

SEQ ID NO: 184426 - DNA, 288 bp, Homo sapiens
tatctcaaagaaagaacagaagagccttgttctatgttatttttaaatgtgtgcgctacagtagcaaaatctacaatttggttgctaattaatagtgtaatcttgagcttcaataatcaaaacaagtgaactggatttttctgtctaatcacatgcagacctaaactctctcattctgtaatgtcttctcatataacaaaattcttcctatattgtgccaatttgatctagctttgtgtagctttgtgtatgataatcattaagcaaaaaacaaattgtgtcaatatg

SEQ ID NO: 184427 - DNA, 625 bp, Homo sapiens
tttatatgctgtgtgacttacacaaattactttatttaccttatttctctaagcctttgtttatccatcttttaaatgagaataacaactattttaatttttatgataatagctgacatttggtaagcactttctatgtgccaagcactatgctaagcactttacatagctgatggcatttaaccgtcaccaccatcttaggaggcaggtattatcattatcctcattgtacaaatacagatgttccttgacttatgatgaggttacatctcgaataccgtaagtcaaaaacatatttgatacacttagcctaccaaacatcatagctcagcctagactatcttaaatatgctcagaacacttaacattagcctctagcttggcaaaatcatctaatacaatgcctattataaacttgaatatctcatgtaatttattaaacacagtacagtgtgcagtattggttgtttgccttcatgactgcacggctgagtgggagctgcagcttgttgctgcagcccagcatcatgagaacgtgtcagtaggccaggaaaatatcaaaattaagaatttcaagtgcagtttctaattaacatatatggcttttgcatcatcgtaaagttga

SEQ ID NO: 184428 - DNA, 354 bp, Homo sapiens
ttatattaaggaggtgcgtttatcataaggaggtaacagaatggctaactcaaaccggttgaagcaaaaggaaatgtattagctctcacagaaggtggttaaggataaggctgggctccaagtttgctcaatccagtgacctagttttgccagcagagaaccagttctttctatgtctacatttgctttgtaacccacagggtcagccttatcctaaggctggttccctcattgtcatgggacggtcgtccatggaaacttgggctcatgctctcttgttaatttgggaggtatagggacttcttgcagctctcttaagactaaagaagaacttttccacacatctccagcaaa

SEQ ID NO: 184429 - DNA, 498 bp, Homo sapiens
gctcagggctcgcagagtgaagggtgcacatcacatgaggcaacagggcgctgcctccgatgttacctccagtacacaggctagcaggaacacagacactttcaaggggcaatgggcaagagaggtctcggcaatccaggcgaagtccgataacccccagacccagagtagaacaggctgctttgtatcagctgagcacatgccggcctgtaggaggcttccgcactggggagctcaagaactaaaaccccacctttaggtcatttgtttttaaagatgctgctgcacagtttaaacttcaaaacatgaagtgcaagatggtcttatcaacgcaataaagtattggccgtgaagttagtatcattctttctgcagccccactggacacatagggcagcccgtggggaagggcatctgtctcctaatcatatacagtcaggactggtctcacaatgcccattgcttctttgggttccaggtacagaatggaaaacacac

SEQ ID NO: 184430 - DNA, 367 bp, Homo sapiens
caaccaagcatcatggaaaaatgtggctccctctgccgacagacatgaacccattttcaccgagctatctaacagaggtgaatacagggcagaatccaaatctgggtaaccagaacactcctgaccatgttacaaactctactgtaaaaacactgtcagcctgtatgtgcattcaagattaaacaggaacctcaaattgccaacttcttttaaaaaataaaatgtgtaactgcacctgtcaacaggacttcatgtgtgtgatcaaaattcctttcttttccatccttcacttatgactccatcttccaaagtaattgcaaaattgaagattccatcacttatacatccacttattcaactgacaaat

SEQ ID NO: 184431 - DNA, 671 bp, Homo sapiens
  misc_feature (648)..(648): n is a, c, g, or t
ctgcgtgcgctgcgtgacatggggtggcgctgaggagcctctgacctcctgggcctaggccgcctccttcatccctgctgtgcccagcctctcccaggcagagtcagaaagctcaggtgtcaggccctacagaactccaatcggttgtcttgccctggctgctgtaccagtgtcaacccctcccctgggggctgggcagtggctgcacccctgcggctcatgctcactgggagaaaaatatcagcctgtgaatgatggttccttgtgccacactaacttgcccacagcttcccactcagggccactcaccctggttcagccaaaggaacagagtgccctgtttgaatattctcaattacacaccttagggccaaagatagcaccatgtccctgccaggaaggcctttcatttcaaagggatgattgacatgcagactctctgctgccacttttcaatgacacggcagtagctgttggttcgctatcaggagaccaacctggtctcagctaaacctggggcctggggggccctgaccctatgtggtaacagtttaggaagggacttctattaggtgtggaaaccctgaatccagtgggggttgcactgggctcgaggaacagaaaggtcacatggagttagagctgacncagacgcgcctaatgtacgagcg

SEQ ID NO: 184432 - DNA, 152 bp, Homo sapiens
tcatgatgattaaaagaaacttttaaactttaaactctttgaggaaggtgagccgccactgcagtggggctggccactcctgcacttgactcacagctcacggagcaactcgttctggactaggaacaggttggccaggaagccttgccaaa

SEQ ID NO: 184433 - DNA, 243 bp, Homo sapiens
ggaccgattctgtgcgtgctttacctcatctaattcatttaaccttcacaacactcccatgagataggtaaacgtatccccattaaacaggtgaagaaacagaaggttagtaacttgaaggctctcacaaagtcaggaagtggttttgttagccgagcatggtggcgcatgcctgtaatcccagctactcaggaggctgaggcaggaggatggcctgagcctaggagtccgaggctgcagtga

SEQ ID NO: 184434 - DNA, 253 bp, Homo sapiens
agtaataaaaacaccacagtatgggtataggactaaataaacagactggagaaataacaggacacatatgagaatttattatgtgttaacgcaggtatcttcaattgttgggagagaactgatggttctgggacaattgtaatccaagtggaaaaaaaaagtcagatccctacacctaatactaatcttcccaaatacataccacatgaattaaacgttaaaatgtgagccataggaggagtattagaagaaa

SEQ ID NO: 184435 - DNA, 453 bp, Homo sapiens
catagaccatgattacgggatcagcggccgtttatataccagccgaaatctatcccacttacgcactggtaactttatatgtaagctccttcttataactaaagaattcacatggtggttagttatggttgcagtctgccttgcactaacgtattttcattttctagaatgtatatgcatgcctgtcttttcctcatggagtcttctagggaaatcctcagcacactgcgagagggcagtcatttccttgttaggtgtgagtgagatgtgatccattccccaaacagcgtgcatttcagtaagggcattgtttttatgtgaggccgatccatccgtatctatgctattgtctgttacttgaagaatattgactgtcttggagtcgtatttctatcacatctctaccctgctggcttcaccatctaagtggtccttcagcaaacttctcaaact

SEQ ID NO: 184436 - DNA, 615 bp, Homo sapiens
aagtgtcctgtctggcggtgccgacggtgaggggcggtggcccaacggcgggagattcaaacctggaagaaggaggaacatggagaggagagcagcgggcccaggctgggcagcctctggatggaggcctgcctgaaggaggagcttccttccccggtggagctggaggagagccttcggaatggagtgctgctggccaagctgggccactgttttgcaccctccgtggttccgttgaagaagatctacgatgtggagcagctgcggtaccaggcaactggcttacatttccgtcacacagacaacatcaacttttggctatctgcaatagcccacatcggtctgccttcgaccttcttcccagagaccacggacatctatgacaaaaagaacatgccccgggtagtctactgcatccatgctctcagtctcttcctcttccggctgggattggcccctcagatacatgatctatacgggaaagtgaaattcacagctgaggaactcagcaacatggcgtccgaactggccaaatatggcctccagctgcctgccttcagcaagatcgggggcatcttggccaatgagctctcggtggatgaggctgcaggtaag

SEQ ID NO: 184437 - DNA, 570 bp, Homo sapiens
  misc_feature (37)..(37): n is a, c, g, or t
gtaccgtgtgtcgagtaagggaggaggaactggaganaagcagcgggccaggctggcagcctatgaacgcctcacagctgaggagatggatgagcagaggcggcagaatgttgcctatcagtacctgtgccggctggaggaggccaagcgctggatggaggcctgcctgaaggaggagcttccttccccggtggagctggaggagagccttcggaatggagtgctgctggccaagctgggccactgttttgcaccctccgtggttccgttgaagaagatctacgatgtggagcagctgcggtaccaggcaactggcttacatttccgtcacacagacaacatcaacttttggctatctgcaatagcccacatcggtctgccttcgaccttcttcccagagaccacggacatctatgacaaaaagaacatgccccgggtagtctactgcatccatgctctcagtctcttcctcttccggctgggattggcccctcagatacatgatctatacgggaaagtgaaattcacagctgaggaactcagcaagatggcatccgaagcagctggcgg

SEQ ID NO: 184438 - DNA, 619 bp, Homo sapiens
gacataccaggtctcaaaatctaccttcttgtctctctgaagaactggaaatattccaccaagcaaaacaataaactaagaataataaaggcatgtgggccagataacaagggacctaacaaaacaatgaaattcctggagaacagagaacaaaaaactagaatgacacagctgtgtagtgggcatagcacacagtgatgcagactgaagctggagaacaagacttcaagaggagcattttcaaaaaaatatatacaactgacagattatctgataggtttcacaatagagggcaaaagaactggggagaagtacatagaaaactaagcaaatcaaaaagagagacaattatcacatataagaaaaacaaaattttgtatgagaagggaaatataagcatatactactttggttcacctctcattaatatttatacaatcacaacaacattgatgctccataatgatttaaccagcttttagattactagttggggcaagggcagaggtaatatatgatatattctgatctaatctaacatatcaaagctaaagttagtaaatccttaaatccagaagttagaatattaggttatatccagatatatggagataatatg

SEQ ID NO: 184439 - DNA, 445 bp, Homo sapiens
tcattgagagggcacgttagaactcagttctggactccaccctcgtagttactgattcagttggtctagagtgggaccaagaatttgcatcttcagtaatttcccaggagatgctggtctttgcaagccacttctggagagtttatatgatgactgtgtgcaggatagtttaggtagggagagactagagatggagacatcagccagacaacgttacaccatccaggtaaagagggagggacaaactccatcactgtataactgaagaaatttttttttatgaaatattaaagcaatacaaaaccaaaaatgaatttctattaatatgatagaaattaattctattaatatgatttgaattagttcaaagttatgtattaggtaaaggggtagcttcctttcaaatgatgtgaaaggatgtcttttatttcttctgatattgaag

SEQ ID NO: 184440 - DNA, 196 bp, Homo sapiens
gataatatctacagtaagactaggtgaccacttaccccctcaaatcccaaaatacaagctagtgaagacgaactacaaacagatacaagacctgcatgatctcagtgtctgtgcaggatgaagaaggcgcaaagcctgacagatgtgatgacaggcgaaaccccatatcatcgactggaactcctggaaagcacca

SEQ ID NO: 184441 - DNA, 189 bp, Homo sapiens
gatccgtgtgtgtgtgtccctgtgagtctgtgagtctgtgtgtatgagtctgtatgcgtctgtgtgagactgtgtgagtgtgagtctgtgtgtgtctgtgtttgtatgagtgtgtgttagtctgtgtctgtgtgtgtctatatgtgtgagtgtgtgagttgtgtgtgtttgagtgtgagtctgcatgtg

SEQ ID NO: 184442 - DNA, 387 bp, Homo sapiens
tggtatgagagcttagatagatagggtgggccataatatggagggttttagatgccaggctaagaaggtttgacttagtgcagagagcacaaatcactgcagatgttaaggatgagatcttgacacaatgataactaacatcgtgtatcacagcttgtgtatcacagcattgtgtatcattgtgcatcatagtttgacacaatgatagtgtctgagaaaaatgctacagttaccagttatgcaaacttctatcctgaacaacatactcccacccactgcctgccaatttaatcatgttcaaaatcaaagacaaagcaattcacattattgcactgagttattcttctaaagagagcctactgtgggatgcgcttgacactaatgata

SEQ ID NO: 184443 - DNA, 231 bp, Homo sapiens
agtaatactagcagtagtaggtgtgttggaatagaataaagattgtgaaccaatactttaaaaaattcacctctgccttgaaagagtgttctgcctgttactccttttttaaagtaacagcacaacaatacaccttctttcacatcctcctttccctcagcaattgctctgttagtatctctttgaagtgatttattattcatagccaacagtagagaaacttttaacttt

SEQ ID NO: 184444 - DNA, 386 bp, Homo sapiens
gaaaactccatctggtctctttcctcccttcttactctggccaccatttaggccctggggtgactgttaataggattcccatttttttatttgccaagttctcccccacccttttacatcctgtgctctgctctagccaggtttttccccaaagccagggtgggaggtggaatcagactgatctgggaggcgctgggtcagccgcacagccacgtggcagatctgtgaggagttgagaacccgcttggaaggggctgggtaggatctcactgtagagaagaggaggaaggtagtgaggaaaaggccacacataccaagatacaaaggcctgaactgagaaggcaggggacgtgtggggaccttgagaagtccagtttgagcagagc

SEQ ID NO: 184445 - DNA, 283 bp, Homo sapiens
cagtagaatttaggcatgatttgagaagaagtaaaaaaagttgctggaggttatcaaactgggttgcaacaatagatggtggtcgatgactataaagcccaatgcaagtcatgtaagtgggatgtggcaaccaccatccaaaaacgatgaggacagtttaaaaagacattccacagcttgactgctacattgaaaacttcgcatcaccaatgtgtatactgccctccttaaattcttcattaattacttaaaatagagattctcaacagtgctttttattctg

SEQ ID NO: 184446 - DNA, 347 bp, Homo sapiens
tcccttaccaatcaacgatcttactcttgtgtcagctgggcacgcatgcttccttttcctgctgtctctgttcccaatgggaagccccaggagaacgggtctcatcggcgtcatcactgtcctctcagttctcgttccaaacaaataacaaaatgaacaaatgaacattcacttggaccaacacagaagatgagcaaacgaggaagtgagctgcttgctttcactgccattcgttgattgtaaaccattcattccaagggatgtgcctccccgttcctggatcccacagcatcctctctgtggccatcaggacccacagtagccccagtggactggatatgttcagg

SEQ ID NO: 184447 - DNA, 341 bp, Homo sapiens
ccggaggctgaggcatgagaattgcttgaacctgggggacagaggttgcagtgagctaagatggcaccactgcactccagcctgggtgacagagtgagactccacctcaaaaacaaacaaaaaacaacaaaaaactggcattctataagtttaaggattcaaaaagaagttaactgatgggaagctcttagaatagtactttgcgctaagttttatctatgattattttttcttctatacatgcatttgaaaaacacaacagacatctaagagtaaggaaaggtttatttcctattttcagtctgtggatggtgtatggataacttcatgattctgataag

SEQ ID NO: 184448 - DNA, 371 bp, Homo sapiens
aagcatctgaaagcaggatgcacgccagaattttgattcttaccttacatcttttttcggtatcagtaaataatttaccacaacctttgttgctgagaactataatgttgttactaacagtatatcttttagaaagtcataatttgaaaaaaaaaaaccttttaattaattaaaaacaatattttactgcattatgaaacacgtctggagaatattttttatatctaagttgttatggtttgtctaaatgcaatcaagggtttatatcgggatcgcgatttttcttttctgggtggggctttatgaagtagctagtgtaaatgcaagtctaaatggaatcagtctaaatgcaatcagtctaaatgcaatca

SEQ ID NO: 184449 - DNA, 532 bp, Homo sapiens
tcattcctaggagaagaagcagcagacaccaatgcaggattggtcttccacttccagtctggacaagatagcatagactcatttctccctgcttctcccagatggagtcttgctctgttgcccaggctggagtgcagtggcacgatgttggctcactgcaacttctgcctcccaggttcaagcgattctaccacctcagcctcccgagtagctgagactacagtgaactacaggaccatgtgaggaataactctgcccagagaaatctgttcaaacctcagggtctgcggcttttatgtgtagaggaacagctctgtcatggcaacctgacaacagagaccacacagacaaagacttgacctgcagtttatctgaatcttggcagaactccttgtgatcttctcggtatacaagaggataagaggtcccttttgttttgatgtcatcctttttggtgtgtgaaacaaggaccacagggagctggcacctttggctacacttcttttcactccccaggtaagtaataaactgt

SEQ ID NO: 184450 - DNA, 593 bp, Homo sapiens
catgtatggatttaattgccatggctaccatgtgaggtcaagaggaaggaaactatttttatccctaatttgtagatgagtacaaaatgcttccatgatttaatggctcacccaacttcatacaactggtgggtctgaattggacctatgctttaagattcctcattctgactcttacttttgtatttaccacccttcccctagtttcaagtttcagtgtgaaatacctcttgacatatgaaggatttagagctcgaaacctcaaatcaaatgttacttaaacaccaatcccagggatgaaatgtcatttaatgaggtgtctaatggcaggattatctgtgaagatatttcactaaggaagggtgggaggcgggaagtggctgcctctggaaggtcaattttgatgtggttgaggtgagatgggaagctcacccaatgggacatagaaatcctaccctccagcccagctccaccctcaactagctgtatagcagctggcagtttccctgactgccctgggtctgtttcctcatcaacaaatagacagaagctcaaactaaagtaatattatgtctttcccagccctaaaggct

SEQ ID NO: 184451 - DNA, 517 bp, Homo sapiens
tgtacctcctgccccacacccagcagcaagtgaactgtctgcctgctgaacatctctggcccttcctcaacagcagcctctcctgccctggggaaagaagcagccccctcctccgtgcccccgctgggtcccagggtatcccactgcctgtgttctttatgtcatctctgcttctgaactgtagcctcctgagagtggggactggtgtgcccacaggccccctagagccagtgtgagccagcagctgctcaatgagggaatggtgagaccctggttgcccaggctggagtgcaatgacgcaatctcggctcactgcaacctccacctcccaggttcaagtgattctcctgcctcagcctcccgagtagctgggattacaggcatgcgccaccatgcctggctaattttgtatttttagtagagatggggtttctccatgttggtcaggctggtctcgaactgccgacctcaggtgatccacccgccttggcctctcaaagtgttgggattacaggca

SEQ ID NO: 184452 - DNA, 438 bp, Homo sapiens
acactgattttttttttatatgctctgtttttcttaggcaggatgatgtagaagataattgcacagatatggaaggagatgtttctctgtatgtgaagcctttaaatccagaacaattaatttcttctcttcttaaaaccccgtaacatcacttgactctggaatttcctattttcttttactttctccattttttttccatctgtccctcctacgaatatgttttacatgaaataatgtattgggttttatcttttgtcccagcagacctgaaaatcccagtatattaccacagacacacataccatctggtcaccaacagggacatcagggccaagagcagtttatacttctttctttagctcacaaactactatagcttgcctgttcagttttttttttttttaatattcagttttgtgccatactctcccccac

SEQ ID NO: 184453 - DNA, 249 bp, Homo sapiens
cctgtaatcccagctacttggaaggctaaggcaggagaatagcttgaacccgggaggcggaggttgcagtgagccgagatcgtgccattgcactccagcctggatgacagagtgagactctatctcaagaaagaaaaaagaaagtgggaaggtaaacagggctatttccactgtgacagctcatgatgttttatttctaaggagtcaaagtccaggactggctcacctaatccgaggccctggtgacct

SEQ ID NO: 184454 - DNA, 667 bp, Homo sapiens
aagcatagaatgtgatgacaaaattactcctgaaagacaaaataccctttgctgagggttctcaaggactaatgtcttctattggtaaagctctacttagaaatgatgtatagttttgcaaaacagggttcagaagggtaaggaaacattcttttcaaatcagccctccaatgttataacaaatttttcacttcttaagtcctgatagagatcatcctgtgaatgtgttaattttttttcttgagtgaggtgttatatattttatcacaatgagttcttaagagagtttatagcaatttgttttaggggctgtttttcatctttgaattttgccatatctacagggaaatttttttatataacggtttgactctaggattatatactttgcaaggcagtaattgttaaattatattcacatccagaaagaaatggttcttactgacttgaatattttagtacattggagcttcatgagaaggctgtcctcaagatccataccacatgactgtgtcatagttggactgtaaaatgctgaaatcatataccttcaatactcaaaacattttaggtggtaaaatgaacctaatattaaaattcatatagtgttagctcatgctataaggtccatggtattaagggggagaaatcttttccagtttagaat

SEQ ID NO: 184455 - DNA, 200 bp, Homo sapiens
caagcgcagtaccatcccatgcaccccctgctaccatgccactgcagcaactccagacagatcaccatacctctcattggtgtctggataggagagttcaccttccatgttcattcacatcccatgttcattcacatctcctcttcctaacatgattacgcatctgggagaccgggatttgccttacatatcctccacag

SEQ ID NO: 184456 - DNA, 361 bp, Homo sapiens
ttatttgtttcttgtgtatctatagatattttaatacatttataagcaaaatgcacacatatacacacacatatacacattcaaaatgtagtgtattttataatttgtgtgtgattgtatgtgtatgttttttcctcaaagtttcctatgtcctatacagtatttccagaaagtttacactgtcatagtagtatatggaaatgtctttttcccataaccttaccacattggattccatcagtctttttgattttgcaatctgttggtgaaaaatagtatctcatttcttgtgctatgttttctttaattaagagtgagtttgaacatcttttcatatacttagcatgtcctttgtctattt

SEQ ID NO: 184457 - DNA, 192 bp, Homo sapiens
gggaggtcaaggctgaggatcgcaccaacatactccagcctgggcaacagtgagaccctgtctcagaaaaaaaacaactcgcagtaagggctcagaaggaagtgaggagcagggcagagagggctttgttgccctagagcaggggtcccccaccccctgggccatggactggtaatggtctgtggcctgtga

SEQ ID NO: 184458 - DNA, 207 bp, Homo sapiens
gctgggattacaggcgtgagccactgcgcctggccaagaccttgtctcttaaacaaaacaaaacaaaatcctcttctaaacaggtctgtggtttcctgaattgactgggaaagggtaccagggaacttgttagcataatagaaatgttccatatcatggttatggtagtggttacatgggtgtatgcagttgtctaaacttattgaa

SEQ ID NO: 184459 - DNA, 354 bp, Homo sapiens
catatattttaggatctctgaggaaaacagatgacaacacttcactgtccctaaataagcttttgactattaccttaaaatcaccatgagttttgaagagttgagaaacttgctggtatttatttctttatattattcctaataaaattaatttctcatctgcgtcaacaaaaagaatattacaacagctttaaaaaaaaggactatgaagggctagccaagaggcagagcgactggaactcccatgtactgctgggaagaatacaaaatggtatagctacgctggaaaactgcttagctgtttcctgtacagtgaaacacgtactctatgacccagcaatttcactcctgggt

SEQ ID NO: 184460 - DNA, 515 bp, Homo sapiens
catggtggtcctatctttggaatatttagagtttaataccgctgtacagaaagtacttgctgtgtacccgcaaaaatagaatcagattctcaagtcagatcattgtgaacaagtatttcatctaaatgtgtgtccagtggaatattaaaaatttgttttaatagtgggagaatcttgttgtccagggctgaccttgtgtgttgcaagacatcgtgaatccttggcccctctgagcactacgttctggtcattatgacaaccagaaaaatagagttctgaaatgtcccctagggggcagtcctgcacccacagaggacctcgctatggggtccttcctgtgacctctgcttcctcagtgcactcagtacttaagcttttccccaccttgaactgctcaaattattagtcctactctcataaacaggaggaaaaccagcgcctaagaagtcactccccctgcagagctccaaggatctgtacagtctgcacttccttttgatgcttgtcttactgtt

SEQ ID NO: 184461 - DNA, 598 bp, Homo sapiens
tttaattagtttaattaatagcaggacttttgcctgtttttaaatagtgatttttttcctaaaggaatcagctttttttttttcattgtgtgtgctttttttattttagagttacaagagttatccctcaggagattccttttaaaaaaagcaggattcatggatgatatgtaacataatttttccgtcgattactggtattatatctaaaataacttgagagtttgaggcctgaggcattaaaaaaatgaggaattcatcttgctttcaaagtactcaaagaaaaactgttctaaaacatttcaccaatatttgatggcacattagcattttcagctgaaatcagttacaatcgtttttgttttagctgaaagaaatgtgaagcatacggatgtaatgttcatttcagttgggtaatatctgagtaatcttaaattgtctaaacagaacaattgagtttgaatttgatatgctacctatagtatataccatgtataaataaatatgcatatgtatttttgttattaaaataatatgactgattaaacataaatcacattttggcagatgtgggaatctttcacagttttctagcacc

SEQ ID NO: 184462 - DNA, 460 bp, Homo sapiens
ataaaataaaaagaaaattataaagaaaattaaataaacctaaataaatacagagatatcctatgtttatagattggaaaacagaatattgttaagatgccaattatccccaaattgatctataaattcaatgcaatccatcaaatccaggaagactagatttttatgttcaaattgataaggggattatagaatccctacggaaatgcaaaatacctagaatagccaaaacaacattgaaaaacaaggacaaagtaaataactcatattcataaagctatagtaatgaagacagtgtcttattagcataaagatagacaaataaatgagcgaaaacagaaagcagaagcagacccagatatacatggccagtgggctttcaacaaaagagcaaaagtgattccataagcaaggattgctttttccacaaatggtgctagaacaaatgaatatgcatatg

SEQ ID NO: 184463 - DNA, 1189 bp, Homo sapiens
aggatgcaagagacagtggtccattgtcatacttgctgccttgtatgctgtcttgtacctctcttaatgtccccgtagtctcttgaatctaccaccatgatttaatccaaccttctgcctattctccacctgtcgccatcctgtgattggttacattctagatttgcaaccttagtgctacccagctgtcatgctctatccccccatcttgttctctcctagacaaccatttcatacctcgtccactttcttcaacctgcagtacttggaaaagtccacacatttctatatcttccctttccccagcatttgtacctcacttctctgtctttacacttcttgctacaaaataaccatccagtgctccagtcaaagggttacctcatcttttagttactcagatccatttgcaatcgtcttttattcctcttttgctctcaagccatatcgaatacattagctaatcctgtccacattatcttcaaaaatatatccagaacctacccatttcatattgcctccactgctacccctttctttgagctcttcttcagtagctgccttaaaatgtctcttccatacattatggcatggtatcctaactgacatcttgtttccctacttgctctccttagtctgttgacaacccagcagccagaatgatcctggagagatgaaagccagagcacttcactcctccactcagaacccggtttcatttagtcaacatgcacgtcctttgagagtctcacccatctcccccatcctgtcccatcatgccctgtcacctctgtcctagtcactcactttttctttctgcttcctgtttctctaacatactaatcaccgaatcagtgatttgcttaaatccccccaagagctccccatttctcccagactaaaagccagattccttttgtggcctacaaggacctacgggatgtggctccttgcttgttctcaccctgcccttactaactctgcctgccagggcatgccagtctaagaatgctcccttatgcctcaccattgctgtttttctgtcactattttattttcttcagatcattattattgacatcgtcttgtacttgatttgtttgctcatttattagctgtttttcccaattcttagtctggcctcgggtctttggctcggcctatgccatgccttccctcgtttcccgcc

SEQ ID NO: 184464 - DNA, 1332 bp, Homo sapiens
aggatgcaagagacagtggtccattgtcatacttgctgccttgtatgctgtcttgtacctctcttaatgtccccgtagtctcttgaatctaccaccatgatttaatccaaccttctgcctattctccacctgtcgccatcctgtgattggttacattctagatttgcaaccttagtgctacccagctgtcatgctctatccccccatcttgttctctcctagacaaccatttcatacctcgtccactttcttcaacctgcagtacttggaaaagtccacacatttctatatcttccctttccccagcatttgtacctcacttctctgtctttacacttcttgctacaaaataaccatccagtgctccagtcaaagggttacctcatcttttagttactcagatccatttgcaatcgtcttttattcctcttttgctctcaagccatatcgaatacattagctaatcctgtccacattatcttcaaaaatatatccagaacctacccatttcatattgcctccactgctacccctttctttgagctcttcttcagtagctgccttaaaatgtctcttccatacattatggcatggtatcctaactgacatcttgtttccctacttgctctccttagtctgttgacaacccagcagccagaatgatcctggagagatgaaagccagagcacttcactcctccactcagaacccggtttcatttagtcaacatgcacgtcctttgagagtctcacccatctcccccatcctgtcccatcatgccctgtcacctctgtcctagtcactcactttttctttctgcttcctgtttctctaacatactaatcaccgaatcagtgatttgcttaaatccccccaagagctccccatttctcccagactaaaagccagattccttttgtggcctacaaggacctacgggatgtggctccttgcttgttctcaccctgcccttactaactctgcctgccagggcatgccagtctaagaatgctcccttatgcctcaccattgctgtttttctgtcactattttattttcttcagatcattattattgacatcgtcttgtacttgatttgtttgctcatttattagctgttttcttccccaacttcttaagttctgtgacatcagggatctttgtacttcatggtattattgccaatgtctttaacagtgtctagcaggcaaacagccaagtgctcagtaggtataggtacttttgttgaatgactatatggcatccaaggtgaaatggaatatttctgagagaaatatgttaggaacattgaccacagaagtagaaagcctt

SEQ ID NO: 184465 - DNA, 468 bp, Homo sapiens
tccagtctgtcaggtttctccactgtaacgttattctttccccccactttccctactgtgacctttggaaggaagtcactatacacagtccacacttaagaggcagggcattatgtcccatctcctcggaaggggagcatctacatgcagtatttggaattcagtacaggagattcttatttattcattccataatttattcatatcatatagactcataagcatttcttttctgtgcttttctaaatgggagctcttcttccattataactgtttgtttgtaaatcagaaaatgaatgatttttaagaagtttattttgtaaccatccatcttatcgagttgtattgtttctattttccattcagttgatcatcttggttttcctatgcatcctccgaaaataatgataattttgctgcctcctttcaataattctacctctaatttctttcatttatctattagta

SEQ ID NO: 184466 - DNA, 374 bp, Homo sapiens
aaatcacagtgtatctgaaaataaattcagtgaattgggtaaggatgggaaaatatttctggagcacttgatcttgttttctctgagctgcttttcaaaagtaagaatttcttgttatactgatattgctttattggaggtgatatggcaggtgagggggtcatccacctttattgcagaggtatccagaatgtgttaaatatacaacatttattatagagggagcaagattttataacctgttcccaggtaaggcctatttctatttgagtttattcaacaccacttttgatctccccaggtgctatttactgattgctggcttattttgtttaaaaacccttggggtcttttctgtcctgtgcctctgaatg

SEQ ID NO: 184467 - DNA, 206 bp, Homo sapiens
ttgtagtatgtttagaagtgcaatgcctgcagtttaattcttcttgctcacaattgttttggctatttggagtcttctgtggttcgagatgaattttagaatttttttcctatttctgtgaataatgtcattgggtttttttgtttggttgtttttgtttttgagatggagtctggctctgtcgcccatgctggagtgcagtggcg

SEQ ID NO: 184468 - DNA, 241 bp, Homo sapiens
tatgagagctagaatacttcgagatcatatatggcaataattgcatgagcacattaaaaggcaatcagaaatactagggaaaaaatttaagaaattcatggtccaaatatgaaaaaactaaaaggtaacacaaatttaaacaactgatgaagagtgagaaaacaaaaaatcccatttgactttggggctagatatctcatcctttgattggcccaggaatcctaaaaccagacccacagtg

SEQ ID NO: 184469 - DNA, 1367 bp, Homo sapiens
gctggtagcgcgccgctctcggtcgcgcggagtgatcgtgtggaatcgcgggtcgcggacgctcgccgccggccatagctcagcctagcgccgccaaggccgacggccctcagcctctgccatggacttcgaggacgattacacacactccgcctgcaggaatacttatcagggctttaatggaatggatcgtgattatggccctggatcttatggagggatggatcgtgactatggccatggatcctatgggggtcagagatccatggattcctacctaaaccagtcatatggcatggacaatcacagtggtggtggtgggggtagcagtttttcttcaccccatatgaagcctgcacctgtaggctctcgggggagaggaacgcctgcttatcctgaaagtacgtttggaagcagaaactatgatgcttttggaggaccatcaacaggcagaggccgaggccgaggacatatgggtgattttggaagcattcatagacccggaattgttgttgactatcaaaacaaatccaccaatgtgacagttgctgctgcaagaggaataaagagaaaaatgatgcagccatttaataagcccagtggaacctttatcaagaaacccaaactagcaaaacctatggagaagataagcctcagcaaatcacccacaaaaactgatcctaaaaatgaagaggaagaaaagcggcgaattgaggctcggcgagagaaacaaaggcgcagaagagaaaaaaacagtgagaaatacggagatggatacagaatggcatttacatgttcattttgtaaatttcgaacatttgaagaaaaagatattgaactgcatctggaaagttcttcacatcaggaaacattagatcatatacagaaacaaactaaatttgataaagtagttatggagtttttgcatgagtgtatggtgaataaattcaagaaaacatctattcgtaagcaacagacaaataatcaaacagaagtagttaaaataattgaaaaagatgttatggaaggtgttactgtagatgatcacatgatgaaggtagagacagttcattgcagcgcttgcagtgtgtatatccctgctttacatagttcagttcagcagcacttaaaatctcctgatcatatcaaagggaagcaggcttataaggaacaaataaaaagagagagtgtcttgactgctacaagcattttaaataatccaatagtgaaggcgcgatatgaacgttttgttaagggtgagaatccttttgaaattcaagaccattctcaggatcagcaaatagaaggagatgaggaggatgaagagaagattgatgaacctattgaagaagaggaggatgaagatg

SEQ ID NO: 184470 - DNA, 180 bp, Homo sapiens
tatccgggaaaaacactagtcacaaacgagtggctgtgtactctgaagaggttttcaatacatgtttttaaaggagagaaggaaggatggggaaggataggcatgaggtgaatggttacattcctgtgagactttagttagtactcagtaaatctacactttacataagataaggtgaac

SEQ ID NO: 184471 - DNA, 279 bp, Homo sapiens
cttaagtgatccacttgccttggcctcccaaagtgctgggattacagacatgagccactgcgcctggccaatctactgactttctaattatgatttcatttatgtcttatctaagtttattatttgtttttgcaattcagttccaagcttgatgagggtaaggattttttctgccttgattgctgctgtatcctcagccctagaacatacgggtgctcagtagatatttgttagatgaattaaacaataagtgaatactgtttcttaatgcagcagtac

SEQ ID NO: 184472 - DNA, 470 bp, Homo sapiens
tacacctgctaagctaagctaattcctgcttagcttagttttaagaatttataggggtaaagaaaaagagaatatatcaggtgaatcctttagtggtaaatttggctgacatgaaaatttattgctaaaggattaagtataggccctgattgatgaagcacagtcagtaaatcatctcttcattccccagttcttaagccaacatcagcaacactgagagaacattagattaaaggcaggtatagaagagagacttagggtaacaagttagtgggtgcctgaaggcatgtgggaagagatgtggtaaaggtgtgcacactattccttacgtgacttaaaatgtcaaggggcttggtgtggtggctcatgactataaaactagagcactttggaaggccaaagctggaggatagcttgaggtcagaagttcaaggccaacttgggcaatatagcaagactgtgtctctacc

SEQ ID NO: 184473 - DNA, 293 bp, Homo sapiens
tgtacagctcagagcgactcttgagtatccctcatcagtctgaataatgcgagcacacgccataatgtctgtttactgacaaactatagaaggcttttcagtcactcagtaaatgaggcagcatccagggagcagttctttcagcaaggaggctggcactgcttaagcacttaataataatgatgatgattattaacagatattgagtacttatgatgtgtccaatattattctaaagacttttatatgaattaactcattttattctctcaacgacattttctttatgaggg

SEQ ID NO: 184474 - DNA, 169 bp, Homo sapiens
gcaataggatcctgagtagggaggagggaagcatgcttgtggaacacctttatgcccagaattctttaccatttgtagattagcagctatacctatactctaggggatccacagccccggtgcctcaggactctgtactcttccccataagctcctgtacgtcccatgg

SEQ ID NO: 184475 - DNA, 567 bp, Homo sapiens
taccacctaaagttgcccatagaggtccaaggagacactgctgatagcagaaagtcttccagaaagaaattaggcgacccacaccaagcatgtatggctttgagtcttacagatggctttttaatagtttagtctcttaacctaaggaagtttctgaagttccggtcagagagtctaaaaattcacattttacctaataaatgataatgaggctatttatcttgtctgtctggattttttcacttgacatttaatgaaatatcccatattacctataatttttatttgaaggtaaaaatagactacagaagaatgtgtaaaatttgtatcaatcagcagagcacaaatcaagtttctaccagtattgcttataaatatttcgatcttatttaggcatggttaagctgtttttgatggttgaacttgaaggtttgttgagaattacattttttgtcttaatttttctatttttaagtgtctgaagcgtgggtgttcaaccttttggcttccctgggccacatgggaagaagaattgtcttgggccacacataaaatatgctaacacta

SEQ ID NO: 184476 - DNA, 286 bp, Homo sapiens
cttctgggaaagtgtgaaaacgtcaggtctccccttcagtggccctggggcacagctgaagcccccgtttaagggctcactttcctgttggatgacagccggctttctggtcctctttcctagttgagtggaaaggcaggaaatgccgtgggggcctggggttttgattattcgaggtttcaatgtttgctgaaactgagaggagaggggccggctagcttgaggtctcagggcctgtccctgcgggcggggcctcccccctgggggcctggtcctttccactgcc

SEQ ID NO: 184477 - DNA, 616 bp, Homo sapiens
taatttaatccatgaacacaggatgtttttccatctatttgtatctgccttaatttctttcattagcgttttataatttttagtgtacaagtctttcacctccttggttaagttaattcctaagtattctgtttgttgctgttgtaaatgtgattgctttcttaaacttttttttggatagtttgttgttggtgtataacaggggcccccaaccctcaggctgcggaccagtgtggtgcatggcctgttaggaaccaggccacacagcaacagatgagcaccaggccagtgagcattactgcctgagctccacctcctgtcagatcagcagcagcattagattcccataggaacatgaaccctattgtgacatccgcatgcgagggatttaggttgcacactccttatgaggtagaacagtttcatcctgaaaccttcccaccagcccctcaccggtccgtggaaaaatagtcttctatggaactggtcccttgtgccaaaaaggttgaggactgctggtatatagaattgcaaccgattttttaaatgttgattttgtgtcctgcaacttgactgaatttattctaacagttttgtgtgtgtgcatggtctagga

SEQ ID NO: 184478 - DNA, 526 bp, Homo sapiens
aaccatggaatgagagaaaataactgcaaatcatgtatctgataagggactagtatctagaatgtataaagaatgctcgcaactaagcaataaaaagacaaacgtggctgggcttggtggctcatgtctataataccagtattttgggtggcagaagcaggaagattgcttctgccagcccaggagttcaagaccagactgggcaacataatgagactccatcgctacaaaaaaagaggcaaatgtcctaatttaaaagtggacactaagcgcatgagaagaggctcaacaccatcagccgtcaaaaccacaatataccactttttccctactaggatggttaaaataaagagaataacaagtattgatgaggttgggaagaaatcagaacctttgtacattgctggtgggaatgtaaaatgatgtagccgttttggaaaacagtttgacagcttctcaaaacgttaaacagagtgactgcatgactcagcaattccacccctaggcatatacccaagagagtgga

SEQ ID NO: 184479 - DNA, 574 bp, Homo sapiens
ccaacgctgtcacagagtatagcagttagggcaagtagtaggttagaaaatgtcctactctactattgcatttgtcctcttcctatttatttatgacagagtctggcactgtcacccaggcggagtgcagggcgcgatcatggttcgctgcagcctcgacctccctgggcttaagtgatcctcccacctcagctacttgggaggctgaggcagaagaatcacttgaaaccgggagacggaggttgcagtgagccgagattgctccgttgcactccagcctgggcaacagagcaaaaattccttctcaaaaaaataaataaattaaaaaaaagtgtaatttgttgcttagaaagtgtatcttcattctcatctaatcagaatttgaattgaagtacatattgatttcaagttttttctccttacattaattttcctattaaaaataataccttgagttctgatctttgttgctaaataatgtttcttcctaggatatctcacggtttatagatcatcttgtacatatttaattccatcactagacaggtatagaactgtgtaaatacagtaagaa

SEQ ID NO: 184480 - DNA, 521 bp, Homo sapiens
taggtagtaggctagtccaggtggctttgcatttcaactgttgctcaaagagagcttgttggttcccctacagatacatatttaagtggaatttggggtctcaaaagcactctttgctcttccttcaacatcaccttctcttagctacctcagagctgcccagtctgcacccctcccaacaaatgccaatcattcgatgacttgctaaaaagagagcacacattagtgagggtaggaaggccaagggaaatggagtattgacatcaggagtttcattttttctgttcagaaccttgacgcactgtactatgcactctctgtttaggagcctcagctgatacacaccctgcttgccaaatagaaaatttagaagagtcttttcctctcttccctcagaaatttgtggtgcctgagtcggttgacatttgtgacaatgattgttgggaatttccaatggagtcttgaatctcaccaccattcccttttcttaggagagacaactaggggggctcctccccatg

SEQ ID NO: 184481 - DNA, 481 bp, Homo sapiens
aggaaaataatgcaaagtctcaaccctgggtttagaggaggaatccttagggggccgccaggacaactgaccaaaaaactctgggaactaacaagcagttatagcaaggatgcagcatacagggttaatgtagaaaagtcaattgcaattgctcttttaacaccagcgatgagcaattggaagttgagttaaaaatataccattatgttcacattcctccctgcaaatggaatacttaggtataaatctaacaaaatatataaaagatctagtaggaaacctacaaaattttgatttaagaaatctaagaagaactaaataaatagagagatagtccacgtttgtagatatgaaggcctaggatttgtgaaatgtcagttctccccaactcgctctatagattccatgcaatccccattgaaatctcaacaatttatcttgtggatattgacaaattgaacccaaggtttatatggagagg

SEQ ID NO: 184482 - DNA, 452 bp, Homo sapiens
ctgctgggaattttgaagatagcccgtcctggccatcactaatagaggtagtcaggtctggcaggggtccacacaattgggtttttatgatatgtgagtgtaagaggaatagagtggtcaagaatgagcctcaagtctatatcctgagctgctggatgaatggtaaagccaggagctgcagtgtataaaactgtaagaaaaacaggtttgggagataagaccaagttctattttgaaaatgttcaatttgaaatgcttattagacatctaatggaaatgtcaagtaggtggcagaatatgttaagtctggagctcaggggaaatgtcagggctagagaatatagatctgggagttattgacagagagatagaaattaaagccatgggactggataagatctcctataaagtgaacgagtgtatttaaagaacagaagatgtttaaagaaatt

SEQ ID NO: 184483 - DNA, 561 bp, Homo sapiens
acttcctcaagtcaaactctccaggcccaccttctgcttcccggtggcatgaacaggcccagctttgacttgagaacagcctctgcaggccctgctcttgcctcccaggggctttttccagacccagctcctgcctcatggcagctgccccaggccaaatttctgcctgcctgccagcagcctcaacaggcacagctcctccctcacagtggcccatttaggcccaactcatgactgtcgggccatttccaggcctagtgcctgcctcgtggctgactcttgaagcccaaaacttcctcaaatcagccttttgcccaacttctgtctactgtcggactctacaggccagcctctgcctcacagtggaccctccagacccagatggtgtctcactgtggcatcctcaggcgaagctcctgcctttccgcagcctctacaggcccagctcctgccttgcagtggcctctttaggccaagctcatgccccatggcgacttttccaggcacagcttttgccttttgcagcctgtccaggcccagaatgtccttaactcggcatct

SEQ ID NO: 184484 - DNA, 153 bp, Homo sapiens
acaccattggatttctcagcttcttagtagtaagatttaccttttgtgatgcctgccatgtttacagcaccttgctgggccctgggaggtgctaggagcagctgggccttggcccatgctcaataccttctataagatgtccagatgaatgcg

SEQ ID NO: 184485 - DNA, 353 bp, Homo sapiens
gaatcaaccaaatgactgcaggaaaaagctgacatggctataggggaaaaaaagaaaaaggggggaggataaccttaatgacctgtatctacaaaagaaattgatgtagaagttaaaaatgtttccataaagaaaattccaagctcatatggttttattggaaaatgctaccaatcatttaagaaagcagtaacagaaacgttttgagttctaaagcattctgaaaactcttcctgaaaataaaagtaatagcaacaacttccagagagtatttgtccatattcaacttgcattaatgacaaaaaccattcagcaaatgtggggaagaaggaaaaattatttaacctgaaagg

SEQ ID NO: 184486 - DNA, 365 bp, Homo sapiens
gaacttaacagaccaaaagagtgactcatccaaatgtctagaattactatattttcctcatatttttcctctcattttaaaggaagaaaaaaacctcaacacagagcttctgcacttatcctattctctaaactaaccactaagcatgaaatccagtataaactgattattctgccaagaatgtgcatatatattaatttcaaggacaagtaaaccaagcagtcaggatttatcaaaaagcatcaattatgatgaaaactggaagggtattgtaaagagcaatgacttatcaatcgatattatataataactgtaactcagagttaatgattaaatagattaaataaacagaatatttttccacc

SEQ ID NO: 184487 - DNA, 221 bp, Homo sapiens
caggtgatctgcctgccttggcctcccaaagtgctgggattacaggtgtaagccaccatgcctggcctacagcaaaatggaatctttagttcttaaagttttatatatgttatcactcaagtagactgttgtttccagagaaaacaaccatctgtacaattgcctctgtacagttccagaatgaacatcctgcagtttctgaaagagcatttgtgagccaa

SEQ ID NO: 184488 - DNA, 643 bp, Homo sapiens
tgcatgctactggcagggtgctgtggaaaatacagagatggatgggaagtactcttgtgttgagaaagaagacggaaaccatgtaaaattttctgcctatgacatgttggggctcaagagaggacagaatcatcatagactgcaatatttggggaaggatttgtggaagaggagacatgggagaacagagaggagaaggaagggcatttgaggtagaacaacccttggaaaggctcagagcaagaacaggtgtctgaatggatgcttttgtatgcgttggttattctgaagaaagaatagaaatcatccaaagtgattacatgcaaacacggacaaatttttgaagaaaccttatgaaaatattctagttgaaaattcagggtaagttccaatttttgttgtgacttttcctgtcttattcagcattcccatggtaacaacttccattaacatatattatgtaaaaggaaatattactttgggttatcactactaatcaagtatccagttaaattagaaataagtgaaataacaaactttcgtaacaataataataaagataaaatagataaaatgtattggatgttttctgtgggcattattcatttaattttattaatattccactttagataggtacttt

SEQ ID NO: 184489 - DNA, 202 bp, Homo sapiens
cttgggaggtggcttagtagaaggttgagtcaggcaagctggggctgtttattcagtgtgctgtgctgtgctgtgctgtgctgtgctgtgctgtgctgtgctgtgtctgaatgcctgggagtttgcgttgttaacctttccagggtgctagatccctttgagattatgatggaagccatgaatccttttcccacacctgtat

SEQ ID NO: 184490 - DNA, 177 bp, Homo sapiens
caataaagcagctctcatgagaaagagctccaggagagaaaagaaaggagcggagtagtgtgtcatcttttgtaaaagaaaaagtcagggttaggggaggatggaataagaatctgtaagctctggagggagagagaagaaaccaagtctgtggctacctcttgtggtggtgggggt

SEQ ID NO: 184491 - DNA, 149 bp, Homo sapiens
cagaccacgtctgagcagagacccggcagggactccagaaggggaaagaccttgtgcttggggtcagggcaagacccagaggacatctacctttctgaacaccatggccccttcagtaggatgcctttgcagtctgaatgtggcttcct

SEQ ID NO: 184492 - DNA, 361 bp, Homo sapiens
ctgcctactggttccgactgatatgtcaagattcaacctgactgtcccctccctggccccggacgggttgggaaccgggctgggaatcatattaaccctgactcacctctcctgcccacatcctttcttttccaccccaatccacctctgagtttcttcccaccactgcaatgaacagctaagcaggagcagccatttgtctctgtagccccagctcctggtgctgggcccagttgtaatcagcaaagtaaaggatggccgtattgcctaagcaataacaaagtcatctgataaaaagactgtcttggccaggtgtggtgacacacacctgtactcccagctacttggagggctgaggcag

SEQ ID NO: 184493 - DNA, 218 bp, Homo sapiens
cttcattttcatgtacaaggtgggtaggacagttatggagttgaaccatatgaaactgatgtctatgtaggtgaaaacgaactgaaaatcaacacatttacaggttcaacttctgatataaccctccttttaacaaatcaaaaaagcaaacctagagattatagcaagggacttggagttacccactggatcaatgatggagccgaggctaagtccta

SEQ ID NO: 184494 - DNA, 310 bp, Homo sapiens
tgagctggtacttctctcctcccacctcccatcactcagtagtttcattaatgaaatgattacccaggaaaatacagaatctcaggaaggaatgtatatagtaaaagaaagaataaaaatgtatggttgattaaaacaacaaacaaacaaaaaacaatgggccgggcatgggagctcacgcctgtaatcccagcactttgggagggaggccggcagactgcttgagctcaggagtttgagaccagcccaggccacatggcgagacctcgactacactaaaaatacaaaaaagtagccaagcatgatggtg

SEQ ID NO: 184495 - DNA, 411 bp, Homo sapiens
agtagtcgtaacgatgttctcctagttccaaatttagtacactactgagatcatacctatttcaaggtatgttattacactgattaatgatggaactgctgcattctgaaagtcaagttttaaaagtgtatttgtcactcttaactcacatctggctttacgtgccacaggatacctctgcagacttctcagcaggttgcttaggtaagcatttgctattcaacaagagtctgactgcaatcatcatcagggttatggcaaaggttaaagctctgattttactgaggtataggagtaaagagaatgatgaggatgagggtaacagtggaggaactgaagaaatgggtggaaggggaaaagaggtcaagaagattattgcacataaggtatggcaggagttctcagatcatg

SEQ ID NO: 184496 - DNA, 501 bp, Homo sapiens
gtatttatagcaatacgaggataaactaatacagtgaatattgttgcaataacatggatgttttgggtttcaaaaccctgttacatcactgtgttagccaggatggtctcaatctcctgacctcatgatcagcccacttccgcctcccaaagtgctgggattacagacatgagccactgcgcccagcctactttttggaaaaatatttttaaaaattcttacatttacatagaatttcaaggaccatcatggcccaatcttagaaaataagaacaaagctagaggcacaacacttcttgtttttagaacagaatacaaagctacataaataaaaacagtgaggtatttgcaggaaaacaaatagatgatagaacagaacagagaactcaaaaactaaccatcatgtatatgctcaaatgatcttcaacaaggttgctataaccatacaataagaaaaagacagtctctttaataaatggtgttggaatactctgtatccac

SEQ ID NO: 184497 - DNA, 478 bp, Homo sapiens
gtaccggaattgagtgtcactggtattgagtggcatgtgaggacacagcgagaaggtggctatctgcaagccagaaagagagcctcacgagagcccaacccttctggaccttgatctgggacttccagcctctaggactgtgagaaaatcagcttctgtgatttagccacccaatctatggtattcttttatggaaacctgagcagactaagaccaccctttcccctgtggcaagacattgcctcatgccgtagctctcctcttctctacaatgtagcttacaggccaagccctttcagaattcaaaacttaaactctttgatctgaagtacccagttcttacaagttcaaagtgttttgctgtcagacccttctgtctgaaatgggcttcaggaactgatctgtcatctcctttgtccttggatgcctcactgtgagggccatggagcaacacggtgtcacctgccacaaacgaata

SEQ ID NO: 184498 - DNA, 526 bp, Homo sapiens
gtaccggaattgagtgtcactggtattgagtggcatgtgaggacacagcgagaaggtggctatctgcaagccagaaagagagcctcacgagagcccaacccttctggaccttgatctgggacttccagcctctaggactgtgagaaaatcagcttctgtgatttagccacccaatctatggtattcttttatggaaacctgagcagactaagaccaccctttcccctgtggcaagacattgcctcatgccgtagctctcctcttctctacaatgtagcttacaggccaagccctttcagaattcaaaacttaaactctttgatctgaagtacccagttcttacaagttcaaagtgttttgctgtcagacccttctgtctgaaatgggcttcaggaactgatcatctcacagtcctagaggctggaagtcccagatcaaggtccagaagggttgggctctcgtgaggctctctttctggcttgcagatagccaccttctcgctgtgtcctcacatggccactcaata

SEQ ID NO: 184499 - DNA, 788 bp, Homo sapiens
gcgactacccaggagaaccagcctccagattgagattggagatgaaggccactcagtcccctccattgcaaaaagaataaaagaaaggagtaggattggccattgcttgcaaataaacaggagggggcagtgttggggtaatgacctccatccggggagggtcaggaagggagctgtcctttactgggcacccaggagatgcacctgtacaatttcattcattctcacgaccacctcgttaggtaggcactatctctgtggctccatttggccaatgaaaaggatgaagatctgagaagtcaagttacactgctaggaagaggttgacttggagtggaaacccaggactgcctgtctgactgctgaatgggtgctttgcgttccttacctgccctcccagggctccagaccgtccctcctgcacatctgcctctcccaggccgtgcctgcatgtccccagccccctccaacagctccatctcccgagagctccttgaatctcctcactcactcctcactcttgcttcctctttggaatccagccacaggcttttttcttccatctgagggagagaaaatggtctcgttccccacccccaggtctttccatcctctcatccatccaaacctaagcatctctcactcctcccctccccctctcttattttttttttctttctgtttatccatcactagaatctaccccccttccctcttgcctgtaggttctgtggctataaacaaatcataacttttattaaatttaagattactttttaatggaatca

SEQ ID NO: 184500 - DNA, 493 bp, Homo sapiens
acgaacatttgcctacatgtacttgcagaggctatctgcatgttgtggacggaaacttccaagcttacatctttggtcacttgcaacctcctcccttctgaaatttgtaatgtgcattggcatgttgaagcttttgagaagttcttcagtaaagaagtctatttaacttaatttaggaacttcttaatgtgtttgtccaggcaccttttaaatttttttgaattgtaatttacattgctaaaatgcacagacttcaaatgttcagttctgtgagtgtttttgagatagagtctcactctctcgcccagggtgctggagtgcagtggcacgatctcggctcactgcagcctctgcctcctgggctctagtgatcctttcaagtagctaggagtatagacatgcacatggctaacttttttctgtattttttgtagagacagggtttcgccatgttgctcatactggtcttgaactccagaaatcaagcaatctg

SEQ ID NO: 184501 - DNA, 527 bp, Homo sapiens
gcaaactgatgcaaggcattccaagaggcctttgagcctcttgcaagtcaagctgattgcaagacactctgcctttgataaaatgtagtggacagagaagcagtggtttcagtggcagagatgacaaattgttgcccaatattcgttgtccccttctttctcaacaaaatggaacctctgattatgctgggtttagcatagccatctagaataatggttacatatcccagtgtcgggcctccgagcccaagctaagccatcatatcccctgtgggcctgcacatatacatgaagatggcctgaagcaactgaagatccaaaaaagaagcgaaaatagtcttacctgatgacattctaccattgtgatttgttcccgccccaccctaactgatacgatatattctgcctggtccttaagaaggtactttgtaatattctcccccgcctttaagaaggtactttgtaatattctccctgcccttgagaatgtactttgtacgcccatcccaaacctataagaactaatg

SEQ ID NO: 184502 - DNA, 308 bp, Homo sapiens
tgagatatgcttcattatcatagttagaaaccatcactcactcttttctcatttttttaatcatttgttcaatatgcattgtgaatctactatgcttcattattattatcctgttgattataacaataaaaattcttttgctacttaaagtctttcatgtggaacattatgcttttcaagtctttggctttgatatttttaccttacaaattccatcatcaaacagctgtcattcaaagcttgttcagcttcatgttctttcctgcctggtctcaaatgccacacttcacttgccattagtgtgacag

SEQ ID NO: 184503 - DNA, 174 bp, Homo sapiens
atcctcattcaggccatcaataaatttggttagattgtaacaaaaaactattgggttactctgtttcagcattagctcttttccatctttttacatgctacccaccagttgaaacttcctaaagtacaggtttgattatcttttttccaactcaacaccaactgctttcaactc

SEQ ID NO: 184504 - DNA, 355 bp, Homo sapiens
ggagggcgtgctgtgtggcgctcccactgcagctgcttctgctgctgttcctcctcctgctgttcctgctcccaatcagggaagaggaccgcagctgcaccctggccaacaacttcgcccgctccttcacgctcatgctgcgctacaatggcccaccacccacctaacccactggggcacacaggtgactttctcctccaacctccatcagtcccagggcccctcctgaggatgctcgccagggaaactggaaacaggggcagggcaaagactgcagagctgcatccatatcagtgctgtgtcagcgttcccagaagacacttactttttatacagtgttgtcttagtctattta

SEQ ID NO: 184505 - DNA, 693 bp, Homo sapiens
gatttgttgtctgtgtctatgattgtttctgctgcaagctggccagatgagttcccctcctgagcctgtgtgaacagactccatcttggtctgatatggtttgggtctctgtccccacccacatctcaccttgaatggtaatccccataatccacacgtgttgaaggagggacccaataggaggtgactggatcatgggggctgtttctcccatgctgctctcatgatagtgagtgaattctcatgagatctgatggttttataagcgtctggcatttcccctgcttgcacttctctctcctgccaccatgtaaagaaggtatctatgacaaacccacagccaatatcatactgaatgggcaaaaactggaagcattccctttgaaaactggcacaagacagggatgccctctctcaccactcctattcaacatagtgttggaagttctggccagggcaattaggcaggagaaggaaataaagggtattcaattaggaaaagaggaagtcaaattgtccctgtttgcagatgacatgattgtatatctagaaaaccccattgtctcagcccaaaatctccttaagctgataagcaacttcagcaaagtctcaggatacaaaatcaatgtgcaaaaatcacaagcattcctatacaccaacaacagacaaacagagagccaaatcatgagtgaa

SEQ ID NO: 184506 - DNA, 544 bp, Homo sapiens
tggagcccaggaatttgaggttacggtgagctatgatcacgccactgcacttcagcctgtgtaatagagtgagaccctgtctcagaagaaaaaaaaaaagcaaaccacacaggtggccatgatgctggaccgctaagcaatctattcctctttgtgttgagccttcattgcaggccatcacccaaaccatctcctcttccccctccaagtgtcctgcaggccaggctttgggaacactcttcagagggcccacacctgccctgccctacccagcgctaccatgtgaatatccttaattttctgtagtacttgcaataggatggactcatgtgtctgtgcccagcagtacaaaaccaggcaggaatgagaatagcagagggtacagtcgggctcagtactccctttggtttggaagtggacagtgtggaggtctcttgccttaaggagcatgtgtgtgagtgtgtggtgtaaacagatttctctcttctgcccttctgaacacaagggtagagtgggcctgccttagtttactatggctgccata

SEQ ID NO: 184507 - DNA, 407 bp, Homo sapiens
ccttgctaagatctctttgttgacaaggtgaagaaatatgaactacatctgaatagcttagtaaatgttcaatttaccctacaaagtgctgattaatgaacagaccaaggaaggtctctagtgggaggccacaggtctctttctgagtactgtagatttcaacatttttatcaattacttgaacgatggcacagataaaatgtttatctaattcaaagatgacaagtttccaggagcaatggcaaatacactggatgacagagtcaagagctaaaaagatcaacagattggaattgcaatagagaggaaataaatgctatttggacacttgggtgcaaaaaaagaaatgcacaaatgtaggaggtgtgaaaaagacttaggagatttaattggatataatttctgta

SEQ ID NO: 184508 - DNA, 261 bp, Homo sapiens
tcccatctccgctgctggttcctccctctccaggccttgaactccagccttctctagggcccagggcttggaataccacctgtctgctaaggattcctggatcctgtctcccctgatgccagcctcctggctcccaccgtccactcatcagctgcactcaaatgacctgcagacgctgtgggggccagttcatccacgcccagtgctcaccctcccaacagcctccccgtctaatgatgacggggtctctcctgcagccca

SEQ ID NO: 184509 - DNA, 209 bp, Homo sapiens
  misc_feature (180)..(180): n is a, c, g, or t
gtcagactctacgaaggatcccccctagttttagaagtttcaatagcagtagtacaaaactaacatggtgagttatcggtgggagtgtgaatgagcaaacgaatgagtgaacatgaagtctaaagccacccttagctgggcagtgtggctcaacacctgtaatcccagagagatcagatnatattgctattgaaacttcttaaactagg

SEQ ID NO: 184510 - DNA, 364 bp, Homo sapiens
ttgagaagaatgtgtattctgtagcttccaagtggaatgttctttcaatatctgtgaggtacatttgatctatggttcagtttcagtccagtgtttctttgttgacttttttgtctagataatatatctgttgttgaaagtaggtgctgacataccctactattattgtattggagtctatctctctctttaagtctaataatatttgctttatgtatctgggtgctctggtgttgggtgcatatataattacaatttttatatcttcttgatgaattgatccctgtgtatcaaatagggatccctatcattatctaatgacctacttgtttccttgtacagtttttgacttaaaatttatttt

SEQ ID NO: 184511 - DNA, 521 bp, Homo sapiens
tgtctctcagaggcggcctagaagctggagaacatgtctcagaactagtaacttccttcttctctcccttcctcgttttttaacttccttccaaattttggtgtctttccgactctaagccaagttcccctcaccaatctttctgtttctagaactttttcctattcttttccttgggttcgtcccacccaagaataagttgctttcactcttgctatttgctacagcaatgcccattcccctaccatttccactagtctaaaatatggattttacacagtggtttaaaaaaagaacgacgttgctaatacgttggtttgggcctagggggatcttctgagatccttccgggcagaggaagaactcttaaagtcatatttgaaggcactgatgctggagctgagaggactggatgatggccttaactcagatgccatggcaccaggtagctgcctcctactgttggtcagtttctcccttcaaggaacaaaaacttccccattctcacttcaccagacaca

SEQ ID NO: 184512 - DNA, 311 bp, Homo sapiens
ttggcatagactaggcatgtgtgtgtttggagtcaggaggagtaccagaagagggaataccagaagagttttcctgcttctggggaaatccggttgtcacaatgaagctaatgcctataggggggagaggaggaaaaaagctatctgagggataactcaagaaggaaagtacataggaacactctgaaggcaggactctgcctggaagccaacagaagacaggaaataatgctataccactgaatgtatcacaagcctaaaaaaactgcatatccctcagatatggatggatcaccaatgtaatgttgagg

SEQ ID NO: 184513 - DNA, 411 bp, Homo sapiens
ctccttgtcagaagggaggggagatctcttggttttccacggctgggatctctatgagaagatatcctttatcgggaggtcggagctcttattagatgtgggtccctgagagtggaagcctggggaggttgggccgtttagaggctgcaaatgtctaggtcactgttcgatggaagaaggaagtttgctcacagggtctggggtgcagagctctgaatactgaaagaaaaggaagttgagagatggggttttcagagcctgtggaagacaagcgttttgttctgacacttgggttgtggcaggaggcagaaggaggatgcttgaatccgggaggcggaggttgccgtgagtcaagatcgcaccattgcactgcagcctgggtgacagagcgactccatgtaaaaaaaacaa

SEQ ID NO: 184514 - DNA, 333 bp, Homo sapiens
tggccgccttcacctttttgccttttaggtttcagcatagatatttcctcctccaggaactctctctggccatcgtcccccttccctgaccccagggtgccccttctaggagtggacctagcaccagctcttatagcagcggctcttacttgtccctgcgtgtcttatgttggttgtgaatactatttcttgcctgcaactcccttctctgactgtgggctccatggcagtggggactgtattggtttcactgttggacccccaaaggcatgagagtgcctagcacatagtaggtgctattcaatgagtgtaggctgaataaatgaatgaatg

SEQ ID NO: 184515 - DNA, 164 bp, Homo sapiens
atcatctttactccaatagtctttgttctgctattaaatatattctattctcagtaccagacctgaaatcattggagtagctttgattaaaggtctggtactgagaatagaatatatttaatagcagaacaaagactattggagttaaagatgatggaataata

SEQ ID NO: 184516 - DNA, 702 bp, Homo sapiens
acagaaagtcatgtcttcaagcagaaagtaaaatatgtagtattttaggtggtgataagtattgtggaaaaaaatagagcagagtaaagggataaagaatacaagggtagggatggggttgcaattttaagtatgatcgggggaaaagtcacagagaaggtgacacttgagcagacctgaaggaggtggtgggatgcagatatctaagggaagaccattccaggcaaagggaagagtaagggaaaaggcagaaatatgcttgacctttggaaggaacagcagaagaatccagtatgtctggagcagaataagtgagggaaaaatagtagacgatgaggtcagagttgacttagggccagattgaagagagccttataagcagttttcaagatttgggtttttacttagtgaaatgggaataactgcaggattatgagcagagaagtaatgtgatctgacataagtttggaaaagaatttttctgcttgtggttctgaattggggagtggaggtggacaagaagcaggaagtccaattaagaagctgttggcattcatccaggtgagagatgataacggcttgaatcatagtaataatcgtggacgtggtgagaaataaacagatgctggttatattctgaaggcaaaatacagggtatttgttggcagattggatatgtagtgagagagaaagaaaaggagt

SEQ ID NO: 184517 - DNA, 562 bp, Homo sapiens
tcacttcataggggccgacttgatctgattggtggaagggacataccacccacaagtccacgtggcttggatatggagggaaactccgcagtcagcacccttagggagtcagtgcagcatggtggttaagcaccctgacttcaggctgggcgtggtggctcacgcctgtaatcccagcactttgggaggccgaggcaggcggatcacttgagctcaagagtttgagaccagcctggacaacatggcgaaaccccatctctactgaaactacaaaaattagctaggcatggtggcacatgcctgtaatcccagctacctgggagactgagacacgagaatcgcttgtaccttgcaggtggaggttggagtgagctgagattgcactccagcctgggtgatggagcgagactctgtctcaaaaagaaaaataaaaagaaccccaactttggagtcactctgcttggcttcaagtctgtctcgccacctatgagctgtgtgttatttaatctttctagcctcagtgtccccatctggaaaatgggcacgatgatgatcgcattta

SEQ ID NO: 184518 - DNA, 672 bp, Homo sapiens
tttataccttgttcctgaatgttggctgagaatgcttctcttggctccagggctggccgctatgaggtggagtctggctagaggctgctagctcaccctacaaacttgttgtatatgctgtgggtatggatgccatctcagactaggtcttagattggcagttttgaagaggccctgagacattataaaggtcactcaaaatcacacagcacctacatcttcttggggctcatgtgattcagagccctgaccttgagtccctgggccagataaagatgggggtggggggtgacagtgaatgaacatcaggaaacctgaatttcagttcctcttctagcataactgatcttgtgactacaggctgtgatgggtgttagataacaggggaggatatctagccccatgctagtcatatagtaggtgcttaatagactctatagtgctgtatagtggctgtcatttgttgtacccatactatgtgctatgtactgggctatgtgcttttttcctaaaaaaaaatttggaataattttaggtttatagaatagttgcagcagggcgtggtggttcacccctataatccagcactgtgggagaccaaggcaggcaaatcacttgaggccaggagtttgagaccaacctgaacctggccaacatggtgaaaccctgtcc

SEQ ID NO: 184519 - DNA, 706 bp, Homo sapiens
agagtcccttcaagatcaaaacctgactagtttgtgggatgtgcatgtctgtagtgcccgtacaacttcagcaattgtttgaaaactgtagccgtagacaatgatggtctgtaaggttgaatcaaaacaaaacccacaaacagctgtatttttatatctaaatgttacataaaaagctgtttgtgctgttaaaacttttaccattaaaggacagaataagagcacattggagcagactgttaccaaactttttttagggcatgcgtgctagcactttatgtacttagtcactcataaaggcaatacctggttcttgtaaattctacaaatggcctcccactactgccaattcaaagtaaaaaacaaacaaaacacccaggtactgctgtacagatttcttgaagtagcctttttcccagctttgcaccccacctgaagatcctgtccactgcagcttgcaggtgcctatacagtgtttccagcttcagaactacttttttaaaaaactcttttcttcttaattgtggtacgatacatataaaagtttaccattttaactgttcagtcacattaagtacattcacattgttgtgcaaccatcaccactatccatctccagaactcttcaccttgcctgagactctacctgttaaacagtaactccacccgcaaccaccattctgctttctgtctctgaatttaacta

SEQ ID NO: 184520 - DNA, 434 bp, Homo sapiens
gtcggtaccggacagcacgcgctaacaacttggtgagggttgataaaagagggatgtataatttgaactttataaaatcaccatagaagcctgtagaatacagtttctatgaaggtcctgcttatcacatgagacaaactgttctttgttcttgttaaagattgtgaacagtgtgttaaataatattaatggctgggattgtcagtacttaacagtaccgtccttctacaagtgattttattgatcgatacagactcaatgtaacgggggcagattatttttactgattttatcgaaaccttaaccaagtttgttagtgtgccacatatctttaaatagatctagatgatgatatagattaagaaaagcaaaccaccatccatctctttttgatctgttaataacttaaatccatcattgttagcgcgtgctgt

SEQ ID NO: 184521 - DNA, 613 bp, Homo sapiens
gaatttgagcactctagatacctcatatatgtgaaatcaaacagtatttgtctttctgtgactggtttatttcacttagcttaatgtcttcaaggttcatctatataatatatgtcataatttccttcctttttaaagttgaatatattccattatgtggaagcaccacattctgtttatccattcactcactgatgggcacctgggttgcgtccatctcttggctgctgtgaacagtgttgctgtgaacatgggtgggcatggcttatgtacctctatttgggcacataaactaaatcagttctaaatggaactgatttagatcataaggctactgattttgtctaatttgacggaatacctaatatactagaacaactagaaaatgctttatcaccatcattagaaataagactaatattgaccatcaattccctcatcactttatcacacctggcaaatgtgtatgttaacagtttaatctgacctcatgctggcctgagagaagctctgtagggaaaaatcttgaggaactgtcaggccatcagtaaacacatcacagtaactgtgtgcagcatatttatagcttcagaacaagacagggctttttcat

SEQ ID NO: 184522 - DNA, 544 bp, Homo sapiens
tgcttgagtgatttaatagaggttacccagctggaaagtggccgagatgggcttaagcttgatgtcttaaaagcccacatttctgaccatttctaaccatttctaattagatatcacatgccttctcaatagaattaatttctattcatccttttttaattagaagaacttacctagaacttcacacctatgtttttctttcattctttatttttttccagaaaccatctgctggaatgaaaaaatatttggaaaaattcagagaaaatacacagaagagaatatgctggcacatacatgtgtaaaaatctctctttgggagcaaggctggccagattaaggaggaagagtaaagctatagaatctggcccagtatctattgctttaatacaaagaattcaaaatcccagggagatagctctttacagaattggggatttaaagtgcaggagttattgacttattggactatcctgaaacagctgtctgttggaaatgcttttctatatcaaatgtcttaaaattaaagcttcatccatttcta

SEQ ID NO: 184523 - DNA, 290 bp, Homo sapiens
ggtgacatctgagctgtgtcttaaaggacaaataggaagtttcgggtggagctggcatctgcaagagcacaaagccccaagagctagctagtgtccacctcgtcaaacagaggtggcgtcagaacaagaaactctccagggcaagaggaaagtgcctagatttcttgtttgtattttataccatatagataaaattgttatttgttttttgtaaggctttcagtcaccttgagtatctggctaaaacctattttttatcttaaactatagacacaaagattaatgttgtc

SEQ ID NO: 184524 - DNA, 264 bp, Homo sapiens
  misc_feature (5)..(5): n is a, c, g, or t
  misc_feature (8)..(8): n is a, c, g, or t
cgganctngaaatgtgagtggctgaccggcgagtgccggtccagtcagttctgagtcacatatctcaggtcaccgtaaatttataaaataccttcagaggcgagccagggaggcaaggcatgcattccctgcacacaggagaagactcaattggaaagaaaatctcctcttttttatgtgtatttgataaccagtctttataatctaaaagtacaaataaggcacgcattataaatctcacttattgtcctaatgagttagcca

SEQ ID NO: 184525 - DNA, 346 bp, Homo sapiens
tttgagcacttccttactttctggcaagacaagatgctccagagtcatcttgtgtatttcctatccctgtcctagaatcagccatttctccacttatagaatgtctttggaaaaagcagcacaagctggggcaggtatggagggaaatgcatcctcattgtattctcttttggatattttgaatatgtcttctttacatatacagatccaaaagatagctttttaaggggttattctagtggttcccattagaaattttcaagtagggtcttgggagagaagagggttgggtgtcagccatactaggaggttgcatcagcaaagttcagtgattaatgggacacag

SEQ ID NO: 184526 - DNA, 286 bp, Homo sapiens
tcctactagtgttgggaaacccaggatggttttgatctcctgacctcgggattgcccgccttggcctcccacaatgctgggattataggcgtgagctactgtggccagcccctgtcagctgctactgaataatcaaataatgatgaggaaaatgctctcctgaatttgctgcagagaggaaattgcttgagtgggagttgcttcacggaatatgacatggtagacatggtccttgcctttgtggactttgcagttagtggggaagtgatgtaagttaacaactgat

SEQ ID NO: 184527 - DNA, 146 bp, Homo sapiens
gctgtcacttgtttttatttccactttgttcagaaataggactgcttacgcctttgaaacacaggacgaaaggctattgaaattggctcgcaatgaaaaagttgactcatgagattttttttccattaaagagatgaagatggcgt

SEQ ID NO: 184528 - DNA, 503 bp, Homo sapiens
ttggctactgaatattaagagttcactagactcgctacctctgaaagcatttaactggatatgtatggatatttgcagaaggatatagcatgatatgatagaaatacaatgaaaatcatgggaggaggcagggacgcaaatacttaaatcgttttaattttactaaaacagtaagaacacaagaacactcagtaattagctaatagttttcaaccatgatatcgttttaacagtaaagaataagcacaacacatacacttcagaaagatcactctggcatcagtacaaaagactaaaaagttccaaaagtgaaacttttcaactttttactctggtaaatataaggagctttaaacactgacttcatttccaggttcttcttccctcagacctaggctaatcccctccctccagtaaaccctgaaatcctgttttcttgaaggttcacattttagaggtgaaggtttgacgccatgcatacaaaccagctatgaaaagaatgt

SEQ ID NO: 184529 - DNA, 350 bp, Homo sapiens
aaaaaaaaatcacagaactccgtagattacctttctgagacaacccctcatttggtctacataagaatcctatattcttattgttaatataacttgactttattgtggtacaagaactattttttcataaccatgtattacattgcaaaccgctctaccattaacatggctttaagggatatcatggccaattgtgtctctgtaattttggggcttttttctgtgtttgcagaaaggagggactggacagccccatcactcatatgtttgtggcaggatgaaattttgagatattaaccagggttccccaagctcctttcctactcagtcagcagcaggaattgcttcag

SEQ ID NO: 184530 - DNA, 400 bp, Homo sapiens
tccagacaggccaggatgaacttgaagtgagaaagagagagacgggacagagactagctatgtaactacttcgtccaagtaaagaaaagggatcaaatggtggtcatagggatagacgtaaaaacaggaatatgagaatcaatcatgtttgtgtttttttaacagacacccctctagcagtgtgaaaaacttatccataggcttgaacgtgaataccaagctcctgcaatagtccagatgaaagatggagaagtgggcaatgcaaagaaaggtagttatgtttttattaaagattaatatgagaacaagtgctctatatccatagaaaaaagaaagctaagagatggatagactcaggtccaaaatgatctcaaagaatgaaataatgagctatacttag

SEQ ID NO: 184531 - DNA, 350 bp, Homo sapiens
gacttgcccttttcatgaggcggccgttcccatttgttcttggggaactgcgtagcaccaagctacctgacaggcatggtggtcatgaagtctctgtgttaagatcaggaaaccaaggccagaatatgctcaacattatagtggagcgaagctcagacagaggattagaactctttatcctgatcatttattcaaaacactttattgactgcctaccctgatgcactgatggcttcaggaacacaaagatgatgagaataatccctctccccagcagagcctctggttttaaagtccattcagacctgaacagaaggggagagatgccctaataaagacgtgtataaaag

SEQ ID NO: 184532 - DNA, 288 bp, Homo sapiens
cagttccacccctctgcaagcgtgctgaggccagttcatcctacctgtgagaggctgggtgccttgtgcagaaggcagcctacaggagttaccaaaaaagcagactgtccctagcctactcaggactttgctaggctgaaggaaatattaagttggccaatcaattcccattgcctgctgcaaatgctgagcctttgtcagccagggaaacacagtcccataacaaggcaagctcatcctccatccctcggggcttctgctcaggcaatgtaaggcgcagcccatttg

SEQ ID NO: 184533 - DNA, 615 bp, Homo sapiens
gtcctgtcccggggagcagctgagctggtcgggggtctcgacctgtggggctcagaggactcggggtcatttcactgggctgtggcgatgctgggctgtggaggtaggcctagggctcctgtaggcctcagtgagactggcggccgatgcccagtgttcaccctgctggcggcagtcaggaacatgttcacaaaggctttaccttcaagtggtctagaggtgatctgaggtggagtaacaggtccagataggctacgttcataaaacagcttcagcggggtttaggaacactgtgcatttacgggacgcagtgggtcagagtgctgctgtccgtgggaggtggccccagggcaggtcagtgggcacgtcctgtggtaagtgggactgtggatgtgggctcaggctggactcagcagccctgctggataccaaggcctgcaagggctggccccctggtgaattgtcccgtgccctgtgtatctatgagtcctgcagagatgacaaatcaggggacggggtcatgtctagtcaccgtctgggaaaatgctccaggagtgaacacatttcaggctcttgatggatgtacctccaaactcttctctggatgggtgggcc

SEQ ID NO: 184534 - DNA, 296 bp, Homo sapiens
ctgcctctcaaagtgctgggattaaagatgtgagccactgtgcccagcctaataatttccagtagtattcatgatgatctgtttttctaagaataaactggcatgttttagttcagccctggataccagtggccttgacttatatttctatacaaagattaaagatggtaatgtgcagataccctgagttttcagtttaatcttgtggttataactgaagatttcaacatttttctaaattgttaaatatagataaatgataaaggtatccagatgctactctaggtcctgaggat

SEQ ID NO: 184535 - DNA, 618 bp, Homo sapiens
  misc_feature (1)..(1): n is a, c, g, or t
  misc_feature (22)..(22): n is a, c, g, or t
  misc_feature (25)..(25): n is a, c, g, or t
nttgcattgtcttccagcctgngcnaagtgcgaggctgtctcaaaaaaataaaaataaaataaataaaaattggccaacatggtgaaaccccgtctctactaaaaatacaaaaattagccgggcatggtggcatgtgcctgtagtcccagctacttggaaggctgaggcagaatcgcttgaaccctggaggcggaggttgcagtgagctgagatcgcgccactgcactccagcttgagtgacagagtgagactgtctcaaaaaaatgacaatactaataaaaaaagaaaagaaaaagggactacccaacaagtaaaagactcaggtagaattccaatgaagttggctgggcgtggtggctcatggctgtaatcccagcactttaggaggccaaggcgggtggatcatgaggtcaggagttcaagaccagcctggccaacatagtgaaaccccatctctactaaaaatacaaaaaattagcagggcgtggtggtgggcacatgtaatcccagctacttgggacgctgaggcaggagaatcacttgaaccggagaggcggaggttgcagtgagccaaaatcatgccactgcactccagcctgggcgacagtgcgaggctg

SEQ ID NO: 184536 - DNA, 210 bp, Homo sapiens
gtaaagcaggactcagggtggtgggggaggtgggcagtgagggataggattcaaataaaaaccattctttcccttggaatccactacacaattaaccaacaaatcccataagtggaccttttaggaagataacatttctatccatgagcatagccactataatcacaagacatttatctcaagcaagatagagtcaagatactctcacaa

SEQ ID NO: 184537 - DNA, 251 bp, Homo sapiens
gacagggcatgtgcctgtgtcccagccacttgggagacgaggcagaagaatcacctgagcccgggaggcggaggttgtagtgagccgtgattgtgccatggcactccagcctgggtgacagagcaagaccctgtctcagaaattaaataaaatacacacacacacacacacacacacacacacacaatcagccaagacagcaccacctgctgagctcccaaacactgtttctggtcacatccagaagtaca

SEQ ID NO: 184538 - DNA, 532 bp, Homo sapiens
ccctactctagagcatcccccctaggtatatgtcgtgccaaggaaagaacatagcagcaaatggccactcctcaccttggtatttctgggaattttatgaggctactgtagaaaaatggtttgatgaaatgaagcctgtgatcacctagtaaattgtagagaaatggcttccacatgtgaggttgtcctttcccgaatacatgaccttaaggtgaaatggataaaacttctggcttggaaaggtagttagtataattaggaccatatttatttttcaaatacagagttgaggacccctgtcgttttctgcaatgcaagtctaagtgggctcggagggactgtgaactctggtcctggaactgatttcataacctggggcacgttcatggaaatatacggttggaagggagcttggacaggtctctacagatcccactgctgattggttttgatagaagaaatcacttacgtgcctctgtagttgactccattttaataagacagcgcagcttcctctcttctcagctttgaa

SEQ ID NO: 184539 - DNA, 222 bp, Homo sapiens
ccaacctcctttcagtgcattgtggcaaatggtggggctccaggattcttgtgggatgtctttatcacctctcccctctgccccacccccttttctgtgatctgtacccttgcacttgtctcccatagaggatatggcatcaattcaggtcacacctgaattgtgggttttgatggcccacccagtttctcacaattctgagttgaaatttaaaaatgggaa

SEQ ID NO: 184540 - DNA, 393 bp, Homo sapiens
gaccacaggcatgcaccaccatgcctggctaatatttgtatgcttttacagagacagggttttgccatgttgcccaggttggtctcaaactcctgggctcaagccatcctccatcctccctcctcggcttctcaaagtgctgggattacaggggagagccactgtacccagctgacaatttatgatataaccaaatagtgtaggataaacatataacagggagaccttatttaatctggtgtgttaaggaaagcctctctgagggaatatttcagcggagacttgaaggatgaggaagacttagtcaagtaaagagtatggggaataggatttcaggtataggaaacacactctgatgctggggagtgtttgctgggttaaattagaagaagg

SEQ ID NO: 184541 - DNA, 554 bp, Homo sapiens
ccggtgcaagttctgttcatgctctgattgggggtaaatctgcaaagcccttgtgtgttgatgattttcttaaggcctctcctgattttataactgtatagtcaaaacttttttcatttgtgtactgtggctcatttttattttgtcaggtatgtgctggtcatacttgctggatggactgtgtaaatcaggggtctgcctcttgtggctcataaggtgattttgagtgacatggccaaagtcagccctaggcacagtcaagaagtaggcgaagtttctctttgccttcccagcttttctgtccgtgcttctttcttctctcccagtacctttcagtgaacctgatccccacctgccagtgcctactgtctttcttgctcaacagtgtatctcctttgtaacttgctaatgatggtataaggtataatccatttcacgcatatttgcatttcaaaaaggaactctttaagatggaaaagccttcaagatccacaggaatgaagctataatggtgaagctataattggtcattagctccaacagaggaagagaga

SEQ ID NO: 184542 - DNA, 308 bp, Homo sapiens
ctctgctaggccttgctgtatatatctcttcatttgcctggtctgatttatattaaactagatatagcaccagaagataactgcagtgtgatgggatacacttctgcctgaagaacttcctccatctcacagggcagatctactggcaacaaaccccacaacttttgtctgaggaagtcttttgtgggactaggtctcattctatcacccaggctacagtgcagtggcacaatcttggctcactgcagcctcaacctcccaggctcaagcgatcctcccacttcagtctcctgagtagctgagaccac

SEQ ID NO: 184543 - DNA, 628 bp, Homo sapiens
tttttcttgtcaaggtattgtttatagaatttgttcaatatccattactttaaggcctcttacaaaaatattggataatccataaaaatttctctaagaatattttgtttgttagtggtcaattttaatacttaaaaatataaagttgctatccttggcaatctggatcaacatcttggcagctatctgttaattatataatatctgtatgagctcaatattttgacaagttaccttacctcagtcagtagtttattcttgaagtttctgatgatactcttttaataaaaaaaaaagtaattactttctgaggtattttttccctctcaaatgtcagatttccatgtactgaatatgcttgaaataaagtacatatgtaagattttttatattaaaaatgtctgaagcaaaaatcagtaacttaaaatttgaaataaaaatgcaagtgtataacttgatatcagaagatattaagtctaagcacttttgtgggctgtaaatcttgacctcttctaataacctgtcttttcttcaaataggttcttgcattggtaaaagtttaaagaaatatgaatatatatgactgtgacaataagaaaattaaaaaaatgaaaataatcactctcaa

SEQ ID NO: 184544 - DNA, 723 bp, Homo sapiens
cttactctccttgaatacacatatagatagccataagttttactaattctgtttaaaatataaacgttatacagcatctcagctctggaattctccaattagtgaggccccctcatcactaattaaatctgagctatggagtaagctggtcttttccttctccttggttcttcaatccattcaaacactaagtctatagattttccactagcacaatctccagtctctgcaacctctaagtcatcttgtgatctgatggcttttaccatatacttctctaaaaacctacaacacctcttttctgcctgtcacattaaacttttcagttgacctctcagcctgcacctccgctggccctctattaccctaagcagcctagcttccactgctcaccaaaacaaaattcctactctgccacaccgctatgatgatgggtcccctgtactaccacacacaccaagctcattctcctttggtgtctttcttcttggtgcttcctgcatcaggaaaccccactcaaagatggttttatgttctcatgaaaaaactggggcattccatgctattttgcggtcttccatggttctttgagagtatgtacttgttattaccttaggaagttgtgaacaaagtaatacaaataaattctcacaatgtattagcactcaggaggttttaccagtgctaccacctacaagatgcccaggttgtaaaagggagagc

SEQ ID NO: 184545 - DNA, 510 bp, Homo sapiens
ggaacatctatgggtcccagagcggctctgtcctgctgctgcaagggagatcgaacctcgggacaggagtggttcctgcagcccttggtggtgctggtgtcatggccctgctctgtatctgtctgtgcctcatcttctttttaatagtgaaagcccgcagggagcaagcagctgggagaccagagaaaatggatgatgaagaccccattatgggtaccatcacctcgggttccaggaagaagccctggccagacagccccggagatcaagcatctcctcctggggatgcccctcccttggaagaacaaaaggagctccattatgcctcccttagtttttctgagatgaagtcgagggagcctaaggaccaggaggccccaagcaccacggagtactcggagatcaagacaagcaagtgaggatttgcccagagttcagtcctggctggaggagccacagcctgtctgggggaaaggacaagtcagggaccacttgctgaagcacgaagag

SEQ ID NO: 184546 - DNA, 317 bp, Homo sapiens
cgaagtgaacagagtacatagttcatcagccgtccagtacagcaacccaggaaactgcactgggtctctttgcctaccgtattaacattaaacattgatgttctgtatactgtactttactgcacccagatgactttcaacaactcattgaaccggatagcttgccgacccttaccctagtagagcttaagaactgtgggagacagaggtcactctgccaggagagtgccgcagggtgagcctctgcagggcctctgttggtgggtgggccactgcagggcagcgaggggtcccctgaggaggggaccattgagccg

SEQ ID NO: 184547 - DNA, 181 bp, Homo sapiens
tcatgtctcttctgtcagggaatcccagcagctctcaatccaccctatggtttacatcccaggatcctttatcttttggagtaatttaatgcatgattaccagaggtgtcccatatatagtagccttcctaagagttacatttcagtagttgttgttctttgatcctggatgaatttgaaa

SEQ ID NO: 184548 - DNA, 470 bp, Homo sapiens
tccatttaatcttattgttgaatgagtcatagtataacctgtacacagacatcacaccttctgcccaaactaattaactaaatataaactaacaaaaccaacatgcataattctgatactactacttgagccttacgggacggcggtgcactacagtgagacctttaacatgtgaaccacatgctcacatacttgctcctgtcccagttcccctccttggcagataagtacttatcttggcagataagtacttgccaagtctttgaacaagttcttaaactagaacgttgggcatagagcctggatctttgcagacctaggacaaaaaccaggctcctgcctctcacaggcagagcggggctttgagcaaactgcataatccatgcctcggtctcatctgaaaagcatgcacagtacctcctaatgctgggtcacaaactttttctgtaaagggccagacggtaaatagt

SEQ ID NO: 184549 - DNA, 548 bp, Homo sapiens
actctagacggatcccccgcttggcgtcttaacagagcttgcgtattagtagtaaagaaacatgaaatttcaattagatagatgacaaatagataaaatttagatgagatagatataaatatcatgatgaaaataaatagggagatgggctagagtttgtggtgggttactttagattgagtggccacagactatttttgagtctgaattacaagatttggacagacaatattctcagcagggaatgacaatgacaaagcctgaagataagaactagctagttttagaaaacaggagaaaagtcagtgaagcaaagtaagcacagtgaaaaatggtatgacatgactttggggtgttggtagaaactaaatctcacaaagcctcataggacaacataagagattaattttattctatattctgtgttttatcaatcgtatactgctgggaagcaaatcagtccaaaacttagtagcttaaaaaggaatattgggctcagtgcagtgcctcacacttgtaatcccaacaatttggaagacggcaagcgg

SEQ ID NO: 184550 - DNA, 2445 bp, Homo sapiens
  misc_feature (323)..(323): n is a, c, g, or t
  misc_feature (561)..(561): n is a, c, g, or t
  misc_feature (1022)..(1022): n is a, c, g, or t
  misc_feature (1066)..(1066): n is a, c, g, or t
  misc_feature (1389)..(1389): n is a, c, g, or t
tatctctgcccaaaactgaagtgtttacattatatacttaggaagtccaagtaaagacatgagactagactttaggttgtggggctctggtggtggccagtaagccatgagaatggatggactttcctagagagagtgtgcaggatggtaacctcaacaccatttatcagattcttcctctgaaagtctaaattccagaaaaatcccagcaacagattttttttctttaatctgccttttaaaatcttatacctttgaagtgattgcagagtacagttttgctgaagtggacttcacatggtcttaagatagccagaggggcntctgtcagctgcccacatggtggtatcacagctgtccaggccgtgctctgtggacagatcagtgatgataccatgggctgtcacaaaccaggctctcaccagcaatgctctagttgtagtgtttttagttattgatgtgtttcaggggccaagaatggccttaattcttgaattgcaattgtgcaaatatagtttgtacactccattccttaatccacataataaaaggaaaagccanaaggatgcattcaacaaatattggggctgatcagatctttatctgattatgttcttttggagttaaactaagttctagaaatatggaacaggtcaggcccagaacattcttgattgagtagttcaagatcttttgatagaattcagagcctccatggtggctaagccagttattgctgctttaacttgacttctccccacatttggaggatattccagccaagaaaggactttgattcatagtcatcatcttctatgtacaatttgaaatgttttgcatttagggttcttatgcttttttcctaacttaaaattgttttgtatttacatttctatccataggtcaattcacatgatcacttaaagttttaaataatgtcatagaaatcctactgaattgctatattgaatttacttaacccatttctctgtggttggatatttagacagattccattttanttcttaataatatgctgttagaaacattgcttacattggttacntttctttctgtgggtctcttttttgagcatttcttcaagatatagtccctaaagaagaattaaggataaaaaatatggatggttttatagctctagttccatattgttagacaactgagagaaacactagagtaatgtacaatgcccctggcagtagttgagtgggcttgtcgtccaacagctctgcccagtattttaccattgtgtttcttattgtgttcaagtaggtaaacagttattttcattcatgtttctttaattgtgagactgaacaccttccctgtgttagcttatagggtcatttcccagtgtgtgtaatgcanctataaagtgcctggcacagggctgccacctgctagtgtccttctctttcctgctttccccctttactctttagccatttgtcaaatgaagtctcattactgatgacaatatatgtttatctcacactataagattttattattattttggattataaatatttatccattatatttatcataatttaaaattttggggggctccctttgtatttgttttgttacttttcttatttatttatttgatactgagtcttgctctgttgcccaggctggagtgtagtggcacaatctcagctcactgcaacctccacctcccggttcaagcaattctcgcgcctcagcctctgagtagctgggattacaggctcctgccaccatgcccaactaagttttgtatttctagtagagacgggctttcaccatgttggccaggctggtctcgaactcctgacctcaggtgatctgtccaccttggcctctcaaagtgctgggattacaggcgtgagccacctcgcctagccagatgttttgttacttttcattaaggagattttttttttttttttttgagacggggtcttgcttacccatgctggactgcagtggcgtgaacacagctcattatagccttgacctccagggctcaagccattcttccaccccagtctcctgagtagctaggaccacaggcgtgcgccaccatgcgtggctaatttttgtttttttttttttttttttggtagagacagggttttgccatgttggccgggctgaccttgaactcctgggctcaagcagtctgccttccttggccttccaaagtgcaaagagactttaaatagactttatgatattcgagttcacctacctcagtcttataatactatttagttttttaatcatgaatttctctctctgctatagctgggcgtggtggtgggcgcctgtagtcccagctactcggagaggctgaggcaggagaatggcatgaacccaggaggtggagcttgcagtgagccgagattgctgggcgacagagagagactccgtctc

SEQ ID NO: 184551 - DNA, 2602 bp, Homo sapiens
  misc_feature (323)..(323): n is a, c, g, or t
  misc_feature (561)..(561): n is a, c, g, or t
  misc_feature (1022)..(1022): n is a, c, g, or t
  misc_feature (1066)..(1066): n is a, c, g, or t
  misc_feature (1389)..(1389): n is a, c, g, or t
tatctctgcccaaaactgaagtgtttacattatatacttaggaagtccaagtaaagacatgagactagactttaggttgtggggctctggtggtggccagtaagccatgagaatggatggactttcctagagagagtgtgcaggatggtaacctcaacaccatttatcagattcttcctctgaaagtctaaattccagaaaaatcccagcaacagattttttttctttaatctgccttttaaaatcttatacctttgaagtgattgcagagtacagttttgctgaagtggacttcacatggtcttaagatagccagaggggcntctgtcagctgcccacatggtggtatcacagctgtccaggccgtgctctgtggacagatcagtgatgataccatgggctgtcacaaaccaggctctcaccagcaatgctctagttgtagtgtttttagttattgatgtgtttcaggggccaagaatggccttaattcttgaattgcaattgtgcaaatatagtttgtacactccattccttaatccacataataaaaggaaaagccanaaggatgcattcaacaaatattggggctgatcagatctttatctgattatgttcttttggagttaaactaagttctagaaatatggaacaggtcaggcccagaacattcttgattgagtagttcaagatcttttgatagaattcagagcctccatggtggctaagccagttattgctgctttaacttgacttctccccacatttggaggatattccagccaagaaaggactttgattcatagtcatcatcttctatgtacaatttgaaatgttttgcatttagggttcttatgcttttttcctaacttaaaattgttttgtatttacatttctatccataggtcaattcacatgatcacttaaagttttaaataatgtcatagaaatcctactgaattgctatattgaatttacttaacccatttctctgtggttggatatttagacagattccattttanttcttaataatatgctgttagaaacattgcttacattggttacntttctttctgtgggtctcttttttgagcatttcttcaagatatagtccctaaagaagaattaaggataaaaaatatggatggttttatagctctagttccatattgttagacaactgagagaaacactagagtaatgtacaatgcccctggcagtagttgagtgggcttgtcgtccaacagctctgcccagtattttaccattgtgtttcttattgtgttcaagtaggtaaacagttattttcattcatgtttctttaattgtgagactgaacaccttccctgtgttagcttatagggtcatttcccagtgtgtgtaatgcanctataaagtgcctggcacagggctgccacctgctagtgtccttctctttcctgctttccccctttactctttagccatttgtcaaatgaagtctcattactgatgacaatatatgtttatctcacactataagattttattattattttggattataaatatttatccattatatttatcataatttaaaattttggggggctccctttgtatttgttttgttacttttcttatttatttatttgatactgagtcttgctctgttgcccaggctggagtgtagtggcacaatctcagctcactgcaacctccacctcccggttcaagcaattctcgcgcctcagcctctgagtagctgggattacaggctcctgccaccatgcccaactaagttttgtatttctagtagagacgggctttcaccatgttggccaggctggtctcgaactcctgacctcaggtgatctgtccaccttggcctctcaaagtgctgggattacaggcgtgagccacctcgcctagccagatgttttgttacttttcattaaggagattttttttttttttttttgagacggggtcttgcttacccatgctggactgcagtggcgtgaacacagctcattatagccttgacctccagggctcaagccattcttccaccccagtctcctgagtagctaggaccacaggcgtgcgccaccatgcgtggctaatttttgtttttttttttttttttttggtagagacagggttttgccatgttggccgggctgaccttgaactcctgggctcaagcagtctgccttccttggccttccaaagtgcaaagagactttaaatagactttatgatattcgagttcacctacctcagtcttataatactatttagttttttaatcatgaatttctctctctgctatagctgggataaatatgctctcctttttttcttttaaatgctttccatgtttaattagttcattaaccaatttagaaagtactattgtatatggtgagttatggatataatatacttttcttcatattgatatcaggttgttccaccagcatttattaaatggtgattccgacatctattgtcgtgattcttagttttgttttgtttgccatgtcctcaggacttataagtgcttgaatccatctctggaatcactattttagtagagtctttgtcctggctttgattc

SEQ ID NO: 184552 - DNA, 316 bp, Homo sapiens
catcccatcctcacataataacaccctttcttctacctcttcttaaggctcggaaagccttctcagaatctctccctccagcaaatctcctctcatatctcattgtccagaactgcgatatgcatgctcctaaaccaaccactagcaagaggaaagaaatcaaaataagcttaagctaatcaagattggtcaacttttcctgaagcatatgattacacagtacctatacaaatgtgggattctgtcaacaagcaaccaactgtatctgccacatcttccccaagtgttgcagtcaccctgtactgaggagaccatg

SEQ ID NO: 184553 - DNA, 355 bp, Homo sapiens
caatttaccatgcagtcattaggtgccaggcacatacattatatacacaggtggaggtaacgtgaaaactttttatttcactataatacttatccttttttatatatcttcaaacttttttttgtttgcttttcatcaaaatttggtaaaaatgaaatgctaaacttctttaaatttcaggctgtagtggtatgaactagctagaataatgaaggaacatttactgagtatctaggatacaccacacttatagtaggtacataatactctcacaataacatctgagataggcattatcatccccttttacaaatagaaactggaggttccgagaactcaacagcaacttctccaa

SEQ ID NO: 184554 - DNA, 266 bp, Homo sapiens
ataatatcttgctttaacggcaaattagaaacctgatttgtgaaaatatagattgatctacaatgttcatctgaaggcaacttttacacaataattatttgtttcatataaggattcaccataaagtctattaaacaatgagcttcctggctgggcacagtggctcacacctgtaatcccagcactttgggaggccaaggcaggcatatcatctgaggatacaagttagatgactatgctgaccaacaaggtgaaaccccatttct

SEQ ID NO: 184555 - DNA, 238 bp, Homo sapiens
acctgcatttccttgggtgtggaaaaaaaaagttataccaaacgagactcaaagtcccttaaacacaaaaatctataactgcaaggtaaaagtaatatccttgaaaattatcaatcagtggtttatctgaaaacagatgaaaaattttttgtcctcttttttttttttttttttttttttaaaaaaaggagaaatcaaaagttacacgggaacatgaaacccctgcgtatttttgtgg

SEQ ID NO: 184556 - DNA, 333 bp, Homo sapiens
tgtgagtttgttaatttttctttccctgtgaacatttggcagagttaaaattttagccatcatacattttattccctgaaatgtatcagtcacagttcccacaggctctagatacacatttccttgtgggtgtatgtgtaaaactaccataacaaaacattttctatttcctcattttgattaaaaggaaagaagaaatgctaaactgcacttacataagtgacagtgcaatagtgacacacccatctgtgtacacaatttgtattctgtttaaatttaaagttataatgataaggtgagaaatgctaagagctaggaaataaaaatacactt

SEQ ID NO: 184557 - DNA, 506 bp, Homo sapiens
cattttagcctaccacctaagacatccagattcacccagggtccatgcttgaagaagccaaaatcacatggagagactacacaaagcacttttgttaaagtcccagctgcaccccagccttcaagtcatccctgcctaggcgccagacatgtgcatgaagaagcctctggatgattctagctttgagccgtttgtgtattctttgctattcaaacattttcagctgagatcacaagcattacggagaaaaaacaaaacaaaatgattcagtatatatccaatatgaatggtgtccttataagaagagacaccagtggtacaagtgtacagagggatggccatgtgaagaggcagcaagagggcagcagtctgcaagccaaggagagaggcctcagaggaatccaccctgccagtgccttgttactggacttttagcctccagaactgtgagaaaataaatttctgttgtttaagcaaacaaataaacaaaaaactatctaaactgt

SEQ ID NO: 184558 - DNA, 425 bp, Homo sapiens
gaatgcattttttaaattaaccagcacatattttctggtaattgaataaggaatcaaattgcgactggtgaacacaagcacctaaatgcaaaacttccaaaacctctcattctcagtttcagtcaggaggcccgcctctctcctcagctgtcaaccttgctatcggggggctggcctgctgcaccagagcacccaccacactagagaacggcgagtcgagtgtgtgtgcgtttgccacagctgaagcctctgagcacaagggaaggggaatgaaccttccttttctccctgccctatgtccgtggcacaaacaccagaaacacagtagggcctccaagtaaatgctaccaaaatgcatcattaaagagtgagcaacactttctaccctcccgggggagatgcgtttaaagaacagcctcaaaaca

SEQ ID NO: 184559 - DNA, 561 bp, Homo sapiens
aacagctccccattctagctaaagtcttcacaaagccatcctatttaaattgcaaaatctccagagtcactctgtatggttgtgcaagatatttattctgcaaaatgcctggtccaggggaatcaaatgagggctagctcaggctctgcttgccaagccacgtcgcttggtataaggctctgtctgtataaatttcccaaacaggttgtcagcaaccctcgacccctctacatctgtactccttatccctcttactttgctttcttttttccttaccttgtaggctccttttacatactatagaatttggttccttattctgtttcttgtctgtcttcaccaactaaaagataaactccatgagaaaagtgcttttgtcttttattccttaccatgtctccagcatctaaaacagtgcctggcacatagtagatactcaataaataatttgaattgagtttttctgtagagtagtggagaaatgcagtggtagatagaaacataaatgggggtcaagagagggaaaggtttctaatgtgggagagagaaggagacgttgct

SEQ ID NO: 184560 - DNA, 373 bp, Homo sapiens
cacagactgatgacgatgattacttattcgaccgtcagtaaccccgattgagcccgcttaagatactagataattctatcttgaataacttgagaccctttcggggcacaaaagccataaaagtttaaaactccaacaaatgcccacaaacaaaagggcctcaaagagcaaatcaacccatggtaataattcagggtaagaagctgagttacaccaaaggcctgtggaatggagagtgggctggggagaaattctggggtctaatccattctttgacttttactaagagttatgaaactttgaggcaagtcacttgaaccaagttgcagtttcctttatcagccaaagaggaatacttccggtgcgtaagcga

SEQ ID NO: 184561 - DNA, 619 bp, Homo sapiens
cagaggcacaagagatggtaacaagctgagataagctacttgctatacaaaaagaataaaggccaatacttgtatcgagggtgaaatgggtttgaaaatgttgaaaaggtttattccattagggcttggatcattgcagtggtcttagttctgatcttaacactcatgctcagctggtgctctaatactcaagagcaggagaaagagtatgggctctgtggttagaaagtcctgggtttgaatcctgattacccaactcactagttgtaaggccttgggcaagtcacctcacctctctaagattcaaatgtgactacctgcctcagggttgtggatggttttatgtaagttccatttactcaataagtattgaatgtcttccatactggaatagaaaaattaaatgatgccatctttgcctgcctgaagtagctcccatttgggagcctggcatataaactcactgcagtactaatgtgctaagtattgtaaaaaggaatacatggaaggaggagggaacaacggtctgcctgggggtgaaagtgtaggggaagcttcagagagtggagaacaacagagatttgaagaagtagaagctgttctttaagcacacaaagga

SEQ ID NO: 184562 - DNA, 803 bp, Homo sapiens
gctgacctccaggggcacttcctcggctcatcactgggccggtgctctgcagaatgagctgtgagagccactgtggctggccagagggtgccactcacagtcacttcagactcacaggagccttcgtcccgacccctgcattcatctgtgttctgttttatgttttttcccagtcacctgagctgcaggccttggtcaccccagactcctccctcctgtcacccttatcctcaccccagcacctttacgtctgccccaggctccatttccccctcttctgcctggatcaaaccaccctgactttcctgggtcttcgtgcaacagcctgctccggccgctgcctcactgcacctgcaaatccacttgcacccacacccaggccagggtttttaaacagaagcctcagcagatccctctctctggccagctccctgttgaaccaggaagcaggtccctgttgaacctcagcatgacccgcccccacccctgcatcccacttctgctctgggagcctctgggttcctgggcgcacctgctgcccttccctgtttgtcactgggtgacctcccgtccttgtgggcgctcccgggccctggtctcgggccttctgaggacttgctctcctggtagcggctgctgactgtgagcccagagagcaggcgtggctgttgaccttaggtcctcccagaacctggcggatcgcctggctcccaggcaggaggcgctgcatgacgcctccaacttccgccaatctagcccaaggatggcgttctaaataaaacgcgttctacagaaaagtgaaa

SEQ ID NO: 184563 - DNA, 958 bp, Homo sapiens
  misc_feature (656)..(656): n is a, c, g, or t
  misc_feature (658)..(658): n is a, c, g, or t
  misc_feature (743)..(743): n is a, c, g, or t
  misc_feature (787)..(788): n is a, c, g, or t
  misc_feature (879)..(879): n is a, c, g, or t
  misc_feature (900)..(900): n is a, c, g, or t
  misc_feature (903)..(903): n is a, c, g, or t
  misc_feature (919)..(919): n is a, c, g, or t
gctgacctccaggggcacttcctcggctcatcactgggccggtgctctgcagaatgagctgtgagagccactgtggctggccagagggtgccactcacagtcacttcagactcacaggagccttcgtcccgacccctgcattcatctgtgttctgttttatgttttttcccagtcacctgagctgcaggccttggtcaccccagactcctccctcctgtcacccttatcctcaccccagcacctttacgtctgccccaggctccatttccccctcttctgcctggatcaaaccaccctgactttcctgggtcttcgtgcaacagcctgctccggccgctgcctcactgcacctgcaaatccacttgcacccacacccaggccagggtttttaaacagaagcctcagcagatccctctctctggccagctccctgttgaaccaggaagcaggtccctgttgaacctcagcatgacccgcccccacccctggtacctgggattacaggcacatgtcaccgtgcttagctaatttcttgtatttttattagagacaggggtttcaccatattggcctggctggtcttgaactcctggcctcaagtgatccacccatcttggcttaccaaagtgctgggattacaggtgtgagcaacatntncagccagaaaatattttttaagtggagaaccattaagattagatatagcttagaaaatccactatagtagcacaatgaggaaaanatggactgaaatggaggagggcaagattaattaggaagctctgnnatatacaaggtaggggaaaattgggaaccttgaacaaaagacgagcacttccctggggtaccccgagcctcgaaattcgtaaatcattggnccatagcttgtttcccttggnggngaaaattggtttattnccgcttcaccaaatttcccccaccaaacaataccgaagc

SEQ ID NO: 184564 - DNA, 265 bp, Homo sapiens
acacacaaatccataaatgtgacacatcataacaacataataaaggacaaaaactctatagtcatttcaataaatgttgaaaaagcatgtgataaaattgatataaatccccaataaactgggcatagaaggaacacacagcataataaaggccatatatgaaaaacccacagctaacactatacttaatgggaaaaagctgaaagcattccctctaagaactggaacaagtcaagagttctcattttcaccactcttattcaac

SEQ ID NO: 184565 - DNA, 379 bp, Homo sapiens
tgcactcttggctgacccgaggataattagcatggtgagtcccaattagatttcaggagacaggatctgcccactgcagatgtacatctttataacaagctttatcataatagagtatgattacatttgttagttgcagtcctaaaacagtactctggtgttattttcacatgaaattataagaccactcttataggcatgtgctttttaactttactaattcgaggtcatccactaaaaaatatttcttgatggcctctgttttaggtattggagatgctttgtgacgagttccttctctataaattctctatggattttttcctttcttatgagctgtttcttattagcttataaattgtcattatttctcccaact

SEQ ID NO: 184566 - DNA, 203 bp, Homo sapiens
cctgatggtttgttttttactagacagccttagagaagtagaagagcttttcttcttaagcagttacaaaacctgtgagacattttatctcacaagagaacgtgggctcagccaacacaaatatgtttcttgttgcaatttcaaaactatcttttaccatgctttgttattttttgtttttgttttgcagctcatgaagtgaa

SEQ ID NO: 184567 - DNA, 356 bp, Homo sapiens
ccctaagctcccagcctgctgcttatgagtcagttccacaggattttctcccttcaagctgggatcagctcagctccccatccctctgctcctccacccccaactccactgcatgatgcaaggtctattccaggcaagagcccttctccgaggtgggcagcttgtgtacatgtggggcagggggcactgactgatgaggggccactgttcgcacacaggcaccaggtcatcgttcccagctgtggctcaacccagtagtctgcgcatcccaggagcactgcagccccctcacccctatccaaccctctttcagccatcagagcttctgagcagaagggcctggccctctttacagg

SEQ ID NO: 184568 - DNA, 561 bp, Homo sapiens
aatatttatgggtacttactgttgtggatatgtcaaggaaaagacagacaattgcagagaggacagtaaagaaaaaacacaaaaaacttttaaagattattatttgttagaaggtggcaagtgttaggggataaacagcaagtgaatactaggagagggcttgcaaaattaattaggcaattaggttatgctgcgatgatcagctaacattttagtaacgacagaagtgaggaaattattaactcacttagaggaagactgaaaatgatgatcaggagtttagtttgagacatgttaaaattgaaatacttactaaacatcaaagtagagaagcctaagaagaaagattcaaatttagaagtcaacagcatattgacatttaaaagcttgagactggacataaccgagtgagggtgaatgtaaaccgaacagtaaactaaggactgataacaccaaggtattgtaacattaaagatcatgaagattgagaagccagaaaagaataaggaaaaagagagagagagagagagagagaatgaatgtgtggtatcttggaaccca

SEQ ID NO: 184569 - DNA, 549 bp, Homo sapiens
caattttgctttaagcagtgttagggaactctttacaggtttgtgagctgggagtgacaagccattattttatccacaccaaagctttgaatgataaaggggttgaaccactgtcattcattaaattcattaactgttggaattcctctaaggatctatctgcaggccccttctcttctcactctgtacacggtctccccaggcaacttcataatggctaaaattaccatctattccaagagcatgctcaaattgatatttctggctgaaatctcccttttgagattaaagcccttatcacctacttcctccttgacgccggagttctcaggacaccttaaaaccaagttcagtatctctgcccatttctgcttccttacctttaaacctgttcctcattcagtcctttctgtccccaggagtggcagaaacataatccatttgccctagcctcaaacctgggatgtctgtcttcctccgtctacaattaatcatcagccagctcctatcagtgtcacttgaatccatattttctcccctactcactgc

SEQ ID NO: 184570 - DNA, 831 bp, Homo sapiens
gcaactgggggtgtcactgtctacccttctgcatctggatctcctactcagacacaaggattcctctggtaccttaaatacagcaaccacccaacacacaaattgaaggagtgtgtcagtgtcaattcccgtattaaataatagtaaaatttaattttttgtattttggtaaagtataaacattgtaatattttcttcttcatcctagtggatctgcttatacatgccacattagagatgattgctctgattgtttcttctatagtaaccttgcttccctaacaacctttgattgacataaaggttgagtcttgtcttttctgttgtttatagtacctgacagtgctgtgtttcactaatatttgttgactgaatagtgctgaggagtgtcctgttctctgacctcagtaccataaggtcatatttcttggacaacaaagtccagtagcagatttctttggtggctgctagagccatttcattaacagtattgaaagcttttgtgatattagagaaacagctctgtggtcctgttactgttggctgtgcatccttctgcatctgacaggtagaaagggatggtggcagctctagtcactgccatgttgtgatttaggaagtagatggttgtgttcagatgctctggaaatgagctggcagagattgctagaagagatggctgtggtatctagagcagccagctctcttcttcatgagaggggtatatgtctttgatgcattgtttgatgtcttccatcagtttacatgctgaaagtattggtgcagatatctgagatgtatgcttctcctccacctggatagtccaggagg

SEQ ID NO: 184571 - DNA, 302 bp, Homo sapiens
ctctataacagtgtgagatgtgaaattagcaaaaataactcaggcaaaatgtagactttttcaaaagccagaaagttttcataacttgatcaaaggaaaggttcagatgaaatgaatgtgggacaccagagtgccctaatattcttcttcttagaaaggatgggttttctttcaaaagggaggctctgtcaaggaaatccgtatatgttatcttttcactaacagctaaattaactttgtaatatactttggcagtgtagcgttcatgtttggaatttatttaaaccatgtcaatgtttaag

SEQ ID NO: 184572 - DNA, 242 bp, Homo sapiens
tctgattccagcccaaggagtcggccctatactcctcactctcaatcatacctacatttcaaaagctcatgatgaagactggatgggagaagggggaaacttttatcactgcccttggtgggtagaaagaacccaatgtggccattataattattataaccttgaggcacatcaatagattcaggatacaatgactaagccaaggtcagtcctgtccaagacactaactcatcactgaatta

SEQ ID NO: 184573 - DNA, 479 bp, Homo sapiens
gagagtggtgagaacttgggaggtggagcttacagtgagccgagattgcatgactatactccagcttgggcgacagagtgagactccgccccctccaacaacaacaaaaaaaattagccaggcactgtggcgtgtgcgtgtaatcccagctacttgaaaggttgaggcaggagaatcgcttgctcctgtgaggtggaggctgcggtgagccgagattgcactactgcactccagttagagtgacagagtgagaccacaactcaaaaaaaaacaaaaacattggattgtctttttattattgaattgtgagactcctttatactgggtgcaagtcatttgcatttgccagtgttttcattgcctcctatttcacaatcgattaccaggcatctcatcatgcaaaggtctatgcaaatctgtagtttggatttggttctcctgcaaataactaagtcctctgacatcaatgatggtcacag

SEQ ID NO: 184574 - DNA, 341 bp, Homo sapiens
ctctgaaatgtgtcatctagcacagtgtgtgaaaatattgagattaaggtggcctcatcagccctaagcaactctgactctgtccaactccagaataaagatttggtttgtgcttggactggtcctgctgtccaggctggattggcagtcaaagtcagacagatggagagatcacgtgggtcagacaggttggaaggaggcccactcagtatccccccttctggaaagacactggcttcagcattcaggcaatcttccttcttcccaggcttccagtttcaagagtgatgaaatctgttatcaagggagtacttgcttttttgactgtgagaaatcctgca

SEQ ID NO: 184575 - DNA, 281 bp, Homo sapiens
ccatgacccttcaccctagtacttcaagctgtatttcctaagaacaagaatatttctccaacataaccacactgcaatgatcagatgcagaaaatttaacactgcaatattcagattcaggtatcagcatccatccaatgctaataactgctattcacatttagtcaattgtcccaaataacattcttgctagcagtattatttttcccaatgcaaggacacacatgtcatttagctgccatgtctctttattcccttttaatctggaatagttccttagt

SEQ ID NO: 184576 - DNA, 398 bp, Homo sapiens
cgaaggagacacagacatggatgaaggagggatgcaaggggagagtggggacccgagagatcacaagttagtcacatgagaactcagttaccatagtgaaccaaaaagtgtcatgatatggatgcagggggctgcagaggctacagtgaacaagcttgtgggcccctgcactagaggaagtctgtatgctgaggcccaggggccagccctcagccgcacgcccatgcctgactcctctaagagttacgtgactctgtccttgcctgtcctgcgcccctctcaccacttcactccccagggaagatcttggccattcacccagcacactgttcagtaaacttccactgggatctcctggagaccaggccatgacccagtcatgaaggagggatgagcat

SEQ ID NO: 184577 - DNA, 391 bp, Homo sapiens
gtacagagtgaatgtgaacacaggcagagcgaaagtaaacacaacactcagcgcctgctgttttattttttaaagtcttcggaaaccatgttaagtgaaactctttgatgagagggaatcttacttggatcactaaagatacttcactggatacttctgttcttttagccccataattaaagatacatttgactaagatacaaggtatagtaaatgtaggcaggtcagagcaaatgttcagcccaaaaatatgtctgtgaataatgttcagccgaaataatgttctggggaaattattggcaaggtcatgttaaactattgcgtcgttctttggtggcaccccagacctaatataacttgacatttggtgagaacacattagctggtcagt

SEQ ID NO: 184578 - DNA, 565 bp, Homo sapiens
  misc_feature (6)..(6): n is a, c, g, or t
gataangcggaaattggtcacgttacttatatccccagcttttggctcagcacagaacccatactaacatttagattgaacagaactaaggctaaaggaaaactttaaaggaacttattaaaattaccaatcccatttcaacaatgggaagataaggagtggcacaacaccatgggattagaacagggactataccaccttgctccagctccactgtccctgcttctggaaagggccccactccaataaggagaattccacagctcctgctcaaatcttgtggttcttgctccattcttgtccagatttctctgattagattgggtgccattgaaggtcatgggtttttgtcctggtcattgttgtgctcccagatgattgcacaaagcccagcagatagaatgtgctagataaagcacctaatggaagcaatgaggaaaagaatgagtcttaagcagacttcctaaggtgtttgagaatcactaaggaatttgaaatgtatcatagaccgtagggctgagttacaatcaacaataaataatctttttaaatgaaaccaaaatct

SEQ ID NO: 184579 - DNA, 423 bp, Homo sapiens
gaaatgatattgtgttcttctcaggacataatattaaaaggttcttctctgctggtcctatctatatttaaaatatcaccttgtatgtgaaagaccctaaaatatgtggctataatctgctgtctatcaagttacaattttatttctccagccttctgaatgttgccacatggacttcccaccatcatttcactttaacatgtccaaaactgaattaatcatgtaactctaaaaatctttctctactctaactttcttacttttcttaatattatcactgtatctgtttaccttgacttaaaaccccaagtttgctttttgatcttccctctcctttgcttccatagtcctctaactgcttaacctgcttttagtctgtctttcaattttgcctactttgtaaactgtcagatagtattgatc

SEQ ID NO: 184580 - DNA, 311 bp, Homo sapiens
ctccaaaagtactggcaccaaaatagaataacaaatcaatgcaagaaaacatccagaaagagacccccaaataaaaatttagtatactgtatatttaatagtggtagcttttcaggtagatgaggaaagagtggcttacttaacaaatggcattgggacaatcagttaatgattttgaagaaaaaaagttagtttcttatgttatatacttaaactaaaataaattctagatgagttaaggatgtaaatgtaaagtacaaaaggtactagaagagagtgtaagttgaggtaaggaaggccttccaaagcct

SEQ ID NO: 184581 - DNA, 1009 bp, Homo sapiens
acattgaaatgccctcctgttccctttgcccaaggctgttgcagtgacctcggtcctgatagagttgggaacttcccttgttcttgtcactttctcataccaccacccacagcttggtgtcttgatcccaaatctcagccctgccttgtctgatgctgggctgctgccttgactctgaggcttattcccacgggggactatctcatcgtcagtgatcaaagccttttccccttagccttgctgatcctgacctggaccaatttcatggattatctgttgatggcacatcctcttagattccacatttgctgtatcagctcagagttttcttcctttgatctctcctgtcaccataagaaagccaggcctggtatctgacaaacttagtaccaaattgtacatcccattttgctccccctgatgaaccgtcagccctactaggctggtcagtttctttttctagatgcatattctgcacatgtctgcctcataactttgtcctcaccatcctttgcccatcctctgctcatcctctgccctggcccatcctctgctcatcctctgccctggcccatcctctgctcatcctctgccctggctcctcattaaaaatcctcctgtaaatatttaatgaaattctacccatctttcagggtcaaatttgggtaccacctcctattcatcccatcaacccctgagttctttctctttttttgaacccctggaattggttgtacagacatgtgaccacttaaaacacaataaccacttgagcttgcaccatatagcactgagtgtgtgccaggcactactctacacacataatggcaagcctatgaggtaggtgcactgtgattatccccactaaatagacagagaaagtgaagcacagagaggctaagttattgagccaaggttttataactagtaagttgcagagccagaatttgaaccaaggtggtctggctctagacatggtccggaagagacccccacgggatcctctaga

SEQ ID NO: 184582 - DNA, 300 bp, Homo sapiens
tactcctccaagctactgaaatgttgtaccctttgacaacaatctcctctttttccatttctcctctccccaaagcctctggtaaccacctttccattccgtttttatgacactgactttttcagattccacatttaagtgagattattaaaatatttgtgtttctgtgcctggcttattatacttagcataatgtcctccaagttcattcgtgctatcataaataacagaacttccttctttttaaggatgaacagtattacattgtgtgtacataccacagtgtcgttatccattcat

SEQ ID NO: 184583 - DNA, 319 bp, Homo sapiens
gtgctattgttcagaaaaacaaagaaatgtgaaattcttggaccatttcaattgtcttcaatgttataaagaacagatagtttttcttagtggcaatgagtgagggatttgatcacagcacaaataaaggtagagatgtaggcaggcctaacagtgacaccctcctgactacatttagtcagggatgtgtcggagaatagtaaaaattaaggttgggtggaaaaggggccctgttttggggggcattgaagcaaaagagtttggattgaatatattttgctgcttctcacactattctaccaaagtacccctaagacat

SEQ ID NO: 184584 - DNA, 188 bp, Homo sapiens
agttttattccacttcagttctatacttgaaagtaagcctcatggaaagtacttatttccccaaacaaaatcctggcgatttagaatacaaggaacttggactgttatcggagccataacgtcatttcacaatgacaaggaagccatcgcagcaggtgcaatgactaaatgactatgcctaaaatcag

SEQ ID NO: 184585 - DNA, 372 bp, Homo sapiens
tcacagatgagtctaaggcaatcctggtaggaatttgaggactattagtacgttattgccatcaacttagttgatgagtaaggggaagggataagggaagagcaagaagagtcaagggtgcttctaggcttgggtactgggtaagtagcggtgccattgtcagagacaggacacagaagagaagtaagtttgaggaagatatactttagggttccattttatagagttcaacaacagtccaaatgaatcaatggtaatgtcaggatggtgattacctttggtggcgggggatgtgtcggagcattgggagcttctgaggtgctggaaataatttatatcttgatcctggttatggttatgtggatgtataca

SEQ ID NO: 184586 - DNA, 350 bp, Homo sapiens
ctccccaagtatcggcctatccataattagttattttatgagtaggattacataagtcaattattaattgtgaggatataaacccataatcaatgttttattcataagttttattatttactattagttattgctgctgttaataactagctgccatttgtagaatggctagttgttcttagtatcatttgtttttacgttattgctaattcttaagaacagttctttagatgtcctatttcctagatgagaaaatagagatttagagaagttaaattatttgtctgcaatcacagagcctgggatttggatctaggtctgcttgtgttcatattgtcccacgctgtcat

SEQ ID NO: 184587 - DNA, 165 bp, Homo sapiens
aaaaggagaagaggtgagcaggcaagggtggcacatgctgtctggtgtttgtagagcatggagggccctgggtatcctactgagggatctggacttgattctgtaggtaatggggagccactgaaggagaagaccatacatgtcttttaacatttattgggaaag

SEQ ID NO: 184588 - DNA, 295 bp, Homo sapiens
actttttcctgggacactgtgttggcaacatcctgccaaattttgtgtctttggatactccttataaggaagacggctatggtttggctctgtgtccccacccagatctcaccttgaattgtaataatccctgtgtgtcaaggatgggaccaggtggaggtgattgaatcatgggggtggtttccccatgcttctcatgatagggagtgagttctcaccaggtctgatggttttataaccatctggcatttcccctgttggcactcagtccctctcctgctgccctgtgaagagg

SEQ ID NO: 184589 - DNA, 342 bp, Homo sapiens
ttttgctatccctattagaaaatatgaaaagataagatgtaattttgtttcactatatgatagaaaaatcagtctgtaagatcgaatccctgcaagtcactcttgtaggcttgctctagagattcagaagccctgaggcagcctcgttaagagctggtgctcttaataaggtagacctggtcaaatcccagctattccatctgagttcccctatcttctgcaggtttacctaacctaagtctctgttacctcattggttaaaactgagataatagtataatagtaatgaagttacatgaagattaagtgagatttcatatatatatatatacacacacacat

SEQ ID NO: 184590 - DNA, 321 bp, Homo sapiens
caggggactttcacacttcagagaatagcacatgtcatcctgcacttttgtggggtgattaaaagctcacggtatccttttatgtttagcccatccaattcttccaactggcctcagccagaaaagcagggaaggcacccccagtttgcagctgagagactccagcctgggagagctgaataaatcttttgcccagaggggttcctcagtaaatgctggagatgaggctcagacctgacctttggattcccagatggagtgctctgaaccgtgtacctggggctgtcttcaccactcaaatatcgatagagataacataga

SEQ ID NO: 184591 - DNA, 341 bp, Homo sapiens
gaagctacccaattcacaaattctttgctcaattaaactctgttaaacataatttgtctaaagtttttaacaaggaagattatcttataccctctgccataatgtcataaatatttttcagttaaagtcctgttttatatttttgtttgtttttctctattacattatggaccttagtttatgaaccaaatttctttgcaccaatacttaagacaacccaaggaatgctgactttaatgtcttttctatcattgtccattgcttgctcatgagttgttcacaaaacagcaattttgctcccctcaaacctagtatattcattcatgaactaaataatattt

SEQ ID NO: 184592 - DNA, 230 bp, Homo sapiens
ccacggtttcagagttactggaagtatttgctatcagcactggttatcgcaggctgatagctttagattttgacaatattaagactggccttcctcaggagaatccaagtgtgtccttcagggtaatgcaggtaaagaaccatggtgttaaactagaacttaactctgacctaaaggtctactgcaatttctcttatggcactgcgggattttgctgaggtggtaataac

SEQ ID NO: 184593 - DNA, 497 bp, Homo sapiens
tcctgctctggccatgtgatgtgcctgctcccccttcaccttcggccatgattgtaagtttcctgaggcctccccagaagccgagcagatgccagcaccctgcttcctgtacagcctccagaaccatgagccaattaaacgtattttctttataaattgcccagtgtcaggtatttctgtttagcaatgcaagaatggacaaatacaataattaaacggtaaggggattattttgcctgccattccactccaagtatctaatttagaaggcaatgtttctagaagtgtgaggactggatttgtcttcagaaagcattttactcttccattagaagcttttgctgcattcaaaatccagttgagtctatgcacttgagctgtccagtcaaccaccactcttaaaaggttgaatgtttttatttgaatcgactcacatggccactcaatacccaaactcatctgaacatcattctgtcacatgccactcaatacctata

SEQ ID NO: 184594 - DNA, 512 bp, Homo sapiens
taaggtttctttctttttttcttcaacttttattttaagttccggggtacatgtgcaggatgtgcaggtctgttccacaggtaaacgtgtgccacggtggtttgctgcatagaccatcccatcacctaggctttaagcccagcatacattagctttcatatatatatcctacacaaaaacaattccaggtggagtaaagccttacaaatgttaaaaagtaaaaccaagctgggtgcagtgatgcaagcctgtcattccaacattttggaaggctgagacaggaggattgcttgagcccaggaattcgagaccagcctgggcaatatactgagaccccatctctacaaaaaaattaaaaattagctgggtgtggtggtgtgcacctgtagtgccagctacttggaggctgaggtggaaggatcgtttgagcctgggaggttgaggctgcagggagctgcgactgtgccactgcactccaatacaggtgaaagagtgagactctgtctcaaaaa

SEQ ID NO: 184595 - DNA, 254 bp, Homo sapiens
gaggaaaatggtgcaggcagagcgcacctggtctcgggaaaatgctgcccgcgacaacccactgcgggaccctaaatgtctcgacaataaggcctcctcggcacgtctctgaggtcgggtcccgctggaggaggaggcgtttcgaaactgtgaggttggaaccactcttttggtaccatcttcaaagagacatttcagatcccattgaggcgtacagaggaaaaccaaatatcctgcaattaaaaactagaaac

SEQ ID NO: 184596 - DNA, 495 bp, Homo sapiens
tggccctgcaggctgaacttcagggatgagggttgcaattagttcgggctgtttccatggtaatgagtcccaggagtgggtacagagggggtggacggttctttctggggtgagatgacacctctgagggtgggaagggggacgaggggagggtttggtgagtcacccctcaaaggacaggcagaggagaaactgtggttactgattccaaagccagagtggagccatgggctgagggcaggggagggaagccaagtgaaccctccacaccattgccatcactaccaccatcaccaccaccaccatcactaccacagcctcgaataacctctcttccccacagagaaagcgaagtctaggcctccaaaaaactccaggtcagtgggaaatgaggttaggcaggttccttctgaaatgctgagctttatccctgggagtgaggccctatgctgaacccagtcactcccatccctctacccaactcatctacccatc

SEQ ID NO: 184597 - DNA, 246 bp, Homo sapiens
tgcagcacattcagcaagttttggggctggagcctcgatatgtttgctgtgtgggttaaatgtggtcacgtgtgtggggctttaggccagtggccaccacatggcaagacctcagtcatcacttggtataaatgtgtctccttagtgtggtatagtcatttccttcccgaattttagtacctttgcaataagaacatgccaccactcctcacagtggctttatctaggtgttggccatgaagagtg

SEQ ID NO: 184598 - DNA, 346 bp, Homo sapiens
cataatctcagcagtgtcatcagccaagtgataaggaagggccttaggtctccgcccctgagggaacggcccaggagatctgagacccgaggcctgctcagacgccaggtgcgcacagacttcgcagggcctcagcttccccagcgtaaagtgaagagcttatctggttctttctaggagcatcttcacgattcttgcagtatccttgtactaatagcataatcactactttttcttctgcagaatttgattaaattttcaaaaatttaaatgaattcatgccaaaagaaaacaaccataaaaggaaaatcagtatcacttgtcatacatactcagaccatcatcc

SEQ ID NO: 184599 - DNA, 387 bp, Homo sapiens
gtattacctagcaagcatgtctgtgattataaaaacaatatagtaaaaagaaaaccccaggttattgatgtgctatatatgtgtgtatactttaaacagacctagttttacttttatgtggaataatcaggaaaatgtgtgtaacagttcaacagtaaaatgaatcttagcagttagaaaatcaatacagagattcaagcttttcctctgcttaaatatctactgttccgtatgatgtcaaaccaaactgtgattcctaaaaatgcataactgatgacatttttaaagtagagcaaaaattttgttcagaagcttagaggcagagaggggggaagtgccttgatatttatctagtcagcttccttgcttttcgtctataaggtgata

SEQ ID NO: 184600 - DNA, 253 bp, Homo sapiens
ccagctggtgatcattgtgcagaaagctgaagaatgtggcttaacaagattctgactcctcccagtttattacctagcatggatttccttcaaaatacagatttcgtgtgaaaagtccaactgccacaaactgcttgggaagggtggatgctgacaggcagggcttttgtgaaagacgggaatgaaccctgacctgtcgctaataggagttgtgccaaactcatcacatacattaaaaaatagaaaaggattt

SEQ ID NO: 184601 - DNA, 288 bp, Homo sapiens
tggcgcatgcttgtaattccagctactaaggaggctgaggcacgagaatcgcttgaacctgggaggcggaggttgcagtgagccaagatcacaccactgcacaccagcctggcgacagagcaggaaaaaaagaaaaaaaagaaaagaaaaaggtaacttcttcactccctacagagttcaatgctctctaaatcatatggccattggcttccagcatttaaaataaaatgtcccttctatacctgttttccaagaggaaacaaccacttgccaaactgcaaaggtctt

SEQ ID NO: 184602 - DNA, 479 bp, Homo sapiens
gtcccttgtctctatttctattatttcctcctatgacactatgaaaaagtgagcccagcagaagaactggggcaatgttgccccccaggggcatttggcaatatctgggcatatttttggttgttacaactcagaaggggactttcctactggcacctagtgagtagagggcagggataccgttaaacatcccaccccacccaggacagccctcacagcaaagaattacctggcccgaggtgtcagtattgaggttgaggaacttggctttacagcattttcctgcgctcatctttgattcctgccctgcctagccctgaggctcagcatgagtctgtacagaccctgctggaccatttctctagcttcctgcagcgctgtggtccttggccctcagtgcacactggaaccaactgggaagctctaaaaatatctacccagtgcttggacccaatccaactccattaatttatcatctg

SEQ ID NO: 184603 - DNA, 473 bp, Homo sapiens
tcctttatatttatcaggtcaaccaactgctaatcctttcacatgactggtaaagccacctttgacagtaccagctatcttcctgtatctatcttcctgtaagataactttgatcatgtcacttctttgctcattaagtttaaactctttaagtggcactcaagttccttcacaaaggattctgacctgacttctggacttctgaattactcctatccagtaggattcctaaactccaagctaatagtccttctctactgtcctttgaataagtagaggaggcccagctgtttctatctcattccttattcatctaacactatttggatgaagatgttgtcttagtagtttaagattgggaggatgaaggatatagatgaaatatttagtattaatatccaatatatgctatgtgctaaaggagtggtagaggctattcattgatgtatattttccttttctctctaactggt

SEQ ID NO: 184604 - DNA, 418 bp, Homo sapiens
aagcagtttaggggctgtcatgtagtagattttagtacagagagtgatcaggagagactggcattaaaaacagtattgagatatcaagtcggtactgtgtgctattgctaggaatatgaagcagtttttgtttgtttttctttgttttttttttctaccctggttctttccctcttgacatagaactttgcagctagaatgattttcaagagtgaatttggccctttgctttagaaaccacctggtattttcaccttcagctgatctaagaagaaacagtaaatctttcccaagagttcactttcctcatgcttcctatctgttagcagccacatattctttgacatcaaccctatgagaacaattgattttcattattacacccttaagtcccttaatgctacaacattttgctcat

SEQ ID NO: 184605 - DNA, 362 bp, Homo sapiens
tagttttccagctagcactgcaggcaaagtggtatctgatcttaattcacagggtgtttttgttatgaacagtgttcattttacctctccccaccctggcttttaatcagctactttcctcttttgtgcggtgtctggaaaaacaaagtgtcttttaattaactcacttccaattgacaaagttttttctagggtaacacactgaatatgcaagctctatgacatctgaccctctaacagtttcgcaccttagagggagccatctattaaagttcacacacattactttccagacccttcctgaagttagccatgtgaaggcaaattccaattcttcactgaatttctacgctttcaaacct

SEQ ID NO: 184606 - DNA, 253 bp, Homo sapiens
catagtggggcaaagggactaaactgggaccttatcccagtctgtctggcttcaaagcttctactcctgagaaaaagacatgcatgacagaggggaaggggaacctaggctggttaggactaattataagcaaatggtctaatgaatgagtgatcaggtttacaacccagatttcaaggaattgagtactttttttgagacagggtctcgctctgttgtacaggctggagtgcagtggcgtgatcatagctca

SEQ ID NO: 184607 - DNA, 268 bp, Homo sapiens
ctagcaaccaaagaaagagggaaactgatcacatagaagaatcacactgcatgtaagatgggaccgatgaacccgttgctcagaagcagaggtgagtttctcctgcctttatcgcctctccaaagaagcggcatcagcgctggtttgcagtttgctttctggcattacctccctgctcctcagcctgcaccttcctccgctacccgtcgacagcctcctgcgtgtcaccttctgatttcaccagggcctcatcctggttgaagttgtt

SEQ ID NO: 184608 - DNA, 715 bp, Homo sapiens
atttgaaagatttttactgagtatgatcatccgaacaccagctactaaacaaaaatcagatctccttgttcctattaagatgcgctaattaataagatggcaacaaagaccaccatataaaagggttccttcagtaatgttttcttgagtgaacaaaaatcaagcctgccttatattgtattctactttgcatcacaaacagttttagtgtatttctggaaaagcatcagcagttttttcgaattttaaattctggagttatgtaactatataggcaggcttttttataacagaatataacagtgatacttaaatagaagacttcaaatgtaaatatcagtagagcctcgttaaggctataaatccagactttgtgataatgtggattaaatattatttacataacatataaggaggccgggtgcagtggctcacgcctgtaatcccagcactttgggaggccgaggcaggtggatcacctgaggtcaggagttcaagaccagcctgaccaatatggtgaaaccctgtctctactaaaaatacaaaattagccgggtgtggtggcacatgcctgtaatccctgctccttgggaggctgaggcaggagaatcacctcgggaggctgaggcaggagaatcgcctgaacccaggaggcggaggttgcagtgagctgagattgcaccattgcactccagcctgggcaacaagagcaaaa

SEQ ID NO: 184609 - DNA, 186 bp, Homo sapiens
aactttcctcattatcttgtctttgtcacttaatcaagtttgctattttccagccttaatcaaaccagccaatgcaggtcacagtttatccaactttgggactgccaataattattttctgctgaaattgaaagaactactggctctgagtcatctggtataaacacggaagtgacatagataggc

SEQ ID NO: 184610 - DNA, 332 bp, Homo sapiens
tcagcacatcccagcccatggaaagagggaaagaacgtaagcaaagatgaacaatttccatctcatcagttacgctgatgtgtatcagtgatgtatatcacagacatcacttcctcgctggacatggccacatctcatagtacaataggaggtacgtcccaaagggaccccaggagtcctctggagcagtgagctaggacagagcccagctggaggtactgaacccacattcattcaggttccccatgaaatatgtacttccccactgctagggtgggggaaggtactgtaattactgcttatcccctaatatcatggctgttttctatgct

SEQ ID NO: 184611 - DNA, 357 bp, Homo sapiens
aatattcggcctatccttgaaacctttgaatttataaaattctattactttcactgccttttctgaaatgagattcctcttttctcttctccttcctcccagttcccccacatcccccatccaaactatattctgagatcaagttccaaatataatgattttatgaaaccatatttcaggcttttgtgtcaaaaagcgaggtcctcggcaataaagagggactagtgtatgtacagtgggtgttcgaaaatattgtttatgatgaaatactcattaatttcatgctttactttctcctcgattcttattttaacatacttatttgctttgtgactatcaattatccattaaaaggac

SEQ ID NO: 184612 - DNA, 351 bp, Homo sapiens
tcgcccaggctggagtgtagtgacgccatctcggctcgcctggccaatttttttgtatttttaatagagatgggttttcaccgtgttagccaggatggtctcgatatcctgacctcgtgatccgcccgccttggcctcccaaagtgccgtgattacaggcgtgagccaccgcgtccggccctgacttctaaatttcacttaagacttagacttatttggattctttaagatggggttagctgtgccttccatgtgctcaccaaattccagtcattccgggaaactcacctctttcccctgctggattggagggtccttgagcacatgactcctcctcactttgtccatcac

SEQ ID NO: 184613 - DNA, 478 bp, Homo sapiens
ggcctttaaattgagagataacatgctggaaagaaaaaccactgaagcttctggaggatgtgtggggatggtgcaacaatttggaaatctcaaagtccctaagcatatggtgcttttattcccatggtatattttaattgatgtacttgggggctgcatgggaagttagggagctttgaaaagtcagacagaaatctccgatagtacagaattatttcagagacaaagagctgcttgaggaagagaatctgcttcaaatacatggccagtctcttcatcaagacaccaaatttggaaatggtatagggcagaaggctgaagaacagaataaatctcccatagtttaggaagtgaaggagaaagaggcccaactaggctctatccagctcccgattctgggcatttgaaatcaaaggtagggttgagtctaattaaaaatgcaatttaggggcaggcacagtggctcttgcctgtaatc

SEQ ID NO: 184614 - DNA, 361 bp, Homo sapiens
ctcgatttcaggatcttataccatcttgttcttgttgcctctgtgaagaagcttttctgagcctgcaaatagatgattgcagtgtatctttcagcttttcaatttgttctcagcaagagttagtcttctgcaagctactctagcccatctggaaccaaaaccttttgaatgcattgatgagaatactttttaaaaatagtttggattttaagttttgctgtttacccaagcataagccatcatctttcactgttctttcttcctcctttccttgtcttttttgatagctgattctcttagggtgatagattcgggacattgtagttatcacgattcatctggcagaaactttctctcattg

SEQ ID NO: 184615 - DNA, 189 bp, Homo sapiens
cttcatgaccaacatctatatgctgtgatgttatccagtgagtgaaacacaggtcaactctacacgaagcctttttttgtattcctattttgtcttctccatctctcctttcttattatagcatatttttttcactctaaggaaagaacatttatgcagggcttgcttaccccaacaaagcatagcaca

SEQ ID NO: 184616 - DNA, 478 bp, Homo sapiens
tgaggtacccccattgtttgaggcagtgaaagtaattctagatgaaggtatctcctaattgaaaacaagtacagttggccaggcgcggtgtggctcacgcctgtaatcccagcactttgggaggccaaggtgggtagatcacctgaggtcaggagtttgagaccagcctggccagcatggtgaaattctgtctgtactaaaaatgcaaaaattagccaggcattgtggctcatgcctgtaatcccagctactccggaggctgaggcaggacaatcacttaatcctgggaggcaaaggttacagtgagccaagactgtgccactgcactccagcctgtgcaacacagtgagacttcatctcgagaaagaaaaaaaaacacacaaaccactgtggcaggagcgtttctattcactctttgctctcccactggaggcaaaaagctacacaggctagagagtgaccaggcaagagagtcacc

SEQ ID NO: 184617 - DNA, 615 bp, Homo sapiens
attccagaggatccccgtatagtccaaccatacgaaggcctatacaatacatttcaagtggtaattagttttgataatttctccaattatttttgctctctaatcaggaaaatgaagcatttgaaacaaataattgtgaattcattgagaggtttaatcacctctgagtcagtaggcttatcatgattttgtttggcatgctttacgattacgttaatatatcaaccaacacctgaaaaaccatgcacatgtaaatgtttagtttgattatagcaaaaaatgctgaaatttttctgaagacacacaaaaatgttgtcgttcatacaacctggagaacaaatcttttacctccaccccctgactccttcggcgctgagtacagcacaggaagttagtaagtcctcatgtttgcgatcattcctttgcagaaattaacataggagatgacagatgtcttgctgctgaaactaatgctgcttaaagaaagaaaaaactgcaattttagcattttggcttggtatgtgtacaagataataagctgtgtgagtttagaagcttggaaccaattcaactaacagatgccagtatggctcaacagtaatgtcacatgccgtc

SEQ ID NO: 184618 - DNA, 762 bp, Homo sapiens
aatgactgcagtgatgcacataatttaggatggaattgatttaaataaaattcatctaaaattcactaaatttagatttagattactacccaggaaggtgaaatgtaatgtttgcagcttcctatctcttatttgatttaactataatatggttctcaactcataaatgtttcatttttggaaggcctatacaatacatttcaagtggtaattagttttgataatttctccaattatttttgctctctaatcaggaaaatgaagcatttgaaacaaataattgtgaattcattgagaggtttaatcacctctgagtcagtaggcttatcatgattttgtttggcatgctttacgattacgttaatatatcaaccaacacctgaaaaaccatgcacatgtaaatgtttagtttgattatagcaaaaaatgctgaaatttttctgaagacacacaaaaatgttgtcgttcatacaacctggagaacaaatcttttacctccaccccctgactccttcggcgctgagtacagcacaggaagttagtaagtcctcatgtttgcgatcattcctttgcagaaattaacataggagatgacagatgtcttgctgctgaaactaatgctgcttaaagaaagaaaaaactgcaattttagcattttggcttggtatgtgtacaagataataagctgtgtgagtttagaagcttggaaccaattcaactaacagatgccagtatggctcaacagtaatgtcacatgccgtc

SEQ ID NO: 184619 - DNA, 537 bp, Homo sapiens
tgagaagaggtgcagagccgattcaggacatcatttagatctaactagacctctaataaagtcagtgtgaggagtaaggaaaagagaggaatcaagaattgagcccacagtttgacttgaacagcagctgggtggatatattgccactcacactgaggcagagaagatgaggagataaactaacagaggtcaagaagatgaagagttgtttcaaacatggtacagttgagattcctagcattattctagtcagacgtgtttgtcaagtaggccattggatatcgggatttggatttgaggggaattcatagatggaaatataagttcaagaggcatcagcatggataccctatttggatctggatgaaattacctaaaggagaaaatgcaggaggacgtgatgctgggtgattttagaggagaaaccatgaaggattccaaggagcagcagttggtcaggtgggaagaaaggagtgtgacatcacagaagatgaaaaataaaagtattttaagaaacagaaaagtggacaaatgctg

SEQ ID NO: 184620 - DNA, 466 bp, Homo sapiens
tccatctgtggccaagactcggttctctgcccagatccttttgggtcccctctcttgatttggcctgccagcccccaggtttgtcatgccttcacttctagaggcctgcctcacttttagagggtaaagtggcttggggttactacctctggaacagccccaaccaatgactggcagatacaggagtgtgagaccccagctcccctgcttccaggcaggaccaactccgaggtcaagatcagggtggagctaagatggtccctgaaatctcacccttgcttcccttctcctctttcctatcctgtcccatttatttctgggtctcattaggagcatctccctaaataaactgcttacatgatgccctcatctcagggtctgcttcttgagaatccagcccaagacaccatctgacttcatcttgaatgcctgatcttccttgtccacgtgggaaattccttcaata

SEQ ID NO: 184621 - DNA, 943 bp, Homo sapiens
  misc_feature (551)..(551): n is a, c, g, or t
tgcagcaacttctggttcaaattcccgcgcaccagctcgaagctggagcactttgtgtctatcctgctgaagtgcttcgactcgccctggaccacgagggccctgtcggagacagtggtggaggagagcgaccccaagccggccttcagcaagatgaatgggtccatggacaaaaagtcatcgaccgtcagtgaggacgtggaggccaccgtgcccatgctgcagcggaccaagtcacggatcgagcagggtatcgtggaccgctcagagacgggcgtgctggacaagaaggagggggagcaagccaaggcgctgtttgagaaggtgaagaagttccggacccatgtggaggagggggacattgtgtaccgcctctacatgcggcagaccatcatcaaggtgatcaagttcatcctcatcatctgctacaccgtctactacgtgcacaacatcaagttcgacgtggactgcaccgtggacattgagagcctgacgggctaccgcacctaccgtgtgcccacccctggcacactcttcaagatcctggcgtncttctacatcagctagtcatcttctacggctcatctgcatgtacacactgtggtggatgctacgggctcctcagaagtactcgttgagtcgatccggaggagagcagtacagcgacctcccgaagtcacgaacgagttcgctccatgctggcctcattgacaatcgaaccggctactcaaggcgtcgccgctcctgtcggaggggtgggaaactgggacgtgagctcacagaggtggtggcagccgcggctccagggcagtcgcgttgtcgcgttcggtccaaggttcggtgggtctcggtgaccacgatcccgatgcgggtcgggggtgccgcgatccgcttagaggtacaacgttcgtcgcgtccgccgccgttctctgctctccttctc

SEQ ID NO: 184622 - DNA, 483 bp, Homo sapiens
tgggctcaaatgatcctcccaaagtgctggggttacaggcctgaaccactgtgctcaaccaagagagattcctttaaggaggaaagaaaaaaaaagatgaataaatgatgagttttaaatttgtttctccgctaggaagcacattggacacatatgcatttatagagtcagacagatcatagagcacagatagcttcctgtaagaaccttcttaaatctgtctaggacagaccgggtcatgcagctcagacatcctgagctcagcacacctggagaaagtgagacatgaggactgcttcacagtggtagattcatgtttgtttgttgttgttgtggatgtttgtgtgtttgaaaccccagaaacacacaagtaccatctaatctgtgatagaacaaataccctacagtttgctgttacagatagtttctgcccaagactggtctttccgtactagacaccaaagccatccattaggcaaggat

SEQ ID NO: 184623 - DNA, 291 bp, Homo sapiens
ctgtgcttaaggatgaagcaggctgaaacaccctcgaggcatgaagtgatgcctcaggctagtggggatggggaatggacaagagaagagcttgtggggtggtatttgagcctatttataagcaaaaagaaagaacctagtagagaaaaagagatttacatatgatctgggagagagaagggatgattaataaagtgagttatggaggaggtgggagtagatggattttgaccacaaggagaagggatttgaaggaatcgaagatttgctggatactgaagaaaggaatga

SEQ ID NO: 184624 - DNA, 173 bp, Homo sapiens
taccaattggcctcacaccgatacacctatgcagtttccctctgcttaagtgctgtgtactttttgagaaccgagcactactctcaactcataaataccttgactttttaaacaaaatccaaatgcagcctatggcacatcgccaattcactctcattgtcagcatcggccat

SEQ ID NO: 184625 - DNA, 284 bp, Homo sapiens
ttggttgtggggtatggatctggaaggagtttggtacttaaaagaacacacccagagcaagcagtcttcaagtaattcttccccggctctagctttccactctcccactgcttcccctgttgagtaaatgagctatatccatcagtgtaaactcaaagcattacttgctctctgaaccgtcagccaggtttaagcaccagctgccccgtctgtctaaatgctcctccactgcttttctagccttaaggcctgagtcagacatcctgtcccctgcgaagtcttct

SEQ ID NO: 184626 - DNA, 470 bp, Homo sapiens
ctccacagttttagcttgggattggcactaaatggcaagatcttttatgttagttacaaagaaaaaacaatcattgagaagatggcttttgagcctttctaaagggtaggtgaagtaatccaggatccagcactaattaccacttttttcccctatctctttatccacagaaacccattcccgctcttttgagtatccttcagagttctgactatatccccttgtctttgggcatgtttatcctcttaatcccatgataaacccatgaaattccaaatacttatacatcccgtgtcaacttcctccattattccctcgactttcttgttgctgcttctgtttttacatgttgactttattccggtgtcagttttcttcccttttttaaaaaaaaatttactccatcagtttctcattttcttctttcaagttgtcttaccagctgcagaccagcttgggggatccttaga

SEQ ID NO: 184627 - DNA, 453 bp, Homo sapiens
ggactcttggggcagccacagcaccaggtgctggtgtccagggggtgagtccgggccttacaatgcccactccccatcgggggctgcgattagaggactgctcgcttccagtgatgcttccctgaggatttgaaggagacgggtctcctggcgaactgtccacaaagggggacgacaaacagagttccccggtgtccagaactcacgcctggcttaagttcacggagagcagaagagagaccgtggtcctggggagcgatggcccaggtcatagctgatgaccctcaggaatcatgagctcacagcaggtgggccaccccgagcatgcacccttggaataacagtccccagcagcatgcagcatctgacatcaggaagcacggatggaaaaggagcatgatggggatgcccagagacacacagggtgcgcagagtgggaacagccccacgaga

SEQ ID NO: 184628 - DNA, 372 bp, Homo sapiens
tattttaattagaatgatctaacaagagggaaaaatcgctgatttaacaggtaaaaattatgtaacacaaaattagaaaagctagaagtctattttgaaacttttgaaaatttcgcttagatttaaaggggctttattgatcttatctgtagtaggagatactgattttttcccctgcctttccaaacattcagacgtatgcacctatatgtacactaataagagggaggaacgattgatacgagacctatgagattattcgaaatgcaaaacctttgagtatataagagaggatacagtacctggcttcgataggagcggtaactgttcatatatactaataggtaaggattgcttctgcctttctcactg

SEQ ID NO: 184629 - DNA, 386 bp, Homo sapiens
cttgaacccgggagatggaggtggcagtgagctgagatcgcgccactgcactccagcctgggcgacagagtgagactctgtctgagaagagaagagcatcactgagacaccaactcatgacttcctggatgcgcttccttcttaagacaaggcaaaaattaggtgaagtacaaaaaaaaaaatagccgggcttggtggcaggcacctgcagtcccagccactccggagtctgagacaggagaatggcttgcacccgggacgcgcaatttgcggagagccgagatcgcgccaatgcaactcaagcctcggggaccgagtgcgactccgtatcaaacaaaccaaaaaacaaaaagaccgtcaaatggcattaaatatcaaatacattt

SEQ ID NO: 184630 - DNA, 262 bp, Homo sapiens
ctgccttggcctctcaaagtgctgtgattacaggcataagccatcacacccagccaggctctgggttttattgaggctttagcaccattttccacatgtcacagaacatgacagagagtgcgcctggtcagttaccaaggtgcagtgtttacctggtggtctcccagctacacagcttgcttacatcataaatgaagactactggtgtgtagagaaaatccctatttttatttgtttgttttctatcatgacctgcaagccc

SEQ ID NO: 184631 - DNA, 301 bp, Homo sapiens
caccctcccacccccattctttaactttttcacactactctcctgcctatctgacatcttaataaacctggagcccacctaaacctggcccaatggaggtactaataggaagggaattatgtatatgattcagtagaattttactttgacttgtgcagtttttcctgagtttgaccagatgaagaatattacaaatttatatctggattatagatgtttgtacacttgtgaggtagggatgggagggggagcaaaactggagtagataaaatatacaaatctacacattgaaaaaccatct

SEQ ID NO: 184632 - DNA, 357 bp, Homo sapiens
tgctttgaatctccaaacttgaacgacattatgactgtgctcatagccaggcttcccttgcttgtggtcattgctgtggatcaaggttgttttgccttccatgcagtggatttgctgaggtgcttctcaatctgtatctcagaattgagatgtatgagaaagattctcaggaggggagagatatcctcttggggacacgaccattggcttccttggcctcattgagtagcagtgaatatggaccaggggaggagagcggcaggactcacagggatggtctcagcagtggaggatggtggcaaagagtgaggacttaagattcagatgaaccttgcctggaactgtgcctctgtgcct

SEQ ID NO: 184633 - DNA, 384 bp, Homo sapiens
catagacggcttcattttgaggagtaaattacaattgaacatgaccaaatatacatagagaaggcgtggaccacacaaatgtgattgaaagctggcgtggagtcatcttaaattgactttttcccaaagggcccctaaaagagggtagaatcccaacagatagagtctatggagagatagactgctgagacccatattatggtcagtgaagtgcaggcaaggaagggatccttagcaaaatggggagaggaatggatggtctgaaaaaccctgaaggaactgaaacactctgcaaaggaaagaagaacaagtatcagctttgacccctgccagacctaggcagcaacaacggcagctcacaaagcaccagaacaaacgcgcttt

SEQ ID NO: 184634 - DNA, 238 bp, Homo sapiens
tttttgtcacgatctttgctgtcttgccttttctgcattgttgtttaattctgttgattgttttaatttcaagggtattatgtataggatgttttaatcctatcaatgtgaatcatgactagttgaaagaatgtttatttactctaaatgaaatagagaatctattcttaaaagtcctctttaatgtgttgctatgcataggatcgttccaaactcttaatatttcactcttttgttt

SEQ ID NO: 184635 - DNA, 544 bp, Homo sapiens
gaggatccccggacagcacgcgctaacaagcctttcctatctccaaactgaatcattcctcctctggcccttccttgatcccatggtgtagcccttattcctctccctcacaggtggcactcaacctctgccagaatgcttccagggagggagagctattcagtccgcaagcctcagttccatttttgggcagctctgattgttaaaaagttcactttcctgtaatttccctttttagatctgcccctggaacaaccaaagagaagtctgcgtcatttcctttcaaatacatgaaatgtatgccccttctctgttaaagatctctagtcctttcaacttctcacatagtgtagcctgaagggcctctccacccctcattctcacatccctgcaattcgttgttagcgcgtgctgtccggacagcacgcgctaactaaaagagaccctatctctgaaaatgggcaaaatgaaatagaaatctacaagagtttagaagaactagaaaagaataaatgtaaggacaaagcaaggagatctaacatat

SEQ ID NO: 184636 - DNA, 213 bp, Homo sapiens
cagaagctggagtgggaaggatggcttgagcctcggaggtggaggctacagtgagcatgactgtgccactgcactctggccagggtgacagaatgtgaccttgtgttaaataaaataaaacaaaataaaatagccattaaacccaaaaaaagtagaaatcaaagtacatttaacaatagtcatctctgatggtgggattagtgaatcatttta

SEQ ID NO: 184637 - DNA, 1001 bp, Homo sapiens
ctaggattggcatgggatactgtgcctggccccctgtctaatcctgaagcttccacttcctctcctcttaggtgctcaccagtccattcatatagctcttgccatgttgccaaatcctgtggccagttctcagtcttgtctgatatggtcgtcagctgtattgggtagttggtcactcccttctccttgagactcctgcatgtggctttttcagggcataatggtcatggttctccctgcctcattgggctcttcttccccatctcttttcttggactcttgttgccctgattttgggacactggagcatccccaaggagccctggaggtcctctcattcccctggtgagctcacccagttttctggtgctaaatgccacaaatactctaatgttccccagtgtatctccagtctgaacttctccctgacctccagatttgggtgtcaggcatgctttgtgttcctagacaccagtcagcatctcaagcttggcacatttaaaagcaaactccagatttgtccctgctacctccttcctcagtgtcctccttttcagaaaagggcaagtcctgcttttcatttgcttgggccacagtctttgggatcacctcctattcacaaccctcatccaatctatcggtgagttctgtaagctgtgccttcaaaatgttctcagaatgaccacttctcactgcctccaggctctgccttcaggttcaagccactgtcctccctactgagatcatggcagaggcctcctttctggcctcattcagccagagtgatccactgaaactagtcaggtgcctctacaactttgttcaaccctccagtggctttccatcatattcagggcaaatttcacagtcacagtctccacctgtgtctgcagatcatccacccctctctggcctcacttcccactacccttcccctcacccactcctcttcagcagtgcttgcttctctgctatcttttgaacaggctaagaccttttcc

SEQ ID NO: 184638 - DNA, 328 bp, Homo sapiens
gcacaataggcatttatgatactatgtaataggaagcctgtaataaaaatgggaactgtttgatagttatctgtaaatagaatgttagtaaatatattttgtttcatttctcttcctactgcagtctggggtcgggggaaatcagtaggctcccaccttaaagaacatggtgtatatagtaatgaaatgaagtgaagactggtgctcgaatgaattgaatgttggtagttgtctttgaaaaaccaagagggtacggtactcagattaaaaatatgtctaaaagtacagaatttaaaagtatagttatctatacttatctgtgatagat

SEQ ID NO: 184639 - DNA, 324 bp, Homo sapiens
acctcagagtaccatttatactgattcatttactgacctacatattgatccactacttcttcaacaatctgcttttctgttcccaagacaccattttcatgctgaactaaatgtaaacacctagttagcaaatgtggaggacatctgttctttttacatgtccagcatctataacccttttatcttttgcaaacgaattagctgtcctgagtttgctctttttgttgttgttgtgttgttttttgaggaaacagtctcactctatcacccaaactggagtgtagtggttccctcatggttcactgcagcctcgacctcccgggc

SEQ ID NO: 184640 - DNA, 595 bp, Homo sapiens
tcgtgtccaagacctttctctttcaaaggcagcggagtcacctgctgtccctctcagtgactgctgtctgctggtcttccgcttgcacctcgtcatccattgaggacttgtgttcctggctgactgcgttctccatccttcttgccgtcttgtagagcagcaacccctctacattcccccagcaggtttgcaacagtgatttcatacaagacgttggtgtcgtcacccacgtggacaggccagcctactccgcatctctctgggcacttagactgctgcagctccagtgagcttttccaacatgcctctcagccaccactccctgcctgcggtcacacctgggaccctccatcacccagaaaggagacttcagacagctctctgctgacctctcttctgttgctccagaactctccacttggcctccccacctcattgtcactctctctgtggtcattgccttccttaatcatggttcataattaaaatcaactcctgcagggcgaggtggttcacgcctgtaatcccagcactttgggaggccgaagtgggtggatcacttgaggtcaggagttcgagaccagcctggccaaaa

SEQ ID NO: 184641 - DNA, 298 bp, Homo sapiens
gaataagtgctttgaagaaattgaagatctttttttcatatgctgaatctgtggaactttcaagagaataccacacagttttatcagtattgaatatcacagtccagacactatttgaaatcagacttatatcctgtggttttaggaaattaaaatgcagttacatgctggaatgtattcagcctgctgtgaaacatggtcatttgaggtttaaatggcaatctgtgagaaacggttctcttctctggggccagttttacttttacatgacccaaactttgactcagaaaatagagct

SEQ ID NO: 184642 - DNA, 370 bp, Homo sapiens
tggcagagagaaggtggcaggttcttataaggatcctaatcctagtggatcagcacccgcccatacgacctcatttaaccataattactgccctactccaaatgcagccacactgggggtttgggcctcaacatgtgaattgcaggggacacagttcaatcaatggtgcctccacagtcccacctccaaggctttgccagatcacgccccccacggagcacacccggtacagaaccagcccaatcgccactcggccacccagccacccaggcagatctaggtcctaatcagcccgcgccaggccaagggctccagagggcaggaaccctgccttctgcccggaagacgcaggccctcgttctctccaatt

SEQ ID NO: 184643 - DNA, 383 bp, Homo sapiens
gttttcacaagcacgtatttatggaacgttttacatttcttataatgttaatccctgattcaaaggaattaattattcctatatcaaagtattaatgtagaaaatgtcaaaaagaaaataagatttttacttttcaactatacaacttcaattaaacctacatcgcagcttcaggtttcccgtgtgagtcacgcgtttctagaatgcattctaaaactggtgcataggtttggtggtgactgggtaccaggtactgtgccagtcatttttatataccatctgatttatgacctctgagttcagaattctcttcattttaaaacgaggaaatcagctcgacatccagttgagtgggctggtcaatgaattggcaccatctgagt

SEQ ID NO: 184644 - DNA, 362 bp, Homo sapiens
gtgagaaatttgattcaggataagcaaaaagagagtagtaggcaatatataaaataatgcataaattagaactacttaaacttgagggaagcgagtttttatgtaagatttactactagtattacttgattgacaacttagctactatagcaaaaaccaactccctgtgatattttaaaaagaaatactccatgtcataacactgaaggtgactcaccattaacttcctgctcttgcctaaggaccctcttgcattagtaatgactaactaaaaccatttgccatgtctattcaaacaggaaaatcctgattaactacaccacgagttagaggaccaacctccccttgtgacatgggcgtga

SEQ ID NO: 184645 - DNA, 175 bp, Homo sapiens
gcagttttaatatatgcagatgtgtatactccagaattaatttatagttgggaatggaaacatcttcttggaatttaaggctagttttgaactatggaagatgatgaagatattttctggggtttgtcaagaatagaatgtcatcatggttcaggttccactggggtgttttgag

SEQ ID NO: 184646 - DNA, 381 bp, Homo sapiens
tcagcttgaggattgagctatgtgttatgattcactttggtaatatttgcctcagaaggatttctgtgattatttctcttttagcgatgtagagaattctcagggacaatcaagccttcagccccagtacacagtgacccacataaaaaatgtccctgaaatggcactgattataggactagaagtttctaaagagaaacaagtctttcaacaagatagcaaatatttcccacattttgcttttgtctcaaattactgaaaggatataacttaaagatagtaattcttatgccatagatactatccaacagaacatagattgttctgatttatcccttcttgaaaaactgatcttttatttgcctttacaacccctctgca

SEQ ID NO: 184647 - DNA, 343 bp, Homo sapiens
tcagaacatgtggcctgagcctaagtgactgggggaaaaatgagtggagacttggggatctgtgggaatatgacaaaagagctaccttttgtgtcatcatagtgacagaaggaaaggaggaagggggtgggactgaaaaagtattcaaataaataatggctggaagattctaaatacggcaaaagacacatgcctgtacatttaagaagctgagtgaaccccaaacagaataatcttaaagaaacctacaccaagaagcatcacagtcaaacttctgaaaactaatgacctatgaaaaaagtcccaaaagcagagagagagagaaaggaaaccttacctatac

SEQ ID NO: 184648 - DNA, 275 bp, Homo sapiens
gatggcaggcacctgtagtcccagctactcaggaggctgaggcaggagaattggttgaacccgggaggtggaggctgcagtgagccgagatcgcgccactgcattccagcctggcgacagagcgagactcctcaaggtgcatccaaaaaaagaaagaccagaggacccagcaatgctacctctggatgcacacacacgaggacagacaggagggactcaaacagaagcttgcacacgcaggtgcacagcggcacgactgccaacagccacaaggt

SEQ ID NO: 184649 - DNA, 242 bp, Homo sapiens
ggattgctgaatctcaaagggttcatgcatttaaaattttgataaacccttcacaatgattatacaatttgtacttgggaatatatttttaaaatacagatttattgggccccaccccagaactactaaatttacaatttctgggagtagtatttgagaatttctatttaaaatgcagcttttggggtaattctaatgcaactagttctctgaccagcatgttaaggaccactgctagagta

SEQ ID NO: 184650 - DNA, 292 bp, Homo sapiens
atgtaaatatgatgatgttctgagacacacaggcacagattccagggatctttttcagtcacacaggatactatttgtctccagatcaccaactaccaaatataggtgaggtacctgtttcaggggaaccaaggcacaagattgctgagaagtcttttatatacacaagttgcagccaaaatcaggcttttaaaacagagttagatcatccacctattttcaaaagacaggccaggtgcagtggctcacacctgtaatcccagcactcttggaggccgaggcgagtggatca

SEQ ID NO: 184651 - DNA, 245 bp, Homo sapiens
tgctgggattacaggcaaagtctgataaatattttttcaaacagagactagtagtcaggtataatgagtttgggtctgttacaacataaagtcaacaggaatgataaggcttccttactatttgaaggagttacctggaaccaagctagaaagcttagagaaagtaacaaccccttgtggattcaaggaggctggagaaccagtagggaccgaaggaacagtaagtccaggatgtcattcctata

SEQ ID NO: 184652 - DNA, 360 bp, Homo sapiens
aaacatttaaggaaaggacttcttttccatgagagttcttggagccttcagcacatccatgcatgctgtaattctccagaaggctagagatgtgtccagtagctcgtgggactagaatttcccagaacactcttgcagaaactaaatctcttagatactgttcggttctgtgatactgatagaaattaatcaggtcagttctccagcacatggatcgacagctgagctctcatcaactggctgcatgaagtagccctccaagatttcacattgaggcaagaaaaccggcctttgcccttcctctgcttctcctcagacagtgagcacacatgatgtgtttagtatgttgtagacactggg

SEQ ID NO: 184653 - DNA, 380 bp, Homo sapiens
tctgacaaatcaacatagaagtgacttgttacaagtgagaactggtaatgacaggaaccataacagcatgctaatggtctttgataaatatggtgaatgcacatggtagaatttaaaggtcttggtttgaagccctcccaagagtagttgcaactttgaggttgggtttaggaataacttctgcaacctttagcttcactcctgggagaaactttggatacattttacctgcctctcttgagcttcagttcccatatttgcaaaatgccatgacttatctcttaagaatttagttagaataaaacagataccgtaagttaaaagaatacttggttgtgctccagcgtgtgtctgtatccggaataggatacagtaggtaa

SEQ ID NO: 184654 - DNA, 322 bp, Homo sapiens
ggctcggacctctactacggtatctaactgtaaaaacaaatgcacatatggaatttaaaggtcttggtttgaagccctcccaagagtagttgcaactttgaggttgggtttaggaataacttctgcaacctttagcttcactcctgggagaaactttggatacattttacctgcctctcttgagcttcagttcccatatttgcaaaatgccatgacttatctcttaagaatttagttagaataaaacagataccgtaagttaaaagaatacttggttgtgctccagcgtgtgtctgtatccggaataggatacagtaggtaa

SEQ ID NO: 184655 - DNA, 274 bp, Homo sapiens
ttccttcccaatctgtttgcttttcttttcttgtcttattgtattagcttggacttctaggatgacattggaaagcagtggttagatgggacatctttgtcttgttcctgatcttaatgtgaaagctttgagtttctcaccatgaagcatgatgttagtggtagggtttttgtagatattctttatcacagtgacaaagtttccctctattcctagtttactgagagtttttatcatgaatgggtgttggattttgttgagtgatttttctgca

SEQ ID NO: 184656 - DNA, 147 bp, Homo sapiens
tcttgaaataaaaatgccatgtatgtttagtgatgctaccataaccaccggtttcaccagtcagccatcaagaaagtatttaagaacccaaagagctcagatgctaagaaagtctctaaagttgatttttccacctcttaggccaat

SEQ ID NO: 184657 - DNA, 138 bp, Homo sapiens
ttgcgtccctcaagggctaatttcaattattgtgaaattgattcatttgaaacatttgactccccagtgatgacagatgagagagggcagccatctcctaagcatgagtcttggttacattctctgtattgggcttcc

SEQ ID NO: 184658 - DNA, 186 bp, Homo sapiens
acctgttttctgtatcttgggtgtaaggagagagtaatgaaacaacacattgttttgccaaaaagcattctaagcttatctgaaagaagtaacagcttccaactgttgtctaagaaccagcatttttgtactagctttgctagtgggattgggctggggaaaggagaagtaatgcaaggaagttaa

SEQ ID NO: 184659 - DNA, 311 bp, Homo sapiens
atcttggaccaaaatgtgcactcttctatatctaccacaaagagctttgtaggccagatccttggcacaatctctaattatcattgtaactgcaccaatgcacaccttttcagagaaggaggaattcctctcttctaaactaatcattccctctgtgcccttaatcccattgtctcttgtctactctgggaccttatttcaccatctctttcttcctgcctacattcttttcttttctagctgtttcaaacaccaagaccacaaccaaaaccattacatgtagatatagaagagtgcacattcggcccgag

SEQ ID NO: 184660 - DNA, 353 bp, Homo sapiens
cggccctcctccccagtgccccaatcccagtcttacattgacacaatgccagagtcagaggggaccccagggatcatagattccaagcgccttgttgtgcccacgacaagtcctgatcccaaaaaggagaagtgtcttatccaaggttgcatgacatgcctggacaccctctggcccccttccccagaatccttgccctcagccacttctcagagtccacactcacatctcctaaggtgtcgatgataacaatggctttcctttactaagggaatttgcatttggttaaggttagggtgagatttaaggagaccaaactcttgagacccaaaggaatgtgttggtaatagtgg

SEQ ID NO: 184661 - DNA, 245 bp, Homo sapiens
cccgccttggcctcccaaagtgctgggattataggcgtgtgccaccgcgcccggcccacccactctttccagaccaccacaccagcctgctgatggcgtcctggcctccattccgccttcccctattagccagactgaggccaggggactcgttctcaaatgcaaacgacctgtacatccctttgtttcaaacctctatgactcctggtcactgtaaggatagagcacagggggtcctcacttca

SEQ ID NO: 184662 - DNA, 241 bp, Homo sapiens
tgagaggctgaggcaggagaattggttgaaccagggaggcggaggttgcagtgcgccgagatcgtgaaactgcactccagcctgggtgacagagagggagactctgtctaaaaaaaaaaaaaaaaaattatagttacctttacctttaactgctctatggatcacaacctggacattacacaacattaagtgttccctttgagatattccttcagactctgggaggccaaagcaggtggat

SEQ ID NO: 184663 - DNA, 146 bp, Homo sapiens
gcacctttctaatgtcgggacaaacaaggcattttcaagatcttttctacctattcattagttaatactaaatacctctctggttctgtgtgccaagcccaagattttgttgttttcatttcaaacattaaagtacttgatgctac

SEQ ID NO: 184664 - DNA, 682 bp, Homo sapiens
gaaacattttttggctattctcaccttcaatatattcatagaattatctcaaattgcctgtttatttccctctcagtctgaaacgaaaatgagagaaggaaagggctagaacagcatcatgcattctgtttatgcaggtcttgcacctaaggtgttacgaggaggaggaatctaaggtgttatgaggaggtgttatgttcagaagccaggcctgccccttggtccctaaatattatttcccaggctttctctttccttgctctcttttgttatttgtagctaaccctgaagtattatgaaagcttctgctgaaaaagtacttgtagagccaggtaacgtggctcatccctgtaatcctagcactttgggaagccagggcaggaggattatttcagtccaggagttcgagactagcatgggcaacatggcgaaacccaatctttaccaaaaacaaacaaaaataacaaaaattaactgggtggggtggcatcaatcctcctgcctcagcaggaggcctcccagaatgttgggattacaggtgtgagccaccacgcccaagaaggggtaggttttatttggtggagggagcggggagacacagaagcgattggagttgtctttttccagtgggagatatttgggaggagttagtgttggagatggaggtgggcaaagaaagcta

SEQ ID NO: 184665 - DNA, 544 bp, Homo sapiens
aataggtattgttttgctgccgaagactgagaaaagttttatggataccaattttcccctcataaagtagatcaagacaatgttcttgccaaaaccgggtacttcttagtcatgttgagctttgggaggtgtctattttctccagaagaagaggacaaagagatgcaccatatttcttaaagtcctggataggaagtttgagcatctgtttccctctatccatagttcattcacagtggtaacttcagcagtcatccagcagaactaaatagtgtccccatcatcttcaggtgctctgaataagtagtgatttgggctgctagaaagatccttgggtgggctggcagtaacacatcttccagtaatcattactagaagtgtcagcctaggtaaattcatgttcatctgggaccattttctcttactttgcttaaatttaacccagatcttaagatccaagtgttatattgaacattggtgaggtacagcgaaatttgaagaggtgggaaaaagttttcctttccacccttacagagacaacacg

SEQ ID NO: 184666 - DNA, 290 bp, Homo sapiens
cgccccctgggttcacgccattcttctgcctcagcctcccaagtagctgggaatacagatgcctgccactacgcccggctaattttttgtatatttagtagagacaggatttcactgtgttagtcaggatggtctcgatctcctgacctcgtgatccacccgcctcggcctcccaaagtgctgggattacaggcgtgagccacgcgcccggcacagctccatcttttttacttacctctttattggtgggctggtaatattgatgatttgacgctcttttatgtatgatt

SEQ ID NO: 184667 - DNA, 323 bp, Homo sapiens
tgctgggattacaggcatgaatcaccacgcccagtctggaataacaatgagattttttttcattcatggtttttaaaaatctatttttaaaatgcatatatttgtgacttgttcgttgtttaaatttcttcctctctgcccctttttaaattatttttagagacagagtttcactttgtcacccaggctagagggcagtagtgtgatcatagttcaccgcagcctcccacctcagactcctaagcagctgggactacagggatgcaccaccatgcctggctaattttttacttttttatacaggcagggtcttgccatgttgc

SEQ ID NO: 184668 - DNA, 101 bp, Homo sapiens
atgaaggtgaaaaactaaaactttcctgatatgctgcggaagagggtatccaaagactcagaagatttggaatgctgagtggatttatcctgtaagctctg

SEQ ID NO: 184669 - DNA, 623 bp, Homo sapiens
ctgaggcaggagaatggcgtgaacctgggaggcagagcttgcagtgagctgagatcgtgccactgcactccatcctgggcgacagcgagactctgtctcaaaaaaaaaaaatgaaacagttgccttttttgactggttaaatgatcaggtaggaagaattttacatgtatttatgggcacttatttgtagtttttaaattacatacttggtactggcataataggagagcttgctggtgatctttatgaagtgacatagtctcattgggaagtcatctgtctacatttgttgagagccttaaaacttttagaacctgttttattctatttgtggagacctgaatttaaaacatagagaagttttgtacgtaaagatgtttggtgatgtgattttacaattgaaagtgggctaagtgtcaaactacaggtcagccattaggtaaatcacagtatatctctcagtgaagttttccatagtcaaccactataaaccataattatgccagaattatgaaagacaacaatatagataaatgtgaatcataaacaacattaaaagtctgatagaaaatagtaggcccatccagcctgggcaacatggtgaaaccctgtctctacagaaa

SEQ ID NO: 184670 - DNA, 450 bp, Homo sapiens
gatactattcatggaatacgatgccaggaacttaacaggtagtcaataaaaactagttccttcctcatgtagttttaactattgacaaccgtaacaagctgcacataaaaacatccaagattttgctgtttttttgcaaacatgtagtgcaattagttttgccacataatagataagaaaaactgaaagcacagaagttaattgatggccaaagtcttccagtaagtccatgacccaataatttcttatactgttaagaaaatggtgaggacattttcctgctacaatgaaaatgcaactgaggaccaagaagcagcttctcggctccttctggaatctctgcctggttcagcctgcctgactccactcctgcctccaccatgtccatcagggtgacccagaagtcctacaaggtgtccacctctggcccccaggcctttagcagccgct

SEQ ID NO: 184671 - DNA, 162 bp, Homo sapiens
aagcgcagagaaattgttgcatgggtgtcctcaagtctaggatgatcattaccttatctttgtaatggtgaaagactggaatcaacctaaatgtccatctctacaggaatggataaatatggcctattcgtgtgttgccggggtccgggtaccggagctcga

SEQ ID NO: 184672 - DNA, 588 bp, Homo sapiens
gactggggatagcaaggaggtgagtgggaaatgcaaccacaggccagccagcgcccgtgcatggagtcaaagggaggagtcagcatggtgaccactgcccctgcaccgggggaggaaggcatgggggtcctgggtgaacctctccctgtactgcccagagcccagcctgactccccccgaagccgggtagggatgcatcactccgactaacaaatgtctcagccctaaagggcccctggctccaggtcaccctccagctctacagaagggcagggacgaatctgatccttgttagcactgacacaagagggcgggacctgagtcagccccaggggaagccagcatgccctggaaaggctggtcccaccaaagcatgctagtgtgtctcccaggctgcacccaggaaggctgggttggggaggagcccagggccagatgggcagcaaagtgtatccggctgtagccagccacaaaagaggacactgatgtctggcagcagcacagaaacccctgtggctgatgtttcttcctcttggatgctgagggtggtttttggagaatagtcagcttcactcccaccccagcccc

SEQ ID NO: 184673 - DNA, 481 bp, Homo sapiens
ataaggattaaacctataccttctaaatcactaaagagaaaaatgctagccaatgttattcataaatcagtaacatttatgtatatattcatttgtgtgtgtgtgtgtgtatatatacacacacatatctacttcaaacagctcaaaattactgaaaaaaaaaatgtaccaaatgtttaatcccaattaatggaattatgagtgacacatttttctgtattttgtaaagagcatgtataatttttttttttttttgaggcagggtcttgctctgttgtccatgctggagcacagcagcgtgaacttggctcactgtagcctagaggtcctgggctcaagcatcttcccacctcacgctcccagtagctgggaccacagacacaccaccatgcctggcaaattttgtattcttttataaaaatggggtcttgctgtgtcatgcatgctggtctcaaacccctgatctcaagcaatcctcctg

SEQ ID NO: 184674 - DNA, 600 bp, Homo sapiens
  misc_feature (20)..(20): n is a, c, g, or t
cacacttcgatcgcggagangatcttctccgtaggccagcagacgtgcacatgtcccccggtttacaaaggccttataaacttagcctgataagtcatcccccaaattcgtgtgccatgtctgtctctcagtggggatatttttaactcctccttctaactcctctcagttcctttaaggaactgtaatccgaaagggtcaggcacttggcttttacttaggggaaaactttgaaagaatttctgaggctccctctggggtagggctggctttccccaaaagaactggcccttcagagcgtcttttccacataagggcttgtgtgaggcctcaggcaccagttgatggccgtgtcttccccacgacagatggtcaagctttcaatttcagcaagtgatccactgttgagggggcaggcgggggactctgccagcatgccaagtgacaggccagcttagggtaacagggatctggtgtgtgcccggcatagcttttgtgctaacgatgggctgctgacaggcgccctgccccagctcatctttgaggcagaagatcctctgctcccttgattctgtttctccgcgatcgaagtgtggtgtc

SEQ ID NO: 184675 - DNA, 408 bp, Homo sapiens
ctgtccattttccacatctcgacttttgcttagttgcttgatgtaactcacttcatgctgagtttagacagctctcacagtttcctcagcaccaggttaaacagaactatcctttcaaagagcttccctgctgagatgcagagtaggagtaaatagaagagtgtgggatgtccacaaagcaaggaattaaacaaagtaggccagacagactatagagggagctgcttgtctttaagattactctaaggaactctgccacttcctctagcttagtgaatattttggtagattgttctagatactgtgatagccggctatcacattatcgctggttatcctgtgcattgtgactgtctgtgtgactattgtgtgcacatatttttaacctaaatgcagaagattaccggt

SEQ ID NO: 184676 - DNA, 642 bp, Homo sapiens
  misc_feature (393)..(393): n is a, c, g, or t
  misc_feature (397)..(397): n is a, c, g, or t
  misc_feature (401)..(401): n is a, c, g, or t
  misc_feature (523)..(523): n is a, c, g, or t
  misc_feature (533)..(533): n is a, c, g, or t
  misc_feature (591)..(591): n is a, c, g, or t
  misc_feature (603)..(603): n is a, c, g, or t
  misc_feature (605)..(605): n is a, c, g, or t
ttagtggcaataggtaggtcagtctgaagataatgaatttgaagtgtgtatatgtcaactcaagtggaattatcaagttagcattttacctatggatataggcaggagaactggtgatgtgctatagatgtggatgtaacttgcttataatattcattgaaactctaatgatgaatgagattatccaagaggagtggggaaaatacaggaatctaatacaggtcttgaggaacagtgtcattaaagacacaggcagaagaaaagaagtctgcaaagtagcatgtgaaaaacagcaacataggttagagcaagccctagagttgattgtcacaggaggcgatatttaaggaagtcctagtaataaatgttataaagcttctgagagaaaagtgngtgntggngaaaggaagaaagaggttgagaaaaggagatctatcagagcagttgaaaagaaacaattttttaaaagtgacctatggcaatcagagtaattatgtaaatatagtgacagaatgatacaggnaatggttatnaacaggagcaaaggagacacagagaaaaactccaaaggctgtgacttgggtggttaancatatgaatgtncntggatacctgaatgaacactggcaaaatgaatgcgta

SEQ ID NO: 184677 - DNA, 120 bp, Homo sapiens
caacccggtaggtgacaattaactaagaaatgggatcagagttagattttaggatgtcatgtatattgattagggattgttatacacagaattattgaaagttttatctgaacaaaggcg

SEQ ID NO: 184678 - DNA, 375 bp, Homo sapiens
taggctcccaagtcagacagtccattcttctgaggcatgcaatacattctttcccagtttcccatgtcatcccacagtcatccgggctacccaccacggcatcttgacttgcatagggccatcttgggtgtgaggagggctatgaagttcctgtactcactacagtgactgcacatagttctgcccaccagtttgtcacagatgggtcttggaatccgctggcacgagtatgctctggactctggtggatttctctttgtgttgcctgttactttctttccatatgttgtgctactgtgttacttggtgctatgtgaataaagacgcatggtggatctgctgtttaaatggtgccctctcttcttcctacttgct

SEQ ID NO: 184679 - DNA, 498 bp, Homo sapiens
gaggagaaattctgagcttagctccactctgtagggagatacatgtatcctacagggtagagacatttggaactagatggttctgagacagctggagcatctgctgggagagtcaggggaggacagggtcccaggccccacccaaacatttcctgtttgtctccatccagctccaggatgactcacttgacccatctccagataattcatgagcaaagaatagcatctcctgggtcgggataagctgaaaagatggggaaactatttttcaaagcctcccttaaactgtgaaatgtgactagctctctttaagtcttagggaacagtaagtgcctggttataaaagcaaaagctccttatccttcaatgctcagatgtactgttaaccacagggaagctggtggctggccacagttgccaaagaattcagcctaaccgagacacgtgccaaactggtttttcactttattggggatttaaaatggcagaagacagaac

SEQ ID NO: 184680 - DNA, 413 bp, Homo sapiens
atacccaaacctgtgggatatagcgaaagcagtactaggagggaagttcatagctattagtgcctacatagaaaagaataaaaacttcagataaataacaatgcatcttaactaaaaaagcaagagcaaaccaaacccaaaattagtagaagaaaaagtaaagatacgagcagaaatacatgaatttgagatgagaaataatacaagaaatcaatgaaacaaacagttggctgtttaaaagttaaacaaaagagacaaacctttagccagactaagaaaaaaaaaaagatccaaataaataaaattcgtttctagttcttcagcttccatcctgcttcaccagcaacagtaataccttctctttatgatagtttccagtctgcttctgaatgtagaagccttctttcctcctt

SEQ ID NO: 184681 - DNA, 534 bp, Homo sapiens
cacctcatcagcataaactcaggtgcagtgataacgaataacagaagacactcccaaactcacgcctgtaatcctagcactttgggaggccaaggcaggtggatcgctgttgagctcaggagttaagcctgagcaacagagaccctgtctacaaaaatgttaaaacatcagctggcaggaggatcgcttggaggctgtggtgagccatgatcaagctactgcactccagcctgggtgacagagcaagaccctgtctcaaaatacaaacaaatgaaaaaagacactcccatcattcaggaaacttccagggttctcagccctcagtgctggtgccaggatcaggtcaaagaacaaacaaacctttcttcacctggcttcacccttgccactcctgggagagcctccctacctgacctccacctcctccccaggcaatctcttccctgacttgaatacacacgccccacaggtctgatgggcacggcacagtccacacctccaagaactctcaactagcgcccctcctcattctgc

SEQ ID NO: 184682 - DNA, 553 bp, Homo sapiens
actgcaactacggttaccataaagtgattactatgtgctagattgtgtactaagtgctttccatgaaatatttagttgtcacggcaaccctacacaggtctggccaataaacatttctgcaatgatggaaatgttttataatactagcaccacctaactctggtagccattaacacatgtgaatattgagcattgaaaatgtttctagtgtgactaagaaactaaagttttaattttgtttagttttgattaattaaaatgtaaatagctagtgtggccagtagctatggtattgacatgatgcagatacaagtactttgattctcatattacatgtagagaagctacagttcaaagaaattaaataattttctcaaggtcacagaacttgcaaatggcagagcaaggatttgattttgaagtcagtgtccttatccctatagtgtatggccactatttagactgtgcctgctctttttgtatccaaatttgttaagaaacacctctggtacatttgcaattaaccattgaaagaaataaaactgataattat

SEQ ID NO: 184683 - DNA, 166 bp, Homo sapiens
tgcagacagatttttccacaaatgccagcagcgtccccattggaaaacactttgttctgtaaccattttggtgcactgttactttcatgttcgctctgaggacagatctctgataatatacatctgtaaaatactcatttcagctctacttagccctctgaaagac

SEQ ID NO: 184684 - DNA, 305 bp, Homo sapiens
agttaacggtaaaataccatgctaaaacaactagctcaccttcgattttaagtagaaatcttataaacactgtctccacaattttggaatatggtcaacggtcaataagaaaatttaaaatattatgcttagggcaggcacagtggttcacatctgtaatcccaggagtttgggaggctaaaatgggcggatcacttgaggataggagttcaaaactagcctgaccaacatagtgaacccccatggcttatgaaaatacaaaaaaaatagctgagcatggtggtacatgcctgtaatcccagcta

SEQ ID NO: 184685 - DNA, 421 bp, Homo sapiens
cctttatgatggccattcctaggccaaccaccaaaattcacccttccacataatcctctccacagctccatcattacccccagttcccagtacagggaacaatcttaagggagggccacatgacttcctaaggtcacacaccaggacctgcagacaacctgggctcctacagcacctgagctcctgtgtggacccctcactgtgccaggaccctgggggaaccctaaagaggaggtgtggggttagagaggataggccccatgtgactggcagctgctaattcaggtcatcaaatatctttatttggagacaagcgtctccctctattgcccaggatggagtgcagtggcgcgatcttggctcactgcaaactctgcctcccaggttcaagtgattctccggcctcagtctctccagtaac

SEQ ID NO: 184686 - DNA, 328 bp, Homo sapiens
tgaggggaggccagatagggcagggcttcatcgggctgagcagtaacatggccctgtaccctttgtttgaatgcggctgggccacaaacctgccggggtagcactccccaccacgctgggcgtccaggctggaggtcttggggccgtgggtctctagcatgggcctctcctgtggctttgaccttcctctccttgctggacccctggagcactgctaaggagcaggtgccaccccctcatgctggagcttgagcctcaagaccaaggctgccccaggctggaggggaggatatagttgtatggtgtgcgttcagctgtcagacctcct

SEQ ID NO: 184687 - DNA, 972 bp, Homo sapiens
atcctgccctgcctccagcttggactgaaagaggaagagtttcaatcaaccctgagcacatggacaagcctggcaggttagactggacagctttcctgattgcttgcaaatagaaggcagttcaaggtaagtagaagatccataaatgacgtgcaagccttcagcatggacagaaaaccggacagaaaatgatctcaacagatggagtctctctttgtcacccaggctgcagtgcaatggcacaatctcagctcactacaatctccgtctcccaggttcaagcaattctcctgcctcagcctcccaacactgcctgagtgcctgcgatatagacaaggctgcgctgccagaccactgcctgaattgtgttattcgtaattatttacttggtcggacgacgaggagataactcagacaatgctggctatgagcacgggtgcaacggatactcacaagacatccataaaccagcgtagatgatcacagacatcactacgagacttcaccgaaggatagccacgcgatatggaagaaatgggacgtaccatacggttacgaacttccatgaatgcttcaacatttgtggttgcatcccaagcgctctgcgcaaagtaggcacgatgggcaggatagaatactcctgctggcttaggccttaccaaagctacgacaaacgctatccgccaagacctctgatccaatgaccactatggagcaccattcccccaaacacaggaatgaccccgggaaaggaaattttcgcacagcccacattcatgagccccctgcggacccagtccacatccgccgcgaattcaatggtaggcaacaacggttggatcggcacgcacatgataaaccactggccccatgtgatacaacgagtcacccacaatcaagatatcataggtgagcccacttgtgatagcaacagtggcaagcacaccgccatatgatgaaccatcctaggga

SEQ ID NO: 184688 - DNA, 481 bp, Homo sapiens
tcccagggagtgtaaaactttagtgtaggtccaaatccttcttgtgtcaggcctaaattcaataaccaacaagatttgctcatctaagaagaacagtatccaaatgctctcagatcatttaaataggagatcccaagtcttattttcttttttcccagccttttctgacaacttttaattcaatacaatttcaagtcttgaaatgtaaaatatactacattctcccattttgtgcatccagagatcttgtttatcttggtaactattacatggccagcactttgcacaatgcttggtatagagtaggtgttcaattattttttaatgaatgaatgaatttatatatctcttacactctcctgattgttccttcaaaatgatgcatttctggttatctccagcctccttgaaatagacaagaaatattttttcttcttctcccaagcccattcatttcaggttccaactggcatggactact

SEQ ID NO: 184689 - DNA, 506 bp, Homo sapiens
ccattcagtcgcctgcttgatgttcctagagaaagatcctgaagtgcagcgaggcactgtcggaagacccaagaagacatcttggggaaagtgaataaaagagattcctgccaatgtgagtttcaaaatgcacggtgctaaatcaactttagcctaaagctgcctccttacatattttaagttcggcctaaaggtttttctgcatattgtcaactataacaagtggaggtgtaaacaggccagagcctacacttgtgcctatcactgagatttggccgatcacatgtagccagctgtttgaactgtgttcaaataaggcaaacaccaacctgtaacaatccggctgtgtctgggcctcacttccatcttctgtgcgttactttcctttttctatccaaaattattcttctgcccgagggtgcactggagtcctggagcctgctatggctgggaaggctgcccgattcacaaatcatccattgctcaattaaattcctttacattta

SEQ ID NO: 184690 - DNA, 406 bp, Homo sapiens
tgaatcaaaaagaggaagaaagttattgaattgacaaatttgtgtattccagggagattttaatcccaaataacacatacttttccatatttattttcttctttatcctcataatgtccccaggcgatagtcaaagaacagggaattaactttctttgaagatattaatacacagaggtcaacctttgctgcctggttcagatacagtcagcagcagaccaggagacccaccctgtccctcacacttccaccacaggctcgagccatgactgcctccaagcacggtcactgatgaagactgagagtctgcctgtggcatcttcatgcctttatgctgtgattaacagtggcagcagagacagtagtgtgacacgtcttgacagctggtctcgttgatttatgaatt

SEQ ID NO: 184691 - DNA, 492 bp, Homo sapiens
gggcctcatcactccccaccacaccttcctggaatctgaatcttgagccgctctcaaccactcagagcttcggcgataacagtggccctctgcctacaaactgaccactatcccagcctagcaaaatcctactccatccccaagttccagatcaataggaacccaatcctgggaggactttactaatgcccagccagccccagcaacattagccagacctcccccaacccaccacctatcccaggcagtgtaacatcaagtttgcaaaactagtagcctgtggggtgtttgtaaaatctgtagtagtttacaatgtttcaaagtggggcttctcttgaaaattctggtcttgtgatactatgtcttgttttattcgagtacttttatggtttcatttttttaatgtttaaatctctttcctatagagatttgctttggtgtaatgaatgaaggattcttctcctcacgtggctaacccgctgtattttagac

SEQ ID NO: 184692 - DNA, 643 bp, Homo sapiens
caaagagactcaaatagagatgacacatatatctttcacatgttaatttgcatttgaaactttgagctttgatacaggttggcttttctcttttggaatgaagaaatcaagagactaattttttacccatccatccatctatccatctatccatccatccagccacatctttcctaagtgacaggtaaatcactagttgttgggaatgcaaagagataaaccttgccatcacagtatatttagggagatagacaaacagcagtgaatataatgtaaatttagtataataatcaaacgacaaagtgctgggggacacggcttgttgaatggcttgctggggagaagcagaaagaccatagcattcatggagatggtgggcatttgttttccaaggctaccataacaaacaaagaatcacaacctgggtggcttacacaatagaaatgtactgcctcacagttttagaggctaggagactgagatcaaactgtcaacaggattggttctgaagggtgtcagggagggatacgcttagggctttctccaagcttctagtaacctcaggagtcctcagcttctaaatgacatcctccgtgtgtctcacatcatctgatcctctgtacatgtcattctgtgtccaaat

SEQ ID NO: 184693 - DNA, 268 bp, Homo sapiens
tacttactcctcctttcccattcctcagctattttcaaccctactgagcctataggcatgatcaagtctctatcatcttaaaaaataaacagcaaggtgcagctgctcacacctgtaatcccagcactttgggaggctgaggcaggtggatcacttgaacccaggagtatcacttgaacccaggagttccagaccaacctgggcaaagtggtgaaacctcatctctacaaaactccatctctacgaaaaaaataaaaaaaattagcca

SEQ ID NO: 184694 - DNA, 337 bp, Homo sapiens
  misc_feature (3)..(3): n is a, c, g, or t
tgntgcagcatccattcagctaaccaccctatgtgatcctcatcttacagagtagaaaactgaggttcacagagaataagtattcgagtaccttccaaacatgtttattggccagaaagaaaccccctaaacagagaggaaaggaggctgaggtttttaaacttaatcttgcccacaaaacaatttgttcgtgccttgctctggctctagtgagttcttttgcaggccagggcaagcctgcctttcagaatgctgcctgggatcaatgagatggtaggctttgctgttaggcaggccgggatttgaatcccaggtcatcctcttgccacatgtttca

SEQ ID NO: 184695 - DNA, 172 bp, Homo sapiens
gtcttttgcatccctccttcccacatactgtgagggatacctattgagttgcctgccctgattccctctctgcaggaggtagcagccatgatggttaatgccaccctgccacctggtcacaggagaaggcctctgacccaagccagaccaagtgatctcactcccagaaatg

SEQ ID NO: 184696 - DNA, 536 bp, Homo sapiens
ccaacatttgctgagcccctactacatgctagtcgcagcactagacttggggaagtaggtgacaattgtggtccctgacctccagaaactcagtctggggtagacggcaggtgcatgaatgcatctgggatccgtccaatgcccatgatttctagtccctaacatcagcacatcagatctgacaatggatttctctgggagggagtatccgtcgaggccaaaatttctaaaatcaggaatgcagtgaaaactgggctgtctgatcactgtggtgataccctggtgtgctaagtgccctgggggacagtaaggtggcatgactaattctgcctagagggaagggagagattagatagacgtggcacttctttgttgcatcttgaaggatttgtaagattttaccaggcagacctgggagttgggaacccaagtgactagtgggtccctgatggagatgagtctgtgcaagggcccaggggcacagttctattcctggcacctcaaatggttcaatctcctgcttctttgtgttcaca

SEQ ID NO: 184697 - DNA, 505 bp, Homo sapiens
ttcgtgtgaatgtagctaacaaatggttgttgctgaagggaaaatttcaaactttgaagatgtcagaaacaaattaaaactacaatgtaatatttaaagagtttttaaactacagtaattttggaactactttaacaaggataaccaatcaattcagatgtgtaatttaaaagtacaaaatgcaaggtaacaggttaccaaagattttaaattaaagaaacagaaatttgtcactatgtatttctgaaccttggctgaaagtaaaccacacaaatcaaaaccaaagtgagatgccacctcgtgcccagcaggatggctattattttttaaatgcaaaataagtgttggtgaggaggtggagaaattggaacccttgtgtattgatggtaggaatgtaaaatggtgtacctgttgtggatccaacagttccacatctaggtatatatccaaaagagttaaaagcaggaactcaaacagatacttgttcattaacattcactctgta

SEQ ID NO: 184698 - DNA, 311 bp, Homo sapiens
ctaattcctgctggtctatgcaaggcaaggctaattgctatttcttgatttctatcttgaaactctcctatctcgaaaatcctaacatgttcttttatttgagctgtcaaaatagaataaaaatcttcatcatcatcaagaaaattcaagtatctcttttgtactttgctactggcttctaaaacattaattctcccacgtctgttccgtttttttttatggcaattttacctctgctcctcaaatgcagatgttgtctagcaggttttgcgtactcaaattacataatctctgtgggtgatatcatttat

SEQ ID NO: 184699 - DNA, 290 bp, Homo sapiens
ctttttccaggcaagaaaaatagactccagtgctgtaatttttttcactggaggagtgctaatgttgtatcaatctttacagtatccaaatacacaatgaacaaaagttagcccccataagagatgaaaattgtactacctggaatttgcacaattgtttgaaacattttcccgtttttgtgtgataaaagcacaatctagggtggagggttcatactaactggaagtaagtttgtcagaagaattaactttaaatacaatgctaacttggattaaatagtaaacataaa

SEQ ID NO: 184700 - DNA, 197 bp, Homo sapiens
gtctcttgtatttgagtcattgtattgttttgtgtttatagcatcaccacaactagtacagaaaatggtacactgaagtagactgctaccttaacagaaatgaaaacagtgtatagaaggcattataactatactcagtgacagaaaggaaatatgttcatgttgaatgaagagatagaaatcttggcagagaatag

SEQ ID NO: 184701 - DNA, 488 bp, Homo sapiens
cccaacagcttcgggactgtactaaagtgctctaaaaaaagttaacttgatctgtttaatttaaatgtcataatctggtatatagtactgaagggtgtgacaagcagagattttagagagttgattctcagaatttagggttggctttgccgtcccagcagtggattagttgtggcaacaggttttcttttttaaaaaaattagtgatgtgaacgtgcctttttaaaaacagctgttacttattgtgggccaaaccctgtacactaactgcccttctttcgttatgtcattggatagtttaaatgacccgaagagacagatggtatcctattttacacataagaaaacagattaacatatccagggtcacacaggtagttagggtcctgatagggatgaaaaaaatctagatcttgctgcctccaaaacccaactactgtacatagaaacagtagtcctgtgttctaagaaacaacagaatcgactcc

SEQ ID NO: 184702 - DNA, 324 bp, Homo sapiens
tctgaactctttcttgtgcaaatgaaatatctttagttattttagcctaagacttttatgcagaatttgggacacccttctttatgaaagactactttatactcactaactttctagctgctagagtcacccctaactctgtcttgtggtttttattcaagcttccgtcacctacacaaccaatgaccgagttctgtcctctgggaaacatccacaaaaaatgaaatgctcatcttataccattctatcttccaaatgtcaacatccttcagtttcttcctactttctgtcctcctactgtgctttcacatactttttttatat

SEQ ID NO: 184703 - DNA, 563 bp, Homo sapiens
agtgaatcaatttacttagagtcgtgtagatttttccttgtttcactcatttccctggtgaccactggacacagcatggcctccattaggagacagcatgtcagaatcactggaccaaatgatctataaattccctgctaactccaggtttctgtgattccagtggtatcttgctgttagaatagtggttctcaactggggcaattttgtcctctgggagacatttggccagctctgaagacatttctagttgttagaactgggggcagggggacattgggggaggccagggatgctcctcagcatcctacagtgcacaggagagcctcccacaacaaagaaatatccagccccaaatgtcagtagtgctgaagttgagaaaccttgctggagacagaagaaatcccattagacaattaattaaatgcaaccctatcccattagaacaggattagaaaatagtgtgattgggtactgctgcagcctttatttgtgaagtggaatttttgttccattaaggtataactgcttcttcaaaataaaatgtatttttttttaaacac

SEQ ID NO: 184704 - DNA, 209 bp, Homo sapiens
gcacctattacaagcctagacaatggtaaatgtgtttattggaggatgactacatggtggaaattcctccaaacacttgattgaaaagatttggggctgggcgcggtggctcacacctgtaattccagcactttgggaggccgaagcgggcggatcacgaggtcaggggatcgagaccatactggctaacatggtgaaactccgtctct

SEQ ID NO: 184705 - DNA, 372 bp, Homo sapiens
tgtgtgtttatagagagggtaagactatcagccactatatatatctaacataaaacttaccattaaccatttctaagtgtacaattaagtgaaacagcataaatatcaatcaagtatattgcccggtgtggtggctcatccctgtaatcccagcactttgggaggccaaggcgagtggatcacctgaggtcaggagttcaagatacagaaaaaaaaaaatagctaggcatggtggtgggtgcctgtaatcccagctactcgggaggctgaggcaggagaatcgctcgaacctgggcggtgtagtttgcagtgagccgagattgagccactgcactccagcctgggtgacagagtgagactacatcacaaaaa

SEQ ID NO: 184706 - DNA, 466 bp, Homo sapiens
ctctgttaaatcctttctgaatagactgatcttaggtttccctcttgtagaatccactttgagcaagaatcccgctaagtcagttttcggaaaatcccccacccttgttatctgaccaccctggatattatcaccctggcattggcttcagcaatgatcctattcagtcagctccttatccttgatgtttcctcttgatacttttctattcgctgatcccccaccttgctccttggttataaatctctgctcttccttgttagaatcagaattgagccaatctcttcccctcactccaagacctcattgcattagttcctccacctattgccatgggccctcttgaataaagtctgctctgccgtcttaacaagtatgatgaacaactttttctttaacaggcccatccacattataaaaggtaatgttttattcaaagtctgaagatttaaatgttaatcacatt

SEQ ID NO: 184707 - DNA, 244 bp, Homo sapiens
ccgggaaagggaatgctatgcgcagaggcgcccagtataacatgtcgtatgaagtccatgccaccccctttggcaggtgacaaactccccagtgagccgctgaccttctgagagcaggaggctccaagaagccacggggaagacccttccttcgtcagagacccaatgcctctatgactcctccttctcttcctgtccttggccaccagcctgtcctccatttctgccccatccacctctgctc

SEQ ID NO: 184708 - DNA, 427 bp, Homo sapiens
gggcaccagccattcagtattcaccgaagaacaagagacagaagggagaagccgagggcgccgtgccccctgtccaggctttctcatccacaattgttttgctcacaggggaaatgtgaggaattccttgcaggtggctgagaaatgaaaactgaagattgctggattcctgggccctggacggccagggctggctgctccacaaggaactcattacgaactcacggatccagactccatcctcagagaacccgattcagtactggggtgggcccaggatctggattttaataagcttccaggtgattccgatggacagccaggttgacagatgggcaaacagaggcccagggagagcaccgagcttaggaaaaccccagtagctgcaggtagcagagcctgggacttgaatcccggtgtcaggact

SEQ ID NO: 184709 - DNA, 511 bp, Homo sapiens
tgcctcctgggctcaagcagttttcctgcctcagcctcccaagtagctgagactacaggcacacgccaccatgcctggctaatttttgtattttagcagagacagggtttcactgtgttggctaggctggtctcgaaatactgacctcaggtgatccactcaccttggcctcccaaagtgctgggattacaggcatgagctactgcacccggccggttcttgtcttgctatcctagttctgtaatatattgtccttcaaagtgacttctgcagcctctgtgcaataagcattagggttggaactgttgatagatccagtaagaggacagataacaacgaatgccttgttagcaaggttaactagtatatttgatcataattagttatccatttgctttattcttccaatatgtgaataacaaaggtattttgtagcttctgttgtttcctgccacaatagtgtgttaaacagtcatacttaataataaagttagcagatgatgaaatgtta

SEQ ID NO: 184710 - DNA, 235 bp, Homo sapiens
caagatcacacatacacccagagctgccacatctgtgtggaaaacaaaacagttctcaaagtaaaagccagttgatattcctgtcagggcaaatgtaaaactgttaaagaaaggaagttaactgacaaagaacacatgacaagggagatggcagacccgttttcctattccaacctggtccatgacacagttttcaaactacaggtcacaatccaatgaggggtcagtatagata

SEQ ID NO: 184711 - DNA, 654 bp, Homo sapiens
ccttctctttttgttcatactagtcagcaggagcaaaagcattctcttgacttggctttgtatcagtagaagttaatggaagttggccattttcccaccattgtttagtagaataaaatgtataactgtgttgactgaaccaagcttcattttttcttgatagaaattgtgtgagtattgcatctggtggttatggattgtgcttgaacacttttgtctagtggtgaccatatatgggttatgcctgctcaccattggctatttccctgaagctaattatgctttagggaaatgatcagtccagtacagtttgtgtactacttaatgttttctttacacagaagaatgagggaggttgaaaggactgttgaaatgattataaaactcattcattctaacaacaaacatttattcagtattttactagttgttgtcattgtgccaaagaatgcttacagcattctgaatgtgtccaaaatgaaaaacaagcaaaataatccaaatgtgatccatgaccatgtaacagatgcttcagatacctttcgaaatgttacttcttagagcagtcttgtagagaagtggacttgaccaccatgcccactgtttggacattccaggcagctgtattccaatagtaatgatagaaataataat

SEQ ID NO: 184712 - DNA, 469 bp, Homo sapiens
cgcacctggccacacagcagtcttgtttcctttactggcagctcctggaatggtgctgggcacaccctaggcacctgggatgtttgttgaatgcatgccaagtctctattgggatggtttggtctaactatcatgctggcttacctgtaaggaacagtggttctggaaccagagagaagagggttcaaaccctggcacccccacttaatcagctctgtgggacaatgggtaagacattttccctttctgagcctcagtttcctcatctgcagaataggaattgcaatatcaacattgagggttgttgtgtagataggagatggtgcagggggtgaggttagctctcagaaggtacccacaaaggatcagctgttattgtcattatccatgcatctgtggtgacacccagggttgtgagccagtactgtgggattgagaaggtggggatagagtgcctgctggacattgt

SEQ ID NO: 184713 - DNA, 605 bp, Homo sapiens
tgttttggcaacttacatcaatagctaaagagtgtacacaggcttaccccgttctgtaaatgctgtgtcgagttgtttaacccacagcagtaaacagccaagccaaagtcaagaggacaagtgctaacacactcatcaggaatgtatcctagcaatttggctgcagggaacaacaacaacaaaagccttgctcatgtgctttgcaaaccataccctgcagtcggcctgcttcaaaatatctggttctctagagatagagaacaaatctttaaggtaaataagatgctacaatctacagcgctggggtgctcgatctttcctcttcaactgttcatcctctggcatatttatttaaattgatcatcttctagaaaagctgcatgtcaactcatgaaaaaaatcaacagaaagaaaactagtgggctgttctgtccttatttctaaacttgctaataaattactatctctcattgtattgacactgtgttaggtagggaactagctatctgtaccttattccacttaaactcaccaagaaaagcagtgtttcattaactttccaggaactttttttccaggcaaggcgatatctcttgccctctttc

SEQ ID NO: 184714 - DNA, 241 bp, Homo sapiens
agggaagaatgaagttttttgtaacaaagtcataaagtatttttccctaattttcttgcatttcctatttatataaagtatcttgatcactgtgttgcgctacagagattttcaatggagttaatttgggagactgaactaatctctgaaaaagaaattgactagttacagttactttttggacactttttctgtattgtgaattgtgtggaaatgtacagaataaaaatgaagaaatgta

SEQ ID NO: 184715 - DNA, 137 bp, Homo sapiens
gacctgcaagagattagtagtggtgttccatagccttagacatttcttacacttttatccacagataagaaaaaaatagtgatatttgatttgttttgccaaggcttagaaggatctaatatgtgttactcgttgag

SEQ ID NO: 184716 - DNA, 179 bp, Homo sapiens
gtgtgactggagctgaaggagtgacggggaagagttgttggaggtgaggtcggagatttagctgaaaccaagaccatgcatgcatggcttcttggaagttgaaaagtactgtggtgtgaatagttgtttctccctaaagtctttgttgaaatcctaactcctgagatgatggtgttagg

SEQ ID NO: 184717 - DNA, 1156 bp, Homo sapiens
accgtgttagccaatctcctgaccttgtgatctgcctgcctcggcctcccaaagtgttgggattacaggcgtaagccactgtgcccggcccaatttgaggattttctaaactatacttgctgtatttgatataaagaaaataaatagagaatacagaactgtagaaaaaatttcagaatcaaatggtttatcctcttactccctctgactgaagctcattttttctctgaagcctgatctgctgcagaaatgctaaataaaatcgtggaagtaatggtgtttaacaataagaaatcactatgcgtgattacttttttgtgatagaaactatttttgaaacattaatcaaagatttttactagctggattataagtattttgtggaaggtaaagattatatagcaattgaatatttttctggtataaaattctccccatctgaaatgtatttcgattatgccattatttcaatgaaaaataaaccattgattttcgtatatttggcctgcatctgttttgctccatatggtgtttgaggagaggtaggtaaataagaaagatcctgtgacttaggatgctaagattcttacattgcaatttagtgagtatctcaaatcttaaacatttgcgaatgtttaagattttatttctgatactaaaatatgatgtacatttaatccctattcagtatgttaaattttgacagcatacttatttctaatgattatataaaatgtggcttgtatttatttatatttaatctccctctcctgagctatcaattctacttttgctactgtctgctggtgtgttgggaaggaaaccttaggaagccagaagtagtgatatggttttctatctagttacttctttggcatctcaaatttagtataggcagaattgacctaatcgtatttcttccctaaacacaattctcttgtattccatatttctacttaaggctgtcatcacttttcaagtctctcaagctcaaagcttaaagtcacttttaacttcccctattattgtgaagtctgtaatgactctcctcacttttactactctcacaaggactagtttatgttcttggcaagtaactgttcaatctagtggatcatcagaatcacttttggaaaaaaaaaaaaatagattccag

SEQ ID NO: 184718 - DNA, 252 bp, Homo sapiens
gacacgacatctctgtcctcactctgctcagtccatgcccccaaaccaacttctgattaaaactcagcgcaatagacataggaataccaatcaacagaagtaggccctattacaagttaataaattggtctccgattttggtatcagtgacttctgggtttgattagagtatatcagtccactgagcttgaacttccatttaggctgaggacctggacagaagtaaccacagtaaggtcctgccaccccatg

SEQ ID NO: 184719 - DNA, 360 bp, Homo sapiens
agtactaccccacgacctcctacccccacctcctacccagtatcaaacaattctcctgcctcagcctcctgagtagccgggattacaggcatgagccaccacacctggctaattttgtatttttagtagagacggggtttctccatgttggtcaggttggtctccaactcctgacctcaggtgatccgcctgccttggcctcccaaactgctgggattacaggcgtgagccaccgcgcccggcccctctggttgacttttaatctgagttattatactcttcagctccataattttgatttcgtgcttctttacaatttttatctctttattgatactctctgataagatgtcattctca

SEQ ID NO: 184720 - DNA, 195 bp, Homo sapiens
atgagtaggtgtttttctaatcttcccttcagagacaaggcactaggaagtgaagtgacactcgtccagccacccggtagtgaagtggtagagtcaggctttgaaccgcaagtcatttcagagtctgcgtctgtaaccgatctgagcctgatgtttcatgtgtattatctgatctcattctcaaaagactccatg

SEQ ID NO: 184721 - DNA, 429 bp, Homo sapiens
tgctgccaagggtgagtggggagtctgggatggagccgggggctgccgagggaccgcgacctggaggggccccggggagacggttgagggaaccgggatagtcagctctggaatggaatctgaagcaaatggaggttgtcgaactgagggcctgaaggctgagggataagtggaggccgaggaacgagagggagagagcgagagggggaggcttgaagagcccagagcttgggggcttttgaaagctgcgcagtgggggaaaaagatcgaaggtcctgcgggaatgtggacccggaagaagagatgctctgggtttggcagcggggatgaggagtcagaggagcaagacctgggccggtgttcccttcccagggcgagggagggcgatcggggctgggactggagccctctcatggggttctcctctta

SEQ ID NO: 184722 - DNA, 153 bp, Homo sapiens
ctgccttggcatcccaaagtattaggattataggtgtgagccaccgtgcttggccaaagctcacattcttaaccactgtgctatatctgactagctgactaaaggctaagtgaccaactaactaacagctgtgtgaaggaggggcaaagaaag

SEQ ID NO: 184723 - DNA, 152 bp, Homo sapiens
agaccaaactaacacaagggcccagcagacacacgctcctctagccataaccttccttctctcttcagctcaaccctaccctctggaaaggtatccccgttctaaaaagatctccccggctagtccaccctgaagtaaagccctgcttctct

SEQ ID NO: 184724 - DNA, 139 bp, Homo sapiens
actcaacatattgtctgggagatacatctttgttgttttatcagtagtccatcctttttattgctgtataaatataccacaattctgctggtggcatttagattactttgtatttggggctttaatgagtaaagctgtt

SEQ ID NO: 184725 - DNA, 129 bp, Homo sapiens
agaatgttcccccctcccacctaacttttataccaatagggtttcagtacaacagtagagtgcagctaaacaaacaacagatagacttgttattcaaaggaggagaacttaagaaaccccaaatcaagg

SEQ ID NO: 184726 - DNA, 222 bp, Homo sapiens
tttttttcctggtgccatataccttttctttagaacttactagccgttttgaattttcttcttttactttataaagaagcaaccctattaactgacttaccatttgaaaggatgtttgtaagaaacacataattacacgctatatggataaagaaaactagtttaagttagaatgaatgtctagagtgttgaacagaggcttccaataaatatttcccggat

SEQ ID NO: 184727 - DNA, 369 bp, Homo sapiens
gtctctggaagaatgagtataagaatagaattatttctttcttgaatgttggatagcaattactggaaaagccaactgggtctggagttttctttatgggaagatttaaaaccattaattcaattatgttaatatctattggactatttagtttttccgttgtctttatcagttttgataaattatattttcctaggaatttgtccattttgagtacatttcacaaattatttgcttgaaatattcatgatattctgtaaacatctttgtattgcctgcagcataaagtgttgtctcagttttattcctgacactagttatttgtgcctcctccttctttcttgtggtctttgtcagtagttcaagagc

SEQ ID NO: 184728 - DNA, 265 bp, Homo sapiens
tggcccatgcatctccagagaccatgaagactgctcaagccctacataggatgtggatccaggctgttaaaaagttgaggagatggaaaggccgtgtgagtccctctgcaagctctccccttgttttccccaacctttcttcatgggaaggggagggaagcaaaaccattctcacagtgagtcctttatcctcagattgatttgtgcttctggcatctttcagcaacaaattgtgagattgtaggttgtagtcactggtgggttt

SEQ ID NO: 184729 - DNA, 580 bp, Homo sapiens
cttcacagtagtacctagattagtgtttgattgaataaccacaggagggaaacctcaggggagctatttttagaattctgccagccacatctgacaagtctggtggccaaactttggacaaaccctaccatgtgtgacactgttgtgaacctggaaataaaggtgggaaaaggcaactatatgggattggtctgtttttgtattccaagggcccagtaatagaaatggcctctaggcagcaatgactatcacaaaccccatgtgcttggttgaatagaaaagacagagtcatggcctcatggccatagctgaagctgtctcatccaagtaagacagctaggacaacctgatacagcaagaagtgtttgctggtagcagcagcagaagaaagtatactataaaagcacagtgatctgggtttacatacttctgtccttcccctgatgacagagcaccaaatagtaatcatgagcctaaattgacaaaagaagttaagttctatgtactcagtctaagagcagaaaatctataagcagttctctctcatcgatggattcactttccatagttacctattaaa

SEQ ID NO: 184730 - DNA, 640 bp, Homo sapiens
tgccaaacgggaaggcaggttctcaatctggttcaaggatttaccagggactgtttccagcttgaaggttgggtttcaccagggacctgccccatctgcctaggcatttgtctgcctcccgcctctatcattatcacctgagtaatgtaaagtgctgttctttttttaaaaaaacatatttattatatttgtgatctctcttacccattagaattaatttcttgaactcctggactcaagctatctgcctgcctcggcctcccaaagtgctgggattacaggtgtgagccactgtgccaggcctagaatgtaatttctatgcaggcagagatttgggggtctagtttatttgctgatgctttctcagggcctggaataagccggacacttgacaggttttcagtgaatatttgttaaatgaatgaatcaagaagccctcattgagtgtactctcctacctatatctagactctaatacatttttattttttatgattccatcatttggggctttaaggttgttttcccacccccctttccattgtgtatatgtttctttttcacctaggttcaagttttttcccataatacattattataccaggccatccagtctgggtctcacctcaccactcacctg

SEQ ID NO: 184731 - DNA, 213 bp, Homo sapiens
gaaagaatatctgcttagtttaagccacagccctagctgatgaacccttgctctcaatggatgtagctctcccattcacctttcacttttctgagatgcatttaaaaccatttgaatccaaaggttcaagtgttattttaaaccactcaccaccccatcccattcagtgcctatcaaccacttccaaaagcttcctctgaaatcagtaactca

SEQ ID NO: 184732 - DNA, 267 bp, Homo sapiens
ttaatagaaggagactgaaagggagtataaatccccaaaacagttgagtcttcattttgctgatactttctgctattctcatttacctaaaaaaaataaaaatataccccatgcaagaatagtgatagccagaattacacagaaataaagacctatagataacaagcattggtgaagatacctggaaaagggaacccttgaacattgtcagtgggagtgtaaattagtacagccattatggagaacaatgtggaggttcctcaagaa

SEQ ID NO: 184733 - DNA, 444 bp, Homo sapiens
attctgcctccagggtctgtgttcttaaccaatacactatattgtgttgtaactggatacatgcaataagaaggactttaattcccaaaaaggaaaagtggatgatatatgctgaatccctactatataccttatctcatttcttctaaaaagtaatttggactctggaatcagggcataccttgaaagttatcctattattaggagtaaatgagatacaccaagtataaagcataacaccttacacaaagcaattactcagtaagtgtcaagtgtcattattttttcatgacaaatttggagtgacagtctagctgccaaagctgagaaggaaagaaattctacctagcagtacttcatgtgcaaaaaaacacgacttgaccactagtcaaataaattgcagtaccttggtacagcaaaaattcaggaatagaaggatgaaaa

SEQ ID NO: 184734 - DNA, 305 bp, Homo sapiens
gatgtggggtggatgacgattggatacctagaagggaaagttgactgcacagggctacgcagtgaataccctattttaccaggtcagctgaggctaaattctctacttctggggtgggggtactaactgaaatggttcactgaggagggtgaaggtttgtaagggaagatgtaacaatacttttttaaaagcacctaggacaagttttagggtgttgaatagcaccatttaaaaattataggggtatccagcaatttatggagctctgattgagaagtatcattgttaggattttattacccatt

SEQ ID NO: 184735 - DNA, 176 bp, Homo sapiens
accaacaacctgaatgaacttggaagcagattttcccaggccctccaggacagaagacagggctgttgatgccccaattttagcccagtgagacctgttgcattctcacctacagaactgtaagataataaatggctgggtttgttttttgttttgttttctgagatggagtcttg

SEQ ID NO: 184736 - DNA, 594 bp, Homo sapiens
agtggactcattcactggacggtgctactgtcacagaggtgaggcatgcggctcacactgagccaccgcaggtcatgattgggccagcaggtgcctgtgaattgcctgtgacatatgagcagaagactccatccatgggaccccaagagcccgccagctgacaggcacctgaggaatgtggcacaagtagctcctcacatagaagtggccagctttggggcccaggaccctgctcatcctgcccacagctgctcagtctagggatcggccaaaggcagttatcaggccgactggctgagtggtaaagaaactggctcaatcttgtcatcctagggcaccaggaatgtgagggtgggcagaagaggacatggtggcaaaagaagcaggtgagtcgcagaggctttttgagccaagtcaagtcaggagaacaggttgcagtcatcacttgtctgtaagagacaagatgaccagatcaccagggttgctgctggctcctggatggccacaatgtgcatggcagggccccgcaaagccttgctctacagttgaagcttcctgaggatggcagtaatgaatgcgtccgtcgaagtaatc

SEQ ID NO: 184737 - DNA, 159 bp, Homo sapiens
agaaggtgggaacctgagggtcctgggctggcagaggccttgcccccgctttgcctagggaggcagtgagcttcctccttcatttgaactttgccctgaagagctgggccttccttgttcatggggagcctgatgcttcttcccagcacaccacagcca

SEQ ID NO: 184738 - DNA, 492 bp, Homo sapiens
gatgacatttcatcttaggaatgtgccatgattttttttcaactggtcctttttgttctttgcctctactgcaatattctgctcataggaataatagtacaatgaacgtctttgcaaataaatttgtgtgtgcatgtctgattatctttctagaataagctcttagaaatggagttactgggtcaaagatcataaacattttagaggcttttggtacaagttgtgagattgcaggtgacaaatgaccttctttccttaaatttagaaaagttgttttggggctataaatttgggagaaatgggtcatctaaatcatctgtgggaatttgtgctttcatagtttctgttacagaagtcaggcttctctaagcttgctggaggcagtgaacacagagaaaaagaggaaagacaaactttggagattaaattgtagctacttacttgctttatgaccttgagcagctatttattcatttttctcttctagttaac

SEQ ID NO: 184739 - DNA, 671 bp, Homo sapiens
actccagcctggttgacagagcgagaccctgtctcaaaaaggaaaagaaattttatgagaccactcgtatatgcagtctgtcgttgactgaaatgtcgttatgtggcatgtgactgtactcaccagaaacatctggagttcttggactgattatgatgagttccagcacctctcaagatgctctcagcctcagacctctgccagcccctccctggtggagaagccttctgggcttcaagcaccttgctcaggatgcgtgtccccttctgaaagttttagggttaagtgactcttctagctgtgtgcctgagggtcctggacatctcaggagtggggagttggcagctgaagaattcctgggagtctgagcctgggctgagtttgggatcggctcctgaaaacccttgtaaagattttacattcccgaatataaaccaataaagacagcaggctaaatcaaggccatgcccatgtcttgggcacattccgaagatggttgtggtgagtcccgcaccattaattcccttttgcgtctcattcctgcctctctggaaacaagcaggtccatgagatgcagttcagtgggttttgctgtggttcagtggggtttccctccctagacaccccaggagtgcaggtctaaggtttggaaatactttcctttctacata

SEQ ID NO: 184740 - DNA, 426 bp, Homo sapiens
ggagaagaaggagatgaaagcatccaaaatgggccatgtccttccatttcacattcagaatcagctctactgctgagacccctatatgtaacatttatcctgttatttggaaaatggtatggtgtgtttgaagaccaccctccaggcagtctgaaactccagactggaggctcagctcaaaccaaccatcacaaattatatgactgcacaaatcaatttctctctcttaacttcagttcaaacatcttaaatgtgagtgcagtggactagatcagaggcctcagaacttcttgtttaatacggatagaacacaagtatatgaaaagagataaaactggattggacccagagcaatcctaaggaaccccagggctctgtgtgactcagtttccaaaccgctagatcaagagattccaaagacattct

SEQ ID NO: 184741 - DNA, 408 bp, Homo sapiens
ctcactcggtttccggacggtgcacaaaaatgcatgtatactgtttttatatttacttactctattattccatgggtgctcttatttcttcatgtgatttgagttactattttatgtcctttcatgtctgcccaaaggactctcttttagcattttattttgaggcaggtctgctaacaatggattctctattttggcttagctcgcactgttaatttcatcttcatttttgaaggaaagtcttaatttctttttttctgtttctcacgtgggataatctcaattggcctatcttcagatttggcagttctctcttcttcaggctaatatctgctgctgagcctcaccagtgattttttttttcatttccgttattgtagttttcaactctagaatttctatttcact

SEQ ID NO: 184742 - DNA, 391 bp, Homo sapiens
gaaggtggggtccccacaagtttgtttatatatgagaaataacattttcaggaatgagccagtggagtggggaaattgttgggagattaagtgtgccagctgacggtgggggcccttgagcaaggtagcagaatggagtagatggaaacatggtgctgagtgggtagatgggagccgagtccaaggtcttctgatgtcgttccttttcttggtgaaataggaagttgggccatctgctgcgatattaaatgagggagtgttccaggggtaatgagagtgttccaggggtggagaaaagagagggaaggtgtgaaatggtaggccgggaaggagaagaatggaccagggaaaagtagtttgatttccagacagcattaaggacccacctgcg

SEQ ID NO: 184743 - DNA, 453 bp, Homo sapiens
tcagaaagaaggcattgagaatgaacagaggaagagtgcagaccctggactgaagggagaggaagctgggaaccctgcatggggttgctgagcactggaactcactcctggccctgagcagctactggagaagggatgaattaaataggcatggagtggccccctctctccatggacctccaggatcctagctgcaggagaagccataaaccccctggtcatttgagctgatagggagagctgcttggagaattgttaaggacaagactacagcttgtgtccagcccagagtgtttggcacaggagaagctacagtggaacatggccaaaaatgcccatctctcaaagctcaccatgctcctttggggtagctttggctttgttgactgtcagacctgaacagaacaaaactaccttgcctgtgagatgaggccagtctgatctgagcacccc

SEQ ID NO: 184744 - DNA, 475 bp, Homo sapiens
gaccatgatcaaaggattcaaaggtcggcgctagatatatatggctaccactgatttatggttggttaagaggcatttgaggggaaagatctctttccagagacctaggaatctatatgaagaatggtttcctgtttgggaactatatatagaaaaagttttgattagtacatttttaaatttaggtgttgggcgataacataccgtatttatccccaacaccctttttaatgatacaacttacctaagttttacagaaaagcagaaagcaaaaaagaacaaaatttaaaactacctgaaatttcctctcccagatatgtagttttgttctattttttgctacttgtatgcatatgtgtatatacacacaaattaaaaattgaaaccatactgtacatattgtcttagtgatttcttcacctaatgatatactgtgatagtgttgggcgataacatatatctatttcttcactac

SEQ ID NO: 184745 - DNA, 686 bp, Homo sapiens
atggaatgccagttttctcagaactctcaattctaggccatgcctgtgtctggtttctgtggctagactcaaagaggtttttgatagtgcctaaattatgtttttccttatgatttcaggttgaagtcttggcctcggaggatgcagcctttggactcaagttttaatctcctcataaaaggataagtgtcttttcttcagtcatcttaatgtgttaacctgcacttcatatcatcatgattttaaaacatgcattgaatgctgctacagtccaagaataacaacgcctgtggcctccaaggagtaagggacccctggaacatcagcaccagcaaaaggaagagagacactctcagttgtggggtgtctctccctgactcagcccccacctcactgagggtcttccatccccacagtttccatctcagatgcccagaagaatgggaggggccaaaggaggtccactttgtatatcatcaatgaaaccccctgtacccagtcccccaacaaggaagaacaacagataactcaatttaaaaaatgttacttgtggctgggcatggtggctcactcctagaatcccagcactttgggaggccgaggcgggtgggtcatgaggtcaggagtttgagaccagcctaatcaacatggtgaaaccccgtctctactaaaaatacaaaaattag

SEQ ID NO: 184746 - DNA, 618 bp, Homo sapiens
agtgcgtctgctcacacaggggattgcacagtggcccgagggacaggaggaccgtttccactctgctcactcacactactcagccactgagcagctggttagacacagcccatgctggagacctctgcggggctgtcagccagctcacctgcacatggcctctccttggggcccttgggcttcccttgggcccatgcttcccttgggcagcatggcagctgcgggctgagagcagttacccaagaggcaggaagtgggggctgccaggcctataaaaccaggcccagaaactacctcagggtcacttccacctgatcctattggtcagagcagccaaggccaccagcttcaaaggatgggatagatagaaccacccttttgaggagaagtgtcaaagagtcaaagaacatggggccaattctaaaactgctgtagatattaaacagcataccattaaaaagtaaactaaactaaaaagtaaaccaaagattgtctttggacaatcaatgaagaaaaaaagccactagggaaataaaagccatcttggaagcagcaaaaagagacaaaactaccgaaaagatagggtagtggaagatttctgtatgaaaacaaagcaaa

SEQ ID NO: 184747 - DNA, 869 bp, Homo sapiens
ccatcctccaaaactcccctgagtacatttgtagttaactctcttctccagcccctggcaatccttgatctgctttctctgtagtttgccttttccagaatgtcatatgaatagaagtatacagtatgtagcctttggacctggcttcttaatgcacataatgtacagagatccatccacattgtgtgaaccgtgcttgtctcctttccactgcaggaggtatcccgccacatgctgcattccaccatgtacgcaaaccacagcttgttcatccattccccagtcgtgggacagttacgtagtttccagttttggcaaatatgaataatgccattatgaatcccaagagcacataaatttccatttcccttggataatatctaagggtgggattactgcgttgtatgagaacatgtgtttagctttataagaaactgctcaactattttccaaagtggttgtaccattttgcattcccactggcaagggataagagttccagctgctctatgtccttgccagtacttggtggcatttttgctttttttccccccaaagccactcccctaggtgtatagtgacataatgcagctttctataagtttgctataatggtgcttacgacacgccaggtatcatgctcaatggttcacacacatctcaattaatgctcactcaatactacacagtaagttccaatgttttctctgcttttaaatgcatctaaactgaagtggcatctgaaccaaggtcaaatgaccacagtacacgaggccttaaatgagagccctcctgggatggtcttatttactcctgcagggattctccacaattctctcaggctctgactcaatgttacctctttcgtg

SEQ ID NO: 184748 - DNA, 412 bp, Homo sapiens
cctgccttggccttccaaagtgctaggattacaggcctggccgcagcctgcattttagaaaggcctgttatgctaaagcgttcatatgtatgaatacttaggttgagccccagcagtgcagcctgtctggcttaccccgtgtggtctctggtgttagggaagcagtaacgttctgttattgccacgcaattgaggagcgtgggctcagtcatttcctaacatgtccataagccaagtaggtgtgtagaataattattttgccatgtttcaaggtgtctttatattaaagagtgtgcatgtgttctgtgcactcccctcgcccaatagagtggcagcctgagaattgaccgttatgagatgaagaatgtttgacaacatgcctgactttcaagtccccccaactcctgttaaa

SEQ ID NO: 184749 - DNA, 964 bp, Homo sapiens
atcacttcccaagattagcatgtctttaaactaataatacatcagggaattttatgctcttggtgccaagggggccatgtgtaaacacgcatgcacacacacacgcaggaaacatgaggtctaattttggctgtggtcataactactctgttaccctgggtaagtcaggtaacctgtgaatgtctcagtttcttcatttgtgaaatattttgatagtttcaaagttctcttaagttctaacattctatgattctgcctgcacagccccatctaggcaataagacctatctcggatgaatcagggagatccgaaaaggtagtatttgccaaagacattgacaaaactggccacttcttatttctgtggagactctgtccaccacacaaaacccttcttcactctcttcatcttctccataccaagacatcaagatatttgacaacagggtgggtgctggcaccagactgtctgccttcagttcttagcatttcttattacttgactgatattgaacattaaagctaggtgcctctcttccctaatttgtaagatgggtctagtaacaggaactatctcatagggttatttgaggattatgtaagttaaacatatgtaaaatgcctgacgccaaaattgtaaactgctgttcttaccattgatgaaaaattcccattagcctcatgctatctacaccagtgctgttcagcagaaatttctgcaatgaagaacatgttcatatctgtactttctgaggtcgtagttatgagatacatgtggctacttgcatgcaatgtggctagtgtgaattggaaatttttatttaattttaatttaaatagtcacatgtggccagcagctaccatattttatggtgtatcgaggccactaataacttgtcaagtattttgagaatgacttcacaagggattattattatactttatatttatatgtacaatttta

SEQ ID NO: 184750 - DNA, 438 bp, Homo sapiens
cttaaaagagttaaattctaatttaagaagacaggcaataaaattgtaaataaacaaataacttttggatgtcgtttatgtgatggtgagtatgtgtggagatttcttagtacttatgctgttcttaccattgatgaaaaattcccattagcctcatgctatctacaccagtgctgttcagcagaaatttctgcaatgaagaacatgttcatatctgtactttctgaggtcgtagttatgagatacatgtggctacttgcatgcaatgtggctagtgtgaattggaaatttttatttaattttaatttaaatagtcacatgtggccagcagctaccatattttatggtgtatcgaggccactaataacttgtcaagtattttgagaatgacttcacaagggattattattatactttatatttatatgtacaatttta

SEQ ID NO: 184751 - DNA, 352 bp, Homo sapiens
gaaggataaagtttgtgctgtgcattgcccaaaaacctgtcatgactcccttgagagtctagatattaagggtggtaggtgactgcaataaaaaagtgtatgtgcttctctgttgtaacttagaactctatgatgctggcctgcaggtgcagaggcagaaagagaatcatttcttaactgtagaatggccatgcaatgcgggccttggttctgttactctcctgtattgttaggtttcattcattcaacaagcattataaaagtgcaagtgttggactgcaaaaaaaatggggatggggaagatctgtctaggcactgggaacttggagaaggaaggcactggcagctcagg

SEQ ID NO: 184752 - DNA, 211 bp, Homo sapiens
tgttgggttggctttgtcccgaattgcctggaagttcatcttctgtctagccttagatcttgttgctaaataatttgggggacaaggacgtgagaatcccctcagccaggagtcagtctatatgcagtggcaggggtctagacagagtccccagagccaggggtgttgggagaagccccgagaggcagcccctctccactctgaacccggg

SEQ ID NO: 184753 - DNA, 434 bp, Homo sapiens
aaatagagaataaatacaggaaagatggaaatggacatatcacttgttttgcagatgatataaaagtgtaaatagaaaaagcaagattaaccaaatgcataccactgctatgaagttagaaaaggcaatgaaaaatggtgctattcacaacattaaagaacatctgagaatttatatatctagataaatatctagtgagataaaaataatacaattataatgggaaaaataaaggaatacctaaagaaacaaagttatatccattgctcttgatttagaaaatttagagtaataccagtaacattaatccataaaacaaaaaatagattaacataataacaattatattcctgcaagaatactctagaatgtgataaatgactggcaaaattaataaagaaaaataaatacacaataattccaaagaagattgc

SEQ ID NO: 184754 - DNA, 501 bp, Homo sapiens
ctcagctcacctagtaactgggattacaggcacgcaccaccatgcccagctaatttttgtatttttagtagagatggggtttcgccatgttggccaggctggtctcgaactcctgacttcaggtgatccacccacctcagcctcccacagtgctgggattacaggtgtgagctactgcgctggcctggaattttgattctcttattttgtataccatattttctagataagcaaggttatgcccttttgagtttttaatttttttctcagctatttcatcattcttttaatacatattttttaatttgcgtcttatccattatttatggagtgttttatactgtattttatgaaatccatagtatcagcaattacatgacaatgtttatgggacactaaaaaagaaaatcactgacagtaaactgtgaggtgccatcagtaagacacattccaatttcagagatgttaaaatggggagaaacgtacaacttttagaattga

SEQ ID NO: 184755 - DNA, 284 bp, Homo sapiens
aacacaccacaagggtgcaatccacaaatccaggctgtgggaacctctatgggacaaacaacccagtttcttcaacaaatacatttcagaggaaaaagaaagggggaactagactaaaagaagggtcagagacgtctaacaaatgcaatgtgtggattttggatcatgatgtcagcaagacaactgtttaaaaaaaacaactataagacatgtggattgtctgaacactgctacatattggatgacattagacatctttttaggtgtgagaatggtgttgccgt

SEQ ID NO: 184756 - DNA, 493 bp, Homo sapiens
gaaggggagtaaaggaaggtaatggaggtaaggaagagaggaagggaagaaagtaatcttacaaaacaaaggaaaagaaaatgtgagctgacaagcattaacactaaacatttgttgagacatacacaaaagaaaactaactggaactccacataactcaaatagtttacatacatttatgtaaatattagtttggagaaaaattaaaatccatttgaatataacacctttatgctatatttatcattatcagatttacagggacattaatctgtatttaacttaaagagtaaaataaaccaaaataacatacagatactggtattaaaaaaaggtatagcacttaccaaactgaaccaaagttaaaaaccacaaaattttttttgaaaatagctttttagaaaaatgtttaaaagattttaatacctataatatatagataaataaaataccatgcatatataaaatataataagttagactcaggggtctg

SEQ ID NO: 184757 - DNA, 312 bp, Homo sapiens
agtcccagactccagactcccatggtacacaggaccatcgcctgtggtggttccaggaaagaaatcactgaacactgggaatggcttgagcaaaatctcttgcagacactctccatctttgaaaatgagaatgatatcaccacatttgtgagaggaaaaatacagggcatcattgcagaatacaacaaaatcaatgatgtaaaggaagatgatgacacggagaagtttaaagaagccattgtgaaatttcataggctgtttgggatgccagaggaagagaaactcgtcaactattactcttgcagctattgg

SEQ ID NO: 184758 - DNA, 426 bp, Homo sapiens
ataggtagggtcagcacactttttctgtaacagatcagatagtaagtttattacgcttcatgggcaaagagaccaaatcgaggtatgtaggtactcatgagatgattacataatgagaaaaagacattttccacaaaatttttattgacactggaatacatttttttttgtaatacaggtctattaatgagaaaaataaaataatttgtggtgggggaataataacatttcatttaattggagttcagactgagtgttcccatcaccaacattgattgcaaatgtttattaaggctgatttgtaataagatagattttacgtatttcacttttgaaaatatcttttcacacagacagatactgctgattcgatgtcagtccacagttagataatttgcattgagcatcttcattgcttagaagacg

SEQ ID NO: 184759 - DNA, 463 bp, Homo sapiens
  misc_feature (26)..(26): n is a, c, g, or t
  misc_feature (29)..(29): n is a, c, g, or t
ccataactcctcatcttatgctggcnagntaggatatgctagaaaatttgactcttagagtatttactttctttctgtagcttcatccatgctgtaattttttactgattgctagctacaggccacgcgaataaggcagttgtggtaatagatgcgacatgggccctgctctcatgaagctcccaattcagcatggtgggacaacaataagcaagtgagcaggtacattactacctgtgcctcattgcgagtgctcagtgggtcacacagtgacttgataacagcacctctctatgttcctcatacatatgacatttgacatttattgcctatcacactgtacagttatttaattgcttttatgaaggtattgatatagtttggatgtgtgtccccacccaaatttcatgttggattataatccccagtgttggaggtggggcctggtgggaggtgactggat

SEQ ID NO: 184760 - DNA, 912 bp, Homo sapiens
agccccactccagccccagccatctgtgctgtcttgataggggcagacctggccatgcagcagggctatacagacccttgcgggccccggcttcctactgacattctcttcccaaaggccctggcacacagtgctgagcacctgggcactcacaactgcagctccaggcagatgtgtgagcaggttgcccatcaaaactccagctctgggccacttggtgcttgggttgggagaggcagatgtggcatggaggacaggcagagataggaaacccctgtgctgggaatggttctcttgggggtcggccctggccatagcctcccctatattttactggggacctaaggtgccatctacaactctcctttccttttgtagggaaagtccctagatctcaactttctcatgggaatcataagagagatgagacccagggttttttcagtctcttcccagctacagtccacatatttcctccacgtatgtttggaagtcaaaagacccttcagaaccctaaatccacccagtttatacttgttcctgggctatgtcatcctagtcccagaacctgggaagatgccaccatacctagaggaggccatgaggctgtcacatctaacattctgtggatatgacctgcttatgcgctctactggaagtatctgacacttcaagtagaattgaggcccaggcattgtcatctgctttctttactaaattatgccaagccactggaaaagtgactgcataaattacatttttcatatatatctgttgaatgaatgaacctcaaccagaacctctacagatacctgagtgagcctggggcccctccttcaggacccaagggaccactgttctttctctgtcaaggacaaagaccagttagaaagaatcacagacatcctttac

SEQ ID NO: 184761 - DNA, 519 bp, Homo sapiens
aaagtgctagaattacaggcgtgatccactgggcctggccaagaaaacatgttttagagctgtacgatattttgtcacatggatattatgtattttatttagcttcttcagtgaattttagagcagatactgctgagtgctgaggatacagaggcattctaaaatagatatcgttcatattgtcattcatggaactatcaggttaaaggctttaatcatatttcagttctcaaatcattatttgttttttcttctattttaaaaaatgttgcagagaagtacatttgtttgtcttaaaagtgaattatggctttcccatcctgctattctcccctctcagcctcccgaatagctgacattacaggcatgtaccaccacacctggctaattttgtatttttagtagagacagggtttctccatgttggtcaggctggtctcgaactccagacttcaggtgatccacccacctcggtctctcaaaatgttgggattacaggcgtgagccatttccattaaa

SEQ ID NO: 184762 - DNA, 583 bp, Homo sapiens
atccgatttttttgtcctctcaattgctgggattacaggcatgagccatggcgcctggcccgccccagtctaattattagtctgacataagtgtattttggataaactacttttcctaatattcttgctctgtgtttatgtgaaaaacatctgagaaccatgataaaggtttaaaaaaaaaaagatgatggattaatttacttaactgaaacaatgtgctgaggtttggttaacactgaaaccatccttcgtctgggatgtaatccctttttgtcccagaattcactgatttgaatacattttcgattttaggaaggtgtgagtttttttctgatctttttgctgtgttatattttgcagtatttgaattagtgtttgtggtgtattttgatattgcttgtaattttatgtgaatttgagaaatttaaaggaatttaagaaaatttcaaacacccatactttaagaaagattcttttctttggttcatatttaatacgtacttgagtggttgttttattatgcttaccacttcacgttttaaaaacgtactcagaacattgtgaagtacacttattttttagg

SEQ ID NO: 184763 - DNA, 570 bp, Homo sapiens
aaaatgacaaggtatttcccacataagcacttccttttttgtttgctataattagcttttgcatgtgttgctttctcacagataggaaaatggattacttaggagtttggacactaactggggttcagatcacctgggttctgatcttgaccctgtcccaaaggtgtcttttcctttccagaccgcaatttcttcactcttaacatgagagctttgaaggaagtgattctaatgctttctagcaatttcctcattgggcatgctgtgtcagggcatttaaatgatttcctgtgaacgcaccatgtgcgcttaaccctgcacaaactcaccagccacatagccttgacatttctttccacagcttggccacatttggctggccttaacagcctctggtctaaccttgaccaagtctgcatgcattggtcacttggctctctgcccttttccccttccagaactgaaatttgcatcagcctctgtacagatcagttctgagcacccaaatttctgagcacctactgtgtgtcatgcctggtgctgggggccctaaaggtgagtctgacccac

SEQ ID NO: 184764 - DNA, 173 bp, Homo sapiens
ctctgtctcccagttgagagcgcttctctggacatccacaaaacgtccatccagggctttggtgataagattggaagggcttatcataatccagctgcccattcaagacacagtaccctccacaaacaccaccgtgaccaagtcatggtctagccccaacttgattcaataac

SEQ ID NO: 184765 - DNA, 201 bp, Homo sapiens
tggtcgtgcgaggcgtgggctgacggcagctggcatgcagcaggggaggtgtgctgggaccaggcctggagtggggtctggtggccctgccgtgtatggagctgagtgccgcccagagatgccatcttgtcctcagaagtggctcaggcctgctggggacagggcaggtggatggaagctgctgcatgccctgtgccatgt

SEQ ID NO: 184766 - DNA, 390 bp, Homo sapiens
tgataatgtattatatactgtgttcttacaatcaagtaagctatagaaaagacagtgcccttaagaagatgataaggaagagaaagtacatttacagtaccatactggacttattggtaccaaaagtttaggttgtatgtgtatgagatgaattgtctgtctgaaatggcgggcaactgcagccgcagacctgaagtcagttggtacgtttcaaggaattcaactttttcttgtaatgtcatgactttgcttcttgggagcacttccagcatcagtggcattccctgtgggtcctacgttttactcagtgtttatggtgttgcactaaacacgatgaaaaatatgtgagaacaaggagagatcactttttactgtgacagataatttact

SEQ ID NO: 184767 - DNA, 295 bp, Homo sapiens
taaccattcatctttgcagacctccgctgcagggaggccagtgtttgatccggcacactcgaacaggtcatcagggagaaaatggccctctgtatttttaatgtctgatgagaaaagacctccatgcggcatgtgtgcgcccacacatatgtgcaaatggcacttagcatgtgccatgctgctggatgctggcgtgggacattgcagttcatgtaactatagctcaacccaccttatttaaataaacttttgggggaataattttagatttacagaaaagttgcaaagaatcgta

SEQ ID NO: 184768 - DNA, 369 bp, Homo sapiens
tgtgagccaccgtgcccagctagcacagagaaatctgaataaagggaaagggagcctgccatgtggctctctgggaactgtcaatccaggaagaggaaacagcaatataaaggccttcagccctggcctgggaggaggtcttctgcacgtggagctggggaggagtggaggaaatgagttggagggtgggggtgtggaatgagtcaggattatttaagcccttatgggtcagaggaagaactttgagtttttgaattttaatctaaatgtgagaggaagccattggagggctttgagcagagaaataccagaagcttacttatgtttttaaagggccgctcttacagtttcgtggataataaagtgtag

SEQ ID NO: 184769 - DNA, 441 bp, Homo sapiens
acacatacattcacacaaacacgtacacatacacacaaacatgaacacatacacacacacatcttggctgttagccttttcattaagctgacttttaatcatggagctccttacacaaatttgttttttaaatcttattaccatatttcagctaggacaaaatgctgctatttcagaagtacagccattgctctttcagtctggtctggctggcaaaaaggtggccttgttatgtaaataaagccccttttgtagttaaaattaaaaatcttttttttccttttgatggccattttcctcccacttcagagaccctgttccccataatttagggttccccttcagatttgaccaagacagaaagaaaaaaacaaaaccattaagcaaaactaacaatgatcacacaaattatatgatttctgaatgcgtccgtgtaagcag

SEQ ID NO: 184770 - DNA, 977 bp, Homo sapiens
  misc_feature (815)..(815): n is a, c, g, or t
ccagccctggaggggaaaaggggctccctgcccagaaagacagtgatgggggtttctagaacaaggaaacccagaaggttcccagatgtccaggagacaggaaatgagaatttcagagccagcgggaagacaaggtgcctcactgagctgctggaccatgaaaggtgaaaaacacactgaagatgagagccatctcgggagcacccgaacacagatgtccataaaggagctcgtgaacaccacggaccctcccgggacccatcccatccaggcctccttcccctccaccatgctctctctgtggctactctgggtctaacacaaccactagaaaaactatccccaaacaggcacagtgagagcacacgaacagacatgctgatacagttcggacattcgtcccttccaaatttcatattgaaatgccatctccagtgttggaggtgaggcctggtgggaggtattggatcatggaggtgaacccctcatgaatggctttgcaccatctccttgatgatgagtgacttctcactcagttcacacaagatctggttgtttaggccaggtgtggtggctcacgcctgtaatcccaacactttgggaggcctagatgggcagatcactggaggtcaggagttcaagaccagcctggccaacatggtgaaaccctgtctctactaaaaacacaaaaattagggctgggctcagtggctcagctgtaatcccagcactttgggaggccgaggcgggtggatcacctgaggtcaggagttcgagaccagcctgcccagcatggcgataccctacttctactnaacatacaaaaaattagccaggtgtggtggtgcgcgcctgtagtcccagctactcaggaggctgaagcaagagaatcgcttgaacccgggaggcggggcttccagtgagccaagatcacgccactgcactccagcctgggcaacagagcgagactccgtctc

SEQ ID NO: 184771 - DNA, 203 bp, Homo sapiens
atggcttaccaggatcagagcatctgccccttccaagggacatccttccaccacgagttcaaagtggatccacagactgttccatcctgcaaattacagaagacggggtgtcattcagctttgtccctcaagggccagaatgtaacagcatgctggtttcttaagtgaactagtgaataaatgtagctcagtgagtgtggaca

SEQ ID NO: 184772 - DNA, 936 bp, Homo sapiens
gtgagaacccacggaggggaggaacgaaactccgatgaagtcagagccccttacccgccgccgcggccaggccccccaacatggactgtctctgtatagtgacaaccaagaaataccgctaccaagatgaagacacgccccctctggagcacagcccggcccacctccccaaccaggccaattctcccccagtgattgtcaacacagataccctagaagccccaggatatgtgaacgggaccgagggggagatggaatacgaggaaatcacattggaaaggggtaactcaggtctgggcttcagcatcgcaggtggcactgacaacccacacatcggtgacgacccatccattttcatcaccaagatcattcctggtggggctgcggcccaggatggccgcctcagggtcaacgacagcatcctgtttgtaaatgaagtggacgtgcgcgaggtgacccactcagcggcggtggaagccctcaaagaggcaggctccatcgttcgcctctatgtcatgcgccggaagcccccggctgagaaggtcatggagatcaagctcatcaaggggcctaaaggtcttggcttcagcatcgcagggggcgtagggaaccagcacatcccaggagataatagcatctatgtaacaaagatcatcgaagggggtgctgcccacaaggatgggaggttgcagattggagacaagatcctggcggtcaacagtgtggggctagaggacgtcatgcatgaagatgctgtggcagccctgaagaacacgtatgatgttgtctacctaaaggtggccaagcccagcaatgcctacctgagtgacagctatgctcccccagacatcacaacctcttattcccagcaagtggacaatgagatcagccacagcagctcgctcctgagttgtggatcctctagaaacggccatc

SEQ ID NO: 184773 - DNA, 1037 bp, Homo sapiens
gtgagaacccacggaggggaggaacgaaactccgatgaagtcagagccccttacccgccgccgcggccaggccccccaacatggactgtctctgtatagtgacaaccaagaaataccgctaccaagatgaagacacgccccctctggagcacagcccggcccacctccccaaccaggccaattctcccccagtgattgtcaacacagataccctagaagccccaggatatgtgaacgggaccgagggggagatggaatacgaggaaatcacattggaaaggggtaactcaggtctgggcttcagcatcgcaggtggcactgacaacccacacatcggtgacgacccatccattttcatcaccaagatcattcctggtggggctgcggcccaggatggccgcctcagggtcaacgacagcatcctgtttgtaaatgaagtggacgtgcgcgaggtgacccactcagcggcggtggaagccctcaaagaggcaggctccatcgttcgcctctatgtcatgcgccggaagcccccggctgagaaggtcatggagatcaagctcatcaaggggcctaaaggtcttggcttcagcatcgcagggggcgtagggaaccagcacatcccaggagataatagcatctatgtaacaaagatcatcgaagggggtgctgcccacaaggatgggaggttgcagattggagacaagatcctggcggtcaacagtgtggggctagaggacgtcatgcatgaagatgctgtggcagccctgaagaacacgtatgatgttgtctacctaaaggtggccaagcccagcaatgcctacctgagtgacagctatgctcccccagacatcacaacctgtgagagcccttcaaacaccaaagttccccatgacccatcccgtttaacccatgacatgcagtcccacgacatccctgtagctgtccctcttcagatattccctatgaaatagccacaacctctgatccttgctgttgttggagaagagatggaaaatcaattaccataaaagaactag

SEQ ID NO: 184774 - DNA, 1035 bp, Homo sapiens
gtgagaacccacggaggggaggaacgaaactccgatgaagtcagagccccttacccgccgccgcggccaggccccccaacatggactgtctctgtatagtgacaaccaagaaataccgctaccaagatgaagacacgccccctctggagcacagcccggcccacctccccaaccaggtaaacgcccccgagctggtgcacgtggcggagaggaacttgtcccacctcgaggctggccacggggtcgtgggccacgcccacctctcccccttcaaggccaattctcccccagtgattgtcaacacagataccctagaagccccaggatatgtgaacgggaccgagggggagatggaatacgaggaaatcacattggaaaggggtaactcaggtctgggcttcagcatcgcaggtggcactgacaacccacacatcggtgacgacccatccattttcatcaccaagatcattcctggtggggctgcggcccaggatggccgcctcagggtcaacgacagcatcctgtttgtaaatgaagtggacgtgcgcgaggtgacccactcagcggcggtggaagccctcaaagaggcaggctccatcgttcgcctctatgtcatgcgccggaagcccccggctgagaaggtcatggagatcaagctcatcaaggggcctaaaggtcttggcttcagcatcgcagggggcgtagggaaccagcacatcccaggagataatagcatctatgtaacaaagatcatcgaagggggtgctgcccacaaggatgggaggttgcagattggagacaagatcctggcggtcaacagtgtggggctagaggacgtcatgcatgaagatgctgtggcagccctgaagaacacgtatgatgttgtctacctaaaggtggccaagcccagcaatgcctacctgagtgacagctatgctcccccagacatcacaacctcttattcccagcaagtggacaatgagatcagccacagcagctcgctcctgagttgtggatcctctagaaacggccatc

SEQ ID NO: 184775 - DNA, 373 bp, Homo sapiens
aggtaccggcctatccaaggacgggaatgaggctctgatgccagcacaaggtaaatgttatggcatgaaggcagcaactacacagcaccacgcgggcctcatgggaatgcacgcatgtcacctggtaggcctggatgcaggacagtggacaaatgcaaagttttagaggttcagttaaagaatcgcacgctgccccaggtgatcttggaggagtgagacttgggcggccgtccaaccccttctgctgcccccacaggcagaggacaccgccacacctgcgtaaagccacccaccatctcttggttctagagatggaattccgggtgggagtcatgaatctgatcagcatgaggctcttatcatcttccaactc

SEQ ID NO: 184776 - DNA, 728 bp, Homo sapiens
agtcttgcactgtcgcccaagctggagtgcagtggcatgatctctgttcatcgcaacctccgccttacaggttcaagcaattctcgtgctgcagcctcccaagtagctgggattacatgcgccaccacacctggctaattctttttcaaatttttagtagagacggggtttccccatgttgcctaggctggtctggaactcctgacctcaagtcatctgcccgtctcagccaagtgatctgcccgtctcagtggttacaggcgtgagccaccacgcacagccacattagtgttttcttatgttcacttataattcaactttggagaacgttgccttcttccccagggataccactgtcaaagagacaaatatggagaggtgcagaaagaaagagatagctcataatcttccagaaacatctatcacttatgataatccatgttgcaaaggtgttccagaccgaccacttacaaacccaactaatcaatctacttttaaaataagtaaataaaaaaaggaggatgtatctttatcatgttcaccctcataacaaattatcttccctccttgaaatagcatactttaaaaaacagtggttgggccaggcatggtggctcacacctgtaatcccagcactttgggaggccaaggcaggtggatcacttgagctcaggtgttcaagaccaacctgggcaacatggcaaaacctcatctctacaaaaaataca

SEQ ID NO: 184777 - DNA, 154 bp, Homo sapiens
acagagtttcaccccagtaaaataaacttccacgtgagagttgtgttcattcaagggttattttttgagagtggaagtacatttcctgcatttgtcacagataatatcagaaattttgttgttttgattaaaatgttgccatctacttataagt

SEQ ID NO: 184778 - DNA, 206 bp, Homo sapiens
caagcaaaacaggacctgtggcccttcccactggatggggaggagctgaggaaggcatttcggaggaggtgacgtcttacggggaaatttgtgtgttggaatcaaagtgagggaagggctttggggtggagtggccagcaggagcaaaggcttggaggccagagagaatctgagcggcacacaggctggggaggggttggccgtgc

SEQ ID NO: 184779 - DNA, 214 bp, Homo sapiens
agcttctgtcctggaaggggaagggcagcaggcctgtctgggatgtccccagccagcaagcttgcactgggtcgaagagcttttattcctgggaaggagtggatttgttttttggttaagatgaggtaaatcaatgtgaagactggctaaatttttactgcctactctgtgaggcattgttcaaaatatattcttaaaacggattcttttctat

SEQ ID NO: 184780 - DNA, 455 bp, Homo sapiens
tcgcaagctcgtacccgatatgtattttttatttcctttacaaaagatcattgaattaaggcactttctttggctctactagattgttatttaaatataattcaaacagccatcgaggataactgttaataaatctaggttttctctgaagtctcccagtgtatattactgtactgatgactgacaaggaagaggttttgacaaggtccaattctgtatatttctcttaaaatatcctaggcagttcccaggataggagtatctgactcatgcctcatgctaccaggaacctttgcagcctcatcccagaaatgcagaaacacacttgttttgtctgtagaaataaagttttgatggttagatttccaggcaaaccttcaaaatcatgttaaactataatatagggaaataaagtagtgtatgttcttctgtctgcagagtcaagtgagattttg

SEQ ID NO: 184781 - DNA, 558 bp, Homo sapiens
atccatatgaattgcttgctgtagtagcaatttttaaatttgagatataacatgcatatagtaaaatgtacagatgttaattgtatagcatggtgagttttttatgtgtacaaactcttacaattaacactcagatcaagatgtagaacatctccagcactccagaagcctctccttcatggttttcacaggttaactaatatccacttctcctgtcactcccaagtaattattattctgatttttattatcatagattagtctttcctgttcttgcacttcatgtaaagggaatgacttctttcgtttattatggttatgacattcatccatgatgttggtataccttggttctttttattgctatgtagtgtttcattgaatgaatggatcattatttattcttctgttaatggacatttgaattgtttctaatttttgacttacaaagaaaacctgctatgaatattctcgtgtatttctttttatgaatatattgtttcatttttaagagtataattgttggatggttgtcttccaaagtggctgtaccatttt

SEQ ID NO: 184782 - DNA, 349 bp, Homo sapiens
actacatatggtttttgttcacaagtctcttcccaaatctgcagaccgtattccattcttatgtgtctatcatcattgcctccatttctcaatgcccacttactgcttaatctcttggaatctagcttctgccactatcaagtgatgccctgaaattgttctttctataattactaatggcctggttggtttttaaaaaaaaaaaaaaaaagtttttttcttagttctgattctatacatgatcatctcccttcagcagcatattattttggttatcccatttctcagtttaaccaatgccttttttagtgcctacaatatgtaagatactactcatctaggaacccct

SEQ ID NO: 184783 - DNA, 522 bp, Homo sapiens
tgtgtaacaaatgctgcataacaagctataaatattcctgctgaagttagtttgtaacttcaagtcagagatggaaaatatcaatggtgaaaaaataatattgatttttcatgttaaaaagacactttttccaggctacaaaactaactcttgctgaatttgaagagaaattcttcttcctttattttctaagtatcttttgttttattatgtgtattccagctatgtatgcatcacagcccttctccttctttttcagtattatatctatggttttctcattgttgtctttatgccatgtcattttacatggtactttgtaggttttgatgagaaagttggtatttttttaatgtactaaaaaattagttttaactggagagtttgtcaatacaactttcagatcagttaattaagataaaaggcattcagtatccacaggtgagaggaataagtcagttagttttctttttttctgcttgtaaaagaaaaaaaatcttacacaaagtgtggcaaatattt

SEQ ID NO: 184784 - DNA, 465 bp, Homo sapiens
ctctgctcctctgtacatttctgcggaactggcacttgaaaggtaaggcgccggagctctccctgccccagtcataatgggaaaagttttcaccccaggccagcccaaacactcaattgtgttctttctctaccagatacataatccgtgtttaaatctcttggcagtcactcattagtttttttcccctacattcttttcttctttgacaagagtacaccagctatgacccaacctctctcccaagaaatacggaacactcttaaaaagggtaaggcttgtcaatgcttaaagttctctgggtttataagggaccagaggctactaattacccctaaaaatcccaaaggcaagagctgatggcattgaaagcaataaacaaagattccattcacgttctattcaaagtgactggaaatacctggagaaccgcctccacctccctgccggcttcttttcatattg

SEQ ID NO: 184785 - DNA, 251 bp, Homo sapiens
taaagatgactgggttggtgttaagtgtgcaatcaaagatgttttataactagcagaaactattgcagaagagttaacttctgtttccttataaatagtcatctggcaacaccttaaatgtaagttctgagactctacaaaataactgaagtcagcctccctcaccacttgcttcagaatatattggagaatatatttgctcaccacttgcttcagaatatattggaaaatatatttgcagaaaaggaaaa

SEQ ID NO: 184786 - DNA, 143 bp, Homo sapiens
aaacaaggtgagaattactccgtttgctctttacagtcctttggtttttggttcacaaacttggaaagaaatctgtgctttaaataaagccttcttatactccaggttcctaagtggtgtggaggaatttgtgtaaacatcag

SEQ ID NO: 184787 - DNA, 318 bp, Homo sapiens
agctgaaaaccctaggagattagaggtgaaattctgtctcccctataattgaatgtattataacacaaaaatatactcagaaagaagtcattaatttgagtatagtgataatgatagctatcagagtaatcccttttaaaatagtttcagttcctgtaataccaaggcccactcacatgttgtagtattgttaccactgtcgcagtaattagtttccatgacacaaaatcacctcacttgctttcccacagaggcagcaatatgctaaaagagcagactctagaccaggtctcccggggtccaagtcaagtgtgtgtt

SEQ ID NO: 184788 - DNA, 173 bp, Homo sapiens
ttgtatgaaggcagtgaaggataaaagttacacatcttcacatattctgtgaggaccaggctccagctgcgaaattaaaatctatcagaaattcagacaagaactattcccagggtcaggctctcggctttatgtttaaagcaaagaagtaattgggaagaaggagtctgcat

SEQ ID NO: 184789 - DNA, 494 bp, Homo sapiens
acacgggtgcgctgaacgctgcagtgaaaagacaaccattgtgcggctggaaaacagtaagcactggtgtgatcttcagaaaagccacacagaaaacacaaggagatggaagggtgggaatgaagaaagcgcccctgggtttcaccagatccagcggagggggcttcccgcagacaggctgctccagaaggctctgtgggccctgaggactcaccgggatcggggctgtggcagggcgctccccctggtaagcctcacagccccagcccccttcacagccgtgaagtctgcagggacttctggaaacattggtttttggataagagacacaggtgagaaaggaactccctggctgagcccttctctgtccctggtctgcaagcgtcgtgtctgcagctgtggcagcagctgtgatcacaaggccaccaacaggaggataaaaaccaacagccaaggatggagggtcaggacagcgaggccctgccctgtcacca

SEQ ID NO: 184790 - DNA, 349 bp, Homo sapiens
gctgtcaggcacttttgctataagctcatcccttaattatgtatatctctacctcaaaatagtacaccctaactaataacaaaaaagagcaagggaatgacagaaataagccatttaattacctgctgtcatacattgaaaacacacacacacccaaactcaatactatcttgttatccactgtgaatgacaacttgggcaagaaacaaataaggtgccaggatcaattaaggtaattatctagttctcttgctaaatgcttccaaaagacatttcctcctttggcattattcactaaaagcaatgaaggaaggagatagggaaggaaagaaggaaggagatagggaag

SEQ ID NO: 184791 - DNA, 391 bp, Homo sapiens
tgcctcccttaagtgttggaattacaggcatcaatcagccactgcacacggcctatacctgtagctacttagaagtaggtactggggttatccattctgaatgatgggatggggatgcaagaggaagagaaccagtttttagcttgtcttaaactaagtcagaatacagattgatgatttaaacacctcagctcagcggttggtcctcatttcatttttgctcaaagacagtgtggaatcagtcccattggttactataattaggttagctccttaacttcttttgactctgatttctaacaaatgaagaagggcagattttagacaataaatcttgtactaaaatgaaatggtatttgttaaataccataaagaagcttgaaccttaagc

SEQ ID NO: 184792 - DNA, 247 bp, Homo sapiens
gtcctagacaacctcaggtatgtgtgcccaggatacatgtgcaggaatacatgtgcagtgttgctcataggttccccaagtggaaaataaccaaaacgtccatcaagtgtagaatggttaaatcagttgcgtgcaattacacagtagaatactctacagggatgaaaatgggcgagccctgagcgctcacagtaacatgaatgcatctgatgaacaacggtgagcaaagacagcaagacacgaaaga

SEQ ID NO: 184793 - DNA, 775 bp, Homo sapiens
agcccaccggaagtttagcgaaccaccctcaacctccggaagagcgcgggaagtttgtcggaaacggacagaaaggagtccctgcgaccgcgtagcctcctgcagcgccccctgttggcagagtcgtagcgaggccgagatgaggtccgtgacgtggctgcgtgagcatcccggctgcctgtggatgagtgggcgtggggctgagaggcgacaacagtggggagcttcctcagcgatcctgggcttctcgggtcaggccaacttcagtccgggctggaggccgtgcacaacaccaagcgcatggtggggtcctcagctgcctcgggactggctccgcctctgcccctggccctgggatgggggccaaaggttttgggcagtggcagcagcaggaggaagtagcacctggaaaacgtgtctcctgagtcgacccttcctgtctgggggggccgaaccctggctgtctttgttcccatagcaacgaatagggctcccctatgttccagccccttagatacggtgtgccccaggagggctctgcaggagctacaggtccttctggtgggaagggaggcgggaggtgggctggggcagccggctggcctgtgtggagacatcacacttcctggttggggacagggtgaagagggttggtccccacctctgccttgagcagagcttctagtgggtgaagcagtggggatctcctgcctgccggaaggatgggtggggcttccacatcgcagcccagtagggtggactgaccggtcttctg

SEQ ID NO: 184794 - DNA, 375 bp, Homo sapiens
atcagctcggtacagactcggcaccgtcggtacagtatcaccctgactactctacaagggcctcccctgacctgaaaccgcaatgcctctgagcctgtccctgcactgaggatgaggccgagccaggagtccaggcctcctctgagccacagctgtagttgggctggcagctctgcatcttcatgatgtcacccgagatgctccacgacctttccctctgtctccccaactcaggaaggacaggcagggtgaggtttcctctagtctcagtacttgagccttctaagcaaggcccagtccctgccaacagccttctatggctctcactgatcctggcccagcggaaggccaggctttgcagatgcagagcctccc

SEQ ID NO: 184795 - DNA, 436 bp, Homo sapiens
caaggtacatgggattccaggagaagatttctatgaacatgttataataattctgtagacgagtgtatttttgtttgtagctcaaacagttacagtccacatactagagagcacctttaaacacagcaaatgtttagtcagagatttcaacctaactgtgcttagaaatgaaatcctgtaaacaatttggtgatactggcaaatttaaagcatctacctccttccaatctaattttcctcttcagattgttaattaaagaaaatgaaaagtatactttaattttattgccaaaagcactagtttgctttattcatgcaaaacaataatactcaaacttgctatttgcccgcagatctacaaaaatgctgggactggatgatttcaaggatgtacttatcaatggtacaataaaaccatctttttcagaaactacta

SEQ ID NO: 184796 - DNA, 264 bp, Homo sapiens
gggatcattggtccgagagaaattagaatcttaccagaatgatgtacttatacaacttgcaaagttttatgtgtgctccttggaattattgatgtccccgaagtccatccttagattctgagatcaaaatgcctcttacttttagcacatggcaggattttaggagcacctggtatattgctgcttattactggatatttgccaagttgcctttgttttagcagtaacataaattaagaggcactaatttctctcggaccaatg

SEQ ID NO: 184797 - DNA, 532 bp, Homo sapiens
gcagggaaaccacatgcccgtggaagaggagaggtgaactcgggggtgctggcaggggctggaggtgggaggtagtgaataggagatgccaaccttttcttaacaatttagttgcatcttagggaaaatgggggctgaggagggccctatgatgacaacttgaattgggtaaaatttaaggataaggaattactaattagtaataaggtagaattcttaagtgtatgaaatgaataatatgtagctaaaaaataatgatatagcattaggcatttgagacatgtggactccaagcaattaacctctattcttcttctgaattgcaattgcactaattggctgctttactctgacggggcgatattaacctttctgcttttctctaaaggagccagtatgttgggtggatgtgctgctctggtttggaggaaaggtatttttcctgaataataacctatttgcaatttttctcccaaatggttgcattgaaaaggttctgtcaaattttcttgataaagcttcatctatggaa

SEQ ID NO: 184798 - DNA, 506 bp, Homo sapiens
aagtgaataagaatggaatttgcaggggacagccaaatttgaagagaaacaaactcttagtttgatagaaatgagggttttagggaaaaatctgaatatttggtttaatgcaagtttgataaagataagggaaatgataacacaggatgttgggagctatcaagaaaggcatattagaatatggcattcaaggagttctgaagagtttgctgcctttttgtttgtttaactggaggaactgacaaacttcaaggttttattgaaaaatgttaaaagaatttgagccactggaaagagtctccagaggagataggaatgtggtatcatcttcttccatcccagcttacagagggcttagaatccctcaagaactagggagctggagattgcttaagtacatagatctgtgatccagggtggatgtctctttttttctgactcttttctcaattctctcatgtacatgtagggtaggacaaatgtaggattggccggcaaaccagcaa

SEQ ID NO: 184799 - DNA, 398 bp, Homo sapiens
aggagatatacaagtagccaataagtaaacaaaaagatgcttaacatccttactcttcagggaaatgaaccttaaacctacaaacccaccgtgagataccacttcacaccaactgggatagctattattattattattattttattttaagttctggggtacatgtgcaggatgtgtaggtttattacataggtaaatgtgtgccatggtggtttgctgcacttattaacccataacctaggtattaagcccagcaagcattagctatttttcctgatgctctctcttcccccacttccacaacatgtgtgttgttctcctcctgtgtccatgtgttctcattgttcagctcccacttataagtgagaacatgcattgtttggtgggatggctatatc

SEQ ID NO: 184800 - DNA, 215 bp, Homo sapiens
ggaatgaagagcaggatcctaactgttccatacataggctttcaaacaagcaaacaagtggactcctcctccccagtatctaacacctcaaattctggagactttctaagaattcctggggagtcccccactataaacaccgagtctgacctttttttggtcactaagtcattcattgactccactggttcttacatcctatggttagggctact

SEQ ID NO: 184801 - DNA, 388 bp, Homo sapiens
gctctgttgccctctgcctggtggtgggactagggactggacttactcttgtgcctggccttgcacctgggaggtaattggagctccaggattggcttgagcataacagaaactaagagccaaagacctagacccaaaagggacagggaaggattcattcactcattcatccattaactatttatttgaactccatttgtgtttggcatggggaagcaaaaatcagtcactttttatcttcaaggtattatggtgagagagacacttaaacagataattattaaacaatgtcttgagtgcagtgacagacatatgctttgggtaatatgaaaattacaagaaggaatacctaacccaagcttggtgttcaagggacactttcttaagg

SEQ ID NO: 184802 - DNA, 234 bp, Homo sapiens
cgatctgctgggtagtgatgagtggcttagctggttggtaaggggcctggaaggaagtagactggatgttcaggaaaaaatatgtggatagacatgtcaaaatgggtataaaaggcatgctatttcccaccaataagcattcaatacagaagagtacctgaaaaaccaaatgggcaggatgatttgtccaacaaatatcagttaatctctgttctcagacaccccaaccgctcg

SEQ ID NO: 184803 - DNA, 3233 bp, Homo sapiens
  misc_feature (608)..(608): n is a, c, g, or t
  misc_feature (918)..(918): n is a, c, g, or t
  misc_feature (936)..(936): n is a, c, g, or t
  misc_feature (1021)..(1021): n is a, c, g, or t
aaataaatacatctgggatgactgaccaagaacaaagaatgtaggcatcaactgaacaccaactgtatacctgggactggatctgagggtaggattgccagattgagcacaaacaaacaaacgaaacacaagaaacaacagaagggtgcctgttaaatatgaatttctggtaagcaataagtaatttttattgtgttcctgtgcaatgataggacgcacgtatcctgaaaacctgtctgtagttcacctgaaattcacatttaactaggcgttctgattttatgtggccgccctatctgctgggaacataggctgatgcccctgggggttctgcgtttccttggccaggttcctgtagggctgaggtcatgggggagccgtggccagggatggtgtccttgccaggggaggtgacgggcagagctgcaggccctacaacttggggttgggcagggatgagtcgctctatggtggtgcctctgataatagctgttattttagtttctgaaaaatgtgctgccctcaagagcttctgaggctaggcctacttgggtgaaaatagctttccagggagccacattgtggggacgtgaggcagcagccccacnctttggggccacttggctgtctctaactcatctcacttgccagggctggacaaggagatgaaaaagaaaatgccaaggggtgggcaggcaggagcctgttggcgttggcaggcgctgccagccctgtgtcccagtcaagctctggggcgcccttcctgtccatctgggagtagggggtggagtctgaccatgttggggcggagtgttaatattaggagaggatcctccctgggacagggtccccaggcttgggggcaaggccttctgcctggacccccttcctttcctctctcccaggattcctccaggncaccgtagtgctgtgcanggtttggccccatcggtgtgcctgctccttccagccactgctcccttctgcagaaacttgcctgggattcccagggtgcaggggngggggctggtcaggggctggtcagggcctggtcagtgtagagcagggagcttttcacttttagcatagatagagtggccagggccccatggctgcacctccctggacataaccaggatgtcctgtcatctgccccccaaacaaaactggggtctcccctttattttgccaacagaatccaatttttaggtgatgagacaagtgtttgacttgaaaagaccctcctgccctgcctcctggaaggtctggagcccagcccagcgccccggatcccctaggcatgtgaaacggggaatgcagtgtcctccagtggctggctgcagcttggggtgggcacctgggtggtggctggtggtccccctgcaggccactgctgccccctcttgggtcctgttctgagtctcaggcctgagtccctggggaaggccccacacctttgccctgtacctgggtatggggatggccctgaggggctgccttgcttgggagaaggggggaaaacagatatttttatataaataagaaaaagacagcccctctgggcagatgaggcctgctgtagggcagggggcttggtaaactgtgtgtccactggtctgtaacccttcagctgggtccttttgtgcagtgaacagcctggacaactgtccaggtggcccttcagggatatgttcctggacctttcttagcttctcaccgatctttcttccacgccaagtccatgttcctcagtcaaacaagtggcaaagaggaggaggaggaggggaaggaggaggaacctgcttcaccctctggcacctgcgggttttgttccacgtgtcttccttgggaaagacaaggggttcttttacagcctaggggtggtttcccctttctacttctgagtgagaccttctcaagtcacggctctttgggcccacatggctaaggtctagccacctgtgggtgtcctgtgctgcctcagtgggtggtgtgggggcggggctgacctcccccgcgcctggctcagtgcagcagaccctggcccctgtgcccgctctctgccctgagcaggagtttgattttcctaccccgtggtgaagcaagcacaggtgggcggaggtgggcagcggtttccagccccagccaccggggcagggaggcctctgttgctcagggcaagggaggcagggggcttagtgggacgaaggctcaccccacactcttatcattagcattatctgtatttttaatttttaagttgagaaattttctacaactgtcaaactagacaaatgacagtatccagttcccctcacccagacgcagccattgctgacagctgtcagtgttgaagatggccagcatctcatgcccttggtttcactcgttccctgggtggccctcgtccccctccccacgtcccgcgccccgcataccctgagcagccatggccaggaacttggcacgtgggtttgttttttctgaatctgcatgtgcgcagccatgagcatgaggtcactttttgaatgtgaccgaagctgcatcctgctgcgtgtattgctgtgtggctggctttcctccctgtcttctgttcaggaatactgttcaggctgaataccgtcctgtgacatgggtttaaaaacacaggccaggcatggtgtctcacgcctggaatcccagcgctttgggaggctgaggtgagaggatcgcctgagcccaggagttcgagaccagcctgggcaacatagacctgatctctacaaaaaattaaaaaatgagccgggcgtggtggtggcacgtgtcattgtcccggccacttgggaggccgaggtgggaggatcacttgagcccaggagttcaaggccgtggtgagccatgatggcaccaccgtactccagcctgggcgacagagagagaccgtctctaaaaaataaaaaataaatcaacacataaacatacgttctcctcctgagggacagagcttgccccggttgttccatgttgactgtgctgcacacaggccgccccccttgctctgcccctcactgtattaagtctctttgggcctcagtttctccatctctaaaggaggtcggggaggccaggcgggtgttgagtgagatgaagaggcccttggagtcattccaggagtctataggtgactccagtctcttctcacttctgacagcctggtggcgggggtggagtctctgctggggatgtgggtacag

SEQ ID NO: 184804 - DNA, 626 bp, Homo sapiens
acgttcgttccacatttattggatgatggtgaggagcggctggggagccagatggaagaagaaaggggctaacaggcttccacattcccaccccaggtctggggagctcccagccgcagctaaggaggacatactaaattggggttctgaaaagtacatggagccaactctgcctctgggggtccctatccctcttctccaggaaaagtgaagatctccatggcggccagcccacccaggacacaaggcccagggtgctatgtggtgggggatctgtgaccaatgagggcaggcaggttccaggaccccctggagctggcatgggagaattagccccataacaccacactccaggattagaacattgtactgttagcatctccagaggaagaagaggcacattcagtcacaatatgtgacccccacagggaccacatggaagctcaaagccatcttagtggtcccgagcaagaaggggcacaagttttgtctggaaagatgtggaatactcaccacagccaatattcagcctggaaactgaggcccactcctccctctcaaccccaggctctgcctctgctacatccagaggaccgatagtgacaccacacacacacacacacaca

SEQ ID NO: 184805 - DNA, 566 bp, Homo sapiens
  misc_feature (503)..(503): n is a, c, g, or t
ccagtatctccttaacataaccacaaccaaagaatgggggaggcaaaactttaatgtaggggtctaaattctgctgataggaagcaaccttttctctctcaggggttcacctttgtggaggtacaaagtaagaactatcagaacatgagattctgatctaatccgctaagggtccttggcccaaatctggcttgcagacaggtctgacttacacagggtttaaaaatagttttttttttttttggctgggcttggtggctaatgcctctaatcccaccactttgggaggtcatggcgggtggatcacttgaggtcaggagttcgagaccaacctggccaacacggtgaaactcttgtctctactaaaaatacaaaaatgggccaggcatggtggtcctgcatgcctatagtcctagctacttggaaggctgaggcaggaggattgcttgaccccaggagtctgaggctacagtgagcagtgagctgggataacccactgtatnccgcctaggtgacagagagaccctgtctcttaaaaaaatgttatccctttttagtacaggaag

SEQ ID NO: 184806 - DNA, 744 bp, Homo sapiens
tttcttctataatcacatccttatcccatgcaaaactactttctgaataaacgacatccctgacagcttttccaatagagactggtctaggagaaggaagacttctaagttctcctagctccttgcatactcaatgactgctctattactccaaactcttcctcctcacaagctgatgatctacattctatttctcagtttttgtcatcaatagatctctacacccttctcccagattcactgagtatctacagcaaacccacccaatacctgagatcacaccaaggtatggtgcagccatgttccattcaacagagttctttgctctctactcctagactttcacttgtccacacccatgaccatgctgctccatactagaagtctgaattgcaacactccactcttggcccgtggcttcctttttcagttcctcttctcttattatttctatttagggactcatcaggacatctggactctttattttttactttttctttctttgattcagagtttccctcttgttgccaaggctggatggagtgcagtggctcgacgttggctcattgcaacctccacctcctgggttcaagcgattctcctgtctcagcctcccgagtagctgggattacaggtgcccgccaccatgcctggctccagcatacatagttttttacttttagttttatttattctttttttttttttttggaaacagaatatcagggtaccgagctcaat

SEQ ID NO: 184807 - DNA, 904 bp, Homo sapiens
tcaacaggttattctggtagtcttttaggggactatgcacagacaatggcaaaaacagtgtctaagcattctttctcttagtgtagcttcagaagaacttggttctatggtgagttgatgaaatgagaacgtcatcatttcagggaaaaatggaaatagttgccaattcagccactgatagtgtggaaagtcaaattcctccaacaaaatcatagggacttgaaatttatttagtccaattcatctgcttaatatgaatggagaagaggctcaaattgggctcaaattagagtaaaattttttcctatactgctgaagagtcctcttcagtgcaatcaagggttttatgtttcctctctgatcctcatcttcctcttcccttcgcctgtttgggatcacactgtgtctctgtttttcctcttttcagacaattagaggaaatatcaattctccatcatattttggcagaggaagtcttttatctctacgttgccacaggatttttaggcctgtatgttttgaacaaaaatatacttttaagatatctcacatttcatcaagttaacgtgtgctttccattatctgaaaaatctcattaacagataattttatgacattgacacccaatttttgaagttgaaggaaaataagggtttttttttttttttgtaaaatctcataaataatagaacaaactttcttgcagtataggctttcctattcacttcgcccagagtattttagaaggactgagggaaaaaagatattttaccttgtatatattggaaaaataactagatgggagggttctggattagttgtttttttcagatatttgtatttcagctaatttatccttttaaaaatgtgattgcattactaggttcttaccatatgttaatta

SEQ ID NO: 184808 - DNA, 439 bp, Homo sapiens
aacatgccactgtactccagcctgggcaacagagcaagactctatttcatatatatatatacacatacatatacacacacacatatatatgtatataatatcaaaaataaggtagaatgaaaacaagtagaaaatagaagaggaaagaaataaattagaggatcagtttaagatttatttaaatttaaaagatttaaatttaagaatattaattttatttttttaatgattttcttttctccagtttctctagttagagaaactcctcatagttagattttggatctcctcatagttaggttttggcttatgaagtgaaagaaatcatcaaagaaattatacttttcccagtgtggagagagagtgtggagaaagagtgtggagagaagtgtggagagagccagtgtggagagagcgtgtggagagaggggtaccgagc

SEQ ID NO: 184809 - DNA, 112 bp, Homo sapiens
taattagatttagatgatgttatgagagtgggccccatgatgggttaatgtccttacaagaagaataagagaaactgaagctcactctctttctctctccaccatgtgaaga

SEQ ID NO: 184810 - DNA, 237 bp, Homo sapiens
tgaagatacctagtcccaagctggctgaggggcccagatagatctccaactgggcacttgacctctgaactcccagaggacaattcttactttccctgctaagccaggactgtctggtcccatgcagtttgcctggtattggtctgagagtcctcggggctgggtgattctgagcaaggatcatatggtgttggcctggtatccccagggaagtgtaccaagctcacagtatgtcgg

SEQ ID NO: 184811 - DNA, 556 bp, Homo sapiens
atctttcattcttacttccaacccaagcaagcaaactgatttacaccaagtctacacacttgtatctgatggcctcagatttcactgctgcaaacctgcttctgccatgcagtatgtaaaagtgaagcccagaaccctaagccacatcttcctcttaaaagcacactctgagcagtacagactaacctcttcctaatgaggagatggagcaagtggcagagttaaacaatttccaccaaacactttagaatcctgagttttctgcaaaggagcacagatgttcatatctctgacagcagccagaagcctctgccaacacaacagcccatttcaagagaaaaacagacacaaatactaagtatatgccaagtttcctctcaaatagctttcccccgttttcttatttcatccagtttgacgttctttctaccttgcccaccacatattttctgatctcccagtgctcacccattttgcaatgatcagccagaagggctcaaaattgcttgcacccttccgaaatacattctgctctatatccaacaacttcctcaag

SEQ ID NO: 184812 - DNA, 1934 bp, Homo sapiens
cgcggccccgctgcctgccctgctccaggctccacctgcgccgccgatcgcccgggtatcgcgggggcccaggccagctgagtccgttttccgcgccggggtggcgcccctccaaccgtcctaacgccgggccggcagcaaggagtgttcctgggacctcagagaccaggctcagagcctgacatccctgcgaggggacagcctcatccgcccaggccggtgggggtctctacaagtgcccaggctcaggtgcagcccccagcaatgcatcgccggagactggccctgggtctggggttctgcctgttggcgggcacaagcctcagtgtcctgtgggtgtatcttgagaactggctgccagtctcctatgtcccctattatctcccctgcccagagatcttcaacatgaagctgcactacaagagggagaagccactccagcccgtggtatggtcacagtaccctcagcccaagctgctggagcacaggcccacacagctgctgacactcacaccctggttggcgcccatcgtctccgagggaaccttcaacccagagcttctgcagcacatctaccagccactgaacctgaccattggggtcacggtgtttgccgtggggaagtacactcatttcatccagtccttcctggagtcagccgaggagttcttcatgcgtgggtaccgggtgcactactacatcttcactgacaaccctgcagccgttcccggggtcccgctgggtccccaccggcttctcagctccatccccatccagggtcactcccactgggaggagacatccatgcgccggatggagaccatcagccagcacattgctaagagggctcaccgggaggtggactacctcttctgccttgatgtggacatggtgtttcggaacccgtggggccctgagaccttgggagacctggtggctgccattcacccaagctactacgccgttccccgccagcagttcccctatgagcgcaggcgtgtttccactgcctttgtggcagacagcgaaggggacttctattatggtggggcagtcttcggggggcaggtggccagggtatatgagtttactaggggctgccacatggccatcctggcggacaaggccaatggcatcatggctgcctggcgggaggaaagccacctgaaccgtcacttcatctcaaacaagccgtccaaggtgctgtcccccgagtacctctgggacgacaggaagccccagccacccagcctgaagctgatccgcttttctacactggacaaggatatcagctgcctgaggagctgaccacggagctgggggttgccatggatggggacccaaagacctgcagccaccagtgcttcactagcgtgcagaccagccctgtcccgcctccctgtcagtcaggcgaattcaaccggaaaagggacgtggaaaggccactgtgaactgcagagggctgtgcacacagtagcacacaggatctcacagtaacgcggcatgggaacagtgagacagggggaggggaggcgcagttacaaaggcagggcccggcaggcttgccacgttctgcagccgtgcctttgcggggcaggctctgaagcctcagcccgactcagagtgcctgaaccctgccgcgccagtcccccgtttattgcatattgcccttaacgtagcatttctaataccctggtgtgaaggcgccctagaccccttttctctggtcacaggggtcctgggtcctttgatgtctcccaaccacatgtagccaattcctcactcaggcccccagagtgagcctttgaaatggaacaggtctaggctccctcggtttcctgcaccccaaagtgagccgcactctcaggggactagccacctccttcttaagagggtttggggcagtttataataaagggggcgtgtgctcaaac

SEQ ID NO: 184813 - DNA, 1271 bp, Homo sapiens
cgcggccccgctgcctgccctgctccaggctccacctgcgccgccgatcgcccgggtatcgcgggggcccaggccagctgagtccgttttccgcgccggggtggcgcccctccaaccgtcctaacgccgggccggcagcaaggagtgttcctgggacctcagagaccaggctcagagcctgacatccctgcgaggggacagcctcatccgcccaggccggtgggggtctctacaagtgcccaggctcaggtgcagcccccagcaatgcatcgccggagactggccctgggtctggggttctgcctgttggcgggcacaagcctcagtgtcctgtgggtgtatcttgagaactggctgccagtctcctatgtcccctattatctcccctgcccagagatcttcaacatgaagctgcactacaagagggagaagccactccagcccgtggtatggtcacagtaccctcagcccaagctgctggagcacaggcccacacagctgctgacactcacaccctggttggcgcccatcgtctccgagggaaccttcaacccagagcttctgcagcacatctaccagccactgaacctgaccattggggtcacggtgtttgccgtggggaagtacactcatttcatccagtccttcctggagtcagccgaggagttcttcatgcgtgggtaccgggtgcactactacatcttcatagcgtgcagaccagccctgtcccgcctccctgtcagtcaggcgaattcaaccggaaaagggacgtggaaaggccactgtgaactgcagagggctgtgcacacagtagcacacaggatctcacagtaacgcggcatgggaacagtgagacagggggaggggaggcgcagttacaaaggcagggcccggcaggcttgccacgttctgcagccgtgcctttgcggggcaggctctgaagcctcagcccgactcagagtgcctgaaccctgccgcgccagtcccccgtttattgcatattgcccttaacgtagcatttctaataccctggtgtgaaggcgccctagaccccttttctctggtcacaggggtcctgggtcctttgatgtctcccaaccacatgtagccaattcctcactcaggcccccagagtgagcctttgaaatggaacaggtctaggctccctcggtttcctgcaccccaaagtgagccgcactctcaggggactagccacctccttcttaagagggtttggggcagtttataataaagggggcgtgtgctcaaac

SEQ ID NO: 184814 - DNA, 357 bp, Homo sapiens
agccttcccacggggaaaggttagtactacagccccaggacttttcattgctgcctctgttttttcctcagaaagaatcctctgtcttgaggcataatctggatcttatttggggaataaagttggaaaaggcagttggggaactctgtgttggtatgttacactttcacgtaatcaccttttggtaaggcaccttccttcttgttcccagtatatcaagcagtttacgttcagagcttcttgggctcaatctttttcagcaagtaaaccttcattttcccactagggcatgtgggaacgtagttattgggctacacagagtgggaaaagtgaactgggagtattacttctttttct

SEQ ID NO: 184815 - DNA, 503 bp, Homo sapiens
gctaaaggagatggcttctgtcctggagacctcagtagtagcaccagtggacactttagaaagaacagtgtttgcttctgtggctaagctggtctcttcagaggtgctggtctccctcaatctggtggtcagtgaggaagctggctctgactgaattttcctagtgttagataaggcaggagttaatgtagaaacacttgtatcccccataatggagatggtacccatcgccgatgtggctttggttgtctctgagtcaggtaggacagaggaaggggattcatgtccagaactggaagttccaactttggttactgccgtgtttgagaaaggatgaattttctccgtatctgtggtgacttcagaggtggccagtatttcaactgaggtgctgctcaaacttggaggtgaactggtttcaggttctgcacttgcgtccaacacctcagtagtcttcacgtggcctggtgtgagaagtgaagtcacagaagcagaagaggagt

SEQ ID NO: 184816 - DNA, 240 bp, Homo sapiens
gcagttcccttgattagtctactgcgcaggtaaaaattgtttacattcttttcctgtgaattgttaatttcccactagaaaggctatagtacattttaaaagagaattctcttaaaacaagattagaagactggataagatcttacagaaaaggtttacccaattatcgtggatattgaatgtatagtgcatagtaggctcctactacagcaagtccttgaactcttgggcgtacgggga

SEQ ID NO: 184817 - DNA, 794 bp, Homo sapiens
cgggaactgacggggtcccagacggatgagagctggggagaagggggtctcggctgaggggtccggggctgaggcagggtcatggtccggcaggacccggactgacgggtcgcgggcgggcggctcacgggtgaccgggtgaaggggtcttgggctgagggcacccgggctgagggtcgcgtctaccggagcgcgcactaggggcggagggcgcgggcacagagagccgcggccggtgccgactcgagtggacgcgagccggtgcgtcccggcttccaggacagcccccctcgggagagcgccgggtgggcgcggagccggggacacggggacctccgcgtccccggcggaggtgcgcaagcgtcgggagccgctccgggggaactttggagcagggtgtctggacccggggaagcgaagatccgcgtgcgtccgtcctgaggccgcgcggcacccctgctgaggaggaggtcccgttcgctgtccagagcccaggggcgaccgccgcttggggaccgggggaccgttcagcgaggggcgcgcttgtagctggccaggccctgtgccctgacgcgttgtgctggccctacgcccggcggaggggctggggacggggactgggtgcctccgtgcctccgcggatggagcgcgcagccaggacccccagccgcaccccggggggctggaaaggcgaagtcgctgctttgtgggctcctgcaagtgccaggcgctgaccactcctcctgggagcctaactgaggggggtagaggcagcagaggttaacagaaatctc

SEQ ID NO: 184818 - DNA, 352 bp, Homo sapiens
aggactgggagctagttcttatcaccactgttttcattattgtcaattaaaaagataagtctatctattttagtgttcaagggtataatctgaaaaagtaccacatcttacctttggcaggggtgggggagtgtactcataattttcccaattatgagttctcttgttgttctatgatttcacagcaaaaagttttaaaagccttcaaaaccagcacattttgctcacttgaaatatgtttatattttagcataaaatatactcggcagctcctaacatagttggatggctacgcattgcaaaaacttgatttctttttaatcaaatttttagaaccgcactaggtttcttg

SEQ ID NO: 184819 - DNA, 202 bp, Homo sapiens
agttaggtgactcatagaggatccccagtgttcttcaagagcataagattttttcaatttatttttgtcatctcaaattcctttaatcagtgtttgatagttttccttgtaggtatttttcacttccttggttaaatgcattccagatattttatttttacagctattgtaaatgctaacaaactgacaacttgatttggtt

SEQ ID NO: 184820 - DNA, 370 bp, Homo sapiens
aggaggagagaaagaagggtcaggaggaagtgtgttgggtacagagacatggaaataagaaacaggaaccctgaaagacacacccgcggaggttctgtaactgtacatgtgctcttgttaaatcgccagtttcagaggactcagatctgaggccatatagaaatctattaatttgcatcttgactttggggcttccagtaacagtaagtatttgtatttcaggatccactcagcagaaaggccatacatattcaagtcacataataaattggtgaattccaagtgaattgtgaataccaaaaaagaaaactgattatgtgactttctggaatatgatgtagaaattgacctaacaaaatgtatatgcaca

SEQ ID NO: 184821 - DNA, 563 bp, Homo sapiens
actacaggcgggcttggcaaagctccctcctgaatgccacttccctgactcacttccttccccgtatctctctggccctcagggacctaaggcccaggtgaagtgggggaacagcaggattgaggagaagccagcctgaggccacaagcaatgaaatgccgtagccagaagccaagagctcagaggtcaaagccatccagcactgggtttgcttgcagcagctgagatggaggaaaggagccccgggagctctggccttgcagggaggactgggttcctgaggggagggtgagctatggtgtctgctaagcggaggagtgtctacctcccactcagcttccccatggatgtgcaggacactgtcttcatttgtgagtcaaaatacattggcataggagccttgcccattactcatacatttttgtggctgcctactaagaaggcagaggagaccctgatacccaggagctctaagctttgaagggccctaatcatgcatagccttcgcccccaagcccaaggctcatccttccaaaattgggcaactccagacctgaagcagg

SEQ ID NO: 184822 - DNA, 480 bp, Homo sapiens
acctctatgctgaaaaccaaaaaatattactgacagaaaataaaaagacaaatgaaggggaataccatgatcacagatcggaagactcaatgttgtaaaggcatcgattctaccctaacttatctatagccttaatgtaatactaagcaatattctagcagataactctttgaaacttgaaaagctgattcgaaagtttatgtggaaatgtaaagagccaaggaaatcttgaagaacaaagctggcaaaccgattctagattattgagattaatgataaagctaggcacagtggctcacacctgtagtcccagctacccaggaagctgaggtgggaggatcacttgaggccaggaatctgagactacaaagcactatgatcgtaccattgcactctagcctggctgatagaacaagaccctgtatctatcaatcaatcaatagaaagagttattataaagctgtaacaattagacaaaca

SEQ ID NO: 184823 - DNA, 273 bp, Homo sapiens
cttcttcagtcccattcatgtgtcattctctcctgaagaataggccttttgcacaggctattctctctgtccctgctctccagctaactccacctgatcatcaggtcttatagcttgaatgccacttcctccaagaaaccttccttaactcccaaaacagttgggagtctgtgtacacgctcttcatagcaccctttgctttctactacctagaattacaactaaaaccagtgtatcagaccggtgtggcagctcacacctgcaatcccagca

SEQ ID NO: 184824 - DNA, 422 bp, Homo sapiens
tagtccctgaagatgcttttgaaagagaatgccacaagacagttaaagcacaccagtaagatctccaggatgactgtgagggcaggaagtaaagtgaaagcacagcactgcaggtgctttattttcacctttcttccacttagaaagcaactcttctcacaattatcctatagtgcctcctaccctttggtttaactgaccatgtaagatgcattgagtatgagggctatctgttgtaatgacgtaatctctaatgttattctgcctatggaaatctctgattgttctggtaatgctgacacttcttacattatgacaaccattcttgaagagttttgtgaagattaaaaaaaattaagccacagtgtttgatatactagggattgccatctcccccatgaaggcctatagcaaatcatttt

SEQ ID NO: 184825 - DNA, 338 bp, Homo sapiens
gtccccctacccccacagaacaggaagcacatgtcacagagaacttcatgcttcagcccattagctgaaacaacacagagcacctcacagtaaacaaagatcagttacatatccatctgttgtacaaccactagctctgaaccataaaaccattgataaaagaaaaacttcagttgaattatatttttaaaagtttaatttagcaatgaacaatttgtgaattgggcagcccctagaatcacagcagattcacaaagactccagtgcagccacatagtggaagatttatagacaaaaaaagggacatgacatacagaaattggaagtgaggtacagaa

SEQ ID NO: 184826 - DNA, 439 bp, Homo sapiens
gaaactgcaggaaagcctttatttggttttctgaggaaggaatgggcaaaactggataagcaggcttgaacaggtttaaaattggctagttgaaataattttggccgacttcgggcgtaggggatatccctagttgcctggtagctggtctggagtgattaggatagggcaatattggccaggagtataagaacccaagatgtctgtgttgggagttgggggattctggattggttagtttgcataggaattagctaaccctgggagaggtagtacctctccagtcatcaaggacccacctagataccaaatgattaacaatacaaaaataagaaagtacaattaatacaaacagtcataataaagatacagtattaacacagttaagacgtggaaattttaataaataaacactattaagacgggccggctcgatcga

SEQ ID NO: 184827 - DNA, 485 bp, Homo sapiens
gaaactgcaggaaagcctttatttggttttctgaggaaggaatgggcaaaactggataagcaggcttgaacaggtttaaaattggctagttgaaataattttggccgacttcgggcgtaggggatatccctagttgcctggtagctggtctggagtgattaggatagggcaatattggccaggagtataagaacccaagatgtctgtgttgggagttgggggattctggattggttagtttgcataggaattagctaaccctgggagaggtagtacctctccagtcatcaaggacccacctagataccaaatgattaacaatacaaaaataagaaagtacaattaatacaaacagtcataataaagatacagtattaacacagttaagacgtggaaattttaataaataaacactacagtaaatgtaggactgcacccctcccaaaaaatttgagataatttgatggaaaggtgtgtaaggaagg

SEQ ID NO: 184828 - DNA, 603 bp, Homo sapiens
  misc_feature (14)..(14): n is a, c, g, or t
ttcgagctcggtancctgatgttatccccaacacccacctcccatgtatgattttactaactgaattgaatttttaaaatctcattacagacttgaataatcatcccatgaatgttaactcccctaacactataaccgaggcccatttctaaagttgatcttaaaactggaaaatttgagtctatctaattttgtgaaatatagggatgccttttacatgatgtaaaagtcatatttgtaaaatggttaaactaggaggcaatatttttattgcaagtatgatctcttaagtgaaaggtttctgtcatttaaaatttttagagtctttatattttcataaacagtatttcaaaggcaaatgttctttctaacgttgtgtgtgtgtgagatggagttttgctcttgttgcccaggctggagtgcagtggtgagatcttggctcactgcaacctccacttcctgggttcaagcgattctcctgtctcagcctcccaagtagctgggattacaagtgcccgccaccatgcctggctagtttttgtgtttttagtagagacggggtttcaccgtgttgggcgataacgggatcctctagatgacctt

SEQ ID NO: 184829 - DNA, 435 bp, Homo sapiens
gagtgagtccacgctctggcctctgagttcttctcatgggaggctgagaaaagtctgggggtctgggacagccagggccgggtttccccttccaggcaatgagaaagaacaggctctgcctcccaccataagagtcaatcccaagttccagatgtgtcagggaagcgatggagagccccagacttgaggcatctgcagacaggttcctgctcagacatccacgtggagggtgttagtatcctgggagccttcagaaccttgaagcatgccagcagaggagaatgagggaagataaaatcaaagtgacttatcacaattaaggaaatgtgctatttcatgtacaactgtgtgtgaggatgagattcctacctgccatactgaggtattatgataagaactaagagagtccaaattcctacaggatgaacagctgag

SEQ ID NO: 184830 - DNA, 130 bp, Homo sapiens
accaagataatcaacggctgctaaaacattaggttagaggctggtgaaggactttataatggatggattcagccaaccacgctgatgaaggattagaggctgatgaaggattttataatggatggattct

SEQ ID NO: 184831 - DNA, 499 bp, Homo sapiens
ggatcctggggaagtggaatggggctggagtcgaggaggatgctggagtgagagagcctgatgactccaggtcaaggccatgagcccaggacagctgtgatctgcctggacctcacaggcagcccctgagaggatggagcaggacgtcatgcccagtgcagatgaggaaaccgaggctcagaatgcagattcaggggccttcagactcctgcgtccagctgcctcttactgtgccaccccaaactcagtgggacccaaacagaagtcctgcttcctccctggcgcccacccatctccatgaataaacccgatctggtgagaagtggcatgggtctgtagtcgaggaggatgctggagtgagagagcctgatgactccaggtcaaggccatgagcccaggacagctgtgatctgcctggacctcacaggcagcccctgagaggatggagcaggacgtcatgcccagtgcagatgaggaaaccgaggctcagaatgcagat

SEQ ID NO: 184832 - DNA, 825 bp, Homo sapiens
gaattatgatttataaatttatcattattacaaagaaagcatgtatcaaatctagaacttttaaagatatgactgtatcaagtgttatgcagcattaggtgatctggtggttgtgaaacatcactgagtacattacacaaaacaaaatggtatagcctactatctacgtaggctatgtgttatagcctatttttcctaggccacgaaccttaacagcatatcactgtactgaataggcaactgtaacacaatggtatttgtgtatctaaacataaaaaaggtacagtaaaaatgtggttttataatcttatgggacccctgtcatacatggtccatcactgactgaaaagttgttacatagcacatggctataactgttgtaaaaatacaatgggataagaaacaggttctctgtgtctagatggaaagaaggatagaaataacaatgatcaggagtgcttatgttcaaataaggcagttgagatcaatttttaaactgtaataaaaattgaagggaggttttcctagctcttgggaacttggggaaaaaaaactgaagggcgggagaataccgttatgattttctgttctatttcaaaaggacctacattacttttattggccattacataagattatcagtgatgttaagagaacatcagaaaacatactaatagaagtgaagttacagtaagaatgatgatataatttattattattaaataacaattactttatagataacatttactgagcacttaatatatcctagggggtattgaaaacactttgcaggccaagcacagaggctcaacacctgtaatc

SEQ ID NO: 184833 - DNA, 878 bp, Homo sapiens
aatgaaaaatgcccagaaggaaatgaagcacaagattcagttacacaaagatgaaagctattgaccacttggccacttctcatactaaaagagaaggaaataacacgaagtactggaagtgacattatattgtcctcatggtgacaaccaggatgggcctgacataagccagtccaggctgtatgtgtggcccgagtgcacacatgcggtttctctggccaccgaatcagaaccagctgggccccacaagtcagtctctgggggctgtgattctgcattgcaaacaagtccttgggtagctctcagggttcaccaagatttgagaaccactagtgtggctgactccagtgaaacagtcccacttttactgctttcaactgtcatttatatagattcaggcaaagaatggtttttagaatgatgcccgatgtagcaaataaaatgatctcaacatatagtttatctttgctgcagtcttttctcagatgggaagaacagattatccctctctgccacataatttgttcccttgaggtttcatagcatccagaaagttcaggtgttcccatgtccacttcccattgccttgccaggttcccatggaggaaggctgcccagctcttgggccagtcttagatgggcattttcattctccaggtatacacagcacatttcatatcagtgtggactgcctacttcaggccatgccaaggattataacttcttctataaccaggaacttcttacactcacctccagctcagtgaaattatactaagaggtgatcacttaaagggcacgcagctcagcccttcctagacagtctgggtgtcatccctggattaagccagacttcaaagaaccacagttatagacca

SEQ ID NO: 184834 - DNA, 582 bp, Homo sapiens
atggggtgtcatgagtgctcaactgccagaggcccaaacgcagctcagtaagaaaatgcttttgagctataacccaggttgagtaccattggtacattagaatcacagagtcagattttactttttggggcagtggtaggtgtggataaagtatctccagtccagatttcttgtactggtgctattgggtttgcgggtggagatttatgacctcagggataataaccggaagaacagtgagtagaaagctcagggatatgagttttgctgtatatcaaagctgtgtgactttgggaaaattacttaacctttctgggccttagctttgctacctattcatcaagaacaataaaatccatcttgtttatttcatgagattggtgtgaggaccaaatgaaatagtatatgggaaggtgtttaaaaagttgtgagttctacacgacttaaaaatgccagtattatgaatgcaaccattctttgttgtcatttgggtagtcgtggatagcgtggtggtaggagagccactatcggagcaagactgttccagagggtaaaacacacgcgtgcctgtagagcagttgt

SEQ ID NO: 184835 - DNA, 491 bp, Homo sapiens
tgcccaggctggtcttgaactcctaggctcaagtgatctgccctccttggcctcccaaagtgctgggattacagggatgagccactgcgcccaggccaaaatctttttaataagatagaggatccagggttagtttttgtagccttggctggcccatcagcctctgatgtgcttgaatttctggtccctggagtggacacagggcttagtgtggctatgctgggttcccagggccttgctgaaatgccagtacacttcttggcccttgtgaggcccagagagcaggatggtgccacagcctttgagggtgtccagggtcagctggtcaaaggtgagaatcttgtccccagccttggggatttggctgcaggcccaactgctcatgtgcagtgcacacaccttcagtttgggcacctcctgaacatggtccccacaaccacagctgttttgttttcctggccaggaagcttcatcttccagatcatccagga

SEQ ID NO: 184836 - DNA, 538 bp, Homo sapiens
caccgttgaagacccagtcctagaaaggagctttctaaattattgtttaattagtgtaatccaagaatttatgagacttttggaaaagcagagcgctagaagtgccacctttcggaggtcacggatttagtcaggtgacccagcaaactcaactcgttggggttagagatggagaattagaaccaaagctgaatcactttctgcttatcactcatagactgccagattttctttttttgttggagggaaagcaccttacaacaaataataatactattttgaatttcagagctttccctttttcaaagcactttaccacctctgacttattttgtcctcctaacaaggccataagataaggaagggagggctttttagagcctgtctaacaccctaagacagagcttaatattgctgaaggcattgaaaagtataggttttgttctctcatccctggccacactcaagtacttagtggcacaacttgaagcaaattgacatagatgtttaatcctacagtggactgtgtttttaatag

SEQ ID NO: 184837 - DNA, 242 bp, Homo sapiens
tccctttgatgcccatgtagccaccatcccaggctgtgcacttactgcaggctggggcagggcgggtgtggcttccatcaatctgatccccattatcagctcagccggctcagccacagaggaaacgagatactggtcccgctaagctctggcacaaatgggagggagaacgggtggtggccagattagcaggctaggcctcaagaacctgggtctgaaccacccagtcacctcttcactct

SEQ ID NO: 184838 - DNA, 384 bp, Homo sapiens
ccaggcatgcagagcagcagaatataacctacaattgagaagaaaaatctgtccgttgagagtaacccagaaataatacttgaaattagtaggcaggacattataacacttattatggctgtattttatatgttcaaaaagctagaaaaaagattgagcaaattaagcaaagacatggaaaatatgtttaaaagattaaaagacacaaatagaatagatactgaagaaaagactaacaaacttgaagacatatcaataaacaattcaaaatgaaacagtgaaaaaaataaatacagcaatgaggaacaggacaccttcacttggactaatatacataaaattagagtccccaaagaggatagggacacataaatgtttgaagaa

SEQ ID NO: 184839 - DNA, 178 bp, Homo sapiens
tcaagttaaataaataaagaaccaaaaaaaaaaaaaaaagtcagggaaatgaaggtcaaaagtgcaatagaaaatggacaaaagacatggacagacggttcacagaaatagacacagaaatcatttatatatgtatatgtggacatctgctcaaattcactgataaataaatgagatg

SEQ ID NO: 184840 - DNA, 369 bp, Homo sapiens
attctatgtggaagcaaatctctgacatcatgtattccatgcataaatagctcagtgtgtcaaatctacttttgaaaaggaatctgaattcatctgttcgtgtttacgatattctgtaacattagagtttaagttaaggcattaacttattacagaatcacatacagaaaaccaaagtgaaatcacagcctcagacctctcacagatatcatgttactttcaaaagatatctgtcagataaatgcagtcctgtatcacaagataattcactgactcactcaaggatggcaagatgaatacagtattgcatggctgaagaacactttttaatacaatcatattactttaggaacaaacagatagtgttat

SEQ ID NO: 184841 - DNA, 673 bp, Homo sapiens
acagtcctgggggtttattctgcttagcttttgtttttatttttatgtatttatttgttttgagatggcgtttcactgttcttgccccagctggagtgcaaatggtgcgatctccgctcgctgcagcttctggctcctgggttcaatctgcttagcttttaaatggtagcatacattaatatgggtatacaagggtacagtaaacaaacacttaggttaggattaggagaaaccacgttcttggcttacggttatttccctgagaaggccaaccggttgtccttcatttctttgtcatattatttttgtagcgttaagattaaatggtcccaccctgaaagccaccatgatgagaacaaaagccattgggtttccagaattgagacaatatcattgcagaaatgtttgggtcacatgtcagccatggccctcagtgtagctattgctggtttggagccttgggtgcaagggatcagaaaggcaggtcccactggcccagggctccaccgggagcctttgatggaatcaggccagacccctactgttgacaggatttggtggtttgttttatgttttccaaatttggtagttacctgtctcctgtctttccccccaaacctctccactccttagcttttggctttcttctgcacagctcttttccaaaggaagg

SEQ ID NO: 184842 - DNA, 160 bp, Homo sapiens
tgaggcatcaagatcaagtctgaaattcagagaccacccctaggctctgtgggactttgatcttctgttccaaggcaatgtttaggggaactagaaggcagtaaaaaaaattagtggactaggtgtatgatcgtttatccttaagctcaccattgatcag

SEQ ID NO: 184843 - DNA, 179 bp, Homo sapiens
gattaattggtgtggaatatttaagccacgagaataagtactataaaagcaagaatttataatagggtctttaatgatcagttctgttcttacacagcttctccccactcctactccttggaagcaaccaagtggtatgagttggcccctactcaccccctccctggtgtcagtggacc

SEQ ID NO: 184844 - DNA, 363 bp, Homo sapiens
gtgcccatattgtgggtggggatctctacccgtgaagtgagcgtggggctttaacggagactggatcacttatgttctacctataaatacatggaagacttggcatacctggttggtccataaaagtcttttcaattaacataccattttgtagtcagcgaattggtgaaactaacaaatagttattgttaattctgatgtttgataagagtgtttgaaattaatatctaaacattgcaaaccaggtcttcctcctggtgatctggggacatcttgagattaagagtcctccagggtaaaaagcagaaatgacagccctttcctagactttattgatttccctgtgtgcggcacctgtcacaa

SEQ ID NO: 184845 - DNA, 449 bp, Homo sapiens
gacctgttgatacctactgagattccatttaaaaaactgctacctgttacctgagagagtagggggccagctctggccagggcccaaccaacctggcgaagcaaaggcaggtatgcaaaggcaggaaggtgaaggcagtcgggcggtggttgagagtcactgaagacaaacttaagatgtctcacggggcttagccaggactagaaggtagctatggggccaggcagtgggtggatgcggtgaagtcagtgggcccctgccctgccagacatcaagctggaagcagatgaaagtgggccaagaggacagatggggcaaggggttccagcactgcatggctgcacctcttaccaagttggtcactggttctgtatctccctttccccatctacaagatgggcgtgctagactcaatgtgcccaatgttctcagcagaaaaaagtgagaag

SEQ ID NO: 184846 - DNA, 362 bp, Homo sapiens
tgagctgatttggttaaaggtgatcgtaaaatgctatggttattgcttctattttctggagcaaataggaaacaacatgatagactgagactgaggatagaagttggaagtatgaggagagaagaacaagtatgaaataagcgtgtatacttgagggagacagaatgggttagagaaatggagtgtgaaagttggccattgaggctggagatctgatgtctctgtattattattttcttcaagcactgcaaggaatgtttgagtgggatcagaggatcattaaagtcaggacgaaatataaagagtgagcaagttggaaagatggctagtggtgtctgtagagtagggtcattgaaatcgag

SEQ ID NO: 184847 - DNA, 420 bp, Homo sapiens
atttcctatatgtatgattatattgtctgaaaacagggactatttgacttcctcctttgcaatttggatgccctttatttctttctcttgcctaattactgtggctaaggtttccagaactatgttgaacaaaagtggtggaagtaggcatccttgtcttgtttcagatcttagaggaaaagctcattcatggattactaggttaagaatacttgtactagattatgagattgtagaggtcagaaccatttctctctctctctttctctctctctccctctcagttttttcatctgtaaggaccatttcttatttttaatttttttaataacatacaatgctttgcacaaagtaggtactcaaaaaacattgttagcacaagcagttgatatgcaagattactttcctcattcttagtcc

SEQ ID NO: 184848 - DNA, 309 bp, Homo sapiens
tccaaactggaaaggaaggagtccaattatccttgtttgcagattatatgaccttatatttggaaatgataaagactccataagaaatctattagaattgataaatatattcaataaagttgtaggatacaaactccacatacaaaaatcaggaacatttctatatggtatcagtaagaaatctgaaaaagatatcaagacagtattgtcatttacaataactacaaataaaatatctcagaataaacttaaccaaagacgtggaagatctccacaagaaatactgtaaaacattgaatcaagaaatta

SEQ ID NO: 184849 - DNA, 538 bp, Homo sapiens
ccctcctgtcacatgggccagcctgcgtgcaccgagcttgcttcctgttaacccaggcatcctgtgcagcactcactccactcagaaccacaggggcctgctctgcatcaaaggcataaggaaaggcacagtgggtgagggggggttctgagtgtcatgaagacgtggccccaggggagacatgccacatgcccagaggctgaggacccacacagcctgctctagagtttgggtaagagctcggcttctggatccagcccatgtcctggctggacaggggcagccccaaggggtgaggactgacgtagttgaaatcctctccttgcggggcggcctgagcctcagcttcacctgctgcaggcaccatgccacacctgcctggtcacccatcctcactcagccacggtggtcacacactgtcggggtccacacaggcacctgcccaggctcttccacagccacggtgtctgtattccgcatttcaggctcctccccatctgtcaacaccaacgcacccccgctgccctcatcatctaca

SEQ ID NO: 184850 - DNA, 400 bp, Homo sapiens
gcaatttttgaattagacgcattaagcagtagggagccagtgaagggcagtgacctagtcagagcaacagatgacacaaatttttcttactatggcattttattaataaattggttatataagaaataggaagcagagatttaaaaaatgaaagttttttaatagtgtaagggttgtaatgcaaaccctaaacaaaaaggggccataaattaaaagaaagatacttaagtaacctaagcaacttaagtgggattcagagggagtgaactaagacaacaatatgatgtaatgcctggaaaactgaggtatttttaaaactttgcactaagtatatcgtcaagtactatggcttttgagttttttgatttgacctatagtaagaaatgtattttacatcatg

SEQ ID NO: 184851 - DNA, 377 bp, Homo sapiens
cagggtgcactgcatggtgcttttggtggaaaagctcgtatagcaaaaacatgtgtctcgcatggagaaataaatcatgtaaacgactgtggccccacttcatgcactggcatgtgtaaaatgtgtttattagcataatagctcatttcactgtattttggctcttaaggaatcttgcagaaacactttcttcttttcctgttgagacatccttttagtccattatgggccaattgcctctgggaattgttaattctaaattaaaatcattaaccatcagaagtgaagcctgtgcgtatacagatcacaatttgtaatcaatatggcctcgcgggtcccagacttgtctacctgactgtgtacttgtcagctcaacg

SEQ ID NO: 184852 - DNA, 102 bp, Homo sapiens
tttctttttctttttttctttcttcttagagtcatgtttttaacaagcactgctgtttggtcagtcaacaaacacactgaatactcactatgggcacaatga

SEQ ID NO: 184853 - DNA, 231 bp, Homo sapiens
tgctgttgagatgtttgaggtccctgtacattttggacattaatcctgtcagatgaatagtttacaaatttttttctcccattctgaagtttatcttttggctctgttgtttcctttgctgtgcagaaggtttttagtttgatataatcccacttactttttgttgtctatgcttttgaggtcttatttataaaaatgttttcccaggccaggcggtggctcacgcctgta

SEQ ID NO: 184854 - DNA, 452 bp, Homo sapiens
gtaagatcgagcgaggaggatgaacaaagaaactgtttatctgtctccttgtgaaatacatagagtaagggagcgccgtaactaacacatctcttatttaatgtctgttgccctcattaggtttaattacaaaatttgatcacgatcgtattgtagtctctcaaagtgctctagaaattgtcagtggtttacatgaagtggccatgggtgtctggagcaccctgaaactgcaccaaagttgtacatatttccaaacatttttaaaatgaaaaggcactctcgtgttctcctcactctgtgcactttgccgttggtgtgacaaggcatttaaagatgtttctggcgttttctttttatttgtaaggtggtgttaactatatagttattggctagaaatcctgagttatcaactgtatatctctatagtttgtaaaaagaacaaaacaaccgag

SEQ ID NO: 184855 - DNA, 195 bp, Homo sapiens
tccctgacctccatatttaaaataggaccctcactgccctaccctagcccctccccattaccatctttatcctgccttgttttggtccatatgacttaacagcatctgatataccatatacagatgctccctgacctacactggggttacgtcccaataaacccattgcaagttgaaaatattgtaagtcggcca

SEQ ID NO: 184856 - DNA, 475 bp, Homo sapiens
ctgaggtctaagactctcacctgtggctctaaatctttgtgtccaactcccacgtgggccccactgcctgaggtctaggatcattcttacctctggctctaaacccctggcccaaagcatcactgggtccctcagcccgaggtctggagcctcctctcactgctggctgacagctgcttctctgatcctcagctgggacctgctcttctctccgtctcactacttcattccccattccccagctcagcagcctgaggtctagggctctaggagcactttccaccttcagctcataatcccgaacccaaccccatctggacctgaagcctgaggtctggcaccttcaccaccatgtctcaacctctacccttgtccctagagtggccctcacctctcttcctttttttttttcttttttctctttgagatagcatctcgctctgtaacccaggctggagtacggtggtgcaatcat

SEQ ID NO: 184857 - DNA, 306 bp, Homo sapiens
ggggagcgttctagaggatcccagatgatggtccaccgcgtcgtctgcacggacttcattccccattccccagctcagcagcctgaggtctagggctctaggagcactttccaccttcagctcataatcccgaacccaaccccatctggacctgaagcctgaggtctggcaccttcaccaccatgtctcaacctctacccttgtccctagagtggccctcacctctcttcctttttttttttcttttttctctttgagatagcatctcgctctgtaacccaggctggagtacggtggtgcaatcat

SEQ ID NO: 184858 - DNA, 262 bp, Homo sapiens
ggtgccaaccagatgttgatgcctccaggaggaacctgacctgggataagagcaaggagcttgtctgcagaggacagcatgggaaggccatcgaggaactgactcgcctcactctcgccaaccagtgtcggctctcttccccatctgcatgtgctcaggtgaaccttggcccatctctgcgcctcaagtcctagatcagtttacctacgaccgccataacaaattaccacaaaggcttaaaacaacagaaatgtagtctctc

SEQ ID NO: 184859 - DNA, 593 bp, Homo sapiens
attagaggacaacgtggcttgatcccagatgggcttttaatgacttcctcctgaactggatttatcctcaggccttgtcctggccgccttacaggatcacagcgagtagacagacccgaatgactcagagggacgagggctggctgggcacgcacagttcctgctcccagttccataggaagagtgaaagaaaagaaagctggccaggtgcagtggctcacccctataatcccagcactttgggaggccaaggcaggcagatcacctgaggtctggagtttgaggccagcctggccaacatggtgaaaccgtctctactaaaaataagaaattagccaggcatggtggtgcgtgcccgtaatcccagctactcaggaggctgaggcaggagaatcgcttgaacccaggaggcggaggttacagtgagccaagatcacaccactgcactccagcctggcgacaaagcgagactctgtctcaaaaaaaaaaaaaaccgaaagatgtagactttgttgttgaagccccttaattgtccctccccactcctttttcctctgcggggttgaccattcttttgagttaaggcttatcat

SEQ ID NO: 184860 - DNA, 587 bp, Homo sapiens
ggctgtttctgagaagtgccatctcttgacttccatgatacttaattcagtcattgtttgataactcctgctctattctgtcattaattgaaaagtcagtatctattgaggttcatcattagatttttttgtcctcaaggattgaagagcgtagctagaaactggctttgcaagttatgtttgggacctctaactacaataaaacagaagctctagaatagagagttgaacagtgttcacagctaatttacattgactcaattctcttgttttattgttggaataaagtcatcattgatcattgaagcatcctggaataatattctggaactgattttagttttctaaggcttttttcccttgtatataccatctattttctaatacttcatttattttcaagtatgtactttacacgttaatgtttctgaaattgagatggctctaccagccaatggaacatcatttataattgagtacatttttttctctcttaatgagaaataaagtaggtgttacaaccagtaccatttaatgaaatatagtattttgataatatatagtactgtgtcaccacttgaccccaa

SEQ ID NO: 184861 - DNA, 196 bp, Homo sapiens
gaggaggcaaaaagggagggaggggtatttactccacatgaatcttgaccctgaatcctcactcgagctctctgccagacatgtggagcgcttttctggcattgcagcttgtagttcagtctcactctttggagtgattggttcaacagggctgcctccgcctggatccttagactgtttggtgatcacccagcat

SEQ ID NO: 184862 - DNA, 128 bp, Homo sapiens
gtccaaaatatacaatgggggatatacccccttaggaggatgaatacctttcctagcctactttctgtcattgacacttgagaacccaaagatcactttggtcttgaacagtgacagtctctcttagc

SEQ ID NO: 184863 - DNA, 109 bp, Homo sapiens
tgtacactctatgtatagactatgctctgggtggctgctagacaggcataggtgggccaggggtagaactggatactatatggaggccactagcatttcaggtcttagt

SEQ ID NO: 184864 - DNA, 513 bp, Homo sapiens
catttaagatgtaaattatagggataaaatatagataactcacatggggtgatttgattggcatctgttttcatttttctttgtttctttttagataccaccaaagtccttcctatttcaggcaaaaagatatgttttaaaaaccactcacaaggcctctacaatatgtcagataatgcatgtgcgtgaatgtccttggatgtgtatggtctcttgcttgaagttatcagccagcaaaatggtgaaatacttagaattaatcaaacatctggaggtcaagaaacgcagtacctatattcttctccttactttaagaatgaaactaataaaaaataaggcggagctggcccttcagcaaaggagggatttttattatatgagtgaatttgagagaaagggggacaagaaaagacctttgagatcagggcccaggtctgttttgttactactgtatccttactgcatagcacagtgcctggcacctagcatggtcacagtaaagattgaatgata

SEQ ID NO: 184865 - DNA, 275 bp, Homo sapiens
gaagtggggccttcggggaggcgtttaggtcacgagggctctgtcctcatgaatagattaatgctgtcataaagtgacttaatggaagaagtttggtccctttcttgcctttctgccttctgccatatgaggacacaaagtgtcctcccctctggaggatgcagggttcaaggtgtcaccttggaagcagagactagaccctcacaagacactgaacctgccagttccttgatcttggatttccaaaactgtgagaaataaatttctgttcttta

SEQ ID NO: 184866 - DNA, 648 bp, Homo sapiens
ggagggtggtatctgagccaaggcctgcgtgtggcaagctccgcaggaaagcccccaggggagcctgctgcacgttcatgccgggaagccacaactgtagaccatccccctgtgttcagaggggaagctggaccgtggaggcaggaagggagacacagagtactccatgccctttttacccacctctgttccctctggtccagcaaataagcatctgtgggcgggtggtgggaagtcaagtaatgaagagttgcaaggtgtggggtaggtataaagtgtctcaaggcagctgggccaccacttggggggtcaccacttggggggggcacctttctacctcttcctgtttcagcctggagtctaagtcatcagttccataaaggtaccaccactactactaaataaatacacagccttaggatttgggggcagtggggagagaagatgatgaacgtttggaaagtgaaaaaggctttccctttcctgtgatctcccatctcttaatcaaaaaagtcttaaaacacggtagaggctgggctccgtggctcacacctgtaatcccagcactttgggaggccgaggcgggtggctcatttgaggtcaggagttcgagaccagcttggccaacatggtgagacccccgtctct

SEQ ID NO: 184867 - DNA, 413 bp, Homo sapiens
tcgacctcgggccccgttttagcaccgtggtaggtataaagtgtctcaaggcagctgggccaccacttggggggtcaccacttggggggggcacctttctacctcttcctgtttcagcctggagtctaagtcatcagttccataaaggtaccaccactactactaaataaatacacagccttaggatttgggggcagtggggagagaagatgatgaacgtttggaaagtgaaaaaggctttccctttcctgtgatctcccatctcttaatcaaaaaagtcttaaaacacggtagaggctgggctccgtggctcacacctgtaatcccagcactttgggaggccgaggcgggtggctcatttgaggtcaggagttcgagaccagcttggccaacatggtgagacccccgtctct

SEQ ID NO: 184868 - DNA, 713 bp, Homo sapiens
tgcatttgccaccacgtgtgggtggccaccgctgttccccttgattttaaacgagggctcataaatattgttgaccttgctgagatattacctggtggagctggaaggtttgtaaaccttcttccgatgcccgtttattgattagaacaagctaacaacactgcacttaagtggaaaaaacagctggtaaaaatgtaattctttcagccttagggctgctgtgctccttttctggagagcaaatgtggaaatcaagatctgtggccttctggaaccttcaccaggaaaggtgaaaagaagaagaacccatccacagctgagagtggatggcaggcccgcgggtttccaggtggccagtaggattgtccgatgtctggaatgagtaccggggccgccaccaggaacacttgtcatttctaccatggagaggaaagcccagtgcatttctgtggttcagaaacttgacacaaagagaaaagctggaatgtttaaaagcaaaaatagggcagagatcagtgaaagtgcaggatgtgtgtgaaacaagggtagagtgagcactggtggggatggaggtggtgaggggtcttctgagctggggacgtttacttacaccagccctgcctcccaagaacccatcccctgtgggtccagaagaccagatccccgccaatgtccttccctttcagagctgtctggaggagcatgccactagt

SEQ ID NO: 184869 - DNA, 769 bp, Homo sapiens
gaaattacttgcaaataactaggaatggcatttgagttggaacctaaatgatgggcaaattttggacaaaaggcagaaagggcattccaggcaaggaaagtacggactgatctggcacattgtgggtgagaaatggaagtgtacattggagataagtcatgagttttaagctgaagaagtttggctttttttcccccagtctttggttctaaaactttgctgaacacaaaatcagatgggcacatttattaaaaatacaaattctcgggccttatctcctgaagatttgaatttaggtttacaggatagcctagaaattagcattgttagctgtgatgctgagcaggtctgcatgtggtctgtgctttgagtaagttaagggaatttttaagtgattcagttgtatgtgtctctgataggatcacatgggggagatttgaagaaattagaaaacccagagttttgagggtagggtttgataaccaggtttaccaatgggaaatggggtgggggaaggtttaagttgaagcaagaggagtgctttaaactctggtggtaactctgatttaacaaatgctaggaagacctgctttttgctaggtcctgtgcaacactgtaatgatagtgatccataaaatgcactcctagatggaggctcaaagtctagaaaatctttccaaatttaatcctcataaactccctgttaaatacgtgtgaaactattttgtgccttaatatagagaaggtaacttgtccagtgtgcagctag

SEQ ID NO: 184870 - DNA, 376 bp, Homo sapiens
caaaggtcgagagaattagcggagcagtatggtgactacatttcatctctcaaaagacagcagcaataggatgctgatctcaggaggaagcagagcttagaaaacacaatctgtcttcaaggctcattcaaatgcaaacattatggtcaggggcaagatgtccactgcctaatgaggtgcccatataactacggattaggacaatctccttacatgaactcaaacagccagcccagcaggcactcctaaacagacccaaattgctgaagcatctgaaagtaggaagccccggcacctaagaattggtggcaggaaggaattagatgtctaatccatgtatttttgtttcaccagactaatttctctcggaccaatc

SEQ ID NO: 184871 - DNA, 596 bp, Homo sapiens
ctacggtgggaggatcacttgagcccaggagtttgaggctacagtgagctctgatcacaccactgcactcctccagcctgggtgacagcgagattccatcttaaaaaaaaaaaatcctcattaaaagcagacattgtgagattggataaaaaagcaagacctatttatatttatatgctgtctacagttatcccactttgaatataaaaatacaaatacgttaaaagcaaaagagtggaaaaagatgttaatatgttaacattaatgaaaagaaaaccttagtggcatattaaacaaactatattttaaaatgaatgtcaccaaggataaaggagaattatttcataataataaagagatacattcatcaagacataattctaaatgtttatgcatgtattaacagagattcaaaatacaaacttttcaaggagaaataaatctgtaattatagttgaaggtttaacaactctctcacaaaaactgatagaacaagtagacaaaaatcagtgaggatatagaagatttggacaatataatcaactgacttgacttaattgatgttcagtagaacattcgacccctaaacagcagaa

SEQ ID NO: 184872 - DNA, 331 bp, Homo sapiens
ctgccaactgagccagggcttgggcagtcttgaattgctccaagaactgggagcctgtagtactgccgcctttagcttcaccgacatcaccaaatcctttccctaacatgctcaccatactgtgatgagaaaatgtgttccttgaggcagcctgtgatatgccagcctgcttcgaataactgaccaccaaagcctgacccaaagaggaggcttggaccggacccgaattggaggatcattcttcaatggagaggggggcttccccagcagaacagccaggtcaattctttgaccagcagtgattgtcaaattctcagcaggtgcaacaggg

SEQ ID NO: 184873 - DNA, 249 bp, Homo sapiens
taatacacttgaaacgtaagacacatacttaatagggattgttgtctggaaagaaatgcatgtgatcaagccactgaaaactcccccaaaacagtacagtctctgacatctctgtttaccttactcatttgtataatctttttttgggggggcagggtggagtcttgctctgtcgcctaggctggagtgcaatggcatgattttggctcactgtaaactccgtctcacgtttcaagcgattctcctgcc

SEQ ID NO: 184874 - DNA, 538 bp, Homo sapiens
tgaggatccctatttatttgttttgtgtgttcgaatgtcattttatttttatgttattggtggatgggaacatagtcagtgaggaggagtaggctagtcgtatgtagaaatagaggtttagcagtgctgttattgctatgggtgttggcatgatgatgctttcattttttgttatttcttgaatgattattcattttggtataaatcctgatagtggaggcaggcctcctattgagagtagggttactattattaggcttgtgatgatgggtatcttgtttcatgtatgggatagggagaaagttgcgctgtggcttatcgagtgcttgtagctgtggaggcttgtccatggggtgtttgtggggccctaggagacaggacttccggaggcagaggaatgtttcaggggctaaggagagactcagcagacctggagcccgcttaagctcatctctggtggccttgtgggtctttctcttccctgtcccttttccagtcctgtctggccaccccaactggcgaaggcctcaggcatgtg

SEQ ID NO: 184875 - DNA, 235 bp, Homo sapiens
aagccataaatatacatgcagcattggatggcactttctaatcgggttccatgttcttcctatactgcacattgttagagaaattaaacttcagaaatgatgtgccaatttagtattacttgttagtaaaagacagtttttatacaagttaaagagatcaatgggtccaattaattccactgtttttcttcattctactaaaatttaacgcatacatatcaatcaaaaatacaaa

SEQ ID NO: 184876 - DNA, 224 bp, Homo sapiens
acaaccaatcccccacagatactgaggaacaactgtaatttagaaaactgggagaagctacctgagtagactatttacacaatgatactgcactaacaacctaatgattttagtggtttgcaacaatagcatttatttttggctcttaaatctgtggatgaactaagattcagctgatacaggttaatgcataatgggattgctccaagatgcagattgggtct

SEQ ID NO: 184877 - DNA, 739 bp, Homo sapiens
gtaaaaggtaattacacattttatttccagaaagtcaggggtctataaattgacagtgattagagtaatactttttcacatttccaaagtttgcatgttaactttaaatgcttacaatcttagagtggtaggcaatgttttacactattgaccttatatagggaagggagggggtgcctgtggggttttaaagaattttcctttgcagaggcatttcatccttcatgaagccattcaggattttgaattgcatatgagtgcttggctcttccttctgttctagtgagtgtatgagaccttgcagtgagtttatcagcatactcaaaatttttttcctggaatttggagggatgggaggagggggtggggcttacttgttgtagctttttttttttttacagacttcacagagaatgcagttgtcttgacttcaggtctgtctgttctgttggcaagtaaatgcagtactgttctgatcccgctgctattagaatgcattgtgaaacgactggagtatgattaaaagttgtgttccccaatgcttggagtagtgattgttgaaggaaaaaatccagctgagtgataaaggctgagtgttgaggaaatttctgcagttttaagcagtcgtatttgtgattgaagctgagtacattttgctggtgtatttttaggtaaaatgctttgtgtccatttctggtggtgggaggggactgaagcctttagtcttttccagatgcac

SEQ ID NO: 184878 - DNA, 587 bp, Homo sapiens
cagaggatccctctactcgcgactgctgtggggttttaaagaattttcctttgcagaggcatttcatccttcatgaagccattcaggattttgaattgcatatgagtgcttggctcttccttctgttctagtgagtgtatgagaccttgcagtgagtttatcagcatactcaaaatttttttcctggaatttggagggatgggaggagggggtggggcttacttgttgtagctttttttttttttacagacttcacagagaatgcagttgtcttgacttcaggtctgtctgttctgttggcaagtaaatgcagtactgttctgatcccgctgctattagaatgcattgtgaaacgactggagtatgattaaaagttgtgttccccaatgcttggagtagtgattgttgaaggaaaaaatccagctgagtgataaaggctgagtgttgaggaaatttctgcagttttaagcagtcgtatttgtgattgaagctgagtacattttgctggtgtatttttaggtaaaatgctttgtgtccatttctggtggtgggaggggactgaagcctttagtcttttccagatgcac

SEQ ID NO: 184879 - DNA, 449 bp, Homo sapiens
ataagtattttttaattcaatggtctaagaaaggtgttggtactctgtttccctgaaaggtgttctctagaactggagatgaacttgttgtagctttttttttttttacagacttcacagagaatgcagttgtcttgacttcaggtctgtctgttctgttggcaagtaaatgcagtactgttctgatcccgctgctattagaatgcattgtgaaacgactggagtatgattaaaagttgtgttccccaatgcttggagtagtgattgttgaaggaaaaaatccagctgagtgataaaggctgagtgttgaggaaatttctgcagttttaagcagtcgtatttgtgattgaagctgagtacattttgctggtgtatttttaggtaaaatgctttgtgtccatttctggtggtgggaggggactgaagcctttagtcttttccagatgcac

SEQ ID NO: 184880 - DNA, 368 bp, Homo sapiens
atcgtcaccatgggtcggagcacacgaagtacaagaggaccatcctaccagtggggccacgtctcaacggtttatccatcacccatttttctgcacgtcatcctgaggtaaaccaatttttaataaggatcccctaggttgaaatgggcacagaaattacagtgaaaaagaaaagaaaaagaaatggaaaagactgaagaaagaaaagagactcaagaattcctatttctaaaaatgttcaaaatattgaagtacattcaccgtcttctcttctgctcccttaacacttaaacagatccattactggaatttctttctagaggagggtaacccaaatttctgtgcccatttcaaggccgatctcgatt

SEQ ID NO: 184881 - DNA, 248 bp, Homo sapiens
tacatcgagctcggcaccttgtaatgggcacagaaattacagtgaaaaagaaaagaaaaagaaatggaaaagactgaagaaagaaaagagactcaagaattcctatttctaaaaatgttcaaaatattgaagtacattcaccgtcttctcttctgctcccttaacacttaaacagatccattactggaatttctttctagaggagggtaacccaaatttctgtgcccatttcaaggccgatctcgatt

SEQ ID NO: 184882 - DNA, 615 bp, Homo sapiens
tttcttgaacagaaactttacaccactgtcattatgttacctatagagacaaaactactaacacaagtaatatgggcttacaattataacacaaacctgtgagagggcatgataaaattaaattttgattgccttcttttattattatcactactactgtctgctcacaatttctgtgcccatttcaatgggcacagaaattacagtgaaaaagaaaagaaaaagaaatggaaaagactgaagaaagaaaagagactcaagaattcctatttctaaaaatgttcaaaatattgaagtacattcaccgtcttctcttctgctcccttaacacttaaacagatccattactggaatttctttctagaggagggtaacccaaatttctgtgtgcccatttcattgaaatgggcacagaaattaaaacaggcaagtaaagtatttcttcggaaaacattttatcaacaccaaatgttaaaaagactttccttttgtaaaactggattagagaagacttttcagtgggttatctctaggatgatcagtagttcagcacttaataactgcagaggaaactgaaagttatgttccagatgactttccgttgtttaccatatt

SEQ ID NO: 184883 - DNA, 398 bp, Homo sapiens
tggtaggatgttcctcttgtacttcgtgtgctccgacccatggtgacgatgacacagcctggtggcatgcccgtgtatgttggttctagcgttgtctgcattgttctagagtgatacaggtgtcaggctgtcactgttcacacaaatttttaataaggatcccctaggttgaaatgggcacagaaattacagtgaaaaagaaaagaaaaagaaatggaaaagactgaagaaagaaaagagactcaagaattcctatttctaaaaatgttcaaaatattgaagtacattcaccgtcttctcttctgctcccttaacacttaaacagatccattactggaatttctttctagaggagggtaacccaaatttctgtgcccatttcaaggccgatctcgatt

SEQ ID NO: 184884 - DNA, 601 bp, Homo sapiens
tggtaggatgttcctcttgtacttcgtgtgctccgacccatggtgacgatgacacagcctggtggcatgcccgtgtatgttggttctagcgttgtctgcattgttctagagtgatacaggtgtcaggctgtcactgttcacacaaatttttaataaggatcccctaggttgaaatgggcacagaaattacagtgaaaaagaaaagaaaaagaaatggaaaagactgaagaaagaaaagagactcaagaattcctatttctaaaaatgttcaaaatattgaagtacattcaccgtcttctcttctgctcccttaacacttaaacagatccattactggaatttctttctagaggagggtaacccaaatttctgtgtgcccatttcattgaaatgggcacagaaattaaaacaggcaagtaaagtatttcttcggaaaacattttatcaacaccaaatgttaaaaagactttccttttgtaaaactggattagagaagacttttcagtgggttatctctaggatgatcagtagttcagcacttaataactgcagaggaaactgaaagttatgttccagatgactttccgttgtttaccatatt

SEQ ID NO: 184885 - DNA, 373 bp, Homo sapiens
ttgaaatgggcacagatatttcaatgattggtccaatgttccgtttcttgtttttaatgagttcagataccataaccctgaactttgtttctaacatcttgcttaatttccagaatgtgcctaaattgcttcctaatttctgtttgaaatgggcacagaaattacagtgaaaaagaaaagaaaaagaaatggaaaagactgaagaaagaaaagagactcaagaattcctatttctaaaaatgttcaaaatattgaagtacattcaccgtcttctcttctgctcccttaacacttaaacagatccattactggaatttctttctagaggagggtaacccaaatttctgtgcccatttcaaggccgatctcgatt

SEQ ID NO: 184886 - DNA, 294 bp, Homo sapiens
aggatgacaattaacaccttaatttataacaatctagttcagattaacaccaacttaattttagtagtacatgaaatgtcgcacctatatagctccatctctctcccccacccatgatgctattgtcacaaaatatgacaccaaaagcataaacaacaaaacaatagatagattagacttcatcaaaatttaaaacttttctgcatcaaaggtagaagtctagcctctctgtgtggtctccgttgacaccatggggaggaggacaccttgccactggctccctgcttagccttc

SEQ ID NO: 184887 - DNA, 502 bp, Homo sapiens
tgccttgatgtgctgcacacatttatacacatggaaacaaagatcagactgattcacagacaacactaatgcctatcaaaactcatacaataatgtctgtaataaagtgaaatgccaaagtactgccctagggcagcacaggcagcgtgattcagggagacataaatatgtgcctctatcatggaaactgaaatacttcccctcccagtgagaaagtcactcaagtgattcaaggatgaaacagatctgggcaaagcaattgcctgcacagcataattagctcacggctcagaatgttttctaattcaattactggccctatctatcagggctgaggagcattcggcggtggagatttaaaatctgctcttgctgacgtcaatgaatgactggctgccagtccctgatgtcaccagttcaacaagcacacatggaaatgctgggtcaattttttattttaaaaagaaaacattctagtatccaagttttcttttttttttaa

SEQ ID NO: 184888 - DNA, 139 bp, Homo sapiens
cctggtaaattttaatgaatagcatcttggattggttgattcttgattgagaagtcaaggagttgacttctagaataaaatttttaaagaagaaaccctcttttaaatatagttttatactcaaaacacccttttggat

SEQ ID NO: 184889 - DNA, 196 bp, Homo sapiens
cccttcctcagctgatatcacccctggctgcgctcttctctgtgatacaaaaggcacttttggagtgaatgatactctctccagctgaaaaggccaacctgtaatatatctacatctatatttagattatagaattagatcccaatttagctgactttcatctcatagcctgtgatgtttcccagcgctgcctgaa

SEQ ID NO: 184890 - DNA, 277 bp, Homo sapiens
gtcaggatagctaaatatctttatgtggagctcattttaattggcccagagcaatccacgttactagtgaaagagcctaaagcagtatttcccaaacaattctgagttgtaacagacctctggacttccttagagtctgagaagatgagtatgtaggaaagtgaggccctacaattattaatattgttctctacccaggtatccaagtaatctagtcacctgttcatcagcccctctgaccatccagccatccatccctcgctctctctctcataca

SEQ ID NO: 184891 - DNA, 644 bp, Homo sapiens
ggagagaagagcatccaagaatgcaacaaaggtgggaagactttcattgtagctcattatataatgtcagagagttcctgttggagagaacccctatggatgtaatgaatgttgaaaaagcatttatttggaactcacatattatttacaatgagataattcatagaggatataatggatatgagaggctttggtgtactgtgggaagtaggtggaaatgtgggttcctgctattgccagctgctcccttttgaataaactgccctagcaggtgcttgccccagggtggccatgctctgtagggaatcttgctttagactgggattgtaagatggagacaaagacagccttattcctggctgggaatgccactggaaatgctaggggaggccagtggtccatggcgtggcctgatctcaaatatgcagaaaccagaagcagagaccagacccagagagaggcagataaatgcaacccccaaagtggatgcacaggaaaatggaaaactactagagttagtgttgggtctccagagctgcctttttatcctgaacaatgatgagcaatgactccaggtcttcgtgaaaccaaacagaatagctgaggcagcttcctacacctctgcactaagttttttaaatctg

SEQ ID NO: 184892 - DNA, 687 bp, Homo sapiens
taagaagttttttgcctacatacaaagtttcagaagatatactcacatgttttagatgttttacatgtagatctgtctatgatgcatctctaactttcctgtgtggtaggagacaggggtgagcccatttcaggaaaatttgtagaccaagtactgcaactttgttcctattagctattctaggtctgatatggtttggctgtgtccccacctaaatctcatcttgaattcccacgtgttatgggagggatgcagtaagaggtgactgaatatgggggcaggtctttcctatgctgttctcatgatagtgaaggagtctcacgagatctgatggttaaagaaaaaaaaaaggggggggtttccctgcacaaaactctttttgcctgctgccatccacttaagatgtgacttgcccctcctcgtccatgattctgaggcctcctcagccatgtggaactgtaagttcaattaaacctctttcttttgtaaactgtccagtctcaggtatgtctttatcagcagggtgaaaatggactaatacaagtccctttgcatttccatagaaatttcaaaatcaatgtgccaatttcttccacatcctccctgagatacaatcccaatagaattactatcgggcctgcattgaatctgtattactgtagagagaagtgacatcttaatattttc

SEQ ID NO: 184893 - DNA, 314 bp, Homo sapiens
tctgtccttccttctgggcttctttttattcttgctttaactgccacacggtcttgctctgacacccatgctggagtgcaggggcacaatcacagctcactgcaaattgaacctcctgggctcaagcgatccacctgcgtcggcctcccaaagtgctgggattacaggtgtgagccaccgtgcctggccacaattaagcatgttaatatttcaacagtagcttttttactgaacactatgtatcagacacgttatgcagaatttttcctttgagcttctgtataccctccttttaatccagattcagagtaact

SEQ ID NO: 184894 - DNA, 400 bp, Homo sapiens
agttgtcagttccataatattcaatttattataagcgagtcattattttctgccccacactcaagggaagggaaataagttctatattttagaagggggagtgtcaaagaatatttggacgtaatttcaaaccaccacaatctgttcctctcctttgctttcatactgggacaaactgtcgtcagttcttacctacacaacataatacgattctggttggtcttccctcatcttcactgctcttccactcttgtgcatttctaatccattctccatggagaatcccaagtgatcatttgaaaacacaaatctatcatatcacctttcttctttttttgttgttttgttttgagacagggtctcgctctgtcgcccaggctggagtgcagtggcacgatct

SEQ ID NO: 184895 - DNA, 209 bp, Homo sapiens
gaagtctaaaatcaaggtgtgtgcttctgacactccctggctgaagcagtatcccgccaacctctgccctcatggtcacatggccaccttctctatgtgcctcttatgaggacacttgtcattggatttagggcccacccacttaaaaccagcatgctctcatcttgaggtcctcagttattatctgtaaagaccctttgtccacataa

SEQ ID NO: 184896 - DNA, 498 bp, Homo sapiens
tcagtaagcggagcatcagtaagggagcagcagcagcaatagcaacacaacatacccccagcaggcgtgaccgctccgcttactgatgctccgcttactgatgctccgcttactgatgctccgcttactgatgctccgcttactgatgctccgctcagtaagcagaacagagtgctgggatggatcgaagtaggagaccgtgcccacccctagattgttcttaagctcttttttgcatcttttacttgcctagactctgaaatggctcactgtttcctatcacataagagccaaactattctaatttcaaagcctgctctgactcagtcccattttacctctccagccggcttgtttctaactgttgagaaatcacaccttttgacaaggctgttttttcactggctttcgttagtgctgtgctcgcttactgagtaagcggagcatcagtaagcagctcagtaacggagcatcagtaagcggagccaacacacatac

SEQ ID NO: 184897 - DNA, 373 bp, Homo sapiens
acacgtcagttgagctgcctgtggaggtaagcagaacagagtgctgggatggatcgaagtaggagaccgtgcccacccctagattgttcttaagctcttttttgcatcttttacttgcctagactctgaaatggctcactgtttcctatcacataagagccaaactattctaatttcaaagcctgctctgactcagtcccattttacctctccagccggcttgtttctaactgttgagaaatcacaccttttgacaaggctgttttttcactggctttcgttagtgctgtgctcgtttctgtctttgagattttgcacattatcttttatgtgctcttttgcccttttccacctatttaaagtttgcctttct

SEQ ID NO: 184898 - DNA, 491 bp, Homo sapiens
caggtggctgcccaccaaataaaataaaataaaattgaataaaagaaatgggcctatacctgtgattttattgaatgctgtttctctttgctattcattcatctgtattctctctattttgtagttattcgttgctccatgcttcacgaaaaacatttagcaatgtcaaagtcagtatctctgagcagtggaccccaagtgcttttaacacgtcagttgagctgcctgtggaggtaagcagaacagagtgctgggatggatcgaagtaggagaccgtgcccacccctagattgttcttaagctcttttttgcatcttttacttgcctagactctgaaatggctcactgtttcctatcacataagagccaaactattctaatttcaaagcctgctctgactcagtcccattttacctctccagccggcttgtttctaactgttgagaaatcacaccttttgacaaggctgttttttcactggctttcgttag

SEQ ID NO: 184899 - DNA, 558 bp, Homo sapiens
tggccctttgtctcccactgttttccatcttagacgaggagttgtttttggtctctggagtgcctgtgcttcggtgggcaacattttgggagcgtgcctagcttcttctgttcttcagtatggttatgaggtaggtattgttttctagctctggtgctctctctctctctctgtgtgcacatgtgtattgctttttatgtattaaataatactgtggccatttaaaactatgtagaactgtgtctggatagggcaaggcttgtattaaaagtagacaaacttctggccgggtgtggtggctcacgcctataaccccagcactttgggaggccaaggcaggcggatcagccgaggtcgggagtttgagaccagtttggccaacatggtgaaacctcgtctctactcaaaaaatacaaaaattagctgggtgtggtggcgcatgcctataatcccagctactctggaggctgaggcaggagaatcgtttgaacccacgaggcggaggttgcagtgagccaaggtcgcaccgcttcactccagcctgggtgacagagtgag

SEQ ID NO: 184900 - DNA, 2999 bp, Homo sapiens
ctggcggcgggggaggcgggcagcggagccaagctgacccggcgagcggagccggggctggagagcggcgaccactgcggatctcggaaggaagaaatgatgtaaatcactcatccaaactttaaggtcaaaggtgagaaggaaggtcaggaagaacatggcctggccaaatgtttttcaaagagggtctctgctgtcccagttcagccatcatcatgttgtagtgttcctgctcactttcttcagttattcgttgctccatgcttcacgaaaaacatttagcaatgtcaaagtcagtatctctgagcagtggaccccaagtgcttttaacacgtcagttgagctgcctgtggagatctggagcagcaaccatttgttccccagtgcagagaaagcgactcttttcctcggcacactggataccattttcctcttctcctatgctgtgggcctattcatcagtggcatcgttggggatcggttgaatttgcgatgggttctgtcttttggcatgtgctcttctgcattagtggtgtttgtctttggtgcgctcacagaatggctgcgtttctacaacaaatggctgtactgctgcctgtggattgtgaacggcctgctgcagtccactggttggccctgtgtggttgctgttatgggcaactggtttgggaaagccggacgaggagttgtttttggtctctggagtgcctgtgcttcggtgggcaacattttgggagcgtgcctagcttcttctgttcttcagtatggttatgagtatgcctttctggtgacggcgtctgtgcagtttgctggtgggatcgttatcttctttggactcctggtgtcaccagaagaaattggtctctcgggtattgaggcagaagaaaactttgaagaagactcacacaggccattaattaatggtggtgaaaatgaagacgaatatgagccgaattattcaatccaagatgatagttctgttgcccaagtcaaggcgataagcttctaccaggcatgttgccttcctggagtcataccgtactcactggcctacgcctgcttgaagttagtgaattactccttcttcttctggctccccttttatctgagtaacaacttcggctggaaggaggcggaagccgacaagctgtccatttggtacgacgttggagggatcatagtatttagtgtctctgatccgggacaagctaggatggatgtgggttttctactttttcattctcatgacaagttgtacaattgtgtttatctcgccattaatagtgagggaaatattctctctcgtgctaaggagacaggctcacatattgagggagtgaccggtgcccgcgagacagaaagaacaatgtcagccacatcaggaccgctggggcttcgagtctgccctaatttgggtttgtctaggagctccagcctgatcttggattgtcaggcgtctctcaacactgccagccacctgagatgctgaccagcagtgaaggctgcactagttttctacactacaggaattactgttgatgatttttgctgttgtttcatgaatgtgccgagtgacttctgactctgccagcatctttgacctctgactctgcccgcgtctttgtttggcctattgaggtttagcgttttaaccttaactgttgttttggacttgaactttctctagccttgaaaatggagtgaacaggaggcaaagccacgcgtggtttgtgttggtggtatgttccacaaatggaagagatcattgcattttgctttggtaatgagtttacagagagtgggtcatctttgaagcatcaaatcctgatcaaatgctcaagctggaccgagctgcaagcctgccttggacaaagaatccctctgttcactgtggtgggaaagatcacactacatgcctgttgattggctcagtcactctgtgtctgatctaaacgtcattcagccctagaagcatgaattgcttcaaattattgtcaacttgttctcttccattttcattcaaattaactttgactcctggaagtattgagtcttcctttcaaggaccataaggtacatcagttatcttgaacattctgacgtgtaaaggaccataaggtacatcatttatcttgaacattccgacgtgtaactcacagccgaagcactccatcccagatttgttgtctgggaactttaggatcctctaggaagctaatctgcttagtctatttttagaggattgatctctggcacaaccagcttcctggagttacctcagcagaagactagaattagagaaaagggaaagaccttttcttctagtaagtgtcaagtacagatgctctttgacttatgatggggttatgtcccagtaaacccattggaagtcaaatgcatttaatacccctgactggacaccacagcttagcctcgtccaccctaaatgtactcagaacacttagaattgcccacagttgggcagaatcatctaacacaaactctattttataatcgagtgttgaatatatcatgtaatttattgaatattgtacattatgttgaaattgcaaccatttcacaccattgtaaagtccaaaaatcagaagctgaggactgtctgtacatgacattgaatcacatgaatggattactagggcctgaggggtgtccgttctttagaaaaatgtagagtatatatatcttcagggctgtgaattccatactagttatcaatattttaagatcattctgtatatacatattttaaattatgcaagcaaactaggaggagaatgtgcaattttgagggatacctaatttgcattcggttaggggatatttttcaacctcttgctttatactctgatatggggtgtgtttatgaacttgttaatgttatttaatcatgcagatttccaatcagtgtattgctcatttactgacaaaaagggaaaatacgaaacacagaaagggaaaataaactgacttttataatg

SEQ ID NO: 184901 - DNA, 355 bp, Homo sapiens
agactgacggactcatcacacacacacacacagttaatatctttaatagatgtaagacaatttatctccttcctaggtgagttctggaagtttgcaacttttagagaattagtttattttacctaaattgtcaaatttatcttagacttggtcacagtattccctcattatctgtttaaagtcagccctgtagtgatatcatctcttttagtaatttgtgtcttctgtctttatttctttgtcagtcttactaaaatttttatcaattttattgatcttttgaaagaactacctttgaacttcattaagttttctcctttctccctgtgcttttagcttattgaatgcgtcctta

SEQ ID NO: 184902 - DNA, 690 bp, Homo sapiens
ggtctctctcagacagccgggctggagtgcagcgatgcaaacacggttcactgtagcctcgacctcctgggttcaagcgatcttcccacctcagcctcctgagcagctgggaatataagcacatgccacgacactcacctaatttttgtattttttgtggagatgaggtctcattgttgttccccaggctggtgtcaaacttccatacccaagcaatcctcctgccttggcctcccaaagtgctgggattacaggtgagccaccatgcctggccactttcttcatatctattttaccttattctaaacagaagttaaggcaattgcaaaaacatgttaagtacagatttctgtttaactaatgagaaaacctttacattttaaatcttcataactttttgtttacagaaagtgaaaatacagtaggagaaataagatgaagcctctgcagagcactagaaagcatgctctgaggccctgtacatttgcaacgggtattatcctgattttctgagtgacgaatttgaggttcaaagagttaaaagtaactaacccaaggttaccctggcaccaaccctaaattcagggaggcacttgactccgaaattattgatacttctattgtattatactgccttaggaaatagaaggattataggattctgagatatgcctcatactcttacatctt

SEQ ID NO: 184903 - DNA, 431 bp, Homo sapiens
catgtttgccaatgtggatgccttttctttctcttgtctgattgctctgtctaggactttcagtactatgttagataggaggagagaaagtggacatccttgccttgttccagttcttagagaaaaggctttcaactttttcaacatttttcaaatgtattttgtattctatgaattcttcagttccagaatttctgtttggttcttacaaaaaatctatctctttgatgagtttttttttttttttggattttccagaattatcttgtagcttactgagcttcttaaaatcaatattttgaattatttgggattttgaagacttcttttgattaagatctattgctggagaataattgcatttttctggagatgtcatatttctttgctttttcatgtttcctgtgtccatatgttgatatcagttcaac

SEQ ID NO: 184904 - DNA, 185 bp, Homo sapiens
aagcactctcgcataatgacaggaacaatacataacaaaggatataaataggcaattcatagaaaagcaaattcaaaacgccaatcaacataaaaagatgctcaaacttacgatagtacttgtcagggaaatgcaagttaaattaacactaagatttctttttatgcttatcagatgatgggcgg

SEQ ID NO: 184905 - DNA, 464 bp, Homo sapiens
tggctactataacagagttccataaacctggtagcctataaacaacagaaatttatttttcatagttctggaggctgggagcccaaggtaagagtaacaacatggttgggttctggtgagggccctcttcaggtttcagacagccaacttctcattgcatccttacatggcagaaacaggactagggaactccttggggtctcttttataagggcagtaatcccatttatgagggctccaccctcatgacctaatgaccttccaaaagctccacctcctaataccatgacatggtgggttaggatttcaacatatgaattttgaggagacagaaacattccatctataacagcatacaatgcccattcatgaattccacatctgtgaatctctgggctaaatataggataaatccagacaatggataaagtggttaaaatgatgaactccatcttctatgtttt

SEQ ID NO: 184906 - DNA, 356 bp, Homo sapiens
gtgctgggattacagaaactttgtgagccaccacacctggctggatatttttaaaggatacaaatagcccagtcaaggaatacataaggtgaggcctggatgggccctgagtgcaggagctttcatttcactggagttggggtgcactagcctcctgacacgtgggtgagttctttctcactttcctgcaagtcccatgagttcagctgtccagaaagtcctccgaccccatccacttgggcctcatgtggaaaattgattggataggcatgactgaagcatggacaaccttatagaactgtgattggacaaaaagggcatgctctactactaatagactgggcacagaaacccag

SEQ ID NO: 184907 - DNA, 157 bp, Homo sapiens
tgacattttggagatcaaacggatgttagtaatgatgtatatagtctagacagtgaccaggagagttggcaactggggtgaggtgaaggaaaagcttgtgcaaagtgagatcaaagaactgaaaaatcagatgttggtgtacatggacttgaaatat

SEQ ID NO: 184908 - DNA, 278 bp, Homo sapiens
gcataagacaacgaacaaatcactaaattgccacataatccagcaacaaattttgcaacaaggaaatctcaagcaaataacccaactgtgagttccctttgggcatcaaggtcaaactacaaaagtaaatttgtgacttttcaagatctatgcagttttaccaaatgtatttattttttgtgagagaataatttttttctgtccagtactagtacataaaaagtaaaggtatctgaagccatcttttaaattttttttaaagccaagaaaatgatttg

SEQ ID NO: 184909 - DNA, 442 bp, Homo sapiens
  misc_feature (411)..(411): n is a, c, g, or t
aaaacagcactatttgactaacaatgactagcttaaagtgactttccagagccctcgtccttcctgtcatcagaaccgactgactggaaggccagtaatttgatatcggaaatttacaattgataaagtcatcaatggtgactcctcccaaatgcacagaagatctagaaatgctgacctcagagtttctggactgttcagggcttgaccaggattctctggctgaaaaaggaaatacaccagtcagcactcagcatgccagagagcagcccaggccacaatattcatatttgtcaagccccgacctaacgagagctcagctctggacaaaacaaagccgtgcgcaacgtttagacttgactgacacctactgtgtgctccgtgctactgcccctcacttggtcatagctntttcctgggggatcctactatgagtcaacct

SEQ ID NO: 184910 - DNA, 238 bp, Homo sapiens
tggtatggagggaactgcgacccagagtgggagatgaggaatgctggtgactatagttgcaatcttatgtaacggaaggtgcagtctgggaagatagcactggagccagtactttttcagaggtggtctggggtggcaagaaaactttatacttgggctgtgtccagttgaatcgctattagctggaggttttccatataaatggactgaaatacgtatcttttttgttttgttttgt

SEQ ID NO: 184911 - DNA, 235 bp, Homo sapiens
ccaagcagttcctctttagaatttactttatggttaaacttgcatgagtgcatgaagacctgagaacaaagatgcttgttgtagtcctgttcgcagttgcaaaagtttggtgacctaaatgtttattgatgattagggcctggttaaacaaattatgggccatatagtatatgaggcatgtgctgctgtgggagagctctgagttagtagtagttttgagaaaaagaaaggtaca

SEQ ID NO: 184912 - DNA, 299 bp, Homo sapiens
ccagcttctcctcttcctcagtaccaggggcaacgtgcttttctgcaaggcagaaggaagtgatactaaaccagtagaatgtttcccaatcttcactttgttcttaagctcaaaccattcatttgtttgcgatctgcggcactgaaataacacagaccattatgagcatcaggagaattagaaaataccaccttgcaaaagtcagaggggagaggtctgatctttctctcctgggtattttcattggcttggtgagaaatggagcacaaattaggcatttattgctttagcaggtattc

SEQ ID NO: 184913 - DNA, 400 bp, Homo sapiens
atcctgaaacacttatttgctacacaatgacgtcacatcatgagtgggggttaggttttaatgtcagagtctagtacaaaaacatcagtcagaatcatgcttgaaacttccataggtcattcataacatgggaagataacgacattgtgaggggcatgaggaaattgggacaaagacactatcagataagcatctcatgctcattctggaccacatgctttttgagtagaacttctggcagaatcaccagcactattgaattgttatccctcctagggatatgggaagtgagcacaatagttgacatttttttttttttttttttttttttttgagacagagactagctctgttgcccaggctgaagtgcagtggcatgatcttggctcactgcaacctc

SEQ ID NO: 184914 - DNA, 736 bp, Homo sapiens
atatttctgtttgcaattactatgacaaacttgcaatctgtaaggctttaaagtgaagcagttctcactacctttccttggtgatagttgtcctgagagtgattgctgagctgctggtgtgactgtcactggcaggaggtgatgctcgctctgcagggctgtgagcatctccaccctctgtgtcttcagtggttggagataccatgtggaacaatgaacattgtaaatgacattcttctcaaaggttcaggacattcttcaatgtacctgttttcattcttttctcacattgtgtgatccatttgctctcaaaagaatgacatttcttactttgcacatggctggtcacttgtcctggcctgtctctacccttcacttctgcaggctgaccaggccctcagacccccttttttcagttgttcctctctcctgggcttagcctgcttgtgttgcaggctctgtctagtcccaaatcctgtgacatcctgggtgttgcagctcctttgtcctcagtttcagcgcactgcagtggcttcatggtagaaggtattcttttttatttgcttgtgtgttctaaaaacagagttacctttacatagcaaactccttcaggcatttccaatgatcacctcaggttgaataggaacaggctttgtggcttctgtgctgtcccgtggagtcagatgtgacagtcccctacccctccagtgttgggccattcggcatcattggtgtg

SEQ ID NO: 184915 - DNA, 526 bp, Homo sapiens
ccaatctagtatgtgaaaagaaattagaattatttttataccacacattatcagttaagattttctatataattaattaggaacaagcaattttaacaaaaatgagtagaagagaacggtatttgttatagcacagttattccctatacgcttatctgctggactcttaagaattggtacatttgcattgtggggtagaccagcaccatgatgcacaaatttggctgaactctacaggggagcagcagtgtatccatagtccatattttcctgtgtgttcattcatccattcagcaaatgttcattgagtgcctactgttgtcaggcactgttctaggtgcaatgaaggacttctgtaggcgtgaggagtgggaccagtgagtgtctttatcttgtgggtcttttacatttgcatttcaaaacatcctccacctttgcctctgtcaggaatcttcttttgatggcaagatatgatgggaattgggaagatgaggatgttttacttttagagtttttattcatttat

SEQ ID NO: 184916 - DNA, 883 bp, Homo sapiens
tacactatggcaggtggcagtccagcagccaagagggtagtggtgtaccggaatggggacccattcttcccaggctcccagctggtggtgactcaacgccgcttccccaccatggaggccttcctctgcgaggtgacatcagctgtgcaggccccactggctgtgcgtgccctctacacaccttgtcatggccaccctgtcaccaacctggcagacttgaagaacagagggcagtatgtggccgctggatttgaacgattccacaagctccactatttaccccatagagggaaggacccaggtgggaagagctgcagactacaaggtcctcccgtgactcgccacttgtgtgatggggccattggacggcagctgcctgcaggtgctcccagctatatccagtgagtgccagtgtgagggagcaggggtgttgatgtttgttttagtaaggccaagaaaatggtgttgggtttgttctaggagcctctggttactgttgggaatgtagaagtccagcatgcttgatgggtgaagagagaccagtgttatggttattgctggccctgtgccacccttcccctcacatgtagggactcctggggacactcccccttaccaggctttttgtctcagtgtgttcaggaatggggacctggtaagtcccccatttagtctgaagctgtcccaggctgccagccaggactgggaaactgtgttgaagctcctgactgagaaggtcaagttgcagagtggggctgtgtgcaagtgagtatggggactgcgagggcccaaaagtccccaaagagagcctcgccactggcttcagctgtggctgaggatgaagaggcaaaaggaaagcatgttcccccacatgggacttccc

SEQ ID NO: 184917 - DNA, 316 bp, Homo sapiens
  misc_feature (314)..(314): n is a, c, g, or t
tacactatggcaggtggcagtccagcagccaagagggtagtggtgtaccggaatggggacccattcttcccaggctcccagctggtggtgactcaacgccgcttccccaccatggaggccttcctctgcgaggtgacatcagctgtgcaggccccactggctgtgcgtgccctctacacaccttgtcatggccaccctgtcaccaacctggcagagggagactgtggcaggagcattaatctgcattcagggttttatccacatctgccctggggagatcacacttaaacataggtgttaccctattccagatnct

SEQ ID NO: 184918 - DNA, 157 bp, Homo sapiens
aatggaatatgattccggcataaaatgaatgaagtactgatacatactataacatgggtgaaccctgaaaatacgctaagtgaaacaagccagtcccaaaagaccacctactgtatgattctatttatatgacttatctgaaataggcaaatctaat

SEQ ID NO: 184919 - DNA, 473 bp, Homo sapiens
tattattgtacctgtcccctaagatcaagagcatggcaagaatatctactctggccacttctgttcaacattatgctgagttccagccagagctaaaaaaaaaaaaaaaaagaaagaaagaaaaaaagccatccagagtgaaacaactatttataaatggtagaatattttatatagaaaatccttaagaacccacaaacatatacccagaaaactcttagaactaataaacaagttcagcaaggttacaagaaatgagatcaacatataaaaatcagctttatttctgtacactagcaataacctaaaaattacattgagaataaatttccatttgtaataatatcaaaaggcaaaaaatacttaggagtaaatttaaccaaaagagtgtaagacttgaacacagaaaaccacaaaatattgttgaaagaaattaaagatctaaataattagatagccattatttgtgaatt

SEQ ID NO: 184920 - DNA, 528 bp, Homo sapiens
tgccctggctcatcttcctgtgcttctttttcctgtttgacctgacttctccagattgaacatttgaagcatctttattctcatatgttcctatatgctgcagaataagataaacccccaaggcaatgtcaggcagtccttgttccagcatgaaacagaatacttttctacttttcataagatatgctcatgcataaaaagtcagaaataagacactcagggagaaatacagagtttctttaaacagaataaatttttagatatttataaaaagttaagagctattccctctaaagaactgcatagatatataaatagcatatgatagaaaagtgtctctataatggtattttagtatacattaaatgagagttaatataagaaatactgtaatttagtgtatgcagtgacagaagaccaaatttggaatcaagaagcctgagtgtgagccccagttctgctctttgcttcctgggtgacccaagacaaatcagctaatcttcctaaacctttgtttacctatctata

SEQ ID NO: 184921 - DNA, 295 bp, Homo sapiens
tcttttacttaaattgcctctccttatttaaaaatttatttgacatcttccattttagaaaatcctctcttgacccggcaacgctcctcaatgacagtctgacctctcttccttcatcaaagacaaacctcctgagcaagttttctatgttaactgtctctacctgctctcctccctctcattttaaatctcacctgcaggtatcctgtctcctaaatagaaacatctcttgctgagatcaaaaataacctccatgtttgcacctgcagtgaaaacattccacagcctgttactt

SEQ ID NO: 184922 - DNA, 546 bp, Homo sapiens
ctggacagtggatggggtgtctccagccttcatccaataccaggaagaggatgcacaggccacagcattggaggcattaggcagcacactctgacacaccaccctcatgcttgatccacacagcacacctccagtttcctgaagggagcgtggtctcttgggtctacacatgctgttccctttgcttgtaattcctttcacccactcactcctaactcttccttcagggtccagctcaggagtgactcctccaagaggccttcttttgtcccccacctgccccagagctgcattaggccttcctcatcatagcagcctccacactgtactgtaactctagctctgggactctctctcccactagactgtgagctactttggttgggaatagtgcttaattcctctttgtattcccaggggccagtgtagagcctgcaaagagaatacctcatggacagctgataagtgagtgagtgtgttggggaagactgcagaggcacctctgagaagacctgcaccggagctggaggctgcacccccatgtcc

SEQ ID NO: 184923 - DNA, 650 bp, Homo sapiens
tgcactccagcctgggtgacagagcgagactccatctcaaaacaaacaaacaaagagttctaaataaagaaaagttgagaatgaggagtgggtagtttttcttaaaaagatgagacagtaagtattttaggctgctatctggtctttattggtactcagttctgctcttatagtacagaaacagctgtagatgacatgtaaatgaatgaacatagttctgttccaataaaatgttatttgcaaaatcagatgttgggcgattcttggccagtgggccatagtttgccaaccactggtttagactaagctaacctaatcttggcagtggcatgtgaaatatggcatttagacattccgacaacacacttggacttggaaattgaggatgttttctttgtttgtgggtactgctgactttgcagtctttttttattttttccccatcctctgactctcatgcaaccctctttgcttacactttgtaggagccagaataatttagatgtttaagaagcagttagctggacacggtatctcacgcctgtaatcccagcaatttgggaggctgaggcgggtggatcgcttgagctcaggagtttgagaccagcctcagcaacatggtgaaacaccatctttaccaaaaatacaaa

SEQ ID NO: 184924 - DNA, 655 bp, Homo sapiens
cttttcaaccaacacaagtagggtggtttcaaagtcaatccacagcaacattggcagcgtcggcagggatcaccattttattgggacacagctgcacagtccttgtagttcaaagaacgttaaagacagtattttctgaaatgtttgaaggaggggatttagcaagcagggatgaagaaaaggcatttaggatcttgtctatggtctggaaaaagcttataggtacaaaaaatattagatattgggagagttaaaaaattatttgggggataggcaaggagaggaaagaacaggctcagatgtgaagaccatatacgacagattgggtaataagactttcatctgctcagtcttgactttaaattccatccattcatccatccacacatgtagtgactgtcaatacatgttgacattacacgtaaaggtataagcttatgtgccagacacttggataaaaagatgactgagacatgatctctgtctctaggagctgtctaggagttaaataagtgtgtgggctgtgtgtgtgtgtgatctatctatgactttacaactcaatgccatagatcctttaagttttaagagagtgccatgtgagggtgcgggattaacaaatagcctgggaaaactgtaaaaaatgtgaaacgatata

SEQ ID NO: 184925 - DNA, 664 bp, Homo sapiens
agtattggtaaagtcagtgtcttaaatggaaaagcaagtgggcagttgtatgttttcacacaagtggtgttaagtaataagaaatggaggtgggggtacatttttggaaagtgaagtctttataaaaagtaaagacagtattttctgaaatgtttgaaggaggggatttagcaagcagggatgaagaaaaggcatttaggatcttgtctatggtctggaaaaagcttataggtacaaaaaatattagatattgggagagttaaaaaattatttgggggataggcaaggagaggaaagaacaggctcagatgtgaagaccatatacgacagattgggtaataagactttcatctgctcagtcttgactttaaattccatccattcatccatccacacatgtagtgactgtcaatacatgttgacattacacgtaaaggtataagcttatgtgccagacacttggataaaaagatgactgagacatgatctctgtctctaggagctgtctaggagttaaataagtgtgtgggctgtgtgtgtgtgtgatctatctatgactttacaactcaatgccatagatcctttaagttttaagagagtgccatgtgagggtgcgggattaacaaatagcctgggaaaactgtaaaaaatgtgaaacgatata

SEQ ID NO: 184926 - DNA, 579 bp, Homo sapiens
atatgaattattatacctaaaaaggcttgagttatttaagtcccttattaagactgatgatacaacaatattcatgaggaacaaaaatgttatctatagataatatgagatatttggtaaatagaagtaagaaattaaatatttatatcgagagaggatattgtgtcctgctttattcttaacaggatttgggatggtattataagttggttttgatgcagaataaaaatatgtgaggaaaaaaattaaaacagataaaataatgctagggataaaattagtacctactagaaattaggtaagactatggctaagggaatctaggatgattggacttcttcctcagcccacagtactgctttttttgttacttctaggggagctatctgcaaggaacaatgacaaacagtctttgagacctaaatgctaatatagagagctgtgataaatggggctggaaccacagtctaggttagaagcctgagagacctctactactcactcgcaatttaagcccacatagtagattttacgttgatcagattggatgccttcaagggaaaaatagtcagagagaga

SEQ ID NO: 184927 - DNA, 406 bp, Homo sapiens
atccctttttgccaaagggatgatgtccattagctgctcaatccctttgggttaaaaggcttttaaagccagttttcctctcaccataacaggcagttattacaaggactggctccctgaaaggtccccagaggaaatcaaggagactgtgtttccctctgagtaattgaaaaaaaaaaaaaaaaaaaggcctcaaagccacaggtggtttggggttttgaattattcacacctgacattcatagctgcctccttggctccttctggggacgtaggacaacatcgtgctcagaaagacctaggttccaagttcagcttggaggcagaaagcaattcctttttcttctctctgtgtttggaaaataatagattattgacacaaatattaaaactgatactgtaatgc

SEQ ID NO: 184928 - DNA, 262 bp, Homo sapiens
ccggatccttaacatgaaaatcagtggaggcaagtttagtttttaaaactgctttctacgggataaaatccaaatttctgggccaggcatagttgctcacacctataatcacagctggatcttatctcagcactttgggagggcaaggtgggaaaatcacttgaggtcaggagttcgggagcaggctaggcaaaaaagcaagatcctatctctaaaaaataaaaataggctgggcgcggtggctcacgtctgtaaggcaggt

SEQ ID NO: 184929 - DNA, 282 bp, Homo sapiens
aaaaagcatcacacactaggaggaagctctctgtggcagggcccagatctgtgactcaatataagcccagtgctaatttatccagacccagtaggaggagagaagcctcaaaggaggcaaacattttgacatttagagggaattttttatggctttttacactgactcagcatcaagtacaaagttatttttgctctttgttgccaatcgtgggagaaggggctgttagctaggagcttggagcagggagcctgcaggaaacagcttcacttaggaaggctc

SEQ ID NO: 184930 - DNA, 175 bp, Homo sapiens
tctttgtgctaccagtgatgtgactttgggaaaatccccagccccttctctgtggcctggtttcttcagatgtgtaatgaggctggtgatacccacctcgcagggtgattgagaattgcacctggagcctgatgcaaagtggaccctcagaacatgttgcctgacaccaagaggg

SEQ ID NO: 184931 - DNA, 688 bp, Homo sapiens
tccacctctttaagtatttgctgcagaaatatctctcttttggtattaaaatttctactagattccaaggtccaccataaaaattacaataaaccaggtgacttaaaacaatagaaattaattctctcatagttatacaggctagacatctggaatcaagttgtcagcaaggccatgctcccattaaagtctctagggaagaaccctttcttgcctcttctagtttctggtgaccccaagcattccctggcttagaacaaaataacttatttctctggtctctatcttcacaagaacatttctccatgcgtttttctgtgtctctgcatccaattttttctttcataaataaggacacacagaaaaacgtcttaaagtgctaattagacaattacaaaagttcatacacacaatgaattagactatgtaaaatattcatgaaagctatgactgaaaagaaactcaccaaatcagcaaccatagatagtgataatctttggttaatgaaatgtgatgtttttaaattgcttattgaaaaatttatttccaaaactttcacgataaatataattttataaatacagaaaacatttttgacattatatagaagagttaacatataaaaggtcatctaacatgtcaatccagtaagctggatttagagcttaccctaatccagtattacctc

SEQ ID NO: 184932 - DNA, 204 bp, Homo sapiens
agcctgggtgacaagagcaaaaccccatctcaaaaataaacaaataaataaaattctactggaacagacacacccatttatttatatgctacctacctatggttgcttttgcactgtaaaggcaccattaaatagatgcagtagataccagatgtccacaaagcctaaactatttacgctctggcctgttatggataccaagtt

SEQ ID NO: 184933 - DNA, 294 bp, Homo sapiens
ccttcctgtcctggatttgcctgttagaaaggtgtcactgctggatgggttgaatccattcctccaaaaaatgtgccctggagtgttgttggtgtaatgcaggcaactgttgccaggcgtcacctccacccaaagatgggtgttttgttctgcactgtgggtggcaattgcttcctgccgtgaccgatttttcggaagctcctcatccttcagggaccccctaagtacttctctgtgtctctcccctcttgctccctctgggtctctctctgtctctttcctttcttctatctg

SEQ ID NO: 184934 - DNA, 965 bp, Homo sapiens
agcgggcggccgggcgcagcgcgtgggagacgaaggcgtggctgactcggcggggcggatccctttaggacccgaggcaggctctgggcccgccgggtccgttaatctcaccgcgccgcaaggggccacgttttaccacttgatttagcaaccctaagcggtttggaatctgctttgctctcacaggacctcagcccgtcgtgatcagattctcccactttcttttttctttcctggaatggagtgggcagtctttttccatctctaccgaagttgatgttcatttttaatcttttcgcccctcacgcttttgtaataatggtactaagactgagtgttatttagattttattgttgttgtttgtgtttaacgcgaactatttaggcagcccagggataatgctggccatatagagatgcgcctgattaggtctcaggagtcaattcggactgggcagagcactagaatgctgcagggttggcctttggcctaaaccatttctagctatggacttgccagatgagagccagtgggacgaaaccacctgtggcttggctgtttgtcagcacccacaatgctgggcaactatccgccgcattgagaggggccatcctcgaatcctcggctcatcctgcaaaactcccctggatgctgaagataaactcccagtgctcaccgtggtagacatcttagattccggctttgcagctcatcatttaccagaatgtacctttactaaggcccattctttattgtctcagagttcaaagttttactccaaatttcatggcaggcctccgaagggtttacctgacaaaagtttgatcaactgtactaacagacttcccaaatttccagtgttgaatttgaatgagacgcaacttccctgccctgaagatgttagaaatatggttgtatgtggatcccagaagaacagagatacatgtgaggtgagtatcatatc

SEQ ID NO: 184935 - DNA, 828 bp, Homo sapiens
agcgggcggccgggcgcagcgcgtgggagacgaaggcgtggctgactcggcggggcggatccctttaggacccgaggcaggctctgggcccgccgggtccgttaatctcaccgcgccgcaaggggccacgttttaccacttgatttagcaaccctaagcggtttggaatctgctttgctctcacaggacctcagcccgtcgtgatcagattctcccactttcttttttctttcctggaatggagtgggcagtctttttccatctctaccgaagttgatgttcatttttaatcttttcgcccctcacgcttttgtaataatgagcactagaatgctgcagggttggcctttggcctaaaccatttctagctatggacttgccagatgagagccagtgggacgaaaccacctgtggcttggctgtttgtcagcacccacaatgctgggcaactatccgccgcattgagaggggccatcctcgaatcctcggctcatcctgcaaaactcccctggatgctgaagataaactcccagtgctcaccgtggtagacatcttagattccggctttgcagctcatcatttaccagaatgtacctttactaaggcccattctttattgtctcagagttcaaagttttactccaaatttcatggcaggcctccgaagggtttacctgacaaaagtttgatcaactgtactaacagacttcccaaatttccagtgttgaatttgaatgagacgcaacttccctgccctgaagatgttagaaatatggttgtatgtggatcccagaagaacagagatacatgtgaggtgagtatcatatc

SEQ ID NO: 184936 - DNA, 559 bp, Homo sapiens
ctaatttttttgtatttttagtagagacggggtttcaccgttttagccgggatggtctcgatctcctgacctcgtgatccgcccgcctcggcctcccaaagtgctgggattacaggcgtgagccccgcgcccggccgaaggccttggattctagcaagctggtggctgagggaaaagatcagcaatactggttatggctaagtgagactgctgggctcacagtggcctttattcacttttattatttcttctgttttctccatgatcaacggtgtgactgttgggtggttgaattgaaacttaggagtgtatgatgttcatatgttcccacttgatctttctcaggagtgtttgtacatacagcctccctgtctccccttcctccatcccttcccagtcatttctagtaaccactgaacactgtatgaggtggaaagtccatcacgtagtagagaaaaagattcaggcatctcacctaaagttgtctatgaagttttcaaaagcaaatataatgatctccttgtgccagtggacttctttggtttatttggggggtaaa

SEQ ID NO: 184937 - DNA, 433 bp, Homo sapiens
tgagcaatattttaggcatgtgcaaatatatctatgtgattctagcttccttttcatataaatagaagcatgttatgtaaactcttctgcactgtggacttcttcacttcatgtatttaagagatgaacttagacacatctgcattccttttactggctgctcagtattccattgtgtgagtgaaccattcattatgtaaccatcccttgctgatggacatgtaagttgttccttcatttttgtttgttcccttcattttgttcttacaagacagcggtgcactgtttttttttttttttttacatatgtctttcccacatgtgtatatttttagaagtaaaattgctgggtgaaagagcatgtatagttctaattttaatagatattgccaaattccatttgatagatactgccaaactccatttggcaata

SEQ ID NO: 184938 - DNA, 367 bp, Homo sapiens
tgagtctcaacttcaggctggtctcaacttcaaggcctcaagcgatcgtcccacctcagcctctctaattgttggatttacaggcatgagccactgcacccaccagacaccagttttcttaatctataccttgtgaacaaacttcctgaaactagaatgaacttgtacactttctggtatactcattaacatttttgttttttctactttatattatagcatgtatttcattctgactctttttaccactcattgcaaaatacaaattctgcctttgtgatcaaatattaagcaagttaacaaaaagtattccgtctgccatcaggtggaggcacgaggattccaaatagagaagcacattcctgga

SEQ ID NO: 184939 - DNA, 296 bp, Homo sapiens
cataaaagcagacttagaacaattaccatcatcttgattaatcttatgattgaaatgtttaatcattcatttcacttgtaatcattatcttttatcactgaccaaacatgcagttttaatgcccccttctattatttatattggacattttagggttacactctacagttacattatacatttcattggaattttaaataagtccttaaattttaaaaagctaatcactatattcacatctgccctatttgcataaagaaacactagaaggattcatacaaaattaatacaagcag

SEQ ID NO: 184940 - DNA, 221 bp, Homo sapiens
ctaaagcaggaaaagtccatggtgagccaagatatcgtgtacccaaaagtaaggaatcattcaaagactaatgggttcaggaaaaaataattcaggaacctgtttgaagaagctcccactgtccttatttgagacaatttgagcatcaaaaaaaaatgaaaccacatgttgtgtgcgatctaattttgcacacacagatccgttcagtaatgaccgataaa

SEQ ID NO: 184941 - DNA, 310 bp, Homo sapiens
ctgagattatgctttttctgtgacatcatgctgctacagaccatataaatttcctgaacccaacatgtttaaaactccagcatggtagtatagaagttcactggtatacaagttcaagttataccctaacctctcttactcatgctgaatcagaacatcaaaaatggcctctcaagagaatccaagtaaggataaggctttgattttatccgacaacttactacctttagatggtatggatagtaagttttgctatcttctccttttgggaagacagacaagtattatggacactgcagatgaatacagt

SEQ ID NO: 184942 - DNA, 359 bp, Homo sapiens
tcattcaatgtctacatatttcttagagatattttttaaataccatgaagctgaatgtccttttgtgtttattttccccatgttttcttttcactatgaatctgcagaacttaatcatcacttttgttttgcttaacaaatgtattttgctcattttaatatttgtgtactgatctggttttcatatcaagagaaacttaaagtataagctttatttcttagtgttttacaacacaaattttcctgtaatgacttgattgcttaggaagggagtttaatctttttactttgagagtcttcatcatccagttaacatttactaataatttaatcttcattcttttatagtagactaagta

SEQ ID NO: 184943 - DNA, 333 bp, Homo sapiens
atctgccatcaatgttagagaacacagacctgttaactagattataaatttgacaacagcagctgtgatgtgtctatgctctagtattgtgtttggtacatactatgtattcattaagtgtttattgaatgaataaagaatgtcacttatgatctcaaaaacatcatacctatgttcaacaaaataaaatttcaaatcccctaatatacaacattcataatagtctgatcaatttacctttccagccacatttgcattgttccctttttcccaccttaacacacacaagcctccttgaagtttcttgaaaatactgtaataggatgttaatgg

SEQ ID NO: 184944 - DNA, 146 bp, Homo sapiens
  misc_feature (5)..(5): n is a, c, g, or t
atcgncgcccagcccccattgcttttaatagaggagcaaggagcagtgtggagaaggtagatacgcagacaggaagatcactctggctagaaccaagagtggctgatagtggggagtaagattgcaggtggatatatagcagtgag

SEQ ID NO: 184945 - DNA, 1149 bp, Homo sapiens
aaaaagagttatcagtcttatctgtaactgtaacagagcttagtgaaacacattagtaagaccagcttggtgctttcactcttagtgagaaaaagacctaactaattgttatttgttaaatctaccttttttcagactattcccagaattgtgtgtgtgatttgatacatccctagggatttatctggcataagtatcaaatccttcatggcttaaaaattaataaacagttttttaatatttctggaaagaccctacctccaccccagctgccaagtcctcaaagattataaattatctatatgagtgtatgtatctgtatacacacatgcaccattacacatacaacataaatatgtatatgtatattcatttgtaaaggcaaaggtgccctggctttttcagataactgaatagaaaaacatttcatacatttaggattatttttctcctctatgtatttactagatattatatttggtttgggttgctttctgctgctgttctccttcacacacagcaaaatatacatttgtttctgtagattgacacaacttataataattactcccaaaaagttgtctgttcttttagaaaaggattaaataaggctcaggggacccacttcactctactgaatctaatgtacgagacagtactactgcttctttgtgtgcttgaatttgcatgaaagcttaatagcaaaatcttctatctcagtaattatagcaaatagggacctactggtagggagcaggtgttggctcagaaacctgaaaaagacaacccactttcatacagttctattaaaatcccctaagttttctaataaaatgatatagtccaaatatggcaatcgactggcatttatgggagcctctaaacctggaattatggggtttatttttctcccaaatgagctgcaaaagataattattgctgcccagtaaacaaaatgtatgtcaaatcagtaaagaatttgtttagcataatattgccttatctttcagaagctttcttctatattcttgtgtcttcagtacaatccacttttgtttgaaatccatttgcatattatcttactgtgcatttagtgaattctcaataatgttgtatttgctgacaagaataataaattggaccacaatt

SEQ ID NO: 184946 - DNA, 271 bp, Homo sapiens
cctaggcccacagttcctctttctcttgcccactggcttcgttaccttaccctcagtgattccccaggtgactccccaatagtgtgaagtgtactccctctcttggaaactgtgagtataataaactgtcttttgaatgacagtcatttcctgctctgtcagcctttaccatacctaagtaataataaagcctattaaaacacaaatattctatatctgaattgtgttgatggtaacatggacatacacaaactgcacacttaaagaagat

SEQ ID NO: 184947 - DNA, 324 bp, Homo sapiens
atgcatttagatctagaatggtttatatcgggatcgcgatttttctttcttggtggggctgtttgtgaagtagcttgtctaaatgcaatcatgattgtatttggggtctttttgggctcttcattctgtttgattgatctgtctgtctgtccctctgccacagtcctgattactataactataaattcagctttaatattggttagagtgatttgttccactttattctgctttgtcaagttcttttaaggttcttctagggcctgtgccttttcatataattttagattaagtttgtctttgcctagtctagaaaaaaactta

SEQ ID NO: 184948 - DNA, 139 bp, Homo sapiens
taagtcgagcagatggatggcagacgccggcttgctgtgaaatgaaaatccatgaaaaattaatgaaatagaaagattgtgctgaggatgagggcagagcggccgtgggctccgcagcccctgcaatgctacagtcgtc

SEQ ID NO: 184949 - DNA, 250 bp, Homo sapiens
gtgagtaccacactcttcattaggcattgggagcacagatgggaaaagaaaacagtctctttcctcaaaggctcaaagactggtggggaagatgagaatgtaaagagaatggggcacatgggaaacatgagccagggctacaaggaggtcaatacagaggttgctatcaaagggggaaggtttacaagggaggcatctggaaatagaaaaaattaaacaagaccatgtttcaagtttgtttagaaaacac

SEQ ID NO: 184950 - DNA, 357 bp, Homo sapiens
acctccaccccaggtgacattcactgtcccctcacaggatcccaagtgtccttggtgcctacaatggtagggtctgacaacagtgagagtggtagagaaattcccagcaacagcaagggaggaaacaaggattctgtgtctgccagagaaggagggaggggacagcctatttgtgtgaaaagaacacagtaataattaatatggttaattattgcccaaatcccttagtagaccaagagcctctcaaaaactagactatatcttattaatctatgtattcagagaatcaatcatggcacctggcacatagtaggccgggtgttggagtaagcagagcagtttttgtattatatgaca

SEQ ID NO: 184951 - DNA, 342 bp, Homo sapiens
tctagaggttccccgctgatccgcttaaggacagggttgcaaactcagatgcctccagtgaccagaaagatcatgtaagcatatgaaatggctggctggggatggggtgaagtgtacatgcctcacctccagcaatgacccctggagaatgtaggctcaaggttttcctgtcttccaatttttgaaataaagccagaagtctgagtttttatgtaaaacctctggttggcaaccagctcaatatttggcatggaccaaacaaaatctgcccatagggcaaatgtggcctgccagtttgtgacctctgttttcttaaaagggacagagaacacactgtggagc

SEQ ID NO: 184952 - DNA, 192 bp, Homo sapiens
agcattccattccatggatgtatcacactttgttagccatttaccaaataatgggcatctgggtcaccactgttaggcaattacaaataaaaaacattcacaagcaggtttttctgtgtacttaatttttaaaatcagctatgtatatacctagaggtataactgctggaactttgagtaagactatgttta

SEQ ID NO: 184953 - DNA, 199 bp, Homo sapiens
actgggtagcagagctaggcctggcatccaaagagactgactccatgtggctgctcttaatcacactgatgtattacagtctgagcagccctcaaccaaaatagttgggaccagaagtgtttcagaatttggaatatttgcatataagtaatgaggtatcttgaggatgcggttgggtgtggttgctcacgcctgtaat

SEQ ID NO: 184954 - DNA, 179 bp, Homo sapiens
aaaccaaaacaagaatagcagtgtaggcaagttaatttagatacaacgaagcaacagaggaaataaggcaaagactgcaagtggttgcctctgcattgtggaattcatgtgttagaagcagtagaaaagaatactactgttttctgtaacctttgcagcataccatttcactttttttc

SEQ ID NO: 184955 - DNA, 222 bp, Homo sapiens
gtttgagtttaataaataacctattttttctatgtcttgcttctgtcaccatctcatctagtagcatgcaagacacacatacagcgaacagagttcacacttcaatgtgttgttaactctgaaagtcaaccaggaataaatcacctattttctgggccctttccaggtccaagataactaacagctccctctccagcactctgacggaagaaagcatgctgg

SEQ ID NO: 184956 - DNA, 341 bp, Homo sapiens
gctgtgtgtgtattcccagtccactttttcaaatatcaagagattccatgaagaaggctggcatttgacatgggctttgaagtgtaagtaaaattttgatgagcaaaagtaggacacagtacagtagttaaacaagagggaatgacataagcagaaactggatatttcttggggaaatagtgaccagttgggttgggaacattttaaaaagtacagtagagggattgtgaaacattaagtaaggtcaaatgagttcaggtcgcaggaaggtctacaagtctgaataaggaatttggacttaatggttttgttcaagtcccaacaggagagtgacctccctg

SEQ ID NO: 184957 - DNA, 462 bp, Homo sapiens
agaatacttaccatttttttaagaaatagtgcaggttgctctattttaagaatttatgtcctttaggtttgcaaaaggaaagggatcacatagggaggaaaggatggctaaatattctctcaggtacagaacactttgattgcgtatgaccatgttttggaaatctctcaacaactgatgtcatcttacattggccaaattaaatttacacatgcttggattaattttttgttcagaacctccctgcccttcttgcatttcaatatgaatcatacatttcaatattgttttcctattcttcattcagattattttttaaatcaggttatatttaagggctgttggagatatgctgcaaacatgatttctgccatctatgagctatgtttttatgagctccattttagccaggaggctggaaaagtcacatcccactggcagatttgagcagggaggggaggt

SEQ ID NO: 184958 - DNA, 476 bp, Homo sapiens
aaaggaagtaaaagtgaaggctatttaaaaacttgcctaagatgttaaaatatagggactgaaatttgaacacaagcaatctggttctagagtccctgtatcatctttgttatccttcaccaaggtaaggatggtctctttcagtcttagttttctgacactttgttgttatttttaagttttagatgaacagttgttgaatgttatcagatgcttttcaaacatctgttggaatgaccctgtcattttcctttggtctgttaatatagtaattagcagtatcttttctcattttgaactgtgcttattttaggctaaatacttgttagcattcacactttggttttgttttcaaatctatttagacttttctctaaccatactacaaaaaaatgttaaaggcagtttttcaggcccaaggaaaatgataccagatggaaatacggatctatacaaaggaattaaaagctctagaa

SEQ ID NO: 184959 - DNA, 524 bp, Homo sapiens
gaatttcctggacctgaatttccctttcacatttgggaaagaaaaattaattctactggatgtttcagtgcactacgtaggccatgaggtcttctctaaaagtttgttttggtagctactgaagggctcatttcttccctgcagcacaacaaactttttatctgtaaagactcatattatgtggccatctcattgagtgttttagcagaagttgattgtatatatctgctggatcctatgctgcctccagaacatacaaggatgaaaggacacattgccctaagggggaccacagcccagtagggaggacagacgcaatgtgaagagttttctaatacctgagaaaaatttaggtccttttttcacagcaataatgattttatgatttcaagaaattttaaagagtgctctctggtaattgctacttaagaggatatgtgaagtcacacaaaacagtaatctctccataaaaggagttcagcaaatgtttatactaaaaatattactgctgattgagtttgggc

SEQ ID NO: 184960 - DNA, 604 bp, Homo sapiens
  misc_feature (475)..(475): n is a, c, g, or t
tgttatcattttatacaataaccccatctttcagttgttttatttcttgagaaaacaaaaatcactggtggaaaatacactaccattctttggagtaggggaggggtggtgttaaaccagcttcacaagatgaaagagaggattcaacattgtgcttcttaaactttttttttccccccaagatggagtttccctttgtcacccaggctggagtacagtggcatgatctcggctcactgcaacctctgcctcccaggttcaagcaattctccagcctcagcctcccatgtagctgggactacaggtatgcaacactgcatctagctaatgttcatatttttagtagagacggggtttcaccttgttggccaggctgatctcgaactcctaacctcagatgatctgcccagtttagcctcccaaagttctgggattataggtgtgagccactgcacctggccattggaagcctctntaatctgcctcctgagtccttgctatctgcctgacaagaggttccaggcttatctgctacttgtgctgtgtgagacatggaatgagccatttcttcatgaagccctgtttttactttttgtttttagtg

SEQ ID NO: 184961 - DNA, 314 bp, Homo sapiens
tagtgggctccccagctactgagctcaggtaaaaacgctgagtcctgcaaggtcaccacaaggtgaccacaagcaaaaggagtgtacagggaagaggaggggctgtcatggaaagaccctaaactccagacaccttgcctttcgagattctgaactccgtaaatcagagctgggacaataaaatctgagaatcccaaatggcaccaagccaagcaaccaacccaggggcactgtttaagcaataatctctctctctctctaaacacacacacacacacacacacgctaatttctttcttcctgcaggtttgatg

SEQ ID NO: 184962 - DNA, 600 bp, Homo sapiens
caaatcacatatcccatacgcaggcctttccttgcccatttgaacagtattttagatcaacccctagctaatgagctgtcacactagatcatgcctgcctgcatctgttccaaggttgctgattaaacagctctagggaaaagaaaccattatcctgttcggtgcaaacctcaagtgactatctcggtgcagcatgacttgccttggataaatagcacacatgggaagcaagctgtctgctccagaaaatcaccccccatgggcggtgcaccctggtgttctgattcactagaaaggtacccttgtggtctgaaggctctttcaaagggcccaatgtcctgaagtacgtccctcagaatggaagaacgcagctccacctctgggataagaacaataacccaaaaagcaagctgacaggcccacgtctagtcacacagggataacaggctcttttgtccgtcacgcacactgcagtgttggtactaaagaattctgcagtggtggaaagcatcagatatgggcaataggatttcagccagaagactttgggatgtgaagaaaaataagaacattaaaaaggaagtatatgtatgttcatat

SEQ ID NO: 184963 - DNA, 593 bp, Homo sapiens
  misc_feature (50)..(50): n is a, c, g, or t
gatgaaaaattatccccccgcataatatagcaaggactaacccctatacnttctgcataatgaatcaactagaaataactttgcaaggagagccaaccgtggactagtctggctggctcactcaaccccctctctgcttaacataaaacgcagtttattacttcccgcaagttgccatctgcaaagatatgccacaacgcaatgcacattctcacacccagggacaagggagagaacccagggaaaactccttcagtccatttttagctattggtttcatccttttgatttatctgggcattaacaaggttgtattaagctctggctgtgagcactgagtacgcctagatgggactagagataggaccagaaaagcaagcaggttacagtgggcaatagaaagggcagcatagagaattacaaaggagcagccagcagccaaagacctttctagggatgctaattaggcaaaaaaaaatagctactggagccgggcatggtggctaacacctgtaatcccagcactttgggaggctgaggccggtggatcacctgaggtcaggagtttgagaccagcctgaccaacaaggtga

SEQ ID NO: 184964 - DNA, 688 bp, Homo sapiens
  misc_feature (50)..(50): n is a, c, g, or t
gatgaaaaattatccccccgcataatatagcaaggactaacccctatacnttctgcataatgaatcaactagaaataactttgcaaggagagccaaccgtggactagtctggctggctcactcaaccccctctctgcttaacataaaacgcagtttattacttcccgcaagttgccatctgcaaagatatgccacaacgcaatgcacattctcacacccagggacaagggagagaacccagggaaaactccttcagtccatttttagctattggtttcatccttttgatttatctgggcattaacaaggttgtattaagctctggctgtgagcactgagtacgcctagatgggactagagataggaccagaaaagcaagcaggttacagtgggcaatagaaagggcagcatagagaattacaaaggagcagccagcagccaaagacctttctagggatgctaattaggcaaaaaaaaatagctactggagccgggcatggtggctaacacctgtaatcccagcactttggaagactattttataggcaaataattttgacagcaccatggaagatagactggtgtgagaagagactgctgaccacattttattcattctacatgcaccacggcatcataaagcacctattaaggcccagcactgtcctaaatgctacaaacacagtag

SEQ ID NO: 184965 - DNA, 500 bp, Homo sapiens
ttggcacatagtgatatggattggctgtgtccccacccaaatctcatcttgcattgtagctcccataattcccatataatgtgggagggacctggtgggagatgattgaatcatgggggcagttttccctcatactgttctcctggtagtgaataagtctcacaagatctgatggtcttataaggggtttccttttttcacttggctctcattccctcttgcctgccaccaggtaaggcgtgtcttttgccttccgccatgattctgaggcctccccagccacgtggaactgagagtccattaaacctctttttctttataaattactcagtctctgttatgtcgttatcagcagcatgaagacagactaatacacatagtaaactttcagtaagtatctataataataagtattattcataaaggaggaaggaaggaaggaagagggggaaggaggattttgttgccaaatgtaatacttgctattggttgtttttttt

SEQ ID NO: 184966 - DNA, 292 bp, Homo sapiens
catcagactagtgcagccatctccaataggacagatggtatagaacaggggacagatctgcttcaaggggcaggttattgcatcccctgaaagttatacaaacattctgccaaatgtattttggtatctttccttgtttatagaaagattaggtgatataaatcaattttgaaatttttttgctacttactatgcatcttcattgttgtatagctgagcctctacttcttcatttattaaaaaaaaaaagtaataaaatctcttacagaattggtataagggggccaggcac

SEQ ID NO: 184967 - DNA, 130 bp, Homo sapiens
cctagcatggccatcctggggctcctaggcaaggacatgctgccagctagcccagcacccatctacaaagtgaaatggattagcggctcactttcaatcaggctgagttacgagctcagcgatttgtggg

SEQ ID NO: 184968 - DNA, 261 bp, Homo sapiens
ctttttttgtcatattctcacaagctcctcagtctttctgtttttaattctattttctatgttgttgtatacgctgagtaatatgtattattctatcttctagtgcatagattatttcctctgtcccattcattctgctgttaagtctatctctgaatgtatttttttttctggttcaatttctctcataaaagctctgaactttttatttcaattactgagtcagttataaaaattctaatttaaaaaaattattggcca

SEQ ID NO: 184969 - DNA, 356 bp, Homo sapiens
agggattcggcaatgacaaagtgcagagtttctggtctcattagcagtccccgccccaccgcactgccatgacactcgctcactttctccccaggctctcctcgccttcatccccatgctcatctctgcctaagcttcttccgaggccactcataacgcttcacctctgctcccaggaattctcacatcctcttcgcgttggccccacttgctgtcacggcaagtttcagtccgggtggtgccctgcccctgtctatagactctggcctgtaaaacctcactgcacccctctggcctcttcgcccagtctctcagctgccacctcctctccagcagtcttggatctgagcttcacc

SEQ ID NO: 184970 - DNA, 208 bp, Homo sapiens
tctcgagctgtctctagagtatcctcctcaatgcgcgacgccatcttaattggcataacatgattttagtgcacaaataagaaccaaagcatagtgttttggttaaagagattgacttactctgaaattggaaaaggcatctgctgtacaggatttttgatttaatagaatttgttataaccagatcagcagagcattattactgtgg

SEQ ID NO: 184971 - DNA, 432 bp, Homo sapiens
taggcagtgaatgaatgtagaaggggaaaatagcaagaaaacctttactctgattcctgtgcagaaagaaatttagaggtcattaagccagagtcctgtcatcttctgtcctcactcccagtgctccagcacctacctatacctccctaccgatccttaccctttttcgtagagaaaaggtatctctaaagtcctgcagtgctttaaacctttgatacatcctgacaaacacagaaaatgataatatttgttcaatacagtggggtaaaaagagtgcctgtttgaggtgactggcccaaggctttcagttccctgaagctcagctaaactgccctaagggactgagtattaacatttccacacccataaagcactcacagatcagcgcagataccacattcccagcccatgttgagaagccctggccctaac

SEQ ID NO: 184972 - DNA, 366 bp, Homo sapiens
ctcaatcctccacctctagatgcagtttcctgggctcggggagcatggagatctagaggggaaataagttacctgtttaacttccacagagttgaaagctgagtcatggggccacacgatacaaaggtgatacacacaaaagcatctgcaaattgcttttattgggaagccattttcctcccctttttcaagccacatggccaacccactccctgagattctgcaggcctcccattccggtgagtgtagctcagttggtgaaatctgccccagctcaagttcttccccaccttttactatttccttattctgaagatagatgaagaagtgcattttccttaccccctgccagccatctgaggacaa

SEQ ID NO: 184973 - DNA, 240 bp, Homo sapiens
gtcttgctaccacctaggctaggctgttctctcctttctggcttagggaaaaatactcatgtgttaaggatgaatttagtagtatatcaggaagcaaagtaacatgaaaggcagagaactgtgccagagaagtgtggtttcagtgtgccagcattttcctgcgtatctgtttatttggttaattagcacctgcaaagatggttatagcctccttttttttttttttttgagacggggtct

SEQ ID NO: 184974 - DNA, 171 bp, Homo sapiens
ggatgtgtctgtttctccttggagttctatgagttcctcatgtattttgaggctctgttattaagttcataaacctttaagaaggattgtttttggatgggctaagatattattcgctattttaaatgttggaccatctcttgccttattcactggttacagcaaccattg

SEQ ID NO: 184975 - DNA, 236 bp, Homo sapiens
agacaaatatccaagcaagaattagagaggaaaaaggataagagaaattccacacagattaatatatgcatttctgaaatactttttaacttccataaatagaatatacacacagacctcaaaagaggcactatgaacatagtgaaattgagcaagaagccattatttctagtaaatcatataaactgcacctactgaatgttgccatttggtatgaatcacatggccaagccgtt

SEQ ID NO: 184976 - DNA, 883 bp, Homo sapiens
ctaaggtctgttcccaatacaagaagactctttgacatcataataaaatactgcagatacgatgctgagtgaaaaagagtagaaatgggaagacttggttgtgcagaaactgagttcttaaagagaggagatactttatgagggctggagtgcactggagcaatcctggctggccaatactgagttcttgaaaacaggagatgcttgatgaggatgggatcatctagttgcaggaaaacaaggctcagggtgcctactgattctacattatgcttggtccggagagctgccttggactctccaatgcagctgcctctgttaccttgactcgtctcagatttcattgacccaagatgggtcctggcactaggaatgtaagactgtctccattcttttggcttgttccagagaagcccatgcaaggttcctactgaccatatgtttctttcttttcttttgttttttgagacggagtttcgctgttgttgcccaggctggagtgcaatggcgcgatctccgctcactgcaacatccgcctcccggactcaagcgattctcctgcctcagcctcccgagtagctgggattacaggcatgcgccaccacgcccggctaattttgtatttctagtagagttagagtttctccatattggtcaggctggtttcgaactcctggcctcaggtgatctgccctccttggcctcccaaagcgctgggattataggcgtgagccaccgcccccggccttgaccatatgttttatttctagctttgatgtctgggcatcgatttccctcggttaaactatttgctcaatgttaaggccactctgtagaaatttgtctgtgtaactgaggtgctatgcaggcctgcctgtgtgac

SEQ ID NO: 184977 - DNA, 352 bp, Homo sapiens
aggataatcttgttttaaggtcagctgatgagcaacattaattttatctgcactcttaattcccccttcctatgtaattgtgctgtgtaacataggacatgagcaattggtggcggtgggggttattactttggccaccacagtaactattttatgccaggtactcagctaagcactggtgaattaagcatgaataacacacactccctaatctccatccattcatgggaggagcacttcacctgccatgctcctgagaatctcgggagtcatagaagtcttctatgaggaggtgatgccaaagcggacaagtgacagaggagtcaaagctagctaggaagagagtagaggt

SEQ ID NO: 184978 - DNA, 466 bp, Homo sapiens
ctaatccatagaatttctaacgtggtctttgttttgccttattctgtaaactctccaggatgtgactctgtatgcctacaacctctgctaccacctgtacgctaataaatccttatttccagcctagtccactctccctacttctacacatatgtatgcaaatattcaccggacatttccatttgattgtctccacaagcatctcaaactcgacaagtttagaaccaaattattttgctcccttgccctggccccaaatagctctccttttgtattcccagaaccaatccctacctgagttgggtactcagatacccaacccagaaatctgggagaaaactcagactcttcctcctccctcacttttaaaatgcagatacagcagggagcagtggctcacgcctgtaattctaccactttgggaggccaacgggggtggatcacctgagttcaggactttgagact

SEQ ID NO: 184979 - DNA, 870 bp, Homo sapiens
tcctccaggcctgtaagatgaggagacctactgcactggcgtgttaggaggttgaaatgaaatgaggtggctgggtgtggtggttcatgcctacaatcccagcactttgggagtctgaggcaggaggattgcttgagcccaagagtttgagatcagcttgggcaacagagtaagatctcatctctacaaaaaaactaaaaattagccagttgtggtgatatgcacctgtaatcccagctgttctggaggctaaggtgggaggatcacttgaacccaggaggtggaggttgcagtgagccaaggtggtgttactgcactgcagcctgggtgacagagcaagacccttcctcaaaaaagaaaaagaaaaagaaatgagataaggtacatagataagtcagcttagtgcctgataatgtaacagaagcttagcaagtagtagctattgtttttgatgttacagttactgatactattattgcaaaaacttcatgtttgatggtcgcctgatgtcacttttcctagttcagcagaaagaggaagctcaggcatagaaggcattaattcactgaccatcaaacccctgctgcatttcagtcagtggttcttctagaaactacctttaagtctttgtatcagcgtccgtccctccaccttctccctggatccccagtgaggagacccatttgtgtgcagtccctgtcatccgatctccacctgcggtgttggcagcctggcctccatgcagagggctttctgttgaaagggcttgaacttaacattttaaacactgaacactgaaatcaaatataacaagattttgaagcaaagctataaagtatgttttttcagagaaatttctggatgatggct

SEQ ID NO: 184980 - DNA, 500 bp, Homo sapiens
tcaatttaaagatgaaggaaaatgagatttaaaaagtagaagagccactattggaactcaagaagatcggctccagtgtctatattcttaactactatatggtactacattccttttgagaaggaatgagtggaaagatggctgggtacatgtatgacactattttgtgagctattttaaggttcgtgtttgtgaatgtatagtcctacctcctactaatggaggaaaatgagctctctcctgatctctgtgggttcttctacttgtaataacaggtaaccttgataacactgaccgtcccctcagttgcacaggtgcacctacccaaagcataaagagagagccctgcgtaattgagtggctttacctttattggtactgtcaaaatagtgacattaaaaaaatacaggtaccaagtagacaaatgaatagtgcctaataaagaggagaggcttcaaggaagaaagaataaatgaagtatatgaagcatgcatacttat

SEQ ID NO: 184981 - DNA, 173 bp, Homo sapiens
tatttgcttttttgagatttataaggtgatctgattataaaagcagcatatttttgcttaacttttccttaccactacttttgtggtgaccttacttactgaccatttgtatgaaatccttctgagaattgaaaggtcccgtttcaatttttttctttattgctttgtgttta

SEQ ID NO: 184982 - DNA, 261 bp, Homo sapiens
ctctatctctttaaaaaaagaaagaaaaaaaaatttttttgacacattcccatcagcagataaggaaactgaggctcaaagatgttaactgacttgatgccatttgtaaggagcagagttgagatttgaacccgcaatttccaactctagggtagggagtttctcagtggatactttgatttttaaagcaagaaaatggtgagctggatattgctgattcgtgaatgtgggttttgcatttgaacatgatattgctacaac

SEQ ID NO: 184983 - DNA, 479 bp, Homo sapiens
atgtcaaccccttattcaagtgcctactgtgaactcttgactgaggagaccacaagtctacttttctaaagagccttcagggtactgcacagtctgtccttttttttctctctcttctcacttctgactgtccaacaataaacactagtagcaatggcaataaacataactcttagtatgtgccaggtaatgtttaagcactgttttaagtgtttttcatatattaaattatttaatcctcagattaaacaataataaatgtgtatattgtaatactagtaatgtagacattaaatcacttgcatgtctaataaaagtaggatttgagcccaggtcgtctagttcccagagtctgtacttttaactaatctgccattctgcctttcagtaacactcttctttaagtcaagtcactatgttttttgttttgttttgttttaaatgtgtcttttaagataccatttgccctgttgtagctc

SEQ ID NO: 184984 - DNA, 318 bp, Homo sapiens
cttgttgggaaattagttattattaaaagaaaacatgtgaaaagtatagcaaataataatcaaacattggataaataaacatagaattattttaaagttagctatattcagcaattgttcagaaaagatcaagtgaaaggaaaaaaaaaatgggttgggggtttagtttctctctttctccagaaaagacattagctccatctgttacaaaggtaggaagaccaacagcctccaccaacaaaaacaggtatttcttcacattccatccaattcttgtgggtctatttagtctatttctgagaatgagttactaagttc

SEQ ID NO: 184985 - DNA, 397 bp, Homo sapiens
taacacaaattttcaatacacttatgtacaattttatgaacagagaaaaccacacccacatgtactccttgaatatctaccagctaccttggttcactgtgtgttaggaaacacacccatctggtctgacaactttccatccttccaccatgcagcagtaacacacaagctataacccttctgagacctacttccccacaagcaaacttcaggttttcttcaaggtaaagtgccatatttatgtaatatttatgtatttaaccattttaacatgtgtaaaactgcgttactgtttttattagtttcccatctttttttcatgtgtcactgacaacgattttaagtgctgtgcttctaaccttcctttttctcgtaagtattgtggggattttttgtt

SEQ ID NO: 184986 - DNA, 540 bp, Homo sapiens
aattggaatcaggctacatgatatttcacttatcgccgggagtttcaagaacctatcaacattaaaatgaggacttctgtataatatagtaaatactaggcgatgggaattttccaactccattataatcttacaggatgaccctcatatatggtttgtcattgaccataacatcatgatgcagcacataaccgtattcaaacaaacatgccatataaagaatattgaggccaggcctggtagctcatgcctgtaatcccagcactttggaaggctgatgcgggcagatcacctgaggtcatgagttcgagaccagcctggccaacatggtgaaactccacctctactaaaagtacaaaaattatccgggcatgggccaggcgcagtgactcacacctgtaatcccagcacttggaaggccaaggcaggtggatcaccagaggtcgggagtttgagaccagcctgaccaacatggagaaacccatcgctactaaaaatacaaaattgtccaggtgtggtggtgcaagcgtgtaatcccag

SEQ ID NO: 184987 - DNA, 427 bp, Homo sapiens
aagcagctattccaagtgctatagattcctcaaagaccctagaataccccttgaaacacacctccagattcccctcactcagatgagacctgtgggccctgggggtgacaacagggttagaaaacagcctgtgtgtggccctgtaatcacttaagaaaccatcactctgttcatccttgtgtctcctgtgtacactgtctattttataaaggattttcgtatccatgacatcatataatcctcccatagcctgtgaggcaggttataggaaatctcattcacagaagaagggagattcagagaggctgcacacttgcccaatgacacacagcagcagagtaccaaaactaggatccatatggttgtcttctggtctcaagagtggacttcttttcactgcataaagcagcttccacatcagaatgac

SEQ ID NO: 184988 - DNA, 578 bp, Homo sapiens
aactgctgtactttgtgggatattcagatgtcaactaatgcaaaaatagaggaaaacacccagaagaagtgaaggttatctggcagtctattgatatcacagagtaagggtttggaggggaggaaaagagtaggggattgggctacaacagatttccagaacagccaggagattagagtctgggtggtaaaaaatgacttgagggtggaagaggtaaaaaggaattcaaagtaggtgggaatcaatactggtcatctctgagtgggcattagttctagctccaaagtctctaaagctctgctctgtggtatgacaatttctagaggaccttctttgggaagcctttccaattctccactgccagagagttagacacccttatccttaatgcccatatatatcatttaacccatattcaataaatattagttgaataaattaatgactcaccataacctgagtagactatgagaaaattaaattgaaaatcaacttcacaaaaggaatgacatagcagaatttccagtgatgcctacatgctattgggcatcactgctcgacgagcttcggatccgtgc

SEQ ID NO: 184989 - DNA, 128 bp, Homo sapiens
tggaaaagaatgtgaaactaaaagaaaatttgaatgtaatttaattttagagggcactgtggtgaaaaaattatttaaagaatacaactattggctgggtgcagtggcttacacctgtaatcccagca

SEQ ID NO: 184990 - DNA, 456 bp, Homo sapiens
atgtttgtgtgcatgacaatgtatattcttcaacatcgtagactcgatgttggatgctcccatcgggactgtgtgtccctgtactggaactcgagtgaacacttggctctaagttcattgctgttttctagaaatccagcccaattctcttggttaaatataaggtgcacgtagtaggcattgctttttctttctggagacaaaactcaggaggattgccccttgatgaacaaagctaacctgctgagactttgaagcaaggaactggagatggtccttttaagggtttatattctggattccagaaaatgtgcaaacagggccaataaatgcatctttatttttgtgtccattttaacctagtcaaagaaaattacaacaaaaaatccacagtgctggagcaagaagatctcatgatgtgaccatctggaggtaagaagcactttgtgttttgtg

SEQ ID NO: 184991 - DNA, 248 bp, Homo sapiens
cccacaacgtatattcttaaatatcatcttagattccattttggttgctcccatcgggactgtgtgtccctgtgctggaactcaagtgaacacatggctcaaaatccattgctgttctctagaaatccagcccaattctcttggttaaatataagtcaaagaaaattacaacaaaaaatccacagtgctggagcaagaagatctcatgatgtgaccatctggaggtaagaagcactttgtgttttgtg

SEQ ID NO: 184992 - DNA, 627 bp, Homo sapiens
tcgcgtctcagtccatcggggggggagggggtggtgcgcgcgccatttctagtcgttttcaaagcgcctcgcgcatgattctcacgggcccggcgtgccggcccccgctctgtcctgataataaaatggctagtcaggtgaagtggtaatgcggtacagttaacaagaagaggaagaaccaagtggatacttccagtgtaactcacacagaacacttacaagacactgatagaggcaggcctcccacagaaggtggcagaaagactttgatgaaatatttcagacaggattggtagcttatgtcgatcttgatgaaagagcaattgatgctctcagggaatttaatgaagaaggagctctgtctgtactacagcagttcacggaaagtgacttatcacatgttcagaacaaaagtgcattttatgtggagttatgaagacctacaggcagagagagaaacaggggagcaggtgcaagagtccacaaagggacctgatgaagcgaagatcaagccttgcttgagagaactggttatactctggatgtaaccacaggacagaggaagtatggtggtcctccaccagacagtgtgtactctggcgtgcaacctggaattggaacggaggt

SEQ ID NO: 184993 - DNA, 386 bp, Homo sapiens
tccccactaacctgccccaaggcagggcctgtgtgtcggtcggaatatctctgtctgtggatgccagggaaatgaatgaaggtgctgatactctgcactcaggcacttccagtaacattactgcatctaaagctgtttgtttcactttcagaaggtgatcttctgtacgataggtgatattctgcacgatgaggtgagcttctgcacgatgaggtgatcttctgcacgataggtgatcttctgcacgataggtgatcttctgcacgatgaggtgatcttctgcacgatacggtgatcttctgcacgataggtgatcttctgcacgatgaggtgatcttctgcacgataaggtgatcttctgcacgataggtgatcttctgcacgat

SEQ ID NO: 184994 - DNA, 619 bp, Homo sapiens
taaatcggacagcacgcgctaacaaaaacagacatcaccagagccaagaagttgggcttttatgcatgacctggttgtcgaacaatcttattactcaatatcataattaataaactgtttagcagccagtatggagggctttgcaaagaactcataaaggacacattcacaaaagcagtatgatgaacagttctgcttctaaatcaaggttttgtataacaaagtcacagaagagccttgattccagacacctgggtgacaaatccctcttaggatcagggaagtgagaggaaataagtatgggacattgaaggccacccaaggagcattacagcagtctcatctctagaatgacaggagttccacagttgttagcgcgtgctgtccggacagcacgcgctaacaacccccccccccaaaaaaaaaaaagtggaactggggattctgaaaaggtggatttgaataagtaaacctactgtaaagaaaagtgatattcaagtggctcttggtcacctgtgtatgccttgtttttttccaatttagactcttctttaaaggatgtaaggaaaaatcccatgcctttccagttcttttttcctcccgggcacttcttttttga

SEQ ID NO: 184995 - DNA, 328 bp, Homo sapiens
atttgtattcctgaagatgatatttgaattttaaaagaatgtttaagtggagcagttgacattcctctctctccccccctccttttttttgagtcccttctcctttagttaatttctctttgtttttattattgttttttattttagccttgtgaatctgtccaaatatttataagcccacatacatttctttgtagccactgtctcctgtggtgacccacaggtgagtaaatgactgttctttacttgggcagcaacacacattcacagcattttctagaccattggctctttctctaattgcattaaccatctcagatacagctga

SEQ ID NO: 184996 - DNA, 179 bp, Homo sapiens
aattatttcaatctagacacttatcgcacaggtatttatgctatctgtccacatgtaagcagtgagagtgtatacactagtacttagagattttgattatccttttgaaggagttgtttgcagcaaaaggtctggagtcaaagggcctaggttagatttcttgctccattatttttgga

SEQ ID NO: 184997 - DNA, 305 bp, Homo sapiens
ccctcacactcctctaccctccacctcaaatcagctcaaggcttcagggagcttttttaacaagggccactacactagcatgttctagttacacacagtcagtggatacagaaattctcttagccaatttgagataaaggtaacaggttcattttcactactgcttgtcacctctaccactataccccatcacctgaaccagctgatctggtgacggcaaagagagagtttaaaacaagcatctgatgagaattctatagttaattttatactttgcggggaagctaccaatttattttatcaat

SEQ ID NO: 184998 - DNA, 379 bp, Homo sapiens
ccagctgacggctatcagcgtgggtcagtgctggccgcagctcccagctcattgaccctggtgtcttgctcacacagaggcgggcaccatctgccgcaagaagtcccagagccgtgccacgttgtgctgccgagcggtgatgcgcttgatgtcgtggtagcgcatcggcggccagttctgcagccacagtgtccacatgcctgcacccggccgctgtaggccacgatgtccgtctcaatggcttcgtgcttccgtacggctgtcagcccaatggcaagccgcggtaattccagctccaatagcgtatattaaagttgctgcagttaaaaagctcgtagttggatcttgggagcgggcgggcggtccgccgcgaggcgag

SEQ ID NO: 184999 - DNA, 607 bp, Homo sapiens
gggcttcaattcactccagtaaaggaaggcagtgtggctagcaggcaatggctctgggtttgaatcccagattctgtcttcatccttctgaatcccatttttcttaagagaaaattggaaatcacagctatctaatatggttgctatgaggcttaaatgagactcatggaaacacttagcacagggcctggcaatgtgagctccagcctggcacttggtacatattatctcttttaatatgtgcaagtactttgcaaggaagctacttttgtcttcatttttcaatcaaggacagggagactcaggagtgaaggaactcgctcagggccacatctgtcatgctgcccgcagacactgctttcgtacctctcacgaaaggctgtgcgccgcacgcctaagtctaaagaaagagcacttcccagttagattaagcaatctgggagttagttcaccagcagctgtaggaaatcagctcaagaaatagttggccttttgtcctgctgtgtcccatcaggacaacactgcaatttgttctcagttagttataaagctgaaaatatatgcatattacttattctaaacacttagctggccgggagcggtggct

SEQ ID NO: 185000 - DNA, 369 bp, Homo sapiens
tgatagctagtggagctgattgacatcctagatattttaattcaggaaatattagtgcttaattatacaaacaggttggtaggctattctgaatgaaatgctgcttgctggtgaaatactctgttttcaagaccgcaaaactaaaaccttgttttaggaattctatacaagaataactttggggaaaattttttcccttagggcatttccactttccaaatttttcctcgttgttcccttttcctccaatgattctcttaattctgactgataccagtcagggcatgaaagaatgaaatgtccaaacccttactgacaaattatacctgacagcagaataaacccacatctactaagaggcttccatgg

SEQ ID NO: 185001 - DNA, 405 bp, Homo sapiens
gcttggtcactatcctcttccaaggagaagctgaccctcttttcaggctggctagagaccttgttcagtgaactgactcttatttctttttgtacagccacctcggcttcagaagcaaaatcttcactggtactgaaacccagcaaggtgattctgaggtcctttccatggtcttgggggctggtgcttgctgagatcctgtcctctgtccccagaggaatgctctctggtacaccagattgactatgagatcccatggccatggatcgcacagacccacaccaggcagtgtgtgcctcagaggaacgccctctaacatttccttcggggctgtggcttctggtctccgtactctggtcctgatgctctactccagttaccaagggactgttatgaattttcaac

SEQ ID NO: 185002 - DNA, 428 bp, Homo sapiens
taataactgagcagtcattgtcagcataggtgtcccatagcacatcttgtgtcatatccctccgtgggcccacctactgtttctgcctgtcaatcttgcctccccaccatatatctagccacactgctggcaaagcacagaggtggaggtgcaggaaagcgctagatgccactagaatccctggcaaaaaaaatacccccaaatgtaatataaataacatgattccggaagaagaaaatgaggatcattttcttcttccgggtgagaaaggcccctcttggctgtggtatgaggggctggtctggaagtttctctccaggtgggaaaggcccctcctggctgtggtgtgtgaagggctggtctggaagtttctctccagatgggaaaggcctcttctgggtgtggtgagagggctggtctggaagttt

SEQ ID NO: 185003 - DNA, 564 bp, Homo sapiens
ttcccttctccctttataacattattgggtttttgttaggtttgggattcctgtgatctgagcagcccctgccatcggccgctctgtttgcctttcccaaatagactccatgggcagccccagtgaaatagtctgttcgaggatgtcacgttgtgggatggtctgatccttaaagacaggctgggtctgtgggctggagtattcttgctctgaatttttttctgtacgggggaatcgtgcatgggtagggggatagttctgcattccatgtgaggcagtcgatgaaccaagaacacctacgttgaagggaacccaagactgggatattgaggctaacgctggaaagatggtcctgttgtataccagtctctgtgtgaaaccagagattatcttgtgggatttatttttttaaaaaactagtttccaatggaatacctgatcctggcttggatttgcacctgaccctcttcttagaggtgtcattagtattcagattattttaaaatttcttttgtttacttctcaaagctcttgcttctctcttcaatgtgttctgtttactat

SEQ ID NO: 185004 - DNA, 197 bp, Homo sapiens
agtaactgagattacaggcgtgagccaccacatctggcagcacttcaaattttctgtgacatctcagtaaggccagaattgaagatcacagaggaaatgagacgtctggcttgtttcctcactgacctcatttgtgtgcctggattcctctatggatctggccagcagagctctggggcctctgatagtcagctggg

SEQ ID NO: 185005 - DNA, 204 bp, Homo sapiens
tcaactacataaatgttatttgttttgcttcaacatatgattttagtggaaaaatagagttctccttctttaaaaacattttttttaaaaaaccactggactagctaattcctactcctaaacctttgtaattcaatataaggtctacccatcaaattgtttagactcctggatgatactcatgtttttaggaagggttcctac

SEQ ID NO: 185006 - DNA, 517 bp, Homo sapiens
atatttgatgaatgaaccaattatctgggcacagacccaatcgtggcaaagaaacagaggccaactttgtgctgggtaagctggtcagataggataattatgggatggatgggtggatagactgggtaaagtgacatcagaggaagtgagatgagattttgttttggacaaataagatggggataactgataatgggcaaataaaactcaaggttcactctcaagaaagagctcacaggctttggggatttgtgcatgaggagatacagtgctgcattcctaactgtcgagtgactctgctttaattaggtttgggcagtaagtaggaagaacagtaagagactccttaacatcagacagtgtggcccagcaaacggcctgctggatgtgtctattctgttctgttgctgactgtagaaaacgcacccctcttcctacacacctcttcttttatctctctttctggagccatcacatttacttagaggagaaatggggaggaggggaagcagccagg

SEQ ID NO: 185007 - DNA, 490 bp, Homo sapiens
cagctagtaggtgtcagcgtaggtctatattaataaactggctttttcaattggggcctcctctcttttctgattagcttgcctgaaaaagtctttaaatttaatgcccaggggatatatgactcattgccagcgttctgggagccaagtaagacgaggtcctgagcttatcctccccatttcagtatgacctcatttctactctcagttgtgcctagtggtagagtctagatcctctcggttcaccttataatctcctggtcctccacaaagtatgacaggagatctagcatctaattgtttcaagactcccaaccaatcttcagtctcagcttcatactccatttttttttccaaccaatcctccagtctcagcttcatgctttttttctttttctttctttttttgagacagagtttcgctatagttgccattgcactccagcttgggggacaagagcaaaactccatctcaaaacaaacaaacaaa

SEQ ID NO: 185008 - DNA, 617 bp, Homo sapiens
tatttttcctaaagacagtggtaggagacttacagattttaaagagcagacctttaatctcattgaagtcattttcggctagtaagatacacgattacagatcatcccagacaacagataaaattaaaacatcatcctataaaattctgtctaaaactactattacaatctgagtcatttgattaggattttaaaaattacactctttaactgattttaaagcaaaaagattagatcattgtgttggggatgggaagaagtctcaataaatgtgtaatttttttctttccagttaagggggagaaaaataattctagtagtagaattaggtaaacattaaagcaaaaaaaccccaaccacccattctcactaccccacttcctttaaagttcaagtacactctgagaatcaaggtgaagtcaattttcagctgagctaaattccaaatccattcttacaaaaaaaaagtattagtttatatagcacctacttatatataaaatataaatttgaaaaatgcttttaaatggtaactccaactttttgtttacccattatgttccaatgctgggtaggtgaacagttttaacccaacttcttcccccaatttttttttt

SEQ ID NO: 185009 - DNA, 167 bp, Homo sapiens
ataaattcttagttgtaatttgcttctcttaattatattcccattggtgaaggtagaaatcctttcattttctgattctcaaaaccacagtctacttgcaaactccatctctttgattccctactaccatgttcaattttctaatccaacagaaactcccacagtat

SEQ ID NO: 185010 - DNA, 312 bp, Homo sapiens
tttgaggtcaggatggatgaaaaccaggcagaatcaggatgaatgaagaacaaagaaaacccagtgcaaacgcagcactctgctcactgatgtcaccaaccatgactagactggccttaccctatttccttcctcaccaggtccagaaagaggaatctctttcacggatggatccatgcaccatggacccattccttccccacccttcctctcctgtgggaatttaggaaaatttgaccttttctaagtctttttcttaaaatgatcagagcctgaagccatgaaattcgacaaaggggcttatggttgttg

SEQ ID NO: 185011 - DNA, 207 bp, Homo sapiens
aagctcccaaggaattagaatagcttccaggcaccaagatgtcactactcaaagatgacccgatacagcagggataggcgagacacattaacttcagaggatgtggcaggagtgaagaccacctgcccagtcacctgccacacgcaacagcccaggccccggcagggtgaccctctgcagagctgccccaccaagacccctggatac

SEQ ID NO: 185012 - DNA, 450 bp, Homo sapiens
tccgtctcaaaaaaaaaaaaaaaaaatatgaaggagtggccagaatgaaagaagaaaaactaggagagaataatatactgcaaaccaagagaagaggacttcaaagagggaaaattaccaacaggtcaggtgttagagagaagaccaaagaggatggttattagaagttattagaggatggttattgaagtggtaggataaaaagccagactgtaggggttgtgaatgaatgggaagtaagaaagtagagattgagagttgattgtgaagggaggaaggaagtagacaatatgttgaggggatgaaggcagttgggcagaggagaacttcgtataggtcaaagagaagaaaattaaggatatgaaatgcctatggaggtgggaagatagacattgagaaagttttaacatcttatttctctgtaaagtaggaaacagcatatttttttgc

SEQ ID NO: 185013 - DNA, 258 bp, Homo sapiens
gacacaaatgctttatacccttttataaaatctggggacactaaaacctaatcgaatgtggacaggaaagcccatcatccaaaatcaacaatcccgggccgggcgtggtggctcacacctgtaatcccagccctctgggaccacaggcacacaccaacacacctggccaatttttaaattttttttgtagaggcagggtctcaccatattgcctaaactgatcttgatctcctggactcaagcgatcctcccaccttg

SEQ ID NO: 185014 - DNA, 429 bp, Homo sapiens
cactgtgttgcaagactcctgagcagaggctgtccctggagctttggaggtcagaggccatgcagagcccttgtgctcacagacgacttctgaggactctgcctcttcagagctctgtgtgttgtgttgatgctgaggagtaagctccagggtctgcatggtccagctgcggcgctcagggacacactcgtgtacctcttggcctgggctgcacggtgccatgagctcggagtccttggccataggtccttagtttttttggttttttgtttttttgttttttttgagacagagtctcactctgtcgccgaggctggggtgcagtggcgtgatctcggctcactgcaacctccgcctcccaggttcaagcgattctcgtgcctcagcctcctgagtagctgggattacaggcatgcaccaccatgcctg

SEQ ID NO: 185015 - DNA, 288 bp, Homo sapiens
acctcgtgggttcacgccattctcctgcctcagcctcccgagtagctgggactacaggcgcccgccaccacgcctggctaattttttttatttttagtagagacggcatttcactgtgttagccaggatgatctggatctcctgacctcgtgatccaccagcctcggcctcccaaagtgctgggattacaggcgtgagccaccacgcccggccaagcctatgtcgcttttaagatgaatccaaaaagactgtgtgctactaggctacagaaagcagcattaagtctga

SEQ ID NO: 185016 - DNA, 174 bp, Homo sapiens
agtggtagagagagtgctgggctaacaatgggttacaatagacctactgagcatgcctgaccaagttttgaaaaagaaaacttccataatcaagtaagatacatccatctaccaaaaaacataatttagggtggaagaaagaagggctcttttaaaatgccaaccggttagttt

SEQ ID NO: 185017 - DNA, 307 bp, Homo sapiens
gaggttaagcggctctcctgcggtgcagagctagtgggcatagactcccaaatggacagtctttcctcttagccaaggtgtgatgttaaggaaggtgacataggagaacggggatctcagcccaagtgagtagaaacaggaaaagttagccgggcatggtggctcacgcctataatcctagcactttgggaggctgaggcgggcagatcacgaggtcaagagatcgagaccatcctggccaaaatggtgaaaccccgtctctactaaaaatacaaaaattagctgggtatgttggcacgtgcctgta

SEQ ID NO: 185018 - DNA, 545 bp, Homo sapiens
tagatcaaaacaattaaaaaatgctcctggaaggaaaaaaaaaacaatgctgttaacacaattaaaccaaacaagtaaaattattatagccccgaagagatacaacactgcatctgtaagacaggggcaggacaccatggacaaatgagcaggcagagaatgaaaactgaaccttgaaactcaatagaagttctactaaataaaaattcaatagaagggttagtctatgaaattgaggacatttctctgaaagcacaaatagaataggaaaaaatatatgatcattagagattcaatttaggaaacaaaatatgattgactagatttctagaaggagattaacaaaaaaacagaaggaagaagttattttttaaaaaaggaaagaaagaagaaaatattctggaagagaaggacacatattccccgagagtgtggaaaaactcaagctgtatttttcctctgccctcacatcaccacaacaatcaacagaagtcacagaagacttctgtgactacatattggcggggggtggtttcttcccacca

SEQ ID NO: 185019 - DNA, 291 bp, Homo sapiens
tttttggtaagttgtaagagttccttatacattctggacactagatccttatcaaactatgatttgcaaacattttctctcattctgtaagtcagtttccactttttggattatgcattttgatgaccaaatgtttttagttagaaattagaaatctaggccaggcacagtggctcacgcctgtaatcccagcactttgggaggccaaggtgggcagatcatgaggtcaggagatcgagaccattcctggctaacacagtgaaacccgtctctgttaaaatacaaaaaaat

SEQ ID NO: 185020 - DNA, 309 bp, Homo sapiens
gaaattcaggtataaaaaagcctaactgtggagttgttaggaagattaaattaaattcattaaaagctcctagttggtacctggctcagaacaagtctcagtgtatgttaatgcccactctttccacagagagcccatggtagcagcagagcccttgtgtaaggcagccccagattttgggacaatggctctgctgagaagccaagttgaaaggaataggggcagcaatctcaccaaactcagcagccaggcttccctgaatccccttgaggttaggcacaagaatagatgggtctagcgtccagttcc

SEQ ID NO: 185021 - DNA, 288 bp, Homo sapiens
tttccaaagtttatatagtactcgagtgagtaatttcttacataattgtactaataaaaatgttcacttcgtttgcaagtggtgagattttagactcttttaaacaggaaaacatgatgaagattacaaaattaagttagtctgactcaaaatgagatgtttgataaaatatggacttttgtgcaatagttgtgtagtgttaattgtatgggaatcgtcataaatttctgatatctcttatctgcccagttgtaaaggtattgactacctgtggtgatacattttata

SEQ ID NO: 185022 - DNA, 193 bp, Homo sapiens
aataaaataaaataaaataaaataaaataaaataaatctttcaggagtgtaacgaaggctgaccatagtccagaacaccatgcctcagcacataggccatttaacctgggcggtctggtcacactgagctgtcactccacgccttggagaagcagggtggtcagtgcgacaggctgtcactgccagtgccacg

SEQ ID NO: 185023 - DNA, 276 bp, Homo sapiens
tgagtgcatggggggacgagatgagatcagagcggcagaaagatgaatgtgcacaaaatgttaaactgataaagaccaaatagctgaaaagtgatgggaggagaacgtatccgtgatacatgacagattggagggctaagatctcaaacacagcagccccagttaagaggcattgctgcagttagattttagactgattagaatggagacaaaggaatgggtatgaaggaaaagctccttcaaagcagacggactaatgttgcttagaggaaaaaa

SEQ ID NO: 185024 - DNA, 118 bp, Homo sapiens
agaggtacactggttggaaagagttgagagttctattccttgtgcttgaaacaggctgagtaggaagagaacaggtgacaagaaagcagtccctgtcagccccagggtgggagatgag

SEQ ID NO: 185025 - DNA, 495 bp, Homo sapiens
aaaaatgtggaacgaactggattttactagaaaaacaatgtacttaggaactcctggtaggaactaaaacatgtttttaaaaatcctgcaaattttttaccaccacagtataaaaatactaacggcttatagattaataagttaaatctctgaatctttgacctttgacaaacgtcagtgttatgctttcactacagatagatgttttcctttggattgcctgataaagtatgcacagtatattgaaatcacttgagataaaattttgcaaggagtcagaaggttatgaatgcttgacatacttaaatttaggatcactactgtatcataaaggagattatatttcacagctatctgttgtctggaagctgtctaaatagatgtgttatttgtggacttacggaactggcaaggatcagagctcacatgcttcagcctccaactcaattctgcaatcggggccacatcatcactgccaaatgaccgggtaccgcc

SEQ ID NO: 185026 - DNA, 424 bp, Homo sapiens
cctgcccttagatcctgtgtgctcccactttacacatagctttaatctgattggttactggggaagggcaaaagacatggatggcagctaaaggcaggggaagaaacaaaccagcaggttgttaacatatgcatgtgtaagtgtgtgtgtttaaatgggtcatgaagaagccctacagtcaaccagcactggaacaagcatggggccatttgtggagaggcacatgtttctccgcagcaatccctgaggtctgcatgagagaccctggaataatgaacactctagcagggatcttgagataccatggcactgtgaagtgtgttcagtttgtgctttcaggaagcaattaaaatagttttaaaaataaaaacttctagaatagtacactcaactttcacaatcctaagacttccagactgtttgc

SEQ ID NO: 185027 - DNA, 180 bp, Homo sapiens
tgagtaatgaattcttaaggttcagctgataatgtggacttagtttaattgcattagatgtttgcctctcacttaggggtagttatatttttaggctaaatttttattatataacgcagaattgagttgcttcaaagaaaaataggttatcattcttgcacatgttcttgattaggatgt

SEQ ID NO: 185028 - DNA, 341 bp, Homo sapiens
tttcttccaggtagagaaatattagaaacaaaaatttccatttctaaagagactttcaaagtgatttctccattaaagggacaatgtgaaaagcgtactttttccttgaactccaaggagttgcctttttgagccattaaaggactacatgttgagacagtaaatagtaataaaaaacggtatcttcagttttatttatttttatgaattagaaaacaaaatctgaataaaatggaaaaagcagctataaaaaaggataattttcctatcaatctgactcaagagtagtacaattatcatacgtggtaatatttatacttaagtgtggatgtgtcttacat

SEQ ID NO: 185029 - DNA, 129 bp, Homo sapiens
cccaggtccccaaacttgagagtatacagtgtccctgggaatgagggagttcctgagtgagcggaaagcatcttatctctgctcctctctatatcaaagacccatccaggtcttgaggcctttcctgtc

SEQ ID NO: 185030 - DNA, 537 bp, Homo sapiens
cattcacgatggacacagtgagccgaccctgctttgctgctgctaccgtggcatgcagaaccggaaacctccccaacacatattcacataaagcaaccatttattctgatgtctccctgctttgcaggtttactggactcatgcgggtggtagacacgcatgtgtgtgggagtcacgttttctgaaggacctacaggctgggatcccagaggattcttcacttatgtttgactcaacactaagggtgagtgaacacctgggggctggctggttgtctccttccctacctcccctacacattagtgtcttgaattttctgaaatcatgaaggcctcatagttgttggacttaatcaatgattactgtcttccaccaaagaaggactttcaagaaaccaaagaagaagctgccaggcatcatagaacttagctttgaaaattggagagtgtcacttttctatgacattatattgattaaggtgagtacagacagcccaaatcatggggaggggcctccacaggttgtggttgttttgat

SEQ ID NO: 185031 - DNA, 358 bp, Homo sapiens
cattcacgatggacacagtgagccgaccctgctttgctgctgctaccgtggcatgcagaaccggaaacctccccaacacatattcacataaagcaaccatttattctgatgtctccctgctttgcaggtttactggactcatgcgggtggtagacacgcatgtgtgtgggagtcacgttttctgaaggacctacaggctgggatcccagaggattcttcacttatgtttgactcaacactaaggcaatgacccagagctgcgggtggaattctacactggggcaaatgaggactcagacatcgccttccatttctgagtgcactttggccattgtctggccattgacagccatgtgtg

SEQ ID NO: 185032 - DNA, 319 bp, Homo sapiens
aggagacaggaaggaggcaggaagagatggtgaagcagcttaagaagcccaggtatccagtaacaggtagtgagattgaatcagtaataaagtctcccaacaaagaaaagtcccaaactggatggctcccctactaaattctaccaaatgtataaagaactaacactaattttcttcaaactatttaaacaaattaaagggaagggaattctccctaactcattctatgaggccagcattatccttattccgaaaacagacaaggatgcaacaacaaaaaaacaaattacagacccaaatctctgatgaacatagaccc

SEQ ID NO: 185033 - DNA, 434 bp, Homo sapiens
gcctccataatcacatgagccaatttccctagtgaattccctctcatccatccgtatctctctctatctgatctatatcctatttgttatgtgtctctggagaaccctgactaatatgtactgtagaaaagcctcctgagacttagacgctatgtttcctttgtttaaatgttgttgaattgatcataggtataatgcattagatttttcagaagaaagaaaaggtttattccacattacatctcttcagaagcctacccaaaggggatatctgttttggctatttattgcagtgtaataaactactctaaagcttagtagcttcaattagtgatttattatgtctcatgattcagtgggctgaccaagctgttcttctggttcatgtggtgttggctaggtgctggaatggctgtgttcctctgagacttgga

SEQ ID NO: 185034 - DNA, 614 bp, Homo sapiens
tcagccttctgagtagctgggattacaggcgcccgccaccatgcccagctcgtttttgtctttttagtagagatgggtttcaccttgttggttaggctggtcttgaactcctgacctcaagcagtccacctgccttggcctcccaaagtgctgggattacaggcatgagacaccgtgcccagccaagaagaaaaaacattcaagcattccctataaatatttgccatgaggaactacttgtagttcccataatatgacacattctctcttgagacttcccatggatattctttttcctagaaagttctacccttattcattctctgacttaattctattgctttccattctcagctcactcttcactattccagggtgttgtcctggaccttccctggctagactgagtgtccctcttctctactctcaatgtttatcatagcagtcttcaccttttgttgtaattatctgttcactcataatctgtatcatttgactataatgtttttaagggcagggattatatatttatatttccgtctttggtgccttacttactgcctgaaagtttgacacataaggcgtccaccagtgtttgttcagcaaataatagt

SEQ ID NO: 185035 - DNA, 509 bp, Homo sapiens
taacaatatgctaagcctgaccccaacagctcaggtggagcactaggccaaagttctaagttcaacaaatgacaaataaacagtcttgagatggttaattttatgtgttaatttgactgagctaagagatgtccagataggtggtaagacattatttctgggtatgtctgcacggatgtttccgaaagagattatcctttgaattggtagactcaagaaagaagatctgctctcaccaacatgggcagcatcagccaatctcactgagagtccaaatagatccaaaaggcagaggaagggcaaattccccctcactcttattgagctgggacacccatcttctcctgccctcaggtatcaggcttcctggttcttgggcctttgtgctttgatacttacttatactgcagccctttcccttccaccccataatcttggctctcaggccttcagactcagactgagttatgccaccagctttcctggttctccacgttgcagatggcaga

SEQ ID NO: 185036 - DNA, 528 bp, Homo sapiens
gtaaacttgatcattgaatgcctctgggttaaaaaaaattacatactttggaaaatgacttgacaaaagtttaattagagaaaggctgattagatagttatgctattgaatctctttatgttatcgaatctcttatacttggaggaggaggggaagtgtataattcaattcaacgagcttgtgttgagtgctagacgactatgttgtgtgctgggaaagacatggttagttacttccaggagactgagatatataactagttgctcattttttccagaaacttaattaatgcattttgaatttaaggcaccttattttggtataattctcaggatgcttatgaggttttagtgggttctctttactcttgctgtgtgtttttgtttatttaatcatcagatattactgcacttcaaataagggccaggtaatgtgttaggtattgggcattcactgttgaactgtgtcactcagttcttcatctcacagaatttatcctttaatggggtaattagataggtaagcagg

SEQ ID NO: 185037 - DNA, 203 bp, Homo sapiens
ctgaggataagagagaacaccacctggcaatcacactgtgccagaacagtgtctgttcctacactggcaaacacttcgttttaaatgcgcattgggtagagtattaggaagggtcttgattcactagtgaggaataattagtcttagaataaatggtatgctggtcctgcctaacaaattttcaaatgtttaaagatacaaaa

SEQ ID NO: 185038 - DNA, 603 bp, Homo sapiens
tcgtaatagtgccctagttttattttacttttgtcactgtgttatgtttttaaatacttggaactatgttcttactggtacataactgacagctatacacaaagcagcttaaaccaacacccatttatttgctccactgttctgtacattagagctgtagttagggctcaagtggcttctctgcttaaaatcttaaaaggctgagaggaaaatgtcaggaaggctgggctcttacctggaggctctgcagaagaatccacctccacgctcattcaagttattggctgaatttagttccttgtgattgttggactgacatccagtttccttattggctgtcagcaggaggctgttagggggtctttctgctcttagaggctggttgtgatttttcttttttggccccctctagcttagagccagcaataacacattgagtcccctttgcattttgaatctctctgacttcctcttctgcaatcagccagaggaaactgctttaaaaggggctcatatgattagactaggaccatccagataatcttttatatgctcagctgtaccatatatcataatcatgggcatgatatcttatggaattca

SEQ ID NO: 185039 - DNA, 155 bp, Homo sapiens
gttttctaattgcttgagctcagaacctgactcatgcttgactctttttctctcatcccatgtgcaatcattggcattctgtcagttctaacttcacaatatattccaaattcaaccagttcaaactgcgttcgcctgtatcactctagtctgaa

SEQ ID NO: 185040 - DNA, 396 bp, Homo sapiens
cctgatattcaaggaaaagtcagccaaaaacgtgagtcactcattagcctctttaaaaggtggaacatgctaaggcggggaaggtaaacagactcttgctatgttggattaagatgtacccttagatataactcttctctggaaatgaaaaaaattctctaaaaaatatagcacacatatccttgacccaattaaaatatagcatttcaaaaaggaagcagatagcacatggtttgtcaaataaatgactcaatagaaacgcatgaaatatatttgaatagagattgccaaatgttgttttttaaataaggaactcattaaagtctatgaaacagacttcagaaattgatttcctggagtgaataccacaaatgattctccagagcccacgaagag

SEQ ID NO: 185041 - DNA, 735 bp, Homo sapiens
tgtagagtacacccgctcaactgatccaatgcaaccaatacagtattggaagctttctacgaacaaggcacccagagagggctcggaggaagatgacagtgccaacgggcacagggagaatcgtgagcttactgcaccttcccagcaggcagagtgagcccgtaggacaagagccccctttctccgtttcccatctgccctgcagccccgaggaacggtccattctacagacaagaggcctgaggctcagaagcaaagcaacttgccacaatcgcatcaccggagaaagtaccttcaagacagtcctggacgcggtggcttcacgcctgtaataccagcactttgggaggccaaggcaagaggatcactggatcacttgagcccagaagtttgagactagcctggacaacatagtgaaacccctgtctttacaaaaattgattaattaattaattgtttaaaagagactattcctcattcttttgacatcattttaaatgagaatgcagaatatgacattgtacatactgatatttgattccttttatataacctttcatgtattaaaaaactgcactgaaaatctagaattaagttaaaattggtgtgggttatttgtgaatggtgggattttttaaatgtattccaacacccatatattccaacttttccacacttccaaagtctggaatactttgaggatggggaggaaagatatgtttacggtccttggga

SEQ ID NO: 185042 - DNA, 278 bp, Homo sapiens
cctgctttggcctcccaaagtgctggggttacaggcgtgagccaccatgcccagccaaagattttagtacacttttaaagaaagcatcaaggattggtggtggggtggtggttgctgctgctgctatttcaacactatttcttctaagaggataataaaacactttgagaaagttgtggcttctttttttctttctttagcaggggaaagggatagggatactgaattgtagaatccctttgctcatgaagaatacaatgtatttctcaaaatgcaag

SEQ ID NO: 185043 - DNA, 441 bp, Homo sapiens
atcttcctctgtcatatccaaggtaggaatgtatgccagagagcaccttgccctctagcaatttcgactaagatgtccaagtagaatgtttccttttacaatcaaattactgtatttattaatttgctagaatccagtaaatcattttggtagctctggctgtgctatcaataaaaagatgaaagcaacaagttgattttttttaggtctactattgattgaaccggatagcttgccggttcaatcatctccttttatgaggattgtctggatggtaaagaatgagtcctaggtagaggtattcattttagtcagggggaaacaactttttcctgtaagattgaaggaaaggctacaaagatagatgtgggcctattgatgaatagaaataaaaataagattttatagataatttacacttaatgatagtatcttcagaaa

SEQ ID NO: 185044 - DNA, 540 bp, Homo sapiens
ctgttccagtacggatgtgtgtattataattccattttcgttaaacaaaacatactatatatattcactggaaatgtatttcaaagaaatctagaagtgtatatattctacagtgttaagagtagttatctgagggaaggtggaacatagagttttactttagactatatatttctagactagttggattttttcatactgagcacacattagtttttttaggcctggtaatattacagaagtcaaattacagaagtcaccctagctccccactcgccttctaaacctaattctttagcatggtgtgctgtgcccttcatggtctagctcagtttacctgcagccccatctcatcactcacctggatgcatccactctcaggatattctcaggattaaacttggggattacattttctgaccttcactttccctcccttatcttagatggaattagggagtttttctgtatgttcccatagctcccaatgcctaccttgcttttagcattttgacctaccctaccctgtagattgttgtt

SEQ ID NO: 185045 - DNA, 199 bp, Homo sapiens
atggagtagatggatggtgttgccaccaaataaggagaaagcaggtttgggggttaggtgatgagttcagctttggtcatgttgagttggaagctccagtgagacatctagatgaagcagtcccacaagaaactgggaatctgaatcaaagttcgtgatagaaacatagcctagaaaaagatttcggaaccatcagcct

SEQ ID NO: 185046 - DNA, 521 bp, Homo sapiens
ggtgaagagccagaccagtagatgatgaaggaacagggtagaagggcctgttgcccaataccctcatgaagcagagttgctgtactagttgagaccatggcatgacctagaaataaacttctatcttgttttaagtacctgttatttggggtcttcactacatgtacttaaacccattgtccaacaaatacaaagcaaatgagacaattttcagtcaagtggcaacaaataattgctgctacttggtgtctccaccagaaccataaaccatggtactaaaacttttaaaagctaatttaactcttatgtagaagatacaaatcccttataaacttttcattgttaatcctcttgataattttttttttattattttttttgagacggagtgttgctctgtcagacaggctagagtgcaatggcacaatctcggctcactgcaacctctgcctccatgattctcctgcttcagcttcctgaggagctggaattacaggcacccatcagcacacctggctaat

SEQ ID NO: 185047 - DNA, 335 bp, Homo sapiens
tataacttctgctactcccaattgcccagcaggaatcatggaaagccttcagaggataacttggcaaccagtgtgccagttttaacatctgagtttcagaaacctggtttaaaaaaatggcaaaatggcctttttctcagagtcccttgatctctcttcagataatttatgtatttaaaatgcctaccatacctatgtattacctaaatgacatccattccacattctggatagaaatttttcagcaacatggttgtcaatcaggttataaaagaaataatataactactgatattattactcaaaacagagatgttttaaatctaaaataaacc

SEQ ID NO: 185048 - DNA, 406 bp, Homo sapiens
aactcatggcggcggcggcggcggcagctgcttgggcgcggtgcggtgttgactgagctacgagcctggcggagggtgcgcgccgagccccggtccggccaggcccctgcgtgcgtcccaggctccgcacccctgatgctgcgcgggtgctgagcctgctccggccgggacgatggtgaagtatttcctgggccagagcatgctccggagttcctgggaccaagtgttcgccgccttctggcagcggtacccgaatccctatagcaaacatgtcttgacggaagacatagtacaccgggaggtgacccctgaccagaaactgctgtcccggcgactcctgaccaagaccaacaggatgccccgctgagccgagcgactgtttcctgccaatgttgctcactcggtg

SEQ ID NO: 185049 - DNA, 319 bp, Homo sapiens
actgtatagatgtgtgacggtgtggactgtatagatgtgtgcatgtaacaggtgtggactgtatagatgtgtgtgtgtgtgacggtgtagaccatatagatgtgtgtgcatgtgatggtgtggactgtatagatgtgtgtgtgtatgacagtgtggactgtatggatgtgtgacggtgtggactgtatagatgtgtgtgtgtttgtatgacggtgtggactgtacggatgtgtgacggtgtggactgtatagatgtgtgtgtgtttgtatgacggtgtggactgtacggatgtgtgacagtgtggactgtatagatgtg

SEQ ID NO: 185050 - DNA, 581 bp, Homo sapiens
ttgggactggttcatgcagagagttatgggaaccactggaggggaacttgacttggctcaaggaaacacagaagggttcctgaggaggtctaagctgagactgaagataaacaggtactagccaagtgagggagagaggggagaaaactgttccaggcagtgggaacagaatgtgcaaagactcagaggcaagaggatacttgtctgttagattttccaacatattcaactctatagtacctagagccatactgggctaatttcagggccgagatttccatttttctcatgaggagactggggctcagagagttttagtgctctgatttatatgacttgtctaactcagcttatatgaggaggagctgagatccatccagaatttaaggctcagatcagggctgctccttgaggggagccctgttctggggctagagctatgcctggatgcttgtcattggctctgctgttttgtgctgaacatgccatggtctttttcacaccaagggcaggatttggtgatatgactgggaaggtagagccctgcagtgtgggagtcagggagcaggcaggtgagaagg

SEQ ID NO: 185051 - DNA, 1662 bp, Homo sapiens
cccacgcgtccggattctcgccctgagcaacggcctgacgtcggtggagggaagcaggcgcaggctccgtgaggaggcaaggttctgaggagacaggccccggagcagcactagctcctgcccacactcctacctgctgccctgaccagagtcatcatgccacttgagcagaggagtcagcactgcaagcctgaggaaggccttgaggcccaaggagaggccctgggcttggtgggtgcgcaggctcctgctactgaggagcaggagactgcctcctcctcctctactctagtggaagtcaccctgcgggaggtgcctgctgccgagtcaccaagtcctccccacagtcctcagggagcctccaccctccccactaccatcaactatactctctggagtcaatccgatgagggctccagcaacgaagaacaggaagggccaagcacctttcctgacctggagacgagcttccaagtagcactcagtaggaagatggctgagttggttcattttctgctcctcaagtatcgagccagggagccattcacaaaggcagaaatgctggggagtgtcatcagaaatttccaggacttctttcctgtgatcttcagcaaagcctccgagtacttgcagctggtctttggcatcgaggtggtggaagtggtccgcatcggccacttgtacatccttgtcacctgcctgggcctctcctacgatggcctgctgggcgacaatcagatcgtgcccaagacaggcctcctgataatcgtcctggccataatcgcaaaagagggcgactgtgcccctgaggagaaaatctgggaggagctgagtgtgttggaggcatctgatgggagggaggacagtgtctttgcgcatcccaggaagctgctcacccaagatttggtgcaggaaaactacctggagtaccggcaggtccccggcagtgatcctgcatgctacgagttcctgtggggtccaagggccctcgttgaaaccagctatgtgaaagtcctgcaccatttgctaaagatcagtggagggcctcacatttcctacccacccctgcatgaatgggcttttagagagggggaagagtgagtctgagcacgagttgcagccagggccagtgggagggggtctgggccagtgcaccttccaaggccccatccattagtttccactgcctcgtgtgacatgaggcccattcttcactctttgaagagagcagtcagtattgttagtagtgagtttctgttctattggatgactttgagatttatctttgtttcctgttggaattgttcaaatgttccttttaacggatggttgaatgaacttcagcatccaagtttatgaatgacagtagtcacacatagtgctgtttatatagtttaggagtaagagtgttgttttttattcagattgggaaatccattccattttgtgaattgtgacaaataacagcagtggaaaaagtatgtgcttagaattgtgaaagaattagcagtaaaatacatgagataaagacctcaagaagttaaaagatacttaattcttgccttatacctcactctattctgtaaatttgaaaaaaaagcatggatacctggatatccttggcttctttgagaatttaagagaaattaaatctgaataaat

SEQ ID NO: 185052 - DNA, 1943 bp, Homo sapiens
cccacgcgtccggattctcgccctgagcaacggcctgacgtcggtggagggaagcaggcgcaggctccgtgaggaggcaaggtaagatgccgagggaggactgaggcgggcctcaccccagacagagggcccccaataatccagcgctgcctctgctgccaggcctggaccaccctgcaggggaagacttctcaggctcagtcgccaccacctcaccccgccaccccccgccgctttaaccgcagggaactctggtatctcagggagttgaggaccttttcttcagagggtgactcaggtcaacacaggggcccccatgtagtcgacagacacagtggtcctaagatctaccaagcatccaggttctgaggagacaggccccggagcagcactagctcctgcccacactcctacctgctgccctgaccagagtcatcatgccacttgagcagaggagtcagcactgcaagcctgaggaaggccttgaggcccaaggagaggccctgggcttggtgggtgcgcaggctcctgctactgaggagcaggagactgcctcctcctcctctactctagtggaagtcaccctgcgggaggtgcctgctgccgagtcaccaagtcctccccacagtcctcagggagcctccaccctccccactaccatcaactatactctctggagtcaatccgatgagggctccagcaacgaagaacaggaagggccaagcacctttcctgacctggagacgagcttccaagtagcactcagtaggaagatggctgagttggttcattttctgctcctcaagtatcgagccagggagccattcacaaaggcagaaatgctggggagtgtcatcagaaatttccaggacttctttcctgtgatcttcagcaaagcctccgagtacttgcagctggtctttggcatcgaggtggtggaagtggtccgcatcggccacttgtacatccttgtcacctgcctgggcctctcctacgatggcctgctgggcgacaatcagatcgtgcccaagacaggcctcctgataatcgtcctggccataatcgcaaaagagggcgactgtgcccctgaggagaaaatctgggaggagctgagtgtgttggaggcatctgatgggagggaggacagtgtctttgcgcatcccaggaagctgctcacccaagatttggtgcaggaaaactacctggagtaccggcaggtccccggcagtgatcctgcatgctacgagttcctgtggggtccaagggccctcgttgaaaccagctatgtgaaagtcctgcaccatttgctaaagatcagtggagggcctcacatttcctacccacccctgcatgaatgggcttttagagagggggaagagtgagtctgagcacgagttgcagccagggccagtgggagggggtctgggccagtgcaccttccaaggccccatccattagtttccactgcctcgtgtgacatgaggcccattcttcactctttgaagagagcagtcagtattgttagtagtgagtttctgttctattggatgactttgagatttatctttgtttcctgttggaattgttcaaatgttccttttaacggatggttgaatgaacttcagcatccaagtttatgaatgacagtagtcacacatagtgctgtttatatagtttaggagtaagagtgttgttttttattcagattgggaaatccattccattttgtgaattgtgacaaataacagcagtggaaaaagtatgtgcttagaattgtgaaagaattagcagtaaaatacatgagataaagacctcaagaagttaaaagatacttaattcttgccttatacctcactctattctgtaaatttgaaaaaaaagcatggatacctggatatccttggcttctttgagaatttaagagaaattaaatctgaataaat

SEQ ID NO: 185053 - DNA, 112 bp, Homo sapiens
ccatgtgcagtgtgatgttttgtgatgaaggaaatgttccatatatccagtgtccgataggtaactactagccaaatagagctactgaggacctgaaaagctagtgcaatta

SEQ ID NO: 185054 - DNA, 576 bp, Homo sapiens
ttgggaccacaaggggcctcaccctacaaccatcctatccttgagcttctggtaaaactgcaggggccagcagtgtagcctcaggtctcactccgcaacctgcagccctcccactcacacctgcagaaaggggaggtatggccttcaccaagaatattacattatatgcatcaaaaggaaacaaacaaacaaacacagaggacaaaacacacacacacacacacacacacacacacacacacacacacacaatttatttaacagaaagttggacaagacatttcattatgaaaatatattccaaaatatgtagacctgtttgtaagtaaacttctttatatagttttttacataatttcaggtgtgtatcactcatgatctagctagatcactgacttgcttacagcacctggaaccttatacagtactgttaagattttttttttttttctggagtacatacatcatggatcaggtagtggcatctgctggcaatgagtgatattgctttctaattctataggtggccaggcatttcatcacagtacatccctggaaagtggatcatggtgttgc

SEQ ID NO: 185055 - DNA, 341 bp, Homo sapiens
taaataaacgcaatactacatcagactgaggtgtttcttttgaaaaaatacaggattggcttaacattcaataatcaaaataattctccattttaaagaattccaccaaggaagaattccataattcaccatattaacaactaaaaaagaaaaaccatatgatacagaaaaaagcatttgagaaaatccaacattcattcctgattttaaaatctcaggaaactagggaagggaaatccctcaacttgataaaggtaatctaccagtaacttacagcaaacatcgtacttactgaaagaaggcaagaagttctctctgcctctactcttgtgtaaactgtt

SEQ ID NO: 185056 - DNA, 461 bp, Homo sapiens
gagaaataaaaaatcttggacaatgagcccaagtaatttaagacattcacagttgggctgtgggttgctcttgccaatgtgcagatgcaggctgcatatgttgcagggtcctcctcattcattcctcaaacatttatcaagcatcagtgatatgcccaaacgcttagaatatagtgctaagccagatgggttctatgggaaaggaaactcaatagtaatgataattatgtgccaggcattttctacatgctttccctgtgttatctcatatcatcccaacacagctataaagaaagtgctatttttaataaacttcatttttagagcaaagtctaaacctctgttttaagttcacagcaacattgagcagaaggtacagagatttcccatatatcctctgcccccacacaggcattgcctctctcattatcaacaaccctcactagagtggtacattcatt

SEQ ID NO: 185057 - DNA, 125 bp, Homo sapiens
caatttaatatctttttatttcaactgattttccttacaagtacaacagaaccatcaagtgcaaaaggagtaaaaggtgttctgcaaacaaaagcaaaggggacaaacccaaaccaccacagctc

SEQ ID NO: 185058 - DNA, 507 bp, Homo sapiens
cagtggatttgggttgttcttttaaagcctgacaggtaattctgatatacagccagggttgagaatcactgatatagactaaatggcatgactcaatttggaggtggacttattaataaggttggatgaaaggttgttccatttgtcgtatttgggtcaattttggcaagttcaacagataaagtacctctcgtttttaaaagatatactaggtcgggcgcagtggctcaggtctgtaatcccagcactttgggaggctgaggcaggcagatcatgaggtcaagagatggacaccatcctggctaacacagtgaaaccctgtctctactaaaaatacaaaaagttagctgggcgtggtggcgggcacctgtcgtcccagctacttaggaggctgaggcaggagaatggcgtgaacctgggagacggagcttgcagtgagctgagatggcaccactgcactccagcctgggcgacagagcaagactctctctcaaaaaaaaaaaaaaa

SEQ ID NO: 185059 - DNA, 589 bp, Homo sapiens
cagtggatttgggttgttcttttaaagcctgacaggtaattctgatatacagccagggttgagaatcactgatatagactaaatggcatgactcaatttggaggtggacttattaataaggttggatgaaaggttgttccatttgtcgtatttgggtcaattttggcaagttcaacagataaagtacctctcgctttccaactgacacttacattattaatcacctgtatttctgtgaattgctatagtagtgacagttggggaagagaagttgctttttaaaagatatactaggtcgggcgcagtggctcaggtctgtaatcccagcactttgggaggctgaggcaggcagatcatgaggtcaagagatggacaccatcctggctaacacagtgaaaccctgtctctactaaaaatacaaaaagttagctgggcgtggtggcgggcacctgtcgtcccagctacttaggaggctgaggcaggagaatggcgtgaacctgggagacggagcttgcagtgagctgagatggcaccactgcactccagcctgggcgacagagcaagactctctctcaaaaaaaaaaaaaaa

SEQ ID NO: 185060 - DNA, 136 bp, Homo sapiens
tcacatatttttaattagctccttttgggttctctacccctcctctcaatgttcctaccccttcctattcctcttattctccagcagactatccccttacctcacccagaaaacagacaagtcactggagaataag

SEQ ID NO: 185061 - DNA, 708 bp, Homo sapiens
tttctaacagatcaataagcttatcacagtatgacagcaaaaagaaatgagactcttggattctatttctctttcctatcttaaaaaacatttcctcttcccgcgaacatgtgttctctatctcttaaatttaaaaaggagtagtttctaaaagagaaccagtaggaaagaatcaggaataccagcaaaagtcaacatcaaagaagtcagtatctgatcctctcttaaacctagcaggagtggagctctctggccaaggggtaaggcaaaagcaatgtgcaggttataaatgtcccttcaagctcagttactccggtttacctctctggggtgagcctctaacagctctggctcgccggaatctttcctccctcggctccagcacacactttccatagcggccgcgttgcaatttcaaagagttctcctttccacgtaggtcacccaccgatggtaacctacatgcacaaacacactcgcacaatcacaacagagaaaatgggacatacaggaaatggcccgggtggaggcgaggacgggggtggggataggactttgtctttactctggtgttgctcccattgaaacaagcacatggactttcatggaactcatgaccatcctgaaataacagaaaagtcgaacgggattgaagaaaatcctttgcttttctaagttcgaagaacactgggccgctgaatggaaggg

SEQ ID NO: 185062 - DNA, 555 bp, Homo sapiens
ggggcccattggttgtgagaggagggtctggtgaaattccataccgattgtccgtgtgtgagctgctgtaccatagcctccctgcagaaccactaacctgtcaaatgcagaaatagttcagggacagagctgttaaaggattggcgggttaaagaaaacagtgaatcccaagttttgttaattggatttttttgtttgttagttatttgttttgcttcattgtcttcatcacaccaggggcctccttaaatctggtggaaaaatttccttggaaaacaattcagtgtttgtccatagacttgggagggagagatgctagatgctggaaagtcttgcttattactttggggacactgagatgttcccttcaccatgtactttgagacacacatcctggttgagttcaggcaaggatgcctaacagttgataagaaaactgggaaagatagaagggatttgtaaggtaagtcagggtgagtgaaaacacatccggtatgctggagacctagatgcttgactgccactcgctcctgtcacctcagtcaatctgggtct

SEQ ID NO: 185063 - DNA, 176 bp, Homo sapiens
acgtaggtgggatcttttaagaagcagccttatctagattgggaataagctattatagttttaggctgtgtggatctggtcaacttttgtgctgcctacttctctttgcttctacaactgggcattgctgcagaaaggaagaaatatggaagtgacttcagctttgattttcttcc

SEQ ID NO: 185064 - DNA, 448 bp, Homo sapiens
ccattcatccactcatccactgattcatctacccactcactcaccttccatctatccacctaacaatccacccatccttctactcactcaccattccatccttcccttcatctgccgaattatccatctgtttatctatccatccacccaatcacccatccgtccattttatccttctatccatttatctacccatctatctatttacctactccctatctacctttccgtctgtccacccaatcatccatccagtcatccatccacccacccactcatctacccattcagccttccacctatctacctaaccatccatccatccatccatccatccatccatccatccatccatccatccatccatgtatccaccaacccaccaggttggagacaaggtggtgacccaaatagataaggccattgcccttgtagaacttacacctaa

SEQ ID NO: 185065 - DNA, 467 bp, Homo sapiens
gtgctaggaattcggcttagactgtcgaccaggttgcccacggagggtgaaccggcccaggttgcgaatagagcagatgaaacatctctcctatgctgatcagtagtgggattgcacctgtaaaaagccactgaactccaacctggacaacgcagtgaaacccgtctcttgaaaatcaaaaattcaaagaatatttttaggctgggcacagtggctcatgcctgtaatcccagcactttgggagaccaaggcaggaggatcacttgaggttaggagtttgagaccagcctggccaaaatggtgaaaccccatctctactaaaaatacaaaaataagtcgggcgtggtggcatgcacctgcagtcccagctactcaggaggctgagggaaaagaatcacttgaaccctggaggcagaggttgcggtgagcccagatcaagccactgcactccagcctgggagacagaa

SEQ ID NO: 185066 - DNA, 577 bp, Homo sapiens
ctgccttcttaaacacaggagttcagccctcggttctgtgtagacggttgtatgcaggaagtgcacaggcagaatccatgggctcaaggaacagctggattttttaaagctaattaacaatgttccatttcagggctctgggtagaaagctctgacaaagccactgttcactaacgtgctgtgtgcttagtgatgtcattctgtttgtggtgtaagtacctggttaaaattaagcttttctaaatgcctcccttatagcattgtttcagtacccaggactaagaactttgagctttttagattatccccagaggagaaggagggagtatagtatgtaaacacacacacacaacactcacaaacacacaggcacacaagcaagcacacacacaccacttattttgagactctaacaatgaaaactgacaaccatgtttcctagacaaaaactatagactctaatttttttttaagttacaagaatcaaaagactaagcttatttttgctgatctacagatgagaattaagaatttatctcggggctgggcgcggtggctcacgcctgtaatcccagca

SEQ ID NO: 185067 - DNA, 418 bp, Homo sapiens
ctgccttcttaaacacaggagttcagccctcggttctgtgtagacggttgtatgcaggaagtgcacaggcagaatccatgggctcaaggaacagctggattttttaaagctaattaacaatgttccatttcagggctctgggtagaaagctctgacaaagccactgttcactaacgtgctgtgtgcttagtgatgtcattctgtttgtggtgtaagtacctggttaaaattaagcttttctaaatgcctcccttatagcattgtttcagtacccaggactaagaactttgagctttttagattatccccagaggagaaggagggagtatagtatgtaaacacacacgtgcacacacatgccccctcacccacacacatgcacacacacgccctcacccacacacctgcgaacctatga

SEQ ID NO: 185068 - DNA, 686 bp, Homo sapiens
ggtggcatgtgactgtaatcccagctacctgaaaggctgaggcaggagaactgcttgaaccagggaggtggaggttgcagtgagccgagatcacaccactgtattcccgcctgggtgacagagggagactccatctcaaaaaacaaacaaacaaacaaaaaacaaacaagcaaacaaaacacataagcacagactagggaaggtttaaaaacaaacagatgctgagagtataatctggttcagtcttttaaatagcacacactgtaacccaacaatccaatcccactcctaggaacctaccctacagaaacaccagcttaagtgactaaagatacatctctagcatatttaagacagcactgtctgtaaaagcaaaaagggcctgaattctaggcaaataaatattatcagcaaatgcagttatgtgttaataaagaagggggcacttcatgcctttaccttacagagggtcctgaccttctgcgcatgtaaatttgtgacccttgccataaacaatttccactgttaggtttcttccgagacagagaagattcacaactcatgccattaaggcagttaaggacaaccaatatacctggaagacggtaatcttccaagttacagaggatcagaaatccaatgcatttcacctggataattcagactcaaaagttcaaatatttatc

SEQ ID NO: 185069 - DNA, 502 bp, Homo sapiens
ttatatgttcttgcccacactatttgatccactgccacactctatgtcttatacatatatgactccaaatctctctcctgagctccagatctaaaaatctacatgcttagaagacatggaaaactcaaataatgtgatactcttgttatttcccaatgatataattattcaactgcttatccaaaccagaaacttgggagtcaaatcatgttttttattcatgtctcacatccaactgatagtcagctctgtctgtcctgcctctcaaatgtcattcctctatgattctctatcacagagatgcccatttgggttcaggcttccattgctcatcccctgcactattgaaattaccctcaaattagccctctaacatccaggtttgttctttttaatgtatacataaaacacattttagaatttctgtccaaaaatcctcttctttcatagttttctcctgtttattaaaaagtctaaattctgaatttaccacataggcctt

SEQ ID NO: 185070 - DNA, 320 bp, Homo sapiens
cttagctatcacatttctccaaagtgtggtttgtatcaatacttctgtttttgacctaccacttacttttcaaagcaatttattatgttttaagcatacagaaacatgtagagaacaatatgatttttttaaatgttaatgtttttctctcatttactcatttatagagaaatataacatagaattttccattttaatcattttgaaatgtatggttccattaatgattcccactcacttttaaatgtttggaattgagagaactcttactggacagggatgagggtaaaagccaaagtctgccagtgtccatcctcaac

SEQ ID NO: 185071 - DNA, 523 bp, Homo sapiens
tgaagctcccacctaatggctaaatggaaacttaatgagaaggggaagtgggctagttgtgctctgaaaagagtaacaactcatttatggatagcagtctctctaaattccttccaaaacctaaaattataagactggggtataaaatttaaacaacatttgtctcatagtattattcaaaaggatattatagatctatttaaggtatcagtgttttacaagatcctgtttgttgtctttagggaataagcctctctcaaattttccctatttttcctttatgttctacaagtcctaaaatgtttggactatttatacagtatttccaaacaatccatttgaaaataccaatgtaggtaatgatgtaagaatcaccactgaacactagctgctctacaggtcacaaaactggctctgatcaggaatgcagtatgatggagtaggaaagtcaaaggctttgaagccaaagagaagttggattcctgatttggtcactcattctgtgtgtgtgtgtgtgtgtgtg

SEQ ID NO: 185072 - DNA, 367 bp, Homo sapiens
gaaaaacagcagtcatgcttactgctctgtaagcaataaaagtagattgaagtaggggccccctgatctgggtggtcagggaagacctccctggggaagcctgccttgagaatagctagagccacacgtgcaaaggccccagggcaagcatgaaattggaaggtcaaggcagccagtgtggcgggagcatttgggtgatgggggaagatgatgaggcccaagatatgttgaagaactttaagctggaaagcagctggaggtgatccctgtttgatgtaatccttctggctgtgggtggagaatagaatgtaggaaggcaaaggtggcctggggaggccagagagggatctcatgaagttgttaggat

SEQ ID NO: 185073 - DNA, 392 bp, Homo sapiens
catgagctggtgtggtggcacacacctgtagtctcagctattcgggaggccgaggtgggaggatggcttgagcctggaaggtagaggttgcagtgagcccagatcgcaccatggtactccagcctgggcaacaaagccagaccttgtccccgtccacttacccccaaaaaactgtggttctgaaccacagcaactgagccgagcacaatccttctgtctctctaagacccagtctacactgagtagttctgttgatggcactgcttgatgggcctgtaactgccacaagctctggaaaaaccaggtccacagcttctcagagccttttagcttcactgtgaaaggagcaagagcacaccagtgaccaggtgttcataatttctctgcaaatg

SEQ ID NO: 185074 - DNA, 577 bp, Homo sapiens
ccaagtgatagaaagataggtgcccccatgcttcttgcccaggaggaggtcatatctagtggccagagggatgagtaaaaagccattaaaataaaaagtagtgcatgttataataaaggtatgagtaatcagccatgagaaccagaggagggagtaattaaaaataataataataatatgcctggaagtgtcagtgtttagcagagaaagtaatattccagccagccttgaagaatgagtaagaataataagagttaataattattgaacatttccagtgaccaggcattgtatacattcattatcacatgatcttagtagctactattattttctcaattttgctgatgaagagcagaggttcatagagcttaaacaactaggatttccctacctaggatatggtagaggtaaagagtattccagcgggcagcagtagctcatgcctgtaatcccagcactttgggaggccgaggcgggcggatcacctgaggccaggagttcgagagcagcctgaccaacatggagacaccccatctctactgaaaatacaaaattagccggaagtggtggtata

SEQ ID NO: 185075 - DNA, 533 bp, Homo sapiens
caaacaccagctgatgttagcaggaacccagggtgactgctgaattcttcagccagggtcacattggtgctttggtcatcaaggccaatatttcattgcattcacaccaaagacaaacagggtctgtcctgcatccctcttgagtgtggggtgtttctgtcctggcagctcagtggcttctcaccgtgtcgtcaggatccattgaccaagggtaatagcattgggggcctttactctctaaggctaatagcactggggatcttcagtctctgaggccaacagcattggggtctgctctctgaggcttaatgcactgtggtctttcttctcccagacagaggccactgctctgtggggagccctggatggcggggaggttggatcccttttctgcatgtggccttctgggcctggggaggtcgttctctttgtcctccatattgactgggaacaggtggttcgggctgaggagtggcccaggaatcttgctgagaaggtggatgcgggcagctcggcaactgcaaatctgaagt

SEQ ID NO: 185076 - DNA, 304 bp, Homo sapiens
gaaggaggaaaggtattctaggagagtggcaggttggatcaggacggagagatatgagagtgtagggtattcacttatgattcaaaaatgttttgcatcatcttccatatgtgaacctccaattttggtttgaacagtgagcaagacagaaatgatctgttcctttactgagcttgtgttcaagagggaggaaggaagggaggaaggaagggaaggaggaaggaagggaaggaggaaggaagggaaggaggaaggaagggaaggaggaaggaaggaaaggaggaaggaaggaaaggaggaagga

SEQ ID NO: 185077 - DNA, 176 bp, Homo sapiens
gtgtcaggtgatatctcacagtggtttaaatttacataattagagatgatgagcattttttatatactttttaatatacttcttggccatctgtatatcttcttttgagaaatatctattcaggtccttggcctatttttttttcatttctttaagccacacatatttattgagag

SEQ ID NO: 185078 - DNA, 267 bp, Homo sapiens
ttgagccttgattttctcatctgtgaaatggtgccagacctacctaagagggtggctatagagttgatcttctctatggcagtccctagtacacagcgtggctcaagctaattgttccgcaaagatcacgtcctcccttcctttctgtactccgcttcccttgtctggaacatggaagggttcaggagctgatctctgctggccttcctctcaggccagctttccatttctgctttctgggcgggtattcctggcaaagctatcagg

SEQ ID NO: 185079 - DNA, 242 bp, Homo sapiens
tgaattcaaatttaatctttattctgtggccagtagaaatccaatgaaatgtttctagcaggaggggacaccaataaaagctgctctctggagatgaatttgacagtgtctgcaggatggggtgaaggaaaaagaactcagagcatgagtccaggagtcactggggtcaaatgatccctcgtgttcaaggcacatctctgcccaggtagaacagagcctttcccagcataacgcatcttttt

SEQ ID NO: 185080 - DNA, 155 bp, Homo sapiens
tcctcctgcatgttcatttgaaaatgttctcttttggtgtggaggcaaatgagctgattatattgagctccgtccaccaatttatttatttatctaataaacattttaatgaaggggtatcaggcacgtttatgttttacccaagagacttattt

SEQ ID NO: 185081 - DNA, 327 bp, Homo sapiens
ccaccaaaacctcctctcccactctaggtgctgactgtcccattatgagaagtcagtttggctttctctttccacatgtgaggaaacagcctccgaggccaggtgggggcaggtcagacagcccaccgagcatgccccgctccatggtcctgcaccacgctggcagctgccacacctggccgctgacctgagaacacgctgtggctttccactagactgtaagctcctgaagtctgttttacatttatcctcaaagaagggggccgggctgggcccaggccagtgatcaaagcattacccatgatcactgcccaattcttgtctgtc

SEQ ID NO: 185082 - DNA, 263 bp, Homo sapiens
ttccaggattcactataccaccatgaaaatgtagactattattagttggaagtctcccacgacaagttatcttgagaggacttctacagtaaaacaagcttatgtggttttacagattaagttagatatcatgaaataacaaaaacctaaggagtgttcttcagaggtagaatttattttgtggtagctcgcattgtgcttaaatatgcttgaattaatggaaggcaggtttaaaaataagatggggagggagtagtttaaat

SEQ ID NO: 185083 - DNA, 217 bp, Homo sapiens
caccagatctctgagatatggaaggggtgagaaagtgcccaaccatgtgagtgccagcacggctgtgctgtgggttcccggagtcacatggaatatgctgctgccgctcccaactaccatctaggctccctggaggaggcgtcacacatcgctgcccactgccacgtaacttgtggtgtaacagcaacttccccctgggtgctttccctcctcagtg

SEQ ID NO: 185084 - DNA, 307 bp, Homo sapiens
atatatactgacatagagacggatccatatgttgcccaagtggtcttgaatccttgggctcagcgatcctgcccactcagcctcccaaagtgctgggattacaggtgtgagactccacgcccagtcttttcttttttcttttttagcgacagagcaagactctcgtctcaaaacaaaacaaaacacctggtgttttgaaaaatctttacattttttcttagaattcctaggatagaaagagtcttctttgccttcagaactgcactataagatcctggaagaataccaccctgccttttaaaagaca

SEQ ID NO: 185085 - DNA, 327 bp, Homo sapiens
ggcagcccagggctccctgcctggctttggaggtgtaaggtgtttgaaataacattctccaacatgctcaaagtgaaaccagcttcctttgggaacatatggagaccacaggcacttcacaggggctgatgaggacccaccaactctgctgtgggctctgtccctgccctcggagctcatagcctggtgaccttggcattcattattttcattccagttctcagcacagcgcttggcacatagtaggaactcaggaagtgtttatgggatggaatggggtgatgatgttgaggcaagatgaagggtatgaacggagatgacatctgc

SEQ ID NO: 185086 - DNA, 531 bp, Homo sapiens
caggaactaccacttatgcggcaattttgtcccttgcttgagcctcattttccatgtctataaaaatgggaattaataccattttcttttccctgccccacaaaattcttatggggatcaaaagtgataatgcatatgaaaatggtttgcataattctacactgtctgcaaatatgagccatcagcactattaaaagtgaggcaatagaggattggcagtgcactgacagtctgggaaagtggcgcacctgccttcaggcaggaactctgttattcattcatcaataaagaacaaaggcttgacaaaataatcatgagataagaaataagatcgtttcagccacccactggctggagctgaaggagaactgtgataaattgtgccttttgttatgcaggtgccatcccacctgtgtctgtgtgccttaaatgaaggaaagtaataaaagtaataacaagagcaggtactgttgattggatgcttatctatgccatgtaccagcaccttaatttaccatctcttcctttaaa

SEQ ID NO: 185087 - DNA, 179 bp, Homo sapiens
ttcttcagctctgtaagctggaccctgtggctggagtctggccaactgcagggacaagtttctattattatgtaaatggagtcccagtgcggccttggaagagtttttggcacagggtaaccctttgtctgccaaaaggtagcctctccctttgcttcaagcccagagcgtgcattgtg

SEQ ID NO: 185088 - DNA, 255 bp, Homo sapiens
acgcgcatctggggactgggatgctgttgcatgttatggttagctcctcattacatgctggtggagcagtgcatgctggggatatgttgcccgaaagggccttacttaggcatgatgcatctcggtgttaggaagcctctgcagaggggtagtttggtagaggtgacgtgtgtatgcatggcagtgagagagtaaatctctgcaggatgcaaagtgtacatctgaatttggaggtttggagggcatgtgtgtgta

SEQ ID NO: 185089 - DNA, 486 bp, Homo sapiens
ggctcacacgctgcctccttatccaagtcatggccatctctcctttgaactgatatcagggctcctatctggtctcccagcttccacccttgtcactttgcagtctgtccccatacagcaaccagagcagtcctcctcaagtcagatcatgtcactcactcgtagctcacatcgtttcatgtctgcctgtggcactcagaagtcagaatcacaggatgtggctaggccttaggaccctatatgatctcaacctacagtttcccttttgtcctcagctcccaccaccccctcctctcacactccagctgtactagcttcactgagcccacacatgggcttttcactcgctttgtcttctgtctagaacactcttcctctaaaaatatatatattgctattttctaatacacaaaaaaaaaaaaagaaatctattgcggaaaatacacgggcctagttttatttttcttcatattcaactctagtttt

SEQ ID NO: 185090 - DNA, 259 bp, Homo sapiens
aaagacgccaaaaatccagcgctgccctcagagaagggcaaccacgcagtccctatcttggcaaggaaacacaatttccgagggagtggttttggcctccattctaagtgctggacatggggtggccataatctggagctgatggctcttaaagacctgcatcctcttccctaggtgtccctcgggcacatttagcacaaagataagcacaaaaggtgcatccagcactttgttactattggtggcaggtttatggatg

SEQ ID NO: 185091 - DNA, 533 bp, Homo sapiens
ttctggtctaccatggtgagaattgactcgttcctctccatgcactaggtattccgctttcacagttctgccgccttctctactgcttcctgttcttccagatacttggtgctatctctcacccactgtggcttctcctctgtttactttgttcctgtgaatttatacaattttatttttctagtcttatcttactctttctgaaaggaacagagataaactcaacaatgcaccatttttaagcagaaatccacaaatggctttaaacaaactgaaaacaacctacctggcttcatggtggtcttcttttccatggatgaatttagcggatctgagaatgtcatttatttgaaaattcagcttgtcgtattttcagtttgcatcaaaccctgcttctcctaggaatcagctgatgttagaaggaaggagaactccattctccctttatgtctgctgtaataagcacttgcataacagaataaaggcctcttagaggaaatggcttcctacctgaccaaactcaaaagatttgc

SEQ ID NO: 185092 - DNA, 725 bp, Homo sapiens
catactcccaccatagtgtacttcatttttgttccacatccttgccttcactacatcctgtcactataagtctggttctttccaaagtatattcttaatcatggaagcaaagaacaacatttattcagtaaatttttcagtaaatattcagtaatattcagtaaatattctcaatgcaactccaaacacttcccactccaggacatagttctttcttcaggcttgctaacattttgcaagtattttgcagatactctacctagatcaccaactacagaactgaccagatctgactcatagaatctttttgccttctacttgggtagctattacaattgctccctcctttgctaacccagttacccatgactggttgaatagcatggactccgatgcttgctatttgaatttgatcgcccagctgctatgttggctagaagaaattattttattctctctcatctttttttccccatggactcaatagattagatgcctttttcttcaataactttccatattcaaagggtcctcctgtaagtttcaatggtagccattagaagcattagttgattagaagagcagaatgagaacattaggaatttttattttctaattttacttcgttgtaattaaggtagaaggtttgggtagttagattaatatctttcatatacacaacaaatgtttctagtgtatatacttataccagctactgtgctagg

SEQ ID NO: 185093 - DNA, 923 bp, Homo sapiens
gtcaggggtaaagtgggggtgtaagtggaggtggggaggtgccacagggaagtaagggattctggggatttctttaagagagatagaactttagagagtccttggttagcatttctaagttgtttgttggcttattgtaaggacatgaggtgatcttccccccatttgctactctctaggtaccattgaaagtagctctcccattctggttgtttagttttgtgcctgcgttttgcatcctagttcacaggtacactaatttgggcatctcagaagatccccatctaggcctctgtaggttagaatctgccttgattatagtggtccacttgattaaatatttgcatgacaattcaccataagtgtttttgcatatacctggccagagtttctaagggtggaactttgtgttccacagctgtgggggtttcagccaacttaaagggctccttccacataatttagagttttccttcagatttgaccaagtcggagggtttgttggatccaaagtgtgctgcttggggacctagcttttcagggccgttactcgctgaactggtatcgtggctacctggcacagtgtgtcaggggctcaaggcatgggagatcagctccttatttgcacctgctagctgagattacaccctaagtacgttcttctgaggggaaatcctactcagagccgttgcacatcttagggagtgtttcttccagacaccctcatgtaattctcagttgcctaagaaaggctgagaagggcgagctcttatttctttggagaggaaaattccatactataagctagaggttttagagttggccatatccaataagagaaggactgaagcatacttttatacacctgatctagacagaaacaaatatataagacatctcagctcttcgtctagctagtcacg

SEQ ID NO: 185094 - DNA, 569 bp, Homo sapiens
atatacccctggcataagaagaagacacattatattgaagttacctgtgtgagtgtctacatcaccagactgaaaatctggtcaaggagggggaatttcttattcaactttgtatctcaaacaataacaaattaaatgaacaaagttctactaaacatatactacatataatgtacagcctaagtaatcatgctaggaaccaaatctaatctaggttctcatctaaaaggctaaaatagtgatactgtcaaaacaacaaataaaagtaatatgaataatgactatatggcctaacagaaaaaaaaagtgtggtctatattttataaaagttatattctcttgtttcccaaccacgttttcagaaggggtctttaaagacaaaaaacaacgtatagtcatttttggaataagcaacttcattaaatacacctctgaatgcagtaagcccttggtacccaaaatgtattgctgtaaattttctattgatcgacagatttcagtattataggaaattcaatgttggcatttaaaacacgtatgctgtcagcaaacatctataggcaaaatga

SEQ ID NO: 185095 - DNA, 288 bp, Homo sapiens
ctccgaggagtcccggagaggcgttaggcttctctatggcttctgtagcgccatcatcctatgtcttactccattttgtgctgccatggcagaatacttgagactaggtaatttataaagaacagaagtttattttctgtggctgggcaaggtagccatgcctgtaatctcagcactttgaagggccaaggtgggtggatcccttgagggcaggagtttgagaccagtcttgccaacatgtactaaacccatctgtactaaaccccatctgtactaatcccatctgta

SEQ ID NO: 185096 - DNA, 1120 bp, Homo sapiens
  misc_feature (88)..(88): n is a, c, g, or t
  misc_feature (99)..(99): n is a, c, g, or t
tagaggattacgcatgccattgtcttccgaggtagctttaattacaggcatgtgccaccacacccagctaatttttgtatttttagtngagatggggtnttgccatgttagtcaggctggtctcaaactcctgaccgtgggtgatctgcccacctcggcctcccaaagtgctagaattacagatgtgagccactgtgcctggcctctttttactctttttttggagacagggtctggttctgtcgggcaggatggagtgcagtggcatgatattggcttactgcaacctctgcctcctgggcttaaagccaacctcccacctcagcctcccaagtagctgggagtgtaggctcatgccatcacgcctagctaacttttctactttttaaaatgtgacgttttactgtgtcacatttatgatttacattatatttccattgaacagcactgccgtagagctgtagagagaaagactgatttagaaataaaggatgaggtgtagttggtgctttgggcttgtgtaagatcatcctaggacagattgtagagtgactgtagcagacgtcttgggagagaaactgagccagtgctgacgttaaggagcaaatggagatagaggagtaaactaagcccaccaagaaagaacagccagcgtggtcagaagtgggcaagtgagagggtgtgattgatgtcagaggaggaggggttggcagtgtagtttgcgtaaacaggtgagaagatcgaaatctcaagaacattgtagttataaagtggcatgctaagttttaaaactttagaggtggaatagttgagaggaagaaggaagtctgtggaaagtaataagaatgcgattctgcaagtattaagaaaatctgcccctggggtaggggtgtgaggatggaagagaaagtctttggagttgagaaggtaaggatgaacagctcgtcatctgtgcagttatcagtgttatcacaatggcgatagaacttggggtggaaagcaaggctctgagtcaggtaggaagtggagcaaaaccaaaaagaatagtcataatcacttttcctggtttcccggttccctggttcccacctctaaagctggaagtgagagaatgagaagc

SEQ ID NO: 185097 - DNA, 264 bp, Homo sapiens
ttccttgacactcttaaaagttattaccctaaagagcttttgcttatatgggttacatctatcactatttataatactagaaaatacaatcgagaatattctgaaatattttaaattcatttaaaagcaatagattattgcatattagctttttgaggaaaaaataaatagtgaaaagagtggcattgttctacatttttgaagatctttttaatgtctggcatagcagaagacagctggattttcacatctgcttcacatatt

SEQ ID NO: 185098 - DNA, 198 bp, Homo sapiens
gccagtggtgctgggacgctgatacccacacgcagaagaatgaagttggcccctcacattacattgtgtacaaagttaacccaaaatgagtcaaagacctaaaactataaaacttttagaagaaaacatgggccagaaccttcacaacattggatttggcgatgatttctcagacgcagcaccaaaggcacaggcagc

SEQ ID NO: 185099 - DNA, 400 bp, Homo sapiens
tgttacagagcaggtttttaaaacttttttggtatttcatttaagtgattaaaaataagtaacttgtggaagtttactaatctgtgttatctaattttagttttcattatccacaaatatataatacatagttattcatttattcagtcaatatacagttatatgcttacttttgtgcagatacaactataaatccatttttattgtaattgacaagtaattcaaaaatattttaaagttattccagctttcttttttcactattatttgaattattgcttttattatgttcaacactataaaattccaacttgagaagtctgtttctctgtgatctcaagattattgcattgggactgaaattgctagtgatggttggccattaaaataagtgatgatg

SEQ ID NO: 185100 - DNA, 184 bp, Homo sapiens
ccagatctgctgggggatgactgaggtcaacacagaaggccctcaggccgggcacggtggctcacgcctgcaatcccaacactttaggaggctgaggtggatggatcgcttgagcccaggagtttgagaccagcctgggcaacatggtgaaaccctgtttttatagagataaaaaaatacaaaa

SEQ ID NO: 185101 - DNA, 437 bp, Homo sapiens
accttcaactcagggaaatttttttgccttagtttttaaataattatcactcctaatttttttctgttgcatcattcttaaactctcattaatagtgttgaagttcctagattaacatcatgttttcatgttttccctcatattttatatttctttgtatatttactatgttctgggtgatatccttctaaactttctaatacactgttttattttagtaagatattcttaatttctaagaatatttcttattctatcattgctcctttttcatagcagcatgttcttgttttatggaggcagaattctctcaacactaagaagcgtactaacttgaattttcaaacttttttctgtatctgataggatctcttttcttcagaataaatgttctgccttttacaaatcttaatatttcctgttaatccatgttcttg

SEQ ID NO: 185102 - DNA, 297 bp, Homo sapiens
aacgttgtcataaagcatagtgtgagagtcagaggtgcatctttttagagtgacattcttttcaaaaacagaaaggaaaatattcaatataaaatatttgtcttacatttatttatgaacctgtttaaaggtgtaaattcatctttttagtaacttatggttcttgagaacttgggaaagggaaggaagatttgattttaaactttaagggagaaaatggataggagggatcagtagtttcaactgtagttagtctcatcagaaggggagaaagtacctagtttatgacacctatct

SEQ ID NO: 185103 - DNA, 398 bp, Homo sapiens
gttttagatatgaagtccttgcccatgcctatgtcctgaatggtaatgcctaggttttcttctagggtttttatggttttaggtctaacgtttaagtctttaattcattgaaagaaatacaaaatacattgaaatcgttaataatagaataatcagaaaaacaaatctcagaaattgaagacaggtcttttgaaattatccagtcagacaaaaaaaaaaaaaaagaataagaatgaacaacatcttcaagatgtctgggactacacagagtgatggaacttatgaattatcagtattcctgagatcaccatctattagtccatttttggactgctataaagaaatacctgagactggataatttataaagagaagaggtttaatcggctcacagttct

SEQ ID NO: 185104 - DNA, 355 bp, Homo sapiens
gttaatatctaaccatgaatctcattccctttattatgtattaaactcaagagtaaacttggctctcactcttctacctttgtagtaggaagaactttcaacatcctgttgtttcccaccaccccccattttgttttatggtggtgataacatcctaaagactggttctgaggtataactggtaaactccttgagacagttgttctgttacccgggctagagagcagtggagcggtcatggctcacagcagcctcgacctcctgggctcaaacaactcttctacttcagcctccccagtagctgggactacaggcatgcaccaccatgcccaactaatttttttttctttgagat

SEQ ID NO: 185105 - DNA, 269 bp, Homo sapiens
ctggagcttgttggctcaagcagttcgcagcctcagcctcccgaagtgctggaattacaggtgtgagcctggctcattcgagaatatgttaacaactcccaaagaaaccctgtaatcattagcagtcactcccaagtgcccccttacccagcccctggcaacaactaatttactttctatttgaaaggatttgtccatttgggacagttcatatgaatgtagtcatacaatatctggtcttttctgtttggcatttttcacttagcatg

SEQ ID NO: 185106 - DNA, 547 bp, Homo sapiens
gacagagatcatatggcccacaagtctaaaatatttactacctggctctttaaagaaaacgtttgctgaccgacctctaggttagatacttagtccctttcctttctaaaggcccctaggccccttattcaaactagctcatcactctctcctgaaagttctgcaaacctagggaagatagagattttgataggcatgaacatcacagaagtaggagtgttacactctttgcccaagacagacataccaatccacctcacatttgcagaacaaagagagtcagtagtagggactatagaagtgtttcaagggtgcttacagtctgcttacctaaagaagcagacagcagcttccttgaaaaaaaaaatgttttaagtgttcccttgtattagatccctgccacttctcatatccaaacatgaaatatgaattacatgtagactaacgatactagaaagtgccctgagcccacccatagagaaaagctgggctagccagcaggaagaccctcaaagatcctttagtttaatataatcctaagttaaaa

SEQ ID NO: 185107 - DNA, 918 bp, Homo sapiens
gagactggaacctcttcgtctttgtgtccccatgtctagcatggttcctgcagtcaacgttgattgtcttgatgtgacaagtctcggtacgggaatcaaacacatatctctaatgagcggtggacatccggtcttggccagtgtcagagtccttgaaactggttttgctgcgggatgctttgcctgatgggagcctgagggctgcacttgagcaagaagggagcattttgctcacttctcagagacccctgccctttctgggcattccagcagagttcacaagagtggcttggtggtgtgagtcattcgtttcatgcctgagggcagtgcagctctcatccctggaggtgattaatgagtgggagtttccctagagagttctgaggccagttgagtagcagatcctggctggcctgaaattgattgcctgctgaccacttgctgggttgcttataacctggccccaggacagcttcctggtagcctccagatacgcacggggacaaatttgttagtttcatgggcaaagagaagaaaaaatacaataccttactgttaaccacagtcacccttctgtgcaatagaacaccagatctcactcctcctgtctaattggaactttgtacctgttgaccaccctctccccatcttccccatccgcatccctgcatcccctccctgcccagtctcctgtaaccactgttctcctctctacttctatgagatcaactttgtttagattccacaagtgagatcatgctggaagacagagttttgaatgttctcaccacaaagaaatgataaatacatgaggcgatggatatgctaagtaccctgatgtgatcattacatgacgtacacatatattaaaacatcaaattgtaccccataaccatgtacaattataatgcatccatt

SEQ ID NO: 185108 - DNA, 499 bp, Homo sapiens
cacattcatactcttggttcttccttcacactgttattattaaccattcatacgtttctatgtacatatgaattaaagtcatccctctgtatacacaggggattggttctaggaccaccctcagctatgaaaatccacacatgctcaagtcctgcagagccctgcagaacccatgtatgtatatgaaaagttgactttccatatacacaggtttctcatgccaggtttctctctttatatttaattataagcaaaaaatgtacttaaatataaaaatatgattataaaaaaatagaagatatattttctatttgcctttggttgaaaaaaactggtgtataggtggacctatgcagtccaaacccattttctttaagggtcagctatatatatttgtgatttctaaatatatgtatacattttacatttgtggatacatattgtatatattacatcacattgtccttacatttttacttctgatggtcttatagtagcc

SEQ ID NO: 185109 - DNA, 427 bp, Homo sapiens
ggaaaaaagccagggttttgtaagcattgagacccccaccatttttcccgaacaccttcaaaattgatgcatgctttctagatgcaaaaaaagaaagaagaaaatccaaacagatataatcagacgcactgcagtgcaaaaaaaaaaaaaaaaaatcatacctgtcaaaggaaccgtatgtaatccgtgcacacacacacatttcacatttacgttcagaatgcaatacatatcattaggatctgtctataaatagactcgagcgtgtgtgcatcgggacttagtcccaaactgggttttcaaacgtgggtgatgagttctttgctctgatcagttactcagaaggtgcctgaatgtgtgggggtgggagcgtgggagggggctgcctcctctttctcctccttccctttggctctccccctccttt

SEQ ID NO: 185110 - DNA, 830 bp, Homo sapiens
gcccactcctgatttgagatggcattaatcaatgagaaacctctaaatagagggcaaccaatattgtgaaacatgctgtctgagtagaaatagcctcagaaatcatggcgaagcaacacttttcttttttcactctctagccatggtcctcttctaactgggcaccgactctttcctcctctcccagctttatccttcccctacccgccctggcgcagagttgtcatcttatgactctggaacccccttgcaatgtgctgtttctgtacctcacctcttggaggtagatgttgcagtggcagcctcaaacagggatgcttttttaggcaccatcggaagccacagcacagtgctaggcaagaatcagaggaataaaacacaatctcctggagctgatggtccagttgtcccaactggaaaacgaagttagaccacagtggtatgcaaagtgtcttctgactgtagaattctcagacaaatgaatgcacaccagtgccaaatataacacattaattttaattgtagccctctagagaggatgacctagccactgagtgaagatttcaggcaggtgggcctttctgtttccaccgaaattatattatattggcagccacctagtcttaaaattgcctttaggaaggcgtaggagactgaattggaaaatgcagccaggcaatttatgggaaaattgaacggagcgtccctctgagtaaggagacagggcgtggtaatgtcagtcctccttctaaagaccagagaaaatttctgttccacctgataaactctgtatccttttggactttgtaaatattgcacttggaattgac

SEQ ID NO: 185111 - DNA, 594 bp, Homo sapiens
aggccaaggcgggcagatcacttgaggttaggagttcgagaccagcctggccaacgtggtgaaaccccgtctctactaaaaatacaaaaatttagctgggcgtggtggtgggcgcctgtagtcccagctactcaggaggctgaggcaggagaatcacttgagccggggaggcagaggttgcagtgagctaagatcgcgccactgcactctagcctgggtgacagagcgacagagcaagacttcatctaagaaagaaagaaagagagaaagagagaaagaaggaaggaaaggaaggaaaagaaaacgagggttctagatgttacgtaatttgcccaaaggcccacagagtcagaccttgaacccagatcagcatgccctatccagagcatacagccaggtaggggggcagctcagatgaaatagatcatctcaggggtgtgcaggagaagctcgagaagggctgtttctggaagggcatcaaggcaagggagccccagaggagcgatggtgagagcctcctcgctttctgcaaagacaggtcaggggttgagacagggtccaaaagaagtgaggaggtcaggggcctgtgaggac

SEQ ID NO: 185112 - DNA, 563 bp, Homo sapiens
tcgggctgctcttgaggatccccctcggctctaccttgtttttactaaaaatacaaaaatttagctgggcgtggtggtgggcgcctgtagtcccagctactcaggaggctgaggcaggagaatcacttgagccggggaggcagaggttgcagtgagctaagatcgcgccactgcactctagcctgggtgacagagcgacagagcaagacttcatctaagaaagaaagaaagagagaaagagagaaagaaggaaggaaaggaaggaaaagaaaacgagggttctagatgttacgtaatttgcccaaaggcccacagagtcagaccttgaacccagatcagcatgccctatccagagcatacagccaggtaggggggcagctcagatgaaatagatcatctcaggggtgtgcaggagaagctcgagaagggctgtttctggaagggcatcaaggcaagggagccccagaggagcgatggtgagagcctcctcgctttctgcaaagacaggtcaggggttgagacagggtccaaaagaagtgaggaggtcaggggcctgtgaggac

SEQ ID NO: 185113 - DNA, 963 bp, Homo sapiens
ctgctatgatctgaatatttgtgttccctcaaaaaccttttgttgagacctgattccaatgaaatagtattaagaggtgtgtccctttggcaatattagtcatggggtagagctctcatgaatggcattaatgcccttataaaagaggcccaaagaaatttacttgccccttctaccatgtgaaaatgcagcaagaaggtgccatctgtaaggaacataactatgagaaagaaatttatgtcatttataagctaccttgtttatggcatttttgttaaagcagcctgaaaggactaagacactttacatgttaattttgttatataaaagataaaaaagaccagtaattctgagacctgtagatactggcttgaattctggagtgtgagaagaagatgatgtggctttattatcaaagaataggcagtattttaaatggatgctcatttggtttttgtataagaaaacattacttttgttacaattattagtacatgagattattaaaaatccaaaatagattttaatccacctgacaataaacctaatagtggaagacttctctggtcttatggtgaatttctaaatgtattccaggtctgttgctaagataactgactctaatttagaatatacctgttaagtacctcctctaagttctgaccacaagaacagatcaaagaataagacagtctttgtcccttgaaggatatcttagtggttgtatttatcaattgtattaataaagcaatctttattattattattgctattctattttgaattgtataggaagatgctaacattttaattaacaatatatcatcttatgtggcagatgttttaaaattatataaaagtaattctcattttagctgtaattttagaaatttgttcaaaggaataattgtatttgatacatttttaataaaaatcactatacttggaaaaattttaaaaaaa

SEQ ID NO: 185114 - DNA, 224 bp, Homo sapiens
aaatggaatactccaggttatcgtcaatttatggtagatgatattaaataccatacatttaatgaagatttattaggtattaaatttgaaaatttttttcatttatactgatcaaacctagagaggctagtgatttgctgagactgaaattcaggtctcccatctcataatggcttttttgtttttatttattttattttattttattttttttgagagggagt

SEQ ID NO: 185115 - DNA, 175 bp, Homo sapiens
gattaaagtccaagtaaatatattaaaaaacgaaatgctaaaaaaggcacctttaaaacatttttgttagtttttcttatacattgttttcttaaaaaaacagatgtctatgtgcaaaatttcattaatgagaggtgtattttttttttaaactactacagggtcttcactaata

SEQ ID NO: 185116 - DNA, 600 bp, Homo sapiens
actcaccccttccatctatgacagacagtcatctggagtgaagtctaagagtcacaaagatgttatctcaaccgtggctcagcattcaaacaaggattctaatctttcagggctccagatgggaaacagattgctgagaattatcagttttatttgaagagtgcagagaggcgatttgtacaaatgggtatgactgggttttccttgggcggagaagagccggctggcctgctgagaagctggcttcctactccggtggacgccatgctggaaagggtcagcttcctgtagtaagagaagctaagaggtcaggggccagagggaccttcaggggtcccctgcggctgtggcctctgcagaggggggctcagggaggcctggagtgagggctagagaaagcccatggcccggggtcttccagcccagcccagggagcactccaggtaaggcaaggcctcaccaccctccaagtcctcagcactaggagcccaccaagagccaactctgccctggaggccccggacactggagcgaggtgcccccagccctacagcttcagatcccagatctcagtcccctacaaagcatgcagtccctcac

SEQ ID NO: 185117 - DNA, 613 bp, Homo sapiens
catgtgttgaaatgacagtatggtttttgctattcactgtgttaatatgataaatcacatttattgatttgcatatattgaaccattcttgtatcgcaagaataaaccccaactgatcatggtaaatgatcctttcaatgtcgtattgaatatggtgtagtagcattttgatgaagatatctgcactatttacaacagcaaagactactgtgaatagtgctgcaatgaatgtacaggtgcatgtgtttttggtagaacaatttattttcctttgagcatgcacccagtcatggcactgctgggttgaatgggagttcaactcttagttctttgtgaaatctccaaacttctccgtagtagctgaactaattttcttgtagtactttcgtatggctttgctatcagggtaatgctggccttataaaatgagtttgaggtattctctccagttcaattttttgaaagagtttgaataggactggtattcatttttatttaaatgtttggtagtgttgcatcatgaaactatctggtcctgggctaatcttttatgaaagaatttctattgctggccaggcatggtggctcaatgcctgtaatgtcctgaagaatg

SEQ ID NO: 185118 - DNA, 458 bp, Homo sapiens
atccctcccttcgctgcttgtatgttgctctacttaaatacctcccaatgcttggtcttaccagcaacctcagaaaggcagtctttttacatttaaactattttcagtaatagaaaaagccaaagggaaacaggctaaaagaattaatttagcatcaaatgctaccttttatcattttctggaactaatggctgtttagtaggggcacaatggatttctcctgcagactaaaatctgaataaatgataatggggaatgaagtaaaatccagcttgagaaacaagattcttcaactaaatacttttgtcagatgggtgaaggaaaaatgggggccttggtggcagacataagattttgaatcagggtttacataatgaaagcactgactggacaaaactcatttatctgtcttttcatccacacgaggcaggaattgagattattacttccctttccta

SEQ ID NO: 185119 - DNA, 357 bp, Homo sapiens
gatccctttcacatctactcccatctatggaggctcactttgtcagtaatagcattcctgctattcctggtctaaatagatgccactcaccagaactcaactggcctttgtaatatgaaatggatgcaatgaaatagcaattatattcctgtcaggccctgcaccagctccatcaccttatgtatggagaggactttaccagaagagtgatcctgagaaccaggagctacctttagaatgccccacaatgcatcacaaatattgactgggagagcacaagggtgtctcaaacccaccttatggagcagaaaactgccttaaaagcaaaagcacctatctgtaggtgggacaagcacg

SEQ ID NO: 185120 - DNA, 231 bp, Homo sapiens
gtgggttgacgtggcttgtgggttgaccgtggcttgtgggttgaccgtggcttgtgggttgaccgtggcttgggggtggaacactctaactagtgcctttacaggagggctcactcctctccttccatattgtgaggacacaactggattgggccctcatgaggaacagaattggttggcaccttgatctggacttcccagcctccggactgaggaataaatttgttgttt

SEQ ID NO: 185121 - DNA, 299 bp, Homo sapiens
atatagtagcttggttccctccgaagtttccctcaggatagctggcgctgttgcagaccagagcaagccaggccgggcttgctcaggtctcctgtgctcagttatcaaggcaccttggcgatagtggggtgctagttacattgggtgggagcagaggggctgtcatttcttgggagaactgacacttaaggccttaaaaaagcagatagatttaggtgtgtggaaatagaaaaaaaatgtcattgcaagaaagagaaataaccagagaacttagcttcacagagaccatagcaacagcg

SEQ ID NO: 185122 - DNA, 296 bp, Homo sapiens
tggaactgtgagtccattaaacctctttttctttataaattacccagtctccagtatgtctttatcagcagcgtgaaaatggactaatacagtgggggtgccctgtcgtgtagaggagggagacctatttttgtcagaagggtgggagcagaggggctgtcatttcttgggagaactgacacttaaggccttaaaaaagcagatagatttaggtgtgtggaaatagaaaaaaaatgtcattgcaagaaagagaaataaccagagaacttagcttcacagagaccatagcaacagcg

SEQ ID NO: 185123 - DNA, 460 bp, Homo sapiens
gacaggttttctatattccccctcaggcataggatctgtttctcttaagtaattaatttttatcacttaccaataatttaacatctatatgtctaagttctctttatattgtttttcttatccttacctacaaaatctcatttaccattgatttaaatttcagtatattgaaacaatggattgtaacattaaaaataaatgaaattgccaaatgatactaacagctgccttcaaagcatttaaacatacaaacaggcactattgaagactggagagttatcaaaattggcaattttttggcagtcttgctgtgaagtaaacatttttaaaaggaaggacattgagaatattgtaatcatattacttacatcttgttgggtttggatttgaccttacatagcctggtattcagttaagagtcaaagttgctgctattaatttagttgagaaggataaatag

SEQ ID NO: 185124 - DNA, 688 bp, Homo sapiens
atgggtgggggtggaagttccaacacactaatcttctcatcacttggtctttctggtgactagcaccatcctgaggctatctaggggcccaaacctatgagtataacctcattagcatatactcaagggttaccaaagaggcttattattaataataaaagacactcctatcactgaaaattcaaaggattttaggaacttctgacaggaactggggacaaagaccaaatgtgtttcatattataccacacttacctaggccattcattaactcttcacctggctgcaaactaaaattacatgtagagtttgtaagaacaaaacaaacacacacacagacacacacacacacacacacacacacacacacacacacaaaacaacaaggcaggcacggtggctcacgcctgtaagcccaacactttggaaagtcaaggtgagcagattacgaggagttcaagaccagcctggctaacatggtgaaaccctgtctctactaagaatacaaaaattagccaggcatggtggcacgtgcctataatcccagctactcaggaggctgaggcaagagaatcgcttgaacctcggaggcagaggttgcagtgagccgagatcatgccattgcactccagcctgagtgacagagtgagactccatctcaaaaacagcaacaacaacaacaacaaca

SEQ ID NO: 185125 - DNA, 312 bp, Homo sapiens
ccttcaaagtccatggagaagtaaaacagattattgaattcctgctctttgaaaaaactgtcttagcctattttgtgctgctataacagaaatctgagactgcacaattcataaagaacagaaatttattattcacagttatggaggctgagaagtccaacagcaaagcatctggtgtctggtaagggccctcttgctgagttttcaaagggcagaaggcagaagggcaagctagctgaacctgtgtgaagtctcttttataagggccttaatcccactcccaagagagaagccctcatggtccattcacct

SEQ ID NO: 185126 - DNA, 651 bp, Homo sapiens
gcctccagtccaacaaggaccctcgctatgaaaatatgcttgggtcattactggaagccaatttaggagaatttcctcctagtagtaagattctcatgatgcttccataatcttcagaaagaatcatgattttctccagtattcaactcaaatgtatcttggttataacctcagtagcaagcaatactctcctgaaatgtctggtcctagcaagacttttaatcacccaactttatttacagtgagtgaatcttcacatcctaaaatgcatattttttcttatttattatgtttcctgaaactctagcatccaaagtattcctagcatggacatagtcatatgaaatccccttttcaggccctctatagtaggccctatcctacagaaaagcattaagtccttttctccccactcatgtctcctaggctacaatggaaagtcccaaagatgcttgttgaacaatgcacctatcaaaagagatgcccccaaatttttacaaaatcattttagtcaatttggtataaaagaaaacttggagccgggcgcagtggctcacacctacaatcccagcactttatctcctctatgagatttcaccttttaaaaaaaatcccttaccatattatcacatacaacaggcaattcaaaat

SEQ ID NO: 185127 - DNA, 461 bp, Homo sapiens
ctgagtgacaaagcgagaccctgtccctaaacaaacaaacaacaacacaaccaactattgctttattcagatggtagatggtggtagcttgaattaagatttgttaataatgagaggtggtaagattggatatatattttgggggtagagctggaaggacttaatgataatttggatgtgtggcataagggaaagaagactatcaaagatggctcgtaaggcttagacctgatctaccagatatttgatggtgtcactatgcttgaggtcctataaaagaactaaaacaaaatagtttagcataaattgaggttcttagaattttgaggaataaaaaaattgattcaaaagttttataaatctttaaaataccataatttcatagttgattatataaaagtagtatatattcattgtagaacattaagaaaaatttagctgtaatgacagttccaaccaaa

SEQ ID NO: 185128 - DNA, 200 bp, Homo sapiens
ccatgccatgcaaatgtgttgcttgataacagaaagacggatgctctcggggcagagagttcccaaggtgaaggccaatgcctcagatccaattccatggattcatccaatacaacgcaaccagagatggtttccctcattcagaagttactggcatattgccatgataacagcattttgcccaatttattaggcagaga

SEQ ID NO: 185129 - DNA, 229 bp, Homo sapiens
taaaattaaaaatcaacacaaagaggaacttaggaaactatacaaatacataaaaattaaataacatagccaggcacagtggctcacgcctgtaatcccagcactttgggcagctgaggtgggcggatcacaaggtcaagagattgagatcatcctggccaacatggtgaaatcccgtctctactaaaaatacaaaaattagctgggcatggtggtgggcgcctgtagt

SEQ ID NO: 185130 - DNA, 466 bp, Homo sapiens
aacccaggcaagattggctgggagccagaggggcttcccaacgtggagacagaataagtgagcaatccccaacagtccacgttctcaccacctcctgtaatcctagccacgagagagtgctttgacccttgtgggccctgatactggcagagggagatccctggagcctgtgtgatggcattgctccagaaagggaatgcacactgagtcccacgcatcccccaggtccctagtgggacacaggaccattttgagagtccagctctcaccaaactgtatcctgccctggggcccaatagcccctgcctctctacatccctggagcccccctgacattccctcgtatctgcctagagggctctagcagcaagacactggttgggcccagaggaaccacagggtccacacaatgtcctgtataccagggaaagggcagtgtagtgtatcagggaggctgctcccagga

SEQ ID NO: 185131 - DNA, 215 bp, Homo sapiens
tgtttctggagcaatgtgcgtggtcatgcccgcaggcaagacgccaggcattcttcattcagaaaacatgaaatccatcttcagatacgggagtgagcacaggaaaaataagtgagagtgcagtggggggactttctcctctaaagtctcccgcgtctttcctcaaggaggcacaacaccctctctgccagggcctatggagccttggtcagcgt

SEQ ID NO: 185132 - DNA, 450 bp, Homo sapiens
ataaacaatttgaataaattagaagacagacgagagaagatatttgaaagagcaactaaaaatgcttaagggactgatggaatacacaacagaatgagatcacttaggaagtagaaaagaatgacaaaaatacaaagagaattcttaagagtaggaaaaggacagagaaagatgaaagtgacctataaaaaagcaatgaccttagaaccaaactaaataggacaccagtgaaggcacaaagtacactactaaaattctcccaaaggcttactcttctggtctgctctactcaaccactactggctatctatagaactcttcaccactctctggccatgtgcttttacctaacaattcttgcacttctacctgaaaccaaaggtcagtgatcaaaggcagatcattcatagttcttgtgaatattttccccttcttacagtaatcctttat

SEQ ID NO: 185133 - DNA, 703 bp, Homo sapiens
agttatatatgttatatgagggcaaggaacttatcttaaatactgctgctttctcagttcttaatatcatactcataggatgtgctccataagtttgttgagtgaatgaatggatggatccttaggcattctaaacaagaaagataactaagagactaatgtcatgcactcctctctagccttataccatacaagaaatgtctgctcatctctaccctttgtgttcagtctccacaggtggtacaatagctctgctcccacttcacgactctcaaagtcttccaagggactaaacagctgatgcacaccaatgtggcttcttccacatgcatagttgtccgacaaataaaatggtaacagatgtgcctctggtttctgaaagctgggtgaatgtccttgggtgagtgttgtatgcttaagagtttacggcccacggtaggaatggaaactcagtaacctggtgttgagccttcctcaacttatttcctcaagaaagtttctcaaacccgaatgttgtaaatgttgacagctgtagtcaggaaaaggcatagtaatgagctgctgtgccaatttccttgagctgtcataactaattaccataaacatggtggctttgaacaacaggaatatttttgctcacagttccagaggccaggagtttgaaatcaagctgtgccatgccagcggtgtgtgactccgatct

SEQ ID NO: 185134 - DNA, 207 bp, Homo sapiens
tgctgggattacagccatgagtcaccgtgcccggcctcaaaatttcttagactgaggtcatcagttactttttccaggttttagtctaattaggttgaaccatatgagcttgccggcaagctatccggttcaatcaatagtagacctaaaaaaaatcaggttgttgctttcatccttttatttgatagcacaggcagagctaccaaa

SEQ ID NO: 185135 - DNA, 417 bp, Homo sapiens
ctttaaatataaaaacacaaataggtacaataagaatatggaagaagatattccatgttaacaataaaagaaagctgaggtggctatattactcaaagtagactgcagtgcaaagaatattataaagaataaaggtcattataatgataaaaggtcgattttatcattatgttctctgactacaatgtaattaaattagaaatcaataacatgagattatctgaaaaatacttggggaaaaattacacacgtctaagtaacccatgggtcaaataagcaatcaaaaggaagattaggaaatattctgaactgaatgaaaataaaaacaaggcatatcaaaatttatttcaataaatttaacaatttaaacaaaaatggacaaattcttataaagacacaacctaccaaaactcacat

SEQ ID NO: 185136 - DNA, 323 bp, Homo sapiens
attaaaatttaaataaccacacatggctggagactattgttggacatcacagggctccactcaatactatagcactgcactctctcatcccatgctgtctacatagccattccccccacataaatgtaacctcccacctatactcttaactctcaaatctttaggtcaacactgatcagtaatcctagactcctatttttggctgcctacagacagatatccttccctggatatctcacaaggccttcaaagtcaacatgttctgagccaaacaattccttacctgacattcagcctacttttccagtatcccaaatctttcc

SEQ ID NO: 185137 - DNA, 186 bp, Homo sapiens
agttaatccactctgagaaccgaccctaacacttagtgtttttctacatcgtaaatgcagacccacatctgaaaagagcatcccaaaccccagctaacccccagggtcccagagagtgaaggatgtgtgccgagagcctccgtgccgtgcagcggcactttaaacgctgtttgttgaatgctttgg

SEQ ID NO: 185138 - DNA, 1298 bp, Homo sapiens
cgccgcttcctgcggccggggccagtctaatgcatggggcccggcgggggactaaggggaaactgagtcacgtcggtgtgggagcagttctgtgtgggaggcaccaccccccactgggctcggggaagatccccctccaagctatgcttgagggtcccagcccccatctgtctccacaggggccgcaccccactcccgccttccccttcttcagcacccagggtcccgccctggctcccagcagcctcgactggtcccggaatggctaggaggatccgctgcagccgccttcgctcccctcgcgcctccgctctccccctcgcgcctcggctgccgtccctcgccgccgcgtgtcgctctgctccgcgccgtgtcctcgctcccgtgcctctgcccccccagtccaccgcggacatagtaaaaacctccctgcaacgcttcagccccactgaaaacagagcatgtggactcctggcccacacacgcccacttcaatcgaagatacacaccaatcacgctaaacacaaccaacgagctacatagccaaactagcacgccaccaagagtgatcgctgactggaccagccttaccctccggcatttatctcccacgcgactcacgccgcacgcaccgaccgtccctcctccacatctcacccaccaattcgcgccatccacctcccgcggcaccctcgaccacaccgccacgttcggccactccatccacatctccagctccaatcaccccacgccacaacaactctccaacacccccttcccaacactctctcatctaccacaccccctccctccccacatcctaccacacacccccaccccctcccccccacaccacacttcccatcctacccccctctacaccccacccacaactccgaccacaccccccccactccacacacaaccacgcaccccactcctcacacatcatcactatgaacacttcactcgccccaatccccacatgacatacatccacccactagacgctctactgcgtaccacaccacactaccacaaccctacaagacgtctaacctgctctaccttacccaccactctacaccacactgcacctcccactcaaacctacgccctactcacctcatcctacaactctaactaaccccaaaccccctatatacatgctatcacacttgactaacgccacctaaactaacaccattacacctcctccactccctcacttcatctcctacaccatcaccactagatcaaccactctcactaccaacacgccccctaatcaccacctg

SEQ ID NO: 185139 - DNA, 536 bp, Homo sapiens
gagtctcagcgttctgaagaatttggtctattgtgttaatactagagctggttttagtactaccaatggtaaaaacatcagcagagatttgggagaaattactggtacagcagttaagagacaaagttttagccttgactcctcctctgactatgaactttgtgaaaaagtcacttcagtcccagtcactttggacatggggttgccctaactcagggctttgcaaatgttttatgttgatcctaggaaatgttaaataaatgtggtgtgttggaactacaatttttcaaaaattatgaaatacaaaaatttcgagtgcaatgtatacactaagggtaaatatcatttcataaggtttttgttacagaggggtgtgtgtgtatgactgctgtgagatgttatgtaaagtaagcttttttctttttataaattgaggtatttttgataattaaggattaggtatacctaaggcatacaatttgatgatgtatgatacatatccattattaaataattaccatagtcaaactaattac

SEQ ID NO: 185140 - DNA, 501 bp, Homo sapiens
aatcagcatgttgaagagatgtctgcactcctatgttcattccagcattatatagccaagatatccaaacaactgaagtgcccatcaacagacaaatggatttttaaaacatggtatataaacacagtgcaatactattcagccttaaagatgtaggaaattctgccatttgcaacatggatgaacctagaggaccttatgctaaatgaaataaaccagacacagaaagacaaatagctaatgatctcacttatgtgtggaatcttaaaaagacaaattcattgacgtagaagagaatgctgattaccagaggcttgaactggggagggggaggatgggtaaatgggaaagaggaagttgttggtcacaggttaaaaagttttagttagacaggaggaataagttctgttgatctattacacagcatggtgactatagttaatagcaatgtattgtatatttcaaaatagctaaaagaaaggttgttaaatcccactgcga

SEQ ID NO: 185141 - DNA, 289 bp, Homo sapiens
agatttgcaaatattttctcccattctgtggatgttaatttttttagtaaattctcaagatacctatgttccattttattgaactctactacagagttttacaatattattttatgttttgtattatttttgcttttacttgataatgtaaaaagcctatatatggttatttatataatatataagtatataaaatttatatgtattttatgtaaaatatgcatacacatatatttcagaatttcataaattattctgttctttattaataatttggagaatggctaat

SEQ ID NO: 185142 - DNA, 370 bp, Homo sapiens
ccagagacaaaggaaagtttattacagcattagcagtagccaaagtatcagcattttttagtcaattctatgaacctcagttctctcacggaccacgttataaacatgcattgggttgcttggggaggaagtctgaggttagagatccaaatatttttataatgggcagtgagcatgcttgctttttgctccaaatgaagacagtatctccatcttataaggcagtaagcaaactggcttcttgctccaaaggaagacattatccctgtcttccaagaatattttctacacaaacatatttgaaaagatagccaagaacaaaaacagccagtacctttaatcagcaggtggaggcaattgtcctaagcaa

SEQ ID NO: 185143 - DNA, 299 bp, Homo sapiens
ctgaacacacactctgcacacctcggggcccacccctgcctgtcccccacctcaccaagcctgtgactccagggtggagtcctctgtgcctgtcctgaggggactgtatggactgctgtttccttccgggctgtcacagatgctgtgacaggcctccttctctctccaggaatacggctgcagtcggtgagcccccaagaaacacagtgaagaaatcccccgagaacatggagtgcgcccacctccagccttggctccactgctcagaggcaaggaggaagccctgctcctgtggccct

SEQ ID NO: 185144 - DNA, 402 bp, Homo sapiens
agaggatcccccgcttgcggcttggctcaaatgatccacccgcgtcagccctcccaaagtgctgggattacaggtgtgagccactgtgcctggctcattcttttttttactggtaatttccttgatgggtaagctcagtggtttgtcctagaatctggattcttctaattacatcctcatggttttaattaacatattctgttgtccctcaattttctttaaatttatttggttttgggttttttccccacatgctagcatgacatgtaagtaggtaatgaggtttattctgtgagaaattacattcatgtctcattcttcggttgtctctttttttgtgatgttggcaattcctggacctgtgggttcagtaggcatatgccgtggtaagactaattctag

SEQ ID NO: 185145 - DNA, 382 bp, Homo sapiens
accacctgggctcaagcgatcctcccacctgagcctcctgagtacctgggaccacaggtacacaccaccacacctagctacttactaagttttttgtagagacagggtcttgctatgttacctaggctggtcttgaactcctaggctcaagcgatcctcccaccttgacctcccaaattgttgggattataggtgtgagccactgtgcccggccaacaaaatatagttgttaatgcaagcactagttcctgatagaagggggctgaaacaatgtggatttattatcatcagaacctagaggcagggccaggccagagtttattcagagccagactctttccatctcattgttgaggtgacatgttctccatggccataagtt

SEQ ID NO: 185146 - DNA, 171 bp, Homo sapiens
gatatttcatagaaacatgaactgaagaatatggaaaaagcattaatcatttttaaaattgctacatagcagtaatcttttcaaattatttcttaacacttccacttgtttttataccaagaaaaatggaattatttatatggaattctacatgttctggatggctgggaa

SEQ ID NO: 185147 - DNA, 445 bp, Homo sapiens
agcaaagagtccccacccactggggacagtgggaaggtggaccctgtctacgagaccctgcgctatggcacctccctggcactgatgaaccgctccagtttcagcagcacctctgagtccccgacaaggagcctgagtgagcgggatgagctgaccgaggatggggaaggcagcatccgcagctctgaggaggggcctggtgacagtgcatctccagtattcacagccccagcagagagtgaagggccaggaccagaggagaagagtcctggacagcagctccccaaagccaccctgcggaaggatgtggggcccatgtactcctacgttgcactctacaagtttctgccccaggagaacaaggatctggctctgcagcctggagatcggatcatgctggtggatgactctaacgaggactggtggaaggtgacttggcagggtg

SEQ ID NO: 185148 - DNA, 586 bp, Homo sapiens
taatttttgtattctttttagtagagatggggtttcaccatgttggccaggctggtctcgaactgcggacctcaagcagtctgcccacgtcggcctcccaaagtgctgggcttacaggcatgagccaccgttcccagcttacttaggttttttaacctccttctaacctttctccctgagtggagagtttttaaacatttttaaaaactgcctctcctgtgaattttattaccaccaatatattgtgtctctctttatgtactgtatgtttatctgagctttatatctaaaaagaggagggctttttcacgtcccactaactagttttagatctctttgagggtgacatcactcctgatgagaatgctgagctaggtccattcagtttatgaaatgaacttaagtttgtagttggtaacttttttccccattccaaaatctgtactttgaaaatattggtaagtctgggtctctatatattttctatcggtactgtgttgttttgagccttctctgtagcacaactttatgttgccttatgatacttattccttatacaatgcttttatttttctgtatttttcgt

SEQ ID NO: 185149 - DNA, 336 bp, Homo sapiens
tgccagcaccatgtgattgagctggaaagtcgattttctgaggactgccaacagccacccaagtgagctgggaaacagatccccctgcagttgacccttgaggtgactgtagcctgacagacaccttgattacagctttgtgagagatctgcaccctaatcacccaactaagctgcacctgtacctgaatttctgactcagagaaactgtgagataataaatattgtgattttcaaatgctaagttttggggtaatttgttatgcagcaatagatgactgatacaagtacctactgttttcaggtagtatgcgaggccattaaaatgtgaaaaatg

SEQ ID NO: 185150 - DNA, 367 bp, Homo sapiens
aaggaagtatacaggaatagatatgaccaggacacagatactgatcgtgaagcagcctccctccctcacttgttctctgttctccaaaccatttcttctttcaggtatgttaaatcagatatatccctccaaaataccaggctttcttaggatatcgggtgactgactgcacttctgctctcttagcctggaatgtgttccccatggctaattccaattactctctcaaagacaagtatagaatgaataaacaaaatctagtatatctacatatggaaatactactcagccataaaaaggaataaagttctgatttatattacacggataaactttgtaaagattactctacttgaaagtggccaca

SEQ ID NO: 185151 - DNA, 428 bp, Homo sapiens
ggctcctgacagcggcgggtgtgggagcccaagggatttaatctccaagtccctcgtgggaggagccctgatggggggacatgctgcctggccccttccagccaaagggtctgtagccccaggagctgcaggctgatactgcccctgtgggggtgtctcctcttgcggctgaacatccaacccagggctgcctggggtcccaaggtgctgtaggggctgcaggtctggacgggatgccatgactccatggccagggcccatggggaccactcacagacactggggcctcactctctcctggttggtcaggagccctgcccaaagaagggctgaggaggttgagcagcccctcacaggaccgaggcaaggcaggcctagagcccgtggctccatcctcaccccgcagcgggcggcaaactcccccactg

SEQ ID NO: 185152 - DNA, 399 bp, Homo sapiens
caaagatgtccatgcagcttaaattatctaccctctgtgccacatgctagatagagactctcaaattctaaacagtcaacccaaacttttttctttaagaacaaggtctcactatgtttcttaaagaaaaaaggaaagaaagaaactaacaaagaaagacagtacctcatccaggcgaggaggaaggaggctccctagggtgagaagctctggagagagggggaagctggctcctccaatactccaacgcataggactaaggacacaagatggacacagaagcttcagtgggccgagagaggataccactgcccattcttccagtgtttatcgaagatgtccacgcagcttaaatcatctaccttctgtgccatatgctagagactctcaaattctaaa

SEQ ID NO: 185153 - DNA, 165 bp, Homo sapiens
tgatacctcctggagaatgtgcacagggaccctggtagagatcactgtctgtttagccagttgctgttggaactggagagtgtgaagggaaaactagaaagaaccacaattggccgggtgtggtggctcacgcctgtaatcccagcactttgggaggccaaggcg

SEQ ID NO: 185154 - DNA, 411 bp, Homo sapiens
ccaggcagaagctatttcagtatccagcataacgggataatttaggatagggtggtggcaatggaaatgaagactaaaaaaaaaaagttgaagttttagaagtagaattgtcaggacagataactttccaaagaaaaccagctcaaagagtcatctgtatttcaaaaaagaagactaaaacaaaataattagctaatgcatttaagaagtatcatacaagcaaagcccatttagcaccactgcatcaaaaaagacagcatcattcagaagaaattatacatatttttgctccctactcctctcatgatgtacaaattaattaagctattcctccagatccttgagcatgcttctcaaacatttgagaactgactcatttagctgaagcttcaaagttcctaacctgtcctc

SEQ ID NO: 185155 - DNA, 673 bp, Homo sapiens
ttgtcctctgggtccattacatttatcttgggtgtcttcaccctgaactcactggtcgcctgccacttgggtgcttttcaggaagagcagatcaactaaaggaatcagctgccagacaatgggacgtgagactgtcaaggtagaggatgacatcaagtttggaaaatcattccccttcctcagaaaagccttctggttctcaggacagcctgactgctaccctttgtcatctgttcatcaaatacttattcagcatctattatgggccaggtatctttttgatggtcaggaatggaaaaggaaactcaaaacaccatgcacaattattttaattctacttgatagccatgaagacaactcagcgcacttaagcatacggcagcatgcatatggcctaaaagaatggcaagtggggaatctccttacccttgctattgaatcacagagttagcaagtcagagcctctggattcgaggtctggaagacagactcacaggatacaaactaatggacagtggagaattacctgatgttctgatgtgagtagtggtctatgcaggtaaccacctaaggtcacttcctttcctttctcaaagtagactatggtcacagacacttccagcatatattccaagttattgagggctttggtcattgagcttatcagggaagg

SEQ ID NO: 185156 - DNA, 425 bp, Homo sapiens
aaaaatgttgtattttatctatttatccaccatttaatattattatcagataaaagggttagtctaaccaatctattcagtgactagattcaaaaccgtgagtagactttgtgtgaaactcagtgaaaaaccattgaagtatcactttcaatagtgatgccatgttatttcagaccaatatcagctttgctaagataggaaaacaagtccttaacttaaaaaaacttatgtttgaatagattttttaaataatattcaatcattaacaacaggtctttaaacctcaaaatagcaaaatactattttgcaaaaataaaacaatattcgcatgccgtcagttttatttaattatttaagttacaaatatatatcaattaaaatgtgttatcttatcaaactgaaataaagtggacatctcacttctt

SEQ ID NO: 185157 - DNA, 147 bp, Homo sapiens
gtcccaaaggtagacggaggcttcacagaaatgtcacagagctctaggtccaggtgggccatgtcctgggcagaaaagacccaaataaagtggcaccaaggaaagacagacacaatcagagttggggggcgggcacgggcaaggcct

SEQ ID NO: 185158 - DNA, 319 bp, Homo sapiens
aaaaccctttctttcctccttccccaggtgtctcttcaaaggaataaacttccttcctggccaaagccttgtggcaaagtaattgaccacagctttgacagcaacaaagatgacctcttcacatccacttccttagccctttccttccactttctgtttcaggagaagaaggaccattttgttgttattaaaatgactatgctgttctaagaatttctgactgattactccactcctgccatcagcttcttctttacggcccaactctcctaaaatatggtgctggatttgttgtgttgtagagtaaaaataatattgt

SEQ ID NO: 185159 - DNA, 311 bp, Homo sapiens
ttcattacctggtttctttcaatctctctgacctcatctcctcctgcttttcctcttatggccttcactctagtcacccttggctttcttgcaattcctcaaacacactcctacctcagggcctttgcacacgcaggtcatctatctctctgaaatgctacatagcccctgcctctctctctctccttcacttcctccacatccctggttacatgtcacccaagatgcagttttcccaaagaccaatctaaaacagcatccaccatcctaacttcctcaaaacatcctgtcacccttattttacatcctcc

SEQ ID NO: 185160 - DNA, 379 bp, Homo sapiens
cacagttagcaggataaaatacttaacacaaaaactgaggggcctacaaaataagaaaacctcagttgagattcttagtcaatctaataaaaaatgtaatagtcgatctctagatgacatggcacctactttggtttgctcaatgatcaaaactctttcacgaggaaaacaaatccaaccagaaaatttaagattttatctttgtcaataaacttctggatttaacactgatatctgaatcaaactcaaacttctagaaaattatatgaatcaactgtcaatagactacttgtgtattattattaatgacttctgattctacaatcagtccctgaatatttcaaatacggcacttaactctaaatattctcaaacagaa

SEQ ID NO: 185161 - DNA, 674 bp, Homo sapiens
ttggaggtggtggtaaggaagactgtgcagctaattttttcaaagcctcagtgaataaagacttcttttctggtatctgtggttaggtgagaagatgggggtaaatccagaaagcagagtgagtcaagcttggggacaaatctggggactggaatttcatgactttcactcaactccttaataatgaattgctgatagaaaagcagcattgtttggaagggacaggaacagacacaggaatagaactaagaggagactgaacttacaatggacttctatcatatatgcccaacacccatccatctgcatcagtttgttgaggaggaccatcccccatcactccaaccgtgtagttctgagggaggctgccaatcagtatgacctgcccctggcccaggctggccaatcatggcagcccttccctttctactgccagctgtccagagatggcatgtgacccaggcctggccaatcacagtccttatctgggattttctttttggagccactaggaaagatttcttaatgtaagaatgagattttggaactgcccgagtccatgtttcttgctatatggggaagaaaagaacttgttggtagtgagagagaataaagccaacaaagaacagagctgatgaacactaagatggtcttgacactaaatgcccccatct

SEQ ID NO: 185162 - DNA, 633 bp, Homo sapiens
catcttcccctacccaacactccctaaatctttctggagggttctgatgtatagcctggcttgtgaactgctgatagatatctcaaaaaggtttatcttgtgggtagaatactttttcttcacagcctgtgacttctgtaagcataaaatcactcccttaggggttctgtatcagggatgtccatcatcatccactgtggagtttttagattccatttaggtaaagtgtctttcaagtaatagctcagtaactttgtttcctctgttatgtcaaattaacaaaatctttaaatttatcattaagcaatcaattataatcgttttcattacccttgatggcatataggagtgtgtttccttagccactgctcattcatttcattcattttatagtcagacatatgttaccacaacatataaatttgtaagtctggtatatcaggagaaggtttgaggcatcaggagtatagccagaaccttgaggttctttctttggagtttgttgcctgtaaatattcatttacatatttctcatgctgttcttctagagtgaaaattggtttggactttgtcgaggcaccattctaagagtctgacctctagtttctgtggcaaatatttacagccatcaca

SEQ ID NO: 185163 - DNA, 517 bp, Homo sapiens
ctacaagagaacacagacaatcaaatgaaatgaggaaaactgcatgaacaaagtgagaatatcaataaagagatagaaactaattttaaaaaacccagaaattaaggagctgaagaacaaaataactgaattgaaaaattcaccagagggatttaacagaagacttgatcaaacagaggaatcagtgaacttgaagacagatcatttggaattatcaagttagaggaacaacagcaacaataaaataatgaagaaaagtgaaggaagcctaaggaactcatgggacatcatcaagtggaccaatatattcactatgaaagctcagaaggagaagagggaaacaaaggaaaatgggtaaaaagcttatttgaagaaacaatggcaaaaaagtccccaaatctgagggaaaaaatagacatccatattcatgatacttaaaggactatacataggataaatccaaagaaatctacatgagaacacattaaaatccaactgtatatgtcaaagataaaga

SEQ ID NO: 185164 - DNA, 350 bp, Homo sapiens
agtggcttctgatctggtgctggagggatgaggagcaactagtttgcccaccaagtcctaggcatctgaggccagccagggtcatggctcctgcctcctccttctgtgcccctccccagatgcccagttgtgagggagtgatcagaacatgtcgggggtattgcaagaatctcaaacagctgtgacttgagtgtacaagccatttttatccaagaccctgtgaaatccatggcaccacccactgggggctggtccctcaggatccacatagggcctatagcccacccccgtgcccccgcgccctgtgccccgtgtggcggcctgtgagatgcatcagaacacccagggga

SEQ ID NO: 185165 - DNA, 351 bp, Homo sapiens
gctctgttgcccaggctggagtgcagtggtgtgatcatagttcactgcagcctggaagttgggattacaggtgtgagccacagcaccctgcaaattttgacaggcattgtttgtcaatatgtaacaagttttataatttttatagctgacaacataattccactttggagaacacatccaaggaagtcagtgcctcctttgcccctttcccaacgaaagtaatctgtacaaagtgattcacagcagtgttgctaataaaacagtgagaaatggagctaatataagtgtccatcaatcactggatgattgagcaaataacagtttctcaacctgaggaaaacccatctgacc

SEQ ID NO: 185166 - DNA, 334 bp, Homo sapiens
atctttcccactggagaaggaatccaaattgtccgcggctaccagatctagcgcggtgtttcggaagctgtgaaggctttattagtctttgaaaaagacacttggctaagtcacaagtgtggcaaatggaaaaagatttctggccgggcgcggtggctcacgcctgtaatcccagcactttgggaggcctaggcgggcggatcacgaggtcaggagatcgagactatcctggctaacacggtgaaacccgtctctactgaaaatacaaaaaattagccaggcgtggtggcgggcgcctgtagtcccagctactcgggaggctgaggcaggagaa

SEQ ID NO: 185167 - DNA, 759 bp, Homo sapiens
cgactgtgaataggtaggtccccccccatcccccatactccttacactattcctcatcacccaactaaaaatattaaacacaaactaccacctacctacgatgtgaaataggaggttgataagactttacaaaccaagatggataatcttgatatttaaaaaaccgaaaataaaaaaatttgaaaattttgtacataaaatgattaaacaagctatataaacctgtatttgtaagtgaatactagacaaggagctaatttctgtaatatacaaattcttacaaattgacaagaaaaggaggtgatagctataaagaggtaattcacagaaaagcatctctctgctcttgaactgctagaaatgcaaactgtaaaaataaaagtacccaaaccttatcctaaaatgcacagatgtttactgcaagtgttgtttatagcttcccagaactggaaacaaaacacattcccattatgagaaaaatggctgagcattttgcatgtatagccacccaatggaatttccacagctattgtaaagaacaactttaatttagagccatataagatgtcttgaaggtatatcaacaaggagttaagtgataaaatcaagatgtagaaaaatgttagttatgggtctgtcaatcctggtgatctctttaaggagctaacttttatctttgttaatcttatctattgcctttcatgtactatttcgtttacttctgctcttccctttacctacctatttcatagatacgta

SEQ ID NO: 185168 - DNA, 480 bp, Homo sapiens
tttgttgcgaggcgtagggccaccctgcgcgcccagcagaagcgctagagggcacggttgcccggggtgaaccgcatgtccaaatgtaactgtgtgctccgagttaaaattgtttttctgcagactttgcttgagccaacgattccggaattggggaaagggttaccttaggtagaaatcggaaatttataggagacacagaggtaaggaccaactgttaggactgagtgaaaaatggttccctccaactgtaaaagtggaaaaaaaaatacctatcttataggtggggcagtgaggagtaaatgagtttaatatatttcaagcttttaaaacaacctcgcccatcataagcactgtttaaacattagctcttatcttttaaaaatattagtggatgtttaaaatgaatgaatacaatttgtccaagaaatatggcgtaagagcccagaagaaataaagtttaatcttacaaagggcttc

SEQ ID NO: 185169 - DNA, 363 bp, Homo sapiens
attagaaaggtggcagtgggagcagaatggagtaaacaggtgcaagaaatattttgagaaaaattcaacaggatttagtgaataattggatgtggaagacgaaggagacaaggaaattgaggccagctctgaggctgtgaatcaggatggctggaagaatagtggtgcctttaatgaaaaaaggggaacattggaaagaggatataattggatggaaagaaaacaagtttggctgcaggcgtttcaagcttgaaacattcacagaacattctagtggacacgagttgcattggaaattcaggactagaattcaggagagattccttaaatagtctagcctctccaacagtaggtgaattaatg

SEQ ID NO: 185170 - DNA, 235 bp, Homo sapiens
aatagagaatggagactcagagaggtaggggtgggagaaaggtggatgatgaaagcttgcttgatgggtaaaatgcgtgttgctctaatgatccatgtactgaacctcctgacttcaccacatgcaatatatcaatgtagcaaaattgcacttgtatcctataatcccagatactcaggacgctgaggcaggagaactgcttgaacctgggaggtggaggttgcagtgagccgag

SEQ ID NO: 185171 - DNA, 349 bp, Homo sapiens
ctccaagcccagtccaggccaggagaggttcctgaaggccagctttatccggaaagatgaccgttgcgggggctgatagtaaactgaagtgttttcggggggccagttgaacaaaatggaggtgatggtgctggtgatggagtagacagctgagtcagaggcctggccttctcccacacaaccctccagggcacccctgcgtggttctgggtccctggcctgttgctgccagtgtggaggacagccccaccctaccgtaagccatcagtgctgtcctggaaggggcagacctggccatacagcagggctgtacagaccctcgtgcgccctggcgtcccacagacattct

SEQ ID NO: 185172 - DNA, 224 bp, Homo sapiens
caggcagatcacctgaggtcagggattttctatatactagtagtctttggtgtctccacaaaacaaaggattctttggtcctttgggagggtgctacacatgctatctgtcctcttttctagtcataatacatgtatgcacactaaagtctgaaaaacagaggtaaataagatagtttacctagcatttcccaaacttattaatacacaaggaaaggattattt

SEQ ID NO: 185173 - DNA, 695 bp, Homo sapiens
tgcgacgtcccgagagagggaacggggctcgttgaaaccggtgggatgcggctgtggcgagcctcaggccttccttcagtcagctccacaatccgtgcccgggttctccttgcccagctcggcctcagtccccttcagcgataagatggcggctgcgttgacaggcgggctccgggcgtcctgtctcttccctgcccagtgactgtgtcctggcctggagccctctctgggcagctctgctcccgcagcgccgcgtctctcccagattgtgcagggatcacgggagggtcgtcaggggagaatcctgactggaggtgctggctcatgaataggaagcactttagtccgtggggttcccagggcctctttttttctattaaaaatttatgggcgtcaccgcgaaaagattaaataatttaatcaaagagtgattcaaacattgtagagcacccagctatggtttgtaatttgtggtctatgaaaggccttgaaggagatatttttataaggttcatggtaaagaaaaccaaattcagtaatttgctaggtacagttatgtaggttttgttttgttttgttttttgaaaaggagttttgctctctcgcgcgggctggagtgcagtggcgtgatctcggctcaccgcaacctctgccttccgggttcaagcgattctcctgcctcagccctagtagct

SEQ ID NO: 185174 - DNA, 333 bp, Homo sapiens
aattatttaatatggtaagatgctccacatatcagttgagaacttgacagtttcaagatttatctatccatttggtttatttgaactgtggtataactttctgatgaatgactgtaccttgatttacttagcttttcttcttgtgatggacactgttacaagcggtgctataataaacttgtgcaagtaactcttcatacctgtcttggtcatgtaatgtgctggctcacaggacacatacatagtcttcagcttaactagatgttgccagtttgttctccaaaatggcttctctgcaaatctcactaccattccatattttcagattctaaa

SEQ ID NO: 185175 - DNA, 164 bp, Homo sapiens
tccagtcacattggtgtactcatccactgtttttgtgggcatcttcccacctcaaaaaatagacatccacatcatctctttcatgaccctgataaaatgccatttcattcaatggaactattggtgatagaaaaagagagattccatttcatgtctagatgcat

SEQ ID NO: 185176 - DNA, 839 bp, Homo sapiens
ggtgaagccagcctgaaacctcatcttctaaaatgcaaagtaaatgtgaaaactttgggagcctgggagagaaaaactccctggtttggaaactcagcggaacaggaactcgatcttacaaatgaaagaggctttggagtgtgaagctttggaaggtaccagggatgcaaagtacaggaacagataaaggagtggatttcagtgattacacttaaacaacagtggtagtagaaagaacagcatataggccagagaaaaaaccccacacttgatttgcaggtcgctctccagggcagaatccgctgacctcaatactcatttgatctcttatgtccagatttggccaaactccactgatttgggttgagactagctctgggcatccctggcaggatccacaagccttccagagactggcaaccatcctgaggatgtcccagactaagcagggcaattctgggtcctcctgcaaagggtctgcctcagggagcgcccccttacaggaaacagggtaagagccagacccaggggttacatgaaatgcatgggctagagggccacttaacttgctctcttctgtctccagcccttctaaataattagatggagaaatgataatgaattcagcctgccgacacaatggagtgagtttcaaaaacctccaggagcctgttttgctaaagaaacaattttactacaaactctctggccaacggatacaaaacgcacagatcatttttttattttcttactgttccagagaatatggtcacattacagaataaggacaaggccagttaagaggacatcttttttttttttttttttttttttttttt

SEQ ID NO: 185177 - DNA, 376 bp, Homo sapiens
ctgggtgtggtggcacatgcctgtggtcccagctactcaggaggctgaagctggaggattgcttaagcccaggaggttgagcctgcagtgaaccacgattgcaccactgcactcgaaccagtgcaacagagtgagaccctatctcaacaacccaaaattatactgccacattgcacataatgcaatattattcagcagtaagaaaagaagcaactactgatacacacaagaacatggatgaatctcaagagcagtgtactgatgaaagtagccagacacaaagactcaagaccatctgattctatttatatcgtattatggagagacaaaaccatagatcagtggctacttggggtaggtatgaggggttgactgc

SEQ ID NO: 185178 - DNA, 461 bp, Homo sapiens
aagaacgggggtgggggaaggaaggaaagcacgcttcgccaggatccagctgttttctaacaaacctaagcctacggaagctaggaagatatcggaagcaaggaagatatcggaagcgacggcatccctcaaattcgagagggcggatgcctctagggctagagaggctccctagccctcagttacagagcgactgggaggggacaaaatggagttgaggtttaggggcaccctaaaggtcgtttggaggtctagcaagcacttcatggtctcctccggaaagggccgtggcaaagcctagtaccccgatcaggaagatgacttctggccctcgggatgcggtgagcggcaggaagaggcaggctggggttccgaggaccccagagtccatcacaggagcagatacagtgacctcgggaatcttcccggccccagcggaggcgagcggatagatagccctg

SEQ ID NO: 185179 - DNA, 252 bp, Homo sapiens
gtggatggggcaggagctggtgggtggtatatagaatcaaacatctggaaagaagaaagctgaggcagaagtttcttgggaattaatggttttgaagggctactgcgtatactggagaacccagagtgcaatatgcatgcatgaggctgggaacatgctcataaaaaaagaatgatagaaccctaggcttgcacctttggctgatttttggactctgtgcaagtaggaggtaaagactaagtcacagtcata

SEQ ID NO: 185180 - DNA, 250 bp, Homo sapiens
ttcttatctgaccccaaccaattaaacgccagtgtttttcaactcttcggctaagggcaattttttctcctacctctgtgcacactggattggtcaaaacaattttgcccaaatcggccttgacagcactaactctccctcctgtcgacagggatcctatgttcaccatgagcacttcattcttagacagcttttgaacctttgctgctttcttgtctccttcagtgcgtacacctagaagccgtctaag

SEQ ID NO: 185181 - DNA, 295 bp, Homo sapiens
gaagccctctctgagcctcagatgcctcttctgtgaaatagaccagagctagggcttaccaagtgtgaattacacaccaaacacttggcttatacatttcatttctggctttataagatgggttgtgttcctggctctatttaacggatagttcctggattgttaaaaagaaaccaagccctgcccaaagtcctccctcagctgggggtggtttggaagctccacagcgactgtggtttgcacaaagtgactcatccatgtcactttcctctacaccgacaggcacctcaagcgg

SEQ ID NO: 185182 - DNA, 331 bp, Homo sapiens
catcctttctccccttatgtatgtatattttcaaacgaagctatggtgtgtctataccattttgagccctgtttttgctcagtctgctatgggaagcgttcctcccgtcgcacagagacggagatggggaaccccgggagcggtagcaatggtgccccacggtcatcctgcaggaggggctggaaggggcttggtacaccaagacttcatttatcaaggatctgggggccagaggagatggtctgtgcacctctgaggagggtataagtcattaatttttagagaaatacagttcagggaaaaaacacccaggtaagcaccaacatgtatg

SEQ ID NO: 185183 - DNA, 737 bp, Homo sapiens
agcatgaacttcagaggaaagagagttttgcacaaagatagagaaaaaatggctaacctgaccgtgtatgatctatcacctaaactagaaaatgtgtgaaaggatattaaggaactgcataaaggaacaacagcaagctaggcagaagggccaccctaataaaggaatagaatgagcctgtgaatggagaaggatgaagaccctgattctgcatcctgacataccatagtgcaagaaaacctactgctaacctcagagggctaaaggaaaggtaagattaccagggcagatgggcttaagttaccacaagaaagccaaaaaacatcttatgaacacgagggagaggtttaacacaaaaataacatttcagagaattcaagaggaaagccttaggaattaaacaagagatttggtcaagggaagaagaaactctgagtggtatgaagatcagatggactttcattctggacaatgacagatgacaggaatgcatggcatagtggaattggcaggtctcaggaattctgagagaacttgtcctcacatctctgaaagacaggggcactcaaacctttgaggaaggagtcagaaaaagacagtgcctctgaaggaatgtgggcaaaatattgttagttctgagaccaccctattagcatatctttctcatgctgaaagcaactctgacagagaagatgatcgggttcttccctccctcctctggccttttctctctttgg

SEQ ID NO: 185184 - DNA, 501 bp, Homo sapiens
tcacaaggttctgtgattctcagcttaagcatggggcacctaggccaggaatgaagtcctcccctcatgattcccatacgtgtgtaacctatccagagagaaatcacatccttttgcatccacattggaaccaagacacagagcaggagacctcagaattggagtctctgtatcaggccagtcttcaggcttctcaagctggctgttctggatgggggcagcaggataccgcctggcacccacttagccaaacaggtaagaatgcaaccaggggttggggggaggggggaggatcatataaaagctgaaagcagggaaagatcagaagggagtgttctatacagatactatccccagcttagtaggaggtaatagaacttttgactttactcagaaagccttcaggacaagacctagacatttttctggctagagtggaggaaggggcagaattaccactcataggcaacttccctccttctaaagtaagagattactaag

SEQ ID NO: 185185 - DNA, 562 bp, Homo sapiens
tgctgaatggaaaagatcactccaggactgagtgtgaggaacctgaaggcccttgcttctttctggtagtgtggcagtgtaggttagttgaggattgcacctaggccaggaatgaagtcctcccctcatgattcccatacgtgtgtaacctatccagagagaaatcacatccttttgcatccacattggaaccaagacacagagcaggagacctcagaattggagtctctgtatcaggccagtcttcaggcttctcaagctggctgttctggatgggggcagcaggataccgcctggcacccacttagccaaacaggtaagaatgcaaccaggggttggggggaggggggaggatcatataaaagctgaaagcagggaaagatcagaagggagtgttctatacagatactatccccagcttagtaggaggtaatagaacttttgactttactcagaaagccttcaggacaagacctagacatttttctggctagagtggaggaaggggcagaattaccactcataggcaacttccctccttctaaagtaagagattactaag

SEQ ID NO: 185186 - DNA, 247 bp, Homo sapiens
gtacccggccaatggtctttgttttctggatgatctgttgtcattgggagaataatacctatgaaattgatgatcacctaagtgttattgacttctagaactacatgtgatttattgcaaggccatcagaagcaaactagggtggccaaagagctgaagcacacagttaagttctttcacttctgtttctttgtatggttgtttagtttttccggggagatattgaactatactgctttagactgtt

SEQ ID NO: 185187 - DNA, 311 bp, Homo sapiens
ccgactctagagtatcctctccccgtacgcccaaaaaatatgtgaacatacacataataaaagaagatacatgtttggccaaatgcatgtgaaatggtggtcaacatcattagtcatcagagaaatgcaaattaaagtacaattgtatgcctcctagtagaatggtgaaaattagaaagactgatgattccagttgttcgggaagatgtggagtactggaactctgatgccttgttgctgtctttgtttagtgttggtataacagaatacctgaggctggatattttactttaaaaaagaggtttattggg

SEQ ID NO: 185188 - DNA, 628 bp, Homo sapiens
tcaggcatggccggggagctacagtccctcagtccccgcggtcccgctgagcttcgcagggaggcagctgcggcgtgggggcagcaatcataagccaaggtgccagggcagtcacagggaatgggttccacaggcctggttctgctccacaagaggccacatccagcacaaccacagagcaagcgaccccagaggacccacaggaagatcttcagtgcctaagccaagaggcaagctcagccatccctgcactcactcaagccgacgtgcacatcaaaccagcttccagggccaagcgaagttcccggtgcagcatcgtgcactgaagagcacctgccatccgctcaaggtcaaggctaacacgtgagcccaaccacagtgcagagcagaactaggtcaggctggggccggccaaggagcaaaccaaagccactgtcacatccctgcaggacttctccttccccagagcagtcggcgacctggcagggcctaacctggccactcaaatgcttggaaagatgccaccatgacactgcgaggttgccagagcaccaggaagggaaacaagtgtcacctacgagcatcagagtcacaaagtttaaggacagaattagctctctgtggaaat

SEQ ID NO: 185189 - DNA, 464 bp, Homo sapiens
atatccttcatgaatataaatgcaaaaatcctcactaaaatattaggaaaccaagtccaatgacacataaaaaagattatatgccctgaccaagtgaggtttgtcccaggaattgaaagttgttctaacatcaaaaagtcagttaagatattaatagaataaagagcaaaaacaaaaaaatatatgataaatgccgaaaaatcattaaaaattcagcacttattcatgataaaaactctttaacaaacttggaataaaagagaattctttctcaacctgatagagggcatttatgcattctatgaggctagtattatcttatagcaaagacctactgctaacatcttccttaatggtcaaagatgaatgctttttcccaaagttcagaaacaagacaaggatgtccatttgtacctcttattcatcatggcactggatgttctaacaagtacgatcaggcaagg

SEQ ID NO: 185190 - DNA, 487 bp, Homo sapiens
caccatggaacactttaagcaataaaaagaaacaggactactgatacatgaaacaatttgtataagccttaaggaaactgtgctaagtggaaggaaaaaaaatagtctcaaaaagatgcatactacatgattacatttatataacactctgaagtaacaattatacaaatggagataaattagtggttgccaggggtcaggcatggagagggacggggtagatgtggctataaaagaataactcgatgaagctttatggtgatagttcagatatgtatcttgattaatgatggttacacaaagctagacatgataatagtgcatatagctcttccccacttcccccaataacagtgctagtataacgtgaaatgtgaataagctctgtggattgtaccaatgtcaattccctgattttcacagttattagagatgtctgctagtcacgcaaggtgttaacaatgaagcaggctcagtgaaagttgca

SEQ ID NO: 185191 - DNA, 441 bp, Homo sapiens
tcaggctccaggaagggtggcagaatgcaactctgcaggaccttagctggaagcgccatctgggagaaggaagacttataaacatgttcttccagaagcctgtgtcctccatcccctcacaaagacagcagaaataaatcacaacgatgtggttctgcatcagcacacctgatgctatggcccaatcaactatttttgggaatcaatagctctcttaaagctttttagtagagtatctttttatgaaacttctgcaatttcctaaatcagttctacttaacgttatatgaaatgattgatagattaaaaatacatgtacccatgtatcctgggaccctaatatgcaaagtaaagtaagtggtgcttcatcaaaaggatgccataaagaggaagcagccgaactacttgtttccttgattgaggccacttaagacaaactgg

SEQ ID NO: 185192 - DNA, 791 bp, Homo sapiens
aagtcagagatagagctgagactgatttaaggggaaagttgcgggaatatgaaccctgatcctcttacaatggcattctttggacttctaaatcagaaatcacttctgacctgccctctctattggtgtgtcctctattgtgtccaattaagccttgtcatataccaacctggatatactactgcattaaaaaaaaacccattatttttcataatgtctgtgttgggggcagagggagaacagggttcttagattatgaggcaccagataagagattccaggtctatataattttttttcttcatgcatgcttaatgatggctttttggtaataaagatattaacaacaatctggtagtcgtaaaggcctcttctaggtattgaatacaataaatcataagacataaggatgcagcaaaacacgcctcagagcagaaagctggctaagtggaaaatattctcacaaatgtgaagggggtaaaagattgctcaaatcttatctagaaaataaaagcacaccagagaatagaaaggaagctattgtgtcttcaaggggacaacactcagcaaatgagaagcaaaattacatttattgccatattttgaccctgtctgagctcagtaagaagagaactaaaaataaattccatttttatatattaaggaatcaaagcagggttgaaaagtctataccaaaaactcatcagaacatcctagggcatgttttagagtctcattaaacatacaaatatgttacatcttctctatagtgaaagcccacggtaccggct

SEQ ID NO: 185193 - DNA, 748 bp, Homo sapiens
gagaaaagcaatgccaacttaaatgtctgtggccccacaattcacaagcactgtagcactcatcctcagtggctttatacgtcctctgagaagcacacaggcaggcatcattcttgccatcattccgatggtgaaatccctgcatgcagaactcattgacttctcaaagatgttacctgttccattccactaatacatgtcttctctaaagcagtgtctttatgacctagctgcatatacttacatttctgaattcagagtaatttcagtacattgctgctgctgctgctgctgctgctgctgctgctgctgctgctgctgctgctactgctacattacaattgtccactaagcaatcagagaaaattgctaaaagcttctttactgcttccattccatcagcagaacctttttttttctttctttcttttaaagaccagaatgaatgtttagagtactaaatcttattagtggtcaattgaagtattggagagccacattttgaaggttctctcccccacccaactccattccccacagcaagaaagggagtgtttttatatgttgaattctttgttaaaaagatgaaatgtcctgattttccagtcacaagacagtaattactttgcacatacagcatatcccattttaatgctaaaaagggaaatgtcactcaatttaattcatctggaagtttcccagtgtcaagataacattgtagcctttttaaatgcaattaaatgtatct

SEQ ID NO: 185194 - DNA, 124 bp, Homo sapiens
ctctcgaggaaggacccggaagttggcccgcaaagctggccccaacccactctgatctgtggtcccctccatggttgcaggaagagtggtctcttttgtcttggcttacgatcgtccagtcggg

SEQ ID NO: 185195 - DNA, 1244 bp, Homo sapiens
cacacagtagtcactaagccatgatttgtacttatgatttgcacactttggtggttgtaaattgtacagcaatctaaaaacaaatgaggtcagtgtgcctcactacagagcttcaaaagtggtagatagcacatctcttttttcttttaagccatctaatacagagttgcttggaataaatcctaatagatacagtgtttctagaaacaagtaaatgaataaaccttagctgttaccccgtaggagccaacagaggtcaatctgttctcaagcttttacaaagttacaagaacaagtaatcagtgcatattttgttgaaactcctactgcaatactgaaaacttcaaatggagagcagctcctttttggtaattcacaacagacttagttttcaaattaccaagaatataaggaattagattagaagcctaattcaatttagaattatgagacattatttgtaacccacaagtattatttttcccatgatactgaacaattcacctggcatgaacttaaaagaagaaaatgcttattgcagccttcttgctttaagagcgaaaaaaacaattttgctagctgtggagggactagaatacaatgtcactttaagatttacactctcaaaagttttgacctatcagattgagagccagagagagagacagacagaaggagaaggataaatcaaatgtggtaaaatgttaacctttgggggatctgggtagaggggatctgggaattatttgtactattgcaacttttctgtaagtctgaaattgtgttgtcaaaagtcaaaagaaaaaatttataaatactttatcatccatttgctttataattaggtacagagtatgatgacagagagagcctactgtatgccagatacttaacagaaggaaagtagtttatatgtaaactctgggaaaagtggagccaaatgattacactgtgtgtaccctttagcactgtttggggtggggacatggggggtcagggtgcagagagggactgttctggtctccttggaaggtatgtgcctatagtaaaaagcatgagtaagatatcacatctcctaactccgtaacaaccaagcaaacttataatagcattttaacttatatcaccttttttataggagcggatatatattccagcagcatgagtattttagccctctttgcaattgcagtcttcattcattatcatcaataaactggcctctggttgattgatctagtcta

SEQ ID NO: 185196 - DNA, 263 bp, Homo sapiens
gtggggaggagcagggatggggccagcaggagatgttgacagaagggcatgaagtttcagttagactggaggaatacgttttagtgacctattgtacttcatggtaaccatggtttgttctccttgggaagagtggggacgggtccctgaagcaccaagtcactgaaacttcaatttattgtaaggacaaattcaaaagttggaaatcagagatgaaccaatgtggatcttccagtgttgactcaatatggggcaaacatttt

SEQ ID NO: 185197 - DNA, 298 bp, Homo sapiens
aagttgtggtaaaatacacacaacataaaatgtactatcttagccatttttaagtgtacagttgtgttaagtacattcacattgttgtacaactatcactactatctctagaactttttcatctttctgaactgaaactctgcataaaacttccctgttccccgatagcatatgtgatactaacataggcatgaaaagcacttgtacatggggtgggggctgccctctcttgctgccaggatcacctgtgctaccactgaacctggctgggttagtaactctgcagatccgagaccat

SEQ ID NO: 185198 - DNA, 338 bp, Homo sapiens
ggggcaagtgcctatgagatatggtgtgggtgtgcccagttggcaggtaggcacatggatgtggaaccttagtttccttaaaacatctaacaaagttaggcccgtttttgagcagcatgtcccatgtttaagatgcattcctcaggcataataaaagcaattctctgtgacttagtctcacctctatataaatctgaccaaagagaaattcatgtaacatcccacatactcgttttggtttgcacaacaattattattttttttttaaattttaagcaaaaagtttatttaaacaagatatgtgaagagaaaagtatctaggattctttttttttttt

SEQ ID NO: 185199 - DNA, 263 bp, Homo sapiens
agacaccatctctacatacaaaaccaaaaatcagccaggcgtggtgttgcacacctatattcccagctactcgggaggccgaggtaggaggattgcttgagcccaggaggtcgagactgcagtgagccaagattgtgccactgtgcttcagctcaggtgacagagtgagacctcatctcaaataaataaagaaatgaaattatatgatatctagggtatgagtaggggcatagatgaaatagatgggcattgtgatgaagctt

SEQ ID NO: 185200 - DNA, 454 bp, Homo sapiens
ctactacaaatacgaaattagctgggagtggtggggtgcacctagtagtagtagtcccagctactcaggaggctgaggcaggagaatcgcttgaacctgggagcggaggttgcagtgagctgagatcgtgccactgcactccatcctggagacagagcgagagtccgtcttaaaaaaaaaaaaaaagtgttttttttttaaccagttaaaatctggaaagaaagataataatacagactttataatttgattagaagttatcttgtaatatgtatttataaaataatcatgaatgtaacaagctacaacatagtccattactgagttaaaatccacaacaaatacatataaatatatgtaaaataatgaatatatactgaaaaattcagtaaatattgttcccaacacaattatcgattttagttacaaagaatttcagaaactcctatttaag

SEQ ID NO: 185201 - DNA, 427 bp, Homo sapiens
gattatgggagtgagccactgcgcccggcccaactgttttcttgtccaacctctactcttctggcactgcttcctccccaccacctctgtttacatgtcatagggaggcagccattatgtacacaaatgatctgtccacccttggccacagctggccagaaccaaggccagccactcagggtcctccctcaggaatatggcattacaactaaaagatgacagcttagcctggctggaatcaggcatggaggtacaagaacaggtggtgtgggctaccaggtcccaatgtaaaaactggccctcaaagccagtgtagctgaggagaatgaagcaagcagggaggtgagtgagactcaatggccttttgcattagagacctcttgactctatcgtttaagttgggctcagtgaatttctttctttcctt

SEQ ID NO: 185202 - DNA, 445 bp, Homo sapiens
aacccatggcagagtctgaagatttgttttctggagagggcagatgaaaggtctctgaaatgagggatgctaggtagagttacaagtgtgggcactgtcaccaaaaccacaggattatgtgatgatatgtaaaccacatgctgaatgctgcagccccctccccctgctggcctcccagcaccctggtagctagacctttaccctctaggtaggagataggataacttttctcctagaacctaactggcctagaggaaagaactaaagatactgatattagtggttccccaacaaatgactattcactgaagctcaaagttgacaagtgccatacacacactcaacgttcctttcaacttttaatcctccacacttaaacataagcgggcagcaaggggtaccaacatctgaaaaaagaaaacttctaatataaaacattgaaaca

SEQ ID NO: 185203 - DNA, 182 bp, Homo sapiens
ttattccctgctgcagagcctgtggacccacagtctggcttacctttattttctccatctccagaatatgtctctcctccatacccccataaattaaaagtgacttaaatatataaaatggaagagagaggcaggataaaactgtttgataacttaatagtacaactggccagtctctcgta

SEQ ID NO: 185204 - DNA, 221 bp, Homo sapiens
agagggagatcgacgatgcagcactgatgaagggaggtctgaggtgaggcagagtgcataggtgtagggattagctttaacaaggtaaggaaggaactgtagctgggagaggcagaacaattttgattggacaagaatagtggatgattgagtttataagcaataaaatcattatttttcattgaagtcatatgctgtggcagataagggaagaacacagc

SEQ ID NO: 185205 - DNA, 274 bp, Homo sapiens
cgagtgcagcttgatgctgtaagtcgatctagatgatcccccaataaaacgccaggaatgagtccatctgctctgtgacctcccaacctgctgacttcccaacccacagaaagctcccggggtcctgggacaacacaggaccctctctctcacatttctaagtttgcttcctctgcagctagctacagtgtgtccaacaaaggcaaactcagagcgagtccatcctgcctgagcagatggccacaggcctggtcattcttagtctccagtctgt

SEQ ID NO: 185206 - DNA, 919 bp, Homo sapiens
gctgcagcagagcagagacaggagcggagacccttgagtcatccaacccctgttctgtgctacactctttttccaactctaaattttatgtgcaaccagcaagcaatcaagacaggaaaaacaagcaaagttttacatacaccgacaaaatgctgatctgtctattctattaataatacaaaatctcagcaaatgcaaatggcattgcatgcataattccataaaaagttaaatccacactaaatgtttccacctgaagtgacatttccagcgacttctccattaatatagttaacgctgtttttttaaagagattattctgtatctcctaaaaaaaatgtagatgctaaaaaaaaaacaagaataatatccaaaaagtgaattctatataccaccttttattctgaaatactgcacgtcgtagcacaagactaacccacaatcatatagttagaaatatttctgcccacagtctaatgcgaatggtttttcgctttcttttttctttttttccaggtctcagtgtaatactagcgctaaaggaataataatcaacctcagattcagaacatatgccaaactgctcaaactgaggctgaaggatcacttgagcccaggaggtcgaggctccaatgggctgtgatgcgccaccgcactctagcctggacaacagagcgagaccttgtctcagaaaaaaagaaaaaaaaaagccatctcattatcaaccatgtctatctttttttaaaagaagacaaaaaaaaaaaaacgtaattttaatccacttccgtagggaagtgacttcttagcactgactttagaataatgacacaaaatatcttgaagtaggaccttgaaaaatagtcatgaacatgtaacatggaagaaacaagtttcagaaaatataaatacagggggccag

SEQ ID NO: 185207 - DNA, 301 bp, Homo sapiens
tcaggatacaaaattaatgcacacaaatcagtagctctgctatatactaacagtgaccaagctgagaatgaaatcaagaactcaaccccttttacaacagctgcaaaaaaaaggaaaaggaaagaaaaaaaagaaaatacttaggaatatatctaacaaaggaggtgaaagacctccacaaggaaaactacaaaataccactgaaagaaataatagacaacacaaataaatggaaacacatcccatgctcatggatgggtagaatcaatatagtggaaatggccatactgtcaaaagcaat

SEQ ID NO: 185208 - DNA, 528 bp, Homo sapiens
atctctcagttctgctccacagatctgaggaccccacaaggtgctcccgggcatggtaaacagtgaaatacattgtatcaaacagtgaagggagaaacagcctgaagaatccactcatcacttttacctgctttatatactgggattccaaaagtgcatttggagaaacaaaatgagttctgaagctcaaataagtttgaaatctaaaagtggaaatattttattgtcttcaaattacagactgattggcttattgaacatctctaccctggtttctgttcgacaagttggaggcctaaatttcccaaaataatacagtacacaaggagcaagctagacttagggacagttaatctggtgctgatcactgttggcatgctgcaactcatcgagatatttgtcagcctattatcagcttttgatttaataaacttaagctatctctaggccaaattgtagatcctcggtaggaatgcaggctgttaatgcctccccatagccttcgtctaaagagcactgctaaaatca

SEQ ID NO: 185209 - DNA, 297 bp, Homo sapiens
aacaaataggcagaaaatcagtaagaatacacaagaaattaaaaacaccatcaactgccttgacctgtttgatgtttacagaacactattcccacttggagaatgtgttctattcccacctggagaatatgtgttctttaaaacatatttaaaacatacaggaatagagtcctgtatgtatgttctactttatttattaaagtagaccctaatctggttcatcaaatgagtttcaaacattttcaaaagattgagatactacaaaatatgcttcttgtttataattaattaaattag

SEQ ID NO: 185210 - DNA, 465 bp, Homo sapiens
atgtttgacagctccttccccaaatttcttttggaaatcttcaaaattcatcagggtttagattgttgacctgttttgaaaaccctaatttttaagttttcaatcttttaagccttggaaaggataggcatttaataaaagagaaaatagatgattttatatgtatgagaaaatacatcgctttaaatttactcgtgagattcaccaatgatttctgaacaccaaacattggggtggcccagtgacttaatcggagaaacacagacactttgaaaagaaatgtgggatttaaaaacctgcaaaactgagtctgtcattctttaaaatgccatctcaagtcacaaaataatgatgttaaaatctgaaaccatatgtgttttgaatggtttaggttctaaagaaaggtacaataatgccagtcttttgggtttgtacatgatttgtttctttctcacacatctgtca

SEQ ID NO: 185211 - DNA, 598 bp, Homo sapiens
aaggagagggccactgttgtggaagttttacccactccatacttttgtttggaaatgtcactggtttgttagaatatccatggaaaccacattgaattgacagataatggtcctttggtctgtattttcatccttatgtttattcttgtagaaaacaatgaattcaattcactctgtctctcatcctacatttattcctctgctgttttcactgaatctcaaaatctttatatacaacatggggcctaagaaggatctgaagagttgttatgatttggccatatcctttcttgactctcatacaaaaggtgaggaaaaaagaatgtcatttagagtggctgtgtttttcctggaccatcttgtacaagaatccagttcctgctgaaattctgacaacccttgaaaaagctaaagcctttaacccaagttaattttcttgctttgctaagaatgataatcttgtcataaatgctatttaaaattttaacatttgagctaaagtagcacataggaggtagatttttaaaaaaatgaaatgttattatctaacattttttataacttgaaagtgaatgagcatattttgttctaaatctta

SEQ ID NO: 185212 - DNA, 446 bp, Homo sapiens
attactgaaaacaaagtattatgaaatggataagtagtgcagttaagctaatagtgataatctctcagttatttcagctgccaatgaatttctttgtgaaatcatattcaaagttttagaaaaaatgtcgaaggtcctgttcaagcttaaaactatacttgggcgggcacagtgtggctcacgcctgtaattccagcactttgggaagccaagccgggtggatctcctgaggtcaggagttcaagaccagcctggccaaaatagtgaaacccggtctctactaaaagtacaaaaaattagctgggcgtggtggcaggtgcctgtaatcccagctattcaggaggctgaggcaggaaaattgcttgaacttgggaagcggaggttgcagtgagccgagatcgtgccattgcactccagcctgggcaacaagagcgaaactctgtctc

SEQ ID NO: 185213 - DNA, 154 bp, Homo sapiens
caccgcgccgggcctgatttcagtttcttccagcccttcctattgttaacatgggggttgtgttgaagaatataaagttacaaagtcaaggaagtaggaaacatttttacaagtattatgtagccatcttgtggagcgtgtggtgaggtaggct

SEQ ID NO: 185214 - DNA, 391 bp, Homo sapiens
ggcggccagaggatccccctctctccacactggtcgggtgtgagggttatatgcaaagtcgtggtatgaacaaggttcatttcctgaagaatcaattttcctcaatgacaaataaattaaatctcttttatactgcaatatctattatgccctgaatataaaatatttgcatgtaaaaaaacaaaagtactagaaataacacatgaatgaatttttatataatatagaggaataatatggcatttataaaatttggtaagcatgataagaaaccatgcaaaagttggctagatcacactattaaaacaaacattcatctgtatggcaaacacatataagtgaggttaaaataataaactgggccgggtggagtggctcatgcctgtaatcc

SEQ ID NO: 185215 - DNA, 216 bp, Homo sapiens
tcctctaggctttccaatcctcactattcttctctatcaaagctttttctatccaactgccagtgacataactttagcccttccaaagaattcttcctttcctcactaatacttcatgtgtaatctgatccactttatcaaagtaaacaactggcactgcctaacaatcctagcacaaacaatcctaacaatcccaaggcaaaatcgagtagcaat

SEQ ID NO: 185216 - DNA, 528 bp, Homo sapiens
tgcatgttctagctaggtcaattaggcaagaaaataaaataaaaggcatccagttggaaaatgaagaagtaaaactacctctatttgaagatgacataatcttgtatttagaaaatcctacggattccactaaaaaattattagaactaataataagtgagttcagctaggttgtaggacacagatcaacatacaaaaatcaattggatttatagatagtaacaataaacaaacaaaataaaattaaacaattccatttaaaatagcatcagaagaacaaaatatttaagattaaaatacttgtacattaatagaagtataaaatttatactctgatattacaaaaccttctgggttttttggtggaaaggtggccaagatcttgctctgtcacccaggctagagtgcagtggtgtgatcacggattactgcagcctcgacttgctgggctcaaacgatcctcccacctcagcacctccaagtagctgggactacaggcacgtgccactgtgctgatttgttaaaaaa

SEQ ID NO: 185217 - DNA, 527 bp, Homo sapiens
cttcagagatgggctcagtggggaggaacagcagatattatgagcaaaatacagtttgctacaagagggtagcttaggttgaatctgagaaataagtgttcgtagggctgataggtcaaggaggaacatgaattatctagacttaatagttattaacacattaccagcttgcattatcattcacttctccctttctggccaaattatttcaaagttaattctaaatatcacgacacccttaaatataccacatttctctaaaaagtgaaaatggattcttacataaccacaataccattactacgttcaacaaagttaatggtatctaatacgaaatctgtgttcaaatttctttgatttaaaaaaaatttatatatattttgagacagggtctcacgtctgtcatccaggctggagtgcagtggcatgatcatagctcactgcagcctcgacttcctgggctcaggtgattctcccacctcaaccttcctagtagctgggactacaggtgcatgccaccatgccag

SEQ ID NO: 185218 - DNA, 402 bp, Homo sapiens
cccttggacaggcaaatgccatcatctttcattgtttcctggactttcagcagtcacctgagcccccctccatgcccgcttcaaggaggcaaaggcagaacctgcagatggggcaggctctggggcccgggcactaagttcctctctggttttcttatctgctaagcatcaacacaggcttgggttggaatactgctaatggaaacaagttccagcttcttctgtaagcaaacaacattcctgaggtggaaagggaaggggggcccacccgcagtcttcagctcctacctcctgggcactggcagctgggaggagccccccactccttgttagcctggggagagtgagggcctaggtcgaggctgctgtaggttattagccctgggtgacagaggagccact

SEQ ID NO: 185219 - DNA, 298 bp, Homo sapiens
gtgctctctcacccaccccatgtgccatcttctggagtaagagggagtgctttcactgtgtgcaggtgtggctaaagagtattcactgtgtgcaggtgtgggtgaagagtattcaccgtgtgcaggtgtggctgaagagtattcaccgtgtgcaggtgtggctgaagagtattcaccgtgtgcaggtgtggctgaagagtattcaccgtgtgcaggtgtgggtgaagagtattcaccgtgtgcaggtgtggctgaagagtattcactgtgtgcaggtgtggctgaagagtattcactg

SEQ ID NO: 185220 - DNA, 292 bp, Homo sapiens
tatcataaattatggtgcaaccggtctgtactgttgtgtgattttctctagcaatgcatatctgtttaggtacaggcacagtaatgagagtaataactaggtttattcaatgttatagcaaaggagtttgttatacagacaagtgtgttattgaagtgaaagtggtaatggggctgatgaaaaggagataaattgaagactaaggaaggttgtaggggagtagttaatattagtaagattttgtaataacagctacttagaagagggagagaatgggagcagacagtaggag

SEQ ID NO: 185221 - DNA, 521 bp, Homo sapiens
gtcccttaggaaatgtgttctttacaggcatttgaaaactatagggaatagtgattggggtcagaaatggcatcactggggctaagaaaccaaagataaagtcactttggagctaacctttgtattcagagagctttgtcctaatcctgcttagaatttccacggcgtcttttcttcccttaagagaaatcaaaaggctttcacttttcccctctctgccctgtgaagacaggcattcaaaacctcgttttgcaggttaaggaaattgagttcatggtctaagatcacagtgaattgaacagactcaaaagcaagcatttaatctctctcactctctctcttaaatgtagttcttagaatgagaattctcagtggttttaagaaaatggtaatgtttgtactatatttaacccccagaaacagaacatcaaaaccaagacactttggcaatcgtcttatccaatgttctcattttaaagatgtggactctgggccgggcgcagtggctcacacctgtaatc

SEQ ID NO: 185222 - DNA, 702 bp, Homo sapiens
tcccttagctgtatttataaccatcttccacatcacctgctgttgctaaccatatactgtacaccactttcacactaccttctcatttagtactctcagtatttgtatagtgtattatggcacataaaggagattacatggagtgattaccatttgagtgaggcaactacataacaaaaaagcaacttggatataaacttgtaagatagagaacactcggctgggtgcggtggctcacgtctgtaatcccagcactttgggaggccgagacgggcggatcacgaagtcaggagatcgagaccatcctggctaaaacggtgaaaccccgtctctcctaaaaataaaaataaaaaaaaatcagccgggcgtgatggcgggtgcctgtagtcccagctacttgggaggctgaggcaggagagtggcgtgaacccgggagcttgcagtgagctgagattgtgccactgcactccagcctgggcaacagagcaagactccgtttcaaaaaaaaaaaaaaagataacactgttcttataaatggctaggaatgtcaagtcaagcaggcataccatcagtgtgggatacaactagtcactttggcggacatgggttttagaggaattaactaggaaggggtgtttcaagaaagtggacccacaggagcaaagacaggtactaccaaggctcatataggagatgataagc

SEQ ID NO: 185223 - DNA, 253 bp, Homo sapiens
catgaccagcctgatcttttctattatctatttagtctctatttcgtttatttctgctctaatacttattttctttcttctaactttgggctcagtttgctctttttctagttccttaaagtgtaaagttagtttgtctaattaagatatttctttttgcttaatgtaggcatttctggctgtcaactttcatcttagaactgcttttgctgtatcccgtaagttttggtatgttgtgtttccttttcgactt

SEQ ID NO: 185224 - DNA, 465 bp, Homo sapiens
ctgggtccttagctctactatccaatactattgaatttaaaattggtgctggatattggattttattatttgggcaataatatttaatgccactgaatttctagaattatcattaatctagagtgaaggatacagattacctcaaaaaaaaggggatggttcctgttaagataaaacatcttgaagattttcttttctatttcaataaaccgtcaagttttccttaaaagggttgatctaaaaataatttatgtggagcaaaaactcccaaaatccttctacaaagggagaaaatagaagccttagggtatattaggaaatctggtgaaaatttattctgagagaccaggtttctgttgttctctaacattacatctctatacaaatttcactgagcaggattcagacattcccactcctcctgagaaaattctatggccacagccttgaaagttaacatttcct

SEQ ID NO: 185225 - DNA, 173 bp, Homo sapiens
gacagatggatgttcatatctgcttctgcattcacactgtcaccatcttagggaaccccagggatccctagactatactttgagaacctctaggctaaatgattagttctgttgatccagaatgacactctttagcagtagttcccacacctattgtggcgtcagaatctctc

SEQ ID NO: 185226 - DNA, 137 bp, Homo sapiens
tcatcagatcctgtctactgcatcactccaacgggcacctgtcatcactccatcttaaacacgccattccgcaccccatgcctctgtctcgctgctctcctttacagcaaactcagggacagaatgcaaatactcat

SEQ ID NO: 185227 - DNA, 471 bp, Homo sapiens
ctgcatttgtgctacagtgtgtccaggagtggatatatttttaattatggtacttggagatagttgtgctcctgagtctgataatttgtttattgatattgtgcctgctgttttctgtttttcctgtgcaccccacttaagggtacagtggaccctctcagtctatctcccacattcccacgctgcagtctctgctgtgtcctaggttctttcttcacatctttattccaaatgattaattctcaccagttatttctaatctgctgttaaattgccaacagagacttctatttcaacagtcatgatttttacttctagatgctttattattttttttaagaagattcctggtaaattgtgatagtcttttgttgcctgctcataatccagcttttatttcttcgaacattgcgattatagtatctgaagtcattggaatgctctgttctcttggcctgccctcattcaggc

SEQ ID NO: 185228 - DNA, 265 bp, Homo sapiens
ctgatgtgcagcctcacattcaagtcaccttttgctggtgtctgatactgtagttgggaacagcctgaagcattgtggcacactgtgtaattaaaatacccactgggctgaagtggaaatagaaaggaaagagacatttcaaagaataattactaagactttgatcaaatactgtatattagggatatcctagcaggtcttatctcctctattagaatgcaaataccttcctgacagggcctatttcgttttctactgctccttg

SEQ ID NO: 185229 - DNA, 242 bp, Homo sapiens
ggcggacctctcctacggttcttatggcccctgtgcacaagccctacctacccactcagcctgtcccatcagctctttttgaagaaactttaaaatatatcatgaatattggtagagaaatagagatgataatctgttggggaaatgagtagaataccataaacaggagtattcagaggatagggctcttggaaattaagagtgtaatggcagaagtgaaaactaggcagattggaggatga

SEQ ID NO: 185230 - DNA, 107 bp, Homo sapiens
ctttctttttttggatgataatttccacagctctttggaaagacaagacagtcagcactagacaatactgtgcattgtaaaagacccacgatgtttcttcaataatg

SEQ ID NO: 185231 - DNA, 704 bp, Homo sapiens
ttcttcagaaaactgccagcccctaacataatatcccatgaatggtggatgattaataggtgattctagaaacatgaagctagaagaagcctctgagatccattcattcaatagtttaacaagtttttactgagtgtccacaatgcaccagacacttttctaggatctgagattaaggaggcgaccaagaaaaaagctgacccctgccgtctgatgctcagtttctagtgggtgagagagtcaatctataaatcagtaaagaaatcataaataaatgaagcactgggtaatgctaagggttgtaaagcaaactgcagcagagtcaagagctgagagttggggaacgcaggttggtttagccagtaatgtctctgggaaggggaacattggagcacaatctgagtgggctgaggactgggtcacactgtgacttagggttaaaacagtccaggtagaaggaagagaagtgccatgccctaagacagaagtgagcttggtgcattacagtgacagtacagaacccagggcagaggtgagatgcccaagacaggcaggaaggctggcagccaagataagatgctagagtttactcccagagtgaagggatgcagccatctgagggtgttgaggcaggaggtgaacaaatgtgacgcacttttaacattactctaactgccatggggaacaagagtggaagcagaaaa

SEQ ID NO: 185232 - DNA, 1248 bp, Homo sapiens
ggatttggttattttggaaggtctttttatttggcaggacagttttgctgctggtattattctcacttgacagctgttttcttcaggactttgattatgtcacacagttttcttctggcctgcaaaactttcatgaaaaattaactggttatctcataagattatgcttataaatgacacattattttcatcttgcagctcccaagattctcttgtctgtgactttttaaattgtgcttatatatgtgcttgttatataaatatctttgtgtgtattctagtttgttgagccttttcatttttacatcattttatcttacagtatttcagttattttttgtattttttccctccacaatttgttttttaatatctttcattgtttttgttgttattcccatttttctgatttttaatagttgtctgtgttcctgttacactagtggagtattattcaatttattttaaatttttaaaatatatttgtgcatctttttttgttttgttttgtttttgtttttgaggcagaatcttgctctgcattggccaggctggtcttgaactcctgacatcaggtcatctccccacctcatcctcccaaagtgctggaattacagacatgagccaccatgcccagcctgtatcttcattttttaatgcttgctttctgaaaattttataataattgatagggctatgttgccctaatattttgtatacattgtaatcttcaattgaaatttgaacattaaaaaaagctacctgtcagtgtttataatgcaactttgtcctggcaaagtctgagaccatttgtctggctaaagattctgagagtctttcagacatgttcttaggatgtgtcatgtctgaaattttttagggtttttttagttcattcttgtttcttcttaatagtcagtagtcacttgctacaactgttccctgtctctttgcagctgtagcatttacctatgatctcagtggactcaacattttgtcattccaaagtatcctgccatttgtttcagcactttatgtcatgggaaacagaaaccagtgtctgcaaaagcacctagaagccagaaataaagatgtatgtgttattatttctcttgccttttgaaaaagaaaccaagagttggcagtttacttctagaggcactatgttatatcggggaacagaaagagctgtgttgggtaaatgtaacagacttttctctctcttctgtgtggctctttgcattgtgc

SEQ ID NO: 185233 - DNA, 289 bp, Homo sapiens
attattatttttctaggtattttggcagcggggctagtaatcttacttcaagaaggctgtgatctgcacaagtcccagagacaagctggctttgtaggaggagagagaacatgcgagtttacatttgtttgctgagagaaccacatactttaggctcagcctgaggagcgactcactgtattcagggatggtcaggatccagatatgccagagtcagtgggaagcctccagatccctagtcacacagatagaacttaggcacctcggaagcaagctgctggattatgtg

SEQ ID NO: 185234 - DNA, 350 bp, Homo sapiens
aggaggcgctgcactccctggacttggatgatcttgagtgtgaacccctcctgaggggtggcaccttggccacctctctgaccttatccccatcctggctctggatgtgggtgcctcttgatcctgaatgtgctcttttagactggccttggcacgccctcccctcctgctcactcattcacctggaactttgcactcacaggttctctcctggccattatgtagtctcctaaagatgtatggaaaggccacaaaaaggctaaatcggagaaccaggttcttcacctggtttctgcctcagcaccctcaaggaatacagggcaccccatgaataacaatgttcactggat

SEQ ID NO: 185235 - DNA, 326 bp, Homo sapiens
gctaaatgttctttccagaaataaacatttgcctttatttttgccagtttacctgcttccaaattgcccttcccaaaggcagtttaaaatttatacagtttgaacgtggtttctacatgatctaaatgatagtaatctttgtatttcagaccacaaagcaagtactcagaaaatacttgttccaagaaccactgacttaatgatttagtaaactaccaagttaagagaaacaaacctccacagtataccatttggaagatatatatggaatattaatatttagtttgtgaactttttcttttggctgtgagtaagtctgaacttgg

SEQ ID NO: 185236 - DNA, 231 bp, Homo sapiens
  misc_feature (189)..(189): n is a, c, g, or t
gctaaatgttctttccagaaataaacatttgcctttatttttgccagtttacctgcttccaaattgcccttcccaaaggcagtttaaaatttatacagtttgaacgtggtttctacatgatctaaatgatagtaatctttgtatttcagaccacaaagcaagttaaactcagaatactgtccagaccanctgctatgattagtactccagtaggactgatcgggtcctcta

SEQ ID NO: 185237 - DNA, 308 bp, Homo sapiens
ttttcttatggctttcttggcataagacaaagaataggtcactctctggggaggaaacagctcttctcagcatgaataaaaccagagaatctcctcctcaattatggtgttagttggagtgctagaaatattgttgtgggtgtgactgacgttctaagtggatttgttcctagaaagttggagacattcgaattgtgcactctcctcttcctcagacacacactgtaatgctctcctttcttcctaaatcccagctcactgacggggcacttcagttagggaggtgttcggatggagggtggccctgg

SEQ ID NO: 185238 - DNA, 220 bp, Homo sapiens
acagcagtcacacacactaaaaaacaaggaaaagaaacaatagaagaataatcaacagtagtgcatttttgttttatttatttatttagagatggattctcacactgttgactggctggagtgtaacggcatgatctcaactcactgcaacatccgcctcctgggttcaagagattctcctgccttggcctaccgagtagctgttattacaggcacctgc

SEQ ID NO: 185239 - DNA, 351 bp, Homo sapiens
accttgtaatccgccgtctcggcctcccataaagtgctgggattacaggtgtaagccatggtgcccagcaacctctcactgtatttcaagttcaaatgtgatcaacaaaatacttattctatttgggaaaataagtattttggaaacagttaatgcctcccacaataaaacattcccacagctgaatcaacatttaaacttactattatctccacagagggaaaaataaacagatacaaacatcactgtgagcctaattggaactgatcatctaaaggcagacaaatagcaacagaagggacatgattgtggaaaatgtaaaaagaaagccctattggtttaaccctattc

SEQ ID NO: 185240 - DNA, 635 bp, Homo sapiens
aattcgtagacacagaatacagattagtggttgccagggcctggagggagaggaagatggggataaactgcttaatgggtaagaagttttactttggagtgatgggaatgttttaaaaatagaggtggtggttgcataacattatagatgtactaaatgccgctgttcgttttagaatgattttatgttatgttaatttcacctcagtaaatgtttaaatcaaatgaaaacaacttgctgtaggagatgaagaagtaaggagcaccccatctgagtgtgagatgcctctggggtttgtccaacacacagcccagccgaggctctgagggaggtcgtggtgcagccactgatgcatcacagccacacgtggcattcacacaagcatggtttatgacttgggtaattatccaagctgttccacaaacctggaggtcactcatcgtaaaagtctttaatcataaagatgtgtttcctcttcacagaaggtgtgttttgttctggaagggctcagagtccttgtccttttttccaattgggtgtcagagtacagtgcaagcaactgtatttgctttcaaatctttttcttcaccttttagcccaattttactgctttttaaaaagatgttctttggccg

SEQ ID NO: 185241 - DNA, 546 bp, Homo sapiens
tttttgagatgcagtcttgctctgtcacccaggctggagtgcagtggtgtgatcttggctcactgtagcctctacctcccgagttcaagcgaattttcctgacctcaggtgatccacccacctctgcctcccaaagtgctgggattacaggcgtgagccaccacacccggcctcctcttggttttaaaagccatgcatccaccaagcagatgcttctgtccctggaatcccagctttgcttggtgatcagaaactccaggggtatcagtcagtcttgaccctttggaggaggtcaccaccacatccaggcagggacagcgatttatgcttttccactgatacctgttctagaaccagagggggtcagccagcatggtgcactgagtccccagagcagggtcccaggtgcagcctgaaggatggaaaagacatgggccctgccctcagggagcggatgctctggcaggaacttaccatggtcatgcagacgtcagggtggaacaaaggaaggcgcattaataaaccgcaaatgtgaagtgagtagaa

SEQ ID NO: 185242 - DNA, 389 bp, Homo sapiens
atctcatgctcctctttttcaaacatttggccatttcactcacccccacacatcccactttaaaacagtgacaacaaccacttcctagtcactacactgccttcacaggggccaacccctctgatatgacgttcacctcccacctgctcctccctccctcacaccctcttcttcctgttccctgcatgtgccctattctctctcctcactatctcaactgcgttgtcctgtcctgtgcctgaaacaccctcccctgccctcatccccttgtcaatccgggaactcccactcctgctgtaagactgttcccaaatgtcacctcctctgtggaatcttcaccggtccgaggaggagtagggatgccatccaaagtgtttttacattcttgg

SEQ ID NO: 185243 - DNA, 122 bp, Homo sapiens
tacgcaaaggcatacagagtggcataacggacttcagagattcagaaagaggagggtagggaggtggggataaaaaactacacattggggccaggagtggtgggtcatgcctgtaatcccgg

SEQ ID NO: 185244 - DNA, 429 bp, Homo sapiens
gcccaatgacagcttactgcagcctccacttctgggctcaagtaatcctctcatcttagcctcccgagtagctgggactacaggtgtgtgccaacacacccagctagtttttaaatttttagtagagaggagttcttgctatgttgcccaggctggtctcaaattcctgagtttaagtgatactcctgcctcagcctctcgaagtgttaggattacaggtgtgaaccaccacacgtggccttatattctgttttttgacaattgccattctaatgagtatgaaatggtgtctcattgtattattgatttacatttctctagtgactagtgatattgggcacttcttcatgtcttttttctttttgagacagagtttcacgcgtgttgcccaggctggagtgcaatggcatgatctcggctcaccgcaac

SEQ ID NO: 185245 - DNA, 407 bp, Homo sapiens
atggagacaaagcgcgacctaattaattaaaattattttctagcaacagtgttgaactgtgttgtagattttactgtaaacaaataatgttaaatttcaagcctatcaagtctatatcatagacaatctcttgaagattccccaaaatttattatatgaaacttgttgctgatgagattcattgaaggctataaaccatgattcagaattggaatccaaagtgtgttactattcctgttactgttcaccctgaaaatagaataattgaagtttgcttttactcttgttatcaaagcaggctctggcatttccagaaacctgtaaaagccttgttgatatagctaacgtttggaaataaatcttaggtctgaatttacatttaatgattcctttctttctatccacct

SEQ ID NO: 185246 - DNA, 476 bp, Homo sapiens
tccatcctgccaggtttttttttttccctcctgagctactgctcctccgatttctattgtgaagaaaacccggctcctcttgtgagacaacggagcaagcgcgccaggtgtcccgccctttctgagaggggaggatgaaaaccaaatcgctgagactgagggtcccccaaagcaggaaggtccatggagaaccatgtcactgatgggtcaacattaaaggcactgacttaaaacgtggcctctgggcaccagtcctggggtggggggtgggcgcaggctactcccatctcatttctgctcacccccacgcgctcgctctcactgtggcagtttctggacctgatcattttgcccaagcaacttcagggaggtgactgccctctagctcctaagccaactgtcccttcgattttcttatggcagagactataatagttaatggaaaatgagtataaagatttaaaaatgtaaaaatc

SEQ ID NO: 185247 - DNA, 284 bp, Homo sapiens
tttctttgtagagatggggggctgggattacaggtgtgacccaccgtgccaggctctaatactttttaataaactctgcactccagcctgggtgacagagcaagactccatttcaaaacaaaaaacaaaacaaaacaaaaataccaatttttttgagatctattggtataattctcataccatagaactaattcttttaaagtacaattctatggttttaaaaagattcaaaatcttataaccatcactgctttctgattccagggcattttatcaccccaaga

SEQ ID NO: 185248 - DNA, 517 bp, Homo sapiens
ataccccttcgaagaaaaaggaggaaaactcccaattctcttggttctcacagtgtaaaatgattcttaccaaatgtagaacaaataaaaagggaaaacactaaaaccactaccgcctgagaacatctcactgggcttaaaagatttcaactcacatctgtaggtacaaatgaaaagtgtgaataaatattcctccccattcacattcagaacaaacatcagacactccggccttcattcagctgacagcacttgatgtggaagtctggggacagaaagtggaaagctgagccctgcactgtctccatatcccacacacaccaggccagctgccagcctgacgtcagagcaaattccacatttgcttgggggaaggggagtgtggttctctggcaaaagaattcagcccctccctacttcaccctattactaagaaggcagaaagaaactaaaggaaagccctgccctacccctccctccctgggggacgcctcctttccatcagcacctgcccctg

SEQ ID NO: 185249 - DNA, 354 bp, Homo sapiens
tgtgtgtgtgtgtgtgttgctattgaaaaatagtgctgtatagtctacgtctatctttttcttatttcttgtcaatgtatttttgggatagatgcctagaaaggaggattgctaagtcaaaagggtaatgtgcatgtagtttcgctaaaggttgccaaattcccatccataataagtgtgccaccagcaatatacgtgagtgcctctttcccaacagggtgctgtcaaactattggatgtttgccagagaggcacagcttggtttttgaatacatcggatgtaatcaggatgtgcagtctttttggttcctagaggctgactgggctctgagaagcatagaacatttcctcaag

SEQ ID NO: 185250 - DNA, 310 bp, Homo sapiens
agatatactagagttactcaataataattagcagttgccctggtaagctcagacttactgcttaaatcacccatatttgtcaccatcccctgcctgtaggacaataagatcacctgctttgtgctaatgaaaattgggacattttagtaattttataatccttttcagcttctgttgtaagggtagaagtgatattgtttgtgattatgctaaaaagaggctttttgttttgttttgtagttaccaaagcagtgagatagaaatcattctgggtttcgagcaaattggaaagccctgttcagtctatttt

SEQ ID NO: 185251 - DNA, 272 bp, Homo sapiens
cgtgaacccgggaggcggagcttgcagtgagccgagatcccgccactgcactccagcctgggcgacagagcgagactccgcctcaaaaaaaaaaaaaaaaaaaactaactttaaaaaatctagagcaaaatttgctagtacattaagaactttagtgtggaatttctttggtatagaaactgtatgagggacaggaaactgacctccaactctgtgatcattactctctgataatttggaaatatggaataaaattgatatgcctcagaaag

SEQ ID NO: 185252 - DNA, 347 bp, Homo sapiens
cccccaatgtgaaggtattttggaggtagggcctttgggaggtaatcaggtttagatgaggtcatgaccatgggatctccatgatgagatcagtgtcattataagaaacagaagaaagacgaaagtgctctctttctctccaccatgcgaggacagaaggagaatgtagcagtctgcaagccagggagagagccctcaccaaggaggtgaatccgctggcagtttgatcttggacttctcagcctctcaaactgtgagaaagaaattcctcgtgtttaagccacccagtctgtggtattttgttatggaagcctgagttaagacagctggttcactggggaatccac

SEQ ID NO: 185253 - DNA, 333 bp, Homo sapiens
gctcgctcttctggagctgagacactcatcttctcctgccctggcacatcaaaactccaggttctctgatctttgaacactgggacttaatccagcatccccttactgcctgaagttctcaggactttggacttggactgaacgatgctaccagcttccctggctttccagcttgtagatggcgtatcatggaatttctcagtctccaaagtaatgtgagccaattcctataataactctcttctctatctaatctattaatatttacatttcttattgtttttcatttacctggagaaccctaataaaacttcctgttgcatacctttaatg

SEQ ID NO: 185254 - DNA, 249 bp, Homo sapiens
gaggcatcaggagtggcccactggtgcaccagggtatggtttgcctgtgtgtttcaaggtgagcatttggtggttctgggtggattctcccagaaggtgctagaagaggacaagccagcttgagtctgtgggcccgagctggcagtctctgcaggaggcaggcaagagtgtgtgtgagggactgagctctgcactcggcatcgtgacccttgactgtgctttcagctggttgccgtggctgtgattgtg

SEQ ID NO: 185255 - DNA, 391 bp, Homo sapiens
ggtggtttaagcagtggcagttttgcacacaatagcttgagtgaagaaaaactgagaatgaagcaatcagtcatttgggcattatggaaaatgggagactaaaagggctttgtatgtcagtgggtgtgtgtacatctttgcatggatagacttgataacagtatatttaaattgtgttgctcttttgtatatctattgcaattaatagacatgtatatttatttctagctagaattgaaaggaaaatgggtgggatatcagaaagattacagaattcaggtttaaattcaaacagtgctgtttatcacctgtgcagtaatagacaacatattctctcaaatttggtgtcctctcttgtaaaatggagaatatgccactttgcagtattgag

SEQ ID NO: 185256 - DNA, 520 bp, Homo sapiens
actgccctttcactcttggatttcttggttgaccctccgtattttttagaggtgagatctcactatgttacccaggctggagtgcagtggctagtcacaggcgcaatcataacgtactaaagccttgagcgcctgtcatccagcgacgctcctgcctcagcctcccaagtagctgggaccacaggcatgaaccaccacgctcagctcttcactctccctaattttgagaaaacatacttttttccttctagtaatgacctaataagttttttctaattacgaaaaaatgcacttttttcctcctcatcattgcttattggcaactctcagccttttaaaggatattaaatagcagacaaagaggtataaacttgtttgtttgtttgtttgtttgtttgttttttagatggagtcttgccctgtcaaggctggagtgcagtgacgcaatctcggctcactgctacctccgcctcccgatctcaagggatcctcccacctcagcctccctggtagctgggat

SEQ ID NO: 185257 - DNA, 265 bp, Homo sapiens
gaggggatgctgagggtcttgcatctagctaagagctgagctggctcttaaacttgttttcaagccaggacttacctgactttcttaggaaagtaatcactccatagacaaggataggtttttttcacagagcaatgatgttccctgtggtccctatgtagggtggtaaggaatagggctttgggatcctacagaccagggttcaaatcctggccccaccacttgtaagttatgggacttcagacaaggacttaaacattctaag

SEQ ID NO: 185258 - DNA, 589 bp, Homo sapiens
tggacatgggttctcctgtgtttttatgataaagtttaatgataggatactgtgaattctatttgtattcaacctggagttaatccataacagtacaaagatctttggggggtaggcttttcctcaagaatgattcttaaacaaatactgcttaaaggcttagagagtgactgagtacttcactctgaagtacttgaccactctacactcatatttacagctgaaagttctgtgttttaaccactatcaaattaacacaggtaacaatatttctttggagtccaaaaccactgctttggagaactgaggtgggaaaataatccagatggctaaagttcttcaaaaatttatatatttttcttttttgagacagggtctctctctgtcacctaggctcgagtgcagtggcacaatcacagctgactgcaaccttgacctctcgggcttaagtgatcctcccgcctcagtctcccaagtagctaggacagaggtgcgtagcaccgtgccccactaatttttatatttattgtagagatggggttttgccatgttgtccaggctggtctcaaactcctggactcaagtgatc

SEQ ID NO: 185259 - DNA, 287 bp, Homo sapiens
gcctggctgctgcccctgttttatgagccgcatgacaccacgctagggttggcacctggaggcagaaccgcattggaaacggcctttcctcttactggtgtttggcttctgctaatcactccatctcgtggagcttcaatttcttcacttctcagatggggataaaaatctccaccatacaaggatttgctgaaaacaagagccagcaggcaggtagcacttgctctgggccaggtgctgttccgacatgccctaatttatttatacctcccagcactcctgcaaga

SEQ ID NO: 185260 - DNA, 481 bp, Homo sapiens
tattccaattacagcaggaaatttttccagcccattataacctcagctacagttgtaattaatgcctctagcctactagtgatctgggcttcaggggcttttcagtttatatttgggtgcaggtaggggaaaactagggagaggatggggtcagggttacgtgtgaaacgtaacttggcaaatatgtttaaaaaaaaaaaacaagggctagcttgaatccttgtctctccaccgtatggcacactgcatctcaggacctggtgtgttattgacaaaagtgttatctggcagtttgtttagggcttttaattatttttgaaaatgacttatatgtatcttaatgattactccttgaaacagatcaaaattcttccttggcaactcttcttccttgcttcctcccactagttggatgacttctcatagcacgcagtgggtctgatggccatttttggggattttattgagaccaaaaaggaaa

SEQ ID NO: 185261 - DNA, 581 bp, Homo sapiens
tggaagatgagaaatgtacaggaaacttcatttttatataaaactgtgtgacatctgaaactccaaatacacacaaataaaacccttcaaaaatggtgaattatcaagcagcgattggtgagtggagaggggcacggctgtggatctcagaaggaaccagaaatacacttttcgaagatgacgggcacagcctgagttgcagaaccaatccttcagatcaccagtgtggttttttgactggagcttctgtgcctattatggttctgggaagcaggggatgtcatgtttaagtaggaatttgccaggatctgtttttgtttaacatggggaataagagattttctgcttggaaaacctccagacacatttaaccattctcagggaggagtgaaaggttaacatataggcaaaatcctgtccacaagctgcttccatgcttaggagacagaaaaatggccatctcctatacctaccagttgctgacccaggaaaaactggctatcttcaaagaagaataaagaaaaaatagcagctattaaaacagccactattgttatatgaataaataaaaaaaaagagag

SEQ ID NO: 185262 - DNA, 367 bp, Homo sapiens
cacacacagacgcatgtatacactcccacgtatgcatatacacaaatatacatggacacacacacacacacacacacacacacacacacaccccccaccaagctctgggggagtcatcatcttggatacgaatctgattcctggcttctgactgctctgctgttgtttattggcttgttgttggcataagaacatccaacaaggatgccacagaaattcgagactttccaagagccaagaacaaccatggccctgaaattgcaacagaaatacagctgctggacccaacattggatgtctaccagttcgttcatgtcagagttttgtttctcgggactttcgcttagtcctaaagacagagcacaaa

SEQ ID NO: 185263 - DNA, 438 bp, Homo sapiens
ttccatggtgtatacggcgccacattttcttaatccagtctatcattgttggacatttgagcaggttattttctattttgccatcttggctacaccacccagaaaaagctctttaaaagtttataatcctggaggatatcactgtagtcattatattataatacagtaattgctcttcttagtaatgatcctgagtcatcaaattattttctgtctggcctaaggactttttttttcctcccatggcagtttattggactttcctcgttatcatgtgttaacttcaggaggaaaacatcttaccatcaatgttttttaaaataagaaaaccatggaaaaccacaaaaaaaaaaagtattaaagattctgtggtatttttgccatcatgttgtcaatcccatctctagggaatgtttgcaccttcagagtaaccgatga

SEQ ID NO: 185264 - DNA, 291 bp, Homo sapiens
ctcttagtgtggcgcatggagttctagatccattgagacaagctctagacagtagcatgcagtcccacggctctttgcgccgttgagggtttgtcctggagaaggcagcccatttttctcctctgccccggcacggggccatgacccactgcagggtgagaggagtggagagtggtgcacatcagtagtccagccaccagtggacagagtagtacttggagccagttctccatgtctcacacatagtgagaaaaatcactgtgacatgatgtttaaccttgacccaagctg

SEQ ID NO: 185265 - DNA, 1024 bp, Homo sapiens
ctcccagcctcgtttatcttcaccacagtacagaagggggcccctctccaggcctcaccacttaacttttcttgtacatggaaagacaagcctctgctagaggcctggcaagggttccccttcagagccagccagtgctctgctgctgtaatctccagggaccctgccggccacggcccccatgcagctccctccctcaatccaaccctctttgggcttatcaccctcaaggtctagagtgcaccagggttggctgctctgccaagtcctgttgagactccaaaagcatagtctgtctttattagggtgaccttcatatcagactcccaggtaactcaagatgatagctttgcaatatagtgcctccttttattcctattgtgagtttctccgctttcctcactagactgagagggtcttgagggtaggagctttgtttagttatctctctatccctggcccctaagacactacctggctcagcaaaccaacctttgagacaaagcaacattataacactacattcatatagcagatcatttcatgacccacattctccttcctttttacgaagaaatgggctcaggatgtctgtccagcattatggagtgaacgtcagctccaggaagcagagacttctggccctttgttcaccatttccccagaacctagggtggtgactcacctataagtgctcaaaaaacatgtggcgaatggaggaccagagctaggctctgaatgaggcctcctggatctcacgcagggatggagagtaaggaccagcccctctacctcatgctttcttcctgctatctcgtaagagcccaacatccttctgtcctgagcaagccacaagctgcagccctgccttgacaaaatggcaaatgccagcccctctggcagcatgacaccttggtcctgtgtgctgcagagtgcctcatgtgttgaactgtgtgccctcagaagcatgccatgcccccgctctgctggagcagtggcagatgtcacccttcctagataaatc

SEQ ID NO: 185266 - DNA, 252 bp, Homo sapiens
aggtgcctagaaggacatggctagtaatggaggagcggagatgagctgagagaggcattgagacagcaggtggggcttgctgaagaatttcctctcactgagatgggactcctgaagggttttaagcgcagcattgacctggtcttacctaggttttaacagagtcgctaggctgctgtgttgagaatagccttttgggagtggggctgaagtagggagccagttaagaggcagtgggggtggtctgaggga

SEQ ID NO: 185267 - DNA, 145 bp, Homo sapiens
atttagaaatatttaggaagtggatttgacaggcctcagtgattcatttgatgtggtgcagggatgtccaatcttttggcttctccgggccacagtggaagaagaattgtcttggaccccacataaaatacactaacgctaacgg

SEQ ID NO: 185268 - DNA, 207 bp, Homo sapiens
caggagaatcacttgaacccagaaagcagaggttgcagtgagccaagatagcaccactgcactccagcctgggttacagagcaagactctgtctctaaaaataaaataataataataataatagttgatatctacttaatcacaaatggtttataagtttaaagcatgcttaaaaacagagactcacaaaaccagaattttagatat

SEQ ID NO: 185269 - DNA, 599 bp, Homo sapiens
gcaaagctgccatacatatggtgtgtctgccagtaaagtaacctcccagcagcactcaaaaacccactgctcagacactacctatcaattagaagccaagcaggaaaaaaggttatttgaaggcactggtttcaaggcaccagtttcaatttgatgatttctcattcactctgctggctagaatcaaagtagcatattgaaaatccaggtatttgaaatagcagtatttaaattttttgttccaagtaactcttctatagataagagttgtattattcagcctgagaaggagaggttacattttatgctttaaaatcagactactatctgcaatcatcatgatgaaatggtattcaccatgcttgcacatgtgtgggcttctttctggatctatgcaaagcaaagcccacattgtcttttccaatgggttggaagccaagcactcacactgaccacatgcatgccactgtgacaacagagaccatcatcagctccacctttggagctgatgtgagagtgaatgagactgactcactttgacatcaccctgaaagtgtctggcactgactggtgctctttctccatccagaaaaacctca

SEQ ID NO: 185270 - DNA, 643 bp, Homo sapiens
atttaaaatatatttattaattcatttaaaataatccttagtaaatttattacattaatgtaaataacaattttatgaaaagtaactatatttttccccaaaatgtgataaatggcattgttttacattcttgtaaatctttaatgtctagcttatagaagccagctagattcttatatctgcttttacgttcagtctgttgtgacatgttgttttggttgaagtgtatgaaaacaattttgcctcacacaggtagctggaaaagggaggagtattttaatagtattttaaaaataattgttgatattctcatttgatactatgccaaaatttgacaaatgatactgttttcttaaagataatatggaattcaaaaccatataaatgaacttttagtacttgcattacaaccattggtctgtcgtgcagtttaaatagataatttccccatgcatgattttgtgataaaatgcatcagtcatttggaaaatactggttcactggatgatacagatcctccaaaatattgacatatttcattatatatatatttttaattatattcattaatatcaccaccaatcccatgagaatatttctcaggtattgagaagccgtcaggctcagaatagcacatacaagt

SEQ ID NO: 185271 - DNA, 309 bp, Homo sapiens
ctcactgcaagctccgcctccagggttcacaccgttctcctgcctcaacctccggagtagctgggactacaggcgcccgccaccgcgccccgctaatttttttgtatttttagtacagacggggtttcaccgtggtctcgatctcctgacctcgtgattcgcccggccctgtgtgtgcgttttcatgtgtgtgattgggaaccttgagagatgtatctgaagtaatgtaaaaataagagtctcataattcctggttaatgctggcgtattgttgtcacctgccaagtgactgttaggcaataagactag

SEQ ID NO: 185272 - DNA, 366 bp, Homo sapiens
tgaattatctttgcatcttaccatctacagccaattctgcaatggactccatcccctctggcttcccccaagggctttgctccttcagcggtctctctctaatggtctctctctctagtggcttattcctatcagcagaaaacatgctgtaataacttccttcagccagaatcccatttcagctacccttccatttctctgttctccttcagagcaaacttgttgaaacagttgtctgtcctcataatgttcccatcttcagtttcttgaactcactccaattggacatttattcacactgctctactgctgttcctctgtcattcaggttactgataatctccacttactaaatccaagttcgta

SEQ ID NO: 185273 - DNA, 415 bp, Homo sapiens
agttaacgtggaatggttactttccttcaagattcctttagctgccattttcttcaaacagacttttttagccagaaataagccaaagcagcaagtcccctcattacttgtctctcttttgtgagactgaatttccaacaaggcaattcaataatttttccgatgttttgcctttagtggagtgggatttccatctgaagtttgcaaaggctttcatcactcctctgtcttgcctgtccctattaaccatctggttacaaggtctctgaggcagtcccagggtaacattttgtttttctttcatttcactctcctgcagctgcttcctccatactccaccctgaggtttgtggatttccatgcatgtgtataatttttttgatagatactgcttctcccctagcccttccatcag

SEQ ID NO: 185274 - DNA, 485 bp, Homo sapiens
gggtgtgtcaaggcaaagaagttggagattgaagatgtatgtgcttgagcgaaactctagtagtaatgtctttgtgttccaaagttattggtaaatataacagtagcaaagaaccattttgttgcactaattaaattagtagtcttgaggattagttattggagaaggatagaggtgatctaatgtctctgattttgctaatcatcttgatgtagtagaattcctttatatagcatttggtgtggtggcattgtcgaaacagataagaacagctttttactaggtaataattgttttgtcatagagcatttgatttaccatgtactgaataattagcagttttatagttggggtcctattcccttttttcttttattttttgtttttaagagacggggtctctcttgaccatactagactcaatcacctgagctcaagcgatccacccacctcagcctccgcagtagtgggacaagaagcgtgtg

SEQ ID NO: 185275 - DNA, 712 bp, Homo sapiens
agaggagagagcaagatagaaacaggtcctgagatgaggtggcggcatacaagctatctcacacttctgcacccttccaggtgcgtttctgaaatgcatcaatgctgtgagatctacactgacttcagggatgtggcaaaccccctatttcttgtaaccagccagcgacagtcattgtggagccctgcctgtgccccaggcagccctgtgcactaagaaagccaggcctgggagacactgacttgtcgtttgcctccaggcgtttttagttgtaacagactagttcttgtttcccatcacctagaatctgttgatctgtctggatcttagttcctgagtctcctgctctgcaagacgcaccctgcacatgcacgctcacgtggggcacacacacccaggtgcccatcatgccagcaggtgcacagttggagaaatcgactccccagaccagactccccagagcgcggggagcggccaagtgtcctcgcacaaactggggtggaattgatacaggggccagggaggtccctaaacactagtgggaccctgaccctagccagcatccaggctcttgacactgttgtgagaaggatttcaaggatgagtcagaaaacagtgaaagtacaaagatttattgcagagtgaagagtacactcttgcaaaaagaaagtgtgggggcagactcaagagagccacagaatggggtttgggg

SEQ ID NO: 185276 - DNA, 269 bp, Homo sapiens
atcaacatccaggaggccttaagtaaatttcagaaaccacaattctttttatattatgttttggcaagttcttcatggaaaatttcttgagaatcatcttatttttttccagataaaatcttttcctcttttcctcttaggttaataataaggtaaaatacagaaataatttcaaaagttaaaaataattgagtgtaattcaggcaaatatcagaaaataatcaacagctaatgtgttaagcagcagttatgtatttagcactgcactg

SEQ ID NO: 185277 - DNA, 668 bp, Homo sapiens
cagcctgggcaacaggacaagattctgtctcaaaagaaaataaaaaaagaaaaagaatggtagcataacagtttccatttctaattttattgcgaaagtaattgtggtttctgccataacttttagtaagcataattaattaatgccattaaaagtaatggaaggccgggcgtggtggctcatggctgtaatcgcagtactttgggaggccgagatggacggatcatgaggtcaggagttcgagaccagcctgggtaacatggtgaaaccccgtctctactaaaaatacaaaaattagctgggcgtggtggcgggtacctgtaatcccagctactcaggagactgaggcagcaggattgcttgaacccaggaggcggaggtcagaggttgcagtgagacgagatcgtgccaatgcaccccagcctgagagacagaccgagactccatctcaaagaaaaaaacaaaaaaaggctgggtgcggtggctcaagcctgtaaccccagcaatttgggaggccgaggcgggcagatcacctgaggtcgggagtttgagaccagcctggccaacatggagaaacctaaacctctctactaaaaatacaaaattagccgggcatggtggcgcatgcctgtaatcccagctactagggaggctgaggcaggagaatt

SEQ ID NO: 185278 - DNA, 585 bp, Homo sapiens
ttgattctcaaccccaatgccatgttagaatcacctgaaggacttttacagctcactcccagagattcagatttagttggcctggggaggggcccagacactggtgtttttcttttttgttttttctgagatggagtctcgctctgtcgcccaggctggagtgcagtggtgccatctcggctcactgcaagctctgcctcccaggttcacgccattctcctgcctcagcctcccaagtagctgggactataggcgcccgccaccacaaccagctaattgtttgttatttttagtagagatggggtttcaccgtgttagccaggatggtctcgatctcctgacctcgtgatccacctgcctcagcctcccaaagtgctgagattacaggcgtgagccaccagtcatggcaaagaatggacaggattttgtgcttgattggatgtgggaggtgactgagaggaagattcctagatggcaaccaggttcttgccttgggtgaatggtgagatgatgacagagatggagaatagaagtgatggaatagctttgaggagagttcaaaaatactaggatctgattgagaca

SEQ ID NO: 185279 - DNA, 548 bp, Homo sapiens
ccgggggacccacgtcaaactatgtccccaacttcatcacatggaggtgagtggcaggggaaggtcttcatgtgtttcctagttcatcaacatcatttttactataagcacaaggcatctttttatactctccatccatcttgttattggacaaataggaccagtggatgaagctcttgtgggagctttcactctgagatgcacaaagctgatgtgcatctcaagaaagaaatgacaaaataaacattgaattctacatgtatctcataaagaataaaaataattcaccgacattctgcacatttttcaaagcaaagggctaccctgaggacacacatgacctgcactgtcgggttgctcctgtgtgcactgagtggctttccgcagagaaaagcagagggcccttgtgtgtgggcttctagtggcatgtgagaaactgtccagaattcacagagaagaaagagaatgggcagcgggatacatcaataatataatagctgagaattgttcagtactgaacaaaaataagtaaagtgattgagaaaaag

SEQ ID NO: 185280 - DNA, 344 bp, Homo sapiens
gactgtgccactgcactccagcctggacaacaagaatgaaactccatctccaaaaaaaaaaaaaaaaactcctcattttccatcccagaatgaggggcacagtaagaactgaacccccaggtaagaggtacaggattttgaaataggatatgcatataggggtgctgttttcagggttgagtccaggagctgaggtgacatctctatttttggcagtggctttggaaactttaggcgacagcctccagagccactactctgctcatcacagccttacactccaaggccagatgagccctctctgggatgctgcaggggagtcatgtttatctcatttcaagtca

SEQ ID NO: 185281 - DNA, 531 bp, Homo sapiens
atcgctccaaacagaatctctggtacccactcagtggtaactccatattctcccctattccctggaagcccctaatctacgttctgtctctatgaatttgcctgttctacttaggtcatgtaagtggaatcatacaatatttgccctttcgagtctggcttatttcactcagtatacatttttcaaggttcatctatgttttaacatgtatcagaacctcactcttttcatgaccaaatattccactgtgtagagactacattttgttacccactcatctgttgatgaacacttgcattgtttccatcttttggttattatgaataacactgccatgagcactggcatacaagtatctgtttgagttcctacattcgattcccttggatatacacctaggactgaaacagctgggtcatatggttttatgtttagctttttgaggaaccaacaaattgttttccatagtggctgcatcatttttacattcacaccaggaatatatatgcatattctaatttctctacatcc

SEQ ID NO: 185282 - DNA, 244 bp, Homo sapiens
gaagatagagaagtgaggttgttggataaatacataactccttcctcaactctggggaaatgaataggtaggaacagaggacaaacactagtctataatattgtccctgttgctatgtcttggtaatgatatataccgtgtctggtccaacagtctatatggagtacttactgtctggggcaatagtatctataggaggtattgagatgtagctcaataattgatacttgtgtaagtaatgatg

SEQ ID NO: 185283 - DNA, 166 bp, Homo sapiens
atgtcacagatcacaccactttcaacaaccaagtcacataactcagagcacaccacctccaacaaccaaatcagaaatcttacagatcacaccacctccaacaaccaaatcagaaatctcacagatcacaccacctccaacaacaaatcacaaatgtcacagatca

SEQ ID NO: 185284 - DNA, 359 bp, Homo sapiens
tttccaggacaggatgaggcaccacgagaacatcaaaaatcccacccaaaatctcccaatacctgggagaatttggcttcctgaacgtggtgtccaaggtacccaatggaaacataaagagacagccagtttctgtgctatcctgagcactctgaactcctttccatcacaaggaacaaggggctgacatggttcctttagagctgctcagttgtaaattctagaattgaaaacccctgagacctcttcattcctccctcaccacaatcaggtcccactggataaaacctgaaaaccaacaaacaaaagtggcatctgggtagggttgtcaaatcaagcaaataaaaatataggacacc

SEQ ID NO: 185285 - DNA, 447 bp, Homo sapiens
cagcctcccatgtagctggaactacaggcatgtggcattgcatgtggctgaaaacatttgttaatgctgacctttgcaaaatactgccaacaaacatgtaaataaaatttacaaatgagtttcaaacttctgaaccaaattaattcaatctttaataccaacattatttatgaagtacacagaaaaaaactcattttgttttcaattttatttttttttttgagacagagtcactcttgtcacccaggctggagtacaatggcatgatctcagctcactgcaacctctgcctcccagatttaagcaattctcctgcctcagcctcccaagtagctgggatcacaggtgcctaccatcacacctggctaattttttgtatttttagtaaagggttttaccaagttggccaggctggtctcgaactcctgacctcacgtgatctgccta

SEQ ID NO: 185286 - DNA, 270 bp, Homo sapiens
ttaatttatttctaagcttaagaaagactcattgcaaagaacattattttaagcacatatatatatatatacttttactaactgcattctatttcattatatgaatataccataatttattaaccagtctcctgatgatgggcactgtggtaacttctagttgttttctaatacaaacaatgagttattgagattatcaagtcaaaattaatgtcgtttaagtgctcgactgttattaccaaatagctttccaggaatatctcagtagtt

SEQ ID NO: 185287 - DNA, 507 bp, Homo sapiens
ggaatcaaccttctgccccttaggtcaggaaatagtcttgccaatgctaagaaggagagcaaagtttttcaaaagttaaggctccctctagggcaacatatatgacgtgttcagataaggctttgagcattagttctgaccctatcccagctactccagcctgtacctactcctcagagaaggctgcattagaaagcttcatggggttctcatggaaagagggtggctagggagagaaactcccacagtcttccatgacaccatgtcttccaataataacggctaacatttattgagcttttactatgtgctagacactattctaagtgtactccctaatctaatccttatttaaaactctctgaaggtggtactatcattatctccactttacaggtggagaaacggagacacaaagagatcaagcaacttacctagagacatacaaggaataagtaacagtgccaggattctagcaaaggaagtcaggctgcagggttcatctct

SEQ ID NO: 185288 - DNA, 496 bp, Homo sapiens
cctccagtcatggtcagtcctgagcttgcctggccaagcacattttgtacaaacccactgaggctgccccatctcaccagcagggtctgtcaggagaaaagcagcatagaacagctccccatgcttgagcaggacagtgaggcctatgtgaccaaacccctgggagcctctccgtgtccctaagaaagccctccatctccccactaacttgtcttcccccgtgtacctgggaagtctttggagataaatattttgtgaaatcacctccccaaaagcttagatttgttgttttggtaatcagctgactaatatttcactgttttcctgcaattactctgggtcaggtgcccaagctatggaatgaaagcaggaactcacaccccactaattgacccagaagatgctctattggccagggcacatgtcgtgccacaaggcaagtatggtcctgcccatcctcactgggcagacaaacaccagagctggaggacacagt

SEQ ID NO: 185289 - DNA, 156 bp, Homo sapiens
ctggactcaaactcctggacccaagtgatcctcctgcttcagcctccattgtagttggaattataggcacataccaccgcacctggtttattatgaagtttcttactctaaggaaaatgtcagtgaaagttttatttcatttatgttttaacccac

SEQ ID NO: 185290 - DNA, 157 bp, Homo sapiens
aacccaggagacggaggttgcagtgagccgagatcgcaccattgcactccagcctgggcaacaagagcgagactttgtttcaaacaaaagaatgtatttaggttactagctgtgtcagctagaagtccaaatgaaccaaagaattatgaaatagctt

SEQ ID NO: 185291 - DNA, 900 bp, Homo sapiens
ccgggtggatcacgaggtcaagagatcaagaccatcttggccaacatggtaaaaccccatttctactaaaaatacaaaaattagctgggcatggtggcatgcgcctgtagtcttagctactcggaggctgaggcaggaggactgcttgaacccgagaggggaaggtttcagtgagccaagtcatgccactgcactacagcctggcgacaaagcaagactccatctaaaaaaaaaagaaaaaagaaaagtcctatttttaaagacagcatgtgttatgaaagaaagaaaagggctttggtgtcaaacagacctgggtttgaattctagagaaagacattccacaggaccagagcaagaaaagattctggaggttaaaaacctgacatggtccagaaacatatatgggtagtctacttggctagatggtaaggtataagttgattagtttaagaagtataataaaagcttgttgttggggggcaggcagtcagggcatcagagaaattattttgtccaccgataataagatggactgaacatgacggcccggcaacgagacccccagtttaacaagctattattagtgggcaagataagaagtactgaggggcttgtcttgggcttgatggcacacggattcaccacggctcccctgagatcgtgtcaaggtgcatcaatgttacctcaatacggcgttacaacgctgctagcacgccagtcttagttctgggcccaagaaatcagtgcacccactgcacctggcgtggcgcgacatttcgatattaatccagccgctgtttgagtcgcggccactccttggctattaatcagccgacagcgcggttctgcgggaacacacacctgtttctccacacgccaagcggtgggtcgcacaccaag

SEQ ID NO: 185292 - DNA, 668 bp, Homo sapiens
ccgggtggatcacgaggtcaagagatcaagaccatcttggccaacatggtaaaaccccatttctactaaaaatacaaaaattagctgggcatggtggcatgcgcctgtagtcttagctactcggaggctgaggcaggaggactgcttgaacccgagaggggaaggtttcagtgagccaagtcatgccactgcactacagcctggcgacaaagcaagactccatctaaaaaaaaaagaaaaaagaaaagtcctatttttaaagacagcatgtgttatgaaagaaagaaaagggctttggtgtcaaacagacctgggtttgaattctacctctaccacctgcttttgagtttttcttttgtaaaatgggataatattaccaccctgcaggaatttagaggattaaaaataatgtatgctaagagcctgtttgtacatagtagccatttatattatttttctagtttcccatctctataccagactacatttcctagaaaatcctggacctctttaccactcagcaatgattctccaaacatcgtatataatataggacacagtcccaagtctatgaaatctgcttaccctttctggcgttttaaagaattcagagagctccgttaatatcttctttcaagtattcatgttctacgaactgcagtaagaca

SEQ ID NO: 185293 - DNA, 590 bp, Homo sapiens
tgcctggccccctcctggtcttaaagtttgaagcctgcatttgtcttatctgagttcttgccacaggaaatcaacgaattgaaactcaccagatcactgcatccagacaatgagatgccagacccctcatccctcctgatttccttatccctccctaattcctttgaccaactcctcttccttacctctccctaactctggttttcccacatgtagttacatttcttccctgctgtataaccccctgattttagttgactagggagatggatttgagactgatccccattttccttggctaaagcactcaattaaagccttcttcccaggcagtactcattgtcttggtgattggctttctgtgcagtgagcaacgggacctagactggagccctggcatttcagtaacagattttggttccctacctgggaacacattgcttgtggctcagctgctgcagactgggactttcagaagccccctgtacagctgtctgacctttttttggctggaggtgggtttccatctttttctctttggctctgctgctgccagccccaaatgtattgctgattgcctaggaagaaca

SEQ ID NO: 185294 - DNA, 245 bp, Homo sapiens
  misc_feature (9)..(9): n is a, c, g, or t
  misc_feature (42)..(43): n is a, c, g, or t
  misc_feature (79)..(79): n is a, c, g, or t
acattctcncttctttgggccactccactctccagacccttnncagagagaccccacagaatgcacctcctacttcccnaagctcctccagcaggctgctaggagacggtatgagagcagaacagtcaatgcagaaagagaagttggagccaaagccctgagttggggagaacccgggagctgattgggcagcagtgagtggacttttgtggtcagaacacaggctcaggccagtgtggagagag

SEQ ID NO: 185295 - DNA, 991 bp, Homo sapiens
tacaggtcaaaaaacattttacatcagaacagattatccataaacataaatgattgaaacaaaatcttcataaaatgttatttacctttacaaatatgatctaccctcatattttctacttgttcaccttttatatgctggccccaattcactaaattgattttacaacccactaatggattataatctactctttgaaaaacactcttcatagccagtattccagtgactaaccaccgccttcgctggataaaaatccagacatttaatgacacaaaggtcatctatgacctggtcccggccacttctcagcctcctttcctaccactatttgcagccacccttcatgagaaactccttgttattctctgactatattactacttggtgtatgatgttccctctactataatgcttgccgtctttcaagtccactcctacttgtcattcaaatatttgctcagaagtcacttttctgaggccccaaactccacatcaccgtccaaatgggctcaggcctctcttgtgtactgttatttataatcctgtgggcatacacctaactagttgcctgtctacttaactgatcccttcattcagccaaactgctgaagccagagattgggactcattcttgataactctatcataaggcctgatacaaaataggtgctcaatatatgttcattaaataaggaggagtaagctacatccatgccatattcaactctctggctgagctttacaaacaataaacatggtaccacatgtagagatagggttaagctacactactgagtataccaagcaaaagaaatggtctccttcctcttccagaacttaaatgcttataatgattgtcaagaatgtgagcatatttctaattcatttcccacacattttatattccaattttctggaatatttctaaccaatccacagatagaaacacctataaatttccaagcggcgagcgggggtcctctaggta

SEQ ID NO: 185296 - DNA, 648 bp, Homo sapiens
tgcctttccgcagtaacatttccatgattcagtgtgtccactttgggcagcaagagcaagaggagtgaatccatacgtgctctgtgggtcagggtgtgccccagaaaccagcataagcttcaccatgtcctctctgcccagtttggctgcttcgtggagagctgtcctctcgttggcacaacgcagattgacatctgctccatagttgatcagcaaggcagccatgtcatagcagtcacgcagcacagctgggaaatgagaagtgtggtgggcatgttcaacgggaagttaagcccaaagtagcatatctgcaagtatccctcaggctttcttaaggagttcttcccacccactcccagacccgaacattctgtgtttaggaaacagattgtaaagtaaggcatgtgtcaaataatacttactgagaatgttttacatcaatggactatgtttttctgtaagccatgagtaattattcattgcttatgtggttgaaacacaaatgtaaacttttcacttatctttattcttcaagaaaatgggaacttaattattcagtatagtcctggaaatgtttgtagctgctttaaaataagaaaaaaaacaaacaaaagacagcccagactctgaaacatgccaaaaattaaa

SEQ ID NO: 185297 - DNA, 538 bp, Homo sapiens
ataaatgaacccaaacagatcacgttctcggagacggatgcacgccagaaattcctgtcgtgcccctgaagaactaacaggtctctctctgcaacggtggacgactggtcaaaccctggaaccagccaggaacagcagcaagtgcacgggctcgggaatgggaatctggctttatggaacctccaggctcaaggggacaccaggaagggacagcttcgtgaccaagcccggtgtgacccaccaaaaatctgcaaccacgaagaccaggaaatgccagcagtgccgagcaggagaggtcgcttgacggtaaagaagcagggagcgttatttagcaaaccaggctggttaaagagtagagaatatcagatgtcgcggcccctctgcagaggacagttctgaaggacagcgatgacctaaattggctcctatgagggactgctgggggaaatatttccccaggatcctataagatacaaagaaaaacatatgaaaacagaaaagatattcccgacacttgggggtctcaatggggcggggg

SEQ ID NO: 185298 - DNA, 507 bp, Homo sapiens
ccttaaacagtttctcattgctttaggataagtctagaattcttaaggcagcctaaaagaccatacgaggtctggccttacctgccttttccagcctcatctcacaccattttcaccttgtttcctgggcagacttcctggtcttcttttagtttctcaaaaatgctatgatcccaacaaccaaaggctctatgtacatgccattctctcctttagttatcctatctcttactcatccttcaggtctcagcttgaaagcgacatccttgggaaaaacatttctgacctcccagatacattcaagataccttgttatgtcagctctcttaccaccatataccctcccctcttatgacttaccacagcttgtaactacattttggtatgtgtaactactaggttaatgtctgttgctccccacattaggataaagaccatgtctatttgggcctgcacagtgcctggcacatagaagctacccaataaatatttcttgaatgattattg

SEQ ID NO: 185299 - DNA, 223 bp, Homo sapiens
tattaatagaaaggtgatggcagaaacattctgaagtccttctcttccatggacatgacagctatgaacacagctatcaaaggaccccacactagaggctcaaggtttgcattctgtactacactatggtttccttctgtccagactgaaacaaagatgaaaatccaaacctttatactcacgaagtgtcatttaccctaagccctgtcccacacattttggg

SEQ ID NO: 185300 - DNA, 325 bp, Homo sapiens
ctgtattcttaacgtctaaattctacaagagggattttttccccatagaggcaccattcagggtgagctggatattgttaggatttgggagccgacaggggctatcatttattctcgttctttgaccacatcataggccattgcctcttctctgtttgctggttcatgcaagaccaggagctcccccagtaagtggccggaagggtaatacccaccccccgcaagccaagtctctccccattctcttgctcagcctcagtcacgggaaccaccctgtggttgattcattctgacaattattataggtagcttaggaacggatggt

SEQ ID NO: 185301 - DNA, 389 bp, Homo sapiens
ctaccagaatctggatttccaggattaaaaaaacaaacaaaaacatacagaaacttacaccaatgtctgttacgtgtcaaaagccaaaagatagcagtattttgcaagaaaggaaatttaccagtaaattttttttattatttttgagacagggtctcactctgtcacccaggctagagtgcaggggtgtgatcttggctcactgcaacctctgcctcccgggttcaagcaattctcacacctcaccctcccaaatagctgggattacaagtgtgcgccaccacacccaattaatttttgggcttttttttttttgagacagagtctcgctatgtcacccaggctggagtacagtggcgcgatctcagctcactacagcctccgcctct

SEQ ID NO: 185302 - DNA, 789 bp, Homo sapiens
ctaacttaatgtcaaccagctgaaaacacaacaatatgttttcaagagccagtataagttggctccaatacagcatgagccagctccagcatagcactgcctgaacaatttttaagtcagtgagtaccaaataggagaggctagcagaggctttggagggacttttaaatgtcccctccaccaagggaagcatttccatgttggttagttttactgatttttagtaaaagagcatattattggatcccaaggtgttcaaatattccacgtgactcttaggaacctctcaacagactccccagtatcttgggagattaccaactgtggcttttctaatttctaagggtgaccctccaggaaaacattctttaatttaactaccagttaaaaccatgtttggctgatcttttttaaaaaatctatacctatagttcatcacttgtttccccaactttgtcattttccctatccacttgcccctcatccttctgacacaataaaaaaaatacaggtacccacaaaacagtgcctgcaaaggagcaggggaagaacaaggcacccagtaagctcacttggctctacatatctggaaaggcactgaggttccaaggtctctaccccaccaggggacacccagtaaacatcacgctgagagtttaagttgcactcaactggagttgatttgcccttagaaaagtttccaacggtgaagaaataccacttggtaggaatatctctgggcaacttcattgctgactgggcaaactttgtaggataaggtgtcatgtg

SEQ ID NO: 185303 - DNA, 443 bp, Homo sapiens
aatctgcttctccaaactgaagtagtttacacacagttttaaggctataaatgatagttatataccactgttactaatacatttgtatatagtctaaagtttgaaacaaagctctgtgagctaaggggctgtgtcttgttgttttactgctatttcccaatgcctagaatggtatttgacctgtaggtacacagtaactctttggatggatgaatgggtgggtggatgaatggatgtctaactaacttaaagcccaagttatgggttatggtgttggatgtccagaattcccagaataagatgccatctatttgtggattaaataattctaacatggttttaaaaatatttttaaaataattattctgcctaggctagtccaatcaagagtcttttaattttgaaagaaatctttggtctagaaagagctctgagagatgaaa

SEQ ID NO: 185304 - DNA, 211 bp, Homo sapiens
aggtggacatgaggagcccagttcagggctgtcacagtagctccagcagcagatgattgtggctgggcctcccaagtgtcacgttggagaaccggagaaggggacttctttgggatgtactctggacttgttgatagattaagtgtaggtggggtgaggaagagaactcaaagatgacaccaggtgttggagctgagccacggggagaagg

SEQ ID NO: 185305 - DNA, 499 bp, Homo sapiens
acgtatacacctactatgtacccataaaaataaaaaaaaaattttaagttaattgtgaagttaaatgtaacctaaaaaccatttataggttttggctcaaagttacttttaataaaatttatttaattaaaagggagaaaactattatccattcattaattcaataaatacacattgaatacttagaacatgctcggctctggacacagaaagataaaaagacttaaaaatagtccagacaattgagcaagcaatgacacaggtgataaacaccgagagagacagggaaaacttcctaacaggtaaagaggaggtcatggaaggctggggagaactgggggaggggtatacagctgcacacagaacatacatccacatccgtccgcaagtaagcctctatctcaggagagaactgaggctacgggagaggctgagatcacccagggagcaagagtttggaaaaaacttgcaggataaccaattaaaggaagggtaagcc

SEQ ID NO: 185306 - DNA, 608 bp, Homo sapiens
aacgtgacagtaccaccttggtcacaactgcgagctacagtgagacgtttgtgacctgtgaaagatggagagattttttttttggtgacgaaacagacagtctcttagctttttcccttgttgtgtaatcttgtgcagttacatggtataatcaggaaaaattaattctcttcatggtgtctaaagatgcttcagtaaaagaatacatctttaaagaactgcagaaatatcttccaagtcatgcagtcccggatgagcttgtattgatcgactctctaccatttacatcccacggcaaaattgatgtttctgagttaaacaagatatatttaaactacataaacttgaagtctgagaataagctcagtgggaaagaggacctttgggaaaaattacagtatttgtggaagtctactctgaatctcccagaagatcttttgagggttcctgatgagtcactcttcttaaatagtggtggagattccttaaagtccatccggctcctcagtgagattgaaaaacttgttggtacatcagtacctgggcttctggaaattattctcagcagttccattttagagatttataatcacatccttcaaacagtg

SEQ ID NO: 185307 - DNA, 3070 bp, Homo sapiens
acttttttcatgttctccttgagtgaaggatgaggaaattgaaagcagagtatgcaccttttattaggagattcaaactgcatcctactggattagcctcaaaagtcctaaaatacaaagacatccatctgacagatcactgaggggaggacttgtttttctgttttagaatagtttccgattaaactttttagctcaagaagaaaagaagctagttatttctcacccaggagtggatttgtggtttggcttcaccatggcttcctgccgtgcctggaaccttagggtgctggtggctgtcgtgtgtggactactgactggcatcattttgggactgggcatctggaggattgtgatcaggatccaaagaggaaaatctacttcctcatcaagcacccctacagagttctgcaggaatggtggaacctgggaaaatggcagatgtatttgtacagaagagtggaaaggactgagatgtacaattgctaatttttgtgaaaatagtacctatatgggttttacttttgccagaatcccagtgggcagatatggaccatccttgcaaacatgtggcaaggatactccaaatgcgggcaatccaatggcagtccggttgtgcagtctctctctatatggagagatagaattacaaaaagtgacaataggaaattgcaatgaaaatctggaaaccctggaaaagcaggtagaggatgtcacagcaccacttaataacatttcttctgaagtccagattttaacatctgatgccaataaattaactgctgagaacatcactagtgctacgcgagtggttggacagatattcaacacttccagaaatgcttcacctgaggcaaagaaagttgccatagtaacagtgagtcaactcctagatgccagtgaagatgcttttcaaagagttgctgctactgctaatgatgatgcccttacaacgcttattgagcaaatggagacttattccttgtctttgggtaatcaatcagtggtggaacctaacatagcaatacagtcagcaaatttctcttcagaaaatgcggtggggccttcaaatgttcgcttctctgtgcagaaaggagctagcagttctctagtttctagttcaacatttatacatacaaatgtggatggccttaacccagatgcacagactgagcttcaggtcttgcttaatatgacgaaaaattacaccaagacatgcggctttgtagtttatcaaaatgacaagcttttccaatcaaaaacttttacagctaaatcggattttagtcaaaaaattatctcaagcaaaactgatgaaaatgagcaagatcagagtgcttctgttgacatggtctttagtccaaagtacaaccaaaaagaatttcaactctattcctatgcctgtgtctattggaatttgtcagcgaaggactgggacacatatggctgtcaaaaagacaagggcactgatggattcctgcgctgccgctgcaaccatactactaattttgctgtattaatgactttcaaaaaggattatcaatatcccaaatcacttgacatattatccaacgttggatgtgcactgtctgttactggtctggctctcacagttatatttcagattgtcaccaggaaagtcagaaaaacctcagtaacctgggttttggtcaatctgtgcatatcaatgttgattttcaacctcctctttgtgtttggaattgaaaactccaataagaacttgcagacaagtgatggtgacatcaataatattgactttgacaataatgacatacccaggacagacaccattaacatcccgaatcccatgtgcactgcgattgccgccttactgcactattttctgttagtgacatttacctggaacgcactcagcgctgcacagctctattaccttctaataaggaccatgaagcctcttcctcggcatttcattcttttcatctcattaattggatggggagtcccagctatagtagtggctataacagtgggagttatttattctcagaatggaaataatccacagtgggaattagactaccggcaagagaaaatctgctggctggcaattccagaacccaatggtgttataaaaagtccgctgttgtggtcattcatcgtacctgtaaccattatcctcatcagcaatgttgttatgtttattacaatctcgatcaaagtgctgtggaagaataaccagaacctgacaagcacaaaaaaagtttcatccatgaagaagattgttagcacattatctgttgcagttgtttttggaattacctggattctagcatacctgatgctagttaatgatgatagcatcaggatcgtcttcagctacatattctgccttttcaacactacacagggattgcaaatttttatcctgtacactgttagaacaaaagtcttccagagtgaagcttccaaagtgttgatgttgctatcgtctattgggagaaggaagtcattgccttcagtgacgcggccgaggctgcgtgtaaagatgtataatttcctcaggtcattgccaaccttacatgaacgctttaggctactggaaacctctccgagtactgaggaaatcacactctctgaaagtgacaatgcaaaggaaagcatctagacagtaaaacttacctgttgtggtctttttaatcacctcgtttgagttttatctgtttctctcctttatttcccagtcctctcagaaagtcttcctcaatgtattttgctcaggattaagaattagataaaacctgttgtttattattattcggcataatggacttggtagtttttctatttttcaatagatttgtacttgaataaggtgaagaatttcacacaacatacaagagtaccattgttccttatatcgttaaatctttgtgacacactttgacaaaaatgtagaacctataacaaattcttttacaagttactataaaggacacaaagagaaaactttaccttccagaacaaaatgactcctgatgaacagtgtgtggggatttgcttgtatgtattaaacttttgacctctg

SEQ ID NO: 185308 - DNA, 265 bp, Homo sapiens
gtctgactacagatacctcatgttagtggaatcatgtggcatttattattttgtgagtgacttatgttatttagcataatgtcctaaaagttcatccatgttgtagcaatgacaggattttgaagagatatttgcacacccatgttcactgcagcattattcacaatagccaacaggtgggagcaacctaaacttccatcgccagatggctggataaggaaaatgtggtatatacagatgatgaattattattcagccttaagaa

SEQ ID NO: 185309 - DNA, 307 bp, Homo sapiens
tacagtccaagggtgagggttaggatggtattctttcacacttgatccttgtttttggtcactcttggaattttcaggggtagaaaatttcattccctttgaggtatgctggtaataataatggactccagtatggaagtgttggttggactaaatatgctaatcacctatttgtgttactaaaaattgcctctcaacagaggagactttagcttcatctaagtattagtgagttttgtggagtttagctaattgtgagatggatttcctcttagaagatgtacctcatgtgccaaattgcttggaa

SEQ ID NO: 185310 - DNA, 192 bp, Homo sapiens
ctgttattgaactaataaagcattatgaaaaagctgacattcaccttgcagtttcaacttgatcataatattttgcttccagtcccttcccttcttaggcaactgtagatgtgggtttcgttgtacacttctgcatatgcaattcataaacaatctgtttgtgttttttgaaaagcacttgtgtttaaattt

SEQ ID NO: 185311 - DNA, 439 bp, Homo sapiens
ggctggctattttccaccaacaggatgttacagcttgtcaaaagttattcaacctatagtgttaagcaggtacttcatcattactgaatttggttgatgctctatggagaaagccaaagttaggagttttgtctgtcattgaggtagagaccctcaactagggaagctttgaactgttcatccagctggtattctgtaccaccttgcctctggagttgagcttagaaccctacttccattttttctgtcacttcagggctgtttcaactattgtttcttcatttacttatatcaagtgtgttttctcaattcataagcatgggagaccccaagagacagatatcgcattagtccttttttgtttgtttagcaggaaggtttttaagtaaagctcctaaatgatatgtctcattctcatggaaattcatcaatattgttt

SEQ ID NO: 185312 - DNA, 682 bp, Homo sapiens
catttacataaatgtttgtaaagttattatttataatagccaaaattatagaaatagtttaaattttcatcaactggtaattaacaaaatgtagtctattcattttattcaccaataaaaagaaatgaactactgatacctaatagaagacagatgagcctcaaaaacattttgctaactgaaggaagtcatatgcaaaatatcactgtggtaggcagaattctaaggtagccattaaaattcctcctcctggtgcacagaccctttgtaatccccactcttgggtttagaacggaccagtgaatgtgatgggatagtcactgctgtgcttaggttatgttatatggcaaaggtaaagagattatgcaaatgtaattaggttaatcaaatgggaaatcaccctgagtgggtctgagctaattaggtgggccctagtaaagagagtccagatcttgtatgaaaagagaggttctgagtgatagagatccttttattgaccttgaaggaatctgtttcgagctgcctatggaggggaccctgtggcaaggactcaaggagatataagcagtgtcccgctgacagccaggaacaaagtgtggacttcagtcttacaaccacaaggaaccaaattctttcaaaaacctgaataaatgtggaaatggattcttccctagtcaagccg

SEQ ID NO: 185313 - DNA, 157 bp, Homo sapiens
aacttgtagtgaggaaggctcaagtttgcaggcaagttgctagatctctgagagtcaggggatataggtgtagtagatgtggaaatgcattgcccggacccccttcttccaggaaggcctttccatccagctgcaggagtgagctgggcagatggcc

SEQ ID NO: 185314 - DNA, 273 bp, Homo sapiens
aaaccccaccgaagagaagaatttatcaactgctttttttttcttttttgaaataatactggtagctcattctctctactcttatttccaccatcacagcctttcctttgggatacagtctgatgaatttagttagaatttacatttctggacactaacagtatgactcctgaaacaggggacgttctgtctctgctccctacttggttgctaaccagggcagttttcaagtttgcttgagaagccaagcttattacctgagatttaagaatg

SEQ ID NO: 185315 - DNA, 285 bp, Homo sapiens
gaatttccttatgtttcttaatatttgatccttgatagtctgtacagtggaaaccatttccctctgtgatatccttttttgccaacctatatgaatgtgtttagcgtcacttcagatatagagttcaagctcaagtatacacagcacatgaaagatcctatagttcatgttctcttaggttgaattttcttttcataattttttatgattgaattctaagggtatgttccttggtaaattgtgttaattatgtccactttataatggatttaacaattttacaaa

SEQ ID NO: 185316 - DNA, 487 bp, Homo sapiens
tccacctccacaggcttcagcttccacctccacggctccctctctctttgctcaagtccctcccctgcaaaatgaaactcacctataagatggggtcagatgcagatgttcaggtccttggcaccagcctgaccagtgagcccgccctcctcacggggagagatgtgagcactgaggtaggtaggtctctaacatggagccaaggtgcccctcctctggagtgtgggctagggcctgtgactctgacgggacaagatgtcactcctgcgcttaggttatgtggcaaagacaaggaactttgcagctgtaattagagcccctgaatcagctgactgagccaatcaagagagaaacaccctgggtgggcctgactgcatcaggtgagcccttcagggaccaaaccctttctgctttttgtgtgtgtgtgtgtgtgtgtgtgtgtgtgtgtgtgtgtgtgtgtttgagatggagtcttgctctgtcgccc

SEQ ID NO: 185317 - DNA, 474 bp, Homo sapiens
ttgggtaattctgttaaaagggtctgaatagcttgtgttttataagctgctgtttggtattacactgagggggagtattttttacattgtatttttgtatgcctttggcaaagtggtgttaactctttttgtacaagaaaaaaatactcttgggtaattctgttaaaagggtctaataacttgtgttttatcagctgctgtttggtatactgggggggagtattttttatattgtatttttgtatgccgtttgcaaagcagtgttaactctttttgttcaagaaaaaaacctcttgggaaattccgttaaaagggtctgatttattttgaaaagcacgtttacctgaaattttgtatttagttttgatttctgattgcctgattgtaaaatgttgccttttgggacatcttctaataaaagtttcatcaaacatgtttttttttaaaaaagaagtaaacatctttatgaccttg

SEQ ID NO: 185318 - DNA, 5318 bp, Homo sapiens
  misc_feature (3680)..(3680): n is a, c, g, or t
  misc_feature (3914)..(3914): n is a, c, g, or t
  misc_feature (5310)..(5310): n is a, c, g, or t
aagctgggaaccagcgccttcagtgaggtggtcactgtgaacactttagcattccctattacaactccagaacccctggtgctggtcaccccaccgaggtgcctcatagccaatcggactcagcagggtgtgctcctgtcctggcttccgcctgccaaccacagctttcccatcgaccgctacatcatggagttccgtgtcgcagagcgctgggagttgctcgacgatggcatccccggcaccgaaggagagttctttgccaaggatctgtcacaggacacgtggtatgagttccgggttctggccgtcatgcaggatctgatcagcgagcccagcaacatcgccggcgtctccagcacagacatcttcccgcagccggacctgaccgaggatgggctggcgcggcctgtgctggcgggaatcgtagctaccatctgcttcttggcagctgccatcctgttcagcaccctggctgcctgctttgtcaacaagcagcgcaagcgtaagctcaagcgcaaaaaagaccctccactctccatcacccactgcaggaagagcctggagtctcccttgtcctctggcaaggtgagccccgagagcatccgcacgctccgagcgccgtcagaatcctccgacgaccagggccagcccgcggccaagaggatgctgagccccacccgtgagaaggagctgtcgctgtacaagaagaccaagcgggccatcagcagcaagaagtacagcgtggccaaggcagaggccgaggcagaggccaccacgcccatcgagctcatcagcagaggccctgacggccgcttcgtgatggaccctgccgagatggagccctcgctgaagagcaggcgcatcgagggcttccccttcgccgaggagacggacatgtaccccgagttccgccagtcggacgaggagaacgaggacccactggtgcccacatctgtggccgccctgaagtcccagctcacccctctgtcatccagccaggagtcctacctgccaccaccagcatacagccctcggttccagccccgcgggctggagggccccggtggcctggaaggtcggcttcaggccacaggccaggcccggccccctgccccccggcccttccaccatggccagtattatgggtacctcagcagcagcagccctggggaggtggagccgcccccgttctacgtgccagaagtgggcagccccctgagctccgtcatgtcgtccccgcccctgcccaccgaggggccctttggccaccccaccatccccgaggagaatggagagaatgcatccaacagcacgctgcccttgactcagacacctacaggagggcgctcccctgagccctggggccggccagaattccccttcggggggctggagaccccagcgatgatgttcccccaccagctgccaccctgtgatgtgcccgagagtctgcagcccaaggccggcctcccccgaggactgccccccacctccctgcaggtgcccgcggcctacccgggcatcctgtctctggaggcaccgaagggttgggcaggcaagtcgcccggcaggggccctgtcccagcgccccccgccgccaagtggcaggacagacctatgcaacctctggtaagccaagggcagctgcgacatacaagccaaggcatgggcatacctgtgctgccttaccccgagccggctgagccgggggcgcacggcggccccagcacatttggcctggacacccggtggtatgagccccagccccggccccggcctagccctcggcaggccaggcgcgccgagcccagtttacatcaagtggtgctacagccctcccggctctcacctctgacccaaagccccctcagctcccgcaccggctcccctgagctcgccgcccgtgcccggcctcgcccgggcctcctgcagcaggcagagatgtcagagatcaccctgcagccgccggctgcagtcagcttttctcgaaagtctacgccgtccacaggctccccctcccagagcagccgcagtgggagtcccagctaccggcccgccatgggcttcaccactctggccaccggctacccttcccctccacccggccccgcccctgctgggcctggggacagcttggacgtgtttggacagacgccttcccctcgaaggacgggggaggaattgctccgaccggagaccccaccacccacgttacctacttcagggaagctgcggagagacagaccagctcccgcgaccagcccgcctgagagagcactctctaaactgtagcagctggtattccagctatctgggcagtgttgtcgagacaagcctctcctcagctcaataggtaagggagctcctcggctgggcgggcgggggcgggcaggcggacggggcttcggccgggccattgcttcctggacaggggatccaaaccatgtccctcaccgccccgtggggtggccgctgccgctcctcgatccccacggcttctgggttccccacatcgagccacgctcggcaccgcctagctgcagcttctgccccccaccccccgtccccatgtccggcccctctagagccccctgcggctctcctcactcctcgccagcctcgccagcctgctgccagtacacccagggcctcccacagaagccctggggccctgcatgcaccccgaaggggcccagaacacccgagatctgctttgcatctctgcacccttggggacctctctggggcccctctggtatccaggaagagcccccccgcaccctattctcccagcagccccaggcatagcatcccttctcctggggtggctggcccctcaccagcttcttgagatcttcgtggtattaggctctctcgaggagtacaaggttgggatgagccccacttcttccttgacagtggggtcctctgcagggtcaggtccctgcagtcctatggggctttgtagcgaaatgtcatcactcccctgtgctccttgccttctgcagcctgaccttggtagtcacaggactgaaatgtgacctagcccttgggtccacattgctttcaaggtccctgttgtagccttgtcgtcctccctgggtcatgctgtagggaaagggtcttaggaggacctccccgaggggagggggcaggcttcccctgggcagacaggcattgagctggcaggaagtgaaacccccagggaccagcactgtgtccctccccctgcccccgcagtcagcctctccttgagtgtccttccaggtggaagctaaaggaacttgggcattcagggagcctctgagtccctcacagagactcagggccacccgaagctcgctccctctcacagtagcctgacaaggtgctgccgctcgccacggaccctctgccctgtgcctgggcacacacaggcatcgggcacctgcatgggagacggcgagcctcccgtccaggtgcttctggctttccaggcgagaaggagacaggtgccttccccccctagagatgtcaagggaggttcactttcctaaccagggctataaatctcattcattcctaagagtggcctccataaagaggactgccctgacatttctttaccatctgtagctataaaattgtcagcagcccagaggccctggaattgtgggtgaggctgtctggcatagggtgantgtgagggctgtcaggcagcgtttatgagctcacctgctctggggccctcctgcgcccagagacccactggtcttccaccttccccagctccctccctgtcccagctgtgactcctccacagcccccggaggtgtgggagccctagactagctctcaccccagctcctggaaattcctagactctgctctcatgtgttattcctcaccccttcactcaactccattgaccctcncctttcccagtgtccccactgtgccagatccaagagaagcccgctctcctttcactgctgtggcaaacccagaaaccaggggcagcgatgagggaccatcgtttctctcccgggcctggccagcatccccagcctaggagaaggagaccctccccatcctgagtcagcccctcggtgctggcctctcctgcctgctgggagcctccccggtacggctgctgggtcctggggagatgcaggctctgttcagatgctgtctccatgctgcacctttgcatgtgtgccctcttggtcttgcttggagaagttgtgacagctcttgtccacgtgcgttctcactgtttcttttcccttcagttcctctcctgttcctttggtccatatgtagttgttgcccctgcctctcctcctttctctctccctttttttctcctcttcccaactcccttctcaacatggggagttgtattgcgtggacctgtcctttctgtggactgtggggaggccgagccaattcttagctcctgtctgagcctagtgatgccctgtcctcacctctgcttccactccctttcccattcaggctgactgtcaccgcagggaggcaggtgggtctggagcatggagtggcccctgtcctgggtcagctgtaggaaggggcccctttgtaaacaagcttctgccaggttctgaggcagagcactggtctgagtccggccccacagaagggttccatcttgtggtcagcggggtgggctcagacctgcagactcccgcagtgggcccaccctttcccttgctatggcccgtctatgagtggctttcccctgcctccatcggtgtataatcaggcaggtggtgtttgctcttaggtgattagaagaggaggaaaatgcccatcaagccactgcttcagcctgttggccagggaacacctgaacagggtcaaaatggtcagctcctgggcgctgagctaaggaaatatgcagggggttttgactttccctgtcctgaggcttgcctccactttgacctggctgcatctttcctcagctcttctgggtaagctgagagctaagcaaataagacctcctgggctacctggtcatgatttgggttttgtatggattttttgaaaagagagaaaaagagtgtgggctgggtgccgtggcccagagggcagatctcttgagtccaggagttcaaggccagcctgggcaacatagtgaagccccatctctgcaaaaaaatacaaaaaaatagctgggcatggtggcacatgcctatagtcccagctccttggggggctgaggtgggaagatcatctgagctggggaggtcgaggcagcagtgagccgagattgcgccacttcactccagcctgggtgacagagancctgtctc

SEQ ID NO: 185319 - DNA, 185 bp, Homo sapiens
tccatcacttgtgtcagttgttcagagttcctccataagaagatcagatgagcagaacagagagaacaaacagtaataatcctgctctggtcccctttcttcctggagactggaaaagcagtaactttttccttttagaaaatatgtgggatatgatcataaacataatctgatcaattaccaaa

SEQ ID NO: 185320 - DNA, 279 bp, Homo sapiens
ggagtcaaagaaaatgctagtgtttaaatagtgggaaagctaggagaaaaacagattcagggtctggtgagggggtttgggaattaatcaacgtggacccgttagagggagtgaaacagtgagatggcaggtggagagttgcactgggctacggcacagagtcggcctgtgagcactgaggcaggttgggttttttgtttttctgtttgctcgtgggcagcagcgggcggcagactttctaattctctgtggctgactgggcaaagtcttccctaccac

SEQ ID NO: 185321 - DNA, 465 bp, Homo sapiens
atggtggatttatgtggacataaaaataataatgaagattatacaacaaggaaagatacttatgataatgttaaggaaaagatacaaaattaaatatacatcctaaccacaatgatataaaaatataatatatatgggaaaaagactagtaggccatacgcataatcttccccttcctccccccactaaactatgatttctttaaccacaaggaccatatcatactcttgtgtaccacaaccatacctaggcagaatgctaggcatactggaccagtttaatattttcaactgtattaaaatatctatacttgcttgactcaaattttagatatttggcttacaagatagaaatacacaacatacaacagagacaataaatataaaaaagtactttctgacaaagacctattactgccacactatgaatggcaaagttgattacactcccagtacacacttgaaa

SEQ ID NO: 185322 - DNA, 659 bp, Homo sapiens
gctttcctagactccatttagagcaaggaattgcatgtttataagcgaactttgacacttgcctctgctgatatggctgggaatcctctctttcattcttcattattaatgggtatttattatgtcataggacttgtcattaaatctgctgaaatctggtaatccaagcctccaacccatagtttgcatcaaccaggtggcgacccccaggctctgctggtttccattcctttatcttgattccattcctttatcttgattctccctggccgagagcttttctgacccacctaaaatctgttcatttcagaccccggcctttccaggatgccttttggagcccctgctggccaccacatatcatgttctgaagttctacagccctctgagttggacactgaccatctgggggctcgagtcatcctcagattggtatgcagccattcaaacattcctgtttgtttcctgtgagtcagcattgtgctgggcttccaaggaatctgcagtcctcttcactgcctcttcctgagtactcactgtgttccaggcttctctcagcccttcctgggtacagtgctaggaagtaaagagtcatatccactccagtaaatgattgctgagtggatgaatatagctattttcaccaccaagataaagat

SEQ ID NO: 185323 - DNA, 2425 bp, Homo sapiens
atgtggtggagagttctcagcttgctggcatggttccccttgcaagaggcctctctgactaaccacacagaaaccatcaccgtggaggaaggccagacgctcactctaaagtgtgtcacttctctgaggaagaactcctccctccagtggctgaccccctcagggttcaccatttttttaaatgagtatcctgctttaaaaaattccaaataccagcttcttcatcactcggccaatcagctctccatcactgtgcctaacgtaaccctgcaagatgaaggcgtgtacaagtgcttacattacagcgactctgtaagcacaaaggaagtgaaagtgattgtgctggcaactcctttcaagccaatcctggaagcttcagttatcagaaagcaaaatggagaagaacatgttgtactcatgtgctccaccatgagaagcaagccccctccgcagataacctggctacttgggaatagcatggaagtgtccggtggaacgctccatgaatttgaaactgatgggaagaaatgtaatactaccagcactctcataatccacacttatggcaaaaattcaacggtggactgcattatccgacacagaggcctgcaagggagaaaactagtagcacccttccggtttgaagatttggttactgatgaagagacagcttcagatgctctggagagaaactctctatcctctcaagacccacagcagcccaccagtactgtctcagtaacggaagattctagtacatcggagattgacaaggaagagaaagaacaaaccactcaagatcctgacttgaccaccgaagcaaatcctcagtatttaggactggcaagaaagaaaagtggcatcctgctgctcacgctggtgtccttcctcattttcatactcttcatcatagtccagctcttcatcatgaagctgaggaaagcacatgtgatatggaagagagaaaacgaagtttcagaacacacactagaaagttacagatcaaggtcaaataatgaagaaacatcatctgaagagaaaaatggccaatcttcccaccctatgcgttgcatgaactacatcacaaagttgtactcagaagcaaaaacaaagaggaaggaaaatgtacaacattcaaaattagaagaaaagcacatccaagtaccagagagtattgtgtagtgctctctgcaatggaacatgtgatttcagggttgccgcagtgtcacctcagtggaccagcctgggggaaggagcttaattgctgagacattaataatgacctcttagtgcaatgcaagatggtgtcctcggataatgatctgccccggagctagggcagcaacatgaggaccaaaccatgcacataaagcttgtagtttaaaaaagaaaagcaaaaaaataattatgcctgacactacttcagagcaggaggattctacgaagccttggggatcagggtcagtgtgagcagctaacatcctacctcaaatggaacaggattttttgatgctttgctctaatggaactgttttaaaaatttttttttctttttaatattttcttctggtcacaaaataaagaaatttgggatgcaaagtacctaaagatctctgatcctaagaagttacttctggccaggcgcggtggctcatgcctgtaatcctagcactttgggaggctgaggtaggcagatcacttgaggtcaggagttggagaccagcctggccaacatagtgaaaccccgtctctactaaaaatgcaaaaattagccaggcgtagtggtgcgcacctgtagtctcagatacttgggaggctgagggtggagaatcgcttgaacctgggaggtggagattgcagtgagtcaagatctcaccactgaactccagcctgggcgacagagggagactctgtctcaaaaaaaaagaagttacttccaagacagacttttaacatgtaaccagcacaaagcaatgtcagggaggagtgatacatgacaataaatgagtcagatgagcaagaaggccccagaacccatgccccaaggcacaaagaggagctcagggtaggcccaaagattcgaattccttagattactaaatcacatgagcggaccttgtctgtcagataagatttttacctggaaattccatgaccaatacatgtgcaaaagaaaatgatgggttgaatttactgattattgacctaatggatggctttttaaaatgttttaataaaaagcagaatagatgtttgtttttctagtggttataccaagctatacttcctgttttcacgtgtgaaagtaacatgggacatgcctttcttttccgatcagtttatttaagctatacagcaaactttggcatttatgtggagcatttctcattgttggaatctgaataaaccaattacaaaataaaaa

SEQ ID NO: 185324 - DNA, 1909 bp, Homo sapiens
cacacagttctggggtttctgcacaacctctacaagcaggtagccgctaaatatattctccaatctcttttactgagcacaatgtgggtaaaactgctctctatagtagcagaattttgtttttcccctttcctagttactgatgaagagacagcttcagatgctctggagagaaactctctatcctctcaagacccacagcagcccaccagtactgtctcagtaacggaagattctagtacatcggagattgacaaggaagagaaagaacaaaccactcaagatcctgacttgaccaccgaagcaaatcctcagtatttaggactggcaagaaagaaaagtggcatcctgctgctcacgctggtgtccttcctcattttcatactcttcatcatagtccagctcttcatcatgaagctgaggaaagcacatgtgatatggaagagagaaaacgaagtttcagaacacacactagaaagttacagatcaaggtcaaataatgaagaaacatcatctgaagagaaaaatggccaatcttcccaccctatgcgttgcatgaactacatcacaaagttgtactcagaagcaaaaacaaagaggaaggaaaatgtacaacattcaaaattagaagaaaagcacatccaagtaccagagagtattgtgtagtgctctctgcaatggaacatgtgatttcagggttgccgcagtgtcacctcagtggaccagcctgggggaaggagcttaattgctgagacattaataatgacctcttagtgcaatgcaagatggtgtcctcggataatgatctgccccggagctagggcagcaacatgaggaccaaaccatgcacataaagcttgtagtttaaaaaagaaaagcaaaaaaataattatgcctgacactacttcagagcaggaggattctacgaagccttggggatcagggtcagtgtgagcagctaacatcctacctcaaatggaacaggattttttgatgctttgctctaatggaactgttttaaaaatttttttttctttttaatattttcttctggtcacaaaataaagaaatttgggatgcaaagtacctaaagatctctgatcctaagaagttacttctggccaggcgcggtggctcatgcctgtaatcctagcactttgggaggctgaggtaggcagatcacttgaggtcaggagttggagaccagcctggccaacatagtgaaaccccgtctctactaaaaatgcaaaaattagccaggcgtagtggtgcgcacctgtagtctcagatacttgggaggctgagggtggagaatcgcttgaacctgggaggtggagattgcagtgagtcaagatctcaccactgaactccagcctgggcgacagagggagactctgtctcaaaaaaaaagaagttacttccaagacagacttttaacatgtaaccagcacaaagcaatgtcagggaggagtgatacatgacaataaatgagtcagatgagcaagaaggccccagaacccatgccccaaggcacaaagaggagctcagggtaggcccaaagattcgaattccttagattactaaatcacatgagcggaccttgtctgtcagataagatttttacctggaaattccatgaccaatacatgtgcaaaagaaaatgatgggttgaatttactgattattgacctaatggatggctttttaaaatgttttaataaaaagcagaatagatgtttgtttttctagtggttataccaagctatacttcctgttttcacgtgtgaaagtaacatgggacatgcctttcttttccgatcagtttatttaagctatacagcaaactttggcatttatgtggagcatttctcattgttggaatctgaataaaccaattacaaaataaaaa

SEQ ID NO: 185325 - DNA, 286 bp, Homo sapiens
tcgaattcaagcttctaacgatgtacggggacatggccggggtgttgaaggtctcaaacataatctgagtcatcttctctctgttggccttggggttcaggggggcctcggtcagcagcactgggtgctcctccggggccacgcgcagctcgttgtagaaggtgtggtgccagatcttctccctttcttttccgatcagtttatttaagctatacagcaaactttggcatttatgtggagcatttctcattgttggaatctgaataaaccaattacaaaataaaaa

SEQ ID NO: 185326 - DNA, 307 bp, Homo sapiens
gtgtcatttctcttcacttttccctttttacacatatatcaatcttgtcattctcttgtttcagaacttctcaaggctcctgttattcccccaagaaaggcctaaacaccttaacctggcatctgaggccttttatgatctgtctgtccaacccacctctttaacacatctaactctttcacttcaaatgtgatcctgtagcaaaaccaaaccatctctgtgcccttggagggctttgaacactcattttctaacctcttgggatgccttcctgctgtcgcttagagtctaagtctaatctgctgca

SEQ ID NO: 185327 - DNA, 266 bp, Homo sapiens
caccgtgttagccaggatggtcttgatctcctgacctcgtgctgggattacaggcgtgagccactgcgcccggccagacagcaaaggactgaattttgttaaaacccacccttgctcagagggcatttataaagaaaacaacctccacaatgaaacaaaaattcaggggagatgcggtgtgaggtctgctccaggccgtggtgggtgctctttggcttctctcctctgctgggcctgtggccacatgtccccccgcccaccaccgc

SEQ ID NO: 185328 - DNA, 414 bp, Homo sapiens
gctcattgtcaatgtaaggaaacaaggtcaaaagttaggtcaggagagcaggaactgattcatggaaaggaatgctacatgggcaattgcctgagaagacattcacctgcaaggcccacaggaacaggagtctgctgagaggtgtgatgatgtggaaggagcattagagctagaggacctgtaccaattctgttactacacctcactggccgcatccttgaccaatgtaagggaggggcatggtttctggagtcctgcgtgcttagctgctcctactcctggtgcttccgtgggacctagggctttctggaatacagtttgaaaatcagtgtgtcctgtgatctctagggttcctttcagtcatcctgttctatgattctgaaatgttttttaattccaaggcatttcttagaa

SEQ ID NO: 185329 - DNA, 262 bp, Homo sapiens
tgaattaaccctttcatttgcccttaaacagttttgtttagatgtatcaattaatgttaaacaattaatatacttaaccatctttaccccttatttactgagtatctgccatgtgccagatgctgctaggctctggggatctgacagtgaaacatggtatgatctcttctgtcatagagtttactacattatatggaagatagaaattaacaaaaagatgtacttacaaattgtaatgtgtgttctgaaggggaataaaggg

SEQ ID NO: 185330 - DNA, 285 bp, Homo sapiens
caattcttggttttcatgattgcaagtcacaggcaagtatcaagtgagaaattcagtttcatttgcaaggcttagagaggccaggtgattctagaaaaatgagccttgtatttgttttaaaccagtaaagagctttgagtgcttattaaattgaaagctctttaaatttattttgtattttattttattttatttcttttgagatggagtttcgctctgtcacccaggctggactgcagtggtgtgagcttggctcactgcaaactccgtctcccgggttcaagt

SEQ ID NO: 185331 - DNA, 406 bp, Homo sapiens
taacagtctaaaaagacttcatagacagccttgaataagtagggtttttttgttttggttttggttttttagttttttgttgttgttattgttttctttgagacggggtctcgctctctggcccaggctaggatgcagtggtgcgatctcagctcactgtaacctccgcctcccgggtttaaggaattctcccgcttcagcctctcaagtagctgggattacaggcacgcacccaccagcacgcctaatttttgtaattttagtagagacagtgttttgccatgttggccaggccagtctcgaactcctgacctcaggtgatcctcctggcttggcctcccaaagtgctggggttagaggcgtgagccaccatccccagccaaactttttgtatttttagtagaga

SEQ ID NO: 185332 - DNA, 207 bp, Homo sapiens
tcatgtgagtgtgatggcaaagaacactcctaattttcttttgccagaaatgtatttcactttcatctttgaaggatgtttatacagaaaatagaaatatgggtttgaaagatgtttttctcttagcacttaaaatatgttccactgttttctggcctccatgctttctgataagaagacattacttattaaaattagttcccttgt

SEQ ID NO: 185333 - DNA, 523 bp, Homo sapiens
ggttgagggaacgtggggctcaagtactgtgttcttaaattatttagacttgtttttcctctttggtgtgagtatggtgttcatttaaaatatagttgggtttgtttcagattgctttcagatttagtctccccccactcctacttttcttcatccttactgattttcgcttttaaatacatagggtattaacatgcttctgcaaacccagaactgtacaaaaagatatacagatggtatataggttattaaaccatcagtggtgttatttttgccttacactgttatctgtcctttaaagaaattaaaagaagaacaaactttggtagtggtgggttgtttttacatttactgtatatttaccatttctgttgccctgtatttcttcttttatatcaaaattgtcatctggtattccttccctttatcctgcagaacttcctttagtgcttcttgttatgtaggtctgctggcaacaaattaactcattttttgcttacctggaaatttattttcctttcat

SEQ ID NO: 185334 - DNA, 519 bp, Homo sapiens
gatggtctgggatgacatttgaatgcacagaggacaatgtctaaatgacaatgtcgagaaggaaaggcaaaaagaagctgaaaactattcccgctgtcccatggatactcgtcactccttctgcgatattcttcacatgggagctttgtctgggtagaaatggggagtgggatcagggagggctagacactggggcctggggacaagagccagggtttcatgtccttaaacacattaaaattctagacagatagcaaatgtaatgaaaattgcaacctgaatgtgttctgatagacaaagttaaacactttagctaaagtattacaagtataattaacaaaaagtttgcaatactctgaattgcttctgtgaataaagcttttaagagcatcaaattggttgtgcaaatgaatggtttactgagcatcttttggaatttaggatagctgctttctctgctaaccaacgcatgcacacacacacacatacacaaacacacaccattcatacagccaaaaa

SEQ ID NO: 185335 - DNA, 279 bp, Homo sapiens
gtgggttgaccgtggcttgtgggttgaccgtggcttgggtctcccgcaacaggactgctcagttccgagagggaatgtctcaagagcaagtggtctaagagagaagaagcggaagctggcagttctcttacaaagagtaagcctggaactggtcacagcatcattctccagcattctattcactaagctgccagagggcctgcccagattcagggaaagaagaaataaattgcgaattttgatggcactcttgatgcagttatcctgaagccactacat

SEQ ID NO: 185336 - DNA, 578 bp, Homo sapiens
cacatgagcccctcaacactctgctgcctttctccaacaggagggaaagagcgctcgaccgagcacagcctgaatccagctgctggttctgccactaacttgctgtgtgactctgaagaactgcctttccctgtctgtcccttgatgttctcacctcgacacgaagagatgtaagtcccaggcagtagctgataaaggaagggggaaactttcctgtttcccgcccttcagttcctatattccaggaagtttaatgggttttcagggctagaaaagttattattattattattttgtagagccagagtctcactatgttacccaggctggtctcgaactcgtaggctcaagcaatcctcctgccttggcctcccaaagtgctgggattataggcgtgagccaccacgctcggccaggaatctctgtttttaacaagctcgggagatttttcagcagccagtccagcaccccagagtttggcaggctttgccaagtgcttgatatgaggtggtaaatgtctggcacctttaaaatatagggccctttccgtccatctggccctacaggttgatgttaaa

SEQ ID NO: 185337 - DNA, 783 bp, Homo sapiens
agaggctctttgaaagcatgaatctaaatataaggatggctggaatggcacagtcctagctcctgtactgcagacttagaacctagaaggaagaactgtctcacttgccagcaccatcttctctggaatcccgagttgctacattgtaggatatccctctgtacactgcagattggagaacacaattatgtttaaaacatcttagatggccttcaaggaacaaagagctatgccaaattttcaaaacctggttgcatattctatcccaaaagaactccaaagtcttaaatctaccattaaagaccctagataattctaaaccacttgacaacagagagagaaccagaaactctggatccaagtggttacctctgacacttatgcaagccactttaacttctggtttgagtaagagcaagcgaatagcaaaaggtctttaaaagaactaaaaagtgaaatattcccacaagtaaacatgtgtcaccgaagactcaagaaagaagaatggcattaaaagacatactctctcccagatcccaaagtcaaacaataaaggtacatttaaaacaaaaccaaaaataaaattgttttgttttttgagacggagtctcactctgttgcccaggctggaatgcaatagtgcaatctcaatgcaacctccgcctccagggttcaagccattctcctgcctcggcctcctgagtatatggaactacaagtacccaccaccacgcccggctaatttttatattttttttttagtagagatgaggttttgctatg

SEQ ID NO: 185338 - DNA, 496 bp, Homo sapiens
gagaatggcctggtggaaagaccatcatgcttgtctgtgccaaaccttagccagtctctttttatagagatattttccctaatctctttccttaacttgtgagtaaaaatttctaggaaggctgccttctttcttgtgttgttttagtcactttcctaccataggcatatgtgactggatctttgttctgtgtttgttcatgtgaatcagaagtcctagctgccaggtagattgctcatgcagtaccctgtaattttgttgtgttagatgaaggaaataaattgccataatgtcagatcacctcacttgttattttaaatatgattaagggagtgtacctgttattccttgggattaatggaaaactctgatctgccttaatcagggaacagtagcagtgatcatctgccattttaaaagccaattcaaaaggatttttttttttttgcaagggtttttttttccttctgatgtggggtgtgcatgtgcgctcgtg

SEQ ID NO: 185339 - DNA, 277 bp, Homo sapiens
cccgctcccttacccatcatacaccctacactttagttatacaaaaccactatactcaggctgccattctcaagacttttcattactgatcccactgttgggaaaacctatatctcctttctttgttgggcaactcatataagctccttctgagctggctgagatatcttttaatatctttcctgaaaatcccttcacactgctgaatttaatgcctctcctctgttcccacagaggttcctgtctaactctccctgctactggaaggcgtgggctg

SEQ ID NO: 185340 - DNA, 233 bp, Homo sapiens
tttgtgtatttgcatcctatgtctacaaaatacccatttcaacttacaatattttaaacttataacagtttataaggtaaggaatatctataaaataccaaataacaaatggccaatatcctcagtagaaagagtcagtaaaagagacgttatccatatgtcttattggatcacagtcatttctttctttctttctttttttgagacagtcttgctctgtcgcccaggctgga

SEQ ID NO: 185341 - DNA, 162 bp, Homo sapiens
aagtctaaagtcctctaggcacttgtatctggctgaaatgtgagcatggagatttgtcctaagagggttgtgagcacattattatatagtgtgcatgtgtccgggggggcaaaatcacatactggtagctaaatgggaggagtctgccctcttaactcactt

SEQ ID NO: 185342 - DNA, 265 bp, Homo sapiens
acataatttataaatggatgcagatgaagagtaagttagtgagttgaaagatcagcttgaagaactcttccagaaagaagcagggaaagataaataaataaaaaagaaaatgttggggccaggtgctgtggctcacgcctgtaatcccagcactttgggaggccgaggcaggtggatcacctgaggtcaggagttcgagaccagcctggccaacatagtgaaactccgtccctacttaaaatacaaaaactagccgggtgtggtg

SEQ ID NO: 185343 - DNA, 233 bp, Homo sapiens
cccagtcctgtctagtgccagttacacatcagtgtctgtagtagagaccctggcgctagcatgaattctaccaagcaggctagactttacaatcaatcaatagaataaaaggaaggaaaataaacagttcctcccagcccactgagtactattgtcttgtctcttagtaccactacaaggaaatgctagatcatgagctggggctaccagagagcttcatagacttgacccca

SEQ ID NO: 185344 - DNA, 421 bp, Homo sapiens
gactttcctaatgctcccttactcattttctgcattctaagcattctcctttaactatcccacatttcttgaccctgtttttctccttcaagacattcttccttaaagactgcaacaattcccttccccatctctgccaatggaaatccaaccttcaaaatacccacccttcaaagcccagctcaaaggtaaccttcacgaagacagtcctgaatctcaccccagcttccccaaagaactcttcctcttctaagcaccaaacatataatactgctttaatcccccactcattttggaacatacccctccctgtctttctactatgcttttgcttatagtcactcagcaggtatttgttaaaaagaaaagtcagttaacactattcccttcccttctctaccataaaacatatttaaggccg

SEQ ID NO: 185345 - DNA, 364 bp, Homo sapiens
ggactacaggcgtgtgccaccacgtctggctaatttttgtatttttttttttagtagagacagggttttgccatgttgcccaggctggtctcgaactcctgagctcaagcaatccacctgcctcggcctcccaaagtgctgggattacaggtgtgtaccaccgcacctggccttctaacttgaggagaggttttaatcgtgccggtgagagagaaggaggaaccccaggagctctcgatgacttctggagccgaggctgccctccctgtctggccaggccctggtaggctgtcttcccacctcatcctttctggcacccctcccttctgtgaaagggatgctggagtactgctcttgtgcctga

SEQ ID NO: 185346 - DNA, 115 bp, Homo sapiens
aagagacaattacgggttccagggagaaaggaggcacatacaaaagacagaaacatggaaaagcaggcctgtggaggagttctgtgtaatgttatatggatgaaaaatgggcagg

SEQ ID NO: 185347 - DNA, 265 bp, Homo sapiens
actgtggaagcttcagagcactgtctgggtaagaatcaaaataggaagggattaaagctctgttattggaaggtcccacaaactgcctacccaagtaggaggtataggtgatattaataggaaaagttattctaagggaacctctaatattgaagaacttcagctgtctagctgtttggtggcctgtctttctgaaagttgtatcttttgaaacatagatgaaataatgagtacaagatttagtcattaattttgaacagtaagg

SEQ ID NO: 185348 - DNA, 325 bp, Homo sapiens
ggacaaaggactcaaatagacatttctccatggatgatatacaaatgcccaataagcccacaaaaaactgctcaacgtaattagccatcaggtaaatggaaatcaaaaccacaataacactacacacccatagggtggctagaatccaaaagacagataacaacaagtgttggagaggatgtggacaaattggaaccttctacattgctggtaggatgtaaaatagtgcggctgttttgtaaaacagcttgacaatttctgaaaatgttaaaaataaatgtaccatgtgatccagcaattccatccttaggtatctatgtgggag

SEQ ID NO: 185349 - DNA, 446 bp, Homo sapiens
ggggagcaggagagaaacaaagagagtggagcagctaaaggagaacaaatacacaattgtgctgttgaacttactgttgctaagtgcagcagaatgctagatttgtgaaactcggcctccaagaagctatctctataaagtacattcaaggactctactgggggcaatatgtggacaaaaaggaaggatttatccactggttcctgtttcccactggccaaaggtttactccacaggatattaatttgtctatacttctggattatgtaggccagggtgagggcacagggcagtgaaccaaaaagagaggctttaggagcaggcaggaggcgatgacactctctgcttgggactgtgtaaagaaaagccctcattgagctgcctgccaccacaaaagctgaaaaaataaagaaagaaagaaagaaagaagaaaaaaagaaaaataa

SEQ ID NO: 185350 - DNA, 314 bp, Homo sapiens
ggctgatctagaggatccctaggataccccattatgtgagatcttgtagcaagacttggattcaggagtgagatgcaaaacaaaaaaacaaacaaacaaaaaaccagggaacgcttatgtggtgtgggtgatttcagaggcagcttcctcatcgtaatacagctggggtgcatctagtggccatgttggcagctgctcccttaccagaccggttctacagtgggattcagcccagatcctagggctgggtatcaccatcctctgctgcagtaaatgactttgaaacacatagaatggattctgtagttggcagc

SEQ ID NO: 185351 - DNA, 375 bp, Homo sapiens
ccatatcaggaacacttacagatgaaaagtgttaaacatttatcaaattgtattgcctactttatataatctaatgggtcttatgagtaattattttcataatactaatttatgtgtgcctgggacagtgctaatttatggtggtttcttgtaattattaatagaaccacttttttactctaaatgtgtcctagttcagatgataagtcacttgatgacaaaattggtaataaatgtcctacttctcttaggtctcatgagaatggttgagtttgtcagtcatactcaaaatggcatgaaattaaaatacataaaatgtgtgatttatgttacattatgattcttgatatgttgtatttaacagttaggtacagg

SEQ ID NO: 185352 - DNA, 104 bp, Homo sapiens
aagcccaacacatgcaccagttcttaggtggtaaggctaagttctgaagttcatatttcattctttaagattgtcatatgcattattggtgttgtttatagcat

SEQ ID NO: 185353 - DNA, 349 bp, Homo sapiens
agacattggggagattgtgactggttggggcatttctcttcacacatcgtaaatgtctgggagggtaggaagaactttcgaggagtgccctttgtagcaaaggcatcttctaaacagtcttatgagttaacttagtctgtactcacaagagtgatagttgtaacagaggtaatagaagctcattgaatctggagagtggttcgtgtaactcatgggtagacccaactgttagaaattatcctgtgaaaaggctaggcttgacgctgcttgagtcagaactatatgcttataaggcaatactgttcactggtaggtgtggtatgacaagactgtgagtggcatgggctca

SEQ ID NO: 185354 - DNA, 661 bp, Homo sapiens
gcctagtcaaaagaaatggtattaaagctgagacctgaagaattaaagaaataaaggagccagtcacacaattctaacatattttagtagcagaactctttttaaaaatgaaatcattagtagaataccactcaaaagcaagtaaaatagacttgctctgatggaagctatttagggcttctgctctgctcactcagcctctcttaaccaaacccaaggaggccctggatattcttggagacctttttctagtatcaggatgagctgtctcaataaataatcctcaaaaaataatccagggcttcgtggaacgtggtttgaaaaccactggcctgggtgaagccagtaggaaattgctttatgctgtcctgccctgataatcagatacaaagataagtacctttcactcagcagttgagcctgcgttcagcaccgacacagattttaatctttcccttttatgtcctgaaagtttagatacacaaagcaccattgctatgttctttgtctaaagcttcagtgatcagtaacctagctaaaatgctttggatactttaattaacatgagatcattaatgataataataaatgcctcttaattgtatctaaatatagtaagccttagttaaatactgagaggataagcacttcccttggacat

SEQ ID NO: 185355 - DNA, 409 bp, Homo sapiens
atgttcaggtgacgtcttgaaagtgctccgaccaactcttcatggttaggatgtgtgctataagagggtcagaattagtagatgctaatgagaattaaggtaactggcccacacatagtcttgtccttttcaatacagaattcactcaattagtacttaattaaaattgaaatcccctttttttggagcacttactatttgtcaggcctggggataggtgcaagatctatgtctcattgttatatgtttgagactgtttcatcactgaccaagaagtttcacaatatttttcctggctaattacaagtccagatactggtctttaaaaatgggaggttttactatatgcctttccctgtttatgaagatgtgacttagaaatgatctctgtttacgaaaatgtccctgc

SEQ ID NO: 185356 - DNA, 137 bp, Homo sapiens
agaggggcagaagcaggtcactgaagtcatgagggctccggcctgcaaaggcagaaatctcctgcattacgaaccacaaaagaaagctcaaataggttaacaccctgtgaacactcagctgcaaacactcagaaggg

SEQ ID NO: 185357 - DNA, 426 bp, Homo sapiens
aactgacaaaatttggtgaatgacttgataaggataggtatgggaatggagaaagggcaatcaagaatgttatctcggtttctagctcgggacactggatggatgtgatgcctgtaactaatctatccactcttacactcattgtggcttcaatagattttgctaggaactaagtgaaacaaatatgtttaggtaataatggatgtttaagtaattcattcatgatctgatgtattaaaccgggcaaattttcattcacacttttatctagataatatctgaattgagtcgtgcttccttttaacagttggaggaaaatgtccttagatgcttcatattaaaaggatgcattttctagtctctaattcttaggctgatttactttaaactaacagattaaaaggaagcacgactcaattcagatat

SEQ ID NO: 185358 - DNA, 409 bp, Homo sapiens
ttagccaggcgtggtggcacgagcctgtagtcccacctactcaggaggctgaggcaaaagaatcacttgaacctgggaggcggaggttgcaatgagccaatatcacgccactgcactccagcctgggtgacagagtgagactccatctcaaaaaaacaaaacaaaaaaaaggtggaagctctgaagaaattaagagccatttaaaaaacagttatcaaaaagttaccctgtaggtatataaatacaatgttttaatttataagcttttccagactctcaaagagcaggtaatattagcaccatatgatgtacttaacatattttatgaggccaccattatcttcatatcaacacttggcatagtacacacagacacacacacacacacacacacacacacacacacacg

SEQ ID NO: 185359 - DNA, 428 bp, Homo sapiens
gattctgctcagtgtccttggagccacagttgtccaagtcttgggccctagatgagactttggactgtgctgggaagagcactaggctataagtctgcaggcccttcttctcctcgcccagtccatgaccctcggaaagctatttccagtgtcttggggaaagaggaaaatatcaaactggattatcattaaaacatcctgtgagtctcttattctctagtctgtcaaactgtcaaacttatgaccaaaaaaaaaaaaaaaaaaaatgtactttcatcagactagtgaaacaagaactgaactagaggtccccattctggtcccagttctactactaaataattaagaccttgagcaaaccactagcatcttcccttcatttctccctgtcttgacccatttcatcactcaaaacctagtttgattgc

SEQ ID NO: 185360 - DNA, 423 bp, Homo sapiens
atgcacatatactgaggatgtactcaggttcctgtgtgcttagattgtgttctactgatggaatgcacagtttggagactgcagaaatagagtgctatacttgaggaacaaagtcttcaggactagctgccttatagtaagatgtagcagtattgtggttcatgtgcagacagagagcgtggggaaggccagtccaaacgaacccagtgggaagataaagaaaaatacaccattgggatgcatcttgaggaacagtgaaatgaaatacgctggaccggaatgtgtttgcgttcttaaatattcatggtacacgtctcactttaaggctccttctgtttctcctctaactcgtttcctaagttggtggggtttctacaaattgaagaaccttgcatttctgtattattttgcccccagtctcag

SEQ ID NO: 185361 - DNA, 523 bp, Homo sapiens
cctctgaggctcagttccctctctgcaaaaatgggctcgtaagcaatcccttcctggccaggcaaggtggctcacacctgtaattccagcactttgggaggccaaggcaggagaaccgcttgagcctaggagtagtttgagaccagcctgagcaacatagggagaccaccttctacaaaaaataaaaaataaaaaaattagctgggtgcagtggcgtgcacgtgtggttccaactactcaggaggctgaggtgggaggatcacttaagcccaggaggtgaggttgcagcgagcagacatcgcaccactgcacttgcactccagcctggacagcagagcaagactccatctcaaaaaaaaaaaaaaattctaagacctcagactgtgacactactacaagaagacattggggaaattctgcgggacatgggctctggcaaaaatcccttgagcaataccccaaaagcacaggcaactaaggcaaacggggacaattggaatcacatcaggctaaaaagcttctg

SEQ ID NO: 185362 - DNA, 240 bp, Homo sapiens
tcattcctcaagaaccagatcagatgttcgacttctctaaagccctttcagaagcttcagcagagtaatgactccctttcatgtgctcctctagggtacgcacaaacctttgcatatcataataaagcacttattactttgcactggaactaccgattcacatttcttttctgctccccaccccacctggctgagctcactgaggacagggatgatgccactatgctttactcaacttct

SEQ ID NO: 185363 - DNA, 154 bp, Homo sapiens
tttttttttggtcccaacacatgcaaaggcccctctcatcagtaaaatacaaccacgaagactcctcctttcagaaagcacatgaggtcaaagctattttcctaataacaacactaagatgttacttgcccttcccactgagttgaattttgca

SEQ ID NO: 185364 - DNA, 468 bp, Homo sapiens
tagtcaacatggctctagcagaggaaacttggcagcaatcctctcctttgggagccaacatacagcaccctgcacaaggttttgcccagagcaggcgctaaacaggtgtagaacgaatgaatacgttttagacttgagtgtgcagtccctattatccagtacactgctatagaaatgaaatctattggcaaatcagccaacctgagcagagcatgagtataatcaagtgagagctccttgctcatacgcagtgactccccgactcactgtttcaccaagttgacactattatgtgccctgatttgatgatggttaaggttttacctgatcaactataacaaggaatcacctatattgcctgcatggatataacaagggctttctagctcctgtgcacaaccaaaaagaaaaaaaaaagtgtccagtcaaaaaatattttatttttattgccatgaagcttgggatatg

SEQ ID NO: 185365 - DNA, 184 bp, Homo sapiens
tgctggacttacaggcatgaaccatcatgcctggacatcatgaatgtatgtatgtatgtatgtatgtatgtatttatttttttgagacagagtctcgccctgttgcccaggctggagtacagtgacacaatcttggctcactgcaacctccgtctcccgggttcaagcaattctcctgcctcag

SEQ ID NO: 185366 - DNA, 729 bp, Homo sapiens
cctccagccctaccctgacattctcaatcgctgttgtttaggccttgcagcatagccagaggcatctgggacagagagaagccttgtctagtcctttccccactccagagtactgccaggaccccagggctaagggacacagcttctctggtactgccaggggacatgacagaacagccccaagggttgggctcaatgcaggaccttgttctgctgccgagaaaggggagagtggttttggacaaatggaggctgattctggggaaatgtgtgttcatgtgtctgtgtggtggtggtggggagggcgggcctcccatgactgagaagcatcagtgagcactggaactggcccaagtaatttgtgcagcctcaggccccttggggtgagcccagctggggctgtaaataatgggtggggatggaacttctagtttcctgcccagatcagaaaaagcctggcccagagtggaggcacagcagaggcccaacgaatacctgcacaattgaacccagatggtcccctggaaggtagtggtgtactctgtctcaggtcctagcagagtatactaagtaagagcacaagttcaacaggcaaacttgctggattcaaaatctagctctgcctccatgacctaactcaatatcattgtgggccagtcctttaacctctctgatccttggtctcttctgtaaatggggactgtaaggcctctacctcacaggattgtt

SEQ ID NO: 185367 - DNA, 196 bp, Homo sapiens
ctgctgatcactctgcactcacctgttggctccctctggccacaggggtccagttgctccctgcggtatgtgcagttcctacaagaacacctgacttaggtctccctttgcctttgaagccaccaggaggaggaaaaagcttagtggtgttcattgggttcaaacagacatcgtttcctaaatcaacattaatgtg

SEQ ID NO: 185368 - DNA, 355 bp, Homo sapiens
gtgttgtgatggtagctatcacttagcaagaagagattaaagataggtacaaaggcacacaacaggtaggaaaaagaaactgccccaacagccagcacatatcaggaacaattttgaatgatatatacttatgattggtaagtgattgtggtagatttttgaaaagcttaaaaagattgacactgaatattaagtatgcttgccataaaacaggcaaaaaaggagaaaaaaagaagagaaaaagggaaaggtaaagaaattgatttaggaatagaagatacaaacttattcatactaaaaggaatccactaaaaatattcagttatctatttaactttacaattatatagaaagc

SEQ ID NO: 185369 - DNA, 531 bp, Homo sapiens
gcttgattctgttcactagaagtaggccactaagtctacccatacttgagggaaggagaattaagctccagctgttgaagagtatcaaagaacttgtggacatagatttttcaaaagtaccaccacaaccacacagtccacttcacattgagtagtggaccccccttttctttctctcttcaatcctctgctctctcagaaccagtacaaattcctcctcttgtctcataatgagcagtgtaaccatttccttttcctccaggtctctctgaaacactcctgcccttatcttctacccacatgagcttatcagtgtatttttttcatcccatagataatcttttcccttcgacgaattttggtgccagttattaacataatgaaatttctatttgttgtatgaacttttgtatagagaaaattatgttgaaagaaaattccatatcctaatcaagcaaatgtggaggcaaaaggagacatttgaagacaagcagggattctgaaactttccctcccatgcactctctgaaa

SEQ ID NO: 185370 - DNA, 525 bp, Homo sapiens
tgcctcttcatcgcatcttcattaaccctgggaattaccactttagctttgatttccaccacatctatattccagtgttattggtaaacaacaacaacaacaaaaccttaagataggaccacagtgcaaaaatctatttgcataatcaaaaatgccatttgttcctgtccaggcgtaggaaatccagaattcttgcttcttacaccaagaattctaatgtagatttttaaagatgcctttaaagtaaataatcaggccgggtgcactggctcatgtctgtaatcccagcactttgggaggctgaagggggcggatcacttgaggtcagaagttcgagaccagcctgggcaacatgatgaaaccccatctctactaaaaatataaaaattagccaggtgtggtagcatgcgcttgtaatcccagctactcgggagactgaggcaggagaatcgcttgaacctgggaggaggaggttgcagggagccaagatcacgccactgcactccagcctgggtgacagactga

SEQ ID NO: 185371 - DNA, 852 bp, Homo sapiens
catattagtggccatgtgatcaaaacattccaatgactttccatgtcactaaaaataaaaactaaagtccttaagactgtctatgagaccaatcatgatcttggtgcctgttacctctctgatctccctcttactagtttcctcttagatcattccactccaagtatgctggcctcgttgctggtcttcaagcgcattgggcacattgctgccttgggtcatctgcacttgctgttcaccaggattgtcttcccccaatataaaacgaattgtacctcactcctaatccatgaaagtcaaagcagtgattaattccttaaaataaccatttatcccccatttgcagttctgtaaattgggcatgttgggggtttaatgatgaagaactattacatagagcagttcaatgaattttaattctctacaaatggctttcatagattgagagcttaactgatatctagcttccttttcttctaattcctaataaaatcctaagattataataggctagaattgcatttacttaccaatactacacctgtattaaactggatatttcttatgcttacatccttgaatttttttaatttttaatttttgtaggcacatattaggtgtatacatttatggagtacatgaaatattttgatgcaggcactcaatacataataatcacatcagggtaaatgaggtaaccaataccttaagcatttatcatttcttcgtgttacaaaaaatccaattatactcttttagtttttttaatgtacaataaattactgttggctgctatcaaatagatcttattcattctgtatatttttgtagcctttacccatccttacttgc

SEQ ID NO: 185372 - DNA, 504 bp, Homo sapiens
ctggccctcctaccacgattcatacaaagtgctcactacaggatgctgtgtcaaaatccaggcaaggacccaactccgggcagcccctcctccctgctgacctcaacaagggctgtgctattgttttttattattattattattattattattattattattattattattattattttaaccacgagggccaggtggtggcgccaaggtcatctagctatttatcttacttctgtttctttccaactttttgctttctcccttttctcttgtcttataaactagggaaaaggggaggtgggggagaagctgggaaggacaacaggagaagtggtggtctcattccacaataggaagagtgtttcctgggtcataagcgaaaatttttggatccatagaacaatttaaagcaagagcacagaacgttatgttggaaggaaacgcgtcctttagaactctaaaacaaaacattttctagcatcaggtcacaataaacagaagctg

SEQ ID NO: 185373 - DNA, 188 bp, Homo sapiens
gaaaataggaaaggaaagttaagaaacaagaatagttggtgtagacttttggttgtatctaatagagatttagaaaggaaagacagtgacgaaagaagggactgtagtaataaaataaaagaaggggaaattccagtgtagtgaaaaaagagcagattcttaaagttggaaggatacattgagtgtca

SEQ ID NO: 185374 - DNA, 135 bp, Homo sapiens
caagcctttcttcatttccttcccagaccctacttttggagctcatttagattcatatagaatcttatccacagcaattattttataattccttttatggttaaatgtgggcatatctaacgtacaagattacaa

SEQ ID NO: 185375 - DNA, 407 bp, Homo sapiens
gaggcaggagaatcgcttgaacctgggaggtagaggttgcagtgagctgagatcacaccactgcactgcagccttggcaacagagcgagactctgtctcaaaaagaaaaacaaaaaacaaaaaacattgagcttctgtgcccagccgtgggttggggactggggttataactgatcagggttgatgtggtaataagccgagctttgcctgccagtcatcttgctgtggccatagggatcataaagaaaggggtattttcattttttcaattattttatgtttggtgctttctgtatgataacaggggaagatatttttttttgaggcattatctcaaagtaatcatattcattgtagaaaagttagaaaggatagataagcctaaattaaaaaataaaaaacaagcc

SEQ ID NO: 185376 - DNA, 458 bp, Homo sapiens
aaagagacgatactcaaaaagagaacagagacatacagagaaaggaagtccttactgtgtctcaaaagccaggcaccagtagggttgagggacatctgccaggaaggaggttttcagcagcatgaactgttttagataactagggcagaaaaaaggtgttaaaatgtgacagcaagaaggtcactggtgacctcaaggaagcagtctcatgagtgtagaggtggcagtcagtttgcaaagggttaaagaatgagtgggtgggaggaagtgaaggttttcaaggtatttggcagcagaatgaagggaaagaggaaagagaggagaggtgctctaggggcaacagtgagtggatgggatccttccgttttttcatgggacacaaatctcatcatgttactaccctgcttaaaaacttcaacttcccctaatgcattataaggcccaaaagtaataaagca

SEQ ID NO: 185377 - DNA, 335 bp, Homo sapiens
ccatcttcttcaatgatatgcatagtaaaaatacaattaaaagtttcaatctcacaatatttggaaagatgaaaagtcagtagattcctttgaggccttatagtaatcctgtgaaatggttaaagtagagctattattatctttgtttcacagctaggaaaactgggacagaaatcagaaaaaagccaggactgaaaccttgtttttcctttttaaatgcataggtgtaactttctagataagatgaatattcacctcacccctgcactcccaataagattaagattgtaagttaggttcttctaaggaccaggatgaattaggtggatgtcctt

SEQ ID NO: 185378 - DNA, 447 bp, Homo sapiens
caagctattctcctgcctcagcctcctgagtagatgggattacagacgtgcgccaccacaccagcttatttttgtatttttagtagagatggagtttcgctatgttggccaggctgatttcgaactcctgacctcaggtgatccgccgcctcagcctcccaaagtgctgggattacaggcatgagccactgcgcctggcaggagtattgttggtaagtgctccaatagtggttaagtgcctgaaccatgcccaccaaccaaattatggctttggctctgagatacccttgatcaacttagccagtgatttcccgcaacctaagcatgcaagaaaaagaaatgaagaggatagaaacacaaatacctgtagattctgaaagtcagatttcttggcccctgtaagaataaccactcactgcaaacaccgctagttgcctttaagactgc

SEQ ID NO: 185379 - DNA, 340 bp, Homo sapiens
attttccaacatttaaaatgtgggagactccacagagaatcacctgcttcacctggctccacggggctctccctgttttgcagtgttaagtgcagccaagggcttggcggttccctatcccacctgctctgctcccatacgcttcttgcctggcctccattggcctccgcattagactcctggtctaactttcaagcaactaaatcttcaagatttagttcctttggccaggcacagtgactcatgcctgtaatctcagaactttgggatactcgtgggaggatggcttgaacccagaagtgtaagaccagcctggttactgagaccccaccactacaaa

SEQ ID NO: 185380 - DNA, 534 bp, Homo sapiens
gaatatccaaaagatatgcaagacctcatcacagaacactataaaacattatgaatctaaaggagaactaaataaactgagagatatacagtagtattagcacatctgtagattcaacacaattccaataaaaatcctattggtttttactttttaagtggaaattgacaaactgaatctaaaatttatgtggaaatgcaaagagccaagaatagccaacacaatcatgaggaagattaaaactgatactagatatcaaaaaaaactgtataatttagaataggatagagaaataaaccagtagaatagaatagagagcctaggaaaagacccatacatgtatgaggcctaatgtgtgggcaaagatgagactgtagggaaaagatgatcattttagtaaatggtttggggttaattagatatccatatggagaaaagcattaatcttaactcttaacctcattccataccaagaaaatcaactctagatggattgcagatctaaaagtgaaaggcttagcttctcacatgccc

SEQ ID NO: 185381 - DNA, 347 bp, Homo sapiens
tcagcagtgaatctaatttttaagagtcatgatctcttttattattatcaaaacaacaacctgtagcacaagctaccttggaggctgaggcaggagaatcactcgagcccaggagttggaggctgcagtgagctatgatagtgccattgcactccagcctggatgacagagcaagaaactgtctctacaaaacaaacaaacacataaagtccaaaatattaatggtgagttgtctgtaaactacacttgaatagaagggctttcagttaaacttgacaatgtaaaaatccatttgctttccagggtatcagtaacaatttgcacaattatttccatctttttttatt

SEQ ID NO: 185382 - DNA, 491 bp, Homo sapiens
tttctaaatggaaacccttcaatgactacctacttaactctccaacatgatctcctcacgttgcccaggatctttcttgcttcagtattaccaagctgcttggagtgctccaagcccacttactatgagtttcattgctctacgttcatgctgtctgcctaccagatccaccttctctttctttactggaaaaaattccatgcatccttcaaaatactctttcattgtcttcctgtgaagttttctctgacctctatcctctctttagctcctttttatcttgttaactacactattttatatcaacacaaactgtactataattacatacttatctctttttccctcctcagctatgagttccttaacagcaggtttgtcaggagttcctaagactatccccaggttcagtgattcacttgaaggactcacaggactcaccattgagttgcagcacagggaaaagacacacggagagaagtttggaagaa

SEQ ID NO: 185383 - DNA, 1015 bp, Homo sapiens
ggacacacacctccaaaggttactggatctatgatggaggacgctattgtttccacatcaacacctggttctcctgagactaaaaatgttgacagagactcaacatcccctctgactcctgaactgaaagaggacagcaccgccctggtgatgaactcaactacagagtcaaacactgttttctccagtgtgtccctggatgctgctactgaggtctccagggcagaagtcacctactatgatcctacattcatgccagcttctgctcagtcaacaaagtccccagacatttcacctgaagccagcagcagtcattctaactctcctcccttgacaatatctacacacaagaccatcgccacacaaacaggtccttctggggtgacatctcttggccaactgaccctggacacatcaaccatagccacctcagcaggaactccatcagccagaactcaggattttgtagattcagaaacaaccagtgtcatgaacaatgatctcaatgatgtgttgaagacaagccctttctctgcagaagaagccaactctctctcttctcaggcacctctccttgtgacaacctcaccttctcctgtaacttccacattgcaagagcacagtacctcctctcttgtttctgtgacctcagtacccacccctacactggcgaagatcacagacatggacacaaacttagaacctgtgactcgttcacctcaaaatttaaggaacaccttggccacttcagaagccaccacagatacacacacaatgcatccttctataaacacagcagtggccaatgtggggaccaccagttcaccaaatgaattctattttactgtctcacctgactcagacccatataaagccacatccgcagtagttatcacttccacctcgggggactcaatagtttccacatcaatgcctagatcctctgcgatgaaaaagattgagtctgagacaactttctcctgatatttagactgagggagactatgcacctccc

SEQ ID NO: 185384 - DNA, 538 bp, Homo sapiens
aaataaggacgtcagtttgcaaccagacaagtttagaggcctgtggaattcccaggccaagggaagagttgttacggagactctatggccaagagggacagatcacactagacatcaagctcaatggatgccaccaagggcagccacctgctgtatcttgtacacgtttcatccatccagcttttagcctctcaatccttctcttcctaatagggtaggtataagattcccattgctgctgtaacaaattaccacccacttagtggtttaaagtaacacggaagtattccattacagttctggaggtcagaagtccaagctgggtctgcatggtttcattccttctagaggctgtgagagagtccatgcccctgtctgttccagcttctagaagctgctactcatcttggtggccttgcatcccctctgacctgtttctgtcctcacatcttctgactctgattctcctatttatatgaccctcttataaggacccttgtatattgggccacctggataatccaagatactctcccct

SEQ ID NO: 185385 - DNA, 353 bp, Homo sapiens
attttttatttgtttgttccttccaactgaacttccttctttaacttcttgatagtacatataaaaaggctgagggaagcctcctgccctgcagtatgacacttgatgaggaaactggaggactttgagagcatagatgacatttttaccatttcttctcataaattgctgggacttgaaaatagaattgactggctttatggatggtgtcagtgaaagggattttgatatctgaaccatcttggctggaagtcactgcatctcacatagtcagggagaatgtaattttctagagtccagctgagtgatagaaagctttaacctaattactgaggggaagggctaaaaaggcc

SEQ ID NO: 185386 - DNA, 599 bp, Homo sapiens
tcttcactctaggaaggcagtgctacaaaaagagacagacgagaatctgaaacttcccgacatgtcagctgggcttcctaactttttttgtccttgggctttttctttgttgttttggggattcatttgcttttgtttctaagtttttagcctagttccccttatgggaatgggatcaatcattaaagcgtttgatttcctctgagaaaccaaggctaatagtgcctgctcagaactgtttctgtgatcttaggaatggattaaacaccaagtttaggtgtagtgaacttagcaaaaattgcaaggccatctgcttcacatatgtgtttgagccacaggctaaggatctctagagatctgagtgagaaagagaactgagcccccagagcctggcgctccctccacagacctgtcttcagtatgccagccaccgggccaagcattttattctggtcacatgactttctccaaaccttgaaaaactactgtgaagtcagcttattaccatagttcatcaaattcaagaaaccattcattataatatacaccactattttatgtaccattattagactatgacacagtgccttattttcact

SEQ ID NO: 185387 - DNA, 165 bp, Homo sapiens
gtgattttagacaagtgacttcatttctccaagtattatttcctcattcatcaaatagggatgctacgacttacccatgggaattaaataagataatgcaagttaagcataattgttaataagattataagaaagtttttaaaaaatattttttccttaattttt

SEQ ID NO: 185388 - DNA, 279 bp, Homo sapiens
tggccaagatgaattcagtgacagtggggaccaagagaagggacaatgtggctttgaacacaagggtgagaggaagacaatgaacaccccttcctactcaccctcgacatgaaaccaggggaaaccagaaccaaagggaccttgaaaaaagattgattcaaaactccctccacgaagaagtggtgagtgtactgggcctgggagttcaacaccagcacaaagtacagggagtcagagacctggattccaatcccagctccataatcactagttgcatga

SEQ ID NO: 185389 - DNA, 2097 bp, Homo sapiens
tgatacggagtcttgctctgtcgcccgggctggcatgcaatggcatcatcttggctcattgcaacctctgcctcccaggttcaagcgattctcctgcctcagcctccctagtagttgggattacaggtgcccgccagcatgcccagctaattttttttatttttagtagagacagggtcttatcattcttggtcaggctggtctcaaactcctgacctcaggtgacccacccgccttagcctcgcaaagtgttgggattacaggcgtgagccaccatgtccggcctcatttaattctcataacactttaggtagcttattttattttattttttttacacggagtttcactcttgttggccaggctggagtgcaatggcacaatctcagctcactgcaacctctgcctcctgggttcaagcgattcttctgcctcaggctcccgagtagctgggattacaggtgcctgccaccacacccagctaatttttgtatttttagtagagacagggtcttgctatgttggttgatcttgaactcctgacctcgggtgatctacccgcctcagcctcccagagtgctgggattacaggcgtgagccaccgtgcccagccttggtagcttatttttaaattgcatttgctacaattctcctgcctcagcctcccgagtagctgggactacaggtgcatgtcgccaggcctggctaattttttgtattttagtagagatggggtttcactgtgttgcccaggcttgtcttgaactcctgagctcaggcagtctgcccgcctcagcctcccaaagtgctaggattgcaggtgtgagccaccgcacctggccactactttttggaactctattttgtacttgctgactttcacaaaaagtttgaggcagcttacaataggatgtaataggatgaaagaagaaacaacaatatattaatacgtggccagaattagtgtgcttcagaggttgtagaagccttattaacctttctcacgtttttcaggggaaagccttgccaggcagttactactactcaattgagaaagatgtgtgctaagtctcaaaagcaagtacttgttctcagtcacatcagtagtgagtagcacgcttaaactgagagtttctggttctggggtgtttctgttttactccaatcaagaaagattcttcgttcctccatactcaacaaaatggagggagactgggtaccaagttcagacacaacaatatatttacttttgtttgttgttttttaaaatattttttcagtatacatgtagcatatcatcttcttacagcaagactgtgcaatagatcatatacttgctttgtagatgggaaggctgggactgcgtgaggtcacgtaatgcacccaaagccatgtagccattaactggtagagcccaagctcagacactagaattaattctgtctgaaaccaaatgcaagcttggtccattgttctagactgttgcacttattctgtgctggccagctggcataggcaggacaacactgtagtgtggggacattatcttcccagtggcctagatgggaaggttaagttcagaagctagttgggtctgattccagagttcaccttgccagtccatttattggtggatttccttccagtgttttttccccatccataagcttgtggtttttcttttttcttttttttttcttttgagacggagtcttgctctgtcacccaggctttagtgcagtggcgcgatctatgctcactgcaagctccgcctcccgggttcacatcattctcctgccttagcgtccccagcagctgggacaacaggcgcatgctgccatgcccggctatttttttttgtatttttagtagagacagggtttcactgtgttagcaaggatggtctcgatcttctgacctcgtgatccgcccgcctcagcctcccaaagtgttgggattacaggcgtgagccaccacacccatctttttatttatttattttttgagacagtctcactctgtcgcctaggctggagtgcagtgagccaagatggcaccactgcactccaacctgtgcaacagagtcagactctgtct

SEQ ID NO: 185390 - DNA, 526 bp, Homo sapiens
aagactgctcctcaaaagggaaaaggaatgacaggtcaaatgtggttaactgagctaccggacagttggacaagctgagaacatacagcaaaacagagattttatttccataaaacaaaggcttccaaagtcatttgaatatatttatgacacttttatagcaatctggaacaagtattctggattacattctggcactactttagcccaggagattaaaatcacccactacataaaggccaaataaataacaatacgcttgcttattaccaaatgcctcaagccaacaggaaattcttaagcagcttatttccagcagcttagggtggctaagtactttactctcacctttacccataacttctcattaccacctaaccatgatggccttctttgttcagattagaaaacccactcacaatgataaaaaccatgtaccactacctgtctgcccttctcccctgcaagtgcattccctttgttatataaggaaattaagagaaagtcctgtggcaaaaaaagaaaa

SEQ ID NO: 185391 - DNA, 315 bp, Homo sapiens
gcgcccgccactaagcccggctaattttttctattttttagtagagacggggtttcactgtgttagccagtatggtctcgatctcctgacctcgtgattcgcccacctcggcctcccaaagtgctgggattacaggcgtgagtcaccatgcctggcccatttgtttctttatttgcaagcactttatattcattagggatataaaccatttgttacattaagttgcaaataggtttctcaattacatggctcttctcaaaatcttcagagtggctagtaaaatgaaaaatatgtcagctgggagagcactcaggg

SEQ ID NO: 185392 - DNA, 239 bp, Homo sapiens
tcccaagttttactttcgcttagatgtatttcttacaaagggtatttaaccatgaccaggaaagaatatatgatctttatttgactcatttaaatgggaattccacggatatctccctaggttctttcctactagtatttaattttgtagctctgaaaaacggcctgagtttgtctgtttctctacaaaatagaacactgaatggtatatttaccccacaaccttccttaagacaggat

SEQ ID NO: 185393 - DNA, 503 bp, Homo sapiens
tacatagcccttaaacaaatttacatagcctttttcctagctatcccaaaatgtagattcttcaaggaatatttcaggcatttaaacggaaagtgaactcccatgaattttggcaaaaataatggaaacaaggactgaaacaaaaatatccaataaaacactttctctttcctgaaagggatggaaaggaaataaaacacaccctgaaaagaagatgattttataaaacgttactaggaatagcttttaccaaattgaaagctatttttttgtaaaaaaaaaaaaaaaaaatcaaaacctgtttcccagaatgacttctctaaaatcatcagcagctcacgaatgtttttgtgtttaatgaacgtttacctcatttaagctttctttatattcaaaaaattaaggagaccaattctgccaaaaggcatttttaatcatttcgaataaaaaacaagtcagtcacaaaggactaaccagacatttcaaaagtggtaataattttt

SEQ ID NO: 185394 - DNA, 577 bp, Homo sapiens
tgctggaattacaggcgtgagccaccatgcccagccaggaaaggacttttttaaggtcacacaagtggaggagctgggacttaaatgtgtctgctgagagtgacagtgaactttgcatgtgcccaatcttaccaaattaatgttctcttagttgaattattgcccatctcaccaccaaatgtgtatcttctcaggggtgtcagtttccccagggtccagatcctggccccacacccacacatggccaaggagccatttacatttaacattccataataggatgcataccttttcggttatttagggaggatgtggttttgcctggaaggctttgagaatgctgggcagctagctcaggggacgtggggcttaaagcagaggccgatcaacttttttctaaagggccagatagagcgtaaatattgtcagctttgttggacatgtagttctcggcctgccactcagctttgctgttgcagtacaaaagcagctgtagacaaatgagtgtggctgtgttccaataaaactttattcatggtcactgaaatgtgaatttaatataattcttacatatcac

SEQ ID NO: 185395 - DNA, 1858 bp, Homo sapiens
  misc_feature (873)..(873): n is a, c, g, or t
  misc_feature (1137)..(1137): n is a, c, g, or t
acactgacttctggacgtggtcagggtggctttctctggctggcatggacttgagcagaaactcattgccggcttcctccttgcacgagcaccaagtgattcccaggtcccccatcctcccctgggacatcgaggacacacaaaaaccttgttcaccctccactgagagcggggctagagatggatgctgagtacaggaagggtgtgtgaggattcctttggctccactcttgtttccaactattgctggtcctaggcgcccagtcctgagcaaccatgacgatggagactctccccaaggttctagaggtcgatgagaagtctccagaagccaaggacctgctgcccagccagaccgccagctccctgtgcatcagctccaggagcgagtctgtctggaccaccacccccaggagtaactgggaaatctaccgtgcccctggacatgacaacatgactctaggggttagtcagctgaagaagtttagttcctaattatataatatttacatcagaggcagtggggtaggctaggggatgtcactgtttccgcttgaccttatctttctcattgaccactgtcttctctgaacttgatcattagccaaggacaaaatgcatgttgccctaatttctttcctacccctgcctctatctctgcatctagaacagctaaatggaaagatacagagggatcctgtaaggttgttttccctttcacgtccatcaagatcaaaattgagagaatcaagttccatatctgaatgatctgtaggtttctagagatggaattaggaaactgcacggccatttgtctgacctcccagatgtttttacttcatccctctctttcccggcttcccacctcttcancaagtgcctagcgcagcttctcctggaggcacattgagggcctcctggtgtctatggtagagacgggaagtgggtttccagagggcctggcaagcaaagagtccctgagaagtgcttctgtaactccctgtggcaaccaagaggcccgtaggtgaaagaacagaagcagtacctgtgagggagccagccacgctgccctaggccaaagacccctggagagcatttggtaatgaggtgtgagaggagagcatcctgcaccagaancacccttgtcttgagctaattctcttcactcctcagccttgtggccttcccagtcaccatggccctccagatatccccatcctgcatggcagttccatatgcagagccagatcactcactggaaacccacactccaggtgcctcatttcctctgcccaggagattgtagcctgggcacagctatatgaggagggcccatttggatactgctatcatggatgtcttagtggaaggaagtttagggataaccacaactctagaagtccaggttctggactcactttgcagactctagcagtacctgcctccattccctgcccactcaagctagtttctcagcaaagagaatatgaggaaatatccccaaacatcgtcatccccactgggatcctccacatgagtgtgggctggaaaggttccagggtcacactgaggcaggacattttttgccaatgcctgttaccccatggaaggctgaggtacggatgcacctgatctggaaatgcagcccaggtcagactccacatttctgcaacaaagcatcacctgcaatgactcttttcacgtcagtgggtcaaaggacagaaccagcttccgtgttttaggctcactagattgtctcatgctccccatggctattctgtttgggagaatttgatctaacccgaagcctaaaggaatcaatgtaatgttgaattgtattctatgtaacactgaatgc

SEQ ID NO: 185396 - DNA, 545 bp, Homo sapiens
gcttcctgtccctgggactcatgatgctggtgtgcgggctggtgtgggtgcccatcatcaaaaagaaacagaagcacagacagaagtcgaatttcttacgcagcctcaagtccttcttcctgactcgctgatggtggtttccgcatctccctgccaccttgactgggagaagatctgatgaccaacatccgacatccctgtctcctctgtggggtgccataaaactgatccaggaaaatgttccagggtcacactgaggcaggacattttttgccaatgcctgttaccccatggaaggctgaggtacggatgcacctgatctggaaatgcagcccaggtcagactccacatttctgcaacaaagcatcacctgcaatgactcttttcacgtcagtgggtcaaaggacagaaccagcttccgtgttttaggctcactagattgtctcatgctccccatggctattctgtttgggagaatttgatctaacccgaagcctaaaggaatcaatgtaatgttgaattgtattctatgtaacactgaatgc

SEQ ID NO: 185397 - DNA, 269 bp, Homo sapiens
atttctactagctattctgttctcattccataccagtccttccctttcctcattctttctgatcaggcctgtttataacatttgttggggatcgggcaaaagtacaaatatgggtcaatgttacttatatctaaatattttaatcatacaaattaacctaaaaacttgaaagagaagatgtgtgctatcttcctaccttgacaaatatacttcataaataacctggaagggggagttctaattttgaattattgttctgtgcctaaatg

SEQ ID NO: 185398 - DNA, 405 bp, Homo sapiens
gttcagagaagttgaatgatttgccctaaagcagaaggtagtaaagtggcagtgatgactaaaaacctcgtcaaccctagatccaaggctttgcattctgccacaggttcgacctaagaatcacctccaagtatgtacacttcctaaatcccagttgtaccaattaattttcccaagtaaattttacctagttcaaatttattgcctttcaacattgaagggatatcaatgtgtctacttcattaaaaattagctggcacaggccaggcgcagtggctcacacctgtaatcccagcactttgagaggccaaggcgggcagatcacctgaggtcaggagttcgagaccagcctggccaacatggcaaaaccccgtctctacaaaaagtacaaaaactaggtgggcg

SEQ ID NO: 185399 - DNA, 464 bp, Homo sapiens
gctgggattacagccatgtgcaaccacgcctggctacttttgtatttttgttagagacggggtttctccatgttggtcaggctggtctcgaactcccgacctcaggtgatctgcccgcctcgtccttccaaactgctgagattacaggtgtgagccatcgcgcctggccggtgtttgcttttaaaagactagagggtgttgaatttttagaaattcatcagtctccatgcacgttttcaaggctactttcttttctcataaaatgaagctttattttcatattacagtttgtattagaaaggtaacccctaggacagttaatctgtaaatttagcagaatctcaaattggatggcagaggttttagttactaatgctgattccttaaacttaagaaactcatttcttctgactgggcctctgtttcaatttcattatccaggaggtcccttttcttgtagtgag

SEQ ID NO: 185400 - DNA, 277 bp, Homo sapiens
actgaccacaggacgccctgctcacgagcgcatcccagaacgttccctcttataagaccttaaaactagagccaccacgcccagcacctattagatcttttaaaattacttctcttggttcagccatgtgagcatggaggccctgtggcatccttgaaggaaggaaaatagacagggatccagatcctggcacctgggtttagtggctgtgtgtcatagcagccgtgtccatgaaatgggatcaaacaagaacatagatgtcatcattagcataatt

SEQ ID NO: 185401 - DNA, 479 bp, Homo sapiens
acatttttatgtagaaatatattcttgaaatgtaactagcacatagtcagtgtttcttaaccattttggggtcctgaaactttttgataatgatgaaagcacagagatgctatcaagaaaaatttacccacataggaacacacacacatacacacagacacacacagagtttgcttataagctcaggaagcttaaagatctgctaaagattatgcttgggtttgccatgaatcataaataccaagtcaaatacctttgaatttgattcttaacaaatctttgtggctgagaaaccatgagatttcattctggcatgtccccagaatgtaattatcaatgaacaatagccattgaaaaaatctgaacagatattattgaggctcaaggttgtttaatggcacagataatataattcaaatcatgaccccagggctgatgaagtcttgttgtaacgtgtaaatggggtgggtgatgggaga

SEQ ID NO: 185402 - DNA, 158 bp, Homo sapiens
aatcaggcccatatattggaggaagattatttggaagttcttcagtattatttatcatctgctactactggcaaattgcctactttttaaaccacatactgtattatttgttaggtgggggtcattaggcctccaacctcttttctcccaaatctaca

SEQ ID NO: 185403 - DNA, 493 bp, Homo sapiens
gatccgttccagcagccatgccaaatcagttgtaccacttggattaaaggcagttgcagaatgccatactataaaagacttccatggcatgcttacaaattaggtttttaccagtttaccaggatcaggattaccagtttcacctgaccattactaaagtcccttgttgcactcttccatttgatttgaccctcatttgttgaacatgtgtgtaactgcctttacttttccatcccctgccacttggattcaagtacctcctccaatttcagaaggttagattaggggatttttaaggtttaaaattctttgggtctaggtgttgaaacatcacactgtcagttacaaaacacagtgtgtagcaagaacctaaattatgtttaaaaaatatgtatgtatagacctgaagaacatagactaaatagacctgcaggttataatttatgtatagtttgcaaattgtttacaacaatcgtgttgtttcacagtcagg

SEQ ID NO: 185404 - DNA, 463 bp, Homo sapiens
attcttctgcctcagtcttctgagtagctgggaatacaggcacaagccattttacattccagccagcagtgtataagggtttcagtttctccacatcctcaacaacactttttattttctgtttctttgatagtagccatcctgatggatgtgaggtggtccttgtggttttaatttatatttcccggtgagtaatgatgttgagtactatttcatatacttaatggcactgggatatatccttttgtgaagtgccttttcaaatcttttgcccatttttgagttgggttgttttttggttggttggtttttcttgtaaaagttcttttatatcctgcatatgagtcctttgccaaatacatatgttacaaatattttctcccagtctggtttgccttttcactgtctaaatggaatcttttgataacttggaagtctagtgatcaatttttgccttttaaaa

SEQ ID NO: 185405 - DNA, 1332 bp, Homo sapiens
atgttgaatgaatgaatgaatgagaatgaatgaatatataattgagagcagatgggctgggtgcagtggctcacacctgtaatcccagcactttgggaggttgaagtgggaggattgcttaaagctagaagttcaagaccagcttgggcacatagcgagacctcatctttcaaaaaaaataatatgttttaaaaattgagatcaagtaaatgattctgtctgcttaaccaaaaggatagtctttgggtaaggtattaaggtattactgccagatcttagccacaggctactcctgagcaacaaaaaccattcttttaacctggtaaggctaaaatgtaactggcatagagtccttactagcagaaaatgtatagctagttagcttcaagcattcacatggcattagttagctgctccagtcactcattcgaccctttattgagttccatctgcacatagggcattgtgctaaacacagagtgagatgcaaagggcaatgaggcatagttcctgcccttaaggagattacaatctgatgatgggagataaaacaagtacccagttgtaacccagaaagagaactggtagtgtcgcaaaaatgatgcacagcaaccgttaggtttggagggagacagagagcatcagtcaggtgataaaagaaatgtcacaaactactagtgtttgaaactagctttgaagactggaaaagaatataggagaggggagaggggctttctaggttgatacaacagcatgaacaaaggaagtcaataggtacgtttggagaatgataaatgagatgacttggattggagcaaatagaaagtgtaaagaatcttgaatgataagatttgggaaaatattgcttaacactctgctagcccagtgttcaaggctgacagcatctccctccaccaagcctacttctcagcaaatattacttcagtgcttctatattttccagacatattttatttagtgacctgtttttatgatcaggtagtaaacagattaataagaatgcattaatctttcaattaatacttaatggagccaggcatggtggcttatgcctgtaatcccagcactttgggaggctgagataggtggatcacttgaggtcaggagtttgagaccagcctggccaacatggcaaaaccccatctctactaaaaatacaaaaattacagggggtggtggcagacacctgtaatcccagctactcgggaggctgaggtatgagaatcgcttgaacccaggaggcagagggtgcagtgagccgagatcgcaccactgcactccagcctgggtaacagagtgagactctgtctc

SEQ ID NO: 185406 - DNA, 396 bp, Homo sapiens
aacctagttctcccaggaatggttttgatcttcaagcacctctcctgtcctctttgagggtggcatcacatcgatgtccctaacacaaacagatttagatcctcactgaatccctagaacgagacaattctgtatatctgaaccagaagcataagtatgccttgagcataaacatggcttttgtttcaaagagctgtatcctattaaaaaataaatcctcatgtcttagaaatttttcatacaacaaaaggctgaaaggaaatttgccaaaatgcatactgtagctgcatctggatgtagaatcacgggatctgtatttctttctgtttctttacactgttctgtactttctaaaatgtttgtactgaaaacagagcaattaggaaaccagaaaaa

SEQ ID NO: 185407 - DNA, 637 bp, Homo sapiens
taaaggagataaaggagtttgccacatatctacctgggcaacacgcaacctcagcaaaggaaatctcatcctatgcaaaggccctgaggcctgtgctgttcaataaagagcaaagagtcaggtgtgtctggaatagaatgagcaaggaagaaagagaaaatgaggtcagagaaataaagaggacagaagaaagagcttggaaggtttttagttcattgtaggactccattcagtaaaacaggagaaactgcaagtttttcacacatcccgagtaaaggagtgacataatctgacttgcattttgaaaggatcattctgattgctctgtcgagattacattgtgcaggcaaagataggagcaagggtacctattaggaaagtatattatgtgaatctggtaagagatgacgatggtttaggttaaagtgatagtaataaaagtaatgggaagtggtcaaaatatggctatattttcatggtagagccaatgagattttcttgtagattaaatgtggaatggaaataaagaaaagagtcaagaataactaagatttttggctaaacaacttacaatggagtcagatcaattgagatgtagaagttcgtgggttaaaccatttggggagaagggcaaata

SEQ ID NO: 185408 - DNA, 184 bp, Homo sapiens
aaagtaatcatgtcaggctttcaaaaggaaaaaaagtatttgcagggaagtaattctgaacccataagctaatctggcagcatgttataccaaccacagcccacgctcactctgaatatcctagcagcttcagttccagcattaatggggagaggcacctaggttggctatgggttatcagccc

SEQ ID NO: 185409 - DNA, 249 bp, Homo sapiens
tttgttgtttcaggcttatccagaatagtcttaatccattcagcagcagaaagccccctataagtcagttcccttggaacctcctccattacaaataaatccaaaattatggttggtagatcctatgaagtcctaggtccacttcaggtgatgacaactgagagaagcagcagttccattttcacagagcatgacacacacaaataaagcatatttacagtgctacttttccagctcaggaaaactcac

SEQ ID NO: 185410 - DNA, 347 bp, Homo sapiens
cgaaaattttattaccatatactaacaatgaacaactggaaatcgaaatttataaaaataaaatttacaaaaacatcaaacatatgaaataggaataaatctgaccaagagtgcaagacctatatatcaaaaactacaaaacactgctataagaagaattaaagaagacctaaataattgggaagatatattcatgaattggaagactcaatattgttaagatgtcacgtcctcccaaatttatttataaatacaatacgatcgaaatcccaagtggcatttcatttgtagaaatgagaacagaattatgaaatacagtaaaattcactcttttggtagtaatttta

SEQ ID NO: 185411 - DNA, 400 bp, Homo sapiens
tgaatctttgtaaagtgaacacacccatgcagtcagtcactagttcaagaatcagagcatcaccagccactcagaatccttcattgtgctccctctcagtgtttatggatcaggataaccatgatcctgaattctaatatcatatattagttttgcttttcttttaaaaaaaaactttttaggtagagtaatacagtatatgctctttgatgtcttacttcattgatcaacattttgtgagtcatctatattgttgtgtatagagatcattcattttcattgctgcttaatattctatcaaaggaagacatacattacaatttgcttttcatttcgctggcagtaatacaatttttggaaaactactaactagcatatgcatattcagcagaaataagta

SEQ ID NO: 185412 - DNA, 206 bp, Homo sapiens
gctctctcatgatctgcctccaccacaccgtccccgttcaggcctgctgcccacccatccctccagccagtgtgtgtccgctggactttcacattttttgcgtgtggtgcttgactataagcctgatggggtagggcccacactgcacttctgcccccgcacaggcggcacgtgacagacgtgcattagatttctgtcggtggacg

SEQ ID NO: 185413 - DNA, 359 bp, Homo sapiens
ataacattcgttgactgtcgtttgccatgcattgcatgtattattttatgtaatctttacaaatctatgaggtagttgctgtttttacttattacaggcagggaagctaagatagagttacatgaggaagctttctcaaagtcacacagtcaataaatggcagggccaggctgtgccccaggcaggctggctctaacataagtcctaactccagcctccttgttggtatgtttagaggacatgaaaggtaattcacacttcagtgaatactaagtataaaaaagaacctcagcttcctaataatcagacctgtgccattttttttgtttttgtttttaagacaggttctctgttgccca

SEQ ID NO: 185414 - DNA, 258 bp, Homo sapiens
tccagagctgctccggtgtcaccaggctggccaagtccaaagtccctgaggccaccagccttgactgtcctgctggtcccacttttaaagctgctccccaggaccccctggccgctgtggactggggtccctccgcacctggcccatttgtggctgcgtccacaggggctcctgtggcctcccagagccagctcgggggtcagatggtcgcgggggctatggtcactgtgggaaaagaggttctgggcatctgtggag

SEQ ID NO: 185415 - DNA, 477 bp, Homo sapiens
tcattgaaccatttcatctcttaataacagttcctaactcaggttgtcttcaaatgtttgacaggtcaagctaatgcctcctgccccaaacgatgacctggcaacgctcagcgagctcaatgatggcagcctgctctatgagattcagaagcgctttgggaacaatcagatctatacattcattggagacattcttttgcttgttaacccatacaaggagcttccaatttattcttccatggtgtcccagctgtatttcagctcctcagggaagctgtgttcctcgctgcctcctcacctcttctcctgtgtggagagagcctttcaccagctcttccgggaacagcggcctcagtgtttcatcctcagtggagaaaggggatcaggaaagtctgaagccagcaaacaaatcataagacacctcacctgcagggctggcgccagcagggccacactggattccagattcaaacatgt

SEQ ID NO: 185416 - DNA, 709 bp, Homo sapiens
tgctgacatttgccaatatgttttgaaatatattttggcttttgaattttcccttgagaattgtgtagagaagaatatacaaatcaaagaggatttaatatattattcattgcatatctttccttctgagatttgtttgttttaaatctttggaaagtatgttactcatttcagtatttccactgactttcactggtagatggttcttactaaattaatttcctgccatactatgttaaaaattttattctcaatagatattagccccatattgttttaaccaccattgctttatgttactaatctttttgatggtcctggaaagaactgattttaatttctatttattaatgaatttttgtttttacagttttaactcatgttacctaatcatagcataagaggactgttgcacagtgctcctgcatagagtacagcaacactggctccatgcatgttacctgctgatgggatggatgctagctgagtgtttgagtagactaatcatgatagatatatttcctgttgtgtgccagacactgtttaggaactgatgatacagaaatatgccttcaggtacctgacaccctcgtggggaagcagacagccatcaattgtgtgatgtaatgtgtcactgtcacgaaaaaaagaagactgggaaaggggacagaggatgagggagttgctagttcatatgtcagtcattggg

SEQ ID NO: 185417 - DNA, 357 bp, Homo sapiens
catcctgcctgtgctccctggttcgttttccctccagccactgccaaatgccaggacacaagtcaccacctcccctatgcttagccttgtcatcctccatgtcattgaggccttcacgactcccactctggaaccaagcaatcaaggcctctgaattgcactgttgcactgaccgttcacctccttactgtctgccttatgcagagtgcaagctctgtgaaggcagatgcctcgcctgagtggtttccagctgcccccagagcacctagaagaggcccagcaaatagaaggcactccatgattatttgataaaagaatgaatataacccaacactttatggctccccataactggat

SEQ ID NO: 185418 - DNA, 321 bp, Homo sapiens
tgtatttttacacagacaaatgttcatagcagctttttcaaaatagctaaaaagtggaaacaacccacatgtctttcagttgatgaataaacaaaatatggtatatccatacaatggaatattattcactcataaaaagaaatcactgttgatatatgttataaaatgaatgaaccttggccttgtgtggtggcttatgcctataatcccactactcgggaggctgaggcacaacagtcgcttgaacctgggagatggaggttgcagtgaacggggatcaagccacttgcactctagcctgggtgacagaacgagactcgt

SEQ ID NO: 185419 - DNA, 288 bp, Homo sapiens
ggtggccatctgagtggctttccagtttggacctgttacaaaattgcttccttaaatgttccttgatccatctcttaatgtacatgtgcatgtatttctataatatataaacctaggagtggaagcatgatcttttctaagttagatacctactttgtttcattatccagtaatgccagggattacaacttgtatttcttcatgctactattgtttctagttttgcatgatcattagctgtgaccattttgactttcttaggttcctctccctactggtttctaaatt

SEQ ID NO: 185420 - DNA, 177 bp, Homo sapiens
atttagtccatgtttccacaggtggttgatcttcagttctcctgagtcaggtgggttgttgatgcgtcttttacaattcatcttctgttcccttcctcactttcctccttttctcccagcgtaaatttgctgcctaaacaggaatccttattgcaggtggacccaaactaagacagt

SEQ ID NO: 185421 - DNA, 596 bp, Homo sapiens
cctgcacctcctggggctgagcaggagccttcctacgtggtccctgcctcccccttccctccccagccctgactcgttcctcccagaggaaatgttctgtttctagaaaacaaagaagagaaacatgaaaaacagtttgttttctgttctgtactccctgtctcaccacaccgtgtttgcaggggacgttttcaatgttgtttccaaagcagttccctgtggttacagcgtgtgccggagacagaaatggaaccttcgtcagaggatgctaaggacaggaggtgacgatgacaaggagtatgtctagggagagtcgctctgtgtcatcgaagcgtgacctgggtcagacctctctctcccagggattatccgagtgtttgatttttgtgtacgtggcttagagatgagggttgacatctcacagttggtttgaaagatcgcctctggttaatccattattttaaaaaataataacagacagccctggtcgcattggagtcactggagctggacttgtccagccaccatcaacaactaggaaactggacaaaatgtatgaaacaaccatttccagactctggagctcagaactaaga

SEQ ID NO: 185422 - DNA, 113 bp, Homo sapiens
ccaccttccatcaattttctcaaggcaaagtcatctttcatgtctctgttatcccctgatcgaattcattagcaaatcccgagggcttcaccttcaaaatatattctgggccg

SEQ ID NO: 185423 - DNA, 123 bp, Homo sapiens
ttctcattcggtgtgcaccagcagccacacgctgagcttcttcctgcttccatcaggagctgcactgtccaacatggtagcacctagtcacatgtggctacttaaattaattaaatttggccg

SEQ ID NO: 185424 - DNA, 332 bp, Homo sapiens
ttatttttgacccttgttagtagttctttaggtacaaggaaatgaaaagcaatctctttagcagaggtcaaaagaaagttgtacacttcagtgctttcccatagaaacaaaggaagcttagctgaattggcagaatgctattagaatgagatatccttaaaaatgttggtgggaagagctgatgaaataaataagttgggaacaaaggattgaatttggtattcttcttctactggagaaggtaccgaaaaagaatttgatcctctgattgcctagggttttgagacatgagaaataatgtactttgatctggttttgagaaattattgcat

SEQ ID NO: 185425 - DNA, 158 bp, Homo sapiens
gtccaacgccactctggggccgaacttcgaacccgtggctcctgaccctggcggccaagtctcgagaggcggctcacaacccctcaggtagcgtaagcgtgggccccgcaatggaggccagaggatgggagagccaaggctgcccaaggcatagccgc

SEQ ID NO: 185426 - DNA, 319 bp, Homo sapiens
aattacaggcatgtgccaccaggcccagctactttttgtatttttagtagagatgaggtttcgccatgttggccaggccagtcttgaactcctgacctcaaatgatccacccacctcagcctctcaaagtttataggcgtgattacaggcgtgagccaccgcgctcggccaaattttgaacccagttggtctgggtctggagtttattactatacttttgctgcagcctttgaggaccggagaggaacatgtcaggggaggagactgagaacatctgaaatcatgctgactcaagggaaggagatgcttcaatttccca

SEQ ID NO: 185427 - DNA, 350 bp, Homo sapiens
  misc_feature (296)..(296): n is a, c, g, or t
aagctttccaaagaggaggcaaaggttaattattttaagcatttagaacttggcaacaagtagggtggaacaaacatactgactagacatatgctatagaatattctgtaaagatctctgtctacagtggtttaacagaaagctgaacatatggcaggctttgtttgttttttttcctctggaatcgtctgtcaggacatgagctaccgcctcattatactcacattccactccgtctcaaaaaaataaaaaatctattgtgatggctcaagcctataatcccaggacttagggancccgaggcagtagggttgcttgggctcaggagcttgagaccagcctgggcaatt

SEQ ID NO: 185428 - DNA, 367 bp, Homo sapiens
cagatacatgcttcatcctttaacactacccaagtatctgaatgattctctcagatgtattttaaataaaattctgtacacataatcatctcgtctaatattttagtctcccacataaaaatctcagcaaaaaggccagcttttactgagattacctgttttagatgtgtgttagagtggaaaatgcaaaagtagagaaaaaaggttgtaaggaactgctttaaaatggaaacaatcttttccactggtcaataggattatggctaatctaatcttgatgttgagcccttgacccatatgctctacaagtgtgtctctctgtttcacaagtgtgtattacttttataacacgggtgtgggggagtca

SEQ ID NO: 185429 - DNA, 288 bp, Homo sapiens
tgtctggtaaatctgaagtcaacctcaagggagaaagtgattccatcgcagaaacattaaatattaagtgagcaatttgatttgagcagcgtgatgcacttcagaagtacaattccaaacaaagctggagggtgggggatgagggatcccctgttgcctgatgatcagttaactcagcaccacaagactacttcttagagcagggcatttttacttttaacaacttactttttctatcaggatttttcttctttattttttgtttgaatgttgccaatgaggaaaaca

SEQ ID NO: 185430 - DNA, 283 bp, Homo sapiens
aataaaaattagataaacagtatataaattatacctcaataaacataactgaaaaaaattaagcagccaaaacacaggcaaaaaaataaagtgcagtttacaagaaacttaactgtttcacaaagtgattaactgacttgtctattctagcaaggagagttgttcattcccacttttaagcatatttaatctggtaactaaagaacaaattaagttaggaaaaagtgcttcatcaaaacgtaagacagacaagctacttagactaatttctttcagaacaacc

SEQ ID NO: 185431 - DNA, 549 bp, Homo sapiens
atccacttcctttttttaatttgtttttgtttttataactctccttttatttttatttctagaagtattttaatttaataatataacttatgactgttacatatcttcatttgagcttgatttgggacatgagctatgtgcccaggagaaattagtttacatccttggagcttcaatctacattattaataaaagatactatttttccaagggctgttttaatttatacatagtagctataagcatttttcactgaaaggctcttctaaatatagcaaatatttaagaataagaatttatatttcaaagatttttaataactgggtatattttgtcatatttagtgtattcttttgaaaaatgccaaaataagaattttattatttttcctggaataacagcctaagggattctgcattgtggctttgctaattttagcatatggttttgactgctacaattgaaattaggttgaattttaaactcactattgtttagcttgtgtggtttttggttcatttgcagaaccaaatatattggacatgaagt

SEQ ID NO: 185432 - DNA, 499 bp, Homo sapiens
atgtcagtgtgagatgcgaaggagagagacattgaagtcatatcaccatctgttctctttctaactcttttttatcatatattcattgtttaccccgtcacggagtggctaataagttcaggccaagttaaggctgtcccttggcaagaacagggacaagttaggccaaagcgtggagaaatagtaacagctgattcatattcacaaagaagaactagtcaaagctagaaatgataccaggggtaggtgatatctaaagaaaccatctcagcctgatttctagctagcatacagaatcatgtatggaactgagaagtatccatattcatgaactatatttcacatacttaaaggaatttttttcccagttagtatctcaaattacccaacattccaccatactgcatttcttgtgctaattcctaacaagcagtagtaaaatcgtaatattaccagaactgtaagggggtacgagctcgattcgtatcatgcatgctgg

SEQ ID NO: 185433 - DNA, 547 bp, Homo sapiens
ctgattagtacagtggacattgctgaagaaagaatctctaaccttgagaatatttcaggccaggcacagtggttcatgcctataatcccagcactttgggagtgtgagaggatcacttgaacccaggagttcgagttccagaccaaccttggcaacataagagaccctgtctacacacacacacacaccaaaaaaaacaaaaaaaaacaaaaaaaacacttagccaggcactgtggtgcacacctgtggtcccagcaactcgaagagctgaagtgggaggatcgcttgagcccagaaggtcaaggctgcagtgagccatgatcatgccactgcactgtagtctaggcaacagagcaagaccctgtctccaccaataataataataataataataataagggtattgtaacagaaacctctaaaaaagagaatatccaaggactaaaggatgactacaaaagctatagcatatatttaatgagaatattagaaagagaagtaagaaaggaagagaagaaatatttgaaacaataatgacagaatttcc

SEQ ID NO: 185434 - DNA, 402 bp, Homo sapiens
  misc_feature (173)..(173): n is a, c, g, or t
  misc_feature (268)..(268): n is a, c, g, or t
  misc_feature (323)..(323): n is a, c, g, or t
  misc_feature (328)..(328): n is a, c, g, or t
ctaaaagtactatagctttaagctttatctatatatatgtgactcagtttgagttaatctttgtaaaggtgtgaggtcacttgaggttcagttgtttttttgtttgtttgtttgtttgtttgttttgagacagcaccttagttttcctacaacataaatgtaacaaagttatnttctactgtattgcaccttagtccaaaagtaaaacaactaaatgaaaatttaaataaatcagactgaaaaagcccaaagagtaagaggaataccntataaaatgtgactacccacctaaaaattcttgaactactttgttttgcataggnttttntgggactaaccaaatgttccaggaaccatgaggtgaagactgcggtttcatgataggcacattgttttacaatt

SEQ ID NO: 185435 - DNA, 269 bp, Homo sapiens
aagttgtagcgtaagtcagaatttccttcctttctaagggtgaacataccacattttctttattcatttatctatcagtggacagggttgcttttgccttttgcctattgtgaataatgctgctaagaatatgggtgtataaagatctctttgagaccttgctttcatttctttcaggtatatacctagaagaggaattcctggatcatagcacacatgggcttttggttttgtttttataatttgtttaaaatcagaattcagatata

SEQ ID NO: 185436 - DNA, 228 bp, Homo sapiens
ttagtcaccgatacatgaggagcaaataagttactctttgttttttacatgtgctgctgaatcttcatattccttccttctttcctcactgattatctcccaaaaatgtaatgtttgtttgtttatttatttatttttgagatggagtctcactctgtctcccagactggagtgcagtggtgtgatcttggctcactgcaacctctgcctcccgtgttcaagctattc

SEQ ID NO: 185437 - DNA, 460 bp, Homo sapiens
gcttgtgataatttctttcttagtatgtgatacagcaggccttgtcctaaagatttaggagcttacgtataatggttccagtatcatgtcaacttgatgccactaagcattccggaagaagatttctcttttttcccccaattcagagcaatttttagtattttaatatatttatagttttggaatgtgaacttcttagtatttacataaaattagcctcttctggtaataaattagaactaacttctaaaataatatactaaatgttaacatatcttaatttagacaacattttagttcattttgttaacagcaaatacatataaccttaaaatgttattttataattatgttatacattcccatgaatgaactgctaaaaaggcgcatatttgggtaataaaattgtggaataatcttagttttctgatgttatttcccttgccaccttaaacctacc

SEQ ID NO: 185438 - DNA, 798 bp, Homo sapiens
caggagatgcccatatttgtccttctgggtggttctaccagatgacttccaaatctcccttctagggtacaccctgaagctgtttttttttttcttttttttttcttttgagatggagcctggctctgtcacccagcctggagtgtagtcgcacgatctctcctcactgtagcctccgcctcccaggttcaagtgattctccagcctcaccctcccgagtagctgggattacaggtgcctaccaccatgccgggctaatctttgtatttttagtagagacagggtttcatcatgttggccaggctggtctggaactgttgagctcaagtgatccgcctgtctcggcttcccaaactgctgggattacaggcgtgagccactatgcctggcccaccctgaagcttttaatccagctgagctcaactggacaggcggcaggccctgtgaacaatacaatatgtgggccataaaacactgacaatgagttgcagacttgaaggcctggatttcccaacctgatagtgcttcatgccaaagtgaacatcattcttcctggccggtcatcttatcccagcccacatacaaaccccaaaattcagggataaccaggacagaagcagaggactgtgagacagccatggaagcttgacacaaagttccgatagggacgaaacaacaaactattgatacagactcacaggcaaacagaacagagacaagctggagcaagtgcatggtgtacctcacgggacaaagaacagggcacgtggggcggaatcccggaatacgggaaagagt

SEQ ID NO: 185439 - DNA, 253 bp, Homo sapiens
cattctgggaaattctcagccatgatttcttcactgctcccgcttccctcttccctttctgggctccacgtgtgtgtgcccctgcctgaggtggaggcagctcttgggtgcttgttctaccccacgctttctctctgtgattcagtttcagtatctctcgacctggctatgggacttgagcagcagccgctcgtcctggcgctgaagcagcagcagcaggtcgtccagcagcagcacatgcacctccaagaag

SEQ ID NO: 185440 - DNA, 253 bp, Homo sapiens
gagaatgagggagaaaaaaagaggtgtccttcagccttggaaagctctttggaacaccctttgtcagaaaggatcggttctttctctgccataatcccagccctgtggcaaagcattctcatggttgccattctcctcggcccccacccagtgaggaagattctttgagcttgctccttaaacagtctgaaccctgccacactcatgggcattgttatcttggttctgccctcccccttttccttgtgacagg

SEQ ID NO: 185441 - DNA, 213 bp, Homo sapiens
ggtatcttccggtggagcggggctggtctctggatttgaagacacacccaactctgtcttgtggatgactcaaggaagtgctgggaggagtctcttgacaaatcagtcatgtgagtcccggtgtcctggctcacctccagcttgggtatgaatagagtcagcccattttaagtgccccctgcagtttttaaacaggtctccttccacttcact

SEQ ID NO: 185442 - DNA, 401 bp, Homo sapiens
atctttgttcgggaactggcgccggcagagcagacaggccatcttcttccagtcagctagcttctcttcctcactctcaagtctctccaccagctcctcctcattgtcactgtcaccactgcaagcacgtcttgctgtgttgcccaggctggtgtcgaactcctgggccgaagtgatcctcctatctcagcctcccaaagtgctggaattacaggcgtgagccactgtgcctaacctatgtgtggcttttttaaagccaagattcgcagttaatgtaaatgctacaataaaataaaatccaaaattacggtacctatcaatgttaaaatgcagtattatttccttataactttaaaagggttaagggaaaagaaataaaattagtaatgattgtaatgatt

SEQ ID NO: 185443 - DNA, 249 bp, Homo sapiens
gctcgaggatcccctatacactgatacacccatctcagcctcccaaagtgctggaattacaggcgtgagccactgtgcctaacctatgtgtggcttttttaaagccaagattcgcagttaatgtaaatgctacaataaaataaaatccaaaattacggtacctatcaatgttaaaatgcagtattatttccttataactttaaaagggttaagggaaaagaaataaaattagtaatgattgtaatgatt

SEQ ID NO: 185444 - DNA, 535 bp, Homo sapiens
aaaatctccagggtggctgctccggggtctcattgagcttacgttaaagtgaaggaggagtccgttgacttagccagtcccagcgtctcccagctcagtcatatgattgagcttacattaaagtgaaggaggagtctgttgacttagccagtcccggcgtctccctgctcagtcatatgattgagcttacattaaagcgaaggaggagtccgttgacttagccagtcccggcgtctcccagctcagtcatatgattgagcttacgttaaagtgaaggaggagtcggttgacttagccagtcccagcatctcccagcatcagcctcacattctctcagagcccttgagtttcattgctaagcccaggttgagtgcgctgggaattggatgccccccctcacatctgtaatcattcagcctgggatctaggaagtggttttctgttttcatccatggtgccttctcatcctgctaaaatcccgcttaacagaggtgggcttgtgaggagacccttccctggtcaaggcagcagccac

SEQ ID NO: 185445 - DNA, 404 bp, Homo sapiens
gatttcaatagatgtaaacacaaccagtaagagataggcaataaataatatgtgctgagaaagaaggatccactattactgtcctttctacatctgatcgacctagtaagttttcttgccatttcaccaacatactgaattctacttgcttctctagttgaacaaccttctagttagctaagaaaattctttcctttggactgctaggtgataatgtatcatttacttaaaattacattgccaaatattaatggttatagaatcataaaatgctagagctagaaaagaccttagaaagcatctattcaaccctaattttataaggaaaccaaagcctaaagaagttaatcaacttgcaaaatgtcagattccgtatctaaccactcagtttatcattgcaaaga

SEQ ID NO: 185446 - DNA, 520 bp, Homo sapiens
  misc_feature (478)..(478): n is a, c, g, or t
gctgattctagaggatcccttccgggttgtgcatccactgatccagaatctcctaaccccaaataattttcttgggagaaagggacatttttcatcaatagattggaaaagatgtctccatagcagtgcacgtttctttcatggagccttggctaaaagaatgttagtggtcacctcctgatggctgctggagccaccatcttagaagtttgcccctgtcactgtgccaaccttggcaaccttggcagagggggtcagcagaaaatccacgtttacaactgtgactgtgcagacaatggtccacgtcactgataaatgtccttggtccagatctgatggtcgtctactgacacagaattcaggagagttgtgggggctgagagttcaggagaagctactgcctgacgcagaaagaggatgcatttgccaaggaaaccccgccgtaatgttagcggttaggcgtacggccagggctatnggttgaatgagtaggctgatggtttcgataataactagtatg

SEQ ID NO: 185447 - DNA, 425 bp, Homo sapiens
tggagtaaaaggatttagagttgaatccagcttgacctttctgtgaccttgaacaattcacttaacctctctaagtttcagaggagtaaataaagttaataatacatcaagaattgataggattaagtgagataatgtttagaaaatatctaatataatgtctgacttaccgtgggcatttaataaattttagcttgtggcaggtgctagagactaaaaggggaaaagctgcttccaaggccaccacatgtctgtgccccccacccagctctatctgcctagtgtacataaggtaatttggtgacagttgagactgcaaaaaccattaaaaacatttttaataagaacaaaaggcctgggtgcctacccgtgtgggggcactgtggaaagccttagctagggtgtctggtgctgtgtgataggtg

SEQ ID NO: 185448 - DNA, 562 bp, Homo sapiens
gtgcaagcttcatccatgcaggtgactcgataggatccgcagatcactctgcccttggaatgagaagacagccacagagaatccaaaaaccaacaggcgtggctgtgttcccgtaaaacttaaaacaggcgcctggctccagggtcgttttgccaacccccgtcttactgatctcttttccatatagacaggctgcttcttacagcaaccaagtagagttccccaaataatgcctcttaacctacataatccacctttggcacacacaggcaggaacctcagaccgcctgacaaccaatgtttgccaaaaatggagttaaaactcaacccttcacaggaagacgctggtttacataaagcagaatttggaaatattctgatgaggaaattatctcatgaaagaaatttcctcctattgcctaagctttccagagctcaaataagggcagtcaatccattcagcaggaatcctaacctatggcttacaggtgcaggcacggctccaggcagcacacacacatatttcatcctcagcaggctgcattcaggaatccgagctcga

SEQ ID NO: 185449 - DNA, 591 bp, Homo sapiens
gtgcaagcttcatccatgcaggtgactcgataggatccgcagatcactctgcccttggaatgagaagacagccacagagaatccaaaaaccaacaggcgtggctgtgttcccgtaaaacttaaaacaggcgcctggctccagggtcgttttgccaacccccgtcttactgatctcttttccatatagacaggctgcttcttacagcaaccaagtagagttccccaaataatgcctcttaacctacataatccacctttggcacacacaggcaggaacctcagaccgcctgacaaccaatgtttgccaaaaatggagttaaaactcaacccttcacaggaagacgctggtttacataaagcagaatttggaaatattctgatgaggaaattatctcatgaaagaaatttcctcctattgcctaagctttccagagctcaaataagggcagtcaatccattcagcaggaatcctaacctatggcttacaggtgcaggcacggctccaggcagcacacacacatatttcatcctcagcaggccctgaggtgggcgttattgccccgcacccccgtctacagatggggaaactga

SEQ ID NO: 185450 - DNA, 361 bp, Homo sapiens
attttcaaaccccaccaaacttagattggtttttacttattaatttggtgaatattttcttcaatatttgaaatattcagaagggaattactaatttagtaatataatatacctaataatattgggattttgtggggttaatcttagcaaattcttctaaattcctaaaatatatctgtattgagggaactttgttcatgactaaagaacagtttgtggtcttggatgaatagaaatgaagatttaattttcttttttactattgccctgcccacttaaatagtgtgatcattagtaagttgctcttttgcactcctggatttgtttccttgtctttaaaatcatgagattaaatgtatag

SEQ ID NO: 185451 - DNA, 367 bp, Homo sapiens
aggaggtatatgctgcgggagagcagaacaagggagaagagaaaagatgtgcgtaccaaaaggatgtgaggccctgagcccagggcaggtaaggcatgggactgccttattttaccctggcatttaggacagtactccacaaaccacaaattcttataaatcacagccagtgaaagtatgctcaaaatccagaaagctcttttaaaaaaggtctcaacactttgagatgttagtcttgaaataagttaatgtttcaaattatattcattcctttaaatggattaaattgctatttcttgacccggcaaaattttaccttggtagatcattcaataaagcagcactgtgcccttctctaagtctgtgg

SEQ ID NO: 185452 - DNA, 143 bp, Homo sapiens
agttacgtctggatcataatgaggtaggggagtgatgaaactgtgagtacctgccaagtggtaaaggtgaaatgctttttgcaagataactggcagtcacataagtctggcaagggacacaggcaggctgaaaaatgcaatgg

SEQ ID NO: 185453 - DNA, 563 bp, Homo sapiens
catgggataccaaggctgtgtaaaggttaatcatttaagaaatatataatagcttggaagaacaagccattttataataataataacaatgaaatcactgccatttagtgtacggagtcagccgtaaagaattagacaatccagagctaggaaggcaatacgtattttgagtctatttactacagaatacggttattttgccttaaactatatggtgcacataggtgtgaaacttccagtagcaggctgtatgtactgaaccaaaccctagagatagtcatcttcttcacccattccccaaatactgctacaattaggtgatgatgtggttgtaaagacttagaagaggcggctgttctgggtaacaggatgtttgcttcccttgacccagaactagtattctgcccaagccagcacagcctttgctgtaccttcctgaggggttctatttgcttctactacaagattctgaagtctccacatcatacaaacataaattagttgcttataacaccaacaaaagaaacccttcattcaacaaagatttaatgggtttgttccag

SEQ ID NO: 185454 - DNA, 482 bp, Homo sapiens
ggtacattcttgagaaaaccctaatgcagtgaattaagaaaaagttctaagatgaaatgggattaatagttgtctttgtgcctgggtgtggtggctcacacctgtaatcccagcactttaagaggcttaggtgggcagattacaaggtcaggagttcagaaccagcctggccaacgtggtgaaaccctgtctctactaaaaatacaaaaagcagtggctgtggttttggacccagtgtgtcttcagaagcacccagggtatcattataggctgccactatttcctggtaccacaggatatttccatatcactaccatctgggtgacagggaataataaaatttagaaactgtaactgggccggacagctattgacttggtgagttgaaactagaactatcttatgttcagtaaggccagtttaaagtgttttggaagccttatatatctgaggccattgtacttcttggtcactttacaaac

SEQ ID NO: 185455 - DNA, 340 bp, Homo sapiens
gggaaggcagatcacttgtgctcaggagattaagaccagcctgagcaacatgggaagacctcatctctacaagaaatacaaatattacctaggcatggtggcacatgcctatggtcccagctactcaggaccacaggtgggaggtgggaggatcacttgagcccagaaggtcaactgaaccattgcactccagcctgggcaacagagtgagaccttgtacaaaaaaaaattaataaattaataccaattaacttggaaaattagaaaataaaggaaaatagaagagggaaaatacccatagttctaccatgaaagagaatcattgctaaccttttctctt

SEQ ID NO: 185456 - DNA, 817 bp, Homo sapiens
agggcccagcaggtagatcagtgattgtggctggcatctggggatgcagggggaaggggagctttggtgaatgggagagtgtgccaaagtggggagggtgcctccatctgattgctgaccagcaggaatatggctcatccgctgtggccagctgggattttcttttcccctgtaaaactgcctcatttagaaatgtggtctgtgtagactggcttctctaaagatcatgcgtgaacccaacaaaacgcatttccgggtcagaagaagccgagggctgtcattttgcattccctgtgcgagactggccaaggcacaattcattgcagaatttggcctcaccatgcgtgagtcagaacaagcgccttgaaggccagggatttgcagcctgagaaatgatgtactccgcgggttgaattcacgtctccatacaaaggctcccctgtttgggctgcttgcgtcttgatcctgccatgtgtgcgttttgtggtagtgcttgtggtgtgtggatgccagcctgccaaagctgaaaccatttttaaaaatgtctgtgtaatgtcaccggcacaagggaatgaacgacttggaaacacgcacagatgcagcggaagcccaggatattaaaatcttgaacagtatcattcttgctgagatttgctgggggtatggatgtgttttcagagacaggatgctagagaatgtacaattatagcaatttgctaaccagccccagaccttaattagcacaggatccttgttctcactgttgtatgtaaattaagactttcacaaagggattgtttatgaggacggctgtgag

SEQ ID NO: 185457 - DNA, 456 bp, Homo sapiens
taatactattgcattacactagctacttcataaacagccccaccaagaaaagaaaaatcgcgatcccgatataaaccattctaggtctaaatgcaatcatgattgcatttagacaacacagctgcagcaagaggaagactttattttggccagtagatttgtctctcatttgctttagcaaggaatagctggtatgtgattcaaagtcattccttagaaaatcacaacctgccaggggcttctggagtggccagcaaagaatcaagacagcaacaggaaaatccgaaaacgtcagaggtctgtatttgatgacttcttgaatattatcggtgtgcacaactacatggcccagatgtagtacgagcaccaccgtgtctcctcttgaagtaataatccaacaaatgccttaatgctaagtgattaattaaatcttttcactgggtctaaatgcaatca

SEQ ID NO: 185458 - DNA, 328 bp, Homo sapiens
agaccagcttggtgaacacggtgaaaccccgtctctactaaaaatacaaaaattagccaggtgtggtgagcacctgtaatcccagctactagggaggctgaggcaggagaatggcttgaaccgggaaggcaggggattgcagtgagctgaggtcactccactgcacttcagcctgggtgacagaggagtgagactccgtctcaacaaaacaaaaaacctcttggtctctagtttccctgctcccattccttctcgaacctgctccaagtaggcttctctccccccattctactgacactgtttctgagatggtcaatgccctcctcgt

SEQ ID NO: 185459 - DNA, 505 bp, Homo sapiens
cttgtgaaggaggtgacatctgagcaaagaagcaccggcctgaacagatgagggcttgacggtggggttatctagggaagagcccagtaggtgttggggagtgggctagtttaggtcaggtggtcaggggagacctctaggaggaggcggcactggagatgagtgtggtagaaatacggggatctgggaaaagtaaggccaaagcccagagtggcaaacagcctgggcgtgtgtgaggaacggcagtggctggaaagaccctgtgctcccaggcagcccaggtggcccttgattcctttcagactgctgtgtgggttccggggtggcggggtactgggccaggtccctaatctcagcttgctgcaccccagctcttcctgctgagaagtgacgtggctacttgcacacctcgggggtttccggtccgtggttagctccttcccctaacagcatggtgttcacacaggcttttaaacacccagctggccctgaagacatctagtgg

SEQ ID NO: 185460 - DNA, 308 bp, Homo sapiens
  misc_feature (225)..(225): n is a, c, g, or t
gcagcttggggatctgccgccaaggtggctgttggttgaccttgggtttagagtagtcattgcttcttctttttttttttttctagacagagtctcactctttcactctgttgcctaggcttgagtgcagtggtgtggtcttggctcactgcaacatttggctcccaggttcaagcaattctcctgcctcagcctcccgactagctggcactgcaggtgcccgcnaccatgcctggctaattttttgtatttttggtagagacggggtttcaccgtggtctcgagctcctgacctggtggtccacccg

SEQ ID NO: 185461 - DNA, 143 bp, Homo sapiens
ccactgcgctccagcctgggcgacagagtgagactccctctcaaaacaaaacaaaaaaaaggatgcagcaagcacctccctctgtgctctctcactctccttctccaaccatgtgagatatgcctcctttctataccagcatc

SEQ ID NO: 185462 - DNA, 133 bp, Homo sapiens
ggaattcgagtatgatcacaccactgcactctagcctgggcaacaatgggaacccattggcacatctgggattggcatcctgagctcccatctgtgacctccctcctctcccctcctctcccctccattgccc

SEQ ID NO: 185463 - DNA, 199 bp, Homo sapiens
tgaatgtctagctcacaaggtggtggtggttgtgagatataaaaccggataatgtgtgtctgagggacttgtacaatgaaggagataggttataatagggacagagtatattgaacttggagccagagtttggattctcatcctggtctttttacctcattgagcttcgggctccccttctgtaaaatagggaatataa

SEQ ID NO: 185464 - DNA, 128 bp, Homo sapiens
aaatgctgatggtgagaaaggagggaagacaggagctgggggaaaattgagggcgatggtatatgctagtgaggtcctttgggtgtgggaattgtgaattcctacaacttttgattctagctcattga

SEQ ID NO: 185465 - DNA, 239 bp, Homo sapiens
gacacagagaccagggagcaccgggagggaaaggaagtgagtcagcacctcctctcaggaagccgtagaccctcagccctaatgtgactcgctgtgggcagagaccctggacctaaaggtaagggtgccccaggtcactgtcagcccagctcactggactacctccagggcctggcacaggcagggaggctgaaagcctcttccctgtgtcttcgtggcccacctgggggaccatcagc

SEQ ID NO: 185466 - DNA, 412 bp, Homo sapiens
tatcttaccatcactttaattctatgaggaatttataggtatgagaatggagattgagataataagagacttgcagaaaatcacaaattttccttggtacaagagacagagcaggttcaaggcttcaacccaggttttttaattttttttttattgaaaaccctgtgctctttccactggagcttttttgataacaatgttttgttgtttttaagtccaagaaatatatcggggaatatgaatttatatctcaccaacacatttctatctgcataccacatacgtgtttcagttattcactgctgtgtaacaaccgccccaaaagaagtagctgaaaatgacaaagatttattctttgtcctgattctgtgtgttgactgagcagttcttctgtagccagctggcaggttga

SEQ ID NO: 185467 - DNA, 477 bp, Homo sapiens
gcaggggttcaatcatagctcactgcagcctccaactcctgggctcaagcagtcctcctgccttggcttcccgtgtagctggaaccataggcgtgtatcaccatgcctgcctaattattatttattttttgtagagatggggtctccctctgttgcccaggctggtcttgaactcctggtctcaagctgtcctcccacctggaccactcagagttctgggattagaggtgtgagccagtgcctggcctcttcatttgttgttctttctgttcctcagactggataatcaaaattgactgtcttcaaattttgcaattgttttgtttttttgagataaggtcttactctgttgtcccagctggagtgcagtgatgcaatcatagttcactgcaacctcatacttctcaactccagaattgctaattggtttctttttataatatccatctcatctcactattgatattctccatttgg

SEQ ID NO: 185468 - DNA, 482 bp, Homo sapiens
atgctgggcggggtatggcttagttttttaaaatagtgaaatatattacttttaaattatattattactgaaaaatttaaaacacagtatatggcaaaaaatcagtaaagcttgtctaaaatgatgacagcaaatatttgcaaactattaatatatgtagctaattcttatgatataggaaaccttcccagtagccaatataaagagatggacaaatgaggtaagcagcctctaagacggtgatctcaatgagccatgcctcctagtgttcatgcacttgcataatccctatccttgagtgtgggctggtagttaggagaggcttaaataatgaaaactgaaattactctaaagcttttctgtttgaagcctccagggctctgaatgctctgatttccctgggtgctggcacttgatgctctccatggtattgctcaatttctgttataatgaactgttttatttatttatttgtacaatat

SEQ ID NO: 185469 - DNA, 397 bp, Homo sapiens
taataataaaactcctatctcccgcacagctggctctgcgtgaattactctttctccactgcaagtcccctgtcctgatacatcggttctgtctaggcagcaggcaaggtgaacccattgggcggttacacttgcttggattcaggagggtccaaagtccagcattttgcccacttgaaattactcataaccattattgttggtagttattccattattctaggagacacacaaggaattgcatttttcagttcctatgtaaaggtattaatgtttcctccttgccttaattcaggactggatagctcaccaacaaagactggtctctttaggaagtctgtgcacaaggtctaaagataagatctaaagaaaggcaattgtgtagatattcaactgg

SEQ ID NO: 185470 - DNA, 392 bp, Homo sapiens
agttgtttgaagtttggatatattttgaatgtgaaccccttatcagagtatagtttgcaaatgttttatcccactctataggtttactctttattcttttgattgtttctttggtgtttagaagttttttagtttaatgtaattcagttttttttttttttttgcttttgttgtctgtgcttcatactcaaagggtatgaatatttgttgtatccaaaatattatttcctagaccaatggcgtggagcttccctgttattttcttctaacagttttatatttaagatcttaaattaaaatctttactccattttgagttgatttttatatatcatgtgagatatagctccagtttcattttttctgcttgtgtacactgggttttccctaaa

SEQ ID NO: 185471 - DNA, 267 bp, Homo sapiens
ctgagtgttaaagataaaagaatagaatgactattcaagatgtacaacatgaccatccaagttccagctcaccccttggtgtaaaatgtcaagctggagggtacagaaacctaatctcatttaggagaaagtaagtaaaacagaactggaatccttgaatcctcagaaaaagcctagggagtctgcaagcccctcaaagaagttccatagtcatcatggaattacaatccattgtagtgagcaagtcatagggaagccaagacatgg

SEQ ID NO: 185472 - DNA, 225 bp, Homo sapiens
atgagccaccgcgcccgtccagtttactggtctcacagccacacgcttacacatgcacatgctaatgtgtgttgtgcactcacatgagcacgcgccgatgtgtgtccctgtgtgtgtgcatctgcgtgcgagtgtgaatgagtgtgtcgctgtgtgcaagtttcaatgtgtggtagtgagcgtgggtgtctggaacgtgcatctgtgtgaatgtggaagtgtgga

SEQ ID NO: 185473 - DNA, 447 bp, Homo sapiens
gcaggtgccaccggctcacagcgagtcccaagtcaggtgtcatttccgagattggctgggcccagtggatggcccggcgctggctgcacccgtgtgggatctgagctggggccctgccccgggtgtagccacaacccacgagtgctggtgcttctgcctttggattctgtcagggatgcggcgtgtggacatcctaacatgggagttgttgatatttaatttttctctcatagacactgtggtgttctcatttatttccaggagttttccaagtatcgtacgtttaacgaatggggttggctttttaactttcatttgcagctgctcatcatgacaatcattttctcgccccctaaccaatcagttctaatagcttttcttaaaaagattctcaggggacttaggaatgtaattacctctgagaataaagaacatttccccttgatt

SEQ ID NO: 185474 - DNA, 224 bp, Homo sapiens
tcactccatcctgccaccctgtgaggaaggtgcctgtttctcctttgccttctgccatgaggaaaaaggaaaggaaaaagatatatcaccccaaaatatgtctctgacataaaaattatttttgagcctaaagcaatgaataggggaaaagctctccatatcctcttgcttttctacctaaagacaggatacaaattctcctttactggtgacaactatagact

SEQ ID NO: 185475 - DNA, 673 bp, Homo sapiens
taagaattaaaaagctcaaaggagaactggcattaacaaattcatttaatgctagattgtttggaaaattttaatcttctattttgaaaacaagaagaatgctcttctcatttttgttttacaataatatttttcattttttaaaaatattctatcagttgtgggttaatgaatttctaggataactatttaagacctgccttaatattagttttctgttggttcttgagaaactaagatttaaggaaatatttgcttgaaaaagaaaagttttggaaagtgcttttgtaaacttacttggggattttttttttttaatcaaaaggaatcatctacagcatctctgtggaattaatttaaagagttgctgaagcagcaaatcaggctctcttctccccaaaattgatgataatggtgcgttttaaatgtcacattccaccacattctttatgtataaatggaaaatataaaatatgatattaagagagttattagtatcaaatagttggctactgataaccttctatgaaaaaagctgggagttttagaagtcccaataacttctttctcctttgggaaaagcagctggaaatacttagctgacctgtaggacaagagacttttaagcttaaaattcataagtaactccaatcgaagcaggtttttttgtttg

SEQ ID NO: 185476 - DNA, 436 bp, Homo sapiens
tggtgctgtgaaataaagccagttgattctgagagttactgaaacattatactctaaagtcattcatgttcaaattttaaatggtttactcagttttttagagtggttgctcacacacgtcagggcagttttaaaaatacactttttggctgggtgcggtggctcacacctataatcccagcactttaggaggctgaggtgggcggatcacctgaggtcaggagttcgagaccagcctggccaacatggtgaaaccctgtctctactaaaaatataaaaattagttgggcatggtggtgtacacctgcagtcccagctacttgggaagctgaggcaacagaatcgcttgaacccgggaggtggagattgtagtaagccgcgattgtgccactgcactccagcctgggtgacagagtgagatactccgtctcaaaaa

SEQ ID NO: 185477 - DNA, 449 bp, Homo sapiens
cgttctcggctcactgcaagctctgcctcctgagtagctgggactacaggcgcccgccaccacgcccggctaattttttgttttttgtagagacggggtttcaccaggatggtctcaatctcctgacctcatgatctgcctgcctcggcctcccaaagtgctgggattacaggcgtgagccaccgcacccggccctaaaccctaggttttgacttctgtaagaaggaaagatttaaacaaacaaacaaacattaaattacaaccataataaacaaaaaaacactaaactaaattacaaccataataaaatctcccaaagtccgtaggcactgacatattacagccttgccaaatcagaatagatttctcatgtgttgtcaatttaccagacacaaagagtagctcagatctcatagactcttcagatcttgtagactaatttcaagtct

SEQ ID NO: 185478 - DNA, 153 bp, Homo sapiens
aaggcaagctaaatggctctgtatttgtaaattaaatatagctgcacttcagctttccaaagagctgggaaggagagaaggagaaagaaaaagagagagaggaagagaagaaaagctgccgccctcaggaaagtctggctggtacagattgcc

SEQ ID NO: 185479 - DNA, 523 bp, Homo sapiens
ttccctccacgctttagaaatgcaactgggatgattcttacaagggcatttcccattccagagctgctgtgaagtcatgtaacttaggatcctttttaacttttcccctgtggtggcattcccccttcctcctcctcttctatttgtcatttatactaaggtgcaaatttctggcatcaccactattgggcaggatctggggagtcccaggggctttccagggccctgaaatacttccatcagcccccagggatgccctcacaagacacctagactagctaaaaggaaaaactacagaaatagaatctgtggggagacaagcacatgtacaccttgccagcggtactttcaagggattacatttttctggagagcaacctggtgataataacaggaactaaaaagcatccatagcctttcatctggtaatctggtaatgtaagtttggaaaataggcctccaggaaatatcccaaagggaaaaaaaaagttcaaagatattctcagcactgtttactacagtt

SEQ ID NO: 185480 - DNA, 779 bp, Homo sapiens
aggcctcacagtcatgctggaaggtaaggaggaacaagtcacatcttatgtggaaggcgcaggcaaagagagagtttgtgcagggaaactcccgtttttaaaaccatcagatcttgtgagacttattcaccatcacgagaacagcatggggaagacctgtccccatgattcagttatctcctgctgggcccctcccacaaccagtaggaattacgggagctacaaggtaagatttgggtggggacccagagcctaaccatgtcagtcactcatcagaagggttcctttgccctttgggggctaggccctgtgctcagtgctcatgtgctgtattgggttccacctttaaaagccccctgtgagttgggtagtggtgtgagaaccgtgacccgtcttacaggtgaggaagctgaggcaagatgctggcctaggccatccagttggtggtggaggtacccaggctgctcttggagaggctgagggcaccacaggagctcggggagtcctgtgggcgggaagcctcctagaggaggaaggccagtggggccagcccgcagggtgtgagaagggcccagttctgcagctgatggcatctccactgccctgtcctccactcctgcagcagaagtgccatagtggggttcgggaagactgtgggtccttgaaggacaggaggctgcagggagcaccttctgtgtgcaggcccttccccaggactggctctccaaggaggcctcacagtcccttccagaccccttcaggccagtgtcacctgacca

SEQ ID NO: 185481 - DNA, 578 bp, Homo sapiens
gccgtgcgcccaaaccctataaaaacacctttctcctgagcaatccttaacccaagctgttgtttaaatatttcatcttttaattacacatattaaatactgcactaatagataagtgaatgtttcttatgtccttcactacaatgcaaatgtttttacacctttattctcagaagccattattcagtttttttaaattgtactttgctcttcttctgtcaaacctaccaggtgccaagcacaattaagcccttgatgtatactgtttattaattctaagccttattttaatcataaccattatgcattgctgatgggaatgaaaaatggtaccgctgctgtagaaaacagtctctaaccctccgaagtaagattcattattgtccctttcttaaggctgagttataactaaggctcaaagaaactggataaactaactcaaagcctctcagtccagattcttaatgaacagacttacttaccttgactccaaaggttgtattttacactatttttcactataccatacttcctcccttcaccctaactgtttaggtaatcagcccatcactactaca

SEQ ID NO: 185482 - DNA, 215 bp, Homo sapiens
catttaccttcacactctttaaataccaaattttgagtgagtgagtgtgtaaggttttgtcatacagacttgcaattcctatatgggataaagtagactagcacaggaatttttcttgtatcactcatgcaagactctaaattccttaaaggcagggatcatgtatattttgatcactgttgtatcctcagcacttcacatggtgcctgtcacat

SEQ ID NO: 185483 - DNA, 371 bp, Homo sapiens
cccacgctgtgagcggttcctgcttctctgaaaggtctgttctgcttaaggttgtatcaaggttagtctcttgctacctacttctgtagagcagtctctcgtggctcacctgggttagtggccatgttgcctgtctcctattcttcctaaccttgtgtgttctccaggtagctgagtgatccatccgaagtaaaatattcctcagcttgtctgtaggggctccaagtttcatgaagtaaaagctagtcttgaaaacggcccattagggtcctggatgacagtctccgggtcacttagactccgttgtccgcctcccctcatctgtatcatctttgccttgggtactggcttcggagggtgttttcctgaaa

SEQ ID NO: 185484 - DNA, 239 bp, Homo sapiens
cacgattcttgcctttcactccatcttacccttcattattgcagccctagcatagaggttgtatttctctttgggcaggtatctttcctatacctcaaactgcagttctgttattttccctacaggcttggagctctttgaaggtaacatatgcattcaacattgttttattctctgcatcacctagcaccatgtaatatgttggggtaacaaaaaagatggagttggaggtgtcagag

SEQ ID NO: 185485 - DNA, 598 bp, Homo sapiens
tttattatgttgtttatgatgtctgacataaattggatccaggagagtccagtctagatgtcactgtgtggccttgggtgattgagtgtgactgggagggtgagttagtttctggtgagccagtatctatgatgctgtatcttggtcagctggggctgctataacaaaatatcatagactaagtgacttgactaagagactttatttttcacaattttggaggctgggaagttaaagtgctggcacattcagttcttggtgagggccccgttggcttgcaaatgggttacatcctgctgtgtcctcacatggcctttgcttggtggttgtgtaaacatggagacccctccttcctcttttttaataagtgcactgaccccatcataagggtatcacccttatgacctaatctaaaaccagttacctccccaaagtcccacctcctaacgtcatcacactaggggttagggtttcaccatagtaattttgggaggacatattcagcctataacatgttgtgtcatggtgagactggcaatgctagatttcgtgatttcctaaaaaataaaataaaaataaaaaactaagcacctactat

SEQ ID NO: 185486 - DNA, 619 bp, Homo sapiens
attcctatcgctgatgtgtgaccctgggaaatcttagcagttaattctggcatcatatttattgcaaaatgattatagaacatgtttagctttagagtctgactgactgaattcataccggctacttagaactgtgttgctatgggcaagttcttcactttctctcatctgcatttgctccatgaaatgagaatagtaaccttcccatttcatagaattgttaataaggattaaataagatatgcaaataaagcaattaaaacagtctctgacataaaactattgccaacaaaagttaacccttcttactaatgtgtgaagcatattggaaaatatcttcttgactacatcaatgtaatttttcttattcagagccaaatatttcaaaatttaaaaatactggtgcttattattttattcctttcagtcttagaagttccccgttattcctctagttattctgattagtcagtactcttaaatattgtaattaattcacagctcataaacttaaaaataattagtatttttagggggttgtgtttagcattaattaaaaacagaagcatgcagagttaattgtggttatgttaaactattctctgttctttcagtaaag

SEQ ID NO: 185487 - DNA, 335 bp, Homo sapiens
acacacactgggtttgtgaactctttgaggggtttcccggacagggaacagcaatggcccaggagagtggtatctggcaatggtccttagggcctggttgcctagggtcccagccagcgctgccactggcttgctgtgcgaccttgggctatttacttcctctccctatgcctcagttgccccatctgtacaatggggccatgtagattacctcatgggattgctgtgaggataaaatgagatactgaaggtaaggcactaggaagagtgttggcaagtagcaagctctcaatctcaatgcctgttaggattaccaaggattaccgtccgtctct

SEQ ID NO: 185488 - DNA, 357 bp, Homo sapiens
gtcctcgttcacctgggactcctgaccaaggaatctggatttaagattgcagagacagctttcagtggtggccctcttggtgaattagttcaatggagtgatttaattacatctctgtacttactgggccatgacattaggatttcagcttcactggctgagctcaaggaaatcatgaagaaggttgtaggaaaccgatctggctgcccaactgtaggagacagaattgttgagctcatttacattgatattgtaggacttgctcaattcaagaaaactcttggaccatcctgggttcattaccagtgcatgctccgagaccttgattcatttgcgactgaacccgaatttaatcat

SEQ ID NO: 185489 - DNA, 567 bp, Homo sapiens
gctgtcttgctccatcccacccatggtgtagtcatggagtcatggactcatccttttgtccagtgtatccatgctgtatacactacctgcctgtctgtcacttagtaggcatcttggttagcagatagattgttgcggtatcacagtgcctgtgttcaagtaacccttattttacttaataatggccccaaactgcaagagtagtgatggtggcaattcggatatgccaaaaagaagccataaatctttaggtgaatacgtgaacactcatgacttagtaaggaaagaaaataaaaggtgtgcggaggttgctaacatctacagtaagaatgagtcttccacctgtgaatttgtgaagaaggaaaaagaagtctgcactagttttgcattgtacctcaaactgcaaaggttaaggccacattaaaaagttatgcattcctgtaatcgcagcactttgggaggccgaggcgggcggatcacgaggtcaggagatcgagaccatcctggctaagacggtgaaaccccgtctctactaaaaaatacaaaaaattagccgggcgtggtgtt

SEQ ID NO: 185490 - DNA, 321 bp, Homo sapiens
ctctgccacccattagctgtatgagcttggacaagtcacttaacctccagcctcagtcttctcatctataaacaaacagggacgataatccccacccaccatattggactaagtcagatatccaaagtgcttggtacccagtaggtacctggcctctggtccgtcgcttcctccaatcaagttggtgccatttccgaggctgtcgccatgcccactgaagcgtttactacaggccttcccatgagacgacccacacctccctacagttgggacaaggtcactgaagcttcccttggggaatgggcgtcagtgtcatggggg

SEQ ID NO: 185491 - DNA, 443 bp, Homo sapiens
tgtaaaacccttccagtaccgggcatcgagctacagcatgtgattctctgagcagctctgccctcaaagactcaccaagaatacaagccttggcttgagatcctgagggccaggctctggaactgacaacccaaggagctgtcagaactttgtcagtaggctggagccccagaaaggaccccttggactttgaagccttgttacttaaagtgtggtccacagaccagcagccgcagcacctgggagcttgctgaaatgcaggctctccggccacatttcagactgttgactcgggatctgcaggttgacagtctccccaggtgatttcgcgagagggtttttcgagagtcaagacatgtccaatgacgcctgagtgcaaggcatgtgtacgcgttcatggtgacctcttgtggattcacgatgtatattgtagcagaagggat

SEQ ID NO: 185492 - DNA, 618 bp, Homo sapiens
tgtaaaacccttccagtaccgggcatcgagctacagcatgtgattctctgagcagctctgccctcaaagactcaccaagaatacaagccttggcttgagatcctgagggccaggctctggaactgacaacccaaggagctgtcagaactttgtcagtaggctggagccccagaaaggaccccttggactttgaagccttgttacttaaagtgtggtccacagaccagcagccgcagcacctgggagcttgctgaaatgcaggctctccggccacatttcagactgttgactcgggatctgcaggttgacagtctccccaggtgatttgtgtgcacactgaggcgtgaaagcactgctgtaaaggacaggtagagagaactgtggtggtggacacgagcacagggcattaaggagcccacagagatgggcccagccagagctgaggttcaagagaggaggcattacaagagaagacttcaagtgagaaagtaggaggtggagccaggtgaggggtcctgcagcacagtgcttgtgcagaggattcatttcagggtgcaggaagggtctcccagagaagccaaggtcagttaggatgaggctgcagtagtgtcggcggtt

SEQ ID NO: 185493 - DNA, 618 bp, Homo sapiens
ctactatgtgccagaccctcttctgggtgctagaggacaaagccctgcccttaggaagcttacactctagcgggaagacagtcaataaagtacaaacaaatgagaaaagaaggccctgccagatcccggctagcgccatcaacacaacagagaggctttccaagagggccatcggaggaggctctttcagctcaggtgccggggaaggcctctctgaggtgtctggagctgagacccaaaatacaaggagcaagctttttgaagaactaaggtaagaacaaatatctggaggcagccaccctcatttgtttctggaatattccagacctgctactgcacagtgcaaattaatgggtgtgcttacctgtggaaggaaccaccctcctctatcttcccaacactgcagctcagttgggcatggtggggtgggcgggtcctggactcgaccacctttccctgctcatcggagctggggcaaatgacctaggcccaggagaggggtgaggagggcatttcccctgaggcccagccttagcccctggaacctagccgctgatgaccccctgcccccaagccatcatccatgtttccttcccctcttgatcattcccactggct

SEQ ID NO: 185494 - DNA, 286 bp, Homo sapiens
ttctaaacaagctccttcccccaagcagacccccatatacctcaactaaccagaagctaccacctagacccacaggtgagccaggagccggcagtcagcaaatcacagcaaatcaagccggtaaccagaactgcttttctccaaagtgggagagaaagcaacttagaggcgttcaggccaggactcatcctagacaaggtcttacagcttgctcaattagaatcctctggcaacaaacaccgaggtgcaaataaccagtccatccacccctccctcccgctctcca

SEQ ID NO: 185495 - DNA, 223 bp, Homo sapiens
tccctgacttcccgcaacacgtttctctctactcacagacttctgaccaaatgtgtgtgcagagtttctacaccagttctccaactctctggataccaaccgcgtatcccacaattccattctgacactacctagagttagcgcagaacccacaggttaggggctcagtcccacaagaccactctcacttcagatgccacagtcacccacaagccacggtcaa

SEQ ID NO: 185496 - DNA, 422 bp, Homo sapiens
acaagtacccagctcctaaccagcaacacactcactccacaaggctgaaggaaacaccttagtgcctcaggggcgggggcagcaagagacgcaactctaacccaagaattgtttgacaggagaaaaggggcggagcgaggggggctggcatgtttataaatagcgtcatgaagggtttcccctttatccttagcttctctcccactatcctcttcatcccactgccaccttgccctaaccatggaaacttggaaactaataggaacacttaatcattccaggaacctcacaccttccaatactactaagtcaaaacaccccagtccctgggctatagcagatcacatatatacttgtatacttgtagcaggatcacagtcctgtagctgggtcatctgagctgaagagtggcatgccaatga

SEQ ID NO: 185497 - DNA, 308 bp, Homo sapiens
ggctttcacacattctgttccatttgagatacacctacaagtaagacaggcttgccagagaacgggaaaaaattccagtagagtctgactatccagatacttgtttttccctccgctctttaatcataagaaggggaaaaaagcaagtttgcaaatctactttttttgttaagtaacagatcattttggtgaaaaatcatgtttctgcagctgacagcaaaagtccccttttctttcaatgaggacaatttggtttaaaatagcttctttacttaaatgaaccatgaatcaattttatacatcctgac

SEQ ID NO: 185498 - DNA, 437 bp, Homo sapiens
ttattttcattgtgtgtggatgtgtgtgtttgtactaggctacaatgtaaaatgtttttgtaactgctagcagaagctagaaaacaagttaaaagccattgctattatgtttacagcaaaattccattgaaattcttggacaactaaatggtacatcattttggcccatagcacaaaggaatgtatttcataaagaaggtaagacattctcacataacccataaatacatacacctactatggactcacaaaattaaaaataaataaaaaacaaacggggggcagggaagaaggcaagatttatgacatccttcactactgactggcaaaaaggagtagccatccccaacgtttttggtaccagggaccaggttcgtggaaaaaaatttttccacggatggggtggggaatcagaaggtttcaggataaaactgttc

SEQ ID NO: 185499 - DNA, 648 bp, Homo sapiens
ctaccgacagtgaaataggtaggttagctctggcttgactctctcatgagaggggccgattgtgaaataggtaggttaacaaagaaatcttagttacatggtgctttataatttacaaagcattttacgcccatctcactagagattcacaacctccctggaagtggacagggcctggataatgagtgtaactagtgcccccattacagataagaaattgttctgagtgaggtgccccctcattacctatcaactcaacatagaacagtccagtaattgttcccttgcatcataatgctgctccacatgggctcagatgtttccattccaccttggaaatgaaaaggggaaagcatgcatttattgaacattcatcacgtgcccagtcctgtgtttgatgcttgttcttgcaacagggataacttcagcacgtttaccatgagcagcttcctctagcacagcaatgaaatacatgcacatgtgtcttctgcagatagtacacacccctttgctcttcttattcctatttgtctgaacacattacagcaataagtcagtccaccaatgtaaacccctaaacataagatgtgtgtgcccataggactatgagagcaatcacctacctatttcacaatcggggaacatgtg

SEQ ID NO: 185500 - DNA, 188 bp, Homo sapiens
acaatgagaggcagctgctccctgtggcgccctctgctcctgcctcgatgctcaagaagcctgtgggagcttggggttctttgctacccaagaggtcaaaaccagcttgtcttgggaggcctgggtgtgcctggctgacagggcgtcccagatgcagggctggcactgtcatgggaaaggcacgctca

SEQ ID NO: 185501 - DNA, 653 bp, Homo sapiens
acaaattatagagttcagcaaacgttccgataagactcaacactctgttcagttgttttggggattttctaaatatgatgactatatttacatattattcaaatagttaacctgattataaaatctgggagagatagcaattaactactacacagtagttaagatcaagtgcacaagttcttgaatcctggctgtaatactatagttgtgtaaccttgggtaaattaattaacctttctgtgatccagtttcctcatctgagaaagggaataaaacagtgcctccctcatagggttgtggtgaggatcagttgactcaatacattcaatatctttagaacatgtctggcagagagtaagactccactgacagtagttgtagttattatttctaaagtgatctaggtttacatatcctagtcagccctttgcatccatagattcaaccaacacggataaaaaatattcagaaaaaaaataaaaaaacgtacattcaaaagatagtataagacttatttacatagcatttacattttattaggtattataagtaatctagagatgatttaaaatatatgggaggatatatgtaggttataggcaaatattatgccattttacataagagacttgagctgtgggggacctggaacc

SEQ ID NO: 185502 - DNA, 364 bp, Homo sapiens
  misc_feature (311)..(311): n is a, c, g, or t
  misc_feature (330)..(330): n is a, c, g, or t
cagccatcagtccacctgtgtgagtagatgggtgctgtggctgctctttcggctcctgctgggatttatcagccatcagtccacctgtgttatcaatactctggctgaccatcgtcatcgtgggactgactttggtggaagtccttggttacttatcattactgtgtttctgagaagttataaatttgccatctccctctgcacaacttacctttgggttatcaatactctggctgaccatcgtcatcgtgggactgactttggtggaagtccttggttacttatcattactgtgtttctgagaagttatnaaatttgccatctccctcngcacaacttacctttgtgtgtctttcctgaagaa

SEQ ID NO: 185503 - DNA, 340 bp, Homo sapiens
tcagagtagaaatcttgaaagatgtgtctgagttgcccagaaggaaaccactcccctggatttggaagtatggtgttgctgagctcgagataactaccgcctgctcccacaagtatgggggacatcccggcatacccagcagcagtggcccatggtgagtactcagtacattgtgcagggatggacaggcctctccccctgctgtggggtgctggcaggagcccagaaagatgcaaatgagtgcccagcccagtgttgacaacccctttctccaaatccctgaggcctcgcagcaggactcctgagagacagagggaggtcaagctccgaatctcacctt

SEQ ID NO: 185504 - DNA, 493 bp, Homo sapiens
acaatgaagatcacccgcaattagctcgttttgcgtgacattcaggcaaaccgactaacaggcgatgcgacgaagctgatgggagcaaaccagttaaacctaacaccctgccttgtctgggctcatcacctctccctatcccagactaactttactgtgaaatcctaccacattccatgtctgaatttttggattcggggtggatttacgtcgtcttgaagaacacacgtgggtccttaaggtggattaaatagtgggggtgggggtggagagggagaaggaaggaggagtgagggaagcctattcttcctttctacaggtctgaaattgttaaattgatatcatcaggaagccaaaattttgaccttataaatcatatactaggagaaagggggaaaaagaaagagaaagaaaaagaaagacagagagagagacagagagttttctagctacacaatgttttcatttttcatggaaataaagcttcatttca

SEQ ID NO: 185505 - DNA, 259 bp, Homo sapiens
tgatacccagtaggcatctgaaaagcatcaggtccaaaatggaattcttgatcccccaacctgctccttacagagtgatccttgtctcagtaattccaacatccatcagttgtgtgatccaaaaacttagaactcatacctccctttcctcatgcccacagtttgttcatacaaagttctatagaatctacctcccgaatacattcaaaattagaccacttctcactgcaactcaataccatgctcctcacttccatct

SEQ ID NO: 185506 - DNA, 193 bp, Homo sapiens
tcaacactttttctctatttaactaagaaaataatgctgatcaacttcccggattaaaccttaggactaaataaggcttatctgccattacagaggggcaagttatgaaggtaaaattcaacaattagttaattagtcacaaaatgttggccatttcttctctgagggcctctcacaccagcaccttcccttc

SEQ ID NO: 185507 - DNA, 528 bp, Homo sapiens
atgtctttaaaggattgaaaaacttaaccttcaggtcagaactaaatcatagtaaattccagaaaaccatgcatttctatctaagctaatgtaagaaaccatgataaaattaacacttatagtaaattgattatttaacattaaattgctttaaattaaaatgtttttccttatagtaaaaaagtgtctaaatctcaaaaacaatgctgaattttgaaataaacaagttgcagaaatacatgtaatgttaagatgaaattttaaaatttgtaaattggtaatcccagctacttgggagactgagacaggagaatcacttgaacacaggaggtaaaggttgcagtgagccaagatcacaccattgcactccagcctggacaacagagcaagactcttgtctcaaaaaaaaaaaaattgtcccttaaaaacacacaaaatacaaatttgccccagggggaattagacattttaaccttacttgtaacaggtaaggagttggccccagaattggaaaccctcttgaaaaag

SEQ ID NO: 185508 - DNA, 189 bp, Homo sapiens
tcgaccagaggatcccctcttgtaaatacatgtaatgttaagatgaaattttaaaatttgtaaattggttatttctgagaaggggagagggatgagataaggaggaattcacaagggagggtctcaactgcattgattttacaatctgtagattaataaggtaaaatgttaagactttttttttttttt

SEQ ID NO: 185509 - DNA, 160 bp, Homo sapiens
gtgttgggattacaggcgtgagccaccgtgcctggcctattttttgttttatttttttaatcttgaaataactccacagttatctccaagtaagtctaatatcttctctttgaatttctaactgattcttatttataaacccatagaatctgtaaaccca

SEQ ID NO: 185510 - DNA, 297 bp, Homo sapiens
tgtctttattccagcgctgtctcttaagagttgatcaagatgcccagcctgatataccctcagcagggaaaattgcctgactactgtcttagtctgttccacctgctatgacaaaaatatcacagactgggtggcttaaacaaaaatgtatttctcactttctggaggctggaaatccaagatcaaggtgccagctatttcagtgcctggtgaaggccacttcctggtttgcagatgtgtccccacatgggagagagagagagagagaaagccagctctcttatgtctcttcttttt

SEQ ID NO: 185511 - DNA, 380 bp, Homo sapiens
tgatggttggtaaaggcagggtatgagggaatcattctctggaaagtaatgtaaaatcagatgactgactatgaggcaggcattcagtatcagtatgaagacatattttatggtaattcttttccttagaactttggcacttagaaaaaactgatgtggaaagattcatgacattacctgtagatgaatctttgagatttaaaaaatacactttgggccgggtatagcagcttacacctgtagtcctaacactttgtgaggctgagaaggttggattgcttgagcccagaagttagaggtcagcctgggcaacaaagtgaaaccccatctctacaaaaaatacaaaaattagcagggcatggtggtgtgcatctgtagtc

SEQ ID NO: 185512 - DNA, 549 bp, Homo sapiens
atgtgcgattcttgagaaggatagatagagtccatgaaagggatagatagataaagtcctggagcagaataggtctggaaggcctggcatggcggctcacccctgtaatcccagcactttgtggggggtccaggcaagtggatcacttaaggtcaggagttcgacaccagcctggccaacatggtaaaactacgtgtctactaaaaatacaaaaaaaattagccggatgtggtggcgggcgcctgtaatctcagctactcgggaggctgaggcagaagaatcgcttgaacccgggaggcagaggttgcagccgagatcacatcactgcattccagcctgggcgacagagtgagactccattttaaaaaataaaaatcaaagactgcccaggctgccaagcaagcatgttaacaccttgatctgggtgctagcgttggagaggtccaggattgaatcgtgactcccctgccttgtggctaggtgacactggctgggggagaggcctcttagctggtttcctccttggtgaaatgtgtgccccctcccggg

SEQ ID NO: 185513 - DNA, 470 bp, Homo sapiens
gatggtaggtggatcacttgaggtggggagtacgagaacagccataacacaatatgtgtagaaagcccatctctactacaaatacaaaaattagacgggcatggtggcgcattcctgtaatcccagctactcaggaggctgaggcaggagaatcgcttgaatagtatatgctggcataaactatggagaaaccaccatctccactaaaaatacaaaattagccgggcatggtggcacatgcctgcatacctgtaatcccagctactcaggaagctgaggcaggagaattgcttgaaaccgggaggcggaagttgtggtgagccaagatggtgccattgcactccagcctggacaacaagagcaaaactccgtcttgagaaaaaaaagaaaagaaaagaaagtctcctttccaaaaggttgtggctccacgcgggacacgtagttcggctagaaaagcatggacctagatt

SEQ ID NO: 185514 - DNA, 235 bp, Homo sapiens
gttggccaggctggtctcgaactcctgacctcaggtcatccgctcgcctcagcttcctaaagtgctgggattacaggcgtgggccacgatgcccgtcctatctttgttatacattctggaattggcttgctaatattttgttgaggcttttgcatctatgttgatgagtaaaatcttattttgttagtaatctatttaatgatgtaatttacataccacagaattctcttgcttt

SEQ ID NO: 185515 - DNA, 781 bp, Homo sapiens
attacttcttcccctaaatgtctgggtgactgtctttttaaaaattttattgagctgtaagatgcatgcagtttactaatcccaagtgcatggctcattattccttaatgctcagactgtgccatgtgtggccagttgggggcgctccaggcacctttagatgccgccccatcattctgtgagcactttcttgctttctggttcaggtatgtgttcaggctcatcttttcttgttttctccgtgtctcagtcctggaatcggccatttttccacagagttgtagttctttctagcaggatggggagtttcagtaactgcctgggcccaatgctgtttgtgcttcagaaggtttgggccaggtcctggttccaccagcagcaggcatgcctgcgttgactttctgcttctcctgctgatttggcaggggtgactggctgctcctgcctcctttgtgttcccggtcgtgtctaaggccaggccccttctgcccaggcagccggcgtggctctcttcttgccttttggttgcatatctagtggaatctcgtagtggacctggcacttgtagcaatgtttgatcagtagagtgaagatgatgacatttccctgcttccctgtgttatggagctgtcttgaggggggcttttggtaaataccatcgtcgaggtgtgtacagaatgccaagaaacaggagattggggaaggctgtaggcacagctggagccaggctacctgcaggggagcctcaggggccgtggagttccctggagacttgccacca

SEQ ID NO: 185516 - DNA, 203 bp, Homo sapiens
aggagcgaggtgaggagcaggggcgtggaaaattctccaatgcagcagagaagaaaacagtttaggtcacagcattttgatcttgcatgtgatacaaccactcagctagaaagaatgaagtgatcacactgatattcagagtttgtgtctaaacaccataatctttaagattcggagtgcttcttttattaaagtcccaaata

SEQ ID NO: 185517 - DNA, 312 bp, Homo sapiens
ggtagcatgtaacaatcaattgtaagtttttttgctctgtcattctgtaagatgactctcctctatccccctaaattcttctaacagttggctatacccaaatgtctgtttctttagggacatcgaggaaaagatcttcgtttagacagacagcagggcagggagaagagccgtatgtcctgaccccaagtgagactgacaatgccatagaagcagaaagctaatgtacataatgcctaggagacatacgtccccttgagaagcccagaaatgctggagtactaggcatcccattgcaggtaggatgaggac

SEQ ID NO: 185518 - DNA, 360 bp, Homo sapiens
ataaaatcactggcttgtttgtaacagaaaggataaatgcttgaggggatggagaccccattctctctgatgtgattgttacaccttgcatgcttgtgtcaaaacatctcatgtaccccatgaatatatacatctacgacatacccacaaaaaaagactttagaaaaacagcccattgcagactggccactgcggggagtggttttagttcaaaagcccttcctcacgctggcctctttggcagtggcgtcacagccccattgctgcaggaaatggtttgacatggggcggtgcgggaggggccctgacagtggggtttaggaagccacacccggcccaggtgcctgggggctgaagaaa

SEQ ID NO: 185519 - DNA, 177 bp, Homo sapiens
tacaaaaatcactccgtgttttccttgcctctctctctagtcttctaggcctccatcctatcctgcctactgatggaagagacacatttctaaaacccaaaaccctttaaacattctccactgactataggatgaaacaaaactcctccttagcctggtctataatgcactccaaga

SEQ ID NO: 185520 - DNA, 408 bp, Homo sapiens
cgagaggggccagaagcctggctggtaagaaatgtttaccctttttgcctgcatgtcaggtttctgggttcccattctctgtagcttccagaagaacggagcagctcttgatgaccctgatcgctgcacgctagctgtgggcgccaagtcgcattgcaaaggaaaaccatccgtttctgttttatggaaccacaggcaaaagcctctcaatttttcaagatgctgcccaatgggctgcatggggaactgaattaacattttccatcctggccagagcagagtacacatgacaaaactagtcactatgctcagtgcccagcatcaacttggcaaggctcacacttgctcccgttggtctctgtcatctttgatccactccactcaaggtgggaagggacgccttccacc

SEQ ID NO: 185521 - DNA, 414 bp, Homo sapiens
ataggcttaatttccacataatccagaaaagaaaccgagtcatggaaagattactcaatttcctataatcatacaactagaaatggacaaagtcaggattaagcccaaggactctctgattgctttccatacgcccctgtgctgttctcttctggtatggtggcagctaagcatcagtgctgaatgggatccaacacctggagctggtgtggatactaagaggagtccaaaataaaatgtctaacagaggaaatttctgaagactgagaacatggggctcacagaatcaaaataggaaagcagaatccggtcaagtccagggggtgagcacagtggctaaagcggaaaacatcagaggctgggaggccctagaaagacaccaggagatagagcatggaaattaagcctttgcaa

SEQ ID NO: 185522 - DNA, 534 bp, Homo sapiens
cagaatgtgactacatttgcagacaggacctttacagaggtcattaaattaaaatggggcattagggtggaccctaacccaacctgactggtgtccttgtaagaaaaggggatgtggacacacaaggagaccccaggggcacagaaggacaaccaagtgaggaggtcgcaagccaaggagacaggccccggaagaaaccagccctgtcgacacctggacctgggacttccagcacccagactgtgagaaaattcatttctattgcctagtcaccagtcagtggtattttgtgacggcagcctgagctgactaatacaagtgcatagttagtgctcagtgtttgctgaaggttgaatcaataagcgctttcgccccagccctgggttagctcagtgcaatgcagggaggcaaatgtgaaagggcccagagccgtcacaggagcagagggctgttcaggaagtcttcctggagaagatttctgggggcacacccggtggacacaggttggggaggttctaggtgggggctcgcgtg

SEQ ID NO: 185523 - DNA, 675 bp, Homo sapiens
atttttctggaaataccctcaatctaaccagagcatgaggaatggcttatctgaacttatgtgggaagagaatcttgatccaggtatcataaagatttttctccgtgtctgctattgaagtttgcatctccacatatctgtgactcagttgagaataggtagttttaagttccttcaaggcagatagggtatactattacttctttcatccctgatgctgttggcacagtgctttgcaaatgggcgctcttaaaaaagtttaaatcgaatcctgagatgttttaaccaacagtgatgttacatgtttgtagaatctgatattcattgctgagaggggaaagacagtttcaggcctaaaccaaggttttagtctctattcctcactacactcgccctgcaaactttacacctttgtgcctcagtttttctgtccttggcaaattgagagtaaaaggcccacttctacctttctgggagtgtagttagcataaaattaattttgatagagaataaagtccgcagtgtttcatttcacagaggaaagatgggcaatcatttatcactttggtgaccatgcccctttgggacctactatatttctgcaggtgattggtcagggagtaggcagtagctttggatgtcaggaatttctctgtgaggtcttggaagttctgt

SEQ ID NO: 185524 - DNA, 516 bp, Homo sapiens
atgtctgctgttcagaggatctccgattgtgaaataggtaggttgtttaattggtagttaataccaattaattaattggtagtatttaagcacaattaagatgttacttctctgtactttagatttagtgttatagctgtaatgttctaagagctctaaaattatgtcctagatattctaattgtgtttaaatgactttgctgtagtagtagtacccattttaatgggtacagttttgctttgctatgttctagagtctttttacaagattatgagatatccataaataattctaaaatgaaaccaaaagaaaatctaagataatttttttcttttttttttttttgagacggagtctccctctgtttccaggctggagtgcagtggcatgatctcagctctctgcaacctccgcctcccaggttcaagcaattctcctgcctcagcctcccaagtcgctgggaccacaggcacatgccgccacgcctggctaattttttgtgttttagaagagac

SEQ ID NO: 185525 - DNA, 453 bp, Homo sapiens
caaaaaaaatagcttgttttgtacccccttggagaagctgtattcatattcatcaatagatatttattaataaatgaaaaaggtgtaattggtatctatgtgattctaaacaactaattgaaattttgaacacaatgacacactggtattaggctgatgcaaaagtaattgcagattttggcattacttttaatggcaaaaaccacaattacttttgcaccaatctaataatttgatgtttgccaacttaaaaaattgttttgttggtatcagctactatttagttcagcagacattactctagcatcttctgtgtttcaagtacaatgctagggtgctgcatataaaaaaaatttcaagggaaaattcttggtcttgggaaagttatctaatagagatagatatataaatatatcatttcattataatatggtaagtaatacaatagaagag

SEQ ID NO: 185526 - DNA, 382 bp, Homo sapiens
taatgaaaataatatgataaaatgataggcccttcccacttacaaatttaagtgctgaactgtaaataaacattaaatcatgattaagcaggggtttacctgaggaattcaaatatgtgtaataacagaaattcatttcactaatggattaaaggagagaaaccacattaactgaataggtgcagaaaatacatttgatggtatccaatttccatttattataaaaattctggaagactctaaataaattgaaaattacttaatcgataaaaggcttatgacaaacaatacttaatgccacttaataatacaggagtctctactcccaccttgtattatctgcctcctggtattggagatcctgacacaatgcaatcagcta

SEQ ID NO: 185527 - DNA, 281 bp, Homo sapiens
catgcgcggtcgagctctaaggatcccccatgggtccgagagtaaacttagttaggcagttgagacacatctagcagaatcaagttagtgaatgggatcaatttccaagccacctccaaagtcaatttgtcttagaaaacaaaaatgaatatattcacattaaaaatttctataggtaaaactagattcctagctcatgtttcctatttcaagagaggtgctatggcagagtagttacaacctctgaagctaaactaccgtctatttgaccttggacaatt

SEQ ID NO: 185528 - DNA, 320 bp, Homo sapiens
gttttgaaaatgtggaactagaactatttttttctatgcctccttattacacataaaatagtactctgcctatgatggatacttaataattatagattaggccaggcatggtggttcacacctataatccccgcacttaaagaccagcctgaacagcaaagcaagagtttccttatccattcacctactgaaggacattttggttgtttccaggttcttagctattacaaagaaagctgctatcaacaattaaacaattgtgtatagaattttatatgaatataagtttgcattttctcttttcttcgataatgtgatag

SEQ ID NO: 185529 - DNA, 230 bp, Homo sapiens
attacaggattgcccacgctcagccagagcaggaagatttcttccccacatctccagtaggtacagtgatatgaagtgtgtggaggagaaaagaggaaacacctatcatttgagatggctgcgaaaggaaaaggcatcctcagggaagctagattttacttagagcaagaaatgaagggatgattcagaggttaaagagtggattttatgaattactcaagggagcggtg

SEQ ID NO: 185530 - DNA, 312 bp, Homo sapiens
tcctgtaatccaagcagtcgcattactgcaatgaataattttgacatacatcattttacgagtgtgcaattatatctgaaggataaatttctagagttggaattacctggtcaagggtgtgtacattcgtagttttggtagaatagctggagattcatgtattgccattttccctccccactccctagcagttgagaattgttgcagtataatgacagatattactgacaatgggagagtatgttccacatgtgaatcgtgtggaggcagaaaaaatagaatcactggccccccgacggcttttagttagta

SEQ ID NO: 185531 - DNA, 239 bp, Homo sapiens
acccactagcagagtcaccctccttttccccccaatcttgtcccaggaatgggagctgagctgacacccaagccccagaatagtgagggtctccattgagaggagaacgtgtctgagatgggttgacactcagcaccctgcccctggactagactaccattcacccaaacccctgcagggaaggtgtcccagcctccaggcacttgggtctcagctgagaagccctggctctctcagaa

SEQ ID NO: 185532 - DNA, 426 bp, Homo sapiens
gtcctggtgacacacggcctgaagggccctgtcagctgagagaatcagtgctcaaggggaatgttgtggagattacagcggtcagagggttttattcagagtctctgggagaggaaaataagaaaggacatgagagaaggggaaggaagggctaggcagaggatgaagggggatgtgcatgtgggataaacttgacagagggtgagcaggcaaaacagctttgcctgctagggaagacccaagtgtgagcctggcaggccttgtgtctaggagggacctgggcgattgtaaacaatatactatgctctgaagattgtacccacccctccagtccccactcctatcccttcccaagatggggtctttggtctcactgtgatttctaggcctagcctgaactgtgctggggtgacaccacccaacacc

SEQ ID NO: 185533 - DNA, 162 bp, Homo sapiens
ggagttcaagatcagcctggacaacatagcaagaccttgctcctgcagaaaataaataaaattaactgggcatggtgacagagtagctgtggtcccagctactctggagactgaagtgggaggactgcttgagcctggtagcttgaggttcaatgggctgtt

SEQ ID NO: 185534 - DNA, 571 bp, Homo sapiens
ccctttatcttaatgggttccctgagatggctccctggccacctctcaccactgctctgcgtactcaggtaggtagtgctccctgccctggctaagacccaggaagggaagggggaagcatggagaggccagagacttggtgccctgggattaaagctagttactaaacaggtctgggacttaaaactggaccctaaagtcaatgtagagaaggggaaaaaagaatacaaggcaaaagactgtcctcctaagagtgaaagcaggaaatgggcaggttgctggaggcaatcttagctgctaagagaaatataattacttttcaatttcggttacacctaggctaataaccacaactggaaattcttgttgggagaaggaagttttttctcattaagagataatagaaagtcattcacccttgaacctagaacagtcaacttcaaactgaaagaacttgactcagctagggcctctgctagcctgcagtgcttatcttgcacctctgtgcagattagaaaaaggtgctcctctgtccaagcagtcacagcccccagtttggcaagtgtccccc

SEQ ID NO: 185535 - DNA, 450 bp, Homo sapiens
cagagtactacgaatagcagtaatgaaatattatcatttaaaataaggatataatatcacttagcctgattgtggtcttcacatcacctcccccgaccaaagaaaagtcataaaagcagaagtgttctttgcctcagtggtttagattgtttgtgatatttggaattgaactagacaagaagagacgtatcaggaaccagttcctccttgcctccaggtatcagacatgctagatcccagttggtcttaactttttgtctcacttacccctttggttggaatgcaggcattattctgaagctttgtggtaagcgacttggattttctagtgtcgggctcttctcttttttaggaagggagaagcgggtctgggaaattaaagtgcctgtatctcccagggcaccgattgttaagagggttgggacctcagtatgttttttttccattctg

SEQ ID NO: 185536 - DNA, 312 bp, Homo sapiens
ttcagcttctgaccctatggtgggacaaggggagaaaccccaggcaggttcaccatgagcaggtgaagaagtgtggcttgacctcccactgccatgccccaggcaacctggtgttcctggttactaaagtgacaattgccacaaggtggtaaactctggtcctagacccaaaggttcaagctggaaggtcctgattaaaatcaggcactgggcctcagacatggactctctacctccaagtcctctaggctcaggactctgggcttgaggagtcctgagggggtcccagggttgaggtggaagactgtaact

SEQ ID NO: 185537 - DNA, 168 bp, Homo sapiens
cttttatgttctctacagtctctgcatgcctctgttggctgccatcgggggcagaccactcccactgcccatccttggactccactgttttggtttccctgggcagttaccctctgtctgggcaagtgaagattctcagcctgagcccaatatcaacaatgttccagg

SEQ ID NO: 185538 - DNA, 383 bp, Homo sapiens
atgacatttggcagcagttgagagtatgagtgctgttgatgaaataaacagaggcctttaaaagcaaggcaggaaaaatgctgggacgagtacaggaacagaaaaccagccatttctccaggtctattcaaagacgtagcaacactccctgcaaaccccagggcctcattatcaccactcagggcagtggccccgcacagcacctgcacagttgccagaggaggcctctctataggaagtgctgctttctgttgtggatagagtgactggctgggcctctctctgtgtttctcccctagtcttcaggaatatgaatgccttttccttcagtgctactaggtgcaaatatgcgagttaagggacaatgccaataaagtagccgc

SEQ ID NO: 185539 - DNA, 465 bp, Homo sapiens
aatggcttcaaacaacaggaatttcttctctcccaggtctggaggtcagaagactgaaatcggttgcaataaactgaaatcaaggtgtcagtagggctcattccctatagaagtgctaggggacagtctgttccttgcctcttccagcttctggtggctgccagcattaccttgcttggagtggcatcaccccaatctctgcctccatctggatatatcaccttcttgtcttctgggtgtaatatctctccgcctttctcttataagacacttgcaatcaaatttagggcccacctagataatccagaataatctccccatgtcaacatccttaatttaatcatacctgcaaagactccttttccttataatttaacatatacaggttccccggactagaacctgctatctttgagtggccatgattcagcctactataggtttcatcactatctctttatcaac

SEQ ID NO: 185540 - DNA, 425 bp, Homo sapiens
gtaagtctttttaaaaagctactcaaggggaattgtagtttggccatgaggaatggtgctgttcccttaataacaggagtcagccaaaatcagccatccacagatcaggcaatggaaacaataagatgtattggttaaagcagtattttccaaagcacgggtgagtgccattccaaatgaaatgtttttagtccttgcagacagccctagataatactcacagtgaaaaagtcaatctctttctttcttttttttgagactcgctctgttgcccaggctagagtgcagttgcgcgatcccagctcactgcaacctccgcctccaaggttcaactgggattgtgctaagattacaggcgtgagccaccacgcctggccctaatctcttttctaatacttcctttacattaaggagaaagtgtcagt

SEQ ID NO: 185541 - DNA, 261 bp, Homo sapiens
tagcccacactttggatctgctgtctcaactcagccaggctacttccccagaggcccagaggcacagaggccctcagttcctcatcaccacctccatcacttgcttggactgttgcataggaacaatgcgtcttcttttttgcccctctcagcagctccctgaggaaggcagggcatttttatggtcatggcactgccccacgctaccctgtgcatgggtccttcttcagaccctctctcttttgcccctggatcttctct

SEQ ID NO: 185542 - DNA, 271 bp, Homo sapiens
gccctctaggttgttgtgatgatagctttaaattgaataattacggtaaagcattcttgtatgtctggcacatagtaggtgtccattaagtgacagccaacaaagtgcctgggagagttaggcaagacttcatggaagaagggacatcagagttccagtagcattcagagacctggaggtggaggagggcagaagtaggagcagacatggaatgagttggggtaccaggttaggaattaagagtccatagccagatcccaccgtaccacca

SEQ ID NO: 185543 - DNA, 428 bp, Homo sapiens
atccccctacctcagtctcccaaagtgcagggactataggcatgagccaccgcgcctggcccccagccactggcccctggcctctggcattattttagagcataaaataatgtggactcctgtgtaccactctttctgagcctctggtggagggaaatgaagtagatcagagtgatatttgacatttcagtctctgttgccctttccttaaggcccttctgagcactgtggtgaaggcagagattatcaacccgttagggtgtggaacattcagagctgaggcgagaattatgggctaaggagcagagctggaggatttgctcacctttgtgactcttcggtcttgtgatgggaatttaaaattggagcataggagcatagatgaggatgctcagcaagtcagggagtggagaggaaacacttcttca

SEQ ID NO: 185544 - DNA, 459 bp, Homo sapiens
ataaaatagggctatttccctgttgtcttccctgaacatatcttgaattgtgacataagagatgaggatgtggaacaactggtgtagggtgtgtgaagcccatgtctggccaggcaaagtggaggattattgaggaatggtggtgattctctgggcagctgaagccacaagccctgctcacactctcttcccttggttatgtccaaactgagttgaggtcaaaacccaccagatcaaggtatggttttccagatgctgcactggggccaaagaagctacttttgggcaggactctctgccccgcttttctgcaacaactagcctggaggaaagaacacagacttatccagccaccaccctaaaacagctacaaatgggtctggccaagccagaactcatcaatttgctttctcttttcttctttttttaatagatttagggggtacaagtgcatttttg

SEQ ID NO: 185545 - DNA, 562 bp, Homo sapiens
acagtgaactcaattccaacaaaggtgccaagaacacacattgggggctggacacggtggctcatgcctgtaatccccagcactttgggaggccgaggctggctgatcacctgaggtcaggagttcaagaccagcctggccaacatggcgaaaccccgtctctactaaaaatacaaaaattagctgggtgtgatggcgggaacctgtaatcccagctacttgggaggctgaggcagggagaattgcttgaacctgggaagcggaggtggcagggagccgaaacgtgccattgcacttcagcctgggggacagagcgagactccatctcaaaaacaaaaaacaaaacttgagtgatgatggacttgaatagaagtattaaagtataagacgatacgttttaaaaattgaagtaatttacgtaccataaggtaccacgtgattttaaaataaatgttcttgaaatttagtggccgtaaagtgaattgaaggagtgcagtactggaaagagagtgagcagtgaagaggatttattattattattattatcctttatttggattat

SEQ ID NO: 185546 - DNA, 440 bp, Homo sapiens
ttgatctccgacccctccataatgatcccagacacaactaatcacccaatatgacagggcaacataggggccagggcatcccagacacagaggtgacacaaacatgcactataaagtgtcatggtcacataggtccagacacctacatgtgcagtggctgacacacgtggtccccaaacacctgtctgtacgggggcagcacacatatagccttgacagcaggcacggccacaggcctcacaaggtgaaatggccacttccccctcccctggcatcacaggtaggacaagggacagagagtcacagggccagtgaccagacaaagagacagtcacaaatcacgacttggcagcacacaggacagccacacactcccctgcacctgatgatgacataagtaccgacaacttcacgccctcaggcccacaagtcacacacag

SEQ ID NO: 185547 - DNA, 581 bp, Homo sapiens
aatgagctcgtccgattagctcctaacgggccctgacaaggtgacacacactccaagattggaaacagccatcaggagccggatgggcacacacccagccatgaccatcgccactcacaagggtgacacacggtggatggccaatcacacaagcaaaggacaacgatcccagacacaactaatcacccaatatgacagggcaacataggggccagggcatcccagacacagaggtgacacaaacatgcactataaagtgtcatggtcacataggtccagacacctacatgtgcagtggctgacacacgtggtccccaaacacctgtctgtacgggggcagcacacatatagccttgacagcaggcacggccacaggcctcacaaggtgaaatggccacttccccctcccctggcatcacaggtaggacaagggacagagagtcacagggccagtgaccagacaaagagacagtcacaaatcacgacttggcagcacacaggacagccacacactcccctgcacctgatgatgacataagtaccgacaacttcacgccctcaggcccacaagtcacacacag

SEQ ID NO: 185548 - DNA, 325 bp, Homo sapiens
cagaaagcgtcctgactctggggcattactgaactcccctgctgaggaaggaattttggggccaaacagcaacaataagtctatcaagcgtatagcaaaaatattcctgatagtgtcacatgccccacaatatagagatatctaaggataattaatatcaaggtctgaagtgagataattatggtgggcctagaatatgtgaaaacaatgtcacaggaatggcaagaaccaaatgaacagaaataatagagactgataaattatttcaagtcctactctgagtaattactcatgcatcacaacaagaatgattacttcaaacttt

SEQ ID NO: 185549 - DNA, 1204 bp, Homo sapiens
gatactgcgacggacgcattcatgtggagatgtctgacattcaactttgaaaacaaatggtcttataataaggagaacagccagactagaaaacggacctggagtcatctttatggaagtgataagtgatacctcgggaatagaggaatcactaagagtatataaaaagaaaaaaagacattaaggaaaccttaatccatatttgaagacctagtaacaaaacaaaagccagtggcaaaagagaaagtattaaatttcacagaagcatcagtccaataaacatttatcaacacccaccatgttccaggtactatgctagatatgggggtacaaaaaaaagacaggactcctacccttaagaaatgtatagcctagagaagagatagaaatagattatttccagagagttataaacggggcaccacagagacacagaagggagacacccaggaggtcagggaatactcactgatgtgaggcattaagattaaataaaatgatgcaaagaaagttggtaagggcaaaccaaatgaaatcaagacaatgctcctggacttctaaaatactgagtaagataactggtttaggaaagaacttggttggaaggagccaaaagaggctaaagtgatttaaactggaaagaataatctattcttggaagaaaataaacatagaagatgaaaaaaggggacaaaggacaaggggtttttggccaaaagtgtacaagtttggggtgaactgttacaaaagagagattgaaggtgccaagctgtgtaaggatatgggaaggtgggtaaaaagaacttatttgaagtttgctgagctttatgtaattgtatatttctatctcattagaagatttcactaatatattacagaagttcattactttccaaaggttcggggcttgtctgcttcttttgaatgcaatactgagactggcccaaaatgacccaggtatacgtgaccatgaatgtgtggaaaaggtaaatttgtaagcactaatggttgcagaggtcaagcatgatgtaaagggagaagccactagatttcacatttatgtggtgaccttcaagtgaactttcaaccgaaatgtaggggtagaaaaaaattacaggtagttcacaaagtgaatggcagaggcatggctctaacattgttcattcattcaaaaaatatttactgaatgcgtccgtcgaagtag

SEQ ID NO: 185550 - DNA, 230 bp, Homo sapiens
gtaacataaatgtcaagtcccctgggacactgacagcatctcagggttgacgtgtgacaacacctcacgtcatggcaagtacttaaatgtgcatcttagaattcttgttaagaatgagcttccacagatccacacttctgcgtctcccttttctgacaattaccttatgtctcaggctgcaaaatacccaaaagaaagattgacacgccacgatcactctgcataacatc

SEQ ID NO: 185551 - DNA, 444 bp, Homo sapiens
tgatatctcattgtggttttaacttgcatctctgtaatggctatgatattgaatgtcttttcatgggcttatttgccatctgtatatcctttttgatgaaatgactgttcatgtcctttcctcattttgtaattggattatttacttttttactgttgagttttgagatcctaattctttgtcaaatatgtggtttgcaaatatttccttccagtctgtagactgactttttattctctaaacaggttctattacagcaaaattttacatttcaatgaagttcaacttacccacttttccttgtatgatactatgggtgttaaatttaagaacacttagcctggctctagatcctgaagattttctagttttcttttccctgaagttttatagttttatgttttacatttaagaccatgacccattttgagttagtttttgtat

SEQ ID NO: 185552 - DNA, 294 bp, Homo sapiens
aacgtaaccatttgtgcagttatttacacctatttgtgtgtacagatattttagcaacctatttacaatatttctcccccaaaatgagtaatgatatctgcaagagagaaatcgtaagtctatgagatatttgcatttttattttgattactaaactagtttttgttttgttttgtgttttgaggcagtctcgctctgttgcccaggctagagttcagtggcacgatctccgctcactgcaacctccacctccctggttgaagcaattctcgtgcatcagcctccgggtagctg

SEQ ID NO: 185553 - DNA, 601 bp, Homo sapiens
gcctgttcactctaatgctagtttctttggtttaattagagctctttagtttttttttaatttaagctctttagtttaattagatcccatttgtcaattttgtcttttgttgcaattgcttttggtgttttagttacgaagtctttgccatgcctatatcctgaatggtattgcctaggttttcttctggggtttttatggttttaggtgttagtttaagtctttaatccatcctctgttaatttttgtataaggtgtaaggaaggggtctagtttcagttttctgcatatggcttgcctgttttcccagcaccagttattaaatagggaatcttttccccattgcttattttgtcaggtttgtcaaagagcagatggctgtagatgtgtggtgttatttgtgagacctctgttctgtcccgttggtctatatgtctaaaaagcagaagtataaaagagctagaactaatcttaacactagttccaccagtgagtaaagcaaccagcagcagtgaagaaaatggcagattttcctgttggtgtgagtggactggtcacaagaaagtctccatggggtagcagaatgttgcattgcaaattt

SEQ ID NO: 185554 - DNA, 529 bp, Homo sapiens
gccacaaggaaggaagaagagaccccacaaaacactcccaacagctctttgcctccggtcaccccaaagagaggccgttctttctagggtgatggaaattctaaaattgaatctgaggatagctgcctatatccgtaaatatgtgaatatgctgaaaaaccattgactcgtgcactttaaatgactgtattgtatggtacataaaactgtatctcgataacaccttctcaaaaagaataaatgcagtggctcacacctgtaatcccagcactttgggaagcaaaggagggccaatcacctgagatcaggagttcgagaccagcctgaccaacatggtgaaaccccatctcgactaaaaatacaaaagtagccgggcgtggtggcacatgcctgtaatcccagctagctgggaggccgaggcaggagaattgcttgaactcaggaggtggaggtcgcagtgagcccagattgcagcattgcactgcaacattgcactctagcctgggcaacaagaacgaaactcggtctc

SEQ ID NO: 185555 - DNA, 1096 bp, Homo sapiens
tattaaatgaaattaagtaactctttgtgatagactagttttaagaaaagaaagaaccttcctcaacctgataaagggtaattttctacctggggcgtgtagcaaacccaacgggtaaaatacttcccgtgaaaggaagaacaatactaagttcatttttagtgttctttttagtgctggagaccccagccaatggactaagagaagctgaagcgaaaaagttgtaaatatttgaagggaaggtcagaatgtgtactgtttgtttatgctctttgctaagcatgtaatctacctagaaaagccaagaaaatcgattgacaaactgagaaaactaataaatgagttcagtaagttggctctacacgtggtaaacgaggaaatccatacataggttcctgtacaccagcaatagccgtgtgagaagtactgtcactgtctgttacatctgataaaacctgcctattaatctttggcctgcttgtcagtttcttgtcccagacatgctttgagtcatgaggagagcactccaggagatgaggctttcagtttcctgcttatctcaacacgaaagtcaaatgttgtgaagggtggacacaaggctgatggtttcatgacagccccagagagcaaaattcattccccctgatgcccatctcaccctgctatagaaagtttcattttttggacagcatttcctgagagaatgtatcactgagttttctggagacctgaggtctaatccttagtaatctgcagaaataccaaaggatatactaaggaaaacagaaaaggcattcctctaaaaatagctagttttttttttaatgtaatagcttgcagtaaacaatggcaacaatacagaaaactgctttcctccctactctctttgctctcccctctgtgctgtttccttttccttggtaaccagtgttgttactgtatgtatcttcctaagattttctttccatttacattgcagcttgcctttttcacctaacattttctctatctccctccttttcggctgctcaccctggggttcatttccccgcagctctgtctgttcccttggcagtcctctcccactgctctccaa

SEQ ID NO: 185556 - DNA, 666 bp, Homo sapiens
  misc_feature (24)..(24): n is a, c, g, or t
tgagtgaccaaggcaagattttgnaatgggcacagagaacttcaagtaagcccggagatgattacctgtagtttctgctgctcttagaggcagaatcatctgagaactgattgaggagtgcatgtataccccagagactagtgcactctaggataaaaggagtcattcagcccttacttttggttggatgcagggtgtagtttcaataaaatgtcacagaacaaatttctaagaccatttaggttgagtgagtgttagagtttgtctagtagtatatttctcatcagttacctatttagctgttctgcataggcctttgagataaggaaataagtaagataaattctccccagaaaccgcaaaacaattataatgttgagagaagaatgaagtagtaactctgtctgtactgaagaaggaattcggtgtacagaaaagaggtcactgcctgaggtcgggagtttaagatcagcctggccaacatggtgaaaccccatctctacaaaaatacagaaattagtcgggcatgatggtgggtgcctgtaatcccagctactcgggaggctgaggcaggagaattgctagaacctgggaggtggaagttgcagtgagccaagactgtgccattgcactctggcctgggcaactgagcgagactccgtctca

SEQ ID NO: 185557 - DNA, 271 bp, Homo sapiens
ccttcagttagtgcttttttctgactctgaagctggtgctataatccactctgtcatactgtctttcttcagtacttcttgaatccttctccttttcttccatctcaacaaaccttgattcaggctctcatgatctttcatcaaacttgttaggagagcttcctattagtctatttctatttcctgtatccgttctctctcacacacacattaacacatattttactatggtacttccatatttaacatcgtctaatggcaggcttggtgg

SEQ ID NO: 185558 - DNA, 450 bp, Homo sapiens
ctgcaacctccgcctcctgggttcaagtgattctcctgcctcagcctcctgagtagctggaactacaggcacgtgccactatgcctggctaattttagtaactttaggagagatggggtttcaccatcttggctaggctggtctcgaactcctgacctgaagtgatcctcccaccttggcctcccaaagttctgggattacaggcatgagccaccatgcccggcatacatgagatttcaaatcccacccagttggacatggttactttttggagatatgacggcaggtcctcttctctcatgagtcctgtgaggcccactcgctttcccatccagccatcccacagccatggtgtccacagggctaggaccactcactcgccaagaaggcaggtgtgtacccagtgtttctaaaagtaaggcctggtgcagtggttcatgtctgtaatcc

SEQ ID NO: 185559 - DNA, 709 bp, Homo sapiens
tttcagtatatatagcatgtcaattatttattctctttttaaagacatgttttcaatattctgctattataaaaataccgcagagaatttgttggagaatatatttttatcttcatttcagaaaatgccttttggttgtatttatagaactgaaattgcagggttgaggaagtgaaaacattttttaatgtcttcatgcatactgttgcagcatggtatcacactaaacctttgccaatgctgagtattcttgtttttaaaataattccaatttgatgaactagaaatcagaatgtcaatactatatttattagtcatctacagtccctctcttgtgaaatgtcatgtcctttgcttatctttgggatcttaaatggtttttcttcttatagtttaaatttttattgcaatatagcccaagctggacttgaactcctgggctcaagcaatccccctgcctcagcctcccgagcagctggtactgtgggtgtgcgccactgtgcctggccatttttcttcttctattttttattttattagttttttttttcttttttgagacagagtctcgctctgtcacccaggctggagttcagtagcatgatctcagctcactgcaaactctgcctcccgggttcaagtgattctcgtgcctcagcctccctagtagctggaattacaggcgcccaccaccatgcctggctaattt

SEQ ID NO: 185560 - DNA, 526 bp, Homo sapiens
gagtagctgggactacaggcatgcaccaccaggcctgattgatttttgaattttattagagatggggtttcactatgttggccaggcaggtctcaaactcctgacctcaggtgatccacccgccttggtctcccaaagtgctgggattacaggcgtgagccaccacacccggccacaactctcacttttaattgactgtgccccagaatcaagcactttggctagcaaatgatggctagttagatcacagaggtgtgtgttgcattctgtgtctgttcactgtgaaatcgggattttaagagtgtatgttgttgaacatacacctgtctttgagtgatcggtccccagaggccacctctaaggtgaagatttggggaggtaattgtgggaagccccaggaggagcagaggaaaatgagaaaggggacgaagggaatgtaatagaatgtgtgttgggagagggtttccttatgagccagtgcagaggaaagtcttgaaatgcactaaggaaatacagtctgtgccgt

SEQ ID NO: 185561 - DNA, 307 bp, Homo sapiens
tccctccctcctctccacccccctcagcctcctcttcctcctcccatccttccttcccttcccgccttcccccagcgccccatgaagctagttttagaatggctttttggagcagttatgttataaggattggcagctcatgagtttaatattcttatgggtcttccaaagtgcaaagagaacacaaagttacttttgcttttgtaatagagtaaaacgcatcctatcctgacctaagatgcacaaatcaacccatcttgtcaggcagataaacttctcataaacctgtaaaacatatgacttatgt

SEQ ID NO: 185562 - DNA, 215 bp, Homo sapiens
gtaaacaaacattgcatttggttgtgatgccgtacaactctgtaaggtgaagaatccctgtgtcctgagaaactccatctactctatgatgctcgtttatgtttctttttctacagtttgctccatgtaagatacaaatatcagcttctggccatcatagcaaatgaaaatagtcattagcaaatggcaataggctgatatttccacagtggttc

SEQ ID NO: 185563 - DNA, 463 bp, Homo sapiens
acggaacagcacacacacccacggaacggcacacactcccacggaacagcagactctaccacggaacagcacacacactcccacagacagcacacacacacccacggaacagcacactctcccacgcggggccgctgggtttcctgcagtttctcctcctccaggcctttccctggaccctggtccagtccgtcatttgagcacaggtgcctgttagaacgagaccttcttgttaggacgatgagtgtcccagccaccacctcttttggactccgggaggcctggaacgttctgaacgctccgtggggctccagtcttctccgcagccagggcagcagggtttgctgtctgtcctgcaggcagatgaggagtcagggctggggcctgtgtgggggctctcctgagcgcacagccgccgaggtggagcgtgttctgcctgagcgccgacctggtcgggggaatc

SEQ ID NO: 185564 - DNA, 403 bp, Homo sapiens
ggggggtgccctgggctgatgcctgttcaccagtgtgttgagggcagacctgggattggaacctgggtctctgtgagtctagagatcccaccttctgtaccctactgcccctagggccctcaaaagaggaatcatgcagtaggctcccaggagggccctggtcccataggatgatgggaacagcctggggctcaggtcctgtgcgtctccagagcccacaggcccctgcagagaatctagaggcaaatactgggacaaggacacctgagccataggcacaggcccagccagcagcctggtgagcccatctacactggctagccatgccccaaggacctgggaggcctggctaacccaaagtagagggacaggaggggcagctgccctcacctccagcctgcct

SEQ ID NO: 185565 - DNA, 1291 bp, Homo sapiens
ggattacaggcgtgagccactgcgcccagtcttaaaagaaaaatctgttttctaaatgagagacttgagtttagttctcatgaacataactttttcatactaggtttcagacctggtatcattaaatataattcattacaaagactttttctaatgtcttcaaattctttaagtcaccttcaacaagaaactgtacaagaagcaagctacaaccttacagcaagtggtaaatgtatatttattgctttccccctaccagacagaaactcctttcttgttactaaccagaataggaatcattcacaatcttcaacttgtgcttcaaggatctgatccttctttttactctggcaattctttctcttttaccatcaagtgtaatgtggacctttcttttgattgtgccaacagacttccaatctaactgcatctgttcatataaactatatcaaaataatgctaaagcttttcttcaatcttacagatattgcaatattcatcttaatacttccttaagattcatctaattgcagttgtaagtatcattagtgaatcatttttaacctcatttttccaaggttgaatttctgccttaaatccataaactgtcaagacacatatctttttgtattgtacatataatttgacgaagtttactgattcttcagtaaatctgcaaaatgagaatcattcaccaaaagtttttctcctataatcataaacttttatcaaaacttttcttttggacaggtaacatacttcagcatccaacagtaggtattttgattccatttctcacctaaaactgaaaacacatgcaactgaagcagcttagattttattacagcctccatttcattatattatttaatatggaattcaggtctacagacaaacatatatataatcttgacataaaatctttaaatgttcctatcgtgaagcctcatcatcagtcataaacttaactagcatttccataggaccttctttgtttcaaagtattaaaaaaaaatttagcaattaaatgtatttctttcaggtcctagtaagtgagttacatttttttaaaattattttttatcttatgagtctaatgactttccagtgttagtcactaaattgcccttatggtgggaaaaattaacatctgtacattaaggctaattataaagtagtaaaaatgaaaaatatatcaaattcattatgttcttttcaagaacctccttatatattttacgataattaaaacaattttaacttctctgttaatcgaaaaaaggtaagaaac

SEQ ID NO: 185566 - DNA, 1115 bp, Homo sapiens
agatgttgtggcacctttgcctaattatggcatttgtgcagattgttctcagtcatgtaggtttagtctcaaaacatccactcctcctccctgtgtagacagaggtaagctgtggctgtggatgagagcatctgaatgaattgtatccatttcagatgttagctttaaaagctatagggtcatgttagaagtttggttcccgccaaatgagtaattttagagatctgcacatcagatctttatgggtcttggaaaaatgctcctcctcagttcaattttctgccgggaatgtgtttctaaggccctttaggtattgggcatcttcaggtttatgtggcacatgggtcattagggccataggccccatttctgcatcaggagggctgagtccagatgttctggtttaatatttatgagtggcttccattgaaatacctgtccttccgagagaagtgcccctaccccctgcctctctattccgggtgagtgagctgaaaactgcctcctgcttttctcattcacatgggattctttcagaacagagttttagataggtcttgaattgtgtttttgccttttgccataatcttgtgtctttggtagcaacagtcagggaagtgattgctctacccccatcactgtgccaagccacaggcttgggcggggccccgggatgacagccttcggtggttcagccactgtggctgtctggacaggcatcctcttcttccattcctgttccatgtgccccctcgcgatgctgtctgctcacttgaaggagatcttctcagatggagggtgtagctggtggagaccctggggaaaccttccccccagatcacagggggtgtctggtactacttgctgtggttgggcctcctcactagtcctgctctctctcttcccatgcccagggcagcctgtcagaagccagaatggtagcaggcagagagaggcctcagtccagagggccatggaaagtggagtcatggagcacagtgcctgcagagctgctgtttttccctccctttgaaatcgagggctcatcctaaattgctcttcagtgccaacaagcaaagggacgcccacacaagttcttcagcattttgtacaga

SEQ ID NO: 185567 - DNA, 474 bp, Homo sapiens
ggttcaagcaattcctctgcctcagcctcctgagtagctgcgactacacacgcgcgacaccacgcccagctaatttttgtatttttagtagagatggggtttcaccgtattggtcaggctggtcttgaactcctgacgtcgtaatccacctgcctcggcctcccaaagtggtgggattacaggcatgagccactgcgcccggctggcaattattttttaatatagttaagcatgaagccagatttagcttgcagccaaatttcacacatgcttgcagtgcttcacgctatatttgcaattctgtatagatagtactatcagtaaagtgcttgttggtcatgtacctaaagtgaatttcttaactgcactccagcctgggtgacagagtgacacccggtctcaaaaaataaacccacaagaaggaacagcaaataacgagggcacctgatttaatcctaggaatcagaaaaagac

SEQ ID NO: 185568 - DNA, 147 bp, Homo sapiens
ggaaatgaaggctgcagcgagctatgatcatgccactgcactccagcctgggtgacagagtgacacccggtctcaaaaaataaacccacaagaaggaacagcaaataacgagggcacctgatttaatcctaggaatcagaaaaagac

SEQ ID NO: 185569 - DNA, 644 bp, Homo sapiens
tatataaaaggtatatatacactttttccttgaagttgaggccttccttttatgtggcagaagaggggaagacttttaggaaacatagtctttaggatttaatgtgctttttttcttcaaatctactacttcatgatgagagatctttttgttaaaagagtccaactgtatattacaaaataataacttctctgaggctggaaatttagaaatttttttttaaaaaagagtccaactgtgaaaaagtaaaactatttatgggctacacagttttttcattcaaaacagaaagattttattgagtctcatgggggtaaaaatatatactagcaacctagaaaccctgtgtgactgaacagaatatcaagaagaaattgttaccgcatttcagccactaaaatattaaacagctgggtacacttaagaaaggactacagggagataactttctaatctttcatcaggaaaggatattgcaggctccactgtgaagcaggaccatagttacccttcactgttctagccttttctctttacagattaatggtggaacccctacaataactacctcattctcttgctcatactcatctttctctaaacacatacaactgtgtatttgagaattccaagtgaaaactggc

SEQ ID NO: 185570 - DNA, 221 bp, Homo sapiens
tgcatatttcagatgcctcagtctccccgagctttaatctctgcctcctctgcaagattggtgtactctgcttgggttccctatccctgcactgaagtcaagaaagtaccgccaggtagaaagctgggaggttgtagagctcacctatttgtttcttttctctcaggggtcacaattgtgtgctgcctgttgttctctatatgaaaaacagtttttaaata

SEQ ID NO: 185571 - DNA, 399 bp, Homo sapiens
tgatttcttcgtttagaatatgaagacctttcattggtggatatggttttaacgaatcattttttagttatcctcacctctttgggcctttttgtaagtgaagatcttcgttatccatcacgccacagcttatcgttgattatgttacagttacctttgagagaaacagaaccctaagtgagtcaagctcttgtttttatagtcaggaaccatttcttgaatgggtaccctgcttacctcacatttttaaaggaataaaaatttttccaactgtgctaacatttcttgttgaccaagagcgtggtactggagtttacctcttctataacaaggtcaggaaaactgccattgcatctgtgagcatcactgagaaacaaaatgaccaactgggggatcctc

SEQ ID NO: 185572 - DNA, 230 bp, Homo sapiens
ataaaaagaaatgaggtcatgtcctttgcagggacatggatggaactggaagccattatcctcagcaaactaacacagaaacagaaaaccaaacactgcatgttctcagttataagtgggagctgaacaatgagaacacatggacacagggaggggaacaacacacaccggggcctgttgggggtagtcgggagtgagaacatcaagataaaaagctaatgcatgtgggg

SEQ ID NO: 185573 - DNA, 543 bp, Homo sapiens
tatccagaacatttaaagactcttacaacgcaaccacacatagagaaacaacccaattaatgaatgtgtgaagagcttgaataatttctgcaaagaaggtatacaagtggccaattagcacacgaaaagatgctcgacatcattagtccttagggtaatacaaataaaagctataatgagagattacttcaccactacaagggaagtgtctaattaaaacaaaacaaaaaacaaagtaacaagtggtggcaaggatgtggagaaactggaactctggtacaatgctggtgggaaatgtaaaatggtacagcttctgaggaaacttttagtggtttcttaaaaaccaaccatagaacagcatctgatctagcaattgggtaggtaaatatgcactgggtaggcatattcccaaaagtgagagcaaggacttggacacttgtatgccaatgttcaatgcagcatcacacacaacagtcaaaaggcggaaagaaaccacgtgtctatcaggagatgaacggatacacaaaacgtgataatatacac

SEQ ID NO: 185574 - DNA, 391 bp, Homo sapiens
aggaaggaaggaaggaagaaaaaagtggggcaaggcagcaagaagatgctgacttgttttcagcaatcatcagttatgattacttctcttcttttaccaaaaacttggacctccagcttcctgtaaacctttatcccagctcttactggtagacatgcagtgaagccagagggaataacaagtacccagcacttgaaaaacactttcagtcaagcatggtggcacatctgtagtccccgctacttgggaggctgaggtaggacgatcacttgagcccaggagttcgaggctgcgatgagctatgattgcacctgtgaatagccattgcccgccagcctaggcaatagagcaagaccccatctccattaaaaaacaaaacaaggctgggcgc

SEQ ID NO: 185575 - DNA, 338 bp, Homo sapiens
acacttttctcagaagcaaggttgggagaaagcactgtgcatgcatagctccagcctctgtggtcccccttctggagccagctgggctgcagcgagggcacattctggaccatttgctgccaggaggtgaacagcccgcctgctgagcctggcctggtgagtgtacaggctaacacagggttgaagggttagcagcccccttggccacaggcctggcctttgatctccatccatctacctcctacctctctctccctccactggttcccaacttgggcacccccaaaccccagcactcacacaatcttcctgctctttgccacctctgggatcctgtg

SEQ ID NO: 185576 - DNA, 616 bp, Homo sapiens
ctcagtgatattgacagccatgttattggtcatccacctttagaatctaaactctcagaaaattataatgtgaaaaggaagggaaaacaatgggggagacggcgccattgcactccattgtagggacagctgggtcagttctagtcatctggctgaggaggcagctttgatcagtttagcctggacactggcagcttgcagaaaggctgggcagcacagggtgcagtcaagttacaatgaacctctcgttaaaacaagccccagcctgtgaatgacctattgccaaatgccaggtagcctccttccctgctaaaaaagggatgggaagatgagagaggtttcctaggtacaccttacaggatgctactggggagaagagatttggggcactttgctttaagcagtggttctcaaacttgagtatgcattagaattatctggaagactggttccaattccagagtttctgatgcaggaggtctgggctaggcttgagcctctgcatttctaacaagttcctaagtgatgctgaagccactggtccagggaccgcattctggagccaccgccctagaggacttgtaggggtgtggatgttttctcattccaggtgtgg

SEQ ID NO: 185577 - DNA, 431 bp, Homo sapiens
atgatttttagaaggctctagttataaatgctcataatttctcaagatttcaagttcatctcatgtcatgaaattttaagtgtattgaaggaacgtgtaaaacatcttgggcattttattctccaacttcttgctaataatactttttaaacatcagttctcaagttaagtcattttctactatgctaaatttcagcaacccaaggttgaggaaactctccagtaatgaaacaaagggaagaaaagtatgaccttctaaaattctccacaggcattgagtcagcatattttaatcactgatccttccccaaacaggtattattctctcttaaaggaaagagaaggaaccaagataagggccctactcgaagtttttcagtaacagggtcaagacaggaaaagaaagctccctgtcaaggtctatcctttgt

SEQ ID NO: 185578 - DNA, 477 bp, Homo sapiens
agtgtatggcatttactcaggctgattaaggagctgctgcttaatgcagaatggggaaattgagcagacaacttcttccaaaactcagattcattctacaaagaatccacaagaaattcaatagaccagaaaaagtagaacaactgaataacaggtataagagcccacaaggtgaaaacagctggagttgatggaattcaacagtattgtgatgactataacccaggccctttcagtatcagtgtatcatcacaggtgtgcaagttcaggagcaatactcaatgtaaacttaaaaaaaaaaagaatttgtagatgacatggcagagatagggtgagggtgatagttcagaagagctaaaagttcctttgccaaggttggaacgggagttcaaagaaaaaacaaattttaaagattttaaaaattaatttatctttccctttactaagaaccctagccaaacatactgagaattagaa

SEQ ID NO: 185579 - DNA, 525 bp, Homo sapiens
agccaaaacattgcaatgcagtgttatgactgtaactgtcctatttcattcaggtaatgacttgttaacaattctcaagctgcataggtggataacttcactttgaaaccagtgctgggtgaccctgaactttgggcaggtcctttaaactccaagcctcagtttaatcacctaataagtgagaatcatgatctctatctcacagtatcatcatggggatgaaatgaaatgacatctgcaaagcctgagtgtgagactcagttcattccaactcagctttaatagtcatgtcagacactaaggcaaaggtcaagtaaagagaacatatattataccatagtgtggaccagatggattagttttggattagctcctaatgagataatcattgtgttgggggctgacagaactttgcacatagtaggttctggaaaacattactgattaattcatttaatagtcaatgcctatttagtgggtgtctatcatgtgccaagaactattctagatgaatgagccagacaa

SEQ ID NO: 185580 - DNA, 197 bp, Homo sapiens
atgcatgccctctttttgtttgaatacaatattcaattaagcattaaaaaaaaaacccactctgaaatcctcaatcacaaacctaaaagttaaaacaacaaaatcagcactaactgtaatggttttgaaagttaaatacatttcagcacaagtaatagacatttaaattatccaactgtaagtatcttgttacactt

SEQ ID NO: 185581 - DNA, 301 bp, Homo sapiens
ctatgatgtaatgttcataaccatcagggacttacctttgactacatcccacaggtcttcttgaaatgccagggggcacagtgggtactcacaaatgtggattaaatatttatctcagctgcaacttcataaatataaatctgctcgccagatttctttttacttttcaaatttaaaatacattcttatttaataagctcatggacttatcagtcactggtatgtaaagagaattcagacatcatttcttttctttatcaagtgaaaaatgagacaaaatagtcttctcttaaatgaaaat

SEQ ID NO: 185582 - DNA, 318 bp, Homo sapiens
gaaagattctgtcttgcccaagaatacagatcttggcagagctgaccataaggccaaaggaagccatggagatcgttgtgaagtgtgggaattgctgcaggtgacatctaaaaggagatttattgaggatcaaggcagaggtccccagaggacaaactgtgcctctgattccttcctgctgcttttcttcctggcagaaatagatgattgaattcatctttctcctggcaccttgtctcagagacttcccttgccacagttccagacccatccaggccatgactgccatgtagatgacacacctctctgctcacaaat

SEQ ID NO: 185583 - DNA, 706 bp, Homo sapiens
tctactctgggtgataggacaatctcttttggcttctgtgttttttctgtcctacaactcttctgttttataactgaaaaaaatgttttgcatgtgaattttagactggggtctttgggtaaaagcacctagagattactggcaggttaattctaaaaagggcaatttgttttttcactttatctcagagtttcatttgtttcccagtgattgactaattattttaacaaagtaaagcttcattgttgtgtgtatgcaattgaatcgaaaatatacttttcatacaaagacaacttcctaaaggtaagtgtaaacttgtatgtagtttgttaatcttattgtggtattttgtttttcttaaacacagtttcctgttcttttgcttttgcatgtcaacattgctgaaaataaatattttgctctgcagggatagtaagccagatggagtggtatttataatttgaggaaatagcttaaactttgtcatcagtttaaattgcattaaaaaacctgaagcacattgattagagttgtttaaggtagagaaccagaaatattctaaatatcctatgcctaacctgtcaaaactgttcctgaaatatatagagagggaaagagtacctgaggagctcaggaagagtgatggcctagagcgtagcttgaattgagcagcagaggtttctctggagtgtcctgtattatctta

SEQ ID NO: 185584 - DNA, 583 bp, Homo sapiens
acagcaggtgctcagtaatatttgttgaattatactcagttcatgttggacttcatgagttgttcatcttcatctcttaacttttattgcacatttaaaaatatttttcttttctggattttgagatatttccttaacatgatctcccagcactgctgaatatttgctttttctgtcacccaggctggaatgcagtggcacaatctctgctcactgcaacctccacctccagggttcaagcgattctcctgcgtcagccttctgagtagctgggattacaagcacgtgccaccacacccggcctgcagagtttttcttcctaggcaactgagaaggcagagttctttcatgcaggttcctatttccatgatcatctcgtgaagagggaagagactgttgagacagaaaaggatagcacttactcaccaactcctgctgctatactttttcagtcatgtttatgtcaaaaggatttttcttaatttttctgtttacaaaactaacgttctcactgtaaaaatccaagtatcttggaatgccatttagaatgttaaggtaaaaataacattggcaaagaaaaaag

SEQ ID NO: 185585 - DNA, 280 bp, Homo sapiens
cactcagtctccggagtaaggcgactacaggtgtgcaccccacacccggctaatttttgaaaaaatttttttgtgcagacagggtcttgctatgttgcccaggatggtctcaaattcctgatcttaagttatcctcttgccttggcctcccaaagtgctggtattacaggtgtaagctattgtgctcagcagtttgccacatttttatatgttctgggtacccagttacactgttataaagacatacctgagactgggtaatttataaagaaaataggtt

SEQ ID NO: 185586 - DNA, 263 bp, Homo sapiens
cctcagtcttactcctgagttgctaggactataggactatgctaccatgcccagctaatttttctattttttgtagagatggggtctcactatgttgcctaggctgatcatgaactcctggcctcaagtgatcctcctgccttggcctcccaaagtgctaggattactggcataagccaccctgcccagcccccatcttgatttttaagtctggtaatttatgtagttagaattaaaatcctgaaccagtaatatcaaagaag

SEQ ID NO: 185587 - DNA, 501 bp, Homo sapiens
tcacctgaattactgcagtgacctcctgattagcaccccttcttccagtactctctgcctccagtccagccgccacagggtacatggatttgtttaacacatgaagctgaagaaattcactcattcattcagtcttcactgagcaactactttgtgccagacactattctaggccctgaggatacagctgtcagcaaaacagacattgtgcccattctagtgatgaaatcaaatttaagatcccattatggctttccatggctttaactaaaatcctaacatcttcggtagcatacaagaccgttcctgagcctggccccagtgacctcactgacctcaccgaaactcttttgtataaaggccctactctatccctcatctctctccagtgcctgcacactccctaaacactaaatattaaggaacctgctttctaaggagctcaataagcaactaccttgccaaatcctgggatcctgtgaggtaaacaggaggcagaaa

SEQ ID NO: 185588 - DNA, 608 bp, Homo sapiens
aatgcagtgtaactactggatgactcacggttatcatttttgaatgcttccatagtcactttcttgtcatttggacatatttcaaacaacttcccatattcgccctccttcttggccatcttgaatatgcagtgggctgagaaccaagctaagtgtccaccaatagagaatggattaagtcaagtatggcaacattacataggtagcaaataaaaatgcaaaatatacttcactagtcatcggaaaaatattaattaaagcaacaagatatttttgtccatcagcatagcaaatactaaaaagtgtaatgttatttaaggttgtcgaggatacagcaaataagcactctcctgcactaatggtgggggtatcaattggtacaaactttttggagggcaatttgttagatgcatcaaaatttaagatatatataacatttgacccatcaattccacttctaaaaaatctatgccaaggggtctgttccacatggacacaaggatgtatgtgcaaaaacacaagtgttagttggtgaagcagagaaattagagcctttgtgcattgccagtgggaatgtaaaatggtacaaccactacaaaaaacagtat

SEQ ID NO: 185589 - DNA, 221 bp, Homo sapiens
cttgactttctgtctctatatgtatgggctctgcctatatctggggtccattccctttgtagttactcaggtaccagtctctgggcacaagtccctccataaaggtcaccacctcccaaagagcttctccagttccctccccacgtccacagccttagatgcttacctctgtggaaacaattctctccttccaatctccagggaataaactcttcggaagc

SEQ ID NO: 185590 - DNA, 591 bp, Homo sapiens
aaggcgatctcttccaccggctgtggcacatcatgaatgaaatcctggacctgaggcggcaggtgctggtgggccacctcacccacgaccggatgaaggacgtgaagcgccacattactgcccggcttgactggggcaatgaacaactgggactggacctggtgcctaggaaagagtacgcaatggtggatccggaagacatcagcattactgagctctaccgattgatggaacatcgacatcggaagaaagacaccccggtgcaggccagcagtcaccacctctttgtccagatgaagagcctcatgtgttccaacctgggagaggagctggaggtcatcttctcactctttgacagtaaagagaaccggccaatcagtgagagatttttcttgaggctgaatagaaacgggcttcccaaagcccctgataaaccggaacgacattgctccctctttgtggatttgggcagcagtgagctaagaaaggacatttatatcaccgtgcacattatccgaatcggtcgaatgggagcaggagaaaaaaagaatgcctgtagtgtccagtaccgacgaccctttggctgtgcag

SEQ ID NO: 185591 - DNA, 253 bp, Homo sapiens
ttcctcacgaaactcccaggcgctgtataggaaacataaatccgttgtcaggcagcagtagcacgctgttgctctcggagcttggctgctcgttcgtgctcgcaaccactaaggtctacgcaaacctccacggtttccttccgccttcgcgtcacctttctaagaaattcccagagggcagcgcagacggggcgggctctgagactccgggctccgcctctttccgggaaccgcccactacccaggactccga

SEQ ID NO: 185592 - DNA, 178 bp, Homo sapiens
tgaaacctaatagacacatccagaacccccacccaacagcaaaacccagtgaaacctaatagacacatccagaacgcccacccaacagcaaaacccagtgaaacctaatagacacatccagaacccccacccaacagcaaaacccactgaaacctaatagacacatccagaaccccca

SEQ ID NO: 185593 - DNA, 334 bp, Homo sapiens
cttttcttaacctaactagttattagaatcccgcttgtcataagcctactgaggaagaggtgagtaggctgttcattgatgttattgtaggttggaatatggattttctttttgttgccctgcagctacctgattttagcttttagctctcatattaaactgttagacttacggttctacatggatcatgtttatacttagtgaatgggagcctgttgaccccactcttcgtttacacctgtatgaaaaacatgtcaaaagaatacacgatgctgtaaggacaaggtcacctttcgcctggtttatcaaggctttctcccatggcctaagtgtg

SEQ ID NO: 185594 - DNA, 148 bp, Homo sapiens
ggaatacaatgtagactgctgtttatcacatcacagcaattaatcgtgtccctgaagtagttctttttttcctattacagtcacctatagatacaaccatttaatctcaagatgctaaaaatacctttgccagagtaccggcggcgtg

SEQ ID NO: 185595 - DNA, 368 bp, Homo sapiens
atgctgaatggcaatctgtctgtgatgccacgagcagcttccttcctctctttggttttattttcactagattgttgttaggagtttttcttgtaattcagtcccttagtgttcaaagtgtggttctgggaccagcagcattggcatcgcctgagcgtttgttagaaatacataatctcaggccccatacggccctactaaatcagaatctgcattttaacaatacccccaggtgtttacgctcacattatagtttgagaagcactgatggaatcccaaaaaactttttaaatcaaagttgcatgaactaagacctgtgatgcctcttcccctttcctatcccaatttccctaccaggggcctcccac

SEQ ID NO: 185596 - DNA, 343 bp, Homo sapiens
cgcggacagactcggaccgtccccagctctgttgctttccctgccagtgcctgcacaagtccacgtgagaccctgccctctgcctcaagttagtaagtggggagggtctcagaggggagagcaaggagagctggggtagcggggacgaggttgcatctgatggtgtcagagcggggatcgattcctgaaggatggagctggctgcaatcttctagacttatcccaaagatctctgcccaaatgtgttaagtttttacccgtttgcgtgtctccaggaaaactaacgctgcttcattgggatgcccacgccagtggggctggcacggggtgcactgaggtcatt

SEQ ID NO: 185597 - DNA, 548 bp, Homo sapiens
tccccaagagtttattgtccacaaatcagctagactgaaccctataaactctccaaaagattcccatcccactcagaataaaatcctacttccttatgatatacaaatcctacataaccagtcatcagcaatccccatcactactcccacacaattcttttactttctttttcctcttatatattatcccctaccattctccttcagccttcttctccagccagtctagcctcttctgccattctggaaggatatacacctctactgtaaatacagtctccagacttttgcccttgatggtcctcttcctgaaatgtttttatctcaaaagccaaaagtttgactctttcagtaattctctgctcaaacgttaccccatcagaggctttccccagccacccaatctaaaacagcacatctgctgggcgtggtgacgcaggcctgtaatcccagcactgtgggaagccaagctaggtagatcacctaagggcaggagttggagatgagcctggccaatatggcgaaaccctatctctactaacaataca

SEQ ID NO: 185598 - DNA, 564 bp, Homo sapiens
taagggctttagttttccacttacaggtgccactctccctgggacccaggcgcaggcaagcgggagttctggttcccacccagctctgctctcctgctcatgttctgcttccagggcctcctcaagcccagtgaggctgggccttttgtgggtcaccccggcagatgccaagaccttcccagacacaacacagatttgaaacaggatttcagccccctgaagcacgcccatcaacttccagtgacattggtcagatttctgcaaaacgaatgacgtttatgggaatgcccacgttttcctgcagatcccgactggtagttctccaggtgtccaggatggccaggatctggaagcagctctgtggtctgaaaggcagaggttgactttagcgtgtttaaatgtgagatttgcagaatggactcagggcgtggggatgatgctcactgtgtgccaggtgctggtctatgctcttcgttctcccagaaaaacagagagcttaaggtcagtgtctctattttacaaatagggacacccaagctcttggacattaagtcatttgctgaa

SEQ ID NO: 185599 - DNA, 174 bp, Homo sapiens
aaatccaaagaagcatactattaagagtcatggcagtagtataaagtgctaaaagagatcaggatagagccgtgttttaggccttgttttatacctgtgttacaggttgctcctctcccagcaccttggatatattagacctgcaataaatggttgttcgagcagggaatgaat

SEQ ID NO: 185600 - DNA, 351 bp, Homo sapiens
agctgcgcacatttgccttattacagttctttatgataaattaaatgcatgcttcatacatcctttggtgtagtcatattctctcagcacttgactaagcaggtggaaagcttatttagtcataggatgactgaaaacaatgaactataaacccatgtatatccactccaagaaaagagctaataaatgtcatgttttttattttcccgtggaccccctttttttttttttttttgtattttataacctttccagaatcttgagtgatttttaaatgtttgccctttggtcataaatgcagcaagtaaatgtgagtctgcacactcgaatgttgtataaatcagttgacca

SEQ ID NO: 185601 - DNA, 358 bp, Homo sapiens
cttgtcagatgctgcaaagagtgatgaggggctgagtaaaggctattagatggagttatcagtggattccataccagtgacttttgagaggttagttccaaaggagtggtaagggtaaaagctaaattgttaggagttaaaaattatgtcaaggaagagaacaatacactttcaaaaaacttgcagaaaagaaacttgagagacaagcaaagtaaaagaaagctttgttttgttgttgtttataggatagggatgccttaggcagagaggaaaagagtataggcccacaataaaataggataattaaaaattacagaggaggcagtagaagatgagattaagggcacaattggaggtg

SEQ ID NO: 185602 - DNA, 207 bp, Homo sapiens
tttcttctggccctgacccaccttccgactttctccttgacactaacttccttgtcaaagcctcgcgtccattaagcatgtctggtatttgatctctgtaccttccatcccataactagagtgcccttgtcacagatcttcatcttttgcaattctgtcttctaaagtcagaaaaacatggtagtatagatagcgtcagtatagata

SEQ ID NO: 185603 - DNA, 622 bp, Homo sapiens
gctcaggtggtgtgtttttgcaaggcctcatcttcatcctgggtggggaatgacattggctgggaggagcaaaaggccctgaagtgcctgtcgaatcaacagtgaaaatgccatgaggtgcttgtgggtgggtgggtgagttgtttgtccctaaatctgcagtagccccctggcacataaacataacgttgaagagaaagagtgtgcttactctgccaaggcttcttcaagggaaatttcctgtcccccaccccttcatgcctccccatcagatttgctccaaaccagctctgtgaataagtcaccctaactagcttcccaaccgttgcctacccagatgccactccaggctcaggccttaggataaagcagggacagggctgatggcagagagggatgggcaggctccatgtgcagttcatgcggaggaaggaagagcagtggtgagttccacagactaggaagggaaggaagggtgggtctagtgtttacatgcttccctgagttgtggaggaagttagtgcacaaggtctttaatgcaggcatgagggtggttagggcctcaacggatggtggccttgggattagaaagcaagagatacgtgtacgagatttaggaggg

SEQ ID NO: 185604 - DNA, 124 bp, Homo sapiens
cagtcctcggggcctgttcaaaccactctggaagcccagccccttcaagcctgggagacttaacagagtgtatattccagctccaaatggctgagcacccctgctctacctagaagcctcagga

SEQ ID NO: 185605 - DNA, 240 bp, Homo sapiens
gggcgtgggctgccgcctgctgtggagctgccgctgcccctcgtaccctacacaggctcctcctaaagccagacccgcagccttcccagcatgaaggcaagcacggggtagctgctgttctcttcccggacggtcctcagtcctcggtccagctttctcagtccacatttttattaaggattattggccagacgcagtggctcatgcctgtaatcccagcactttgggaggccgaggcag

SEQ ID NO: 185606 - DNA, 273 bp, Homo sapiens
aaattcctgggatcattaggggagttaggctctatataacaacaatcattcaggagggactcaggatactggttagcttaacaagattaaaactgacttcctagtatacacataaaccaagctagtttctcaaattagcaacagaaaccagatgaaactcctcaaatgagtgttgcaaaataaggagctggtactatagttttatttggggagaaattgttaagtttgggttaactgctcagcctatgcctgatactacccttccatctatgg

SEQ ID NO: 185607 - DNA, 270 bp, Homo sapiens
aagtcacagagctggtaaatgccagagccaagatggaaacccactcgatttatttccagagcctgtgctcccttccttgaggtttccctagggtctttggggaggttttttttgtttgtttttttggcagagtcttgctctgtcgccaggctggagtgcagtggcatgatctcagctcactgcaacctctgcctcctgggttcaagcgattctcctgcctcagcctcccaagtagctgggattatgggcatgtgccatcacacctggcta

SEQ ID NO: 185608 - DNA, 404 bp, Homo sapiens
cccaccgctcccggcctgtgctttatatttttgagcacaaaaatcttgcatttattttgttatattctatctctttttaatgtttatacaattgctactattttgtgaacttatttctaattattcgttactaccactagaagtacaatgtaattttgtgtgttgaccttgtcttctgcaattttgcttaattcatttagtagttttaatagtagaaatttattagataaattcagtagattaatcctttgggattttctatatagacagtcttgtcatttgtggaaaaaaacagttttgtttccccttttaaaatccatcttctggcttttattccttcttgcatcactgtactgacagtgtaatacaatacagtacattgttgaataggagtggtgagagca

SEQ ID NO: 185609 - DNA, 146 bp, Homo sapiens
atacaggtgggtgcacacacatacctacatatgcatacattacatacatagagtattgtcttactaggagattccaggcagaggaagtagactatgcgaatggcatgggaaagcatatttggaatacagattagcccagcagggtg

SEQ ID NO: 185610 - DNA, 523 bp, Homo sapiens
ctccacatggcacacaccgaacaccgaggctgtgaaaggctggcccgtgagtgtctccaggttcaatatcgatttgtcaattgtagagaaaaccagcagttctagttcccagagaccaccctgtgaattgaaataagaaggaacggggagaaattggagctatttttaagctcagcttctgaggcttattttaggaggcattattgatcatacttcggggaaaccgttctgcgtcgctggtgccagtgtctacatgtgcacatgtgaagtgttggcctagactcctgagaccatctgtgtgcccaagggaggctgcagcccagaggagaattcggactgaggctactttgcaccaaaattaggccaaactcatgaaagggccattgttgcagctgccctgggaactgtaacttagaagtgattttgtgcccttacagcctctttagtaaatgaattgagtcatagcatttgtgatccttccgcatgtactttggtacttttctgtacttttctgtcctctttt

SEQ ID NO: 185611 - DNA, 356 bp, Homo sapiens
aagtgctgagattataggcgtgacccaaggtgcccagccttcctggatgttcttgatgcctgcaggtgttcatcgacgtctgggcaatcaagagttaggtatttattctatcttcacagtttggacttgtttttatctgtccttcttgagaaggctttccaggtattcaaaggaaattgagtgttgtaatctaagtctttggtcactgcagccgtatctgcactacagggagccccaagcccagtaagactgtgaccccttgcaggctcctggaggtctcaccttggtgtgcttgggtaagatggagaggaatttcctagattattaggcgatctctcattctcttccttcacttt

SEQ ID NO: 185612 - DNA, 287 bp, Homo sapiens
caaaatgagcatttccaacaaagaaactttgtgtgtttaaagaaagcaattctattttaaagcagcatgattgagccccacaaaacaaagtgtcagctacaagacaacaatcttttggtaaggtattggggcttacgatatctgttttgtgccctcttccttctggttcagagttgatctgctatgataaatattttatttggggagttttttggtactggacaataaacagggccacagctgattgccagagacaattttctaaattagaggacaatgacagctga

SEQ ID NO: 185613 - DNA, 238 bp, Homo sapiens
gaccctgcatgcggagtatacacacatgccccaatacctaggggccagtctacaaaatatattttaaagacaggagttacagtgtgacttctggattattctcagtcttgttaaatagaaattgtctaaaatgcccctagtggtttcaggcattgctggatccagataactaaacaatgtgatgagggtgcgctcttgctcttatctctgagctatgctttcctctgtgctggcttcc

SEQ ID NO: 185614 - DNA, 239 bp, Homo sapiens
aggactctggttccaatcccacggcctttagtgttagctttgcctaggactaaacctccgtgagcctccatttcctcaatctgtagatggaaccactagctagaatatagaaaccatgagggcaagagtctctcttgtttgctgctgtatccatagtgtttaaaacagggtttggcaaatggtagatgctcagtagatgtttgtggaatgaatgaataaatgaatgaaagaatctgaga

SEQ ID NO: 185615 - DNA, 434 bp, Homo sapiens
gttggtgtttattattctcgtctgcttttagttttactatatacgtatgcatctgtaaacgatgccagatagatcgttttgcagcctcctttttcacttaaggttgttggtgagatctgccaagatgttgagtcgtctctgtttctcagcctcggcactgctgacatgtttctgctgggtaattcctcgttgtgggggccgtcctgtgcgtcgcaaaatgttcagcagcatccctggcctctacccactagatgctcaccaccctcacctccaagtgtgacaactaaaaaggtctccagacattgcctattgttcctgggacagaggcaaaatcaggggtctggggtggtggtgggggaatcattctagttcatttgtcttcactgccatttaatatttcattgcatgaatacatactgcagtttatttcctat

SEQ ID NO: 185616 - DNA, 313 bp, Homo sapiens
gaattattggccattgctctagcttttgcttgctggatttgaactgtagtcattttgctgtcacctgcctgggacccgagatagaccacacacctgtggaggcagagctgagagatggagaactgaattctgattttcctttttggaacctgaatccagtagtggttgaagttctattcctgaccttttgacttcctcagcacttttccctcccctctttagcttaagccaattggaattggtgcttctgtcatctgtcacttggaatagaaacaacccaagtgatacacaccaagtatctgtagtccaagtt

SEQ ID NO: 185617 - DNA, 286 bp, Homo sapiens
tcaaccaggcatggtggcatgtgcctgtaatcccagctactcgggaacatggtgaaaaaaaaaaatcaagttagtcattaaattctgacagtaataaatgtaatttgcagaaaataaatttttaaaactgtcccactgttttgcaaacaggtagtttacaaaaataaaaaatatccagtgtcagtatcatatatgaattcaagaaatactgtatcagtagggcatggtggctcacgtctgtaatcccagcactctgggaggttagggtgggaagatcacatgagac

SEQ ID NO: 185618 - DNA, 168 bp, Homo sapiens
agacctccctccggccacccctggtcacacacacctcccaccctgctgggcgggggacaagcactatggacaaaactgcctacggcacaagtccatgaaaccggatcacccaggacttggcacggaggtggggaggggaacagcacatacttctctaccatggtgcca

SEQ ID NO: 185619 - DNA, 351 bp, Homo sapiens
aaaaaacccaaacaaaaacactaatcaaactatacacttataaagggtgaatgttatgtgaaaattatatctcaataaacctgacttaagaaaataataaaacaaacctaaaaaaccaactaagtaaaaataaatctaagaaaaaaataacttacagtttttccaattcaacagtcatcctgagaatgttcttaattgttgtaagtgggacttgtgttgttcccatgtatctgaagaagaaagccgaaacattcatgatatgaagcccaataccaaaattctgtccttaaaaagatatttcaaggacatgtgactacttcaattttggcttctctataaaacaagccagtt

SEQ ID NO: 185620 - DNA, 336 bp, Homo sapiens
tctaaccggactagacactgggccttctgactcttcctccatcaccctctccccaggagatgggagactcttcagagtccctgtggattgataagggacccagacttagaagcagtttgatcaagcagattctgtggatataatgcagcagtttctaaagtcccagggcagggagagtttgatactgtgagcatccatgggagagggaaaggcaggattctgaaccacagctcggtgttgggggcagttctatgggctctgagggcttcagagaaaaaagaaactaagaggcaaataggacaggttgggtgggctttctaattgagacaagaggag

SEQ ID NO: 185621 - DNA, 306 bp, Homo sapiens
cggactactgcttctttgagtctctcctccagaatttctttgccttacgtgcaaaacccacgatgatactgtccaacttaaaacctttcactgtcttcacctgacctccaggatgaagcccccaagcctttgttaggataacaaagacctcattgtcttacccctgcctttcttcagagtccggagcaccaccctattcatactccagcaattttttctctatccttcttgcagattagatgatcattagcatatcaatgcctattattctgtccttctaattttgcttctcctgctctctatata

SEQ ID NO: 185622 - DNA, 510 bp, Homo sapiens
gagtgggaggaataacagtaaaaggttgggaattagatttagtccagtctcttccacaatgattctccacacaacatctctaataattatgtgcatagcttctgctcaaatactttctgtaagagaaaaatactgtgtagagaaaaacaaagcagtgtacttaattcaggtcaactaactataagtcagtggtttctttaacctattttgagtcacagaattttttttttctgagacagggtctcactctgtcacccaggctgaagtgtggaagtgcatatacaactcactctggctttgacctcgacctccaagactcaggtaatcctctcacttcagcctcccggacagatgcagatgggactataggcacacgccaccatgcctggctaattatttgtattttttggagagatggggtttcaccactttgcccaggctggtctcaaactcctaggctcaatggtcctcttgcctcggccacccaaaatgctgggcctcgccactgtc

SEQ ID NO: 185623 - DNA, 208 bp, Homo sapiens
ctattccttgctggctgttggccagtggcctccctccattttctgccatatgagcctctccacaatacagctcacagcacagcagctggtttccatcggagcgagcaagcaaccaaggcttatttggaaaggtgtaactttccagatgtttttctgctgtattccacaccttagaagcaagtctgtaggtccagatcatgcttgcagg

SEQ ID NO: 185624 - DNA, 322 bp, Homo sapiens
aaaattcaagtggttggaaataacttgaattttagcaccattcgtgatagagtagttacaaaaatagacactttttgagtagtaataaattcacttagtatttgtaaagacctggagaatataattctgttacctacctttatgtgtgatagttatctacctttatgtgtgatacttaggattagttgtttaaagaaccctttctgtagtactataaggcatattaagtaatagttatatgttacctagtattttgtagtgtttctttgatctgttactttgggtttgctaaaagatgttaagcctccaaataaaaaatttt

SEQ ID NO: 185625 - DNA, 348 bp, Homo sapiens
catctacaaaatctttgggacaattcctcttgggagtcaagctttagatgcctgctgtccagccatgagagaacatcagagggtcacagcataccccaaggttccgttaacagagcaaaacatcatcccttgcaacccaaaggcaggaacacagctgggccccaggaagacagggattgtactagaatcccttgcagtcctgagagtgctgtcttctggctgcttggcttagctcctctctgcaacccagcttcctctcgccttgctgactctcctgtagggagtaaaagaggctgcctccagcctctactcatacagctttgtttctgtgtgtttcccagcctctgc

SEQ ID NO: 185626 - DNA, 213 bp, Homo sapiens
gcttactatctctagagggcaaaacaagtaaatttttatactggttagatattgaaataaaaatatgttaggtatattgtgttaaaataaattattcacattggtttcatctgtttctttttgccccccttttttttctttttttcttatggagtctcgctctgtagcccagtctggagtgcagtggcatgatctcggctcactgcaacctcc

SEQ ID NO: 185627 - DNA, 184 bp, Homo sapiens
ctcctgacctccttgtaattatccaagaatctattaggcttaagtcacctcatcctctgggggttggaaaaacagcaagcaagcaagattggggtttgtttttcatttactaaggtgaagacaggaaaccctcttggagctcttccactccctactataactgaaggaagctagtgctgtcagt

SEQ ID NO: 185628 - DNA, 737 bp, Homo sapiens
gacaaagttttcagtcgcaaatcacaccttgaaacacataagataatttatactggagggaaaccatacaaatgtaaggtttgtgacaaagctttcacatgtaattcatacctagcaaaacatactataattcacactggagagaaaccttacaagtgtaatgaatgtggcaaggtttttaatcgactgtcaacccttgcacgccatcgtaggcttcatactggagagaaaccttatgaatgtgaagaatgtgaaaaagttttcagtcgcaaatcacatcttgaaagacataagaggattcatactggagagaaaccatacaaatgtaaggtttgtgacaaggcttttgcatataattcatacctggcaaaacatagtataattcacactggagagaagccttacaagtgtaatgaatgtggcaaggtttttaatcaacaatcaactcttgcacgccatcatagacttcatactgcagagcaaccatacaaatgtgaagaatgtgacaaagttttcaggtgcaaatcacaccttgaaagacataggaggattcatactggagagaaaccatacaaatgtaaggtttgtgacaaggctttccggagtgattcatgccttacagaacatcagagagttcatactggagagaaaccatacatgtgtaatgaatgtggcaaggtttttagtacaaaagcaaaccttgcatgtcatcataaacttcatactgcagagaaacc

SEQ ID NO: 185629 - DNA, 227 bp, Homo sapiens
tcctgctgtgtgttcctttgcccagaatacttgggagacttgggacctactccctcactcccctaagtgtctgctcaaactacgttctcagggaaggcttcacattttaacctccaacccccaccaacacctgacagctcgctttccatttttttctttgcaccaatcactattcattttgtttgtccaattgcatcacacgtgagcaagggcttttgtcttcctgc

SEQ ID NO: 185630 - DNA, 404 bp, Homo sapiens
tgccaaggcatttatcccttatttaactgctacatggacgtgttttgcctctccaactggattataaaatctgagtctgtgtcttattcttcattttcttcccagtaccagatgtggaaccaagaaagacttaactagtggtgtcccaggtttgacctaagccagagactgaaagccctggagcttcagtttactcatctatcagtgatcaagatggttattgatcaaggttgatcagatgaatcttgaggacattcaagatttctctatttctatgtttttgagaaccaggagacatgtccatagatctgaagctcaagaaaacaagcctcagagaatgcttcacctatcagtattccatcatatgtgggtttatggctcttttttgttactacactgccttg

SEQ ID NO: 185631 - DNA, 214 bp, Homo sapiens
ccaaaatgtattctccaagtagccttttcagtgtagcccacttgtagcatcacaggagctgtctgacaaacaaatacccatgaccagtatcagaagaagtcagaactcttctgggattatgtatttaagactttgcaaatcctctttttgaaatacatcttccgccaagaaatctttatggatgcagtggctgcatgtcgatcttctagcagca

SEQ ID NO: 185632 - DNA, 330 bp, Homo sapiens
catttaaaaaaaattgtgccaagatgacattgggtaactactaagtaaataaaaatcatcaaaaaagtggaatgcctttggtaacgtaactgcagtaaaactgatatgcagtaccctgaggaatgtatggtaatcatgatccttttggaaacttttatataacttttattggaaactgcaatataaaatagcatttgtggagcacttgctacatgtcaagcacagttctaagagcttgtcttatattgtcatttaatcttcatgatacctcatgaaggaggattcagttatcactcatatttcacaggaaattgagtcatacagggatta

SEQ ID NO: 185633 - DNA, 288 bp, Homo sapiens
agcaattccttctagctgtgcagacctcagcactgctgagcccatgcattcccaaatggccaaaaaggctgtgccatccatctccctgtatctatgccacagtgttatatgacacatgtaaatattgcacatccagccaacagccggcagaaaagttaacagcatccagatccttgtccataatgagaacacttttacttttttcttttttaaaagaaattggcatggtgtagtcattttcttataaggcaccccctgtgcaaatctggaagagaattcaactttgga

SEQ ID NO: 185634 - DNA, 702 bp, Homo sapiens
acaaatgcaaaagtagatgaaggtgccttggatagggaagtgtgctggtagttaaatatgactaggatgcatggtggaattacgtttggtagtgagatacgagattttaaaggtagaggggccaaatcatgaaacgcctagtatgttaacaccaaacctttagaaggagaaagggacatatcaggtactagtacctgaatgtatcattctgaaacccatctgaagaatggattggaggaggagaataagacagagaccggtaaagaaactattgacagcattcccagttaaaaatactgacggcctgaactaaggtcagtatcaataagagtaaaaaaatgaagatggggtgtagagatacttaggaggtagaattgatatttcataaatggttagaagttgggggcacgggtaaaggatagagattttaaggtggtatcaagcactcatgctcttggtggaaacataaattagtacaaacgttttagaggactataaatgttcatttccattggctaagaaacttcacttctagggactactccacacaagtttataaaggtacatgtacaaatgttctttgcagcattgcttgtaattgcaaaaacatggagtattctaaatatccaacaataggaaattgtttaaaaaatggcacatctaggccgggcacggtggctcacgcctgtaatcccagcactt

SEQ ID NO: 185635 - DNA, 226 bp, Homo sapiens
tgaagttataattcaccaatggctaaagaacttttactgggatgttggcctctgcagcagaagaaataaaaacattaggacttcaaagtgcaaaatttataaaatgaggtagggcactttccttgcctagatgggggccactgatactgtacaggggccctgatgtttgcagagcagggatatggtctacctactggtgccctgcctatcactagcagcataaggc

SEQ ID NO: 185636 - DNA, 251 bp, Homo sapiens
gtcacgtacactgccattctaatagtcactaatttatctaagtctgaatgtaaaatttctaaaacatttaatagacatttaatgagaaaaaaatatgatatgttaaatatatttgcagtatgcagctggggacacagctaaaccatatcactcagtaatttaacagacaaataaatagtatgcttgaacattgaaaacaattctttataaggtcactttgccactgccattctaatagtcactaatttatc

SEQ ID NO: 185637 - DNA, 165 bp, Homo sapiens
ttcggttttagagtgttaggtctacatatactgtttccagattgttctttgccctggtcacggtgctctgcctagggtcccatttggacacacctctattaatgcagcaaccagaatgaaacacgttgttcacaggcttttctaaccatccgaagagcagcaggc

SEQ ID NO: 185638 - DNA, 336 bp, Homo sapiens
agaaccggaaaataaaagcatatgaatgaatagaggcttgaagtgaactacagggtgcacattagtaagaaataaaaaagagggtcatttaagaaaaagaaaaagttttatgtgccagaaactgcaagcaaacaatggaattttgtaagggaaagttgacagaaacagtttttctttagtaagctgaacgattctaagcattagtgaaggaaactcgtagtcagtgcacgactgaaagagacagagatggggatgatggagctgcatttaaaaatgaataaagatttaataagccaaagaatcacagaggtcctcaggaggcctgatgataaagaa

SEQ ID NO: 185639 - DNA, 180 bp, Homo sapiens
tgtgttagaaaaacacttggatactggactataaacgagcaaataacatcaacagacaactagtaagattatgaaaattattcagtgcactatcaaagtaatgagaattagaacatataccatttattgcctgctaaattgaaacaattttttaaaataataaaagtactcgatgttggt

SEQ ID NO: 185640 - DNA, 463 bp, Homo sapiens
aagaaaaatataatcactgaattaaaaaattcatttgagacagtgaacacagcatggataattcagataacaattagtcaatgaaaagaaaaacttgagaaatgtttctggcaagtggcttgatatctatcatattagattggagttgaaccgaatgctttatataccataagaaaaatgcatattaccaaaattaatttacaacatgaaaaggaggaggaggaacgttgcaacatacatatgtcaggaaagacatattaatattcttctcatataaaaagttcttacaagtcaataagaaaaaggcaaaaggacatagtcatatataaatataaacaaatggcaatatgcaaatgaaaatgttcaacataatttctaatacaatatgtgtataatctttgtatcatatctttgaaatttatagcactggatgttaatgttaataaactgaaaagtttcatac

SEQ ID NO: 185641 - DNA, 200 bp, Homo sapiens
tgccaaacagacccgacccagccccaggcagggcgttctcagggccagcagaagccgccgtggcctgttcactctgcagctaccctcttgccgcaggctaaccctctgtcaggcagagagctcccggacagcctgctacccatgcatcactgcacccagggcacctcttctcaaaacaaggacagcgttaactgggacag

SEQ ID NO: 185642 - DNA, 173 bp, Homo sapiens
aattgttgctagaattattatttcagtattcccctggacgaaggaacgctgtgacagaagaaaacagagaagtagccaggtccctaaacattcccaatgtatacatacacttccctgggtgcatgccaatgaaagcagcacaagaactttgaaattcaacccccacatgcagg

SEQ ID NO: 185643 - DNA, 559 bp, Homo sapiens
tctctctgttttcctattcttgagtgggttttatgtgaaagaagatggacttccttcaggcctacaataaagtgacactgacttaagaaaaacaaaatatcatttatttttatacacaagaagatataaaatttctacgaatgagcagatttgggtttgaacattaaactccatcattcacatgctgcattgttcagtagcatgtgtttaattttatcataaattatcaagtactttaaaaaacatgtaaaatcctgttttctgacttttgtaattcagataacattctggaatgggacacacacacacacagacacacacttatatctccctaaaaccactgcattagttaggatcttcagggaacagtcacccagataacctaaagtaatataagtttattgtaagatcatatgtctcaaaccgaggtagccatatctcaagggattacatggcattagccaaaaattatgagaagtaactgaaacaaaaaatatgccatgtctctctaaattatccattttaaatgaatacaacatttttaataaaaaataatacc

SEQ ID NO: 185644 - DNA, 404 bp, Homo sapiens
agtagtgacagccggaatgtcgccatgacagtcagaaaaggttgagatgaccaactagcatccctccctgggcaggcagatgaaaaagaaaaaactcagtaaaaacaaaggttggatcatgtgtttcttaactctttaccagttccaaaaagagctagggtgcctcccttgctaataacaagaggaagagcagtaaaaacagtcatgaaacacttccatgagaggggcatccgccctggacactccacaggcatccttttaccttcccactcaccagcgccagcctcaggagggggcatcatggtcccggtgctagagatgaggactttgaggctcagatgaatggaacagccatttgcaatgaaattattgtttggtactgctgggtgctgtattcgtttgtt

SEQ ID NO: 185645 - DNA, 303 bp, Homo sapiens
gaaaaaactttttaaagtatgtgatttatatgtctcactgaaacattctttgctttgttaattatctatctcatcgaattttgttttataccattatggattgtatcaatccctttcatctgggaaagtgttgaacaccattttgagaggaaggcaagtacatcggttcccagtggcactaaaccaggaattgtttttaattacggcttctgcctaaaaatattcttccctaatattttaaaatctggaactaaataatggtttagttcccaggagtcaaatagcctacatataacactctct

SEQ ID NO: 185646 - DNA, 481 bp, Homo sapiens
cggtgatgtgcgatcttgagtgcgatcttgatatgttttcttatcagggttatcttggcctcaaagaaagtttggaagtgtttcttcctttctgctgtttcattcaatcaataaaagaaagcttcaggtattttcaaattagaaagtgcacaaatatttaggactactgttgataatttgacgcttttatcattttgaaatatcctttttgctggcaatactccttgttttaaagtctactttgttcattaatacgcagttttctttctttctttttttttttttgagatgagggtctcaactctgttgcccaggctagaagtgagactgttcaaaaaaagatttaatgtaattattgaattactgatttagttgattcaagtccatcagcttgcaattttctatttgtaccaagtattaactgttcttcattttcctgccttttatgggcatcagttttgattgattccttggctttcgg

SEQ ID NO: 185647 - DNA, 500 bp, Homo sapiens
cggataatttttgtaattttagtagagatagggtttcaccatgttgcccagggtggtctcaaactcctgagctcaagtgatctgcccaccttggcctcgcaaagtgctgggattacaggcatgagtgactgtgcctggcttgtcattgctctataatgtacttttcattctaatacatttcacgtttatccttgcagcatttttgctttgagatgttatggcccactttttgtgggttaaaaatctggaccacacaggtcagttaaaggtgctgagatcagagtaagtccttatcacagtggatctggggctaactatggtttcctaagcttttgtcccttatagctttgcctgtgtagtagatgctcagcaaacacctgttaaacggattagaataaattatatactactgggttttcaccaagtccttaggtcatttttagactaaactttggcacctgcaattgaaacgatatggaaatcttgcaggaaagtgttga

SEQ ID NO: 185648 - DNA, 639 bp, Homo sapiens
gtcttcacctcacagtaaagaattaggtctgtctttattttcctcccactagcctcttgacaaaggacagtgtcttaatcaacttaagcagtatccagcaaatattgggaattacaaaatatttttgctgaattgaactgaatattcattcgcttctaaaatattgtgactgcttagagtctgcaagacagtttgacatgagaaattaatctaacatctttttaagcacactctgaatataaagaatgtattagagattatatagttacaccgttagcaaatcaaagtgtattagaatgaatttgtgccatgaattcatgtttcccctacccattttgaatagtgtattctaattttctccactgaagctgcattttgaaaatatattcacaaatataacttctgtataaaacaaaagtaaataggaaacagtgaaagcagcatagttattcaaactggaaaggtactgaataactctggttatactttttaatgaattaaatccaaagttaagaacttcttaccacaaaataatttaaaatttgacgatttacgtgtgtgtgtgtgtgtgtgtgtgcctatgcaattttgtcatgtttagctatgtataaccaccactggaactggtcactaccacat

SEQ ID NO: 185649 - DNA, 543 bp, Homo sapiens
agaataaaggccatctgggacagaggcagcgtaccttcttgattgctctcaaggcacaggtgaagacttactggggctagtgaaacagtaaaggaaaaaagcctctacccctggaagaggagcaagacacattcccgggccaaaaccattagaggtatcctactgttggtgggagggtctaaaattctcttgtacaaaacctgccaaagatagaaggcaaagttaactgtcatgggaaggaggagcaggagaaagagaggccacacagggtctgcttaagactgagcctggaccaggacaacagaaaaattaccgtacttccccaccaccagatcagcaagtaccaagtaacaaataatagaaatctactactgagagacaggcaagagcataaagagagatcccttctactgtgcgcacatgcaggaaggccaaaacatgggggcagaacaggaacatttcagggggtggggggactctccaagacccctgaataagtacagaataacaccaatggaatttgaaattagtaatgttagtaat

SEQ ID NO: 185650 - DNA, 254 bp, Homo sapiens
aactgtaggtcaggttgacatagaaaaggattattttaagtgacttttatgaaacccagtattttgactgcaaatattggatatttggacaaaaaccagaaaagaaattttaaaatgaattcagtattgctactaataatactggtattgttactttaacagcattaacaaacttattctatctgtctaaaacgcatacaatgcaatgcaaataattgctaatgtaatcaggaactaagattgttcagcataag

SEQ ID NO: 185651 - DNA, 469 bp, Homo sapiens
gagaaatttcttcaaataaccagggataagccagggcatttagaaaagagattttactttaaaccctcaattcttttgaaacaagggcaaggcaggcttggggcagggtagaaagaggagacccagttaatgtaattccagaagcaagttgcatttgccaagcagcttacacgtgggcttatgactgggttcctaggctgattatgataaaatgccagggtgatgtgctgggaagtgtgtgattcagcaaatagttgaccacaaaaggccacgcaaagacctttcagctaatgttctcaaagacacacccatcagacacactgactgactctctaatgtgtgtgtgtgtgtgtgtgagataagagttgagtgaaaccagaatggaagtgactattcctaatagcaaaccaaagaagttttgcttcatcttagatttagagtcaaacttctttggtttgctattaggaat

SEQ ID NO: 185652 - DNA, 261 bp, Homo sapiens
agcctggccctattacgcgtgaagaatggctgacttatgtgactgtgagagcacaaaaggccacgcaaagacctttcagctaatgttctcaaagacacacccatcagacacactgactgactctctaatgtgtgtgtgtgtgtgtgtgagataagagttgagtgaaaccagaatggaagtgactattcctaatagcaaaccaaagaagttttgcttcatcttagatttagagtcaaacttctttggtttgctattaggaat

SEQ ID NO: 185653 - DNA, 506 bp, Homo sapiens
ttccttccttctgggagtgtttgaatgaagattagactctccttgaccatgaatgaagagcaaccagttttttagtatacagtgatttagactctgggtctagagtgtagatatcacgggcactgtgaaagcacagaaggagaaaaggtttttattttggtggggctttgtgactgaattctggccaatggaaccacatggaggcctggcccagaacatctccctgtggattctctcatctggcaactggatgcctacacgaagggtgattttggagtcatgtgttggagatcacaaagcttttgtcagccaggttcctgaatgactgctagacaccatgggctgaactttacgagctccagcaccacctccagccttcagtgactgtctggagcaggcatccggatggaagagaagggggacaaccatgaacttggtgacccacggtcagcctgatttcccttgtggacacatttatgcccagtgtgcattcctcctgaggtctg

SEQ ID NO: 185654 - DNA, 584 bp, Homo sapiens
ttccttccttctgggagtgtttgaatgaagattagactctccttgaccatgaatgaagagcaaccagttttttagtatacagtgatttagactctgggtctagagtgtagatatcacgggcactgtgaaagcacagaaggagaaaaggtttttatgtgagtatatgggagaggaaatagtttattgtcataagctttttggctatggcctccattacatctctagcttttggaaggcactaaattgaggccattcaaatccatgtccacctatcctttgcccgtcacgagactgatggcttaggaagcatgtggtctaggtactagagagggagcctgacccacctacctcaccgctgctgctgaatttgtgcacaactctctgacctggttccatgtcacaaagggtttcattctctctgattccctgaatccccagctctagccgcagatcctggaaccctagcatatgcctgaagctgaatattttacttgccagagtaagagtttttacatagactctgtcatcttctactggccctcctcttaaactgaggcagcggctgctagctactcaccaaacct

SEQ ID NO: 185655 - DNA, 492 bp, Homo sapiens
ctaatgatgaggaaacattggagaaatccaaaccttggaacacgctacaaaacaactaactcgtactctgagaaacatatcagtggactggattccaaacagtggctcatgcctgtaattttaacactttgggaggccaagtttggtggggctttgtgactgaattctggccaatggaaccacatggaggcctggcccagaacatctccctgtggattctctcatctggcaactggatgcctacacgaagggtgattttggagtcatgtgttggagatcacaaagcttttgtcagccaggttcctgaatgactgctagacaccatgggctgaactttacgagctccagcaccacctccagccttcagtgactgtctggagcaggcatccggatggaagagaagggggacaaccatgaacttggtgacccacggtcagcctgatttcccttgtggacacatttatgcccagtgtgcattcctcctgaggtctg

SEQ ID NO: 185656 - DNA, 781 bp, Homo sapiens
aaattaaaggggattaaagaaacgtgacagctaaatgtgacatatgattctgaattggatcctgaaccacagaaaggatattagtgggcaactggcaaaatctgaataaagtttatagtttataaaaaaaaaacagacaaaaaacatgtagttagaccatattttctttcttttttttttttttttgagatggagtctcgctctgtcacccagggtggagtgcagtggcgccatctcggctcactgcaacctccgcttcccgggttcaagtgattctcctgcctcagcctcacaagtagctgggactacaggcgagcaccaccatgccctgttaatttttgtatttttaaaaatttttagtagagatggggtttcaccatattggccaggctggggttagaccatattttctaaccagctttctttgcagtttggtggggctttgtgactgaattctggccaatggaaccacatggaggcctggcccagaacatctccctgtggattctctcatctggcaactggatgcctacacgaagggtgattttggagtcatgtgttggagatcacaaagcttttgtcagccaggttcctgaatgactgctagacaccatgggctgaactttacgagctccagcaccacctccagccttcagtgactgtctggagcaggcatccggatggaagagaagggggacaaccatgaacttggtgacccacggtcagcctgatttcccttgtggacacatttatgcccagtgtgcattcctcctgaggtctg

SEQ ID NO: 185657 - DNA, 296 bp, Homo sapiens
ggaatggaatgagataacatctgaaagctgcaaaaactgacatgtagtaggcagcctataaactttagctttgctttgtctcattttaacttaagaaaaactaaaggtggaaagatttaaaaagttacaattgtcttaaccaagaatgtgacctaccttatattatcattccatagtaagaatccacaaaactttaggaatgaaatattcgttgtaggagggatctgtttagatcagtaattttcagtgcccttggactttccaaagtcacataagagagcacggacctagatttt

SEQ ID NO: 185658 - DNA, 333 bp, Homo sapiens
atagagaaaggcaatgtgaggagaactgaaggcccagacacatgagtgaaactggctgacagcatgtggaagcagagacgacccaccctcgctatgcccttggactcatggctcacagaagtgtaagcaatagaatgttgttgttagccattaagcttcggggtgccttattacatagcaatggattgctgacaattaaaaattggcaccttgaagcaggatggcgccataacaaacacctaaaacatgtggcattgactttaggaccagctggcaggtggaggctgggaggctgataaaaaggttggtggagacttgctagtgcagaggggg

SEQ ID NO: 185659 - DNA, 247 bp, Homo sapiens
gtggttttgcttcatgaaggggagcggattacttttccttgtgtaatggaaaattcggccttggcttttgagattgatttgaattttgatgtgtgttatagaatgcgttcatgtttctatgctgcaccagatgcctgtcttttccaaatgtggcaaaccctcagctgcatggggaaatcgaggtgagggtcctgttcttcacgcccatttcaaatgagttccttgccaggcgctgcttgagctaccc

SEQ ID NO: 185660 - DNA, 327 bp, Homo sapiens
gaataatgaaacagaaagcagagttctgtattagtattcttccatattctggtgaatatacatctatctctgtcaaaaggatatgatagtacccagctggctgggaactagaggatagctaaggagttccccgagccctcttcatcttagacaacatttcaaagtttatgttttccaaactatcctgtattagataattaataaacgcaactagatcaattatgttagaaaagttttgttttcggcttaattgttctgtttgaatctacgttttattttctggaaaaaaagttaaattagatatttagatctacaaatatggatttc

SEQ ID NO: 185661 - DNA, 547 bp, Homo sapiens
ccattctgcgaggaaaatggggatggggtgaaagttccaaccctaccttccggccacagagagagaatatcccctctcttaaacacacacagccacatccaactcacaaccacttccctccagcctctctgactcttcgatccctccctgccttcctcctcaatctatcatggcctaagcactccacttgaccctttaaattgaatttctcaggtagacaacgagtctgctttgcagatgagaggactggatagtatccaattcgacaggattccttatccagagaggataaggaacttgtccaaggtctcagtatttgtttatttaacaaactctagcaatagagcaggagcccatcacaaaacctagatgtgcttacgtttcaggcacgttctaagcacttgacaaatacaaattcatttaacccttataacagatcaatgtagatgctatttctagtttcccatttacagatcactgaggcgacttggcacagaaacagatctggctctgtcccacactcagctatttgtgccttacagcccct

SEQ ID NO: 185662 - DNA, 528 bp, Homo sapiens
tcctgggacaaccatgtttggttccaggaaaccacagatttccaggctaaggcaatcgatccttattttccaagattttgtagtactggagatttattactaattctgttttactgcattcttttggcataaaatctctgtgatcttgcccctctctgtctccagtctcatctcttgccacacagtctctcttacctgcctggtccttaatgtcttagttggactgggtggcttataaacaacagaaatttatttctcactgttctggaggcagcaaagtccaagataaggcaccagcagatttggtgtctggtggggacatgcttcttcacggatggtgccttttgctgtgtccttacatggtggaaggagcaagctaaccctcctttgtaagggcactaatcctgttcctgagggctctacccttctgtcctaatcacttcctaaaggccccacctcctaataccatcaccttggggtttactattttaatatatgaatatgagagtgggcacaaacattcagtcc

SEQ ID NO: 185663 - DNA, 546 bp, Homo sapiens
tagaggatccccgtgacgcttgcatgttcggtttccagtggatcccagcagtatttccatggtgctaaggcaatcgatccttattttccaagattttgtagtactggagatttattactaattctgttttactgcattcttttggcataaaatctctgtgatcttgcccctctctgtctccagtctcatctcttgccacacagtctctcttacctgcctggtccttaatgtcttagttggactgggtggcttataaacaacagaaatttatttctcactgttctggaggcagcaaagtccaagataaggcaccagcagatttggtgtctggtggggacatgcttcttcacggatggtgccttttgctgtgtccttacatggtggaaggagcaagctaaccctcctttgtaagggcactaatcctgttcctgagggctctacccttctgtcctaatcacttcctaaaggccccacctcctaataccatcaccttggggtttactattttaatatatgaatatgagagtgggcacaaacattcagtcc

SEQ ID NO: 185664 - DNA, 310 bp, Homo sapiens
gctgcttttacgaggaaggcacaaaaattcttaaaacaggatttgagcaaaatatcaattctgttcagcttgaatgaaatctaccatatcaccctatgaggaggcatggagcagaagtggtgaatcctccaaggcactgatgagaatcacagcttcatgcacagccagctccccagccctcagcctcccctcctcctgctcccatctcctcttgtctgggagtacctcccacacaaggtcttctccacgctgaaatccaatgccctcaggggcttctgggctgcatgcccatctggactcagagctgaat

SEQ ID NO: 185665 - DNA, 178 bp, Homo sapiens
aagccatcagacaatgttaaatttacaatgtgctgcttgtttgtattaataataagtagattttaaaccttgtctgttgaatggaacactgcacttcaaacagttgcaaaagaaaacaggcaaaatgttttctttgtatgtaataagagtaggtttgggtaataaaagaagtatttgg

SEQ ID NO: 185666 - DNA, 173 bp, Homo sapiens
agccctcactgttgtgagccagccaacaacacactcaagccccagccactgagtgtgtcacagggctgggcgcagtcccattctgagacagaaagatgagaagaaacatttgctgagggatccttgcaaagcagctgattggttctcaaggagcaatttaacaagactgtgtt

SEQ ID NO: 185667 - DNA, 270 bp, Homo sapiens
atcttcaagatttctccctcagtcttctgactgaggaacctcggctgattattctctgactaatttacagtcgaatcttggaatttcctggacatttcctttgcctctctttaatgttagaacccgtaattcctttaatggctaacttcctcattttgttggagccgatcctccagtatctatatttttttctctttggagatggggtctcagttacccaagctggagcgtagtggcacaatcatagctcactgcagccgccatctccgg

SEQ ID NO: 185668 - DNA, 467 bp, Homo sapiens
ggttgttcccactttgttgccattatgaataatgctgctataagcattcatgtacaagtgtttctgtgaacatattttcattttgcatgaatatatacataggtctgggactgctcagtgctgtggtgtgaatgtattcccccaaaagttcatgttagaaacttggtcctcaacacagcagtgttgagatgtgggaccttggggaagtgagtaagtcatgagaattctgccctcatgaatagattaacccactcatagattagtggattaatgggttagttttcatgagagtggatctgttataaaaacctgtttggccctctcaccatgtgatgccctgtcccacctcagcactctatggagagtcctcactgtctaaaagagcctcaccagatgtgatccctcaatcttggacttcccagcctccagaattataagaaataaatttcttttctttgtaaattacc

SEQ ID NO: 185669 - DNA, 243 bp, Homo sapiens
aactgttaagaataaatgtttgttctttataagccaacaagtttgtgatatttttgttatagcaccccaaatgaactgaaagaatgcaatcttccaacactgtttgacatagctataagatttgttggtagatgtccttcataaggttgaaaaagttttcttctacttctagtgtgttcctcatgagagttcttgtcataaatggatgctgcataatgtcaaattctgttttctgtatcaact

SEQ ID NO: 185670 - DNA, 614 bp, Homo sapiens
cttgcgattccgcctgccattagcttgctaaccaaaggaatgtttaaactattcacttttgattctgaccaaaaaaatattatggaaaatgactggttttcagtgtgttaaatctgaaccttggaatggctaattattatattgtttccacaatttgggcaactgtgctgaggtggatatattttcacatattttttttgtgtactccaaaaacattataatggtattttagctaaagaaagaaatcaatctggacatttaccaaaaatatcccatttttaccagaaaccccctaaactctctgactttttgtcatgattacctatgtaaattccaagaagaaaggattccaaactaaacgattttatttactataggacttttcagatatgtattgtatatctccaagaagatgaagaacacagcattatttgcacattgtgcaggattagtgttttatagatcgtattttggcaaattcagctctagttatagtttaggagcatcaaaaaatgtgttggtctgctctgaaattttctttataacgtgtgctatggagcatgcaatgggagcacaggtctggaaatgacagtgatatcacttatttgtcaaag

SEQ ID NO: 185671 - DNA, 123 bp, Homo sapiens
ggaagaggaaaggaaggaagaaatgatgaaaggaaggaaggaaagaaaggagagggacagaaagaaaaaaagaaaagaagaaggaagcaaaaaaggcctcaaccaaagattctgagtcaccgt

SEQ ID NO: 185672 - DNA, 380 bp, Homo sapiens
ttttttgcaagcataaagtcacagcatgcacatttatcaaacttttctcttgcccatgtcttcccaacaagcaagcaacttcccagctgagttggctgctgaaacgccaaattaacatgcagtaaaggccagacattgtggctcacttgtactttctgaggatcgccaagtgatgtcaatgcacaaccaagtttgagaaccactactttaacttaccaatacccttattctagcttaaataaggtgttctgccaaacttccacggagagaaaaaaaacaaggaagggaagtcaggttcctgagcaaaccctcaaccaagacaggtcttgagactagtgagatgtgttatttaaaagcaccatcagtcacacgttagtgtc

SEQ ID NO: 185673 - DNA, 440 bp, Homo sapiens
taccagcggacgcatcagtaaacatcaaaaccagcatgactgaggttgtcctttcatggtggtgatacttcttgaaacaatatcttgttgaaaacaaactaatacattcaaaataatatgagtttcttttcagccgggaattgtgtagcattcatgcaacgccctccaccagtagcgatgggccacgtgcccacaggacaccatatggatagctcacggtgtcctctgagcttctacattacctcattttagcctcaccacaaccctaaggaggtaggcacagtaatttttcccattttgcagaggaggaaactgaggctttcagacttataaaacttgcttaacagcctgtgtgggacctcaattctaattccagaaccaagctcctaactgctaccctatgtgcctcctaagcacacagtgaatgcgtccgtcgaagt

SEQ ID NO: 185674 - DNA, 374 bp, Homo sapiens
gaggctgcactcaggccccctctggtgcttctcctgctcagcccttagcagctcaccgactgggccgcagggtccatctaaaggcttgaatgcgcctccagttgactcctcagccctccagctctccatgattctgcccacccacagttccactccacgatacctgcctttcttacacggtcacccatatgctgcttctcttcattcacccgttaagtctctgtgcacccctggtagcaagcgtaatgagacaggagggactcgacgccctcagaggctgccgtgtgtgaggaggggcgggtgcgtagacgaagagatcattgacggtgggggatggattctgtattaaaggtttgcacggggcgccttgggat

SEQ ID NO: 185675 - DNA, 228 bp, Homo sapiens
tggattataggtgtgagccaccacacctggctgccttattctttttaagtggccagaaaaaaaataaattaaggatgtgtagagatcaagcctgtgagaaaatagaaattaactccacttgtttagatttagatcattttattgtagatattcttgtcactgagtgcccaaggaatggatattggaaagctatagctgtccttaacttcagtgtcaaagagtaggaat

SEQ ID NO: 185676 - DNA, 103 bp, Homo sapiens
tgattcattgtgagaagaggaaaaataagctcaggatgggattatgtagttaagggaggtgagaaaacagagactctttgagttccttctgaaagcaaaagat

SEQ ID NO: 185677 - DNA, 443 bp, Homo sapiens
ggagtttgacaaccactggtacaggcgatgatgaactacagaatatctggagggtaaacagggatggggaaggggggtggttaggcagagatgttgctggagggatgcatagaaggcatatgcagaaaaactttgtatattatgagaaaagttttggatcttatctggagaataatgaagagccattacattattatattatgaatacgaaacacacaaaataactatttaaaaatatatgtgatcataaagatactcctttatatcattccagatatttaaaaactcattcctgtgcagaaaagttttggattttatctggagaataatgatgaaccattacattattatattattaacacaaaacacacaaaataactatttaaaaatatatgcaatcataaagatatttctttatatcattccagagatctaaaaactca

SEQ ID NO: 185678 - DNA, 434 bp, Homo sapiens
ctgaatgcctgggctggcaatcaggcatgttggagtttgagtcccagtctgccactccagctctgtgaccaagaggaagtgaagtcatgtaccctttctaagtctctagcccctcttctgaaagacgaagatgccaccaccaaccatgttagtggttgtgaatgccaagaaagtccatgtgaagcacatagcatagtgtctgccatgcgttaagtgttccaaaaatggaagctatgactatttcacagagtacacttcccatcacttttcagttcattttggccttctccctcaaaagcactccagtgttctgatccagctgataaaacaccaaacattcacatagtgctttaaaagtgacccactgtttttacagactgcattacatatgaccctaacaaccactgcaatatagaaattcgcatctccattct

SEQ ID NO: 185679 - DNA, 285 bp, Homo sapiens
cagcaatgcttcacagtgccgtaggaagagcactggactatgtatgtctgtctatctgtgtcttcctgaacaggttatcatttcacttttctgagcttcaggtttcttgttcgtcccaaacatttcttaagtatctgtcagatgtctgatactatgcttgggtgtaaagttacaaaaatggctcctaaagagcttacagtttagtgacagacaattctaaaattatgtggtaagtgcttgggtatagggaattatgtggtactttgagaaaagaggagttgtagg

SEQ ID NO: 185680 - DNA, 791 bp, Homo sapiens
accgcgcccggcaaggtatagtcttaacatttacctcaacacctatgtctctattttaacttaattgcataatactgaaaaaaatcttgatgcacacaaagtaagtggctacagtggtaacggtttgctttgcaatctcagggaaattttcacttaaacagaaacagcatgagaaactttgttctaacatctatataaagacaaactaatgtgctgacctgaaccgtgttaatatttaaatcagacaacagttaaaatgggccccttttactgtctctaattatccctcaaaaaagttgattaaaaattaatacctatgtgcatactgccctaccatttaaaaaataagaaaagtcggtggtttatgcctgtaatcccagcactttgggaggccgaggcgggcagatcacgaggtcaggagatcgagaccatcctggccaacacggtgaaaccctgtctctactaaaaataaaaaaattagccaggtgtggtggcgcacacctgtaatcccagctcctcaggaggctgaggcaggagaattgcttgaaccaggaggcagaggttgcagtgagccgagatagcgtgactgcactccagcctgggcgagagagtgagactccatctcaaaaaaaaagaaaattcttcttcaaaacagtgaaaatagaaaacacactagcagggtgtttataccattgaatatcctgcagcactgttgtgggcactacaccagagataggacacaatgtggtgatggggtgagcaaattgagatgagggtatcggaatggacac

SEQ ID NO: 185681 - DNA, 257 bp, Homo sapiens
acttcccaatcgccacgacaaggagcagcggagtagagatgcaatcttgtgtgcctgtgtctctagtgttcagactcttcttgcacaatggacataggctggtttcctgcagctgactaacatggaggagctccagctgtgtcagccatgacagagttgttattgcttcactgagtaagcacccagcgcgcaagctgaggcgggctgtttcatagacgggctcggatcatttaccctggcttccctcccacttggct

SEQ ID NO: 185682 - DNA, 438 bp, Homo sapiens
gtggctctgaccaaatctagctcagggggtgacatctgttgtctcatcgacagcactggagctcccacggagaagtaggtctaacaaagtcctaccttgctcgcatttcacaggcagacatcccttgctcaggggtaaaatctctcagtgttgacattgaagaaggcaagagggctgggttggggttcatctcagctcagagtctagaagtgactcagagatgctgctggtctgagagttttaatatgagccttgggatacaatacagggatgcagatgggaattgtattctctatgtcagtaacgaaccatcagtaattgaaaagtcaatacattgagaatagcataaagcatgaaatactttaggataagtatgacaaaaattgttgttttacacactagaagtcctaaaacattgtttagacgcaggtcttaaag

SEQ ID NO: 185683 - DNA, 473 bp, Homo sapiens
actcccctctctcattgcgtatgccgagatggaaaaattggaccacctaaactggatatcagaaaggaggagaagcaaatcatgattgacatatttcacccttcagtttttgtaaatggagacgagcaggaagtcgattatgatcccgaaactacctgttacattagggtgtacaatgcgcatgagagatggctcgtggtgttaagaagcagaagaagcctctggtgggaaaaaaggcagcagctaccaagaaaccagcccccgaagagccacccgaagcgggcgccttgggatacaatacagggatgcagatgggaattgtattctctatgtcagtaacgaaccatcagtaattgaaaagtcaatacattgagaatagcataaagcatgaaatactttaggataagtatgacaaaaattgttgttttacacactagaagtcctaaaacattgtttagacgcaggtcttaaag

SEQ ID NO: 185684 - DNA, 350 bp, Homo sapiens
aacctagccccaagtcccctgagtgtaattagcttccacaatttaatttaatgcagagaacagttactgagcatttataagcttctgtcctggtaatacacaaagagcctacatgagcagatacatttcttcttttttttttttttttttttgagacggagtcttgctctgttgcccagatgggagcgctttccattccccgttccctttccagcctccagaaactccacgaggctcctggacttgattctgcttctcttgggaggtgctgagtgggtgtctctccctgagctgcactgacacctgttgaaggctctgacggcctcagtccacgaaggcccatggcaggg

SEQ ID NO: 185685 - DNA, 287 bp, Homo sapiens
ggtgcacacctgtagtccaagctactcaggagaccgaggcaggaggattgcttgagtccatgagtttcaggttacactgagtccagtgagctataattgcaccactatactccagcctgggttacagaaaaagaccctgtctcaaaagaaaaaaagaaaaagcacaaagaagtgaagtgacttctccaaggtcccagttaatacaaatcaggagcgcttagctcctgttagagagcctaacagttagaaaacagtgttagaattcacaaagagctgccaaagtaaaa

SEQ ID NO: 185686 - DNA, 213 bp, Homo sapiens
cagaatattaattatctgcaactaattaggtgttaagattgagaagcattaagtgatgaggtggaaggctgcatgagtcatttagctagactgatgagagtgggtggagggagctggatgcaggctcagctctgttcctccgtgggccccctcgtgggtcgaggtcccgtgtggctaagtctccttgtcttttgcatgctcggcgccgcccag

SEQ ID NO: 185687 - DNA, 472 bp, Homo sapiens
tggcaagtggccatctctgcaaagagctagatttcctccctctgtcagcttcaggtaatggaaggattatttccctgttcccacaatgcacgtggccccggggttattgcaccaaggagacctttaaggacaatccatacacctctgcctttcggcctcagagcaggatgcaggctgtgtgttcggatagaaacgactgtcccccaaagagagggctgaggtaagaaaagaaagtttcccccattttccaaaatatcccgggagtctgttgggagtgctggacacagcaggccagcaaagcatcacctgatcttgcctcggtgcccatcattccctcctccagctccttggtccacacacctttctcttccatctccagaggcctgctctaggtgcacaccggcccctctgcaaatccccggctggccgaacggtgccctggcagacaaatggctctcaatagtttatgctg

SEQ ID NO: 185688 - DNA, 208 bp, Homo sapiens
ctatcagaattctagaactctcccagagaaaccaggcagatactgctccacaccggtgagctgcttctcacctgggtagtctagggtggtttgctccagaattgtatttctgctttttctttttttaacttggcagtggttaaccattccctggagcagcaccaggtaagtcagcttgtatcagagtcatctgctttacctgacatga

SEQ ID NO: 185689 - DNA, 375 bp, Homo sapiens
acctggggattcttatccctctgtctttgcttcttatgtaatacgtctgtggactattttggaaacatctagatgaacttgtgatcgatcttcccattctatgtatttctcctggttccctgcttttctatcatctcctttgggagggaatatttttcctcattaactagtttccaggtcaaaatttctccatgaagtatgaacttttctctatcccagtatttaatttccaccacttttttttttaaaaaataacataaggctgaaactttttaattgggcaggttacttaattgctatgtggctctattttctcatctgtgaaaagcaggtttactgagaagactggcctatcacggggattcatgtgaggct

SEQ ID NO: 185690 - DNA, 211 bp, Homo sapiens
cagttgtctcctgttcgtctacttcccctgggatcctgaagattctggatggcaggaacgagctcttatttgactattttcacccctggccatgtgctcagcacatcagcacgtgctcgatggatgtgcaggtgcacatttgctttctgttgttggaaaatctcgaacctcatttctaaaatatcagttttcccgagaaaaaccttaatga

SEQ ID NO: 185691 - DNA, 614 bp, Homo sapiens
ggttttgccatcttgcccaaactggttttgaactcctgggctcaaacgatctgcccacctcagcttcccaaagtgctgggattacaggtatgaaccactgcatgcagcccattactaactattaacaggagtgttggagaggtatgaatagaatcctttacaaattcttataaagatgggaaatgaagtgagtacagactaagaagggaaaaagcaaaaagatattgcggatactggtttgcaaagtaagataacaaatatttattgaatacttaaaagccaggtgttgtggtaggaacacacacacacacccctttcttcatcctcacaacaaccaaaaagagtaaatattatagtcctcattttatagaagaaattgaagctcagaattgttcatatagctgacagtgaacagagtcaagactcaaacacagaatttctgattctaaaatatagtttaacatatttgaaatataatttttgatcagcagttatatacagttggactataaatgaatgtttttatgcaaaggtaatgcatattaggcactatttcacagttcccctgggtttgagttatttgaagatggccagaagggattttcacttccaac

SEQ ID NO: 185692 - DNA, 272 bp, Homo sapiens
ggaagttgcagtaagccaagatagcaccactgtactctaacctgggcgacagagtgagactctgtcttaaaaaataataaataagaaagatgcactactctcactataactagagttgaggagacaggctcagggacatccaagtgttcagggcaaggtcaggtagctaatcaatggtggagctagactttgaattagggtcattggctctaagttccaggcttttctcattttgacacttttttctgtctataggacaaatgctggagaca

SEQ ID NO: 185693 - DNA, 506 bp, Homo sapiens
attattcattttcccacaacccacttttatctgtttaacatctttcttcagaacacatcacagtcttcacactgtagggataccttccctgagtccctgggttatccagccttgcctccaaattcaattccttctaccacaaactctcacaggacctgtaccactctgtcatagcaattctccaattatcttttatcaatttgtgcaatgcagtcttctccacacatataaactccatgaagacaggaatcacgtttctttttactcatcacattactcacagtgcctagcaaaatttctaggaagagaagagctaaaatacctgcttaatcaataaagaatgcaaaaccagacaatttatatttcataaatatttattcaattatattaatggtcaataagcattgaactcacctagttattctagggaatgaattactattatctaaacctgatttccattccaacaatttgagaataattttttcctttgttttatggattag

SEQ ID NO: 185694 - DNA, 320 bp, Homo sapiens
tcttcctagccccatgtccttccttaattcatatacatgctagaacaacggggaaaaaaatgctctttttcgtctgagtctgttttgtgaagacaataaaaagcattaacagcagtaaacagatatgatctgaaataacagtatgcataaatttcttaacaaggtttacccccctccggtatttcacccagagagagttcattcacccattcgagctgattttctcatttaacatatggctagtagcagtatagagaaaactaattgtccgtttatgattttgtgaaaatatggccatagttaccctaaacctcaagagc

SEQ ID NO: 185695 - DNA, 272 bp, Homo sapiens
atcacttccgaggttcgtggactagagagaatcagcactggactaaatactggatgtaggaaagctggctagggtggggggaaaagcctgctggaaagcagtgagaattctcctaattaagtagttagggcctagctgcggaaggccttaacctttttatgcctagtattccattactggaacgctaagggcgtgggagttacttttatccgactgctcaagtcattgccaaggtctgatttttcacaaaaaaagatttgcaacctctggca

SEQ ID NO: 185696 - DNA, 507 bp, Homo sapiens
ctttttcttccaaaacttgtttgaaaagcactgtcacctgttaagagtatggggaggagagtgggcattataaatgtgaagaggggtggataaagtctgaaatagtccttgtggaaaatgggggactcaactgaattgacctagacaggctatgaggaagcctaaatgtcataacattaatgaagattttcttgtcatctttccagcagctgtcagcctttaccttctcccactctgaggtagaactaatctttaatgtcttcttcccttgaaataccacagcacatttttcatatcatgatagagatcatctcgctgtattaaaccatctgttagcatgtcttgttcgtaatgatagactatgaaatgaacaagaccatttctgatgccttcatttgtctttgtacttcaatagtttagcaaataaagaaaaaaatgtaattattaggcaaaaataatgataaaaataacagtaacaatttttaaaaataaaagttattgaccatt

SEQ ID NO: 185697 - DNA, 290 bp, Homo sapiens
aggcccagggctgggtcctcaggacttgcacaggtagcttcaaggagacaacagaacggatgtccatccctcccacaggcagtggagagagaaaagagagggagcgagaagtcagcgagaattgctgctgctggcagaccaggccaggccagaccacagcttgaacaactgaaggagaccccaggcctaagctctttgctaaagcagggactctctaaccatgggaccatctgtcccagagccatggagccatgtattacagtgcaagttctcgggcttcagtgagggcc

SEQ ID NO: 185698 - DNA, 138 bp, Homo sapiens
ataaatttgatgccttagatgaaattggaaaattccttccaagatacaagctaccaaagctcagatgaagagaaacagaaaatctgagtagtcctatatctatttaataacctgaagttttttttttttttttttttt

SEQ ID NO: 185699 - DNA, 701 bp, Homo sapiens
  misc_feature (1)..(1): n is a, c, g, or t
ngaggtctagaggacccgaaaatgacatagaggcgggtggcatagtacagcatagtgttcactgcatgtgggcatatgacataggggtgtatgtttgtgtgtgtgtaattggcttaataagcaccaccttcttcagtaacatgaccaagaacacacatctgggaagtgggtgtgcttggatttgagctcatgtttgactagctttcaaacctatcttttcgtcgctctaggactgttgcaacgtttgttgtcgagaaaagaatacttgggccgttccctttcattttccctttggcgcatttatgtgtgctgccatgtggggacacccttgaagttagctgaattggcttcctctggtatctccaaccttttgtcacagagagttgaaaggaaaggtaaattcttttgtcctaaatgaatcatcagctggaagaaaagtctgaactctagccctctattatattccccagccagggatgactttgggcaaattggtgtccctccagttccctgggaaggcacttgactcaacaggcctctttccatttaaataccacaggtaacacttggcttcctctgagaaagctttcaagtcctgcccctttgcttacagctggctggcattctgtgtacccactacggcactaggatgagaccggccataaaatatttgctctatgcttttatcactgcctggaaat

SEQ ID NO: 185700 - DNA, 296 bp, Homo sapiens
ctccccagcccgacaaccactcatctttttactgtctccatagtttcgcctttttcagaatgtcatagagttggaattgtgcagtacgtaacttttcagattggcccaaagtgataacttcacatccttcttttccagttcaaatgttgcctttttcaaaaccactcatggcctgccccgccctcatcctgtgcccataaaaaccgcaggctccactaacagagtagaagagggtgggggctttagttctgtctctagagcaaagcccacagttattggttaatgaatgcgttaag

SEQ ID NO: 185701 - DNA, 118 bp, Homo sapiens
aacaccatagattactctgtttcttcactttatggaaatataatcatatattatgtgtgcttttgtgttcggcttcttttgttcagcattatgcttgtggaattcatctatgccgttg

SEQ ID NO: 185702 - DNA, 464 bp, Homo sapiens
agaggctattcactatgttggtctcttgaaccattattgtgaagtatgttttatgccccatagtttgtatgtaacaataaatttgtgatatttatgttctaagatcttagaaaacaccttaagatctttgcatcttctatagttttatatttatatttagttacttgtatgaaaacacataaccaacttgtttaaaacactgtacagcttcaaagtaacttttgctttttgctatcttttgcaaacttatttgtacttcagatcattttttttttcctttgaaaagccttgcagtgagagaatttctttgtttggatgatccaccgggtccatttgatagcctagaagaaagcaggcgaggtggctcatgcctgtaatcccagcactttgggaggccaaggcgggcggaccatgaggtcaggagatcgagaccatcctggctaacacggtgaaacccgtctcta

SEQ ID NO: 185703 - DNA, 3566 bp, Homo sapiens
tgtgcgtctgggaggcgctgggcgcgcaccggtcagcggaggcgggagagtctgtgatcccagggagctgcgggtctcgccgcctgcagtgcggaagacccgtgaccggcgcagaccccggccttaccttccgagggtcgaactgtgcctggtatttgcctctttcctcccgcccacggggttgctcagagtcgggccacctcacctgaggttttccagagtgagaatgaactgagcgtcctgggagcaactccgcatcaggtactgtcaagatgataagcatggaataaagcttcagaagggtctttaccaatctttctcctaccaacttttacatacatgaaatcaggttaaaatgaactttacagaaatacttcacaagggaataaagtagaggaaaaagggataacatgtaacatggagtcaaggaaaaagagtgtgaagtagttttgctctctctatcttgcaaataggagtccttaaagacaactgggagaaggggtttgagatagtgaattcctaagaagaaaataatggattgcatattagttgttctctaagtggactcaacagtgtgcaagcttgttggaaaagccaaaagaagatggcaactccttatgtcccagttcctatgcccataggaaactctgcttccagttttacaacaaacagaaatcaaagaagttcttcttttggcagtgtctcaacaagctcaaattcttctaagggccagttagaagactcaaatatgggtaattttaaacagacaagtgttcctgatcaaatggataatacttcatctgtctgtagcagtcccctcattaggactaaatttacaggtacagcttcttccattgagtattctactagaccaagagacactgaagaacaaaatccggaaacagtgaattgggaagatagaccatctacacctactatactgggttatgaagtgatggaagaaagagctaaatttactgtatataaaatactagtaaagaaaaccccagaagaaagctgggtagttttcagaagatacactgacttctctaggcttaatgacaaattaaaagagatgtttccaggttttcgactagcacttcctccaaaacgctggtttaaagataattacaatgctgactttttagaagacagacaattaggattacaagcgtttcttcaaaatttagtagctcacaaggacattgctaactgccttgcagtgagagaatttctttgtttggatgatccaccgggtccatttgatagcctagaagaaagcagggcattctgtgaaactttagaagagacaaactaccgcttacagaaagaactacttgaaaaacaaaaggagatggaatcactaaagaaactgctcagtgagaagcaacttcatatagacactttagagaacagaatcagaacattgtctttagaacctgaagaatcactggatgtgtcagaaacagaaggtgaacagatcctaaaggtggagtcctctgcacttgaggttgatcaagatgtcctggatgaagaatctagagctgataataaaccatgcttaagttttagtgaacctgaaaatgctgtatcagagatagaagtagcagaagtggcatatgatgctgaagaagactaatgtatcacaagcagttccctccatttagactattcaaaaatttagaagagtggcaaatactattttaaaagaagaaccaagaactgtaaaacatatagaaaagagcaagaatgcacatgtataaagtttacataaagaagtttttttaagttattgagataggaaatatattcactgctgcttttaattgtattttatccaattacatttaatacactaaaaaaaatcttgttggaattctgttatcaaggcccacattcttaaatactgtgcataaattattatggtgttttgcctatatattgctccaaactactgtgtatatatgtatgtgtgttaaatcaccaattatattaatcaaatggaaattaattgcatgttactatctgggtgatatattcttctttatatctctgacatgacatattttcattaatagtttaaatcagtgaccatcataataaagataaaatttagttgagtttttaatgtttacatgtttacatctctaaataaaatttgcttatttgaaatgttaatgctctttagaaaaatgactttctagtaccaaaggaaaactacttgaaagagctgtaatcatatagctaaagtgataagatagccttgattttaaaagctgattcattaatatcaaaatactttaataagtgtcacagttattaatatgttacatttgtttagtttccacgtaatctttatctctacctagatttagtgagtttgcctctttcagaatactacctccttttgttaaggcatattctttcgaaaatatagattctaaataaataggggcttatacaaaaaagaaaataaaaagccatatatactgcaaagttcctaactggcttgactcctgacattgcatttttatttctatttgtgtgaagatgttgttatactgtattatggctgattttctttttaatatatttagccaagtgatgcactttatgataattaaactcttttgtgccaagtttaattggtggatttttttagtaagtagagttaggagaaagaattatgtagtgcctttactatttcactttctacaaaagtctcctagggtctttgagtcagctttatgaaaaaatgtttgtttatttcagctttgtgtacagtcattaaaagtgccttgtttcatttttataggatgaagttatttattttctattttcactgttttgcatattgctgttaataagcattgtaatcatgctggcattttgcaatcccagtcggtatgctttctaaaaactgagggaaacttactggggaaatagaataacaatctccatttttttctttactatctaaaagtttatcggtatcttgatgtatatatatattaaggtgtggctgtttaaaattctaatgacatatatcaacacattcaatggctgttgttaacctttgaagtaaaaaggagatcactttttaccaaataaccaaaaatttttagtctttgtcaaagtgcacaggtatgttctcagaacatttttcacaatgtgtatcagaaatatgtttgctatccttagagacagaaatgaatataacaaattgatctgcttatttattaaaattattattctagacttacaaaaggcttaaaaagaacaatcatttaatcagtaccattctgtatcttatataacagatctttgccaaattctagatattatagtgttgcctgtctgttctaaagcgaaccagccactttttcaatctggctttttggaagattgtatttaaagttcttcaaggatgaagaaaaaaatctgttaattaggtaaaccactattatttatatttataatttacttttttttacttttataatgcattttactcccagtattatgttcatttaataaattattttttcactacaaaaaaaactgtg

SEQ ID NO: 185704 - DNA, 3479 bp, Homo sapiens
tgtgcgtctgggaggcgctgggcgcgcaccggtcagcggaggcgggagagtctgtgatcccagggagctgcgggtctcgccgcctgcagtgcggaagacccgtgaccggcgcagaccccggccttaccttccgagggtcgaactgtgcctggtatttgcctctttcctcccgcccacggggttgctcagagtcgggccacctcacctgaggttttccagagtgagaatgaactgagcgtcctgggagcaactccgcatcaggtactgtcaagatgataagcatggaataaagcttcagaagggtctttaccaatctttctcctaccaacttttacatacatgaaatcaggttaaaatgaactttacagaaatacttcacaagggaataaagtagaggaaaaagggataacatgtaacatggagtcaaggaaaaagagtgtgaagtagttttgctctctctatcttgcaaataggagtccttaaagacaactgggagaaggggtttgagatagtgaattcctaagaagaaaataatggattgcatattagttgttctctaagtggactcaacagtgtgcaagcttgttggaaaagccaaaagaagatggcaactccttatgtcccagttcctatgcccataggaaactctgcttccagttttacaacaaacagaaatcaaagaagttcttcttttggcagtgtctcaacaagctcaaattcttctaagggccagttagaagactcaaatatgggtaattttaaacagacaagtgttcctgatcaaatggataatacttcatctgtctgtagcagtcccctcattaggactaaatttacaggtacagcttcttccattgagtattctactagaccaagagacactgaagaacaaaatccggaaacagtgaattgggaagatagaccatctacacctactatactgggttatgaagtgatggaagaaagagctaaatttactttaaaagagatgtttccaggttttcgactagcacttcctccaaaacgctggtttaaagataattacaatgctgactttttagaagacagacaattaggattacaagcgtttcttcaaaatttagtagctcacaaggacattgctaactgccttgcagtgagagaatttctttgtttggatgatccaccgggtccatttgatagcctagaagaaagcagggcattctgtgaaactttagaagagacaaactaccgcttacagaaagaactacttgaaaaacaaaaggagatggaatcactaaagaaactgctcagtgagaagcaacttcatatagacactttagagaacagaatcagaacattgtctttagaacctgaagaatcactggatgtgtcagaaacagaaggtgaacagatcctaaaggtggagtcctctgcacttgaggttgatcaagatgtcctggatgaagaatctagagctgataataaaccatgcttaagttttagtgaacctgaaaatgctgtatcagagatagaagtagcagaagtggcatatgatgctgaagaagactaatgtatcacaagcagttccctccatttagactattcaaaaatttagaagagtggcaaatactattttaaaagaagaaccaagaactgtaaaacatatagaaaagagcaagaatgcacatgtataaagtttacataaagaagtttttttaagttattgagataggaaatatattcactgctgcttttaattgtattttatccaattacatttaatacactaaaaaaaatcttgttggaattctgttatcaaggcccacattcttaaatactgtgcataaattattatggtgttttgcctatatattgctccaaactactgtgtatatatgtatgtgtgttaaatcaccaattatattaatcaaatggaaattaattgcatgttactatctgggtgatatattcttctttatatctctgacatgacatattttcattaatagtttaaatcagtgaccatcataataaagataaaatttagttgagtttttaatgtttacatgtttacatctctaaataaaatttgcttatttgaaatgttaatgctctttagaaaaatgactttctagtaccaaaggaaaactacttgaaagagctgtaatcatatagctaaagtgataagatagccttgattttaaaagctgattcattaatatcaaaatactttaataagtgtcacagttattaatatgttacatttgtttagtttccacgtaatctttatctctacctagatttagtgagtttgcctctttcagaatactacctccttttgttaaggcatattctttcgaaaatatagattctaaataaataggggcttatacaaaaaagaaaataaaaagccatatatactgcaaagttcctaactggcttgactcctgacattgcatttttatttctatttgtgtgaagatgttgttatactgtattatggctgattttctttttaatatatttagccaagtgatgcactttatgataattaaactcttttgtgccaagtttaattggtggatttttttagtaagtagagttaggagaaagaattatgtagtgcctttactatttcactttctacaaaagtctcctagggtctttgagtcagctttatgaaaaaatgtttgtttatttcagctttgtgtacagtcattaaaagtgccttgtttcatttttataggatgaagttatttattttctattttcactgttttgcatattgctgttaataagcattgtaatcatgctggcattttgcaatcccagtcggtatgctttctaaaaactgagggaaacttactggggaaatagaataacaatctccatttttttctttactatctaaaagtttatcggtatcttgatgtatatatatattaaggtgtggctgtttaaaattctaatgacatatatcaacacattcaatggctgttgttaacctttgaagtaaaaaggagatcactttttaccaaataaccaaaaatttttagtctttgtcaaagtgcacaggtatgttctcagaacatttttcacaatgtgtatcagaaatatgtttgctatccttagagacagaaatgaatataacaaattgatctgcttatttattaaaattattattctagacttacaaaaggcttaaaaagaacaatcatttaatcagtaccattctgtatcttatataacagatctttgccaaattctagatattatagtgttgcctgtctgttctaaagcgaaccagccactttttcaatctggctttttggaagattgtatttaaagttcttcaaggatgaagaaaaaaatctgttaattaggtaaaccactattatttatatttataatttacttttttttacttttataatgcattttactcccagtattatgttcatttaataaattattttttcactacaaaaaaaactgtg

SEQ ID NO: 185705 - DNA, 3400 bp, Homo sapiens
acacagcagggatcttgggcccgggcagagactggctgaggcggggagcagctgcttttggggcgggggtgtcacgtgaggcttctcgctgctgagggaggaggcgaaaagctgcggttaaggagagtccggtttaaccgtcaccgggaagcgcgctcgttcgggatcgccgagtgggctgagtactgtcaagatgataagcatggaataaagcttcagaagggtctttaccaatctttctcctaccaacttttacatacatgaaatcaggttaaaatgaactttacagaaatacttcacaagggaataaagtagaggaaaaagggataacatgtaacatggagtcaaggaaaaagagtgtgaagtagttttgctctctctatcttgcaaataggagtccttaaagacaactgggagaaggggtttgagatagtgaattcctaagaagaaaataatggattgcatattagttgttctctaagtggactcaacagtgtgcaagcttgttggaaaagccaaaagaagatggcaactccttatgtcccagttcctatgcccataggaaactctgcttccagttttacaacaaacagaaatcaaagaagttcttcttttggcagtgtctcaacaagctcaaattcttctaagggccagttagaagactcaaatatgggtacagcttcttccattgagtattctactagaccaagagacactgaagaacaaaatccggaaacagtgaattgggaagatagaccatctacacctactatactgggttatgaagtgatggaagaaagagctaaatttactgtatataaaatactagtaaagaaaaccccagaagaaagctgggtagttttcagaagatacactgacttctctaggcttaatgacaaattaaaagagatgtttccaggttttcgactagcacttcctccaaaacgctggtttaaagataattacaatgctgactttttagaagacagacaattaggattacaagcgtttcttcaaaatttagtagctcacaaggacattgctaactgccttgcagtgagagaatttctttgtttggatgatccaccgggtccatttgatagcctagaagaaagcagggcattctgtgaaactttagaagagacaaactaccgcttacagaaagaactacttgaaaaacaaaaggagatggaatcactaaagaaactgctcagtgagaagcaacttcatatagacactttagagaacagaatcagaacattgtctttagaacctgaagaatcactggatgtgtcagaaacagaaggtgaacagatcctaaaggtggagtcctctgcacttgaggttgatcaagatgtcctggatgaagaatctagagctgataataaaccatgcttaagttttagtgaacctgaaaatgctgtatcagagatagaagtagcagaagtggcatatgatgctgaagaagactaatgtatcacaagcagttccctccatttagactattcaaaaatttagaagagtggcaaatactattttaaaagaagaaccaagaactgtaaaacatatagaaaagagcaagaatgcacatgtataaagtttacataaagaagtttttttaagttattgagataggaaatatattcactgctgcttttaattgtattttatccaattacatttaatacactaaaaaaaatcttgttggaattctgttatcaaggcccacattcttaaatactgtgcataaattattatggtgttttgcctatatattgctccaaactactgtgtatatatgtatgtgtgttaaatcaccaattatattaatcaaatggaaattaattgcatgttactatctgggtgatatattcttctttatatctctgacatgacatattttcattaatagtttaaatcagtgaccatcataataaagataaaatttagttgagtttttaatgtttacatgtttacatctctaaataaaatttgcttatttgaaatgttaatgctctttagaaaaatgactttctagtaccaaaggaaaactacttgaaagagctgtaatcatatagctaaagtgataagatagccttgattttaaaagctgattcattaatatcaaaatactttaataagtgtcacagttattaatatgttacatttgtttagtttccacgtaatctttatctctacctagatttagtgagtttgcctctttcagaatactacctccttttgttaaggcatattctttcgaaaatatagattctaaataaataggggcttatacaaaaaagaaaataaaaagccatatatactgcaaagttcctaactggcttgactcctgacattgcatttttatttctatttgtgtgaagatgttgttatactgtattatggctgattttctttttaatatatttagccaagtgatgcactttatgataattaaactcttttgtgccaagtttaattggtggatttttttagtaagtagagttaggagaaagaattatgtagtgcctttactatttcactttctacaaaagtctcctagggtctttgagtcagctttatgaaaaaatgtttgtttatttcagctttgtgtacagtcattaaaagtgccttgtttcatttttataggatgaagttatttattttctattttcactgttttgcatattgctgttaataagcattgtaatcatgctggcattttgcaatcccagtcggtatgctttctaaaaactgagggaaacttactggggaaatagaataacaatctccatttttttctttactatctaaaagtttatcggtatcttgatgtatatatatattaaggtgtggctgtttaaaattctaatgacatatatcaacacattcaatggctgttgttaacctttgaagtaaaaaggagatcactttttaccaaataaccaaaaatttttagtctttgtcaaagtgcacaggtatgttctcagaacatttttcacaatgtgtatcagaaatatgtttgctatccttagagacagaaatgaatataacaaattgatctgcttatttattaaaattattattctagacttacaaaaggcttaaaaagaacaatcatttaatcagtaccattctgtatcttatataacagatctttgccaaattctagatattatagtgttgcctgtctgttctaaagcgaaccagccactttttcaatctggctttttggaagattgtatttaaagttcttcaaggatgaagaaaaaaatctgttaattaggtaaaccactattatttatatttataatttacttttttttacttttataatgcattttactcccagtattatgttcatttaataaattattttttcactacaaaaaaaactgtg

SEQ ID NO: 185706 - DNA, 3183 bp, Homo sapiens
acacagcagggatcttgggcccgggcagagactggctgaggcggggagcagctgcttttggggcgggggtgtcacgtgaggcttctcgctgctgagggaggaggcgaaaagctgcggttaaggagagtccggtttaaccgtcaccgggaagcgcgctcgttcgggatcgccgagtgggctgagatagtgaattcctaagaagaaaataatggattgcatattagttgttctctaagtggactcaacagtgtgcaagcttgttggaaaagccaaaagaagatggcaactccttatgtcccagttcctatgcccataggaaactctgcttccagttttacaacaaacagaaatcaaagaagttcttcttttggcagtgtctcaacaagctcaaattcttctaagggccagttagaagactcaaatatgggtaattttaaacagacaagtgttcctgatcaaatggataatacttcatctgtctgtagcagtcccctcattaggactaaatttacaggtacagcttcttccattgagtattctactagaccaagagacactgaagaacaaaatccggaaacagtgaattgggaagatagaccatctacacctactatactgggttatgaagtgatggaagaaagagctaaatttactgtatataaaatactagtaaagaaaaccccagaagaaagctgggtagttttcagaagatacactgacttctctaggcttaatgacaaaataattacaatgctgactttttagaagacagacaattaggattacaagcgtttcttcaaaatttagtagctcacaaggacattgctaactgccttgcagtgagagaatttctttgtttggatgatccaccgggtccatttgatagcctagaagaaagcagggcattctgtgaaactttagaagagacaaactaccgcttacagaaagaactacttgaaaaacaaaaggagatggaatcactaaagaaactgctcagtgagaagcaacttcatatagacactttagagaacagaatcagaacattgtctttagaacctgaagaatcactggatgtgtcagaaacagaaggtgaacagatcctaaaggtggagtcctctgcacttgaggttgatcaagatgtcctggatgaagaatctagagctgataataaaccatgcttaagttttagtgaacctgaaaatgctgtatcagagatagaagtagcagaagtggcatatgatgctgaagaagactaatgtatcacaagcagttccctccatttagactattcaaaaatttagaagagtggcaaatactattttaaaagaagaaccaagaactgtaaaacatatagaaaagagcaagaatgcacatgtataaagtttacataaagaagtttttttaagttattgagataggaaatatattcactgctgcttttaattgtattttatccaattacatttaatacactaaaaaaaatcttgttggaattctgttatcaaggcccacattcttaaatactgtgcataaattattatggtgttttgcctatatattgctccaaactactgtgtatatatgtatgtgtgttaaatcaccaattatattaatcaaatggaaattaattgcatgttactatctgggtgatatattcttctttatatctctgacatgacatattttcattaatagtttaaatcagtgaccatcataataaagataaaatttagttgagtttttaatgtttacatgtttacatctctaaataaaatttgcttatttgaaatgttaatgctctttagaaaaatgactttctagtaccaaaggaaaactacttgaaagagctgtaatcatatagctaaagtgataagatagccttgattttaaaagctgattcattaatatcaaaatactttaataagtgtcacagttattaatatgttacatttgtttagtttccacgtaatctttatctctacctagatttagtgagtttgcctctttcagaatactacctccttttgttaaggcatattctttcgaaaatatagattctaaataaataggggcttatacaaaaaagaaaataaaaagccatatatactgcaaagttcctaactggcttgactcctgacattgcatttttatttctatttgtgtgaagatgttgttatactgtattatggctgattttctttttaatatatttagccaagtgatgcactttatgataattaaactcttttgtgccaagtttaattggtggatttttttagtaagtagagttaggagaaagaattatgtagtgcctttactatttcactttctacaaaagtctcctagggtctttgagtcagctttatgaaaaaatgtttgtttatttcagctttgtgtacagtcattaaaagtgccttgtttcatttttataggatgaagttatttattttctattttcactgttttgcatattgctgttaataagcattgtaatcatgctggcattttgcaatcccagtcggtatgctttctaaaaactgagggaaacttactggggaaatagaataacaatctccatttttttctttactatctaaaagtttatcggtatcttgatgtatatatatattaaggtgtggctgtttaaaattctaatgacatatatcaacacattcaatggctgttgttaacctttgaagtaaaaaggagatcactttttaccaaataaccaaaaatttttagtctttgtcaaagtgcacaggtatgttctcagaacatttttcacaatgtgtatcagaaatatgtttgctatccttagagacagaaatgaatataacaaattgatctgcttatttattaaaattattattctagacttacaaaaggcttaaaaagaacaatcatttaatcagtaccattctgtatcttatataacagatctttgccaaattctagatattatagtgttgcctgtctgttctaaagcgaaccagccactttttcaatctggctttttggaagattgtatttaaagttcttcaaggatgaagaaaaaaatctgttaattaggtaaaccactattatttatatttataatttacttttttttacttttataatgcattttactcccagtattatgttcatttaataaattattttttcactacaaaaaaaactgtg

SEQ ID NO: 185707 - DNA, 1602 bp, Homo sapiens
acacagcagggatcttgggcccgggcagagactggctgaggcggggagcagctgcttttggggcgggggtgtcacgtgaggcttctcgctgctgagggaggaggcgaaaagctgcggttaaggagagtccggtttaaccgtcaccgggaagcgcgctcgttcgggatcgccgagtgggctgagatagtgaattcctaagaagaaaataatggattgcatattagttgttctctaagtggactcaacagtgtgcaagcttgttggaaaagccaaaagaagatggcaactccttatgtcccagttcctatgcccataggaaactctgcttccagttttacaacaaacagaaatcaaagaagttcttcttttggcagtgtctcaacaagctcaaattcttctaagggccagttagaagactcaaatatgggtaattttaaacagacaagtgttcctgatcaaatggataatacttcatctgtctgtagcagtcccctcattaggactaaatttacaggtacagcttcttccattgagtattctactagaccaagagacactgaagaacaaaatccggaaacagtgaattgggaagatagaccatctacacctactatactgggttatgaagtgatggaagaaagagctaaatttactgtatataaaatactagtaaagaaaaccccagaagaaagctgggtagttttcagaagatacactgacttctctaggcttaatgacaaattaaaagagatgtttccaggttttcgactagcacttcctccaaaacgctggtttaaagataattacaatgctgactttttagaagacagacaattaggattacaagcgtttcttcaaaatttagtagctcacaaggacattgctaactgccttgcagtgagagaatttctttgtttggatgatccaccgggtccatttgatagcctagaagaaagcagggtaagtgctgtattatatagcacatgaaaagaggaacaaattaatgcagtacaaataactacattgtttcttggatggaatagcaaacagcaaaatattataatttcaggctatggtagttttgcacagaaagctttcatgtttgagtcaaaggttgctttcagtgaaatacatagacttagctcagtgaaaaagtaaaaattcatatatgtcttatagtcaataaagctctaaaattaaatcctgcattatttttactgtttcaaaaaaaatgatttgggggacctttttatatttaataatactatgtgtaaactgagttttcttccatttgagtgtcaaaataaggaatgtacagctgaaatcaaatttaaaacttcaggggtaggagtgattatcttgttatcggtttagcttgtgcctgatgcttctcaaattacattaattgacgtgttaaagtgtcctgtttcttgaagcaatagcctagattcacaaaacagatttggtaatagtagattagctaggattttatgcaagttttttccccaaatgtttaatggcatttaaatggaacagatttaattggtaggtttgtaatgttttcattcaagctgagtcagttctttgtgttagattgaatgc

SEQ ID NO: 185708 - DNA, 353 bp, Homo sapiens
gtaagtactataataaatccaaactaacatttcagttttgaattcttttctgtttcctatacttctgttatattttttctttgttaatgagtcaaattcattctagttcataagaaaattaattttttaaataaatttttaaaataaaaatttttagcataaaaatgtgaaactttaaaattgccaacagaaatataaataattatcttgtgagtctgaaaaagatgtgtataagatcttttgaattattataaaattatatatgtctataagataatgaacaaaaacatatttaacatattgtattagtttcctattactgcataataaattaccacaaactttgttgctta

SEQ ID NO: 185709 - DNA, 3241 bp, Homo sapiens
acacagcagggatcttgggcccgggcagagactggctgaggcggggagcagctgcttttggggcgggggtgtcacgtgaggcttctcgctgctgagggaggaggcgaaaagctgcggttaaggagagtccggtttaaccgtcaccgggaagcgcgctcgttcgggatcgccgagtgggctgagatagtgaattcctaagaagaaaataatggattgcatattagttgttctctaagtggactcaacagtgtgcaagcttgttggaaaagccaaaagaagatggcaactccttatgtcccagttcctatgcccataggaaactctgcttccagttttacaacaaacagaaatcaaagaagttcttcttttggcagtgtctcaacaagctcaaattcttctaagggccagttagaagactcaaatatgggtaattttaaacagacaagtgttcctgatcaaatggataatacttcatctgtctgtagcagtcccctcattaggactaaatttacaggtacagcttcttccattgagtattctactagaccaagagacactgaagaacaaaatccggaaacagtgaattgggaagatagaccatctacacctactatactgggttatgaagtgatggaagaaagagctaaatttactgtatataaaatactagtaaagaaaaccccagaagaaagctgggtagttttcagaagatacactgacttctctaggcttaatgacaaattaaaagagatgtttccaggttttcgactagcacttcctccaaaacgctggtttaaagataattacaatgctgactttttagaagacagacaattaggattacaagcgtttcttcaaaatttagtagctcacaaggacattgctaactgccttgcagtgagagaatttctttgtttggatgatccaccgggtccatttgatagcctagaagaaagcagggcattctgtgaaactttagaagagacaaactaccgcttacagaaagaactacttgaaaaacaaaaggagatggaatcactaaagaaactgctcagtgagaagcaacttcatatagacactttagagaacagaatcagaacattgtctttagaacctgaagaatcactggatgtgtcagaaacagaaggtgaacagatcctaaaggtggagtcctctgcacttgaggttgatcaagatgtcctggatgaagaatctagagctgataataaaccatgcttaagttttagtgaacctgaaaatgctgtatcagagatagaagtagcagaagtggcatatgatgctgaagaagactaatgtatcacaagcagttccctccatttagactattcaaaaatttagaagagtggcaaatactattttaaaagaagaaccaagaactgtaaaacatatagaaaagagcaagaatgcacatgtataaagtttacataaagaagtttttttaagttattgagataggaaatatattcactgctgcttttaattgtattttatccaattacatttaatacactaaaaaaaatcttgttggaattctgttatcaaggcccacattcttaaatactgtgcataaattattatggtgttttgcctatatattgctccaaactactgtgtatatatgtatgtgtgttaaatcaccaattatattaatcaaatggaaattaattgcatgttactatctgggtgatatattcttctttatatctctgacatgacatattttcattaatagtttaaatcagtgaccatcataataaagataaaatttagttgagtttttaatgtttacatgtttacatctctaaataaaatttgcttatttgaaatgttaatgctctttagaaaaatgactttctagtaccaaaggaaaactacttgaaagagctgtaatcatatagctaaagtgataagatagccttgattttaaaagctgattcattaatatcaaaatactttaataagtgtcacagttattaatatgttacatttgtttagtttccacgtaatctttatctctacctagatttagtgagtttgcctctttcagaatactacctccttttgttaaggcatattctttcgaaaatatagattctaaataaataggggcttatacaaaaaagaaaataaaaagccatatatactgcaaagttcctaactggcttgactcctgacattgcatttttatttctatttgtgtgaagatgttgttatactgtattatggctgattttctttttaatatatttagccaagtgatgcactttatgataattaaactcttttgtgccaagtttaattggtggatttttttagtaagtagagttaggagaaagaattatgtagtgcctttactatttcactttctacaaaagtctcctagggtctttgagtcagctttatgaaaaaatgtttgtttatttcagctttgtgtacagtcattaaaagtgccttgtttcatttttataggatgaagttatttattttctattttcactgttttgcatattgctgttaataagcattgtaatcatgctggcattttgcaatcccagtcggtatgctttctaaaaactgagggaaacttactggggaaatagaataacaatctccatttttttctttactatctaaaagtttatcggtatcttgatgtatatatatattaaggtgtggctgtttaaaattctaatgacatatatcaacacattcaatggctgttgttaacctttgaagtaaaaaggagatcactttttaccaaataaccaaaaatttttagtctttgtcaaagtgcacaggtatgttctcagaacatttttcacaatgtgtatcagaaatatgtttgctatccttagagacagaaatgaatataacaaattgatctgcttatttattaaaattattattctagacttacaaaaggcttaaaaagaacaatcatttaatcagtaccattctgtatcttatataacagatctttgccaaattctagatattatagtgttgcctgtctgttctaaagcgaaccagccactttttcaatctggctttttggaagattgtatttaaagttcttcaaggatgaagaaaaaaatctgttaattaggtaaaccactattatttatatttataatttacttttttttacttttataatgcattttactcccagtattatgttcatttaataaattattttttcactacaaaaaaaactgtg

SEQ ID NO: 185710 - DNA, 3162 bp, Homo sapiens
agctggtgatgactacaagtcccatgatgcaaagtatgagcacggaccaatgttggtcgcagttccttctgggaattgtagtcttctcctgtttggcaaactagatagtgaattcctaagaagaaaataatggattgcatattagttgttctctaagtggactcaacagtgtgcaagcttgttggaaaagccaaaagaagatggcaactccttatgtcccagttcctatgcccataggaaactctgcttccagttttacaacaaacagaaatcaaagaagttcttcttttggcagtgtctcaacaagctcaaattcttctaagggccagttagaagactcaaatatgggtaattttaaacagacaagtgttcctgatcaaatggataatacttcatctgtctgtagcagtcccctcattaggactaaatttacaggtacagcttcttccattgagtattctactagaccaagagacactgaagaacaaaatccggaaacagtgaattgggaagatagaccatctacacctactatactgggttatgaagtgatggaagaaagagctaaatttactgtatataaaatactagtaaagaaaaccccagaagaaagctgggtagttttcagaagatacactgacttctctaggcttaatgacaaattaaaagagatgtttccaggttttcgactagcacttcctccaaaacgctggtttaaagataattacaatgctgactttttagaagacagacaattaggattacaagcgtttcttcaaaatttagtagctcacaaggacattgctaactgccttgcagtgagagaatttctttgtttggatgatccaccgggtccatttgatagcctagaagaaagcagggcattctgtgaaactttagaagagacaaactaccgcttacagaaagaactacttgaaaaacaaaaggagatggaatcactaaagaaactgctcagtgagaagcaacttcatatagacactttagagaacagaatcagaacattgtctttagaacctgaagaatcactggatgtgtcagaaacagaaggtgaacagatcctaaaggtggagtcctctgcacttgaggttgatcaagatgtcctggatgaagaatctagagctgataataaaccatgcttaagttttagtgaacctgaaaatgctgtatcagagatagaagtagcagaagtggcatatgatgctgaagaagactaatgtatcacaagcagttccctccatttagactattcaaaaatttagaagagtggcaaatactattttaaaagaagaaccaagaactgtaaaacatatagaaaagagcaagaatgcacatgtataaagtttacataaagaagtttttttaagttattgagataggaaatatattcactgctgcttttaattgtattttatccaattacatttaatacactaaaaaaaatcttgttggaattctgttatcaaggcccacattcttaaatactgtgcataaattattatggtgttttgcctatatattgctccaaactactgtgtatatatgtatgtgtgttaaatcaccaattatattaatcaaatggaaattaattgcatgttactatctgggtgatatattcttctttatatctctgacatgacatattttcattaatagtttaaatcagtgaccatcataataaagataaaatttagttgagtttttaatgtttacatgtttacatctctaaataaaatttgcttatttgaaatgttaatgctctttagaaaaatgactttctagtaccaaaggaaaactacttgaaagagctgtaatcatatagctaaagtgataagatagccttgattttaaaagctgattcattaatatcaaaatactttaataagtgtcacagttattaatatgttacatttgtttagtttccacgtaatctttatctctacctagatttagtgagtttgcctctttcagaatactacctccttttgttaaggcatattctttcgaaaatatagattctaaataaataggggcttatacaaaaaagaaaataaaaagccatatatactgcaaagttcctaactggcttgactcctgacattgcatttttatttctatttgtgtgaagatgttgttatactgtattatggctgattttctttttaatatatttagccaagtgatgcactttatgataattaaactcttttgtgccaagtttaattggtggatttttttagtaagtagagttaggagaaagaattatgtagtgcctttactatttcactttctacaaaagtctcctagggtctttgagtcagctttatgaaaaaatgtttgtttatttcagctttgtgtacagtcattaaaagtgccttgtttcatttttataggatgaagttatttattttctattttcactgttttgcatattgctgttaataagcattgtaatcatgctggcattttgcaatcccagtcggtatgctttctaaaaactgagggaaacttactggggaaatagaataacaatctccatttttttctttactatctaaaagtttatcggtatcttgatgtatatatatattaaggtgtggctgtttaaaattctaatgacatatatcaacacattcaatggctgttgttaacctttgaagtaaaaaggagatcactttttaccaaataaccaaaaatttttagtctttgtcaaagtgcacaggtatgttctcagaacatttttcacaatgtgtatcagaaatatgtttgctatccttagagacagaaatgaatataacaaattgatctgcttatttattaaaattattattctagacttacaaaaggcttaaaaagaacaatcatttaatcagtaccattctgtatcttatataacagatctttgccaaattctagatattatagtgttgcctgtctgttctaaagcgaaccagccactttttcaatctggctttttggaagattgtatttaaagttcttcaaggatgaagaaaaaaatctgttaattaggtaaaccactattatttatatttataatttacttttttttacttttataatgcattttactcccagtattatgttcatttaataaattattttttcactacaaaaaaaactgtg

SEQ ID NO: 185711 - DNA, 3154 bp, Homo sapiens
acacagcagggatcttgggcccgggcagagactggctgaggcggggagcagctgcttttggggcgggggtgtcacgtgaggcttctcgctgctgagggaggaggcgaaaagctgcggttaaggagagtccggtttaaccgtcaccgggaagcgcgctcgttcgggatcgccgagtgggctgagatagtgaattcctaagaagaaaataatggattgcatattagttgttctctaagtggactcaacagtgtgcaagcttgttggaaaagccaaaagaagatggcaactccttatgtcccagttcctatgcccataggaaactctgcttccagttttacaacaaacagaaatcaaagaagttcttcttttggcagtgtctcaacaagctcaaattcttctaagggccagttagaagactcaaatatgggtacagcttcttccattgagtattctactagaccaagagacactgaagaacaaaatccggaaacagtgaattgggaagatagaccatctacacctactatactgggttatgaagtgatggaagaaagagctaaatttactgtatataaaatactagtaaagaaaaccccagaagaaagctgggtagttttcagaagatacactgacttctctaggcttaatgacaaattaaaagagatgtttccaggttttcgactagcacttcctccaaaacgctggtttaaagataattacaatgctgactttttagaagacagacaattaggattacaagcgtttcttcaaaatttagtagctcacaaggacattgctaactgccttgcagtgagagaatttctttgtttggatgatccaccgggtccatttgatagcctagaagaaagcagggcattctgtgaaactttagaagagacaaactaccgcttacagaaagaactacttgaaaaacaaaaggagatggaatcactaaagaaactgctcagtgagaagcaacttcatatagacactttagagaacagaatcagaacattgtctttagaacctgaagaatcactggatgtgtcagaaacagaaggtgaacagatcctaaaggtggagtcctctgcacttgaggttgatcaagatgtcctggatgaagaatctagagctgataataaaccatgcttaagttttagtgaacctgaaaatgctgtatcagagatagaagtagcagaagtggcatatgatgctgaagaagactaatgtatcacaagcagttccctccatttagactattcaaaaatttagaagagtggcaaatactattttaaaagaagaaccaagaactgtaaaacatatagaaaagagcaagaatgcacatgtataaagtttacataaagaagtttttttaagttattgagataggaaatatattcactgctgcttttaattgtattttatccaattacatttaatacactaaaaaaaatcttgttggaattctgttatcaaggcccacattcttaaatactgtgcataaattattatggtgttttgcctatatattgctccaaactactgtgtatatatgtatgtgtgttaaatcaccaattatattaatcaaatggaaattaattgcatgttactatctgggtgatatattcttctttatatctctgacatgacatattttcattaatagtttaaatcagtgaccatcataataaagataaaatttagttgagtttttaatgtttacatgtttacatctctaaataaaatttgcttatttgaaatgttaatgctctttagaaaaatgactttctagtaccaaaggaaaactacttgaaagagctgtaatcatatagctaaagtgataagatagccttgattttaaaagctgattcattaatatcaaaatactttaataagtgtcacagttattaatatgttacatttgtttagtttccacgtaatctttatctctacctagatttagtgagtttgcctctttcagaatactacctccttttgttaaggcatattctttcgaaaatatagattctaaataaataggggcttatacaaaaaagaaaataaaaagccatatatactgcaaagttcctaactggcttgactcctgacattgcatttttatttctatttgtgtgaagatgttgttatactgtattatggctgattttctttttaatatatttagccaagtgatgcactttatgataattaaactcttttgtgccaagtttaattggtggatttttttagtaagtagagttaggagaaagaattatgtagtgcctttactatttcactttctacaaaagtctcctagggtctttgagtcagctttatgaaaaaatgtttgtttatttcagctttgtgtacagtcattaaaagtgccttgtttcatttttataggatgaagttatttattttctattttcactgttttgcatattgctgttaataagcattgtaatcatgctggcattttgcaatcccagtcggtatgctttctaaaaactgagggaaacttactggggaaatagaataacaatctccatttttttctttactatctaaaagtttatcggtatcttgatgtatatatatattaaggtgtggctgtttaaaattctaatgacatatatcaacacattcaatggctgttgttaacctttgaagtaaaaaggagatcactttttaccaaataaccaaaaatttttagtctttgtcaaagtgcacaggtatgttctcagaacatttttcacaatgtgtatcagaaatatgtttgctatccttagagacagaaatgaatataacaaattgatctgcttatttattaaaattattattctagacttacaaaaggcttaaaaagaacaatcatttaatcagtaccattctgtatcttatataacagatctttgccaaattctagatattatagtgttgcctgtctgttctaaagcgaaccagccactttttcaatctggctttttggaagattgtatttaaagttcttcaaggatgaagaaaaaaatctgttaattaggtaaaccactattatttatatttataatttacttttttttacttttataatgcattttactcccagtattatgttcatttaataaattattttttcactacaaaaaaaactgtg

SEQ ID NO: 185712 - DNA, 423 bp, Homo sapiens
cccaccgagtcccgcttcctgagcagacaggaccgcctgctgttttcttctcctctcttattgccccttgtcatgaaaggagaggtctgacttccacttcagtttgtgtggatagacagcagtaagggaacagaggggaaatgttcattaccgctgttaacaccacagcatttcttactgctcggacattcgctccctctttgggaaggattaaaccaaaggataaattcgtgagcatgtaaggcttcaagctacacccaagaagagatgtcgtatattgcaaattttctgggggatctttcagaattcattttttgttatttcccagtcttattctcaactatctggaatcttgactaggatactctgtgagacttgagagctttttcctgaggctttttgttgttgtttagcagctctgcc

SEQ ID NO: 185713 - DNA, 456 bp, Homo sapiens
ctccactatcctgtttgtctccatcataaaatcttcacccatgcctgtgtgcttatgtcattgctaggttgtcttccaggatttcatagttagagtttttgcatttaagtctttaattcatcttgagtttgtttttgtatatggtgtaaagaaggggtccggtatctctcttctgcaaatggccagccagttatctcagcaccatttattgaatagggagtccttttctcattgcttgtttttgtcaggtttgtggaagatcagatggttgtaagtgtgcagtcttagttctgggttctctattctgtttcattcatccttgtgttctttaaagagtgttttaggtcttcttggccatgaatatggtgtatctctcaattttttttaggtcttctctaaaataagtcttctcaaattttgttagagcggttcttagatacttgggatttttaaaat

SEQ ID NO: 185714 - DNA, 518 bp, Homo sapiens
ccttcccccctttcctgccctttatttgcccatcactatcattaacatctggcatattatttactcttttatgttgtcaatctcccctcactagattttaaactccattagagcaggactttttgtccacttttatacgctcagcatctataagaacaccaggatgtaaaaagtgcaccacaaatatttgctgactgaattagtgatgagaaaaatttaacaggaaagagaaaactcacctgtactaccattaaaaactatagaaataaaactagcaggccgggcgtggtggctcacacctgtaatcccagtacttagggaagcagaggccggtggattgcctaaggtcaggagttcgagagcagcctgaccaacatggtgaaaccccgtctctactaaaaatacaaaaactagcagggcgtggtggcaggcacctgtaatcccagctagtcaggaggctgaagcaggagactcacttgaacccgggaggcggaagttgcagtgagccaagatcaagc

SEQ ID NO: 185715 - DNA, 197 bp, Homo sapiens
tggagcaggatctagcaaatccatggaagtggcaacaagacagtctggacaagggctgaggtgcagtgtgcggtcagcttccacctggaaatgaaagctgcttgactgggagaggtaagggggcatctcagataatgagatggtgtattgtgtatactcacactaactaacatagtaaacattatgagctaagtaat

SEQ ID NO: 185716 - DNA, 408 bp, Homo sapiens
caccgcgcccggcctctcgatacacttttggttccagaagtaacacttgacactcttcttgcagagaggaagaaaatggaacgtttacagggagccccgagtccctcccttgacctctagggcatgagccgcatgttctccaggcctttctctgcccactcacacccaggaatgtgacctgggaggtatctaacgtgtgatcttccgggcaggtcgggaggttcctcccgccgctgccttcgaggagctgtttatcttgggtgcgttcgcgtcgtaattgggatgttccgagccacctggttcttttcagctgtatggacgttcccctcgtggcgctggacacccccacgtccacacacttccctcggtcatttccctgttgtaagcaatactgtaacgaacatcttc

SEQ ID NO: 185717 - DNA, 303 bp, Homo sapiens
ttttggtcagatatattagtggtttccaattttttcattataaataattctgcagtaaaaattttgtaacttattttatgtccttaggatacagttctaaaggaaatatcaaagaataaaaacattttaaagtttctgatacatatcaccaaactgcttttcaagagggatccatcaatttgtattcctatttatattgttgcaaaacattctttactgtcatttttaacaggtttaattagcatataataaagtgcacatattgaaagtatatgatctgataacttttgacgtatgtatata

SEQ ID NO: 185718 - DNA, 214 bp, Homo sapiens
gttggccaggctggtctcgaatgcctgacctcgtgatccacccgcgtcagcctcccaccgtactgagattacaggtgtgagccaccacgcctggcccagtaaaggggcatttttgtcagaggtccctgagcctagaactaaacagctaattctaggtctgattcccaataatagtgagataactacaagagaaaaataccgtaccgaggttcat

SEQ ID NO: 185719 - DNA, 636 bp, Homo sapiens
tgttcgtggaggacagagcaggccacaagataggggccaggatcgtcccagcccattctggatgtgctgtaatttcaagtccagtgaggtctcaggaaagcctttttgaactgaccatttttcagaaattatcatcattctacaaacacagtaatatggtcatttgtgtcaaatgtcttgaccccagggcagtaaaaatgggtgggaattcttccccctgcctttctgtgttttctcagagcactcttatctaagcaagaaaatggacttctgtcttctttaacaatacccaggaaaagaagggtcaacgagaaatgtgcaaatattcgaaaggaaaactttcagggccagcatctaatcgtctcatctgatttccttctctgaccttcactgacttgtgttcccaagtttctcgcaaatcagaagtctaaatattatatgagcttatctcctcggtacaactgagcaacagagccacaaacacaggaaaatgggtgggtgagctgccaggtagccgttagccacgggagctagaacgtcagccagaactatgggccatgcgaacacgctcacccatcctccacccaggatgggacactaggatattccccatcagtcagcaacaggcagctcctg

SEQ ID NO: 185720 - DNA, 610 bp, Homo sapiens
ggctcaggaattcccggtttgttaaaatggtcaactgaagtctgggcccctgtacaatgacttcaagatcccactaggagagaacactttaagcctgttcccatcagcaagttctccaactctcccttctcccaacctgtgacttgcctccccgcaggagtggtccagcagctctacagagaagtcctgattacaaatggtgtgagcctcatccttcctgaatgttaggttgaattgtgttccccacaaaaaagatctattggagttctaagcctcagtacttcagaatgtgatgttttatggagacagtgtctttagagaggtaatcaaattcaaatgaggccattagagtaagctctaaatcagtatgactgatgtccttattaaaagcggaaattttgacacagaaacaaacaggcccacagggagaacaacatgtgaacatgcaggcagagatcaggggatgggcctacaagccaaggaacaccaaaggatatcagcaacccaccgagagagttaggaggaaggcacaggacagattctccttcacagtctcagagaaccaattctgccaacaccttcatctcagacttctagcctccagaactct

SEQ ID NO: 185721 - DNA, 505 bp, Homo sapiens
gcccctctatcatgcaacctggtggtcccccgatctctgggaggtcaccatattgatgccgaacttagtgcgggagcacccgatcgggatagcgcactacagcccataactcctggtggtcaagcgatcctcccaactcagcctcctgagtagctaggattacagacatgtgccaccatgcccagctaattttgtatttttagtagagatggggtttctctatgttggtcaggctggtcttgagctcccaacctcaggtgatccactagccttggcctcacgaagtgctgggattacaggtgtgagccactgtgcctggcttaaatgcatattcttaagtgaaagaaatcaatctggaaaagctatgtattgtatgtttctaactatatgacattttagaacaggcaaaactatggagacagtagaaaagctcagttattgtcgggttagaggagaggaggaaggaggaatgaataggctgcatgtgcatatagaattttcaggg

SEQ ID NO: 185722 - DNA, 520 bp, Homo sapiens
tgagtgtctgaagaggaaagatgtgtttcaaataaataatctcactattaatcagagaaatgcagattacaataataatgtgatatttttctttatccaccagatcggttataatgaaaggattggatagtattaagtattggagaatttgggcaatggctattactgtccattgttgataagggtctaagttggaggggaatttagcacatagggtgtaactgaacctccacatatgaccagcgattcctcttctagtttccacctagtgaaacacccatacatgagcagaagaaaatatgaacaagggtgttcactgcagaattgtttgtaagagtaagaaatctagagccatcctaaatgtccatcgacatggagatgataaataaagtggagtgctaaaaggatgagattatgtaaaaagttaaccaaaagtgtttgaaaagctgtgagcatatttttggttgccagataatgagggcagggagtcggggtgctattgttattttgtgagagggtg

SEQ ID NO: 185723 - DNA, 195 bp, Homo sapiens
taaaattccccgcaccaccactgccacattgtatttctttgtggttcactgactaaggatggaatatttcgaactcccagatgtctgactggctagaaaccatgctttttctctactcagtctaaagtaagctccaggtgtagtttctcctacagagacatcctgcagggattaggaggtgggcaggggatgaga

SEQ ID NO: 185724 - DNA, 430 bp, Homo sapiens
tctgaagatggatgagaagagggctaagaatggctaaagcttggagaataatttggggagtcacagtaaatcaataggatgagatagatgaaagaaattggctctaaagagagcattggaagttttagattgtcatatttaccaccttcagttctcagacctgatagttttcagtgacgtagccttttaggaatttcagaagtgtgattttaccttgaatttattagggctaaattcaattgtttatgtttatgcagttcataattttgcagtttagtttgtgtgggttagtggccctactgttcaactggatggcaaatctgtgctaggaggataccatatgcacaagtattttcttaaataatgttggcgtttgccactggtgttaggggaagaagaaaaaaaaatgagagcaattctggaagccctc

SEQ ID NO: 185725 - DNA, 134 bp, Homo sapiens
acaatttagtacagattccggttgtaggaagcatctcaatatttgttgctgtttttttccctgctgggtgcatatttttctgagtgttggtggttttggaattgtgatgcttttccagacattcacattgcatc

SEQ ID NO: 185726 - DNA, 459 bp, Homo sapiens
tctagacggatccccggagacacttacggaagacacacattaactataaggagccaggaaggccacaagtgaaaggatcaaaaaagataataccatgcagacattaattaaaagaaaacagttatagttaatatcacacgaaagagacctacaacaaaaagcattactagagataacaaggaatatttcttaacaagaaaaggtctaatttactaggaagacagaacaattctaaacattatatacttagcctaaaaatacacaaaacaaaaactacagaacaaggataaacagacaaatccacaatagtgggaaattctaacatgactctcagtatctgaaatacccagacaatatcattaatcagtatgaccctcttgttatatacaaaatgctacaactgacaaatacaaatatacattcttttcaagtagcgtaagtgtttaccggtgctgacca

SEQ ID NO: 185727 - DNA, 308 bp, Homo sapiens
tgaacacagctcactgcagccttgacctcctgggctcagctgatcctcccacctcagcctcctgagtagccaggaccaaagatgtgggccaccacacctggctaattaaaaaattttttttttgttgggattacagggactattatcttttttcaacttgaaatttttattgaaatataagatgtacagaaaagggcacatagcaccaactcagtacacatgtgtaaccatcactttatgccctcttctagtcacagtctttcaccaaagagtaaccccacctgacccagaacagcgtcaattagttt

SEQ ID NO: 185728 - DNA, 425 bp, Homo sapiens
cctcacccatcactgctaaaagctctactgtaaaatctattggcacacattcattcctctctattgaactgctacctcaccactactctctgagttgatttctctcaggcccctctactatctcttctacacatagctatcagaagaatcatttgcaaacataaatcagaccacatcactctttcattccaatccctccagtagcttcctgtagcactcagaataaaatctgaatgctgtaccacggcctataaggctctacatacctcattccagcctacttttataccgctaggacatggtatttttcctctacatcaccaggctctggccttcctggctgctttactgactggaaaacacaacaggcttgatcctgccctagagcctttgtacattatgtttcctttccctagaacattctg

SEQ ID NO: 185729 - DNA, 579 bp, Homo sapiens
aagcgattctcccacctcaggctcccgagtagctggggctacaggcacgcaccaccatgcccagctaatttttgtattttttttagagatggggttttgccatttgcacagactggtcttgaattcctggactcaagcgatccactccacttggcctcccaaagtgctgggattataggcgtgaagcactgcgcctggccaccatcagcttttttttaaggcagggagaataggaaaacacatattaatagagcatcttcaattgcctttcttttggtatctttaggaaggtcactagccagagttagagcatctgagtaattaagattgctgggagtggggtgaagggggacaataataagctccatatcactaaactgggtgtgatgaggtggagataagaacagtaggatagatgtctgcaacacacaaagcctcagtaagtaataggtaagcaataagcaataaggtagatgtgtgaataccagtgccgtatgctgggatgataacatattagcttatatggagcaggcctctcaaaaataaatttgctaattgtgtggcatatagaaaaaatac

SEQ ID NO: 185730 - DNA, 857 bp, Homo sapiens
gagggccctacctggggatttccaggtcatattcttgcaggctgtggccacacaacacttcaggaaggtgaatgagccatagcagctgatgcattgattagatttgttctttatgttgccaggcccagaagaacccagcagtaatctaaaacattaccttatacctagaatggcccaaaccaacagcaggcaatccacatcagcaggaaatccagcctgcctctctagccctgactttggaatgtggaacttaaagcacttcctatttcctttgagttgcagcagatcctttgctttattattattaggggcacttacaatgagtgtatggccctggagacatggcttacaagcacgctgtgaggcgtacaaaaatgagtcaaagcacttatgcttgccctgcaaaattcaagaaatgatttctccccactcagacactctaatagaactacattaacatttggaacttgaggtcatttcccctatttgtgccactgatccttgaactcacattctgagtacgagtatgtatcctgtatgctattaaaatataacttgaggccggacatgatggctcatgcctgtaatcccagcactttgggaggctgaggcaggtggatcactagacgttaggagtttgagaccagcctggccaacatggtgaaaccccgcctctactaaaaatacaaaaattagttgggcgtggtgggggatgcctgtagtcctagctacccaggaggctgaggcaggaaaatcatttgaacccgggatgcagaggttgaagtgagccgagatcgtgccactgcactccagcctggatgacagagcaagacaccgtctcaaaaaataaataaata

SEQ ID NO: 185731 - DNA, 597 bp, Homo sapiens
cccagacgagtgacagagtgagactagtctcaggaaagcaaaaaaggtaaccactgtcctgacttctgacactgtagttgattacttttgagggattgagagactgaaataaaatggtaacagtgaacatagaaacatagaatcctactacacacatcaaacattatgggattattaaatatctaaatttggaaagctaaccttttataagaatatcaaggaggctattttcatgaacttttgagtagggaaagatttctttagcaaaattcaaaacatgaaggatgaaggtataagatttgactgttaaaatttataatcttggatgcagcaaaagatactataaataaatacaaagataaaaccacaacctaggagtatctgtttggagtgcattaactgacagaatattagaatccaggattaaggaagaaaaagaagcaaatcagtaggaaaaaaacagcctaataaaaatatgggcagttcatagaagtgaaaatccactgggtgataaactttagaaaagataatcaatgacagcacttctcaaaataagacatatacgcggtcaacttgtctgagtagggatcctactag

SEQ ID NO: 185732 - DNA, 199 bp, Homo sapiens
atggagagagaatgaatgcagccagtgtgcaatgtgtcatgtcctctaaatgttcaagtccctcaagtcatagatccacctattttttctcaagttaatatctctacacctagttttaattccctgtcatgtatacaggactcacacattttatcttcaacttaggccttctctctccactcccccttctctctccact

SEQ ID NO: 185733 - DNA, 513 bp, Homo sapiens
aacagagtttcaggaagtctaaggaggccagagtggttggatggagcaagtgaaagactgaatggtaaaaggcagaaaaatgacagttgtaggcggtaactgactacacagaagatgttgcccaggctggagtgcagcggcatgatctcggctcactgcaacctccacctccgggttcaagcgattgtgttgcctcagccttccaagtagctgggattacaggcatgtgccaccatgcttagctaattttttgtatttttagtagagaggcggtttcaccacatgggccaggctggtcttgaactccttacctcaggtgatccgctcacctcagccccgcagagtgctgggattacaggtgtgagccaccgccctccactagaatttaacctctcaatctccttagatttccaggctcctaaataacatcagccaacacagtattgatgtgatttattaaaaatttgattttcagctccaaacataggtgctttacacaattctatttgtttt

SEQ ID NO: 185734 - DNA, 324 bp, Homo sapiens
agctctgcctccacgggcacccccatcttccctagtcagtatttgcatgtggagacaaaggtataaggatattttattagggaaaatgggaggagatagaaagaagagaaaaaggagaaagagaaggttagagaaaaggaatgggagaaagtataaaagggagaaaagataagagagaaaaagaaaagaaaaggagagaatagaaaacagcaagaaataaaggaagaaaagacaaatcttatccactagaagaaaaacaaaaacaggaagagaggaagaaaaagagaaatggaaaagaaaacttctttaaggggatagttttcc

SEQ ID NO: 185735 - DNA, 300 bp, Homo sapiens
cacaacactggcccagattcttgcggtgggattaagacaagataaaaaatgttgagacgtaatcattggaaggaaaaagaaggtactatttttatgttagagaataatgttatttacttataaaattcaaatctgcctgtaaaatttgaccaattgaagtatgttttaaaattatcagttcaaaaaattggtttcatacaaaattggcacatgaaaattcatagcattactatttaagagtcttttataaaatgtagccaaaatgtttcattcacaataacaattgtgtgcaaagaccag

SEQ ID NO: 185736 - DNA, 254 bp, Homo sapiens
cattttaaaaccattttttcatgcattgactatgccagtaaaaataattttgaagttttttttccagaaatctgaggttagcaagaaaagaaagaaatcaagaaaatcaatcataccatagtgttttatataaaaatacatcactaaaaagagcatttactctgtgggaaattatcttaggcaaaaccggttgctaaataagtcaaatctatcaaattcacgtgtaatgccagcatgttgccttctagggctta

SEQ ID NO: 185737 - DNA, 658 bp, Homo sapiens
cgatcgtgacataggtaggtatggtagacaaaataaataataaaaaaaaaacaacccatgctctgaatccttctggtctatagctttgggttcaaaaagcccttttcctctcagaaagctaactctgaaagccagaatttcaagaccatactctcttctgtgaattaaaaataattcgattgtgaaatcaggtaggtagatgtccacaacaatatggaagattcctcagatataaaatttttgaaaggggccaaacagtggtagtatgttcccatttgcttttcttaaaaagtgggtaaacaatgaaaacaattttcaaaagaatatgtgaaactttaaattacagatatagttaggaagagggtaaaataggagaaatttgtaggggatatttgtcatcttcaggctgttaggcaaccaaaataccatttcaatttggagataatttcaagagattagaagcagatacttctttcctcatctttctcttaacacatgtacaggcctgataccaactattaatagatctttttgccgtggataccgaatcctagtgaggacaaggtacaggagagtcagagattattcctagagatcaccagaggaggtgagttaatgagcagagtcaccagtttcgaggcatagtggcagcagctat

SEQ ID NO: 185738 - DNA, 642 bp, Homo sapiens
ttaagcacctgccctgggtcccaattcacctcctctacaatcacctcttgaagcctttggaataaagtttccctaggtccgcatcaaatttccttccctaatttttggcactgtccatatcaactcagtgcagccctgcaagtactgatcacacacgtactatgtatgtgtctaggaccatgttctgctttctgaaaaatggtatggacaaggagcttagggtcttggtagctgtgtttgggacatcaaaaataacataaaaaattgaggatgaaggatcaagtatagtgaggtgaaaactgagcatcactgaatcaaaaatgtatgatttgaaagagggctgcagcaactcaaggcagcctgtagggaagtggtctctggactcccggcaggctgggttcaaagtctgactttgccctttactaactctgtgaccgtggatgtttcccttaaccaccccgggcttcatcttcctcatctgtaagatgttgctaataataacatgtatctttaaggctattgtgtggactaggtgagaggtaaggaatttatttagctcagtgcctggcaggtaggaggcactgcataaatgtcagtgaatattattgatctccacactcattctcagcacagagccagact

SEQ ID NO: 185739 - DNA, 592 bp, Homo sapiens
tgacattagggcaggatatgaacaataccatccccttcatttcactccatatgctaccctcagaggaatcttcttataatgcccctctttattagccatcaggcccccttttgcctccagcccaaatatatcataccattcaaggacccccagcattggaatctgtcctaaccttttaaatctgacctgaactttcacctgtagccagtgctagtccacacactgtagaccgtctcgtcttgatcatgtctcccacacttctgcttcctccccttggtacactcccttctcctctctgcatctgcacaaatcgtattcatcctttacacccagctcaaatctcttgactaccccagcaagtagtaatatcttcctgttctaatttctccagatcttgtctgtctgtgttacatattcagcttttccaagggttctttatttggcaaactatttttgcctcatctagattgcattcaagatttcttacatattttctatcttttcctctctctttagtaaccctacacatgctaaatactcaataaacatgggattggttgtaattattagttcagtaatatcaggtgcttca

SEQ ID NO: 185740 - DNA, 264 bp, Homo sapiens
tggtattgagaagtccaaagttagtgatcactaaatggaactgggagagcgggtgagaagaaggaacatggtgttttgctattatcacaggccgttgtgtgtgcctggaactacaagggaagctacataaccaggcaatataggaaatctccactggtcacatcattttgccagctctgcaagactattccgtttcatattaattaaaagacactcaaggaaagaaaatcttactatgacaaagagagaaaggagagcctcatg

SEQ ID NO: 185741 - DNA, 157 bp, Homo sapiens
tcaacatccaagtatattctgctttaatgagagaggctaaagagcatgacatgggaaagtaacagaattcaccaggagggattagcaaagaaggggcggggtcaaaggtgacttgagagccacataggagagcttttggagagaatcataaacctaa

SEQ ID NO: 185742 - DNA, 209 bp, Homo sapiens
gaacatggctgtacaatgtggtggatgcacttaacaccactgaatttttcctttgaaaatggctaaaataatagattttgtatgtattttaccacagtaaaaaatcaaactggccggacatggtggcttacacctgtaatcccggcactttgaggctaaggcgggtatatcatttgaggtcaggagctcaagaccagcctgtccaacat

SEQ ID NO: 185743 - DNA, 187 bp, Homo sapiens
ttcagaggcgtctagcctgaagaaacatcctacccagaggctagaacatctccaactatctagaagatggccataattatttggttaatagccacctccaccactgaacttctgcaacttgcctctgatgaagctgttccaataattgttcatttcttcacccattcttttgctccaccagtatttc

SEQ ID NO: 185744 - DNA, 121 bp, Homo sapiens
acatacacgcttcccttctcacacctatgcattaaacagaacatactcattctctcctcaagaaagacaaccctactgtctcatccaattactgcaaacagctttaaacagaatccctggg

SEQ ID NO: 185745 - DNA, 278 bp, Homo sapiens
ttgcgaggatttagaaacgacatggagtagcttttaaaaataagattccaagctgggtgtggtggctcacacttgtaatctcagcactttgggaggccgaggcgggaggatcatgaggtcaggaatttgagaccagcctggccaacatgacaaaaccccttctctaccaaaaatataaaaaattagccgagtgtggtggcactcacctgtaatcccagctactcgtgaggctgaggcaggagaattgcttgaacccaggaggtagaggttgcattgag

SEQ ID NO: 185746 - DNA, 415 bp, Homo sapiens
aggcaagggagaaaggaaacgcaagaggctgaccacagccagatgagagcacaggccatgagaccaagacatactctagaatgcggcaagtggacaaaagtgagatgcgaagtttaggaatttcccagacagacgggggagaaattggttcggccaacagccattgactgactcctgtgccaggcactcgtgggtgtgacgtgaacgacgacaaaggacggcccgtgccctcgcagagcagacgctctaaaggagacgcccaaccaaagcacagagagatgcaggcgaccgcgtcagactgtgacgagtgctgcaaaggaaaccaggcaggcaagggacaaagggcaaaaggaaccacatcctaattttatttagggcagcaatgagcccacactcaagcgcgtgctctctctct

SEQ ID NO: 185747 - DNA, 508 bp, Homo sapiens
ccaagctgctcacacctgcaatcccagcactttgggaggccgaggcgggtggatcacgaggttaggaaatcgagaccatcctgggcaacatggtgaaaccctgtctctactaaaatacaaaaaattagccgggcgtggtggcttgcgcctgtagtcccggctacttgggaggctgaggcaggagaattgcttgaacccgggaggtggaggttgcagtgagctgagatggtgccattgtactacagcctgggcaacagactgtgactccgtctccaaaaaaaaagattccagtttgttattttctatgctgaagtgtaattcgagtgcattgtagaaacttttgaaaacacagtagtctgttgagaggctgttgttgcattagtgattctcaattgggtatcacattggagaagaattaagcttttgggggcccaggtactatggttattgtaatttcttctctgtacctcaccagatgcttggggaaggtgtctggttgtttataggc

SEQ ID NO: 185748 - DNA, 446 bp, Homo sapiens
tctaagttcacttagaaggaaaataagatgatcagaacaatgttttaaacagtgaaacctggactggtctttagagttaaagtaattaaaacattgtggctgtagcatatggagacacccacagaatgagacagaataaaagtccagaaatagacccaaatacatgaaagaatttagtgcataaaagcagaattccaaatgcatgaggcaaaatgaattatttaaaaaatcacgtggggcaactgggtatcatcagtgcggcgggtcgggggaagctgcatccatttctcacaacttacgccaaaataaattccaactaaattaaagacttaagtgtatatataaaaaaagaggaaacatccaatggctagaagaaacatgggaatcaaaaaatacatattgacgaaaaacttctccaagtataaaaactacctcagaggttctta

SEQ ID NO: 185749 - DNA, 267 bp, Homo sapiens
aaaacctagtaccatggtctttggctcgggtgcctgagagacccgattcaaatcacattgtgcgagtgttctagagtgagggccggtgggggggaatgtaaccggaaatgccggcaggcactctggggccgggataagtgggatgttcgtttgattagatgcctcccttctggttcctgcgttgcccaccagtgtcccctcgagggacagtgacgccatcagcctgcctggcagccaatgtgacccctgccaccagggaaaggtcgg

SEQ ID NO: 185750 - DNA, 661 bp, Homo sapiens
ctttttttaaaactcacagatggactcaatagcagaatggaagtgacaaagtgaagatttagtgaacttgaagacagaacaaaagaaatgactaacctaatgacagagaaagaaaaaaaaagcagagcttcagatttcagagtttcgctcttgttgcccaggctggagtgcaatggcgcaatctcggctcactgcaacctccacctcccgggttcaggacattctcctgcctcagcatcccgagtagctgggattacaggcattcaccaccacacccggtaattctgtatttttagtagagatggggtttctccatgttcgtcaggctggcctctaactccagacctcaggtgatccacccgcctccgcctcccaaagtgctgggattacaggtgtgagccactgcgcccagctgagaacagaggtttaaggagttatgttgattcctcaagatcaagtggcagaatttgaatgaaatgaaagcagtttcgcagagatatctgcactcccatgtttattgcagcataagtcacaatagccaagatacagaaacaacctatacaaatgtggatgaataaatggatgaagaaaatgtggtatatatgtgtactggaaacacatatatacttttaagaaggaaagaaatcccgtcgtttgtgac

SEQ ID NO: 185751 - DNA, 247 bp, Homo sapiens
cgaccgtctatagaggatccccgcgttcggccaaaggaagggacatgcgacccaaaggccactgcgcatgtgggcagtgtgtgaggattgagcaccatgaggtgtggccagagtgagggaactgaagggcagggctgaaggtcagatatcaggcccaattcagagggagcaagcctctggcctctatgcctccatgtgactccagaagacctacagagagcaccacacagaatccccagatacctga

SEQ ID NO: 185752 - DNA, 580 bp, Homo sapiens
ggacccagggtccacttcaggataatctgggcaagggagcttcccaaatgagcctgtagaaagccagtggaagggcttaggttggctaaggtgggatggagggcaaaaccctccccttcattgcagagtataggggcagtggcagagaatgaatgtatgtgtgggtttctcagccttgaggtataaggtctaaaggctctggggattcactgcatacaccacttccagttcaagcgcctaggttggttacagcaggaagttgacaagtatgtatttagtacattcgatgtttttaggcatctgctaaaagtaggtcaaaccactgaactcagggagggggctggggatccatttctaggatgctgtggaatccttttgggacatctgtagtataccacgttgggtagtgagagttgggggacaccccttccattgctgctgcttagtgtagggagtcatgtctttgggcagcagtaatattattaagaaaagctttttttttttttgagacacagtctctgtcacccaggccactgcactccagcctgggcgacagagcgagactccgtctcaaaaaaac

SEQ ID NO: 185753 - DNA, 492 bp, Homo sapiens
tcaagttaggaaataatttgatccttttgaagcttgcttctaagctatcagagttggccaagaacagtcatagtcaaaggctaatttagtctccctaccgaagcagtacctttctgaatactccaccccatgccctgtaaatgacaagactcttctacactgggtgatagaaacgcaagctgcttgaggcctaagaaatgcttcctatgttcatttcaggtggctttttccccagctttgggtggtttctttccatgcagaagctgatcaatattctgctgaagactcaaaggggaccctctgcagatctctgaacttgctttgtgcagctattttcttctggtactctgccctgtgaactcactacctgggcctctccggactccaagaagctctgtctcataactcagggagaccatttcataaaggatgccactggacttacaaagtgtccttgtagctcactgtgaggagtgcccaactgtagtgatc

SEQ ID NO: 185754 - DNA, 578 bp, Homo sapiens
tagagtggtcatgtgaggggtgggcgctctgccctggcatctcgccaagactacagctctaggatttcacatcatcgtcctgtctgtgtaccatgtgctggtagcgatgaagtaacctgccaaaagtcaagctaggtttccagaggtggcctgggtagaaatctgtgcttgccactctagccactggcttccctggagagggtcaggatagggagagcagggtctgtctcttgccttggctgagtcacagcccacacttcccaagtagccaacgctcctggagcctgtgctcaccctggggacaaaaaatagccagtatcgccatgccaatttggagcgccctcagaactttacattggggacctgggaagaggctaccacactgaaaaaaatctgaagtctctttaggggctgttatgaagcaaggttagcaaatgcagcactctcactcatcactgtagaaaagtgcttaacagggccgggcgcggtggctcacgcctggaatcccagcactttgggaggccgagacaggcacatcacctgaggtcaggagatcgagaccatcctggctaacacag

SEQ ID NO: 185755 - DNA, 131 bp, Homo sapiens
caggttcaagccgaagtcgaagctagagatgtgctatttgtgcctacctctgaataatttaacactccctccaaaatagactatcattagaatttgtcaattccagtgcatttgagcagagaacctcaacc

SEQ ID NO: 185756 - DNA, 341 bp, Homo sapiens
tctcctgattgtttcctttgctgtgcaggtttttagtttaatataatcccatttgtctatttttattgcctctgtgttcaaggtcttagccataaaatctttgcccagaccaatatcctgaagcgtttcccctatgttttctttgattagttttatcgtttcaggtcttacatttaagtctgtaatccaacttacttgagagataggggtccaatttcattcttctgcatatggatatccaattttcccagcaccatttagtgacgagactgtctctattgtatgttcttggtacctctgtcaaaagtcagttggctgtaaatacgtggacttatttctgg

SEQ ID NO: 185757 - DNA, 196 bp, Homo sapiens
agtctagaggatcccgcggctgtagaggtggtggaggagagagagacattggccaaagagaatagacaataggagcacctggccagtgcctgcccaccatgtgcttgttcctcttgggggtggttagtggttttctccttaatctcccatattctttttcactcacctgcagcctggtcccagctcacctgcccag

SEQ ID NO: 185758 - DNA, 332 bp, Homo sapiens
tgtgtgctcctgtggacttgggtagaagagtataggactcagcagttttgggggcccagagtctctgcacccactcccaggccttcccacaagttaatttatgtttctcatgtgaagagtttccacttagagagtgaataaaagcaacagtggtatcatgaaaactatgctggtaaaaggcccctggacttggtcatttcaagggatactaagttacctcatcttttgcatttacccacaagttctattgatgctgtatctgagagatttcacatatatccccacttcaccacctccagtcattctgcctgacagtcaactttcacaatttc

SEQ ID NO: 185759 - DNA, 247 bp, Homo sapiens
tacaagaaagaacatcaggtagactaacaatcaagaggctcatgtcagaccaccactcagactactgaagcctccaaattgtgcagatatttaatcattgtgaaaatcttccttccaggaggaataacttcaatccactttggatcacccaagtgctcttagaatttcaaggattttatgagcttgtctgaaaaagcaatataagttgtttcatatgttatttctttgttcgttcttgtggttaggt

SEQ ID NO: 185760 - DNA, 233 bp, Homo sapiens
gaggctgatggcgactagggctgaaggtctaggggtatcttattttacaatcaagggatctgaagaaagagagtttgtcagaacaggacagtaactgccaggcttctagggtaggagataatctccaggcgtaaggccattttatttccaggagctttgagcagaggctgctgggcagacacagaatgtctaagataagagatctttcttatctttctcccattcaggcacgc

SEQ ID NO: 185761 - DNA, 418 bp, Homo sapiens
caagagatggtaaggaggcttgttggagtggcccatgtgagaaatggattccaacttaaggtgcggatggggtggtggtagtgaatggattctatggattccctatctcactggtcactactcagtatcctttgctgatttctccaggtcttggatgtcagacttcatctctagctgtgttcttccctgggtgatctgatccaatcccatgattttgaatatgatcagcattttagtcctgaatatttctaggccccaaacctctcaaaactcatattcaacatcttgatatgaatttctcaatattccaagtcaactccttgattacccaacaccagttgttcattcatccagttgctcagagcaaatgttttgggtgccatcttcaatgtacttttataacctgcatctaatcctt

SEQ ID NO: 185762 - DNA, 169 bp, Homo sapiens
ttcaaaattgaagagcaaaaacgacctaaggcagctacactgtacagtgcctggcacacagcaggtaaccaataaactgctgttgatcagatgctggactaatacgtgtaggtttattttcttccttcaacacgctgtacctgtgttggatacaaataaggccttggga

SEQ ID NO: 185763 - DNA, 363 bp, Homo sapiens
gaaaatgagagagcaaaggacttcgatgtctgggaaaagggcacaccaggcttaggaaaacggagagaaaatatccagaggtggaaacagtcctggtgaatggagtgagggagcaggacaatgagggggagggatgaaaagggaaggatggcccagagaagtgccaggaggagccctgggaaattgtagtcaggagacagtttgtgctttgatttttatgttaaaaaatgactacgacactgaagaatggctaaaataaaagtgttggtgaagatgtaaaggaaccagaatcttcgtatcttatgtgggaatatgagtcaataaagccacttgggaaaatggattgacagtatctactaaagc

SEQ ID NO: 185764 - DNA, 215 bp, Homo sapiens
cttcaccccataatgtaaatgagtatcgaaaaaaaggaaacaaagtaagccccgtcacacggacagtaagagaaattctgaactccaggtctgttccaggatgagagccatgtccaagattctgcattctcttcttccaaccactcctttcaagaactcaaaatgccagtcagtgcaggtaaaggaagatgcacatccgccggttgccaatttct

SEQ ID NO: 185765 - DNA, 143 bp, Homo sapiens
ggaaaagcattagcaaaggtaaagaggaacaaaagttcattttggatcaggatatttgcagttgaaactggaacataagatgagaagtggcatgtagtaagaaattagaccaaagtagtagtttggaactagtttggatttta

SEQ ID NO: 185766 - DNA, 384 bp, Homo sapiens
tgggggttcttcagtgttccatgggtcattctaaatttggcatttgtcccttcttttaccttataaatgtttttaattgctcaagagtgctacatgtcatgaaaggaattgcctgggtgatgtcctaaatacagaaataataatttgcttgaaatggaaaaatagaaatatcacctcttatccaaagtacttctcttgggcttggccatgtaatgactctccaggtggaactgaattatcttctcatttggactataaacacaaccataataaatcatccaggcagtatatgttcttcatttcagtagttctggactttgaaactgtctttattgtttaaatgttggcatttatttatgaataaaactctctccaggcttttca

SEQ ID NO: 185767 - DNA, 284 bp, Homo sapiens
caatcaggagccttttaaatgcattgagtttgatttgcatcttgaacctgagtcttctgtggcatcctctgcccaatctggcttgcaggtgctccactttagctccctgtgaatttaaatatagaaactttatttgtgaggagctgcttccttcctctcacttaacacacaattttccaatgtaataatccagttttgggcatttgattttcataaaaactttccatgtctcagcttgtgagatatgtgtcttgagttctcaatgtaaacactttgccagtctg

SEQ ID NO: 185768 - DNA, 452 bp, Homo sapiens
acctattcagtagagtatttcaataatcattattgaaatctgactcttgttttctgaaacccagaaagcaggttcagtaagtgcacacgcattggtaccagggccaatggaagaagtatgttgatgtttatattttaaagtttggaactagaaacttgccttctactgaaatagtcattatagttttgaagctgatgagtgatgtgaggaggtgacaggagtagggagaaaaggtactggaaggtaagaaatactaatctttatttgataacggctaagtggacgatcaaagataaagacattgtagtacatttctcagttgttaaaaccattcacataaaggcagacaacataaatctatggaagggtttcaagaccattctaggggaaaggacagattcactttggatttggccatgatttcctgaatgtgacatcaaaagtacaggcac

SEQ ID NO: 185769 - DNA, 287 bp, Homo sapiens
acactggaggtttacactgaaacatgagagttaagtctccaagtaatgctgattatttattcttaatgtatagcaaggcttctgtatgagcagagtcctggcatttagaaaaaaatcttttgcggaaatatcaagatttttgtaatagggagagcctctgtggtttgaagtttgtagagggagtgcagttctatttttgaaatgtatccaggacttccaacaggtagagtcacagagctccatgtgatcaaatcagattcatcatgaattgccagtagtaagatgag

SEQ ID NO: 185770 - DNA, 298 bp, Homo sapiens
aagacgaggtctctatgggtgcagcacaccaacatggcacatgtatacatatgtaacaaacctgcacgttgtgcacatgtaccctagaacttaaagtataataaaaaattttaaaaaaataaaaaagaagaaattagccagacatagtggagcatgcctatagtcccagctactttgggaagctgaagctctgggaggactgcttgagcccaggttaagggtgcaatgagccgtgatcatgccaccaaactccagcctccacactccagcccaggcaacagcaggacatcctgtctca

SEQ ID NO: 185771 - DNA, 369 bp, Homo sapiens
cccccaatatgcagtgccttacatcaaaacagctaccagcattaacgtgatgatgagaaatactaagcacattcacatatcaacagggtctttctggaagcattggtttaactgtcaggagtgatgttgaatgttgagaatagcgggggctgtggttggctgctgggaaacttctgtggggatggtcctgtttaatatctctcagatgacaagaactgtcaattctacccacagggctggatgtatcagccctctcacccccaaatttccataggactcttctaccctaatcggttctaatgtttggatgtagtcaaggacactcacatttataatatgcagttagatgcaaagaaaaataattctgta

SEQ ID NO: 185772 - DNA, 433 bp, Homo sapiens
gattacaggtgtgagccaccgcgctccagactatagttgtctttaaaatgtcttgtgcttgctaaaatgtagaatctaagacctcattggcagacagactgattgagaaatataacccaggtttctgtattttaataaccttcctcaagctgggcgtggatgtgcacctgtggtcccaactactcgggaggctgcggggggaggatcgctggagcccaggagttcaagtccagagattgtagtgcagatcacctggactacactgggaaattcctctatgcctgcagtaaaaatcagccatgagagagtcccctatcctttctgccttttcttccttctgatctgcaggaggggtttatgtgatagaaggcagcttagcattaccaggtctctccctccttgaggagagcaggtgttcgggagccacactcag

SEQ ID NO: 185773 - DNA, 293 bp, Homo sapiens
gacctccctaagaagagtgaaatgattggcacctaatacagagtcaggagaaacacttggttaattcatgctgtttgtcaagtgtttctaagtctcccttcctctgggcacaggctttttcatttagtggaattaactgactagctctggccctgagtttgcagagtgaataaatggctgcacatcttctgtatgaagcatgaagtgaggctatttgctatgtagggtcctgggaagtgaattagcaatatgagggaagggagtgagaaggcccactgtggaaaatgtgatgg

SEQ ID NO: 185774 - DNA, 646 bp, Homo sapiens
gagcaatctccaagaagagaggaatgatcccctagatgttatcagaacctcacaggagctctcattcaagatttaacctttcttttcttcagtttcttcatccatgtaaagtgtgtggtacatattacccattcaacaaatattacctgccatttagccaatacttactgagctctgactatatgtcattagccctcgaagcctttttagagtaatgcaatgtataggtcaatgaatctctgattaggcactgtggctttcttttttctctctgtctttctgagtttgtgtgccttctctgggtggtacatccaaagcaggattgtatgagaataactgaaaacccatcctaacttgattgtcctaccctcaacacctatcagaagaggtagcctttaagacttagccatagtttttccagaattgttttgtaagccagcacagaaaatgactgatgtcaaaactgcattttctgaaaagcaagtacattgttgcagttgacctagatgtatattcacttttggcccatcaataaaatcatgaggcaaagctgacgtgtggtacaaatcttgtgcggattccagttaatggaccactgcatatataaaaccttttcccaagaatttttgtgttagtattttggtta

SEQ ID NO: 185775 - DNA, 357 bp, Homo sapiens
aatcccagatatttgaaggccaaatgttgttctctctgaaagacaggacattagacaatttaaacatcagcaaattgagttcagctatccttagtcactgactgatgactctattcctatttgtacatttttaaagtaatacttatgtccttcctggaagttctttttgcattccagattacgacagggactaaagtacaacaaagaaaaaacgcaaaaagtcaagtgtcaggcagaataagatccataagcatacatatatgtaagtctgggtcaaattcaccagggtattaatctttattttaaaattacaagtaatatttatcaaattttgcccaaagtaatttaattctggct

SEQ ID NO: 185776 - DNA, 380 bp, Homo sapiens
gtggggtggggtcggggagaccataagagggccctgtgctaggcactctctcccctcctttcaaactctgcctcacaagcctccagtaccccttccacagattcaaaaactgagcctcaatgggattaggtaactgttccaagaccccacaaaaatgataaatggaaggagccaaaaagtcaaaatttggtctgatcattaagtctcctcttttgaccaggctctacagcctaacaaaatccctcaaatacagcagtctgtagaaaggacacagccacctggtccccacagatgccactgatgctcaggtcagaatcctgtgccagtgatgcaggaggcatttctagggtttcagcaacaggtgtttccagtggagaaag

SEQ ID NO: 185777 - DNA, 660 bp, Homo sapiens
ccagcactcttttcttcatcctcatggtcaccacactagctcaagccccagtatctctttcctagatttactggtgaagcttactaaattcacaccctcccatccttcatgatgcagattcagcaatctcagaaaaatgcaaatctgtagtacatgcatatgacggaacattatacagctatgagaacaattagcaaccacagtcaacaatatggataaatctcataatcgtaaggcttcacccaagtgaaaacacattgcctgccctcacagctaaagaggagtgatggtgggaaagtggaagtgatcagaacccaatctgaggtcagaaaacaaaactacaatctatttcaggttgcacaaatgaaattttaactgaatctgagggacattagatttaatcaaaccaaatgagaaggcaaggtggtgttttgagctaagggcacagcagatgtaagagtcataaaggaagaagaacaaaacacattcaagataaaagacacggagagagggaaagatgacactgtacggtgaaatatcttgcaagtcaatattagatactagcctttgggctttagcttgagaacagtgggaagacattgacgctcagatttttttttctaaagttttttattaatgcctaatacatatagaagcatt

SEQ ID NO: 185778 - DNA, 284 bp, Homo sapiens
cacacgccaaaggcttccctgaatgaagagggtggctagtgagaataaaggtgagtggggaggatgtcgccttattttgcgagatttggggaataatcgtgtcttagagacattacattctcttgcacatgaagtagcccctccagggtgaaagatcaggaaaatcagtggaagaaggagtcttgagaagaggtagtaggtatagcacaaagccagaagttaggagctttctgtctagtcccaagggcactaatacgctatgtgatctcaagtccttccccctc

SEQ ID NO: 185779 - DNA, 220 bp, Homo sapiens
aggatcgcctgacgcgggcacagcgtcctccaagaggccaccttgctgagaggcagacttcccatccacaaaatgggatgacaaaacggctcagagttgaaaccacttctccaaggagacacaactgctgcccgcagagctgaagctcctgacccactatcaaatttcaatcatttatttgcctaccccctttatgatttttaccacccgttacttcaac

SEQ ID NO: 185780 - DNA, 718 bp, Homo sapiens
gctgttctagaggattcccgatcgtgacataggtaggtaaggagcgcactatgtcaggtgtggtcagcaggatgccatgttgctgggcacttttaaaacctccattctgtgactggctgcagtggctcaagccatgtaatcacagaacctgtgggatcacaggagcgagccaccgtgcatggcctacatgactccatttctgatatgtgacatttgattgttgccatgttaaaagagccccacctccccttagtgcacacttttaagcaacctggataaaaaagtctacatgctccttccctttgcaacagcaggagagccaaactcacacccctagccagtagcacggcagaaggaggcagtccaaggcaatgctagttggcattataagctttcacttcgcaggatagcgccatctcaaggcaagcagtgagagtcgtcagcactccactccctgcagccctctccaaagacagatcaaggtcacaaaacttaaaacaagagcgcttcaaggacatttggaacaggtaaaatagagacctacctatttcacaatctgccctctgcatattcctttaatttttagcatatataatatctgaaataaatgtaaattggtgagaatatgtcttagtatgaaattaaacctgaaaaaatctagaatattgagatattatgcattatttatgacttcctacttactatgtaagcaaccaaa

SEQ ID NO: 185781 - DNA, 725 bp, Homo sapiens
accactacatcattgcaaatctggtaggtgaattaattggtatatattattttactagatatgcttatttattaaaaatttaattttgaatggccagcatttatcagtggtgttttaaaaaatacagtttgattgtaattagccaggtgtagtggtgggcacctgtaatcccagctacttgggaggctgaggcaggaaaattgcttgaatccagaaggcggaggttgcagtgagctgagatcccaccattgtactccagcctagtgacaagagacaaaccctgtctcagaaaataataataataaatatagcttgattatatttgatatattagatatattgctgcaattatgttttagaattgcttcccactttgcatcttctaatcaatttcttattattataaatgatataagaatttatagaacaatatttgacaagcttcataaattgtcttagatgctgtattttaagaaaagggaaaattctcaaaaatatttaaagtttaattgtccacatattcccttgtctctgtttttcactgtctctattttttataaactctgccctctgcatattcctttaatttttagcatatataatatctgaaataaatgtaaattggtgagaatatgtcttagtatgaaattaaacctgaaaaaatctagaatattgagatattatgcattatttatgacttcctacttactatgtaagcaaccaaa

SEQ ID NO: 185782 - DNA, 380 bp, Homo sapiens
aaaagcccatgttcccaccagacagcccatgcctgtacttcccgtcgtactgacatgtcagatcctagaatgttcttttcctccccacactcactcactctctcaccttaaacactcattctcagagcttttcccatctccttgccttccccagagtatgtcaggatctagatgtattctaacactattcctcatacacggaccacaagtgtaatcctgctgtcacctggcagcccatgggtgctctgcgaccgtagggagcaagtctgccttgttcattcctgcctcgcggcacagcacccaccgtgcagcagccatgcaatcatctgtttacttgtcagtctaccccatttgagtgtaggttccatgagggcaggggc

SEQ ID NO: 185783 - DNA, 391 bp, Homo sapiens
taacatgaagcagatttcaagagagaaacagtaagaagaagttgaaaggtggttaacaccaaattatggaaggtaccagagtcctgactactgatcattatctttcagaaaataagaaacaaaaagtttcagccgaagacagcttgggtgtggtggctcattgctgtaatcccagcactttgggagggtgaggcgggcagaccacttgaggtcaggagtttgagagcagcctggccaacacggtgaaagcctatctctactaaaaatacaaaacaaacaaacaaacaaacaaaaaattagctagacgtggtggcaggcacctgtaaccccagctactcgggaggttgaggcaggagaatcgcttgaacccaggaggcagaggttgcagtga

SEQ ID NO: 185784 - DNA, 541 bp, Homo sapiens
tcccgggttcacgccattctcttgcctcagcctcccaagtagctgggactacaggcgccgccaccacacccagctaattttttgtagtttcggtagagacggggtttcaccgtgttagccaggatggtctcgatctcctgaccttgtgatctgcccgccttggcctcccaaagtgctgggattacaggcatgagccactgagcctggccgggatgtgatttttaaatcgaggagaggacttgaaagagttgagggaggatcccctgggttgtgcatatggcgggaaggggtattccaggagtggaggatgtcagcagggtgggaatgggatcagtgaggggaggaggagcagaggagtcagaaggatctaagggtagggctgaaggtgggaaaacaacctgtagggctgtttaggacacggaaagggccttgactttgctgccaacgaagatgtgaaggctccaggcaagggtaacaatctaacttacattttatgagggtcctgtggcagctgtggtgagaacagactttaggggtgctg

SEQ ID NO: 185785 - DNA, 203 bp, Homo sapiens
gtgagcggagatcgcgccattgcactccagtctggataacaagagtgaaactctgtctcaaaaaaaaagaaaaaaagaaatacctgggaataatggtccccattctgttacccttgctgggattacgggcatgtgccaccaggcctggccctgccatagtttttccagtcacctgttagttggcacaagtgcttccttttgta

SEQ ID NO: 185786 - DNA, 205 bp, Homo sapiens
acaaaccaataggatccctgtcctgtgtgttccatgcttagtgtctgacatatcacatacgaaacagaatccacatccagaaaaatctccatgtgcactagactaaagctatctaaaagcagtcatttcattttgattcctaggatgtccaggaaataaaatatgtgtattttcatgaaatgaatgaccttggaaatatcaagta

SEQ ID NO: 185787 - DNA, 201 bp, Homo sapiens
gcacttagccaggagaaatgacagaacttggtgagtggtatgcgaaggcaagagaaagagatctagaaagaatacagaatgtgcacttgggcaaacattgatgctaccaaccaaagtagagaataaaggagtcgaaaccagaagagaaaaagttcagtacaaggcatatgagtacaaaaagactccacccaagtggaaatg

SEQ ID NO: 185788 - DNA, 335 bp, Homo sapiens
tgaaagagaagaagtggccctgagcatttgtgaggggagagggctccctccctcctagccacctcctttcccaagaagcagtgctggatggagaaaggcccatgtttactcttctagaaattccatctctgcccccacaccacatcctgctggggtcatctggcatctgctctcccatgacaggctggcatctgacaagaccccttgggcagcatgctagactcagctaaagggacagcactcaatggtgactcagtggtggcccaaccccaggggtcttcctagtacacttcccagcagatctggctcccctgctccaagcaaagcagctgggg

SEQ ID NO: 185789 - DNA, 429 bp, Homo sapiens
tttttttttctgtgagcctacctacctaggttgggaccactcaggtaggatgttctatgatgggcaccttggggcaccacggtgcaaaggacaaagcactggctgctgggagaataggagaagcagaggctttggaattcgacctacttggctccgtggctcatgcctataatcccagcactttgggaggccaaggtgggtagactgcttgagcctaggatttcgagattagcctgtgcaacattgtaaaaccccatctctattttatgaaggaaaaaaaaaaaaaaattataggaataatttcaaacatcagtgattgcagtaaaaataaacttattaaatgacacgtttagattgtgttccaaaatttagctaaaactagctaaatcaaagaattcaagataaaaagtaatcagtaggacagatagg

SEQ ID NO: 185790 - DNA, 516 bp, Homo sapiens
actggacggaggtggcaccggtgggagaccaacagaggaagccctcctcccggctcccaattctggctttcgctagaagacaagagaaatgaggaaaacagctaccctaggaaatagccttccttgaaaatggtttcctttttctcaggtttgatgaatttggggatttgttgttgtcattttttaagtaaaaaaaaaatgccccaaacattagcgttcattatcctagtctgatttgggtccggctctacctgtaggagatgaatgtggtaggccagggggcccctgtggattctaatttatgttttcagttgtttgccattttgtatcttcattacggggctactttcctgcctccctaaagtcatctttcccagcatgctgtttctggactttatttagtaccgtggttacctcctgcaggctgtgtggccccatccttcaccaaaatgtcacctcaattaattcggcggccatgagacagatccatcagtggcccgccgactcccgtcagca

SEQ ID NO: 185791 - DNA, 418 bp, Homo sapiens
accattaacccacgagctgaggggtgcagacaaactacaccaacaagacaatgccaagcatgacaacatccctcggaacagaggaactgatgatgtatatattttcataaacatagaaaaaagaaaacacacaagcagaaacaaacattcaataggcccgtaacattaatcagttttaggtatatagaaaaacttcctgtttaaattctgttagactataacatctttcctataaaactttaatttggctaaggtccattatttctcccgtatgtctaacattagtgccagtattttggttttttcatgtttaaaaaaaaattgttttgattagctgggcgtggtggcaaggtgcctgtaatcccaactattcaggaggctgaggcaggagaattgcttgaacccgggaggtggaggt

SEQ ID NO: 185792 - DNA, 374 bp, Homo sapiens
agcgatggctgatgtttgggagaagagaattacaagcagaggccccagagtcaggagcacatctctagtgtttgaggaacagagagaagcgagtgagtctggattagaatgctcaggaagaaggctatggggatttgagtttacagaagaaagaggcaactaaattttgtagaacctcacagattatggcttggttttatttagagggaaacgggaagcttctagaaggttctgagttgagtagtgacatgacaatgctgtggtaacaatggtttcactctgactgccttactgaagatgcataaaggggatctctggtggaattgggagaccagttaggagactactgcaatcattcaatcagcaggatgatg

SEQ ID NO: 185793 - DNA, 908 bp, Homo sapiens
tccttctttctctatcccgtagaatagttttaaaaggattggtaccaattcttctttgaatgtctgtagaattctgctgtgaatccatctggtcctggactttttgttgttggtaatttttaaattaccatttcaatcttgctccttgttattggtctgttcagggtatctaattcttcctgatttaagctaggaggtttgtatttttccaggaatttatccatctcttctaggttttctagtttatgtgcataaaggtgttcatagtagcctagaatgatcttttgtatttcagtggtgtcagttgtagtatctcctgttttgtttcttagttatgttatttggattttctcccttcttttcttggttaatcttgctaatggtctattaattgtatttatcttttgaaaggaccagctttttgtttcatttatcttttgtattgtttttcttgtttcagtttcatttaattctgctctgatcttggttatttcctttcttctgctgggtttgggtttggtttgtttttgtttctctagtccttgaggtgtgacaactatagaatgtcaatttgtgctcttacagtctttttgatgtaggcatttagggctatgaactttcctcttagcactgcctttgctgtatcccagaggttttgataggttgtgtcattattgttattcagttcaaataatttctatcttgattttgtttttgacccaatgctcattcaggagcaggttatttaatttctatgtatttgcatgattttgaaggttcctttgtggagttgatttccagttatattccattgtggtctgagaaagtgcttcgatatgatttcaattttcttaaatttattgaggctcgtttcatggcttgtcatatagtctatacttggagaaggt

SEQ ID NO: 185794 - DNA, 285 bp, Homo sapiens
gggcctggtggggggacaggggatacacccagtgcttgtgtgagctcttggcagtgcagcctgacagtgagtgccatcccttttcaagggctctggtgagggtcttgcaccagctcctgtctgtctgtgaagactcaagtcctgtttctgcagggggatgccacactcctacatccactttcaaaccagccactctctcctcagcacctgggaatcagctcctaccctcctcaacctgttcccaagttaccaaggtccccaacccccccgccatttctcctgtcc

SEQ ID NO: 185795 - DNA, 430 bp, Homo sapiens
atagacaataaaacaaaccaaaacaaaaacactctgttcatgcacaaaggcaaccctcttccagatgcttaaccccttaaatgagtatttcgatgacacagagggatcatcacttcacttgccactgaaatacagccatctctggagtgaaatttggcagctgggaagtagtcaagctgcagtacttatatgacagtttggggaaaaggagtgagacagaaatagcagattccaaaataatcccattaaaacagcagggaaagtggaattgggcaataagatgggaggatggtttgccccaaagtctgactgtcctgtttagacaatgcggacttcagccccagaagctctaacttgtgtcactgctggaatatagtgaccacagtcaagaatcccctacacacaccccaaaaaggggggcttatctaat

SEQ ID NO: 185796 - DNA, 758 bp, Homo sapiens
tactttccccattgttcaagatgtgttttctcaggcatctccgtgccctggcttgtcattcagccagcatgtgagagaagactcaacaagatcagaaaccaaggaagaagaaatcaccagtctcttcccaggggatccagggacagggctgtcgtcactcatggcctttttcactttctttagttccacctactccccaaggtcttaccctccccaggatggagccccaggaaaccaggtcctggcagtccctcttgagatgccagaggcctaggtgagctgtgcttccctctgccttgcttgggattctctcaccgctccctgaatctggcctcagcctctgtctcttgccccagcatgacacacggcagagtatgaaccccagctgctgccttcctaccctccctctgcttctcttctggaggctgccaaggattggatgtccactgggcttggagttccaatcatccaggtggggaagctgagtttccatccaggaaagtgattgaatggaggtcccttggaaagacgagaggccaggtccatggcccagggatcctagtgcttgatcaggttctcttttcaggacttcttggagctgtggttaggcctccatgttagcaacagacacccactccagaccctcacctcttgaccctggcattactggcgctgcccctgcctcattctaaaatagatggaaagactgatgagccctgggaattctttcaggatttggtgacatttgatgatgtggc

SEQ ID NO: 185797 - DNA, 403 bp, Homo sapiens
aaccaacccaggggttagtcatagcttagttaacactttcgtacattgctaaaggttcctcactgctgtatcccgtgggggtgtggctaggctaagcgtaagagcagcataaactattcaaacttatctttacttcccaacacacacccactatcatttagtcaattcagttttctttactgtccctaacaaatcatgttcatttctgcttatgtgtcatataaacatacacactctccctttaaacatacaaagtaggctgagcatggtggctcatgcctataatcccagcactttgggaggctgacggggcggatcaggaggtcaggagatcgagaccatcctagctaactcggtgaaaccccatcttttaaaaaaaaatacaaaaattagccaggcgtgg

SEQ ID NO: 185798 - DNA, 511 bp, Homo sapiens
aataatttagtagtagtaggagcagcagcagtgtttataagtactcaacaaattttggccgattgggtaactccttagcttgttattgctccattcaatcatataaacagctggaaaactaatcttccaatcatttcactctgatgattcttgtctaccatttcatgtattaacatttcacaatggcattcaaggcttttaataacctcactctcctctaactattcaaacttatctttacttcccaacacacacccactatcatttagtcaattcagttttctttactgtccctaacaaatcatgttcatttctgcttatgtgtcatataaacatacacactctccctttaaacatacaaagtaggctgagcatggtggctcatgcctataatcccagcactttgggaggctgacggggcggatcaggaggtcaggagatcgagaccatcctagctaactcggtgaaaccccatcttttaaaaaaaaatacaaaaattagccaggcgtgg

SEQ ID NO: 185799 - DNA, 499 bp, Homo sapiens
tattctaccacgtatcttataaatgaaggaatttttacaactaagcataccattattacaccttgaaggggggaaaaaacccaactcagtaacagctaccatcccaaaataaaaccatcttacacattactatgtaaaaataatttcctaattattgctaagaaaagaaacataatacaaatataatttttaaaattatattttaaaagtgtttaatatgaaacagtatgttccctaaaataaactaaaatgatttcttaacatttcatatgaaaatacattacacttttaagttagtcctttcccccatcaatgcttacagcggccttaattttatagacataaatattctcaatactgtcaatttttaatcaacccttcaacagatttcctcacatccactgtaaatgcagctccaatgctacacacaaggatatctttgctctaaaatacacactaatgatacttgaaaacttaattttttttttttttttgacac

SEQ ID NO: 185800 - DNA, 296 bp, Homo sapiens
acagtgaagagacaaactcttgaatgagagaaaatatttgcaaagtactcacctgacaggggactaatctaatatccaaaatatacaggaaactcaaacaactcaacagttaaaaaaaatctcattaaaaagtgggcaaaggacatgaatcaacatctctcaaaagaagacatacaaatggccaacaggcacatgaaaaaatgctcaacattactaatcatcggggaaatgcaaatcaaaaccacaatgagatatcatcttaccccagttggaacgactgttaaaaaggcaacaat

SEQ ID NO: 185801 - DNA, 405 bp, Homo sapiens
ccctgtgaatcacttcgtcttaggtgtgttggatgcaaatagcatagttttcttttgttgatgttgctgttgttcttacttgggtttgggtttttttcttttttcttttgctttcttgctttatttctcttctctaatattgctatatgactcaagttgtctcaacatttttttctcaagtgatccacctgccttggactcccaaagcgccggctctttgggctggaaaacgctgaagatgactgctttcactgaggtcaaggattgtaatattgccagctttgtaaagtcattacagccagaagtttcttcagtgatcttctctcttaaaaacatcatcacctccacgggccggcgcgttggggaaaaccgggatttggccattagtcggctggatgaggtcct

SEQ ID NO: 185802 - DNA, 473 bp, Homo sapiens
tcttatcaggaggcacataatggagtgacccattatagtacattgtaatatatgataggctggtccttgacttttaggatctctgttctggtatctctctcttttaaaaatgatcacttatagtttctgtacatttgttttttcacctgtattctctcatattctcttcattaataaaagattaacagataaaactccattttatagattaattataggctatggaaaattgttgtttatctaatgccatagacttttaagtttcatagccccaatattggtaaattgtcgagtactacagttctttggagtgttttggatcatgtgtaactttgaaaatgtaatggaagttgtagacccactcactggaaaatatgcttgaaagctcctacaaaatttggcgatttcatttcagtaggtttaaagacaccctctgctatctccactcatccatgaacttcagttaaagacct

SEQ ID NO: 185803 - DNA, 217 bp, Homo sapiens
atgaaattctttgcattcattgaattcctcttcaagatcttgttaggtaagtgtgtatcttttgccaagggctagaagaaattctgatgtgatctgaatttgggctggagattgccaccaccagacacatgttctttcccttcctgcagtttgaaatcttaccttgattcaccttatatgtgtatataatatttttgcaacttgagtgttattttaa

SEQ ID NO: 185804 - DNA, 127 bp, Homo sapiens
ccatttgctttattattctctctttacatacatagttataaatatatgcacattttttcctgaaatatttgagatatattcgagactcattacccctgagtgtatttcttaataacaaggtcggccg

SEQ ID NO: 185805 - DNA, 304 bp, Homo sapiens
tgtgattgcgccactgcactccatccagcctgggtggacagagcaagaccctgtttcaaaaaaaaaaaagtggccaagcgcggtggctcatgcctataatcccactactcaggaggctgaggcagaagaatcgcttgaacccaggaggcagaggcttcagtgagcaaagatcgcgccactgcactgggcaacagggcggactctgtctcaggaaaaaaaaatgtaatgataaagcattttttcatgtgttatcttcttcattaagaagttttaaaaatgaatgtgttggccgggcgcggtggct

SEQ ID NO: 185806 - DNA, 359 bp, Homo sapiens
atttgtgcctagaaaaataaagaatgatgtgctggtgaatcttgggtcacctatgtactatactataattgaaccttacctggggacccacacgttcaggctcaggtgttttgtttcttagagcctttgttaagtttcctacgtgtgcgacattcctaaggtcttcaagtttcctattctgttttgtgctgtgtgaaagttctgatatgacccctgatgataaagtccataactgtagttaactggtcatcactgctcaggtcccagttactaagaagactaccaaaatggcatcatcttaatcttgaagcgtatttctgacattcctgaaccgttcaacccttatgagttttatagaa

SEQ ID NO: 185807 - DNA, 707 bp, Homo sapiens
  misc_feature (41)..(41): n is a, c, g, or t
gctgaggtatctcgaggattacgatgcattgtcttcctttngaagcctcttcctctataaacatctcaggcatgaattcttcaaagaagttgacaagggggaggggtgcagtgactcaagcctgtaatcccagaactttgggaggccgaggtgggcggatcacctgaggtcgggagtttgagaccagtctgaccaacatggagaaaccccctctctactaaaaatacaaaattagctgggtgtggtggcgcgtgcctgtaattccagctactcgggaggctgaggcaggggaatcgcttgatcccgggaggtggaggttgcagtgagccgagattgcaccattgcactctagcctgggcaacaagagcgaaagtcggtctcaaaaaaatattatccccaaatatttattgagagtacagcatgcctgcactgtgctagatattggatccagtaatgtattctgcatctacaatgcattgcagattacaaagccctcaacacaaatcaaagaagttggtgtatcaattatctattactatataacaaatggctacaaatttagcagcttaaaactacacacactatttcatcatctctgtgggttaggagttccagctatggctcagcaggatcctctgcttagaatctcacaaggctgtcaggtgcagtggctcttgcctgtaatcctagcactctgggagacggat

SEQ ID NO: 185808 - DNA, 456 bp, Homo sapiens
ttgcttgaactcaggaagcagaggttacagtgagccgagatcacaccactgcattccagcctgggtgacagagcaggactctgtctcaaaacaaaacaaaacaaaacaaagtgcataatatataaggaagtatttgtcatataaagttatatgaccagaccagaataaataatgcatacaaatataatatttaaaaagaaagtttatacatcaaaatgttaaagtgattgtagtttagactgagagattttggttttctttttacaaaaaaaacccataaacacgaattttggtagctttctgagttttctatgatgagaattgcttttataagaatatggaattttaattggagataataaatagtgaatgttttcatgtcactggtgttacccttatcagtgtattgttcttatttgctgttccccaaatccacctctggctttacccctggga

SEQ ID NO: 185809 - DNA, 170 bp, Homo sapiens
gcagccaacagtatgtctgttttctgtctctgtggatttacctcttctgaatacttcatgtcaatggaatcatagaatatgtggtgtttgtgttgcttcaccataatcaaattttaactatcaatccagtttcaagccaggcacggtggctcatgactataatcccagca

SEQ ID NO: 185810 - DNA, 231 bp, Homo sapiens
atctagtctttgagcttgaagaactcagacctctgaagacaggatactacccagctggtgctggtgtctctgagtggaacacaatggaactggtttggcaattgttgggaaaaactacaaagtggattcagcagctgctacaagaaggacctgctactgtctgggtaaaggagtgttgccagagtgacccttacaggaataggaagcaaaaagaagagtcccagctgggcg

SEQ ID NO: 185811 - DNA, 383 bp, Homo sapiens
agaaaggaaacaggttacaacatgacgactgagtcgctgcacgcctgttttcccagcatttcgggtgtctgcagcagtaggatcacttgggcccaggaattcaagaccagcctggacaacatggtcaagcttcgtctctataaagaatttaaaagttagctgggtgtggtggtgtgctcctgtagttccagctacttgggaggccgaggcaggaagatcccttgagcccaggaggtcaaggctgcagtgagccacgatcgtgccactgcactgcagcctaggcacaaagtgagaccctgcctcaaaaaaaataaaattaaattgaattgaaattttatgacacaccaggctttagctaatacccgccccctgcagttgtatag

SEQ ID NO: 185812 - DNA, 158 bp, Homo sapiens
aaacctgcctgttggttaatctcctttgtgtcctctagcaagggcagttgttaatataagtaatttggccagccacaatggctcacacctcaagaggactgcttgaacctgggagttccagaccagtctgggcaacatagcaagacgtcgtctctact

SEQ ID NO: 185813 - DNA, 340 bp, Homo sapiens
ttctcataacagatgacgttaaacatctttatatgtgattatttgctatctgtatatctttgatgaggtattcgttgaatcctttccctttttttttaaatagggttgttcattttcttactgtgttctaacccagtttgtgattgtgtttctttttcttaacattgtttttacagagatgttttaaattgtaatgaattccagtttattactttttcctttcataggtcatgcttttggtgttgtatctaaaagttgtaactgaacccaaggttacctagattttctcttgttattgtccagaagttttatatttttgtgttttacatttaggtctatg

SEQ ID NO: 185814 - DNA, 333 bp, Homo sapiens
ctctgactatgtgttgtctcagcaatcagatatatcttacgttgaggtaatacgaatggttcctcttgccgttaggggctcatagtggggtcagtacatttggctaaccgggttcgatcccagatggtggtagtagttgcaccactctctgaacatgagacttactagagacgttcaaatttgcagtgaatacgacgatcaggagatcctctatagacaagtcatgcttttggtgttgtatctaaaagttgtaactgaacccaaggttacctagattttctcttgttattgtccagaagttttatatttttgtgttttacatttaggtctatg

SEQ ID NO: 185815 - DNA, 112 bp, Homo sapiens
agcagaattcaggaatgaataaagtgtacactgaagaaaaccaatgtaattttcccattatacacaaacctatttagaccatcacctaacagtcttcttctctgtgacttaa

SEQ ID NO: 185816 - DNA, 135 bp, Homo sapiens
acctttcctgaaagaaaaagaccgcctcaactaatcagaacattgtgactaagcatcaagacatacataggtgtctgggcatggcggctcacgtctgtaatcccagcactttgggaggccgaggagggcagatca

SEQ ID NO: 185817 - DNA, 763 bp, Homo sapiens
  misc_feature (697)..(697): n is a, c, g, or t
ttccccaattccgtccccttcatcccaacagagctcctttcctaagtacctttgcaagtcttttttatattcatgtaatacatatataatcattacatgtaagcattttcttatttatttctacgcaaatatattgttctgtatctttcatcagtcagcagtaggtcttggggacctgtccatgttactgcatgtagaggtatttcgtttctttttattgcatctttagtgttaatatatcctagtttatttagccatttctctttggtatttaagctgatagcaagttttcatttctataaatgtttcttcagttggtatctttgttggtgccttctgtgtgcatgtgattttctttagggtagaaagcaaaaagtagaattgctgagtgttgagagtatatatttaatacatacactcacaaattccttccatagttctattacaggatttgtaccagccagtattcccacttgtattacctgttgtttcacacatgcacaccaccatttgatattattaaacagcagtgttttgagtaaaaatggcattccatttgcttgattgctagtgaggttcatcatctttacatatttgttatccatttggtttctttgtgggtaaatttgcttattctcactgtcctttgggttgcattttttacctattgagttttaggtggtcttccttttttgtncatgcagagtgtatgagagtctcctctttctttcttaaagaagtcttcttgagaatcgtactatcg

SEQ ID NO: 185818 - DNA, 166 bp, Homo sapiens
ggaagtggctgggatcaggccatgaaatggatttaagtagacacttggtatcagagagactctaggagaagagcttcaaggtctatggaaacaggcaggcagtacacggagggctccaatcactgatcagccttcagaggccaccattgtaagaaccctgaattaa

SEQ ID NO: 185819 - DNA, 579 bp, Homo sapiens
tcctcttagctcccagtttcccaaactgtgtgccaaggtgcccagagcacctcaggcttgaacttgtgttttgagttggttcatggtttcaatattagatacctacacccgtttctacaatgtcatgtctttgtaaagatgtattttcagaggttgctccgataaaaagcaactactacatgaaaatgaatgtagaacaggaaatgacagtgtggtattgtccaatttgattctaaggtttgataagttctacagtgctctacactaagttgtaaggacataactactaagtaagttgttcaaacctatttcttttggcctgggggtgtcgtgaaaaatttgctaagactcagagctccctgaatgggtttggaaacctctgccttagcttttagtttgcttttctgataaaattattgatataaagctagtaccagctgatcatggcttaatatatttcctctcctatgtaatatgtttataacttctgcccagttctttcattttaaaactaatcctattgctaacttgttgtactagtcacttcctggtttttcctgtactggtcttctgcttcta

SEQ ID NO: 185820 - DNA, 155 bp, Homo sapiens
tattaagagtacttactatcaacatgacttatcactgctgatgataaccttgatcacttggttgaggcggtgttaggttttttcactgtaattattccctgagcccctcccccacccacatactgtactttttggaaagaagttgctatgcacag

SEQ ID NO: 185821 - DNA, 490 bp, Homo sapiens
caccaggatgatgagtttagtcctggaatagatgtcgtacaagtcgggtggtgaactgcactgaacatgcctggagtgatgttaggaagacagcaagctgaaaattagcattccagaagggataaagccatctgcatacaatattagaaaattttatgacattatgtttctaggtagtttggactccctgagttagttaagaaacttaattttctttccatcacaaatatcttagggatcttttggttgcaagtaagagaaatccatgtgcttattaaagtaaagggagatgctttatgagtgaggcaggataacctggtagagaaattaggtgttttttccttccttctctcaaaaggctggcaaaagactagctccttattttggaggactgatgtagtctttgctttgagggagaagagaatttttaaaagtcaactttaaatatcagtttcatactctaaaatgtatcagttcaaaaactgtaatt

SEQ ID NO: 185822 - DNA, 445 bp, Homo sapiens
aggcaatgaatacttgagatactggctacggatctgattcaatcagaagtttattccagttaaatggtcagtctctcttctctccatctcccctgaatataatgttgctgattctaaacagtggctctccagttggtgacaatcgaaatcagctgggagctcaaaactcctgacacctaggtcctaccatgaaaattctgatgtaattggtccgggatgtggactaggcaacagaatttttaaaactccctcaggagattttaaagcccaccaagattagagcccactattctaaaaagcactgtaccccttatttaagctaccattaactccacggtcttggcccagtcttgagtatgtctttatcagcagtgtgaaaacagactaatacaagccccacggaaagagttgtcttggccaggcgcagtggctcacgcctgtaatc

SEQ ID NO: 185823 - DNA, 353 bp, Homo sapiens
ctcttgtaaaagtgctcaggtgaccctagcacccctgcaatctggatgaagcactgttgaggtcagtttagtcaggtttaggatggccccagggcccaaggctgattacactgtggggatgcaggggaaagcggccgggaagacccagccaccagccagtgcttctgatggggctttctctgtacttggccctgatggacagaataagagaaggtattcacatggtactgaccctgtgccaaggattactgtaagccccttccatagagtaactcatttaatcctcgcaacaaccatattattatccccaatgtacagactgggacattgaggcatgaggagattaaaatatc

SEQ ID NO: 185824 - DNA, 233 bp, Homo sapiens
aaagctgaagtacgcataagttaagtaccttcacctaagaccacaagtagctgcataagaacccccgccttctattttctaaccttaaccttcctctgctagaccaaggggccttgctgacaaaggcttctattaagtactcatcccctgtaccgtaagcagaattgcgtgtgatgaaggccaaccacagacggcacactttcatgatgtagttggttacggcataaactgtg

SEQ ID NO: 185825 - DNA, 468 bp, Homo sapiens
tgtgtaacaagcctgcatattctgtacatgtatcctgtttttttgttttgttttgttttgttttgttttttaaggagaaaaaggaaaaaaagtctctgagggaatgacagttaagcaggtatctaaaggatgaatgatgaattagtcagcctgaggagagaataggttggctcccagacagagaaaaagaaaaccagaagagagccagtgcatggaaaagcctaagacaaggactcaaatggatctgagtggctgaagtgtagaaagcaaggagaaagcagttgaataagcctggagacctaactaggggaccagatgttgaagggccacctgaacatttgagaattttatttttatttaaggagaaagccattaaatattataagcagggatgtatcatgatcaaatttggatttcaaaaagatctctcttgtgtggaaaacagatgatgaggaacagaatagagca

SEQ ID NO: 185826 - DNA, 506 bp, Homo sapiens
ccattgatgtgaaggtcatagagaatgtaggtaaacaaccaagggcttgaagttcttttaagcctggagaaaatgcacatcttgccaaggacttaatacaaggctttcttccataacacgtttaccaaagctgtccactaggggcacacagagaagaggcaccataggactttattctgctttcctctaccttgaatagcttgaccctctacacttctgcatctgaaactatgcccagaagctctaagtgcagcattttagcagattttctggacctgctttgagtatgaggttctttaagaagtctggttccaactcagatcctggaccaagtgcagtaatcactgatccctacataagacaggagacactaagcacaaatttgtctccagtaacttttcttaggaccccaattctcaacagcaaaaataaaaatcctcatttttgcttcgatacctggggcaatgagattatttcaaaatggtttaccaaactaaaaaaatggt

SEQ ID NO: 185827 - DNA, 521 bp, Homo sapiens
gtggggacaaaccacatccaaaccacatccgaaccatagcacttactattactggcttattataaaggacacaaatgaataaccagatgaagcactgcataggttgaggtctggaagactctagcaccggagcttttgtccccatggagggagagtaccataccctcctggtaaatggttgtgtttgtcaactctgaagctctgcgaataccatcatttaggggtttttatggagcttccactacacaggcataactgattaaatcattggccattggtggtggaactcagtctctagcccctttcctttccctagaggtcagggggtgaaactgaaagttccaatgatctaaagatatggctgattcctctgaccaccagcccccatcctgaaggtcatctcattagcatgaactcgaatatggttgaaaggggctcattttgatttttttttttttgagacggagtttcactcttgttgcccagcctggagtacaatggcacaatctcggctcactaca

SEQ ID NO: 185828 - DNA, 392 bp, Homo sapiens
agctccaagggatgtggtaagaatgtatgagtgacgcacgtggaagagtgtctgggagagagcaggcaacctctacagaagtgcaggtcactagggagacagcaggtacaacacagccttaaaagcatggactccagagtcagccacctggttcccagccgcaatcttagatgatctatttaaacttttccagcctatttcctcatctgtacaatagagatgatgaaagtgtccacctcacagtcttattgtggggattgcaacacacatggcatagagcacatggcagagtgcacatttttaggagctcaattagtatttacttcaagaccgtaagtgtcgctagaaccccatcacatgtctgctatctgcttttcacttctacacaggaa

SEQ ID NO: 185829 - DNA, 332 bp, Homo sapiens
actgtcctgccccagtcctgctgactaaagccacagccctcaaagccacttgaggctcccatctccactgctgctgataccctcttgtccatgccaagtctttgcctggattttactaaggctatgctggcttccaagcagaacaggaggaatgtcttgctctccattctgtgtccatgtcatgtgaccccaagccttaaggtcccttaggataacagttcctttagtttctgcctgaagctcatctcccctccaggctgacagccagtatctgagataagcaccattgtgtcctcttgattccaatttcctaatcaggcccccactcaaat

SEQ ID NO: 185830 - DNA, 367 bp, Homo sapiens
ggtgcaagctgttggtgggtctctaaatctggggtctgtagggtggtagccctgtgtgggggctccaagtccgtattttccttctgcactgccctagtagaggtttcccaagaactctgcgtctgcagcaggctgctgcctggaaacagtgggagatgggggtgggaggcagatccttcaccaatggttaagcaccatcttcttgatgctgacctagtaacagtgagttcttatgagatctggttatataacaaggtgtggcacctctttcctctctcagtcttgcttctattccagccatatgaaacatctccttgccccttggccttctggtatggttgtgaggctccctgagacgtcccagaag

SEQ ID NO: 185831 - DNA, 1832 bp, Homo sapiens
  misc_feature (905)..(905): n is a, c, g, or t
  misc_feature (1088)..(1088): n is a, c, g, or t
  misc_feature (1464)..(1464): n is a, c, g, or t
  misc_feature (1626)..(1626): n is a, c, g, or t
gagccacctccctgaggccgctgcatcgcttccttacagcagtcaaccacagactttaattaatacaataaggtacagacaacagggtgccacggacatttaggcccaaggaatattatgcaaaagcagtgttttaagggagtttcacgtgacagaccagcagattacactgaacaaagaaacaagaagtgatgttgtccctgcctggaagtgaacttggggaggagagagggagaattattcacaaaatctccttccccaaacagtcaacacccagaaccaacatggagctcctaccccactgggacctgctgactgaattctttctgagacccagtaaggagaactggttccggcagctgagaagccaggctgtctgctaacggcctacaaggggctctctcgctgctgttagggctggtctgctctgtgtccgtggtccagttgggtacaacaaacccattcactcaacagtgccagagacccctctggagactggggaagcagcttccttgtggtcgagagctgtgcagccgggacaggagcctgcattcgttatcacacatcacggccttcggcttggctgggggccaggtgggcatggatgctggcatgcccacaggcagatctcagctttccagtgaggtagcagcctgccgcaccaagactcagggctgtcatgaggaagagcccctgggacccccagcatcctcgcgaactccctggagcttcatcatggcccatgcgcagcacacggcagacaaccggttcagcagtccctggagcccacgtgcctccccttccttttgccttggctcccttatgcccacccaccagctcttccaggctccaaaggggaagttgaagaagaatctggtacctggcccagctgccaagccccaagntcacacagccctagaaccctgctgccaagtccgtctcgggggacctaggagaggaagtccgccagcctgggaagctgcctctccagccttggccaagcaccacctggcaaactgcagctgaaatgccgagcacactacagggggataccccctccaccccagccctgctgagaagcccagccncactcttgatctccctgaaatccttgaatctaggtcaagggtggtgctaggggttggatgcacagggaagaggctgagcaccaagacatgtggaccagtcaggactagagacctccttccttccagacatgcacactcagccacgctggagatgacaaaaccttacacactcaaagccaatacatgcgtaggggcggccacatgccacgcactgttctaaatatcttgtacaaactcagctaatcctcaggacaattctcattttacagatgaggagaccgaggcacagcgtggtgaagtgacttgttcatggtcacataggtggtaaggcagtgaggtggaacttgaacccagacaagcagcctccactcccccnacctgctcacctctaactcaggccgctcttcgaagacaacctgaagatttttctttgcaatcgatagtctagagcaggagtctccaaggggagagaccatgtcccactgggagcccaaagcactccagggagggtaggaaaaaaatatgagagcttttgtantgattttgtttcctcactcctgtttccttctctccccttgtgggtgagggcgagtgagcagttgatcatctcttaaaccagggctgccagagccagagccagagccagaaaatggagtgccttccttccttcctttccttccttcctttccttccttccttcctccctccctctctttttttttgatggagtctagctctgtcgac

SEQ ID NO: 185832 - DNA, 205 bp, Homo sapiens
tgagtgggtggagggagggaggggtggaggcagcattacagccgcagccaacgcgcagttctttctttcttttttgagacagaagtgagactccaccttaaaaaaaaaagaggtgtgagtcccctgtgagtgcagaacgggtctgacatctgacacaggcgaggctccctagcagtcatgggaaatggggttgaacttaacaaat

SEQ ID NO: 185833 - DNA, 608 bp, Homo sapiens
tttgatatacacccagtagtgggattgctgaatcatatattagttctatttttaatgtttttaggaatttccaaactgtttttcctaacaacttttctaatttacattcttatcagtagttatcaaccattcccttttttccatgttctcaccaacatttgttataacttttgtctttatggtaatagccattctaacagtcatgaggtgatagctcattgtggttttaatttgcgtttccctcatggttagtgacattgaacacattttcatatacctgttggccacttgtatgtcttcttttgaaaaatgtgttttcagatcctttgcccaatttttaattaggttatttgttttcttgatattgagttgtttgagttccttatatatcttggagattcaccccttatcatatatatactttgcaaataatttctcccattctgtagattgtctcttacctctgttaattatttcctttgatgagcataagctttttagtttaatgtaatcccatttgtctatttttgcatttgttgcctgtgcttttgaggtcatatccaaaatatcattgtccagactgatgtcaagaagatgttccttatatt

SEQ ID NO: 185834 - DNA, 142 bp, Homo sapiens
ccccccaaaatattaaaggaccagactccttaaactacgttatttttaaatccaaataattcagtagctttttgttttccctagtatatgtacacaccgtacatacctaaagttaagaggaagggttaatttagtgcagtgt

SEQ ID NO: 185835 - DNA, 196 bp, Homo sapiens
ccaatcctttttctgtttggagaccctctcttggatgacctgctttctctgcatgaggaagctttctctctctcttctttttctatttaactttctgctgctaaacccactcctcgtgtgtgcccatgtcctgaattctttctcaaccttgaccagaaatcagggtatatagcccagacaacggagctgtttcagt

SEQ ID NO: 185836 - DNA, 258 bp, Homo sapiens
gaccccagcttagctctgtggcttgtctttctggtcactggcattagttgttaaatttgaccatctccctaagccccaatcttgcaggcttgtgaagtttaaattggatcatgtgtgtgttgcacttagcccagggcctggcaagaaataggctcttaattactagagcttaattcttacaagagaagcagggcaactggaggaaagggcctgcatcgaagcttttggctgttgcatgatccacttcctcaaaccctt

SEQ ID NO: 185837 - DNA, 398 bp, Homo sapiens
ttgcttgaacccgggaggcagaggttgcagtgagccaaggttgcaccactgcactccagcctggttgaccaggtgacaaagtgagaccctgtctcaaaaaaacaaaacaaaagtttcctgaggggagtagtatttgaattgacaaggtagagggagtgaaacgaaaggtattctaaccagaaaaaaactcagacaccaggaaagaacaaataaggggctatgtgtagggtggggagaaagacagcatcaggttttccactcgagtcctctgtagctctgccttagctcgctgtttagtttccttaaagtaccgaccaaattcacaactagtttgtctattttcttgctagtgcttgcgacactagaacataagcccggtgaaaggaaaataaatcttg

SEQ ID NO: 185838 - DNA, 263 bp, Homo sapiens
tctagaggatcccgtgatgtatcgcccaacacccaactcttctccaaagacttcatccctccctcctgcctcaggaaaaccagggctggaccaagggggatcagatggggaaccccaagcagcaccttccttctttcctctgatctcaacagaaggtggatatttacatcatgaggcctgaaaaagaccaccaacatcaaaataccaaaaattactaatttatattataaacgtactccctccccaaaaggatatagtcatgt

SEQ ID NO: 185839 - DNA, 657 bp, Homo sapiens
  misc_feature (588)..(588): n is a, c, g, or t
gctgagtcttgaatgctttgattggaagtctgctcagctaaatgtgcaaacttattgcttatgattctgccttccacacagctacaggacacaatccagctaaactttttgccattatattacaaagatcacctttgctctagtttccagtaacatgttccttgtttcctttgttcctttagaatcacctttaattttcatgtttctaacaacattctgtttttgatagtatatgtattcttgaagataatacagactttctgtatcaagttcgtcatttcctttaaggcagagtctgggtgacagtctttaacatccgcatttctacccacagcctgttcaaggaaacctaggccttttctatcatgcttctcacaattctactagccctcctttgttattgagttacaaagccactgccatatttttaggcaccctactcctggtaacaaaattcgtatgtttcctgtggctgctataacacgttactacaagcttggtggcttaaaagaacagaaatttaggctgggattacaggcatgagtcactgtgcccggcccaagctgagtcttgaatgctttgattggnagtctgctcagctaaatgtgcagacttattgcttatgattctgccttccacacagctacaggacacaat

SEQ ID NO: 185840 - DNA, 233 bp, Homo sapiens
gtcgttattaagacgctctgaaaggcatcattttggttggcagtttgcacatctgagacagaacattgaaaaggaagtatccctggaaggttgtcagtgtgcttgttcattggaagccctcacttccttctcctcccaacttctccctccagcttggaaagtaaggggaatattgggcatggagagtgactcactgccatagaagggttgtgtagagaaagtgggtgtgtaac

SEQ ID NO: 185841 - DNA, 339 bp, Homo sapiens
actagatgcttagtccttcctgtctacaaaacaagaaccctgggggcaaggagggggaaaaaacaaaaccaagaaccccagctgcgccccactccgtgctccagccaccacctccttcctctctcccttcacagacgagcttcctgaaggagtgatctctacatgtgcggtttccagctcccctccacccactcacctttcattcctctaacatagcttccctcataagacacacagctcttgataaagccaccaaagacctccctgtctgcctcccccaccataggaagctcagaaagggtagggagtggactgttttgctcctctgctgtatttcca

SEQ ID NO: 185842 - DNA, 237 bp, Homo sapiens
attgagaagttgctaaggcttaacttccaccagaccaggtgcttggactggttctctggtttcagggcaggattctattccattgggtttttaaaaatattttctttctgaaaatctttatagttttaaaagagaagaaattagtgggactggagaatgacagtattaatgtcattcttaatcttgttctgctctttagtttggaaatttgtttgaatggaaattaagcctttgcaa

SEQ ID NO: 185843 - DNA, 281 bp, Homo sapiens
ggaaatatttcctaacctattctatgaggccagcattaccctaaaccagacagaaaagaaaccaaagaaaactacagaacaatacctctcatgaacacagatacacaaatgctaaataaaatactagcaaactgaatctaacaatatacgtaaagaattataggccagtttggttgaaaaaaaatccacatataagtggacccatacagatccagcctgtgttgtacaaatatcaaccgtatatgccttgggcaagaaaaactgagaaggagcttctaaat

SEQ ID NO: 185844 - DNA, 517 bp, Homo sapiens
aacccctaaccaacgccactctttcatatacctaatatgacttagcaggtgagcctccattccctatttttatgcagatatctggacttttcatctacatttttaccttcttggaagcgccatttctgaccctcaggacccacaattattaatatctttccttgcgtggattcctagctcttacatgtattgctcatgtacatagttaaatttcatcatgtgatgcatttgtacatggacaatcacaaaatcccatactgtggaaaggacctgagaacacccttcaaaatcacctggcccaaaatccttatttgcaagtgaaaaacccaaggcccaaggaggtgacatattttttccaaagtcagagtccattgttgaggacactaaaatgagaatgccagttccctggctcccaatccagaacatgccccattatggtctccctaaggagccggtgttctctgaggcaggagctacagttatcaacctcctggcacattgtggaaagctgttgagc

SEQ ID NO: 185845 - DNA, 218 bp, Homo sapiens
gctccagtcacagctgttgctcgtccaatccattccagctcttcttctgtccctcaagcagccagatcccaactggccctgactagtctctcttaacctcccgggctactcttcctcagcctcctttggtgaatccttctctggtgaatcctcctcttcgcccaaatcacaagttgggctaaccccggggcccagtcctcagccctcttttgggctct

SEQ ID NO: 185846 - DNA, 319 bp, Homo sapiens
ctgatccagttaaggtgggattacaggtgcgtgtcaccacacctcgctaatttttgtatttttagtagagacggggtttcaccatgttgtccaggctggactcgaactcctgggctcacgtggtcctcccacttcagcctcccaaagtgttgagactacaggcatgagccaccatgcccagcccagaaaatactttgagatgaatgatgaaacacaacataccaatatttatggagggaaatttctatttgtaaaatgttgattttaaaaaagaaatatcttaagccaataacctaacgattcaccttaagaaactaga

SEQ ID NO: 185847 - DNA, 440 bp, Homo sapiens
gcggccgcctactactactactactgctcgaattcaagcttctaacgatgtacggggattagcatgaacaatttcagttttcagtcacactgaccagtatctgtaagttaggattgagatgggcttgttttatttatttacttttaaatttgtgctgctacatatcccaaacaaatgtggtctttatcatcactggcaagccattttacttattggttaagctggaattttattacaccaccccagcaagatagaggagaaaagcgaaaattaagtagtaaatggttattatgccttaagggaaggtgtgaactggcaagacaaaagagccaaatttagtagtaaagcatagtcatcagcacacagaaaataagtggtgaggaggagtttggccagaaaattggctaagaaaaatggcagtatgaccaagaatgaaaaaa

SEQ ID NO: 185848 - DNA, 968 bp, Homo sapiens
tgcgacagctaggccctgactaaggtcgacccaccaaacactggatcgtccccaggcgaaagagagcttgttcccctcagcctgtcgcggaggagcggagccaatcgagggtctggtgtccccgtcgcctctccaggggcaacctgcggactaggccaaggtctgtaacaggataacgtaccagcgcctggcccaggcgttcctgccgccacctccccgcatatccggaccgccgggactgcacgcagctggcaagcgtccccctgttaactctgcaagggtggggcggcaccatttctcagaccaggtaaggcaagaaaacatgcaagagagaagagagggaagcctaggccaatcggaatgaaaatgtaaacgccacaaccacgttttcagctttacaaatactgaatcttgtagtgggtctagtgggttaggggttagcatgagcaccctaatggttgggagacagtttcaggggactcttgcatttgtgaagatgatcagtcacaggcaatgacttgaagccacgaggcttgaatattaaaatctgatgagcagatgttacacgtagaataattacataatagttctcaaattcctgttatatccaggaatatctggtatgagtgaaaacttggaggtgccttctctaaagtcatcaggaattctgagttgtgtttgtaaaaataggagcacagagggcaccaaactgaacaaaatgttaggtggaaactgaaaaacgttggttagcatgaacaatttcagttttcagtcacactgaccagtatctgtaagttaggattgagatgggcttgttttatttatttacttttaaatttgtgctgctacatatcccaaacaaatgtggtctttatcatcactggcaagccattttacttattggttaagctggaattttattacaccacgagccccacgaagagccacacgaagagccacacaaagag

SEQ ID NO: 185849 - DNA, 1128 bp, Homo sapiens
tgcgacagctaggccctgactaaggtcgacccaccaaacactggatcgtccccaggcgaaagagagcttgttcccctcagcctgtcgcggaggagcggagccaatcgagggtctggtgtccccgtcgcctctccaggggcaacctgcggactaggccaaggtctgtaacaggataacgtaccagcgcctggcccaggcgttcctgccgccacctccccgcatatccggaccgccgggactgcacgcagctggcaagcgtccccctgttaactctgcaagggtggggcggcaccatttctcagaccaggtaaggcaagaaaacatgcaagagagaagagagggaagcctaggccaatcggaatgaaaatgtaaacgccacaaccacgttttcagctttacaaatactgaatcttgtagtgggtctagtgggttaggggttagcatgagcaccctaatggttgggagacagtttcaggggactcttgcatttgtgaagatgatcagtcacaggcaatgacttgaagccacgaggcttgaatattaaaatctgatgagcagatgttacacgtagaataattacataatagttctcaaattcctgttatatccaggaatatctggtatgagtgaaaacttggaggtgccttctctaaagtcatcaggaattctgagttgtgtttgtaaaaataggagcacagagggcaccaaactgaacaaaatgttaggtggaaactgaaaaacgttggttagcatgaacaatttcagttttcagtcacactgaccagtatctgtaagttaggattgagatgggcttgttttatttatttacttttaaatttgtgctgctacatatcccaaacaaatgtggtctttatcatcactggcaagccattttacttattggttaagctggaattttattacaccaccccagcaagatagaggagaaaagcgaaaattaagtagtaaatggttattatgccttaagggaaggtgtgaactggcaagacaaaagagccaaatttagtagtaaagcatagtcatcagcacacagaaaataagtggtgaggaggagtttggccagaaaattggctaagaaaaatggcagtatgaccaagaatgaaaaaa

SEQ ID NO: 185850 - DNA, 465 bp, Homo sapiens
ctaacatcatgcatatagtgcattttgtacattaatgaatcaatattgatacattaatattaaagttcatagtttacattagcgttcactttttgtgttgcgcagttccttaggttttgacaaatggtggtttcactttttatcagtttaaaatgcttagaaattttccttttgattttttctttgtctcatgggtgatttggaagcttgttatttagtttccaaaaacttggagattttccaaatagcattctcctataaatatctagtttactgaactctggtcaaagaacatagtctatatgattggaatcttttaaaatgtattcgtgtttgttttatggccttgattatggtctgtctttgtaattattccatgtgaatctgaaaataatgtgtattctgctgttgataggtggtctgttctataaatgtcaattagacaagttggttgatactgttgtt

SEQ ID NO: 185851 - DNA, 479 bp, Homo sapiens
cactgcaacctctgcctcccgggttcaagcgattctcctgcctcagcctcctgagtagttgggattatagacatgtgccgccatgcctggctgatttttgtattgtttgtagagatgaggtttcgccatgctgcccaggctggtctcaaactcctgagcaatccacactccttggcctcccaaagtgctgggtttacaggcatgagccaccgcacctggcctgcatttgtttcaaaaggaggcctctgtaactatgattcaattatctctatagttgatggaactgatatgagactgcaaaggaatcaagaggactgaattatactaaatgaggctagtaaaaatcagccacttattcacaggaattagaaaatcaagacatctgaaagggcagcagtatcaagtgagttgtgttctatgtgggaggcttataaatgtgtgaaaacaagaaggagctagtggagagattggagatattg

SEQ ID NO: 185852 - DNA, 700 bp, Homo sapiens
atgggaagcacagtccacgagccctgagcagaaggaggatttgggaggtggttgctggttgactcagctcctgctttcccccatcagacccatccagaaatcagcttcctgctctctcatgtccctaggccaaggtctgcctacactgagagacctgggtgcaggtggcccccacattacagaaactcatatgattgtttcttctgtgactcagggaaccctaaaccctcacagttcatacatgtggggaaataaatatcgaggcacagagagggaagagagtcactcaaggtcacacaatgtaggatgaaagaggaagatactgatcaggagacctcctgggagaagccctcctgtccagtcttacctggtgccttcactggcctccctccagcccccaccagcacaacctggtgctaggctcaccctcccaaggcccaaaaagagtatacagagtttgccgtcttttctattttattattgcattcctgtcccaggggccacctgctcaccttagaagtctctagcgttagaagtttcaggggatggggcaggcacagtgacttatgccggtaatgccagtactttggaagggcgaggcacgaagatcgcttgagaccaggagtttgaaatcagcctgggcaacatagcaagacccctatctctacaaaaaaaaaattttttttaattagccagatgt

SEQ ID NO: 185853 - DNA, 483 bp, Homo sapiens
gtcaaagaagaaaaagaaatagcaaatggactggatgcagtggctcacacctgttatcccagtgcttcaggaggctagggcaggagaatcgcttcagccaaggggttggaggctgcagtgagctatgatcccgccactgaactccagcctgggcaagagtgagatcttgtttccaaaaacaaaagaaaaaggcaaatgaagacaattttaacttgtgtctgcagttgaataactcactgatcttaatttagattcagtttatgtagaaataagtaaactttaaaaatctgtcattccacggtttaacaaaagttcagctctctgcttgctgtagttgggcatcttctgtaaatcgcacgtgcctttcctttgcctgttgtggtttttaattgatctgtggaagttctagttatattctggacactaattctctggtgatttatgtatttgcaaataacttctagtttgtttttaactttgtgt

SEQ ID NO: 185854 - DNA, 549 bp, Homo sapiens
gatgggggtaatgcagtgtagtaccaaaacctttggcctcagagccacttgaagtggtttaaatctcaactctggcacctgttagtgggacggtctcaggcaagtcacttaacatttttgagtttcattttctccattctgtaaaatagaatcgactaggatcagttgtttgtaggattataatctatgtgagatatgtgtgtgcatatttaccttatgagcaggtggtttagtatccattgattcaatggtcctcacctttatttctaattttagttatttgtgtcttttctttttttctctgtccagctaatggtttctcaatttttattgagttcttcaaataaccaactcttaatttcattgatttttcttttcttctattctctatgtatcttacccgtaatctttattattttcatccttctggtaccttcgggtttactttgctcttctttttctagctccttaaggtgtaaagttaggctgctgacatgagatctttttttcttttttaatgtaacctttacatctataaactttcctctg

SEQ ID NO: 185855 - DNA, 282 bp, Homo sapiens
ctgtgttctactgacacgctataaactccccttcactcgaattacatgaaaacaaaacttttaacctttttaccaaattactaaattgtaagcttcactgagagaaaactagtagtgctttccaagcatgtgtgccagacgtctttacaggcacacaggacatgcccctgatgattagatcactgcacgactcaggaagtagcacaactgtaaatctggttaagagcccccagcccacctttctccacactcagacccacactaaccaggaactgcaagaaa

SEQ ID NO: 185856 - DNA, 271 bp, Homo sapiens
cacagatcagtgagaatttaggtgtgtggggaccagagggttcaggatgaataattctgaatttctcttgcaaaataaaaattattgtcattctatgagctagaacatgatgtgattaaatgaggttcagtcttgcagcatgcaatttgaaacatggagtggcatgaaagtcagttaggagaccagtggaatagtgtaggaacgaatgataaggatctgactgggggatgggaaagcaatcgattgaaaaagactaatttctgaggcactg

SEQ ID NO: 185857 - DNA, 1857 bp, Homo sapiens
  misc_feature (109)..(109): n is a, c, g, or t
  misc_feature (788)..(788): n is a, c, g, or t
ctgagggcagctggggctacttctgcccttggctatgccaggctttgcatctcgggctatggctcactgcagagtttcgtgggggaagggcaggggaagccaggtgggngccagctgaatttcagtgtggaagaaactttttacggtctcatctcggcccagtcggtcaggtgggtggcactcggcctttctgaggcttctctctctaaaccatccctgagcagcaattcagaagacaagctagaaagccctttgatggcatcacagtgtccctttaacccctgagcacgccccagtcctctgtagctgcccactcagcacagccgttcctggaggctgagcggcacgggccctcggggcagctgcccggtgcctgccacccacacatctctccaccggtcctctcctttctcctcacctcacttgtctgccaggccctgcgtgtgggcccagccatcccaggcaggacaggcagggctctccagctgcctcacagactcaccgtcagccatgcgggagaagaaccgcagcacccaggcaggtctttctggctctttccccaaggccagcaggtcttagaaatcgtcagacttgccagattctctgagtaggaaacggaaccctggggtctccccactcggcctcctggcctatctctccctgagccttgtggaggctcaatgaaggaaaagctcttgctggggatcttggcagtgtccctctcagctaccacaacaagatttcttctgtacgggtcacttcaagccacctaaaaccctgcgtagaanggacttcttggttggagaggtgccctccctggggctggcggggctgcgtctgctggggctgctggtggtatcttttgccggagtgtctctgagacccctggaggccccagctggtgagtttatccaccaggcttaggaggcctgtgggctccaccctctccgtccctggaggcttctccagctaccgggtggagagatgtaggcggcatctgtggggagcatcgggcagcatggggtcctgccgaggcacttgtctgctgagggcattctgagaaagcccctctgccccgagccctagcctggcgaatgagctgtcggccccaccatggagccctgggtggcacaggcccatgaaccggcctcttccccagctgagcgacctcctttggtcactggctctctgcctggagagtgagtggccgggccatgtgctccaagcagaggggcctcagcagggctccctgagcccagagagatgggataggtgggccttttggggccttgcccatcagaatccccaggccgggggactgctggtgagtgcagctgcggcagctttaggggactcagtcctggggttttgtccccacttcacagccaccacccaagagtggcgtggcaggcaggaaccacagcctcatagagggggcaggaccctctcacagccttgcctggcagcagctgcagggagccaggtgtcacccatgtaatgtcaggtacttggcctggttgctctttcccgtggaggttcgcagacaaccttgcaaacgtgattttgatggcttctcaccctggagagtgctcatgttatgcttaaaatttagtgcctaattcggatcacgaggtcaggagatggagaccatcctggctaacacggtgaaaccccgtctctactaaaaatacaaaaagttagccgggcgtggtggcgggcgcctgtaatcccagctactcgggaggctgaggcaggagaatggcatgaacccgggaggcggagcttgcagtgagccgagatcgcaccactgcactccagcctgggcgacataacaagactccgtctcaaaacaaaagc

SEQ ID NO: 185858 - DNA, 727 bp, Homo sapiens
ggcaaaactgatgttctaaggaacattctttaggaaaggttagccagatccgtggttctcaacaggcatgtggtacacatttaataatgtctggagacgtttttggttgtcacaactggggatccagggatgctgctaaacatcctgcaatgcctaggacagccctccacaacggagaattatccaactcaaaatgccaatcattctaaggggttgaaaaactctggactatatgaactatctcaattctctttcaacactaacatttaaatgtggtgtttcttgttttttaaacacacaaaattttatttctgttttacacaaagtcagctatgggtatggatgaatctgcggacagttttcttccatgtgttggctccatatttcagctgctttgatctttttgacatcttatcaatgtgttcttctatgatttccttggcagagaaagagaaagcagagagaatcatgtgctggatcttaaatgcttctacgtggatgtagtaaatgtctcttctactttttttaaataagaagtgtattaaaatataatccatgtatcatataatttactcatttaaggcataaaattcggctgggtatggtggctcacacctgtaatcccagcactttgggaggttgaggtggggtgaatctcttgagcccaggagtttgagaccagactgggcaacatggcaaaaccccatctctacaaaaaatacaaaaa

SEQ ID NO: 185859 - DNA, 408 bp, Homo sapiens
gtgtccactcctttacattattaaccttaataaacatttcacatagagtacgcaggattaatcggaagaatttaaaaagcttatgcagacaggcctgcataaaacgttataataactgtatatcataactgcattttaaatgacaagttatcatttgctgaattttctaaatgtcaggtagtttgccaaacacttcatatgaagcatcttatttaattccaacaatcatataaggtgagctatacaattattatccctatttaaaagctttcagaggttagtagcaaccataatgtctatttgagatcgaagcccatgttctttaccaactaaccaacatacaacagtacaatacagtatgtctccctacatacataaatctaacaaaaacattgtgtcctgtggctg

SEQ ID NO: 185860 - DNA, 1103 bp, Homo sapiens
gttcaatttctaacactacttatattttataaccaaacaagtcatgtaggggcatactcattaggattgagtgctttcttacaccaaaatacatgtaatacaaagatttaaaacactctcggcctcccaaagtgctgggattacaggtgtaagccaccgcggccggcccattctttctattattatgtgtaatttgttaagagttttcatcatgaagggatattgaatgttaccagaggctttttctccacctatggagataatcacattttttgttcttcattctgttgatttatcatgtttattgttttgtgtatgttgaacccattcttgcatccctagaatgaattccacttggtcatggtaaacaatctttttgatgtacttttggatttggttggctagtattttgttgaggagttttgcatttatgttcatcaggaatattggcctgtagttttcttttgcatgtgtgtgtccttatctggtgcttgtgtcatggtaatgctggcttgtggagtgagtttagaataattccctcctcttcattattctgggaaagtttgagaagaattcatatttaattcccctaaaatgtttggtagaattcagcagtgaagccatgagatcatggactttcctttgatgggtgactttttattactgcttaaatcttgttactcagaattggtcaattgaaattttctgtttcttctaggttcaatcctgatgggttgtatgtgtctaggaatttattttctgtaggttttccaactttttggtttgtagttgttcataatagtctctaatgactctgtatttttgtggtatcagttgcagtgtcatttttgtatgtgtttgattttgagtcttttctcttggttagtctaatggtttcttttcaaaaaatgaacttttcattttgttgatcctttgaatttttttttaagtctcagttttatttattactcttctgatctttattaattctttccttgtaattttgggtctgatgtgttcttttctagttccttgagaagcattgttagatttttcttttttcttcttttcttttttaaagagacagggtcttactgtgttac

SEQ ID NO: 185861 - DNA, 106 bp, Homo sapiens
cattccagtatggctcaagctaaaagaactgacctgagcttgggcttatttgtccatcagactacatcacagtatttaaaggcaagcttaatctgatccaggctgg

SEQ ID NO: 185862 - DNA, 117 bp, Homo sapiens
aaccccctcactcagtgtgctgtagagcactaatttcaagacttgccagaatttctttttgttttttgagatggagtctcgctgtttcgcccaggccagacagtggcgcgatctcgg

SEQ ID NO: 185863 - DNA, 233 bp, Homo sapiens
cacagggctcccgttgagacacgagagttcttccccagaaatcccactgggggcccgacactttctgttaggaactgagagcagagacctcgatcccgcaggcaggaggagagctctgcacaacacagggcctctctccataagggcttactggaaagtggtcagaccggctaagtcgtgccacttggacatttgggacaaggaaggcccctggaggagcggtcgcagggagg

SEQ ID NO: 185864 - DNA, 169 bp, Homo sapiens
gtgatgttatccccaacactggagtcagaattaagaaatctcttttcctgtctaaattccactcagatttcttgataaggatagtcaaggcaaatctgaaataaccaagttaacccatatcaaaaatgactgttaaacagcctggcaactgtgttgggcgataacatca

SEQ ID NO: 185865 - DNA, 162 bp, Homo sapiens
tgggcacatgagaactttctggtgtgacagaaatgttgaatagaggtgacaatcatataactctataagtttactaaaaattattgaactgtacacacacaggccaggtgcggcggttcacgcctgtaatcccagcactttggaaggctgaggtggcggatc

SEQ ID NO: 185866 - DNA, 177 bp, Homo sapiens
  misc_feature (20)..(20): n is a, c, g, or t
ggtcgatctaaggatccccntcctattgtgttaatttcctgacatttgcagggtcaatggttctacttactgatggctttctttccttataccataatgcaacaagcagttcacctattccaagttgagagataaggaaggtgacctcttcaggtaatctccaaaaaactttttaat

SEQ ID NO: 185867 - DNA, 445 bp, Homo sapiens
caaaaaaaggagcagaagctctggtacagcagctccatgggcatcaggaatccagctcctgtctttctcagcaccctcaaggttgcctcatggtctgagatgactaccagggaactagctatcatgtccacattccaagccaaaaatagaagaggacaaagtgacatatgccccctcccttttaactattcttcctagaagttccatataacgctggccagaaattaattatgtatgtagatatacccacccactaaggaggctggggaatgcattattaaggaataagaggagggtaagtgttaagagacaactaccagttcccacaccctccactgagaaaatattcagactatagctgccttgagctctaaacttgtacgcttcaaatccttaagtctggctggatttaagcaagaggcaaaccttttcttgggatggagtc

SEQ ID NO: 185868 - DNA, 558 bp, Homo sapiens
tccatcgagctcggtaccgattacgctcctaacggaagaggggaggagagagataagggaagggtattatattgagggtaattaaaggaagtgaaagatgtgactgggagggaagaaggcgtggagtgatcaaggataataggagaagtggtcgattggggtgtgtggcgagggctaggggtttggcaaagacagctgcagagaatctggcgtgtttcggtcccgcccccccatccaccgcccaccagcaccagcacgagtaccttccgggcctacagtgctgatgagcacctctgctctgccccgggctctcccggcggcggccagcaccggcaagcaacccgggacgccatcactcacgaacagtctcatttcgccgtgaatccctcgctgatgcaaccggaaccggcctcccgcttctgagttcagcggcctccgcgaggcacgccgggaaatggagttccgtattaggccactgccctggcaccgctaccggaaagtagactatttctcccatcatgcaacgctaagacacaggaaaagactatcatcgagatg

SEQ ID NO: 185869 - DNA, 435 bp, Homo sapiens
atggagcaatgagctaaattctctacttctgtaataaagtatcaatagataatgactaaaactgaaaaactgaccacagaaatataaatgtgtcatttagagactagatgtataaactactgcaagacttcagtggttaactctggagagcaggaaatgggctgggggagaggcgtctactggttttttgtaacagcccttgtaaaacaacgtccacgtataactttggtaaatttggcagggcacgatggctcatacttgtaatcccagaactttgggaggcagaggcgggcaggtcacttgaggccaggagttcgagaccagcctgtttgtctccataataaatggctcctgactgctgtatttatttcgtgtcttttgttaatttatatttccttctccctcccctcacctttgctgtcaggcagctatccc

SEQ ID NO: 185870 - DNA, 285 bp, Homo sapiens
gaggaattgaggatgatcctgaagtttttggcctttcacagaatggaaaagaatggggagcagcaggggcgttttgttttgctttgttttgattttgttggtggtaggcattgcaggcagagaaatcaagttctgaattagacatgttattgcactgtgttcagatatacagagacatatatcgatgcctagctgcctagttatctaccaagatgtctattggaaatctatgtgggtaaagagctggagttcaagggagaggctagggtttgagataagaacatg

SEQ ID NO: 185871 - DNA, 429 bp, Homo sapiens
aacaaggatggcgtgggtgaggtcactggaggagagaaaggttgcaaggcctcaatcctgagctagggatgggggtgtgcaagagacccgaacaagctaaggaaggaagaggtgggtccacaaagcaagcagctcatcttgtttctaaacaagcccccagatggccttccgatgggaggctgcaggaaataggaaaccaaagagaagggaggatgggtttagaattaacaggcatccccagcccaccccagctcactctgggggctctgtgtgcatcatctgagcagacaccctgagccacaaagtgcccaggtcagtgctgatggctaacacagagtacatacccagcacatagtacaggctgcccagcatgtagtacaggctgcccagcatgtagtacaggctgcacgctgctctcctggaatgggg

SEQ ID NO: 185872 - DNA, 4918 bp, Homo sapiens
  misc_feature (292)..(292): n is a, c, g, or t
  misc_feature (671)..(671): n is a, c, g, or t
  misc_feature (1677)..(1677): n is a, c, g, or t
  misc_feature (2207)..(2207): n is a, c, g, or t
  misc_feature (4406)..(4406): n is a, c, g, or t
  misc_feature (4794)..(4794): n is a, c, g, or t
  misc_feature (4890)..(4890): n is a, c, g, or t
gataccactcttaaaacagcttaaagtatgaatttgtgccaaacactgttgtaaaaagattactaccctagcatcccagtctccgtgtctataacaggtttcccagccttcattacgatctacttattccaggcagtatttgattggaattcattattgtaggatttaacttacaggaatttaggtgtattatttgagccataatgaaaagaattggcttagatctcagaatcaaggtggtgtttgtaccccaaaaaacttgttcgggggctgctacattgtaggggagggngagctgatttcccttgctgctttcagcagggattcttcttgtttgctttctatagagggcgctgtagtccacatctttcttgggaagtctgagctccctctctaccaccagcactcagggaatggtgaagacattcattcatacccaaggctgaatcctgaggcgagaggcagggtcagggcctgatgagtgcatgaagatcttaggagagggggcagttggggcttggaagaattggtaaaggatctggaaaggcagcctgcatcaacattctaaatctgcttgaccagactgttgaccacttaggttttctgcattctagaatggcggggagcagacttctccagggagcacttattgctctctgttatgtcttctncttactcttgtcctggctcttgagtggactgaatcatccagccagagatatcctttccacctttccaccttgaggaggcatccggcgtcctggccataacaggatctgctatgactcagggtttgaagaagaccttcttgtaacacggtctctcctgacctgggcctgagatgcaaggctcatggatgacttttgcagccaggtttcaggagagtagagtcaatgggacacagctctcaagttatcggagtctttttaaaaagtcttaccatgaaacaaaaggatatctcgtgatgctaggaggatttgcaggtgttcccaaaacagcaacagagagggggaatgtcattaatggcttcttatatttggagaaaaaaaatcatttctctttgtcaaataaaagaatccatctcctgtagttaatgatggcacagcagtctgagaatcccctccctagtgtgacagttgacaggagcacaaagactaagcactgcagcacgggtccattctcagactcatttcatttccacaagtttcccattgaatacagaacataatacttttattttgcagcgtatcaattgccaagtaattattatttatctaagagtgggcttgatgcatattcatgatatgattttatcagggaggcatttgaattcgaagtcactgctaagtactagagagaaactatttgcaaatgtgtaatccacacaatagtgttgtggcggtggaaggaagcattcaatctccaaagcaacaagacatgtaacttatcacaggtctactacagtcaggatgaaaccttaagagtagttttctggtatagaatcaattgtcagtctccatgggaaatcctgccctggccctgttttaattgtgtctctcctagaagacaatgaatctaggggaaggaaagggtgtggtattagagatttgcttcatgagcctctctcggttccacatgtccacaggctgagcacccttagcctctcactcacttggnatctgttgaatatagttgccctgcttgactctcaatacaagcagtgtggtgatcaaaaggccaccatactgcatctgtgtcccacatttgtgagatgactttagggagagtcttaggcttccaaaatcatcagataggacgttggggtcatctgataggttcttgaacatactcctgtacctctgtctgccatgcccatctgtctctgactaccttctttctgttcgcatcttgcttttgctgtccaggaccacagcagggatattgtacatttcagctggctttcagctctcctgtcctgcagacggattcggtcctaaactgaccttcagttagaggtttctccgcacactgttcattcttccactttctttgtagtgtttaattcaagggcttttttactagtgtctatatccttgggtaaaaacaattacgtaagatgtagctggattaataggtgggtcttcttggcatctttcacacatttgaaatagaccaagtatagcaagcttggtttctctacgcggggnggggctgatttcagtttccagcacgaggtcagctcttacttgttctgtcagactctgttgccaccaaactgcaaggcttctgtctgtctttattaaactaccagcagtccccagaattccagtgagtaaaactatgacctcagcctttcaggtgggaatagtttccttctctcggagagcatccaaatcctcctatgttgttcctggataaaaatctaaggataaagacagtttcttgcagacaagtgtacccttgatgtcacttgttgcactatttatgtcgtcccccccccaccacccccatttcttcccacagactagtctagttctgctgttgccatggggaccaggcttaggtttccttcacagtgtcctgatttggtctaagaccgcaagacctctcccagcctcaccctaaattggttctgagctggtctcaaaggggcccgccctgaccttaaaggtatatgggcaaaggtggtattcaaccaactcttaagtatttccgggttagacctcagtgggtaagtagtgaatacccaagtccctctgaccgctcttccgacccagcatgaggcttgcctggctgcactagcttcctgcttttaggtggaccagaagttcaagggtgtgaatgagagtatagctaagcctcgaagcgaagctgggatgtagctggcacctgcatggccatgggctgggccgacatagtctcagaactgatctgggcactgtggctgattggcaagtgttaagtaggccaggtctattcacagtttgccaattcccagcctttttcctgaggaaagtgttagtacagttcagtattgctatttaaagatttctcctctacctgctgccacttctgtttgttcaggaacaaggaattggttatttatgcttcgcaatcatgtatgctgtagttagaggaacagtgctaacaaaactccgcatccccaccccaggccctctatttagcatatgtccctgtggcttctcccagtccccagcacgctggcatgcactgcccaagtccctgccatgtgcatgctgagacagcggcgcctgcctctgcttctgtgtccagtgtgtggtggggcaaattgctctggttctctccactgccatttccatgtgcctgctactccctaacttcagcctggccctgccctcacttctgatggaggagctggagtccaggcaagtaagctggagagtgagggcgccaatggtctggtgtggctgggtgggttgagggtgggtttcagagtttgggaaagcagtgtagagctggagggtgcagggctgaacttttgtgtgtcatgatgaggccagagtgcagagctggacatctgagccctggcactcgggacgtggccgtagtgtcacatcactctgtgccacatcactgacttagtatgtaagtacaacattcattgccaaagacaacacagttctgcaaaggagacactaatttgtacctttccagaaagaaatatggtctacttttacaaaaggggcttaattctttgaaagaaaagcatgctaaatacaaaaaaaaatcccatctggtggggaggaggtggtgctctctgcccctgttgtatgaatggggaaacaaagcacagagggctgtagcagactgcccaaaccaaggtttcacgtaacgctgcctcgtttcagtgcttcaagttcgagcctacatagttataaaatgctgcacctcaaagttaaaagaagtccaggctattttgtctcagtatggcctggtttgggttctcctgcagcacagcctgccacagcttgaggtttgagccttatgcccagtaccacttttgacagctgcagaagcagagggctcattagtgctggctcaggcagtagcagcagtgggtgctcacatattcacaggacttgaaaatacctgaaatagtgtaactgggtttacagaggtaaaactcttatttaatctggtacaaggagcattttctcatggcacttggtgccaatggatctgcgatgggaagcatttgagtcaaaggtcttcttctaggtattgctggtactccaccattgaacttgggtacctgcaaaaaaagctttcaatttttttcctggcttctgtaagaggggacttttccttcaccctcaattctaattctgacttcacaatggggaactgagagttttcttcaatgngccattaacaaattgcctccagtactgaccacaatgtcaacctggatgtagaattatcaactgtctcagcctcaagccagtcctctcggttgacagatggagaaactgaggtccagagagaagtgagttgtctacaactgcctagggagtacccaacagacaagcactccagctcctggtctggtgcattcaaatggcctgtcctgttgggatgttcagactggaaagcaggaaactgactctgggctgggcatggtggctcacacctgtagtcccagcactttgggaggccgaggcaggtggatcacttgaggtcaggagtttgagaccagcccggccaacatggggaaaccccgtctctactaaaaatacaaaaattagctaggtntggtggcgggcgccagtaattccagctgtttgggaggatgaggcaggagaatcgcttgaacccaggagggagaggttgcagtgagctgagatcatnccactgcactccagcctgggtgagtctc

SEQ ID NO: 185873 - DNA, 242 bp, Homo sapiens
gtacagttattcgtacggacgcatcagtgctgtggggcacagagcacgctgatgcgcgtgtggcgtgaaagatggtccctctgcaaggatcggcaccgtggcatgggaccagccactccaaaatgccaggactcctgtcctgagtctgtaaccacttttatctctattataatttattctcccagcctacctcctcagtatacgttctctgatttttttttttttttttttttgagacggac

SEQ ID NO: 185874 - DNA, 107 bp, Homo sapiens
tgctgggattacaggcgtgagccactgtgcctggccagtagagctactttttatactgtattcattataaatgtctagattgatgaaacaaatgaaagattataata

SEQ ID NO: 185875 - DNA, 279 bp, Homo sapiens
ggtgtgagccactgcgcccggccgaagattattattttaatgaccaaaatgaaatcacatctttaggatagatctcttctgggtgttttatgcctgagaggcagatacacagtgaggcagttatggtctctagagccctgccttgctacttactagagttgtgaccttggatagaatattcagagtgtgctttaatctcattcgtgaagtagggatgatagtagcacctatctgagttgttgtgagacttaagtgagttaatgtatgtaaggcatatag

SEQ ID NO: 185876 - DNA, 197 bp, Homo sapiens
atgatttgactccaaccaaagtatggcacatgaaaatgagggatcagaattggcacattttctgatttttttaaaaaagacgtcaaaaattaagagttgaacttcttgaatttaaaaaatgccatgtagaccaagcaaaacacatcttttgcttgtctatttttgacctctgatttaatccctttcttttcctcttc

SEQ ID NO: 185877 - DNA, 400 bp, Homo sapiens
aggctggtctcaaactcctgacttcaggtgatccacccgccatggcctcccacaatgctggaattacaagcgtgagccactgcgcctggcctgatctttatatttttagtagagacagggtttcaccatgttgaccaggctggtcttgaactcctgacctcaggtgatccacccgccttggcctcccacggtactggaattactggcatgagccattgtgcctggccttgcaacttccctgcttccatcctatccatctccccgtcgctcacttggctccagccacatggctgatcctccagaatgcaggctggtccagcctcagggcctttgcacttgctgtccccactgcccagagctctgttccctcctttcttcttccgtcacatcctcatcaagg

SEQ ID NO: 185878 - DNA, 855 bp, Homo sapiens
gagtgtcagcattctgttccccatagaataagaagaggctagaaagtttacagatgagatatctaggaatgccagaagatcaggggtcaccgttgaggcagagtaattaattatggttaaaatggtgttgctgataagtgggtgctgggaaataattaaaatttgattttttagaagaatacttctcatgcttgaagagcgccctcattatatgctaaagggcctcaggtttttccttattgccattatgctgcagattctattacatttgtctgaaaagatctaagacagaagggctgtttaataccttcccttttctcctgaacttcccctctcctctcccccatcaggagctaagtaggaaccccttcaccttgttaccatcagatttcatcaatggtctgtctttacaatgaaggaagtagtactgcattctgggcagaggccagtcctgaggcatgccttttcaaggacattgttactttagttacactggctcttctgttttaactcttatcccccagactctaatcctgttgctttttttggtccccatctcccacctttcatcatctgaaatccattcattgtaacttctggaactcagtcgttagaaaatcctttatattctcaatcttgtgaatgttcctttctttcttattccagctgtaacctagccttctccccaagaatgctacttcccttgcagctctctcaagtggtgaatttttcccttcttgcacaccttataacactgaactaggaggtgtgtggactaaatgtctgcttttgttccttattgtcacttcttgacctttattttccaaaacttcaagctttgactttcatgtgatc

SEQ ID NO: 185879 - DNA, 207 bp, Homo sapiens
gaaacttacaattacggcagaaggtgaaagggaagcaggcacctttttcacatggtggcaggagagagagagcgtgcaggggaaactacttttaaaccatcagatctgagaactctctcacttatcacaagaacagcctggggaaaccacacccatgatccagttacctcccaccaggtccctccctcaacatgtgggtatcacaat

SEQ ID NO: 185880 - DNA, 353 bp, Homo sapiens
aacaaaagcatttgagaatttctgaccaggcagtgctccatcaactcttaataatcatctttgtgatattctcctatgtgacttgtccatcaattattccaattcaaaggtctaggttttttttcaattgtcttacacatgtgacatcacaagataccagaagtagcacagtaaattcaagagcatataaagctaagtggaaaactaattcttcatatttagacagtggaaattctcaaaacaatcatttgctaaattaggtccaaatttattattcattcttcttctggaggagacatgggtaccaggtacctgttctgctgtaggtatatttcactggacttggtcttagc

SEQ ID NO: 185881 - DNA, 357 bp, Homo sapiens
aggcgctgcgttcaggtcgcagtctcccctggaggcgtgggttcgaatcccactcctgacaagccgaccttttggcccgcccgccggagggcaacgcccatggcaaccctggagcacctttggccgcttcctgccttgagcccttgcccgctctccagactccagcccccttgaagcaagcctccaaaacgccgccgcttctcaggcacgtccgttcttcctgcccacccgccggctgtcgcagaaacagcccaggaccatgcgccagcgcccgcgaccctctaccaattgcccttcggacagacgccctccccaccacctcacacgccctcttccctggccccacacacagcgagc

SEQ ID NO: 185882 - DNA, 525 bp, Homo sapiens
tctcagtaggatggctcacaattacataagccagaacaagtaaaaaaagtactcagctcagccagaacaagtaaaaaaagtaaaaaaaaaaaaaaagtactcagctcaacatctggccttagcagacctcaaaccttatttaaataccaatattttggcaaatagttgatttgaatatgttcaaaggggagaagaacagatcctataacagtaaaccttctttgcaaagaaaaatagttcctttacataaagagcaaagaaccagttccttatttggagttttgaggactgtggtaggcagaaaaggggcccccaaagatgttcatcatatactaatccccgggaacctgtgcttatgttgccttacagggagatggcattatatcaagtacctgtagatgggagattacgctgcattaacctgcttggtctaatctaatcacctctcagtaggatggctcacaattacataagccagaacaagtaaaaaaagtactcagctcagccagaacaagtaaaaaaagt

SEQ ID NO: 185883 - DNA, 361 bp, Homo sapiens
tattcagtgaatgtgactcttcaatcctttaagtgaataagaatgctatgctttatctgtgcaatcctgggaaatattaatgatgtgctgatagtgtcaagaaaggcagggtctataggtttatttagcagagttgctagaggacttaaaactgcatgtcatggtttctaacctcttcaaaatggatgctgaattaagatgagcccttcccaaagcagactgacaaagtgactaattgctggctgctggcagaggactgatttcccctctctctgctgtccagcgttattaccctcgtccattttacagggaccaaatggcaagtttaaggtggaagaactgtgtttgttcacctgtgagt

SEQ ID NO: 185884 - DNA, 1798 bp, Homo sapiens
acaatcctttgcggtggttcaagatggcggcgcccagtggcactgtgagcgattcggaaagtagtaacagcagtagcgatgcggaggagctggagcggtgccgcgaggcggcaatgccggcttggggcttggagcaacgcccgcacgtggcagggaagccaagagccggtgctgcaaatagccagttgtcaacctcccaaccgagcctcaggcataaggtgaatgagcatgaacaagatggcaacgagcttcagaccacccctgaattccgagcccacgtagccaagaagctgggagccctgctggacagcttcattaccatctcagaagcagcaaaggagccagcaaaagctaaggtacagaaagtcgctttggaggatgatggtttccgccttttcttcacatctgtccctggaggccgtgagaaggaagagtctccccaaccccgccgaaagcgacagccctccagctccagcagtgaggacagtgacgaggagtggcggcggtgccgggaggcagctgtgtcggcgtccgacatcctacaggagtcagccatccacagccctggaacagtggagaaggaggcaaagaagaaaaggaagttgaaaaagaaagccaagaaggtggccagtgtcgactcggctgtcgctgccaccacccccaccagcatggccacagtccagaagcagaagtcaggtgagctcaacggggaccaggtgtcgcttgggaccaaaaagaagaaaaaggcaaagaaggccagcgagacctctccattcccaccagcaaagagtgctacagctatacctgcaaactgaacccagccatgggcacagggctcagccagctccaaggacaaggtgtcccccccaccctggggacaaggcatttccaagccccacctccctctccaagttcaaggactgggctggcaaacccagactgcccatgagaccctgatggtgatgaaggcttgctcgagagttgggccaaaaaagtggctgtagggtgagaagaccaatcaaggcctgcccctctgtgctcccacggagggctggcgggggcgctgtggttccagaacatttcatgacctcaggaaaaaaggaaccttccagttatttgagactagtggccaagtggtgaaacctccatctccctagaactgtctgaggtgggcaggggaagggagaccttccccaccacctccttagcctggtgtgagaaacagtttttagaaaatgagagaagggatccccaagaggccaaggcccagagaaacttttgttcttctctccttagcccacatagacttaacagaatcgtctgagaaaggagagctttttcacccctggctttctagaattttctttgtctgcatttgtgaatataccacacatgatggtgtctctgagccgaccagattatggaaactcaattgtcagaggacccaaaacaaaacttagagtgatttggatattgcctctctgtcaatgctgaaccttaagacattttaagtaaacatcctcctcctctctacacccccaggatttgtgcgttcaccccacccaagacttcaggaagtgtcatagcactcgtggactaggtttcatgggacaaaggcattctgcaagaagtagaagcttgtggccgggtgcagtggctcatgcctgtaatccaagcattttgagaggccgaggcaggtggatcacttgagccaagttccagaccagcctaggcaacatggtgaaacctcgtctctataaaaaaaagaatacaaaaattagttgggcatggtagtgag

SEQ ID NO: 185885 - DNA, 1642 bp, Homo sapiens
ctcggctctaccttgtctgaggctcgatgttgtcaacctcccaaccgagcctcaggcataaggtgaatgagcatgaacaagatggcaacgagcttcagaccacccctgaattccgagcccacgtagccaagaagctgggagccctgctggacagcttcattaccatctcagaagcagcaaaggagccagcaaaagctaaggtacagaaagtcgctttggaggatgatggtttccgccttttcttcacatctgtccctggaggccgtgagaaggaagagtctccccaaccccgccgaaagcgacagccctccagctccagcagtgaggacagtgacgaggagtggcggcggtgccgggaggcagctgtgtcggcgtccgacatcctacaggagtcagccatccacagccctggaacagtggagaaggaggcaaagaagaaaaggaagttgaaaaagaaagccaagaaggtggccagtgtcgactcggctgtcgctgccaccacccccaccagcatggccacagtccagaagcagaagtcaggtgagctcaacggggaccaggtgtcgcttgggaccaaaaagaagaaaaaggcaaagaaggccagcgagacctctccattcccaccagcaaagagtgctacagctatacctgcaaactgaacccagccatgggcacagggctcagccagctccaaggacaaggtgtcccccccaccctggggacaaggcatttccaagccccacctccctctccaagttcaaggactgggctggcaaacccagactgcccatgagaccctgatggtgatgaaggcttgctcgagagttgggccaaaaaagtggctgtagggtgagaagaccaatcaaggcctgcccctctgtgctcccacggagggctggcgggggcgctgtggttccagaacatttcatgacctcaggaaaaaaggaaccttccagttatttgagactagtggccaagtggtgaaacctccatctccctagaactgtctgaggtgggcaggggaagggagaccttccccaccacctccttagcctggtgtgagaaacagtttttagaaaatgagagaagggatccccaagaggccaaggcccagagaaacttttgttcttctctccttagcccacatagacttaacagaatcgtctgagaaaggagagctttttcacccctggctttctagaattttctttgtctgcatttgtgaatataccacacatgatggtgtctctgagccgaccagattatggaaactcaattgtcagaggacccaaaacaaaacttagagtgatttggatattgcctctctgtcaatgctgaaccttaagacattttaagtaaacatcctcctcctctctacacccccaggatttgtgcgttcaccccacccaagacttcaggaagtgtcatagcactcgtggactaggtttcatgggacaaaggcattctgcaagaagtagaagcttgtggccgggtgcagtggctcatgcctgtaatccaagcattttgagaggccgaggcaggtggatcacttgagccaagttccagaccagcctaggcaacatggtgaaacctcgtctctataaaaaaaagaatacaaaaattagttgggcatggtagtgag

SEQ ID NO: 185886 - DNA, 527 bp, Homo sapiens
tagcttttagtaattcagcactgaagagtccgaactcctggcacaaagtcctcagatttaaaggaattatatcataagaacataacttaagttggatgtaaacaaagtttagataggtgtgatcttaagatgatacattggtaggccaaaatgggaggacagcttgagtccaggacttcaagaccagcctgggcaacaatgcaagaccctggtgtggtagcacatatctgtagtcctagccactcaggaggctgaggcaggaagaatgcttgagcccagaaatttgaggttacagttagctatgatcacaccactgtactctagcctaggcaacagagcaacaccctctctcttaaaagaaaaagaacagcccaggagtgatggctcacgtctgtaatcccagcactttgggaggccaaggcggacagatcacgagatcaggagatcaagaccatcctgggcaacagagcaagactccgtctcaaaaaaacaaagcaaacaaaaaagtaaatagatcaaagcgtcca

SEQ ID NO: 185887 - DNA, 667 bp, Homo sapiens
  misc_feature (500)..(500): n is a, c, g, or t
  misc_feature (504)..(504): n is a, c, g, or t
  misc_feature (512)..(512): n is a, c, g, or t
  misc_feature (516)..(516): n is a, c, g, or t
  misc_feature (546)..(546): n is a, c, g, or t
  misc_feature (555)..(555): n is a, c, g, or t
  misc_feature (572)..(572): n is a, c, g, or t
  misc_feature (595)..(595): n is a, c, g, or t
  misc_feature (597)..(597): n is a, c, g, or t
ttaaaagatccaaatctcttccatcactcctctgtcattcccataaccctcatctcaattagctcagctcatcatcacattttttcctatttctggtgtagtgcccacaacagtggtgcaggatattcaatggtataaacacactgctagtgtgttttctatttttactgttttttatataattttttttttttttgagatggagtctcactctgtcgcccaggctggagagcagtggcgcaatctcggctcactgcaagctctgccccccaggttcacaccattctcctgcctcagcctcccgagtagctgggactacaggcacccgccaccacgcctggctaattttttgcatctttaggagagacagggtttcaccgtgttagccaggatggtctcgatctcctgaccttgtgatccgcacgcctcggcctcccaaagtgctgggattacaggcattaaccaccgacttatcttattttttaaatggtagggcagtntgcncataggtntcantttttaatcaacttttttgagggataattngagacagtnaaaggggccccttttanctgttgtctgatttaaatatttncncggtccaggtcagcacattagttcgtctttatatagatgttagacacaagttcccatgctgtttctgttt

SEQ ID NO: 185888 - DNA, 218 bp, Homo sapiens
ctgagtgtggagccagcacctggatcaatagaacatttccagcattttggaagccccctcccagtcagtcactcaggagaactttgtcctgacttctaaccacacagattagtttaacctgtttatgtacttaatctaaataacatcatcacacactcccctgtgtcttgcttctttcactcaaaattatgtttgtgggatatattcatgtggtacgt

SEQ ID NO: 185889 - DNA, 310 bp, Homo sapiens
caataaatgtgaaactaaaaatgtgaaatttttaaaatgctgtctgaaatataaaggtatcctaccttaaaatagattttattttagaaacagctatcattttatagcacatgtggtgctacatctttttaatacctttatggtttatattgctactaagcaattaataagatgtcaaattacaggccttaatctgcttgaaagagactggtaaaggcatttcattttagtaaaaaaaaaatttaaatttattcaaaattcatcagcttacacataggaaaaaatacgaagctatctttcattttggatg

SEQ ID NO: 185890 - DNA, 187 bp, Homo sapiens
cctgaacttggaggatgagtgggaatttgggtgtttgggggctccaggaggtttccctggaagaagtaggactggcaggcaacctgggggtcagggggactttaactagttccttagtctcagctgggggtggcaggctgagagggatccattcagaatgcgctggggtcacagggctgggggccag

SEQ ID NO: 185891 - DNA, 230 bp, Homo sapiens
aactttgctcactacccccataaaccaaaatatcagtgacatatttggcttctctgtgtctcaattttgacagctaaaaatggatagtaattcataccacctagggttgagataaagtaagcatatgcagtgctcaggtgagggccaggcaaagaaaagatttttatctgactttgaaaatacagatctcatagctagagcattctttctactgcaatagtccctctccc

SEQ ID NO: 185892 - DNA, 183 bp, Homo sapiens
gaccgcagtactcgggggggatggaagcagaggtcaaggtcagaggagtgatgggggatggaagcagaggtcaaggtcggaggagtgatggggatgaaagcagaggtcaaggtcggaggagtgatgggggatggaagcagaggtcggagtgcagcactctgaggacggaggaagggccatgag

SEQ ID NO: 185893 - DNA, 417 bp, Homo sapiens
tctgaaacttggtcttaggaaagggcatatgagggactggcttgttttgtgcagacggtttagtaaggccctcttcatgaaccagcagcacaacacataggggatattctgaatttccacagcacttattatgctctgttcatctggaaatcaactatttgtgtagttgattttatgctgccactttgtaccattacttttcatttgttcatgctttatcttcttcactagatttaagttctctagggcaagaaactgcatcttacccttctttctacttgcaaaatttagcacactgcctcaacatgaaaaatgaccaacaagtactacagatggttcaagaactaggccaaataattattatttccactcattaaaatagtgtaaactgaaaaatacagtaaaagagggagaatt

SEQ ID NO: 185894 - DNA, 324 bp, Homo sapiens
tcaggactcttctccaggccaatagctggagggaggtgatggagacagatgggcagcctagcaatgacccccagagagaaggccttggacacaggacaggatgcacagaggtgccccatatgcccaaggggctggccaagtgcagggatgacaagcggtgaacacacagaccgcagccccagctactccacaaagcacccaccgcctccagccaggactggcctcatgagtctgtgcccccaactcctgaccgcagcactgaccagcgctgagggccggggccagacagctcaccaccactaccccacttcccgaggctcagca

SEQ ID NO: 185895 - DNA, 1458 bp, Homo sapiens
gagccgagattgtgccactgccctccagcctgggcaacaaagtgagactctatctcaaaacacaaacatacacacatacatacagacccacacacacatacagacacacacacacacgtctatttagcatctgtcccaggcagtgcttctcaatagcatgttaatagatgctaaaggacctttagttaggaggtcaactggtctacctctgtcacttagtagacaagaaggttgccctaaaatatacactaagacagtatgcattacaaaaaagccacaataaggacatagcttaggagaaatgttatgatctctcttcaccagtctccttatatgacactggttcaattcagaagtagaggtgaagatagttaatatcctaggaataaatgttaaatctcccttcccctttcctcacagtattatagtcaattctcataaggaaatggccctaagttacaacattaagcttttctattcacttctaataactgaaattccgcccaactgcctcctcacttgaattccatgtactttttttccaaataaattaaatgactttctctaagtcaaatgctattaaaattcttgttgttcctcaaactctgctttcttgtagtatcaggtttattgtgacttgaatgagacttatttgtaaatggatgtattttccattccatcttgctcttgcatacacacacatacactgaaattcagacttttctgctagctcttagaaaacaaaagcaatgtgtgattcatgtgtcacccactgtgggaagttggatgttgcattgcatttgtctctcagtcttaaaagtcaatatggcaaagtcattagcggcagagcccagaagatatccctgcccatgagctgtggagatctggacaagttactttacccaactccaagactcagtgaatgctcttatccgtaaaatggggacaatgataatatgtcttcctccctttgggtatttgatgattaaatgagaaaacacgtcacacagtcaattcagtgcttcgcgcacaataaaagcttaataaatactagttatgattatgtttagccaacatgtgttggcatctgacactaaataaatacttgtccaatggaaatgaccagaatttagtgcccctaacacttcactgtagtatttgccatatggataagcaatctttattatgctatttggatttagttccaaagctaaccccacctccttatattgaagccagctcctaggccacctgggtaacttttctggcatttcaatgaacacaccaatacaatacaagcataattagactttctggattttagatctattctcaagtatatattgtatagagaaccaagatgttcaaggactgtagagccagttataggtttggttttaaagcacttcatcttagactcatttcctttctggctgatgttagttaaaataatataag

SEQ ID NO: 185896 - DNA, 329 bp, Homo sapiens
attttctttagacattacatcaataaaatgccacagaaaatatttctaagatagactttaataagagaaattgcaacagtgggttttagatgcaagcaaatagagaaaatgaatatatattacacatacacacacacccacacacgcacacacatacacacacacccctacctctcttacacttagttcaatggtaaccatataaagggtttacgacacccctgccatccatttctccaatattgaatttcagctttattgtctcttctcccacctgcctgattcatttaaattgccaactgaagctgataaagttgtagcagaaacct

SEQ ID NO: 185897 - DNA, 616 bp, Homo sapiens
aaagtggagccaatagtcaaaaagccacagttgtgaagattaaatcgtgtaatagggatgtagcttctccgaggaacactttttcatttgctttctagttattagcagaagttgagacacaaaagagaaatgacaggctaaacattatatgggtacatgtactgttgcactaaaggcatatctactagtgttgtacaacagtgggtaggagatctaagaatgccaacagatggttttgaagaaaaggagaataacagcagctagactaacatcctgactgggagcattcattcattcagaagacaatgttgagtaccatatctctggagcctaatggcattactgtattctgatgtccagaggcacatcctcaatactaccgtttgctcatttcaggagtttcataggagattattgcatttatcacctgttgtgcccctgcccttcattctggctctgtgatcagaacacacctagaagccttctgtttcctaaatgtaacatgactattcatagtgtttcctgcacctttgtttatgctcctccatttgcttagaatgcttttctctctgccaggtaaactcctatttattctttcgtactgaattccagtgac

SEQ ID NO: 185898 - DNA, 211 bp, Homo sapiens
atctccctggaggggtggaggtggctgtcaggcaggcggggccacaccggcagcttagataaccccgagctatttcaggaagaaagcactaagaagataaacaggccagtggccagcagatggacagataacctgagcttatccaaggagaggcaggagggggccctttgggggcagggtccttcaagacaggaaggtgccaaagtgcgtc

SEQ ID NO: 185899 - DNA, 776 bp, Homo sapiens
taagtcaataatacatttttagttaaaggtgtatttatgatcagtttattgtacttgtgctataattttctttattattaaataaaattttgagacacttttaaaataataaaaaccaaaaagtggtattttaaactcagtttctaaatgatgattgactaaagttgtgtgtgtgtatgcagacatacgtaaatacacacatacatataggctatgatgatgacaactatttacttcaaattagatgccttctgtatgtatattgaccagaatacattgctcaagtgatttttaaatatttgtataatttttaaaaattaccatgagacgatttgagctgttgcaactaaaatatttattcagtgtagtagctatatgtagtgtggatttagctacttaatcgaaacattctttagagtccttcaaatatttatagtcagtttttcagttactaaatatgaggtggctactaaagagtaacaaaaagtagatggcatttactgccattggctctctgtgcatttttgcattctcattaaatcccatgccgatccagtattttaaagtatttcaaacatttcctctttttttccttcagaagcagtttttaaaaagtgaaagttacatagaaaatggtccatatgaacaagatagcaatttaaagtatagacttttcacttactgttaagtctgggttgaccaacttcagccatttggaacagcaactctttacttggaattaagcagaaaagacttttgagtagcaaacgactatc

SEQ ID NO: 185900 - DNA, 264 bp, Homo sapiens
cgtatctagggcagaaaacaaaccaacacatttaaaagaagtgaaaccatacacagtatactctctgtccatagtggagtcgaaccagaaatcaacaaaagagagacaacaggaaaatcttttctttttttttggaggcaggatcttactctatcgcccaggataaagtgcaggggcacgatgtgggctcactacaaccttggcctcccaggttcaagtgatcctcccacccgcctcccaggttcaagtgtgcaccaccacacc

SEQ ID NO: 185901 - DNA, 239 bp, Homo sapiens
caccaccatcgctgcatcattgccaccacctccataatcatcacctacatcaccgtcacctccaccgtcactgccatcacctccatcatcgtcgtcacctccgtcaccaccaccaccaccgccatcaccacctccctgtcccagcaaggccatatgtccactgagacaggcgctgcagccgagggggactcaggtgaagctgtctgaggaagaattcacacagagtccagttcagagca

SEQ ID NO: 185902 - DNA, 404 bp, Homo sapiens
tattgggaaagcccagcggaggaagagctcctgaggagtgagtggcgtagctatctgcttcatgtggggcgctcctgctctgcagtgtagagtattttttaggtggactaggagcaaatgcctgcctgatacaggcaacgtttgcacaaaaacccaaaggaagaaggctgctggtaggctaggggtggcaggtgggattgcccttgggctttaaagaaggctgagaaaacttacttccagagtgggaggcaggaggagtgagccttggaacaatagtggagtgtttgtggtggacggacgggagagaggaacacttgagggcatgaacttacttctgtctctttacttgaaaaagcaatccactgagctaagaccctaaaatacatcaacccagagggcttcct

SEQ ID NO: 185903 - DNA, 456 bp, Homo sapiens
catccatgttgtagcatgtgtcagtatttcattcaattttatagctaaatgatattccactgcatcgatatactgcattttgtttatccattcatcagttcatagacacttgggttgtttccatctttggctattatgaataatgctgctataaacattgatgtacaagtttttgtatgaacatgtttccagttcccctggctatacacataagggtgaaaatggtgggactattaatatccttttattagcattctaggataaatttctagaagtgaagttgcagggccaaagaatatacacattctaatttagaatccaattataattttaaggtttcactaattaggagtcaaaaaaatacttcatcttatgtcacctaatcaactatctctaacatataaaaggcttctaaaaatgttaagaaaaagactaacagcccaataaaaagattgg

SEQ ID NO: 185904 - DNA, 348 bp, Homo sapiens
caggcctggcagcatccagcataagctgactgaggagccctgggccttaagtgaacactggtggtaccctggcaataatcccctcttcatgggcctgtggtgctgatggacacaggagcaactcctctgcctgaagaaaggggaagaaagaatggtaatacagagtctggtaatacagagaattctggaccttatccaagaccaccaagatggtacctctataagtctagaagaactacagcattactgggttcggggtaccccctaatgcagatacgattacagtgaccaaagacatagattgcaacactctattccctttgaatacttggaataccttccaataag

SEQ ID NO: 185905 - DNA, 249 bp, Homo sapiens
ggagcgggtgagctcagaccttcctgagtcagcagggagtatgagtgagactctgtccttgtcttgcggcaggagtggtggggttgctaagtcagctgcccgctgttttatggggagtaggatgctctcgcccctgacattggttagttcttgcctgatttatgcatgaagtggctgggagctcagcagtgagcttctgcccagaagaatccacagggcatgttcagcaggcccgctgaagatgatgtt

SEQ ID NO: 185906 - DNA, 350 bp, Homo sapiens
gttgcagtgagctgagatcacgccactgcactctagcctgggtgccaaaaaaaaagaaaaaaaaaaaaaatatatatatatatatatatgattcagctattcagatattgtgtattatttattgacttaaaaggagtaagggaaaaaaaaggaagattcaagtgtaagtatgacgggtctgatacttttaaaaaatgtgcatatgcttacttagaaaaagctttgcatgattctattaacatatttagggtgtataaggtatataaaagttacttttaattacaaaatgcatctatttctgtagtgtttgaattttttgcaaaaaaatatattgatgttttacttgagtt

SEQ ID NO: 185907 - DNA, 446 bp, Homo sapiens
tgcggcttgcgctgcctgccgtgtggccttcggcagccagcttccctctctgagctaggagggatccgagaactgagaccaagcagtgcatggcatgggtccccaagagctgctgctgtggcgggtgggcacacacatcactgggtgagtgtgggactccagggtgccacccccagctccgtgactcgccagccccttgcccctggccgaggggcccacctctgagctgcctccctagcagtctggacagccgtggctggcacttggtgcttcctgaacagggccaaccttagaaagcaagtgatagggcaggtgcggtggtgcacacctgtaatcccagcactctgggaggctcgcttgaacccaggagtttaagaccagcctgggcaacatagcgagaccccatctctattaaaataatgataatgataataataaagaaaggg

SEQ ID NO: 185908 - DNA, 285 bp, Homo sapiens
gagattttcttaccagccatgatagagcctggaaggcaatggaataatctgttgagaattctgagggagatgactgtcaccctagttaacctgtctttccagaacaagggtaaaacaaaatgaatgtgtaagcatctccttgaagattagggaaagaagatcctgggaagtttctagcaagcagagactggtaaatgagaatcgacagtacaggacccattccagctattttcttaggtgtaatacactgatactatccttatgtaatgtgttgtgtgtatgtgt

SEQ ID NO: 185909 - DNA, 461 bp, Homo sapiens
taaaataatacttaatcttactgaaaaactttcatagtaaatatgaatagaatataagcacatttagtctagtaattcaaacaatggccctgtattttgtttttaaataacagatcttaattttcagggccccacctccattattactattttttttatttcaccgtggacctgaaggcaacccctcccattagttttgacaactttttattatgaaataattttcaaacttacagaaaactttcaagaatagtgtaaaagactcccttataactttcattcaggttattagtggttgacattttgcattatttgctttgttgttatttacatatgtattagtttttttcccttaatcgttcttaattactcccaagtaaattgcaggcatcctgtcactctgtccctaaatattaatacttcattgagtattcctaagaagaaagacaaatctcttacat

SEQ ID NO: 185910 - DNA, 762 bp, Homo sapiens
aaaaaagaatgcaatagaagtttgtcttaatgcctgttctgtgatgcacaactttcgtaagccaaaattttaaccttatgaacaatcagttctgtgctgcccttagcagagaaccataaattaaagataagcaatggttcagactttccagggccttgactcaggagtaactctgaaatcccaaccaaatatgtatttggttaagcaatttggcacatttttctattttgaggcattaaactataattacaagtcacttttatttcattccaaataaatgtccctaaagtagatagaactagaggtttcctttttttaaaaaaaggaaacaggaaaacaacaaacaaaaccaaaaagaacaaaagcaaaacaaaacttagtcaagctaacaaattgcatgtatggtgtgttttataatttaatcaatataaaaaattgagtgtgctagtgcctcaggaggactcagaggactcaaatactcaataggttatctggaggaatttctcattggagaaaaaaattaaagttcttttgaacaacccacataatcaagatagtaataatttaacctcaagtttttccttgattaaaaaatccctttgctattctgctccagtgtttgtaatagatggttcaacaagactggtgttttgttagttggaaaagtaagctgatatgaggggtggggagaggaagggcagaaatttattaacaatcagcaagtaaagaaaaacagcctgcaaattgtaatgaaaggaagaa

SEQ ID NO: 185911 - DNA, 785 bp, Homo sapiens
taacacttaccactttctccctccttctatagaatccctttcctattcttcgtgtctgtaattattgttcttttttttttcccactgtgcttaattccctctgagatctaggaaaataatgcccaaaggtgtaagtctcaacttttttaggtataactttagtgtgtttcatttggctctgatacaggcacgcatttcttagaagaagggacaagggaccgttattccccacccccatgtatgtgtgtggaaaccctgcttgagggaagaggaaggaagctactccgctgtgctgtgctatgtcctgccctgtttagaactcctctgagtggctctatgcttcctgagactacaactcccagcatgcttagcctcaggcctggctacacatgctcagtaactctcaaggtccacttctgttaactactagggatatctgaagaggaagggcagttggtgttgctaagggcaatgacctgagaccttcaggctgggtgagaccctgagctcagttagggcatgggccgggggttggtctgagctggatttgggttggaagtgggtggaaattagggagtttcttcttttgtaatggtgatgtcctcgtagaaacaagtggcggtgggggagatccatccatagctaggctgtagttccagtagtgtgttacatctcttgcagtgcctcagactctgcctctgggagagggatttttgctggactcaggcttcctgggtcatgactacccctgggttggcacagactggcctctagaatgggagctt

SEQ ID NO: 185912 - DNA, 395 bp, Homo sapiens
taacacttaccactttctccctccttctatagaatccctttcctattcttcgtgtctgtaattattgttcttttttttttcccactgtgcttaattccctctgagatctaggaaaataatgcccaaaggtgtaagtctcaacttttttaggtataactttagtgtgtttcatttggctctgatacaggcacgcatttcttagaagaagggacaagggaccgttattccccacccccatgtatgtgtgtggaaaccctgcttgagggaagaggaaggaagctactccgctgtgctgtgctatgtcctgccctgtttagaactcctctgagtggctctatgcttcctgagactacaactcccagcatgctctgaagagtgttgtactctatgtaatc

SEQ ID NO: 185913 - DNA, 890 bp, Homo sapiens
tcgtactgatcgtgatctttagataagccaggcttacctggcagataatcgagctcgagagccaaaatgacgaacacaaagggaaagaggagaggcacccgatatatgttctctaggccttttagaaaacatggagttgttcctttggccacatatatgcgaatctataagaaaggtgatattgtagacatcaagggaatgggtactgttcaaaaaggaatgccccacaagtgttaccatggcaaaactggaagagtctacaatgttacccagcatgctgttggcattgttgtaaacaaacaagttaagggcaagattcttgccaagagaattaatgtgcgtattgagcacattaagcactctaagagccgagatagcttcctgaaacgtgtgaaggaaaatgatcagaaaaagaaagaagccaaagagaaaggtacctgggttcaactaaagcgccagcctgctccacccagagaagcacactttgtgagaaccaatgggaaggagcctgagctgctggaacctattccctatgaattcatggcataataggtgttaaaaaaaaaaataaaggacctctgggctacaaaaaaagaaaaaaaaaaaaaaaagaaaaaaaaaaaaaaaaaaaaaaaaaaaaacaaagaaaaaaaaaagaaaaggagaccaaaaagagggggacccagaacgagagacacgcggggggcgcacaagcatgtgctgaagacacagagcgcgaaacaaaaggaggggacataacaaagacggagaaaaataaccgagacagaacgcgcgagagagaaaacaacgagcgggcacagaacaacagcgaaacatagacatgaagcagacggacacatgagggagaaaacacacacaagaaaacacaa

SEQ ID NO: 185914 - DNA, 572 bp, Homo sapiens
caaaaccccatgtctctcttctagtacttcgacgttcaggcctctcacatttgcctctaatcaaaatatggagtacaaccagcctactgtttcctagtagggaggtgacaaagtcttggggttctagagatgtatgtccctgtaattgacagagccctgctatgtctgtcaggtgtggtcttcaggtagaaattaaagtaacgttatgattggggtcagtgtcttcccaaagcattaacatgaaagcaagcatagtacttctaccacaaaccaggcctgaattcttattctgggtcctgtctggagccttcaccacgagctctgaccacaagctaagcatacaaatgaatgctgtaaaagaaatgatcttctatgcaatctaccacagaaacagaggcctcagagatttcactaaactctgaatatggtttatattgaaaagtctaaaataatctccctaattctggaaagagatctggtaaaaggagttaacagaaattaggagatgggcagggcagtgaggactagtgattcggatgctttgggaggcggtgtaccttgcatgtacctgt

SEQ ID NO: 185915 - DNA, 295 bp, Homo sapiens
ctgattgccgattgctgcttctgatctcagatttccagacaaagaagtgggcagccattgttgttataccttccaccattgtttcaaactgctcttcttttgacaagtgacttccaggggatttaaagggctggtactgtttcctttttcttttttgttttcaaattcttctcagttacacatggaacattttccaggatagatcgtgttttaggacacaaatttttgcctcaaatttaagaagagataccatacaaagtatcttctctgaccacaacaggatgaagttagactc

SEQ ID NO: 185916 - DNA, 290 bp, Homo sapiens
atttctctgggccttgatttcctctggtataaaacagaaattgcaacatctatcttgcagagctgtcttgaagattaacagaattatttagagttcgccattactctgacctagtgtgagtgcccagtgaatggcagttcttcttctcattaacaaaacaaagaaacaaagatgtccttaaagtgcccaagattcagccagatggtgaacactgagaggcctaactggaaggtgtggaggcctctcccaggcctgctgaagaggccagagcacgacaccccactctcttg

SEQ ID NO: 185917 - DNA, 220 bp, Homo sapiens
tccagatttgttggggacaagtaagagtagtttggtttttgtcttaggtatcatttattctgagatgctttttctaaacatcactcccaccaagggttgccagatatagcaagtagaggacaatatttggaacatacttctactaaaaaattattcattgttcatctaaaattcaaatttaactaggtatcttatattttatctgacagcctttctgggt

SEQ ID NO: 185918 - DNA, 688 bp, Homo sapiens
ggctccggccttggccagcccagaaaggggctgccacagtgcagcggtgggctgaacggctcctcaagtgccgccaaagtgagaacccaggcagaggaggcgccgagagcgagcgagggctgtgaggactgccagcacgttgtcacctctcaatatctttgatgagttccaaaatttttaaatattaaatatttataatactttaagatttatttgaaaatgttaatgaaacaaagtgtagaatctggatgcaattcaaaaatgcctcaaatattttatctcacaccacatatgacattagtaaaattatattcatgacctatacatcttaaaaaacattgaaacttgcttagttataatttagcaaaaaaaaatttttttaaaaacctgtgagatgggcatttagcaaaaaaaaaaaatcttgcttaattaattttgaccccttctaaaagttcttctcactcgtttatcacttataatttatatctaaatagttaaataatatatttcatttataaattggagagataattatcttagcaaatttctttaattacacaattgtatttatcttcagtcattgagagttatgtaagacttaacttcatatattagagaaaaaaaggagtatttacatcttaaattgtacaatataacttctttttttacccatgtgatgtagttatgt

SEQ ID NO: 185919 - DNA, 489 bp, Homo sapiens
ggtctagttcttaatagccttcttcctgacccttgagaagaagccattatacttcatttagcttctaggttatatcacattcaaatacagtcatgtcatagcatagctacttggttttccatgtgccctgccctgcattatttttgtgtattattatagtgcaaaatatttaagaattcctaagcttcttttcttattttagtctgagattgttatattcaggtaaattaacccctcacctaagagtgtcataattgattccgttgttccagattgtagatttgagtatcaggtagtaatttacatattacaggatcttttaagaattaattgttttaatgtggaagccatatgagataagaaattggaattttcagccttgattagttggctacagtcctgggcctgctttgttgcttggcacacatcaatccaactcttattctcattttatgtctgttagttgtgcatgtgcatatatactcatgg

SEQ ID NO: 185920 - DNA, 314 bp, Homo sapiens
cattcaaaagtgaattcttccctatttatttcacattcttagcttttatctctctaaatagactacgcactacttctataaatactattttgttattgttacctaaactatatactccagaataacactaagtttaccataatcaactataaatagctgtgatttgtcacaaaaatcacattgaatctaaaactggatgattgataaatctgataacagtacttcttatatcttcttattaatgcatgttaatatctaactattttacaggaaaaaaagggtatgcatgtgggtgtgtgtgtgtgtttgcgtgt

SEQ ID NO: 185921 - DNA, 239 bp, Homo sapiens
tagaagagaggaaagttaaaacgtaattgctgctggtaaatatgaagatattgcaagaggtatttagttattatgtgaatagatttgataaattatgtttgagtgcctctgcttactaaagaaattcatgaagaataaagggctacatctgtgtatactgtcctggttagttttttaaaacagacttaagaccgttcaaattatcttgctgaatcccttctaaattctaagaaggcaaa

SEQ ID NO: 185922 - DNA, 113 bp, Homo sapiens
agatcgcaccactgtactccagcctggtgacagaccaagactccatctcaatcaatcagtcaatcaattcattgctacactgagaagtaaactgatgcaaaaggaaaaacaac

SEQ ID NO: 185923 - DNA, 796 bp, Homo sapiens
caacacctaagaagtcgaaggccaggatactggagtcatcacagtgagctccctgatggctacaccccaggaccccaagggtcaaggggtcgggacggggcggtctgcgtctaagctcaggattgcgcaggtctcccctggcccacgggactcgccagcctttccagattctccatggcgggagcgggtgctggctcccatcctgccggataacttctccacgcccacgggctctcgcacggactctcaatcggtgcggcacagcccgatcgccccgtcttccccgagtccccaagtcttagcccagaagtactctctggtggccaaacaggaaagtgttgtccgcagggcgagcagaaggcttgccaagaagactgccgaagagccagctgcctctggccgcatcatctgtcacagttacctggagaggctcctgaatgttgaggtgccccagaaagttggttctgagcagaaggaaccccccgaggaggctgagcctgtggcggcagctgagccagaggtccctgagaaccaacggaaatacctcgatggcccccacaaattgaaccccggcagcattgcccacttagcacaccacaaagcgctgaatgacctgtcagccagcaagaccggggaaacaccctctggaagggctagcacagatggcactgaacgggaaccaagacagatgggccccatgagtagccaccgcatgcagtgccaaggcaggcacgcgcacattacaagtcacggtcgctgcgtgaactggccgaggcgccagaacctggcaggactg

SEQ ID NO: 185924 - DNA, 491 bp, Homo sapiens
caacacctaagaagtcgaaggccaggatactggagtcatcacagtgagctccctgatggctacaccccaggaccccaagggtcaaggggtcgggacggggcggtctgcgtctaagctcaggattgcgcaggtctcccctggcccacgggactcgccagcctttccagattctccatggcgggagcgggtgctggctcccatcctgccggataacttctccacgcccacgggctctcgcacggactctcaatcggtgcggcacagcccgatcgccccgtcttccccgagtccccaagtcttagcccagaagtactctctggtggccaaacaggaaagtgttgtccgcagggcgagcagaaggcttgccaagaagactgccgaagagccagctgcctctggccgcatcatctgtgagtctgggggcttggcagtggcgggtggtccttggtgccaggctcagatggaggctttctgagggatcatctagcaag

SEQ ID NO: 185925 - DNA, 436 bp, Homo sapiens
  misc_feature (357)..(357): n is a, c, g, or t
agttgaggtctgtgtgctgctgtcttgatttttatatagccactgtattgaattctcatattacttccagtaagacaaacttagttgattctcttaggcttccttggctgtctcacatttatcatttcatatgcaaataatcagttttgtctcttccttttcaatacttatattctttccttcctttcctttttctttttttttcttctttctcagggccttgttgtcacccaggctggagagcaatggtgtgatctagctcattgtaacctcaagctcctgggcttaagggatcctcccacttcagcctctgaagtctctcatatggtgtccgagaaatggggacaaatctcacanagggactaggctcaggagggctggaatattcagggaaggtttcaagcagaaagatgaacttgagttggcttttgagaga

SEQ ID NO: 185926 - DNA, 521 bp, Homo sapiens
ctggtggatacagtggtgaatgggactcagcccctgccctcaagaagtttccagtgtgtaaaaacaacccaaggagctgtgggatcccagatgagagggaattgaatctgcttgcagcggtcagggaaagttgggccttgggggatggtaggagttcagcagagatcctggcgggctggatggtctatgcagagataacaggtggtagaatcatcagggtgagtccatcagagcctaatgtggtgcagcctgccctggtgggaggtggccagactcctgggactccagaggcctcattccgcagaggcaaatgaacagggcagggcagggagggtctccccaaagatggggagatgctggccacctgtttcctagaggagctgaattcttaaggagagaagggcaggacacgagtcttggcacaaaatctgccattgtttgcctgccaccatcgccatgatgacagcattaggcagcccaggtccacctggaaggtctgcgcccaagcccctcctcaccta

SEQ ID NO: 185927 - DNA, 988 bp, Homo sapiens
gccaagtgaagtgtgtgcatttttgatagctgtgtacttctggtgactgtacagtttgaaatactattttttatcaagttttataaagatgcagaattttgttttacttttttttttttaaaggtatgttgttagcacacagaacacttcatgtgttttggggggaaggggcatatgtcactaatagaatgtctccaaagctggattgatgtggagaaaacacctttcccttctagttttgagagacttcctcttggctcccaggaggagggattccctgactttgacacacatggccaccttggcacaaaagccttgtggtatagaaaaacaaatttgtttttatgtcctcttctccctttccatctttcagcatagacttaactcccttaagcccagacatctgttgagacctgacccctagtcattggttaccagtgtgtcaggcaatctggactttccagtgatgccactgagatggcacctgtcaaaagagcagtggttccatttctagattgtggatcttcagataaattctgccattttcatttcacttcctgaaagtcagggtcggcttgtgaaaagttgttaaacaacatgctaaatgtgaaatgtcaaccctcactctaaactttccctgttcagagcatcagatgaagacttcatggggtttatagtggctttctgatttttggtagtccattgcagaagggagtttgaaagttgttgtatactgttaacgattgtctgcccacgtcctgcctgaaataccatgattgtttatggaaagtatctttaataaagctggatacagtttggcttgggaaaaaaaaaaaaaagggggggcgaaaaatcccggggggcagttacggttccgttttgggaagggccataggggggattaaagaggggggggttaaacgcgtgggggaagggagtggtctgggggccccggggggatgggacacccagtaggccgaaaaaggtg

SEQ ID NO: 185928 - DNA, 827 bp, Homo sapiens
tccaatgacacccccactgttgaattcacaatgtgatgtttgaagtaaatttggcgagggtggattttgctaagtgacactgccaaggacagcatgtgccagatgctgtgccaagcacttcaactgcaacacttaaaaggcttattacaaaaccccatggactagatgccccaatttttcccattgcacagatcaggaggctgaagctcggagaagttaagtgcattatccctggtcgcacaactaataaatgacccaaaaattgaacacaaaggtctttgagtgccacagtctttcctcttcacaggaataactctctgctaacttacagtgcctcccttcaacttttgatatccatccatccatccaaccatctatccatgcatccatccatccatcatctgcctatccttcattagagacagctagtcaagatcactattcccagagtgagactgtctagattgaaattctgaatcagctgcttgctagctgggaactcgtttaaattatatgacttctccatgcctcagtttctcatctgtagcatgagaataagaatattttattgggctgttgcatcaattagattgtctgcgtagatgtgctcaggatgatgcccagcatggagcgagtatgagctattactcatcttatgcagtggttcctccacaaatggtgactgaatgggagtgtggaggcaaaacaaggaacattccaggttgtggaaagagctgctgcgaagaaaacagctgaggcaaaaatgtgctcacgtgtgggtgtgtattgtgtagtgtgtgtatgtgtgtgctgtggtgggtgtttat

SEQ ID NO: 185929 - DNA, 1011 bp, Homo sapiens
tccaatgacacccccactgttgaattcacaatgtgatgtttgaagtaaatttggcgagggtggattttgctaagtgacactgccaaggacagcatgtgccagatgctgtgccaagcacttcaactgcaacacttaaaaggcttattacaaaaccccatggactagatgccccaatttttcccattgcacagatcaggaggctgaagctcggagaagttaagtgcattatccctggtcgcacaactaataaatgacccaaaaattgaacacaaaggtctttgagtgccacagtctttcctcttcacaggaataactctctgctaacttacagtgcctcccttcaacttttgatatccatccatccatccaaccatctatccatgcatccatccatccatcatctgcctatccttcattagagacagctagtcaagatcactattcccagagtgagactgtctagattgaaattctgaatcagctaggtggtccccctgaggcctgaggaccacattcctaattaagactcaatctgtgtgggaaggactagggctgcctggaagcacagctctccatttctgaatggcccttctgcagctgcaatcccctgcaaggctgcccccgtgatcagccacctcacgcggcaggggcgtgggacaggtaggccctctacgccgtatcatcagcccctgtccctctctgtcttcattttgaccttcttggttatttaatttttgtttctctccctctccttttcatgcctatttttgcccttaatatggagtgctcctctatatcaggaccgtggaattggtttctgtgatggggttccccaagtaccaaaaaagagatcataaagttactaagaagaggcaaatgtgtgattctagaatgtagggctttatgggaaaaaagaacgagggtggctgaagtccttgagtgcaaagataaatgccttcatatataaattaaattacattaaaaataatcttaaaatatatacatttctat

SEQ ID NO: 185930 - DNA, 530 bp, Homo sapiens
gtttgagctgccaggagtctttgtcctgccccaccagctctgtctcatctagatggggccttctgtccagtgctactgaacagaatgttctgcatgcctggccagtgcagagacctccttgcacccctgctccaaggctggctctgccactgacagatagactgacatttgcactgttctgagcccctgggggtgcagtatgcagagctaggccatctctgtcgtcctacaagaaccaggcagccctgagcaaggcttttaacatgcaaggtgtactccactagtcttaagatatcttgagccactgtcttgctgctcccaactcccaagccacgctgactttctttccctcgggactgaaacacctctgctgatccctgatccatatccctccccatgaaagaaatataatacataaaagagagccctctccactgagcacctcccttcctttgtagcacttacttcaactgacccttacagggatcgtgtaactagactatgaatgtcatgaaggctacgtcgtgtct

SEQ ID NO: 185931 - DNA, 450 bp, Homo sapiens
gttaaggctctggataaatactgccagcctgctttccaaggctgctctggtttcaaccctccccagcaacctaaggaaattcctctcactgcatccctcatcaaaacattcatttgatatgtgaaaatgatgtcttccatttgtagaaaatgaagttgtgctccccctcctttaggctagagtatctacacatgttatctggaattctgctgcacaagggatggatctcttcttcccatttattaattttttcaaccatttacttagatcagtacggactcatggatacttatgaggtataagtcaggtataccttgagttatatccagtactatgtcattgactttgttcctgaaatatttccagctttggtcactgagagctctttcagttggctcatgcgtccttttgacatccacccagcaggttttttttgtttgcttgtttgag

SEQ ID NO: 185932 - DNA, 268 bp, Homo sapiens
tgcaaagggatcaggttgaagggtttttaagcctatcagaataaatactaggtaagagacaaacgaatcaggagtttggcttcatagctaaaggaatggtggggaaatttgctacatgggaaggaagagagaaatggattttgttggttgtgggggcaaatggaagaaaataataagtttaatttaattttatttattaattaattcatttatttatttttttgagacccagtcttgctctgtcacccaggctggagtgaagtggcgc

SEQ ID NO: 185933 - DNA, 543 bp, Homo sapiens
cagtgctgtttggcatagaaatgcctcagtgtgatcctgactctctgagagcctggcatttcccaccatggtgcttgtgactatgctacttttgttttgttttgttttgttttgtcttagaacagatacaatctattaaggccttgcaaaagtaataaatctgctctaaagtcccctaattagatgaaaaaagaagcctggtgcagctgatctgtgtggagatgcacgactttataccttttaagtccagaggcctgagtgacaagagcaggaaagggagggaaactggttgtctgagaacgttttatgggccagctaaaacataaaagaggtcactggcatcaagtgcttgctttgcacataaaatacacagtacggttgttgcccacatgtttgataaaacgtggctattcactaacttggattttttccaaattaaatttctgaattcagaattagcaaccctgagcaatgtagaaagcgataaactcctttttaatgacaaaagtcatctgaaccttaagtgtccagtgcaacctgaag

SEQ ID NO: 185934 - DNA, 501 bp, Homo sapiens
gtagaggtgggggtgtctccgtattgcttagggtggtctcgaacttctgacctcaagcagtccttcggccttggcttcctgaagtgctagagttacaggcgtgagccacagcacctggcctacatattacatttaagtctgtgatgcattttgaatttttatgtcaagtgtgagatttaacttgaggttcctttttgtggggtggatagtatgttcgggtgttctggcacctatcttttctcattgaattgcttttgcacctttcttaaaaatcagttgagcatatttgtgtgagtctatttctaagttccccattgtgttagattgagctgtatgtgatctatatgtatgttcctctgtcagtcccactgtcttaagctgtagctgtttaagtctgaaattgggcagactcattcctcctactttatcctttattttcacaattgtttttagatattctaactcatttgtctttccatgtaaattttagaataaagtgat

SEQ ID NO: 185935 - DNA, 283 bp, Homo sapiens
aatgccaaacttccaacccagaaacatatcattattttccattacccttcttacagggtcagaggtaaatttattcctctgtgagatttgtttttgcacagttaagactagagatttctcctggcttgatattcatctagtatctctatgtctggatggtcctccaaggagccatggctttgttttatattgatgacatcacttccagtgtcctctagcatgtctctgccagaaggtgaaaacacaaacttcaaacaagatctcaaagatatgtgattaaaac

SEQ ID NO: 185936 - DNA, 483 bp, Homo sapiens
aaaactttgaggttgtagtgaggcatgctagcaccagtgcactccaacctaggcaacagaacaagatcctgtctcttacaaaaaataaaaaaatgtgtacatgattcccatgtatatgtgaaaacatttatctaggaatggagatgctcccagactatgcacattttaaactcctagaaaatgccccaaaactatcttccaaatgatgcatttattctctccctcgcagtctataaaagttgtcattgcatcacattctcactaaccattgatactgtcagatattttaaaatgtttgccattctggatataaaatgacacctcaactggatttccggattgctaatgaggtgagcatcttttccattgttggttgatcttctgggagtttcttttacgaagtggctattccagtctttcctcttttctctacttgcctatttgcctctttaaaagtcaatttgtagaaattctttatgcatt

SEQ ID NO: 185937 - DNA, 221 bp, Homo sapiens
agccaccgctcccggccaaacatccattttcaacgctcactcagcaaaacagaaagtattaaaaatttgaatttccagagcattctcacagtttagagggcactaatttattttaaatcaagactgggaagtccaggttgtacattagctataagaataaatcaactatcttaaaacaaaacaaaacacctacaacaatgatcaatactggatcccacttg

SEQ ID NO: 185938 - DNA, 523 bp, Homo sapiens
gcccagccatatttataactttttaacagctttgttgagacctaattcacattgccatataatttaccaatttaaagtttgcaaattgatggtttttagtatattcacagagttgtgcaactatctgttgtgcaaccacaatctaattttagaatactttcgtcaccccacaaagaaaccttgtatccattagcggtcatttcccatgtaccccactccttttcagcctatattgatatgaaatgtcagtctatagggactcttctggacatttcatatcaatggaatcatataataggtagtactttgtgagtgcctcctttcacttagtatgttttccaggttcatccatgttggtagcatttatcagtacttaatttctttttattgctaaataataatccattatatggatatactacattttatttattcatcagttgctgggcatttgaattgtttccagtttttagctattatgaataatgctgctgtgaacatttgttaccagtttttatgtgga

SEQ ID NO: 185939 - DNA, 288 bp, Homo sapiens
cagacgtcctgcaggcggctggcgagtgggagcctgctgcgcagccccctgaagaggaggcagatgccgacctggccgaggggccccctccctggacacctgcgctcccctcaagtgaggtgaccgtgaccgacatcaccgccaactccatcaccgtcaccttccgcgaggcccaggcagctgagggcttcttccgagaccgcagtgggaagttctgaatcaccgtttttactcttcttaaactgttttcttttgggcttggggtgggacttccagagatagggatgg

SEQ ID NO: 185940 - DNA, 680 bp, Homo sapiens
aagaaatactaaaaggagttccaaatcttaaaacaaaacctcaaaatacaccaaaacagaacctccttaaagcataaatcttacaggactgagaaaacagtaacacaaattaaaaaaccaaggtattcaggcaacaactagcatgatcaataaaacagtacctcacatccaaatgctaacactgaatgtaaatggcctataagcaccatctaaaaaatacagagtggaagaatggagaaaaatccaccaaccaagtatctgctgtcttcaagagacacacctaatgtataaggactgaaataaacttaaggtaaagtggcagaaaagatattccatacaaatggaaaccaacagcaggcaggaggaactattctgataccagactcaacagactttaaagccacaacagttaagaaagacaaagagcaacactatacgatgataaaagaatcactccaaaaggaaaaatatcacaatcctaactatatatgcacctaacgaggaaccccccaaatttataaaacaattcttacaggacataagaaatgagactgatgaaaacacaattatagtgacggacacaatactgcactgatagcactagacaggtcatcaagacagaaaggcaacaaagaaacaatgaccttaaactatatcctagaacaaaaggacttgacaga

SEQ ID NO: 185941 - DNA, 420 bp, Homo sapiens
tcataattttgcctagggttattggctctaaaagatatttcctcctattaaaaaaaaatgtttggttttatctagggtaaggtatgctaggtacgcagaggaaaattccagagctgtacgccaggaaccgaagtcactagctacatggtaaacagcaggaggaaggtggagccactctggagggttcagctttccaacctggaagaaatctttcctttcaatgcagggaaacagaatcaattacgtttgaccacagaaaaggacctcatgattagacaaaagttaaaaccaaactatcaagatgatcatgttctgagctactgtggggggaaaaaattgtgaggagagaaggttaggaaaaatgtgaaaaaaaacaaaattctctcctgtaagtgccagaattaaagagacggaaacagt

SEQ ID NO: 185942 - DNA, 404 bp, Homo sapiens
tcctgggttcaagcaattctcctgcctcagcctcctgagtagctgggattacaggtgtgcgctaccgcacccggctaatttttgtagttttagtagagacaggttttgccatgttggccaggctggtcttgaactcctgacctcaactgacccgccctcctcggcctctcaaggtgctgggattataggcatgagccactgcgcccagactacgatggtttttcttaacgagacattggaaagtagaagcaagacaattattttgagttaaagactcacttttataggaatgatctgtgattcttcatggttgaccagaatgtcttaaaggcacaggcgttttgcaaaggagacacgtgctcacttagactccacctaaatgcggcacagaggtccgagctgta

SEQ ID NO: 185943 - DNA, 149 bp, Homo sapiens
tccatctctccaaaaccaccaccaccaccctctcatgctcctgtgttcttctctagctactcttcattgccttggctgtaccattggtgtctattttcttactttccatgcacttatccattgacatttggttttgtctggccgggcac

SEQ ID NO: 185944 - DNA, 590 bp, Homo sapiens
cttattacacattaacatgaccagtcctttcaataactgttgtggtagtgataatttatacagcacaacaaatgggggcaacatgaatgaactgtaccaggtgaatatcagaatagctggataaaaagagtttaaggacatactgaaatttaacatctttatgcagttgcaagcagagtacagaatgttaaaataatatttaagcagctaggctatttatgggttttaatagtctctcttgcatgtcgtttccaagttggcaacagcaaaaccatggcaacaggaaattcttccctgcagtggagtttatgaatgcttttctgttttcatgactcaactccttatttaatttcctgtacagaaaatcagagagattactatagactgcaatacagatgtgctaatcccaagaccctctcaaagaaaaacaggtcacaggtgtctatggatgaatttaaagataaaatttaaaactgctttcacacagacacatagcaaaagtcaacacactctttgattagtcccagctaaccaaaataggcatttgagaatgttaactattttactgacaacttggggactggacatgg

SEQ ID NO: 185945 - DNA, 297 bp, Homo sapiens
tagctgggattataggcgtgtgccaccacacccggctactttttgtgtttttagtagagacgggatttcactgtgttggccaggctggtctcgaactcctgacctcaagttatcctcccacctcggccttcccaagtgctggaattacaggtgtgaaccaccgcgcctggcctatatttttattttattttattttatttgcgacggggtcttgctctgtcacccacgctggtgtgcagtggcatgattcacgtcttactgcagcctcaagttcctgcattcaatccatcctcttgc

SEQ ID NO: 185946 - DNA, 664 bp, Homo sapiens
aaactaaactcccctgaaaccccaagcatctctaattccaagagttaagtaacaagaaatggcataagaggggtgccaagggcttccccagtcccctcccaacttccctatatagtacagagcatcttgttctggccccttcatgacagaagggctaggctctgttccaccaccaagtcacaacaccaacgatcctagaattacaaagacattttatatggattttgaacagaatggagaggcagaggaacatctttgcatttagacataattatccatccctcttccactgatgagtcccttctttccaacttgacccgaccacacaagacccactctggagccctttattccttcccaatggtcccataataggaatggcacacagtgcctgccacatggggctgctaggttcatcctcctgtgctctggcctgatgagcttctgcttctcttctaacaaggaatctcccttacaccatgacccatacagggaaaagaccaaaagttccagagaacaaaaacaccatcaaggcagaaaggcaggaggtgaagtgaattctaggaatttctctaaaagctaatccttgaccaagaaggccccagctataaagaaggcaacgacgctccccactctcagctcacagttggagcctgggtagcaa

SEQ ID NO: 185947 - DNA, 547 bp, Homo sapiens
ggggagaaagaaaggggcatggcctgtttgtatccttctcacgtggctgcccaccaggtcctgggggagtgggagccagtgcaaggagggaagtccagtgagaatgacaaatggacgatgtcagacccaggggctgaggcccccacctgcagccgggcagcttctggagtggacaaggagcagcagggaaggttgcggcctggtgttctgggatccactgtctcatctcattctttggggcaccagaacttatccaaagacaagactcagtgtctctggcaacagcgggccagaggaataatgtgtttcagaggaggaagaaggggttgtaccccatggaaacagtatatagttttacagtagtgcgtctctctctaataactagttagcatgttcctgttaatggaaatactggtggtgtaagttcccctggatgttctcatcttcatgtaaatttgttcatttccttccttcctttcttccctacttctctcccttccctacttccctcccactctctttctctctctctttattctttccctcc

SEQ ID NO: 185948 - DNA, 386 bp, Homo sapiens
agatccccaacacaaaaccttcctccatctttgaattctcttctctgcagcagctatcctgaaaatcaacacaactgttggaaaagagggaatggaaggaaaagagctcctgggagtggctaactgctctgggtggactcacgacgcttagcctataaaatctatttgtctatatttgcattgccggtattcagcagaggggctgatagagtgctacgtaaggtctccattctgacgaaccgaatgaatgcttgcatgaatagatgaatggctgaagagccagaaaaccggagataggaaacattttttcggaaatgggtgaagaaggattctttaaacagcagagcagtaaacttggcattgctcagaggcctgtgttgggcttg

SEQ ID NO: 185949 - DNA, 571 bp, Homo sapiens
aggaaggacatttgcagtctgcagtcagagcggccgtttgtccctgaccttttcgatagggaatctctccatgtgaggacaggcagtgccgtgtcacagctatatgaggacaaaactaataagatttaaatcgttcccatggaaaccttagccaggtctcccctgtgtgctatcctggggggccttttgtgatggggatgcttaatagcatcccccactgttgagccaggagggtggacaggaggtggtgcatgacaaatcacgtgcatgaagagaccgagacccagctttgggatgtctgctccttgctgatgtcagaagctcctactgcacaggagaggtggggacagcagtgagacggaagggtccctagcaggcagcgctgcccttctggatctagcctcagagctatatcgggaggagagcaaagagcgggtgaggatttctcttcccgcgcagcgtgttgtttagtgcacacagcacttgcaccctcccgcagggctgggcagacatgggcctcctatctcatcagggacaaagctgggctcaccccacagcactcacagagggc

SEQ ID NO: 185950 - DNA, 1588 bp, Homo sapiens
ccatctgaaaaatcctgatctcaaaataggtaggtacaatgaattaaaaaatgttttggtttgacctcacttagctttgttttctccttgttaagatggctgataatgtttcccatttggttgtgatgtgtttagaatgagaagcaaagttgggtgtagtttttgtactcttttgaaaggccttgccactaggaatgaaaaaattagacttagaaaacacacattaaatagaagcagtttttctctagccatttgctcttgagtttgttttaaaataagtcaaagaatggagactgagatgatttgtgccaacaaatagatgtccttgttagtttttatgctgaaaacttgatttctaaaggtaggacactgtaagaacaaaggagaaattggacttcctaaaaaatgataacaaagcaatggactcagttcagctgtttgctttcagaaaagttctgttctcttaaagtaaggagagcatcattgtgttagtgaaattggataacgcaccttagaaagtgcctccccagtgatccaggataagttggaggctcttttgtgtgtgtgtggcactttttgttaagagggagaaagggcacaaatcagagccagaaagatttgcatctcgatgtattgttaaaatgcttttattttatgtaaatagtgtcaggtgaatcaagcaagcatattgttgtctagcatccttaggattacattaaaatcagcagattggcaagttatgattaggttagacttgacatatgcagaaattatgcttctgtatttttatattaaaagcaccatggtttttttgaatgaaataatgaaagcaagcttttaagacataacttttttaaaaaattaaaaatctgtctttggttagtttataaacatgaagcatatcctcctcttcttccccccaaaatttttgtttaagtcttaagaaagtctttagcaaggtatgaccagtacttaagtgcactggttgcataagccttctgtctccaggtaaaagtttgctaattgacagggtattattgttcagaatctttagagggagagaaatgaaaggcaacagtgaacagtgtttgctgctctgtacactcggacgaactgtggttgctactctgtacactcggacgaactgtggttgctgtcttcaaggagatgtgatccagtgggagagaaatatacctacctatttcaccatcgactcagactggtctcgaatttctgagtgccaagaactcgagtagctaggactacaagtgtgcaccaacatgtccagcctcacatgcttgattttaagtaacatttatatatattttataccagaattattccagattagaatgacagcattacatatttctatgtgacatgagttctaggagttttgtcacctgaatgtgctcactattcccctatttctggctatttagactgtttctaccttttctgagagaccaggttacagtaaacatctttaggcacaagcttggctcttcctttaaatcctttccttagattttcagaggtggactagcctgatacagattatgtacatttgatgaagttacctacctat

SEQ ID NO: 185951 - DNA, 575 bp, Homo sapiens
cgattgtgaaataggtaggtgtaataaggaagatccattatagagactatgaatccaagtaggtagttaaaccagcaatcttgtatcctagtaaccaaagcagaaagtttttcacttaaggaagcacctatttgtgccttacacagctaataggtcaaataagaaataaacttcgtagtcgtgacaggtacagttttcagtagagtggtggggttgaaaatctgtctttggttagtttataaacatgaagcatatcctcctcttcttccccccaaaatttttgtttaagtcttaagaaagtctttagcaaggtatgaccagtacttaagtgcactggttgcataagccttctgtctccaggtaaaagtttgctaattgacagggtattattgttcagaatctttagagggagagaaatgaaaggcaacagtgaacagtgtttgctgctctgtacactcggacgaactgtggttgctactctgtacactcggacgaactgtggttgctgtcttcaaggagatgtgatccagtgggagagaaatatacctacccaaataaataccatagaaaatgtg

SEQ ID NO: 185952 - DNA, 810 bp, Homo sapiens
tgagagggaaacaatgctgtaggtgtgggcatacagaatgggagctaagaaactgtccaacaaaggtagagaaatctgggaaataaatataaagaactgtggaaactgattagggcctgcaaacacacagctatgaccccttctcaaacctagaaaagggcagtacgtaagggaaaaaagctttaatccttaaaacatttttactttaaattcaagaagacagttcagcctatactatatgcagatcagtggtaattattatgcaaattatacagggcatttggattctgggcaaacagccaatgtggtcaacaatgcttcaaagtctatgcaccaaagtcatggaagggaaacatttggcaggagaatggaagtgggtgtcacagcttcctgaggagagtcaaagaaagtggaaagcttcatctctgggccagtcagttttgaattttttcaacccctccaagtcacataataataagcaagttaacactgtgcaaaaggaaaacacacaaaatcttttaaaatatgactcaaaatattttatacataaaacaaacaaaaagatgttaaatacttatataaaatggaactaaaaacaagacagcaccaggtattttttttcatgtatgttgataacaaataagaaagtccaactgccaaaaaacatggcacttcaatagctttctgtggcatagcaactgcaaggaaaggctttgtaaagaacaaatctggcccaagttgcttaatgtgaaacggatgtaatccttgactgtacaaagcccttttatgaagagttaaggagttctaggt

SEQ ID NO: 185953 - DNA, 232 bp, Homo sapiens
ggtcggtacacatgatgtgcactctctctctccctaacccgggctctcctatctggtcaaaacccactccaaactagacccatggccaaaatgtggaattcttatcaaggccatttttcaacttgggctaccttcccgccctctcccatctttctttccctgacaaatctcaggggctctcctgtactttatacactagtttggctggtggtggagcggtggagcacagtgt

SEQ ID NO: 185954 - DNA, 188 bp, Homo sapiens
catgcccttactcaaattttaaaagatactacatgaccataacctatgctacagttagaaattaactgatctcttctgaaatacctactttagagaaagtgggtaaacataatatttgccctggctttattggatagcttagcccaaattttaactggcagaacacttttctaaatggagagaagagc

SEQ ID NO: 185955 - DNA, 403 bp, Homo sapiens
ccatcctgctacagaaagatgtggaggtcagggagtaatgtggtctactttaaagattgggtttttccccccttaaacatttagaaataaaatatttgtaccacttcactggcagaaattcagtagcaatggtaagaatagagttaccttctgtgtctagtgttgcctttacagttgctttgtttcatagttttataaattgggctttctggtttccttggaaacccagttgtcgacattggttgctaaggagcagccttggctgcacaaagcataaggagctgcgagtctgctactgagtgacttcattcttggcagtaacaggcagtgggactcttaggacccgcttatggggggcctccatcttgattttcagcctgaaggattactatggctcttcctg

SEQ ID NO: 185956 - DNA, 427 bp, Homo sapiens
tttttactgccaggctgaggagtatgggttgaactctgcatgcagtggggagttactgagtgttttgcacagggagtgccctgagcagatgtgtttgcagatgcaagactggcagaagaaaggcttgtccatacgcaggaagacacctggaatgatactggcccttgtagctggcacctagggcattgaggtaaggacagtctttggttttcattaggtaacaggtggcattgtcatattactcagattattcaagataacaagctatatctgctttccctagacatttgcattcaaatgtgatcattcctttattcccaagccacggatattcaagttctagtacagtaaactgaggctctgccagatagacttatcctccttttatagctgtagttgagcaacttgggtgccccaaagctttatg

SEQ ID NO: 185957 - DNA, 429 bp, Homo sapiens
taaatacccatctatgtactgatgccttctaaatgtctatctccagtatggtcttttcctttaagctctagatccattgacaccctcaccatctctaaaaggcatttcaaactgaacacatctgatacagaacttttcatttccttcccaactttgcccacgccagcctgctcctccttcacgctttccacttagtatatgatcccactattcactcagtctctgaagcttaaaacctaggattcatccttgactactgtattctttacaatctactcctaatgcattagcaattcttgctagctctaccttcaaaatatattctgaatagactatttcttgccgtttcccctgcttcccctctaaatcaaaacccccattctttttactgtgtgtaactgccgagcctgctctcaaccagttctcctt

SEQ ID NO: 185958 - DNA, 358 bp, Homo sapiens
tacagagtgaatgtgttggaaccatgcatacttcactacctgtacgctaacactgtttccagagctctagaagccaaaacagcgcctgggtacaacatggattcttgccattgtgtttctgggctctttcagcatagctgtctgagctacacggttctggccaaactgatttacaaacacaacacagcattgcaaatcagtcacagtgcaagtctattcagggaaatttcatggattattctaatctagggacagtgttgggggttgttagcagagagctcccttagtctgaccagtcatgacgctgcttggggaaaaagcttccccggccctgcagcagcggccgtcctggacagac

SEQ ID NO: 185959 - DNA, 379 bp, Homo sapiens
aaaacaatattttcagaacaacagaataagagggaaaacaaatttattgcgaccttgtgtggataacaccagtaacttcagcttcctacccttgttcggaattctgcaatttttccagatttgtttatttttgatcattgtatccaaacacaacaaattttaaattatatgtcttatacactctaggggttattaagctagacaattctgtgattttccttctcaagttgtgtctgttactgatccttatagcttcttcgacagattttcataaatcagatttatatatagtcatataattcaggctacatttatgttcttattatcagtgaaattaatgtcaagttaaagctttcaatttttaaagaactggtctcaa

SEQ ID NO: 185960 - DNA, 341 bp, Homo sapiens
cagatgcccaccaccacacctggctaattttttgcagttttagtagagacagggtttcatcatgttggccaggctggtctgaaactcatgagctcaggtgatccacttgccttagcctcccaaagtgctgggattgcaggcatgagccacccaaccagtgagagatttatttcctataaagggttgtagcctgcagggttgtccttctgacaggctgggaagcatagcctccagccagaagccagaaacagactcttcaaggaggaggtaaagaaaatagcaatttatgctgactggaatggccaaatacatttatttaataagctccaggaggagtcatg

SEQ ID NO: 185961 - DNA, 569 bp, Homo sapiens
cagagtacagagtcacatggtttcccagaaagcaaggttcacaggacacatgcatatggacatgaacacaagaagagtctcgatcataaggctgggcctccaggaacctgaggaaagctgcccagccatgcctcatggagagtgaatgtttaaaaatcagaaggtcattcaagactgaggacatctccggaaccaggttttaaggctgtcctcttagcgggtgggttttgtccactcttcagctccaccgctgacattatcagactttttcctgtaggcaccagagtcacggggcctatgacaatgtttcagatcttgaaaatacattatgagtccaaaatatgaaacaagaactataaaaatcccattgatacacattttattagtatacccaaagttcattaatttaatatttgtgctgggtgtggtggctttacacctgtaatctcggtgctttgggaggccaaggttggaggactgcttgaagccaggagtttgagacctgcctgggcgacacagggagaccccacatctctacaaaaaataaagataaaaattagctgggcgca

SEQ ID NO: 185962 - DNA, 731 bp, Homo sapiens
acatacattgaggaatacatgttttaaatgtttttactgatagggaatatgatacaaaaaattttgaagaccactgttttgaagcccagtggaattgatagaaatagactctcagggctggaatagattttaaaggccttcaattcccctggcacccactctcccatctgatgcccaaaacccttggttgcactagattgcctccaggggtggggagctcactacctttccaggcaatccattttgtacagctctgggaatggtttcctgaacccagtgcctatctgtattctagctgcctctgagttcccgggggctgactgaactgctcctccccttactccactgtgtcagagccctgggatctcccaggggcccagtgccaggttgtgtgcagagtgggcctaaataatgtcccatgaatgagagggagtgggagatggggatgagaagggggattctgacaactctcatttggaggtatgttaacagctgagtgctgttgtccccctgggagtgtgttgatctgtgtaactctggatccgtatctattcgtttggatttatttgcatgggtttgtacatttgagtgtgtatgcatgcattgtgtgttttgctgtgtggctatatatgagtgtgtgtgtatgtctatgttgcaccgcaaatatccacgtgtgctgtgcatgtctttctctgtttttctgcatgcctgcgtgtccaggtgtatgtcac

SEQ ID NO: 185963 - DNA, 109 bp, Homo sapiens
atttgctcacctagctcctttcctttctattgtgtccagcgaagaccttatctcattatggatgtctcttccttccactttccttccccaggaaaaaaaatcattcttc

SEQ ID NO: 185964 - DNA, 280 bp, Homo sapiens
aaatgactgtgtagcttctctttcctaattagactctgaccaatacactatcatttgccaacaactcccaaagttttatcaatgactcagacctctaacctgaactccagctgcctccatgacatatccatttggatatttaatagacatttccaaagtgatgtgccaaacagaactcaggatcttccctctcaaaccaactgctcagcagttcttataatctcagttgatggcaattccatccataaagatgattagtcaaaatgcctcccacacacct

SEQ ID NO: 185965 - DNA, 372 bp, Homo sapiens
tgcacccagccaagaaattttaattgatcactaaaccagtacatattggttatcatatgttaaatcccatgtttattttctcagtagtagaagaaaaaagtgttcatacaaattaaaccaccatatgtaagatatattagaacttctagccaggtttttaaatctgcagtgttggatttcaagcattttattttgggatggtttgtgttagtttatgtagccaagaaaggtcgagtagtttaagtgggtgagctgtcatcctacatccctaggccacaagtcacaaagcatccgtgcttaccgatacactgttgtgtcatccacaaagcccagatctagaggtcttagttgtttgattatcttcctgctttt

SEQ ID NO: 185966 - DNA, 145 bp, Homo sapiens
tctcagaactgtttccaaatgcagacatgcacatcttttttctacctccttctcacaatacagcaaagaaaaatgtacacaaatatagtctttatggggaagacagtggcctgaataaacatacttggtcctgcctccctcacag

SEQ ID NO: 185967 - DNA, 396 bp, Homo sapiens
taaatgctttcctctagagaattttcaaccataagccatacatatcaatgaccctgaggtctatagatccacaagtgccctgcaaattaacaaggagaaacacaaaaccaccgtcagtatagttttaatgtggtacctgtaaagatgttgacaatctgtcaacactggaaattttcataaggtgtataatggcatctcttctcatcagaatattgtatttcccaagtaatttgggtaagtagtttaactttttttttagatataaagttaatttctcacattatttttacatctggaatcagaatgcagattccagttttcatcagctactgccagggtcagttccctttcagtggaagacactgtattacacattttattaaatagagcaatttg

SEQ ID NO: 185968 - DNA, 484 bp, Homo sapiens
aactctgcgcctaccggagactgcaggccctgcagccctgcagcagccaaggagaaggttcaagtccactgcatttggagagcgtcttaagtatccttgcaccggggacggccggtgaatctctggacagagctggtgctgagcgtgtgcgcagcccgcttgagcccacccctgggcggtttccagctgtggcaggggggccaaccccaggaatgggttgtcagctcccaccgcccctctctggccaattggtgactcctgcagatatccggagacaggccaggagggtgaagaaagccagggagagactggccaaggccttgcaggcagacaggctggccaggcgggcagaaatgctgacaggtggatgaagctcagtcttgggctttcggtccctttcttttaatgcccatcctcattcctactctgaattgtcacacttttcccttccccaccagttctttaataaaagtatttgaaaggc

SEQ ID NO: 185969 - DNA, 588 bp, Homo sapiens
gggtgctttcaaggtcatagaggtctaagaaggcctggaaaccagacaggtggtattccttagcagtaagcccaacctataactgcaccacccaccctccatgggtatccagctcacagtcactgccccgtcatgtctatgcacccatctgtccactcatctctgaacactgagacctcactgggatttatctatggcttagtagctacgaagggctgctaagtagaaggcatggctcttctgagatgcacttttcaactggagagtggaatggaagaaagggagaatgtgatgaaaaccaaacctttaaacgtgatgaaaaccaaacctaaaaggagaaagcacatacacagcacaggccgggaagcagggaagatgcagattgaagaccaagtttgctagacatgccgccaccactgcacctcttacagccttggtttcctcatctatttaacaaacacaaaatgctcactctggaccaggactattctaatgtgcgaggatactagcttcacagctgaaggcaggaaggcctaggaaggttaggaatcctgcacaaaatcatagctagtcaatggcagaaaaggg

SEQ ID NO: 185970 - DNA, 1336 bp, Homo sapiens
cgggcagggtagccagcggctgcatctgaggcggacgccgcagtgtagggcacaccctgagggtagcgagagacgtgacaggaccgagcagctgggggctgcagcctgctctgtccccaccgatcccagagagaggctgtgagtctggatctgggcgttcgcaccctgagagagggggtcaaagctcccctgcggccccgaggaagaagagcaaggttgaggacagcctcgggtcaccagagtagtttggaggcaggcctgcaggcgcgtccccgctcctcagctccaagctgacgtatctacacctgccggcgggcattaagatggctggttatgccactactcccagccccatgcagacccttcaggaggaagcggtgtgtgccatctgcttggattacttcaaggaccccgtgtccatcagctgtgggcacaacttctgccgagggtgtgtgacccagctgtggagtaaggaggacgaggaggaccagaacgaggaggaagatgaatgggaggaggaggaggacgaggaagcggtgggggccatggatggatgggacggctccattcgagaggtgttgtatcgggggaatgctgacgaagagttgttccaagaccaagatgacgatgaactctggctcggtgacagtggtataactaattgggacaacgtagactatatgtgggacgaggaggaagaagaagaggaagatcaggactattacctaggaggcttgagacctgacctgagaattgatgtctaccgagaagaagaaatactggaagcatacgatgaggacgaagatgaagagctgtatcctgacatccacccgcctccttccttgccccttccagggcagttcacctgcccccagtgccgaaagagctttacacgtcgcagctttcgtcccaacttgcagctagccaacatggtccagataattcgccagatgtgccccactccttatcggggaaaccggagtaatgatcagggcatgtgctttaaacaccaggaagccctgaaactcttctgtgaggtggacaaagaggccatctgtgtggtgtgccgagaatccaggagccacaaacagcacagcgtgctgcctttggaggaggtggtgcaggagtaccaggtgagagaaatgagggaatgtggggggatgaagggagtggaaaagtaactaggagagctgaggaatgagtagcattcctttcccacctcctcaggtacttagttgctaaacttctctttatttgatgagggagacacggtggagagagatggtcatatgggtaaaaaaggagacacaaaaccatgaagattggggcagattgg

SEQ ID NO: 185971 - DNA, 249 bp, Homo sapiens
aagtaggcgctggtagagtagaaggtctagtcttcagctgagtgttgtttggccaatagacagaacgctcctaagaggcatttagatttatcctggcttttcgctcccctgcttgtttgttgatttgcttgcttcaaactttacattagcgtgtccatttataataagtggcttagatcttaaccaaggagttttaatttggccatgccttcaataatgtagaactttccattcctgctgaccagaaaa

SEQ ID NO: 185972 - DNA, 255 bp, Homo sapiens
aaattatttctttattttccattgctttttcctgtcacatagccacctcacttcaagattatgctatacgtgatccaaagcataggaaattgagggaaacttgtaaattcactttgttgctctgacttcagtttgtatgtggttgtaggataataatataaaaatgacatgtgtttgccttcaaattccaagctgtgaattgtaattcctggcaggtatttcacttattccaaaagtggtagttcacaacctagc

SEQ ID NO: 185973 - DNA, 156 bp, Homo sapiens
ccttttgcacaaatgcttttcaaacctctgcttgcatcatatttgctaatgtctcaatggtcaaagcaaatctcagtctcatagccaccctcagactcaaggagttgagaaatagtctgtacctcttgatcagagaagctgcaaagaatttgtagt

SEQ ID NO: 185974 - DNA, 1036 bp, Homo sapiens
tggtgaccattccacccttccatctcactccctctaggatcctgattcaaacaatcgttcaactctacaaagatctccaatgatctccttttcaccatctcagcctcctccctggtgtcttctcctccctggcatctaccttatgatccacagcccatcgttatcagcactgccttccctttactactttgtgaaaactatgaccctcataaacccaactgcctgcctattccacacctagtgtgcgcagatgagcgcagctggacagagacacacaaccatgctgactgccctcacctcaaatccacacccctcaagggctcagcagccccatccatccctgcgcacatccactcttcgaaagcacgaacggatgctccaaagcgcctctcctcagaccttcaacacgccctcctacctccccactctagctccctgctacccaccgaggaaactgaggccaccaaggaagaactgacacaagactcctccacctgcccatccatctgccccagctgtggaggactccctgctcctccccctcagcaagcccacctctggcacgtggtcctggacaagacaagtttttcctctcatctgcatcaatgatgtttttccttcttaactagctcttttctgtaagtgcaatgaataaaaaacttagaataaaaaactttctctcaagcccacttggctcccatcaattatcatccaacttctgtttagcaaaacacagtcaaagtctgtcaatacagtggcctcaagtccgtgccccatctcagccaggcctgtgcctcctcctcaccagccccgccccaagtgcaggccacacccactgacccattggcagcagccctgccagcccgtggccacctgcttccttccccatcgaccgtcatcctccttcctccctctcggctcctttgccaggctctcctcctgcccccattcccacgtcgagtgccggggtcccagtccttggcctccctgacgggttctcctcctgcccctccccctcctgtgtcaagtgccctag

SEQ ID NO: 185975 - DNA, 395 bp, Homo sapiens
gttttatctcctataaaacacagctgccttgtgtgtatttttcttttattttactatgatgcttttaaaatgaccatgggttagtatggaaaatagtaatttttgcacgttaaaagtatgcattgtaaaagattgtctgatgtggatgatgagtagtgccacttccaattttatgtggccgtgatgaacttggcataagttctgaccagatctgagctattctaatggaacaaacaaggaaatacgtctcctctgttgttagtttcctataaattctctaaaattattctctgccctgttttgttttggtttttgttttttgtttttttcgaggcagagtcttgctttgttgcccactacactccagcctgggcgacagagcgagactccgtccc

SEQ ID NO: 185976 - DNA, 492 bp, Homo sapiens
aagtcgccagcggacatttgccagaaacaagtagattgtattcttaggcattgttgctaggaaaaatttagagtggaaatgtaattttttcttttgctgccagtggaggtgctggttcattctttgttgtatgcccagtagtagagatcttgctatcaaaagtgtaagtttctttgaaaggtttaactgaaggaagatgtagaattataaatagaattggctggaaaatttgtgataaaaaataattttaattagatctacaaagagggataaccagcaatcttgctctgctatagaagataaatagttggtacaaagaggaatttgaatttcctccataatatggaagaggatttagggtcttttttctttcatcttttttttttttttttttttttttttttggggacgggatctcactctgtggcccaggctgaagtgcaggggccaaatcatggctcactatgaccttgacctctcaggctcaagtga

SEQ ID NO: 185977 - DNA, 475 bp, Homo sapiens
tctaagaaatgaccaaagggtttcctgcaagtggctatacctgtttatactcgtctccctgatccttgccagcatttggtcagtctgttttgcaagggatggcaatggctcactgagcaagcattcatgatccaggaagaggaaaaatcattctcaataggacagggttattaaggacagggctctcagcttacaggagggctgctccttcttccttcatctggaggcttacacctcagctcaactgttgttcaactgggatacatttcatttatttctctctctctctcctctctctctcttttttttttctttttcttttttttggtagagactgggtcttgctacgttgcccaagctagtcttgaactcctcacctcaggtaatccacctgtctcggcctcccaaagtactgggattacaggcgtgagccatcacgcctggccgaggtcaagaatttgaaatctacctgggc

SEQ ID NO: 185978 - DNA, 585 bp, Homo sapiens
ttggcgtcttatatgggtgtgatttgaggcactgccaaacaactggaataggaatatcaaagatcactgatcaccataacagatactaatagtgaaaaagtttgacatattgcaagaattaccaaaaggcgacacagagacacgaaatgaacacatgctgttggaaaagtgatgctgacagacttggttgatgcagggttgctgcagaccttgaatttgtaaaatacaaaatctctgtgaagtgcagtagagcagagcacaatgaaatgagctatgcctgtacctgcttcatagggttgtgagagttgagtgaggtgatgggtaaagtgcccagcactctcctaaatgtcatagagtttatagaagaaaatgttgggtggtattttatgaggatgattggtgatggcctgagtaatcaaattgggccttgtggaagagatggcacttgaattgggccttgaaggatagcatgctttctctaggtggaactggagggaatttgtactttttccaggtggaggggactggtagatacaggcagagagcctgaaagtatgttaatgaagtggttggatgaaggggact

SEQ ID NO: 185979 - DNA, 175 bp, Homo sapiens
tgaccccccaaagcatctctcgtttgacgcccttttaatctccactgggaaggccctccttccacacacagcaccccagcaggaagacagctgtaggcagcaggtgggcagtcgtggtacctgctcctatttcctcatctttacccgaaagaggaccttgggcttccagccctag

SEQ ID NO: 185980 - DNA, 273 bp, Homo sapiens
gctcatcagcagggtaatggatgaacacgcttggttacagacatagcatggaatgctactcagcagtgaaaacaacaggctactgatacgcaccatgacatggatgaatctcatagatgttttattgagtgaaataaggcagacacaatagtgcctactatatatttccatttatatgaagttccagcacaagcaaaactaatttataatgataaaactcagattcttcgttgcctggaaccaggcatggtagaaagattgaataaaagggca

SEQ ID NO: 185981 - DNA, 271 bp, Homo sapiens
cacctcacccacaattttggatcactaaccccctctcattcaccctcaggtctcagaaatgatgtcaacgtgtgcggatcattcttcaccaactctaaccaaagggtgacatgcatgtttttcaggaactaatctaagaacttggttctcatattcaagacactgaactttaaacttaaaaagcaccacagcatatattttatgctatataacacccagtttttaaaaactctcagcgattctttcatctgaggttcagggcactctgttg

SEQ ID NO: 185982 - DNA, 370 bp, Homo sapiens
tcctgggctcaagtagtcctcccaactcagcctcctgagtagctgggactacgggcatgtgccaccacacttggctaatttttttttttattatttttatcttttgttgagatgaggtctcactgtgttgcccaggttggtcttgaattcctgagctcaagcgatcctcccacctcggattcccaaagtgttaggattacaggtgtgagccactatgcccagccaaagttcacattttaatggaggattcgttctgccatcttcttttggattttctttttgtcttacctttctatgttccttttcctctgctttctttcctttggatttttttctcattttactttttccctctcatctgctaaaagag

SEQ ID NO: 185983 - DNA, 183 bp, Homo sapiens
ctccccaacccccaacacccaacagagggcttagtttaacattgtcttactttcacagcatgtgagttacagctttttgtaatgaaaaccaataatcaattctaaaaaaaaatgacaacaggttcatcaagttcagggcttttgtcagtttccacctgtgttccctctgcctttgtgttggga

SEQ ID NO: 185984 - DNA, 251 bp, Homo sapiens
ctgcaacctccgcctcccaggttctcaaacagatttaacaatcctctgagaatggtactcatttatttggctaaaattcttcagggatttataaactacttgctaaaggagggcattagataatcaagtatttttaattttccatcttgttatactttttattttaaatgcctaaaaccatacagtattgtgtgatgtgtaattcctagtatacaagctacctagagtcaggctggttcagtaataaattt

SEQ ID NO: 185985 - DNA, 327 bp, Homo sapiens
aaagaaggtaaaactctggcttatatagcatctttaacaaaatacaataaacttatagagaaatgacaggacaaaggaaagcagttttagtcttccagggctgggaatcttggggaaggaaaatatatggaaagaaactaatgaagtaaggtttgtgtgcagattcctctggtgccacctctgggctagtaagatgggagagttgcctccagtaaaggaagttgtatcctgcctttaaacagaaaaggaggagggtagagagagtgtttcctgcctttgctgctgcttaattgccttcagctcaaaataatattcatgtcaaatagg

SEQ ID NO: 185986 - DNA, 216 bp, Homo sapiens
atagaggacccgctgatccgcttagtgagtggagtgatgagctcatgcatttctttcatttgtgtttaaacttaacaaaaaatacagttcaaacaagtttcaatattaggtttcctatcaaattagaatggttttatggcaatctaaacacaaggtgatgagctcttagagacaagctcatttgacaatagtgagaagtgacagtagcagcttagt

SEQ ID NO: 185987 - DNA, 189 bp, Homo sapiens
  misc_feature (155)..(155): n is a, c, g, or t
cctgtcttggaatttatgaaggaaaaaccgtaaaggaggtttagtttccctcatactctgactatagaggcagctactcttttacaaaattgtatctgattctgcacgtggtactactttttttgtctttttgtctgttagttatttctccaggngaaaaggcactaattttctaagacggcaagcggg

SEQ ID NO: 185988 - DNA, 201 bp, Homo sapiens
ttgagtgttaaagaattaccttttgtctatgtgtattttaaaaattaatcatccatttaaatgacaaagctctttttccgtggaagtgtgtggattagctctctgatagcaaaagtaataatataatttagggaatgtgggactagctgtcaagagtcctaatttttattccaattctgcctctcacatggccactcaata

SEQ ID NO: 185989 - DNA, 285 bp, Homo sapiens
cgacaagaacaaaaatctgtctcaaaaaaaaaaaggaaatttttttcaaactgaaaaaactttgtcctaggccttctgatcaattaaccataatcaaaagaaaacccagagacaggccaggcgcggtggctcacacctgtaatcccagtactttgggaggccgaggagggcaaatcatgaggtcaggagattgagaccacggtgaaactccgcctccactaaaaatacaaaaaaattagctgggcgtggtggcgggcgcctgtagtcccagctactcaggaggct

SEQ ID NO: 185990 - DNA, 321 bp, Homo sapiens
ttgcacattggctttctattccttgctcactcctcatgttcccttttgttttcttggattactttccttgacaaagtgctagctaaaatgacattgtttcaggccgcacattatgtgaaactatttgaagaaaatatgactgtctttttgcattttacagatgtcaatttagtcagcaacataattttaatttgaattaaagactaaaaaatgaggcataaactatactgaagaatttgttttaattccctgaaatttttatttttttttgcctttttctaagacagtctcttgctataataaagaaaaaatgcatgacta

SEQ ID NO: 185991 - DNA, 166 bp, Homo sapiens
cacatgcccctgcacacaagggtcacgctcttgcctactgacaaacataatccctgaacattaaggcacataaacatacctaagccagtgccaggcacccttgccccaaatttctcaaatgagactaccagatcagtttctgtcagactggagtggtgggcaagtt

SEQ ID NO: 185992 - DNA, 410 bp, Homo sapiens
aacgtagattggtgcagccactgtggaaaacggtatggaggtttcctacatagtccaaaactaaatatagaattaccatatctccaaaatatgatagaactgttataattccagaaattaaatctagaactacaatatgatccagcaatcccacttctggaaatatacccccaaggaaataaaatctccgctcctgtagctagctgctgtctcatgttaactgcagcattattcacaattgccaagatatggaaacaattaaagtgtcctttgatggatgaataaagaaattgtggtatataatgaaatattattcagccttaaaaaaggagatgctgccatttgtgacaacataggtgaatgtagaggatgttatgtgaggtgaaataaacaatacaaaaatactgcat

SEQ ID NO: 185993 - DNA, 736 bp, Homo sapiens
ttcttccttcaactctgccattttcccccatccaggctctaaatcctggtagagcacagacaaagcaatagaaacagggaaaccaagcaagccttgcagctactcgctcacacctccatatgtgcagatatgtgtatgcccttgcttccctgcacacatacccagggacatagctccagagagtggtggcatcttgctattgaggaaatggaaatgacaagtgagagaagacataaggaaggtaatgcaaagggaagagaacgaggaaaggtaagaaccctaaaagagcagaaaatcaaaaagagatttgagataaaaggctaggacgagggttggtgaaaaaaataacagatctcaaaggacatgaaaattacatggaagtcaagctttttaaagatcctaacaggttaaagcaatattctgattgtaacccaatgaaatcaaactggaggaaaacatatggaccagaaattgggtcctacaaaagcaactacatgcatgcaaactggggcaacatggcttagcagcattttgctaaaagagaattagggatttgagtcaactcggagctcagtatgagtcaccagggcaaggtggcctccagagatgctaatgcagtatcgacctcattttaaagggctctagacaaataggagcatgttcctggaggtcagtcaggctggggagaggactggagcccaggctccaaaaggtctggttggaggtgctggaacct

SEQ ID NO: 185994 - DNA, 177 bp, Homo sapiens
gcaggtggatgggagaatggagtcaggcaggtgtgtcaggtgtgcgggcaaactgttgggtgcctgtgaaggatactgccgatttgccacagtccccattcacctctcacctcctgacacctaggccagctgcctctgtggccatgtgtgcccagggcctctgtcatcctgacccac

SEQ ID NO: 185995 - DNA, 547 bp, Homo sapiens
ctaaaacgaacactgacctccctaagcaagtgccaaggtctcatccaataaagaaaaggtcatatggcttcctgagcgtcggaaataagggaagaagacacgtcttctctccattggaaattctctccttcaggatggatgaagaattgattacagcctttcaggaaagctgtgtctaaacaggaaactgacattaactaggagaattctggataataaattttttaaatgacaggttatctcagctgaagtatcacgtacattaaagagcctcaatgtgttttgaattttccttgcgtgttactaagctttctcttaggtaggccgtgactcacaggaaaggaaaggcacaatgaatgtacctcaccaaagagtgctttagctgtacatcaaagacatgcatacactgccctgagtgcataaaaatatatgcatgtgtgaattcaagatactgtcataattatttccctccttatttacaatgcccatttcaaagtttattaaagtgagtaagataatgtctttataatgaaggagtattatgtgc

SEQ ID NO: 185996 - DNA, 142 bp, Homo sapiens
tcaccagttagttaccaatgttactaaataaaatataacaccgagagagactttggaaataatattttttcagctcattttacagtcaagaaacctaaaccccacagaaattaagcaattttttaaagccacacagttaggt

SEQ ID NO: 185997 - DNA, 242 bp, Homo sapiens
aggatttcaacttacgaattttgcgagggacacaatcagttcataacagtagtcttttgtgtctgacttctatgactcagcatgtctatgtgatttatccatgccatggcatctatcagtagcttgttccttttaattgctgagtagaagtctattgtatgaatatatcaccgtttatccttttatctgttgatggactttgggctatttctagttttttactattatgaataaaactcctg

SEQ ID NO: 185998 - DNA, 495 bp, Homo sapiens
ctagactaaccaagaagagagaataaatttctccttccatatcttatttgaagaaatgaatctctgtaaataaaatcagaaatggaaaaggagatattacaactgataccacagaaatacaaaagatcatcagagactatatgacaaactggaaaacccagaggaaatggataaattcctagaaacatcgagtctaccaagattgaatggggaataactagaaaacctgaacagagcaataatgagtagcaagattgaatcagcaataaaaagtctctcaacaaggaaaagcccaagaccagatggattcacagctgaattctaccaaatatataaagaagaactaataccaatcctcctgaaaccattccaaaaaattaaggaggagggaattctccctaactcattctatcaggccagtgtcaccctgatatcaaaagcagacaaggacacatgcagaaaaatctacaggtcaatattcctgataatctagat

SEQ ID NO: 185999 - DNA, 416 bp, Homo sapiens
tgctgtctgcaatgagcatatctgataagcagccagctgttaaggctgattctaccttgacctcagtctcagcaactttgcctgtggctctgggttggagtctaggtccagcttccctggcggccactggcctctatggtgggcagcagcatcctaagagccttcctgccttacccctattgctgtttcaccagctgcttttagcacactactgcctcttccatcttacacctgtacttgtgctgttccttttaccaggaaggaagggtagaaatgaacatgggaacaccctgtcaggtgctttgacatactctctcaagcttgatgtatcaggtttgaggagtgcctctgacctgaagccttttttcagagcagaaatagcatgtgtattaaacccattggatggtcagaccctt

SEQ ID NO: 186000 - DNA, 249 bp, Homo sapiens
aataaggtggagtatggttaacaaaacgattccacatcagcaaatgctaacacagggctcctgggatcccatagagagagagtctatttccatttttatttcttaactcaaaaaataaaattaaactttactttctagaagaggacgatgagagaagatcgctgggtggccacgtgatggataagacatgcaggcctcccttgctggtccccactggcctcattaaggctgggactattatttctcaac

SEQ ID NO: 186001 - DNA, 444 bp, Homo sapiens
aattgtctcgatcctttgttttactcaaatggagcggacttcccatgtttatattctgtcctgtgctttgcgtttcccactccgaagctcgctgtcaggacacagagtgccgcacgcgtgtgctgtgagtctatgagcatggtcatgtggctgtacccagagaccctgaggaggaggtgtttttaacctcgtttctcttttcccgtgtttcaattttcagaaagcacgtttttcctccatgtgcatgcattacctattcccctaaataatcactgaaaaactgcacacagcacaaaaggatgtacagggacgagcaaatctctttcccacccgcctgccaggcccttcccagagatagcatcatcacccccggtttcttttctttctttcttgaaatatttgttcccccaagtgcccgcccctcccttttgtttttactcaaat

SEQ ID NO: 186002 - DNA, 272 bp, Homo sapiens
cagaatccaattacgtatccctctcttccatgtgcatatagtatcacaacctactaatctgatcaatttttttaaaaaaaagcttgttagtcatttcaaattagatacccctccacaagcactctatctattctttacccccatacatttttgttgagttagagatggtcacaaattctttgctaatcttcccattaagtggtagagtcaaattccccaccctctgaatttgggctggccttgtaacctgctttgacaagagaatgtggcag

SEQ ID NO: 186003 - DNA, 348 bp, Homo sapiens
atcagaaaaattgctctgtcatccaaggagatcacccagtttgacaataaatgtaaggtagacacaagctagcacataaaagaagatttgtatgctcctctaagaaacaaaatgaaccaagtgcacttggttcattttgtttcccatttgtctttaaatgaaatattcattacccaatatctgtgtgccttgttatgtttatgcaagtcactaaaaatactcacatacatatctgacatatgcatacagaaaacatgagacatcttcctccagttgctaaggatcacctcaaatttaatacaaaactcaattcatcatcatcttcctgacccttttatttcacccagg

SEQ ID NO: 186004 - DNA, 126 bp, Homo sapiens
gttggccatctgcctgcaatgtcccttatttccttttccatcaaacaaactcttactcatccttcaaggcctcaggatgtttccccactccagtattttgtcataaaaattttcaaacatacagca

SEQ ID NO: 186005 - DNA, 402 bp, Homo sapiens
aaggaattatttttcatttccagctctggctctaaataatgtgtctccagcagtgaaatgtaggccaagatagctctctgatatgtagctcctataaaggaacccacttctcagaagcattggaaaaggcaaattatgaaggttcataatacaatataataaaaattctttagtcatccactattacagatactaagccaaattttaaattcatactgtataacaaatttgaatttagaaataattcctctttattcttttcatttcaacccaaggttacttactgatatagttcagatatgtgtctccactcaaatctcatgttgaattgtaatccccaatattggagatagggcctggtgggaggtgactggatcatggaagtggatccttcatgaatgg

SEQ ID NO: 186006 - DNA, 277 bp, Homo sapiens
gccaggagctgcctcattagcgtaacaaagacactctcacttgggaaattccaagggtttttgaggctctgtgccaagaatcagaacaaagatcagatcgattattatatgtcatataatttaaatatgtccaaattattgttcagtaattcaattacacctcaatacagctattaaaaattttttttaattttattttttgagaaaggttctcactttgtcgcccaggctggactgcagtggtgtgatcagggattacaacagcctcaacctccct

SEQ ID NO: 186007 - DNA, 438 bp, Homo sapiens
gtccattatgctcatccctccttatgctcatcccctccttagtaaaaaggtcttaacacgcttatgtagacgccttatgctcatcccatccttatgctcatccctccttatgctcatccctccttatgctcatcccgtccttatgctcatccctccttatgctcatccctccttattcctccactgttgataatgtaatagttgatctaaatacagtagatatctgatctctctttcacagaaagtcactggggtgtgtgatgggaattgtaaagtaagtattggtgatggtttcaccataacaggtgatatgatatccactgtccacgtcatccaaaacctaagtttgtttggcttcagagttgcaggacattccaattattccacctttctcagcttcctacccttcgtgatccactccagccaacatgtaaggag

SEQ ID NO: 186008 - DNA, 190 bp, Homo sapiens
ttaatgcgtctgttgtggcatctctcaaatctgtactttgctatctctttgactacagagtcactaccttccgataagcccttctgctgtctccagaccgatccttctaaagcgtagatgtcattgtctttctctcattaaagctctttcatggctcctcattttccaggttccagctcatgtctcagga

SEQ ID NO: 186009 - DNA, 157 bp, Homo sapiens
atattgaattcattctactagacaaaagcccacacccacaagtctctttgatatatgctcttctttaacttgggcttctcctgggactgctgaggaataatatctttaggcttcttgggagatctgttgtttacctgaatggttgtctgaagcaaca

SEQ ID NO: 186010 - DNA, 821 bp, Homo sapiens
aagtggtttggagacagtaagaaagaaaagaagtacaagttaaatatctcatttgagccacgtcaattcaaaacaacacttagtctgggggctatccaggtagggatgtctggagtccagcatgaaatgtatacctggatctgaacagagaccacagctggggataaagatgttggtgtctacagctgaagctgtaaagtgagtgagatcactaaaagacaaaaaagatgaagaggaaataaaagagtggagcgcagagtggcgagggacaagtaacgtgaggccacgcaaaccgtatggagcagaagagggagagccagtagaggaaccaaagcagcttgtgctttggtcaaccaaggcaacttggctcaaggactgaaaaatgcactactgaggtcagcagagaatctaagggaagcagcctagcaagggcgatcaagaattctgtaggactggacccacttcagctgccaccacttaccttcaatggccctgctatgtctaattgtagcaggaccaaactagcagcccacacctgtggcctgggaatccctgcccagcactaaatgagcaaaccactggcattaagacaatgaaacaaatgtttaatcttcctctggcaatggcagtgactgaagatcccttaataaaaaagtttgtggccaggcgtggtagctcaggcctgtaatcccagcactatgggaggctaaggcaggcggatcacgaggtcaggagttcgagaacaacctggccaatatggtgaaaccccatctctactaaaaatacaaaaagtagctgggcgtggtgacgggtgcctgtaa

SEQ ID NO: 186011 - DNA, 283 bp, Homo sapiens
acgtagcccacctgccggagcacagagcgcccttttaaaatgcggctttgctatccaggccctgcatctaccgattgtccaaatgttgctggtagcaaaattaagtgtctcctccctcagtgacttcatgtgcacacagcgcatatgctcagtgcatagttttatggatacgtttgcttccctttactctaaacctaaagattacatggtgaaagtaaactccaagagtgagccttttagcccattcacctcttggcagagcgaaccattcaggtgggctagt

SEQ ID NO: 186012 - DNA, 171 bp, Homo sapiens
gaccctggcccgtcaagtcattgaattgtagagggtacctcatctttcctgaagcccatgagctataacagagtctggtcgtggtggacaaggcttcagggctgtgggatggcagtgggtattgatatgcctgtagcttttgactttgttgcacagctaacattgaccttg

SEQ ID NO: 186013 - DNA, 726 bp, Homo sapiens
tagaactagcttttgtactatcttctgcacagcataacttcagtctccctttactaattcaaggaaatctcagtgaacaaattgtataagggtagatgagctaaaagctcactgagtcattaatttgtcataactcatctaagtacaatgattaggcttgtgtaggtgtccctagtttctctttctaaatcatgtcttagtagggacagagcaataatggtggatcgtggcaacgggaaggaagatgatgtgtcagttatctattgctgtatgacagtcgcaaaaccttagtacttactacagaaacaatgatttgtcacattttgtgggttgtctggatggttgttttgcttatatggtgcaggctgagattactcatgcagcttcacagttcttttgcttatatggtgcaggctgaggttacacatgcagaggaaagatgggctctgttcctcattcgtatgcctggggccttggtgcgggttgtggcaatggcgtcttggttctccatgtgccgtctctccagcaggataacctgtagttttctcacagcatgacagctgggttccaggagaatcaaagcagaagctgctagaccaattaagaactaggcccaaaacttgcagtgtcacttctgccacgttctgttcctcagagtaaagtcacaacaccagcccaaagggaggagaaataaacagactccacctcctttgaagcagagagaca

SEQ ID NO: 186014 - DNA, 380 bp, Homo sapiens
caagtttttcttcttctccttcttccttcttcctcctttctccttcctcctcctccctcttccgcttcctcttctcctcctactcttcctcttcgtcctccttcctcttcttcttctccttctctttctccttctccttctccttctcctccttcttcttcttcttctccttctatatattgtaccttaacttcgtttttacccaccactttaaagtattttgttctatgacagcagctagagatcttaatacgttactccatttcatggctatacacagtttatttacccgttttcctagtaatgggactgtaatgttacttaaacctcatctcaaagacctaatataaattaaattctagcttcatttgaatctttca

SEQ ID NO: 186015 - DNA, 504 bp, Homo sapiens
aggacatgactctgtcacttgcccaaagatcagttaaaaggctgttataatgatgcagagaagtggagatctgctttgagtggctcagtctaggggagcagggaggcccaccgtgggcccagcagtcttccccatgtattaccagtcatatgaaagaacttagaaaagcatccacaatgtgtccttcaccatggatgccgtgtttgtgcacatgaattggagacgtaaaaaatgtaatgtttccttagttccactagttaaaaaaagaaagtattgcagagggaggatggatgctcgccagtgaaaatgccaggtgtcttccacaagagaaaggaattggagttgggatccagcaagttgctcaaaagggcttatgcaagggtgaaaagaagaatctggcctcataggtatctgaactgtcctagaagaagactgtcttaaagtaagatttgcctcgtgtctaccaagcgtatcttcaatgctcagcccagtgggtgaaagtaa

SEQ ID NO: 186016 - DNA, 489 bp, Homo sapiens
aaatcaggctgtcaccacctcttgcctacactggccactctgtatctagtctctcccatggcacctgctatgatctagcaggagagatcttccagatctcaggctaatcacagtcccccactcatgaacacctacttgctcagtgaagttcaaactccttagcatgactaataaggctctttttttcttaatctttgtgtgtgtgtgtgacaggaaggaaggaaggagttgaggaagagctagggatcaaggagagaaaaggcagactaatcagcttcttgacaaccagttttcccgctgcctttgaattcttttcatttcaggacacccctagggaccttttactccagatacacaaagtttccatcaacagcctctgtgcttacatgtgctcatctcttccacatttcaaagacaaatcaaatcaaattcaatgccttcccacagaagccttttctgacattctcagtgttggtggctgtgtcataa

SEQ ID NO: 186017 - DNA, 413 bp, Homo sapiens
cagccccgcccaccccagcccccgaccattggtggatggaagccccccaccattggctcccaggcttgctggctaggtgcgggtctaggcagcttcccagctcagtgggactggcctgctttggaacagcggcagtgcccaggaagcctgtgaactgggcctgccagggaagccatggtgagctggaagccagccaggtggggtcagggaaggcagggccatgcacaccacacccttcactgctgggcttctaagggcattggccagatgaacaagcacacgcagaactgaattggccctgatggcctgcaagggaggggggcccggggcctggggcgtcagctgggatatatgggggcagggagtctctgcatggccgatgtttgaattaaaatacagctttcccctgtatt

SEQ ID NO: 186018 - DNA, 370 bp, Homo sapiens
acctgctaccccacgagggcagcttgttttaagctgctttacgttctattaggttggtgtaaaagttaactgcattttttgccattaaaagtaatggcaaaggccaggcgcagtggctcatgcctgtaatcccagcacttgactctgtcttgaaaaaaataaaaataaaaaataaaaataaaaataatggcaaaaactgcaattacttttgcgtgaacttgatacctctgatgtatgggaccccctctaccaggacttgcaaaatggaatctgagagccctttgctgccccagtgcacacttgcttgagtgggtggatgctgtggctgctgagatggttcatagctcgtctgctagaggcgtggttggct

SEQ ID NO: 186019 - DNA, 147 bp, Homo sapiens
acaagttgaagcactttataatacagtaaaaatgttacacaattacttgagaagtcaaaattatacagagggaataaaataaatactaggtaaaatattcaccactgtcatttgaatattttaaattgacatattgaagtgacccac

SEQ ID NO: 186020 - DNA, 727 bp, Homo sapiens
ccaggctggagtgcagtggtatgatcttggctcactgcagcctccgcctcccaggttcaagcgattctcctgcctcagcctgctgagtagctgcgactacaggcgtgcgtcaccacacccagctaatttttgtatttttaatagggacatttttagtatttttagggttttaccatgttggccaggatggactcgatctcctgacctcatgatccacctgcctcagcctctcaaagtgctgggactacaggtgtgagccaccgtacccagcctcgaaggtattttttattttcctatatctgtttgtcagtgagtttcctttaatacagcagtgtgttggtatttttattttatttttatttcgagaccagttcctagatcctcagtattagagaagtcatttcctcttttgttcttgtgacattttcttctggtgtcctttaatactgcaatacatcaggcatctgaaatactaaacacttaaatgtttcagacacttcctaaggcctcagtgtcatctgcacgtagacatttggtttctgggcacttaagatctggggtcgataggcagtttaggactgctgcatgcactgcccaggcagctgctgggagcctgggtggaaacaataagaggagcatccagatagaggtagcaatgttttgaggaacaacattaatcataataataaaagaaagaagtagttgcttctgtttgagaagctgcctg

SEQ ID NO: 186021 - DNA, 122 bp, Homo sapiens
agtgtggagtcttaattagggagagtcaggttggcagaaatgagggaaaacaaaaagaaaaggcagataagctataaatctccctctgttcacggtccagaacacgcagccctccttcacaa

SEQ ID NO: 186022 - DNA, 234 bp, Homo sapiens
agagcgagcatatacaagcaagccctcacaaggaagagaatctgctggcacctccatctgggacttctagctcccagagctgtgagaaaataaagttctgttgtctaggccaccaagaccatggtattttgttatggcaggttaactagactcatgcaccgcctgtatcctccctgggatataaattccatgaaggtgtggcttgactgtcagcctggggctgtgtggcccatg

SEQ ID NO: 186023 - DNA, 1009 bp, Homo sapiens
aacctcatttctaatgatgtctatcacgtctcagcctttgactaagatcaagtgtagtatctgcgatgttctaccgtaatacttttcgttttgagacagagtctcactctgtcagccaggcttgagtgcagtagcacaatctcagctcactgcaaactctgcctcccagattccagcaattctcatgcctcagcctcctgagtagctgggattacagaagtgcaccaacatgcctggctaatttatgtattttcagtagagaggggtttcaccatgttggccaggctggtctcaaactcctggcctcatgtgatctgcccatttcagcctcccaaagtgctaggattacaggcatgagccaccatgcccggcctctaccgtaattcttttttggtagtcgtttttttgggaacgaagtttcactattgttgcccaggctggagtgcaatggctcgatctcagctcactgcaaccactgcctcccgggttcaagcgattctcctgcctcagcctcccaagtagctgggattacaggtgcccactaccacgcttgactttttttttattttttagtagagacagggtttcgctatgtggccatgttggtcttgaactcctgacctcaggcgatctgcccgccttggactcccaaagtgctcggattacaggcgtgagccaccgtgcctggctgaggtcttttttttttactctgagtgaggtgacaagctttgggaaggttttgagcagaagagtggcatagtctgatgaaatctggcttactttgacctctgtattgagaatgaatgacggctttggaggtagtgaaaaatggttataaaggatcctggatatattttgaggaatgagccagtgggattttttggatagattggttgtgagggaggccatcaaagatgattctcagatttgtgatgtaaagaatggacaacaggccttgcgtggttgctcacacctataatcccagcactttgggaggtcggtgagggtg

SEQ ID NO: 186024 - DNA, 540 bp, Homo sapiens
cagaggattccgctgcggctggtgagggaatgatattggagttaagacctgaatgatagggaactagccttgtgaagatctgagacagttaagtgttgcattagatgtctgaagccctactcttacagttttatttttacttataggagagccacttagaccctacttagatctgattttacatacaattctaataagcttgattatcactcgctgggcctatagcagatgaacagaaatgtattgaatgtatttaatgtaaaacaaggtaagaggcttccgagctgtgctgctgaacaggcatgttgacagcaaaaagtaacacaaccataagaaaagagcaagaaaaaaaattaagccaaatgccttttgtgttttaagaggcaggagaatcgcttgaacccaggaggcggaggttgcagtaaggagagatcacaccattgcgctccagcctgggtgacagagcgagactctgtctaaaaaaaaaaaaaaaattgaataatacccttttgtattagcagaattaaatgaaatatgtta

SEQ ID NO: 186025 - DNA, 518 bp, Homo sapiens
actgtgcctggctcgcctcctctgctacgcattcgtatgcataactaggatgcaattcgccgattcctcgtgctttatgcctcgtttcattaggctaccatttgtacagcatcctcctagtgcctggccgctcgttgaccactcttgtcattttacatattcctccgattcttcctccgaccaggcacagtatgaacgctggcggcatccactcaaaccgatccgaaagcatgcacgtttgagacttgtcgatgataaacacaggcctagacctggaaacccctctggcgggaggggtatttggacatttttaaattaaaattacagattggaagggatctagtacactacacctgggacaaatacttttttgtgaagtcagtaaagcctttgcgtgcaatatagcatctctatgcaatgcagcaactcctcgtctatcgctacagtaagaaaacagccacaggtcaggtgttgtggctcacacctgtaatcctagcactttgggaggctaaggtggg

SEQ ID NO: 186026 - DNA, 377 bp, Homo sapiens
tgcaaactcagacccagaagctactaggaagatctaatggcaggaaactaaataaaaacacagagcatccttctgatagagaaatgcttattgactctctaaagggacattggaggaacactcaggtggttgtgttataaggcagagtctgcttactaaactccaactcatctaaaaagacaaagctacctaattttgtgagttcagacaattttgtaacgaaaattaaagtatgcattctggtttttctagcaaatgaaataactccttctatatgggttgattctgcttagcataggtggtgttagccattatttgagaacagttgtttgaggaacagaagtgtcttctccactgtatcttcagtggcagctttc

SEQ ID NO: 186027 - DNA, 375 bp, Homo sapiens
attcagtgacaattgagaagttctgaataatggggtgaggaactgattgtcttgttctcggtaatgaacatcaggcttttaacagagtgcatagcagctgtcttttaggaaacaacacgccacaagtggacctcatgaccccaggcattctgtcactgtataagtgatataagtgcacctctagctggacagctcctcaggtcctcccagtctaaagtacaggatgtgaaagtaagacggttcaactcgcactttatctctgggggatggatccaacgagtccgggaaggagggtagaatctttatgttgcatctcataatcccaaggttgttttttgacattctaattattgtacatagttagcttttcaaaaa

SEQ ID NO: 186028 - DNA, 371 bp, Homo sapiens
cagttgcttacccaagcaggaagacctccacttaggttctcgagggtttgcctgtccatattctggtcaactgcaggggggaagccatgtcttctaagcctcaagatagttgtttacgtgcaactatcagaggtaaacacccatcatttacctctgttgggaggaagtcaaaagacagatggggaaagaaaccaaatttccctgtttaactccacctcctgtattttaactcatgagagcttcttgagaggtataaatttccttgttttcagctttcaggcttgtggctgattgtgtgaacttttggtgtgctctgggaaagaacaaagcagcattcattctcttcatctttggtaatccagttaatgcac

SEQ ID NO: 186029 - DNA, 348 bp, Homo sapiens
tatttcggcctatccttagcaaactaatgcagaaacagaaaaacaaatatcacatattctcccttataaatgggagctaaatgatgagaactcatggacccaaagcagggaagaacagatactggggcctacttgagggtggaaggtgggaggaggaaaaagatcagaaaaaaataacatattgggtatcaggcttagaacctgggtaacaaaaaactgtacaacaaacccccgtgacacgagtttgcttatatgacaaaccagcacatgtacccctgcaatctaaaatataagaaaaaacaaatctgttggctctagtatcaaaatatataatctaattacttctca

SEQ ID NO: 186030 - DNA, 222 bp, Homo sapiens
gtaaaaagttgcccattttattcatagaaaaatgttgatgtttaattcttatatagcattttattgtttgaatgtacctgaattaactactcccctgttgttggctttttgagccatttatacaaagaagctgtgagccattaatcaatgtaatattaaattatcaatgtaatatattaaaatacatgctgggcgcgatggctcacacctgtaatcctaaca

SEQ ID NO: 186031 - DNA, 514 bp, Homo sapiens
tagctgggactacatgcgcttgccaccacgcccagctaatttttgtattcttagtagagatggggtttcaccatgttggccaggatggacttgatctcttgacctcatgatctgcctgcctcggcttcccaaagtgctgggattataggtgtgagccaccgcacccagtcaaatttgtataatttttaacctgacacagagacaaggtagtttataaatggtgtgtttaaactatatgtgtggaaatctcaaccctgtaactggagacatctgataagtcttagacttactgataatttcatttttagaaggtagaggtggaaatttgactagttaattcatgctgagaactttgggtgaaactggctattttattctggggtttcatcctgatggaagttgtgcaagaccctcttgcacatgagatttttagaaaggtgtctcatgaagctcagagcaaagatggtattacctccaaggccagcagaactgtagaagagagtatggtttcatc

SEQ ID NO: 186032 - DNA, 994 bp, Homo sapiens
gcgagccctgaaccctgaaaggctcgcgatgcctctacacaagtatcccgtgtggctctggaagcggctgcagctgcgggagggcatctgttcccgcctgcccggccactacctgcgctccctggaggaggagcggacgcccactcccgtgcactataggcctcatggggccaagttcaagatcaaccccaagaacgggcagcgggagcgtgtggaggacgtgcccattcccatctactttccccccgaatcccagcgggggttgtggggcggcgagggctggatcctgggccaaatatatgccaacaacgacaagctctccaagaggctgaagaaagtgtggaagccacagctgtttgagcgagagttctacagtgagatcctggacaagaagttcacagtgactgtgaccatgcggaccctggacctcatcgatgaggcttatgggctcgacttttacatcctcaagaccccgaaggaggacctgtgctccaagtttgggatggacctgaagcgagggatgctgctgcggcttgcccggcaggacccccagctgcaccccgaggaccccgagcggcgggcagccatctacgacaagtacaaggaatttgccatcccagaggaggaggcagagtgggtgggcctcacgctggaggaggccattgagaagcagagacttttggaggagaaggaccctgtacccctgttcaagatctatgtggcggagctgatccagcagctgcagcagcaggcactgtcagagccggcggtggtgcagaagagagccagtggccagtgaccacacagctcctccatgcctgacaacagggccagctttcctgccagggcctttgcctgaggacacagatcccggggagctgtgagggcccgggggcaggggtggtcctggttcggtgcggccatgacttcagccgggcagttgggggtcccaggagctggcgccaaggcctcgttgccgttggggttcttgccg

SEQ ID NO: 186033 - DNA, 1084 bp, Homo sapiens
  misc_feature (589)..(589): n is a, c, g, or t
  misc_feature (608)..(609): n is a, c, g, or t
  misc_feature (612)..(612): n is a, c, g, or t
  misc_feature (620)..(621): n is a, c, g, or t
  misc_feature (626)..(626): n is a, c, g, or t
  misc_feature (629)..(630): n is a, c, g, or t
  misc_feature (633)..(633): n is a, c, g, or t
  misc_feature (641)..(641): n is a, c, g, or t
  misc_feature (1004)..(1004): n is a, c, g, or t
  misc_feature (1080)..(1080): n is a, c, g, or t
gcgagccctgaaccctgaaaggctcgcgatgcctctacacaagtatcccgtgtggctctggaagcggctgcagctgcgggaatgggcattcgtgtttcacacggtctccgtggctcacgggagcttaacgtaaacacgtttgagcgaacatacccgccgtggggaacgggagaacggggaacgtccgtggagcggtcccccaaactttcccccccggtttgtccagccttaattataggcctcatggggccaagttcaagatcaaccccaagaacgggcagcgggagcgtgtggaggacgtgcccattcccatctactttccccccgaatcccagcgggggttgtggggcggcgagggctggatcctgggccaaatatatgccaacaacgacaagctctccaagaggctgaagaaagtgtggaagccacagctgtttgagcgagagttctacagtgagatcctggacaagaagttcacagtgactgtgaccatgcggaccctggacctcatcgatgaggcttatgggctcgacttttacatcctcaagtatttttaataccctgaaggagtacttttttttcaattttnggatggactttaagtgagnnatnttttttcnnttttnccnntantacccctngttttaccccgaggaccccgagcggcgggcagccatctacgacaagtacaaggaatttgccatcccagaggaggaggcagagtgggtgggcctcacgctggaggaggccattgagaagcagagacttttggaggagaaggaccctgtacccctgttcaagatctatgtggcggagctgatccagcagctgcagcagcaggcactgtcagagccggcggtggtgcagaagagagccagtggccagtgaccacacagctcctccatgcctgacaacagggccagctttcctgccagggcctttgcctgaggacacagatcccggggagctgtgagggccaccggtgggcagtgggtggatcctgntttcgtgtgctgcccatgcaccttccagcccggggccaggcttggcaagaggaatcacccatggaagagcctgggnccga

SEQ ID NO: 186034 - DNA, 1073 bp, Homo sapiens
gcgagccctgaaccctgaaaggctcgcgatgcctctacacaagtatcccgtgtggctctggaagcggctgcagctgcgggaatgggcattcgtgtttcacacggtctccgtggctcacgggagcttaacgtaaacacgtttgagcgaacatacccgccgtggggaacgggagaacggggaacgtccgtggagcggtcccccaaactttcccccccggtttgtccagccttaattataggcctcatggggccaagttcaagatcaaccccaagaacgggcagcgggagcgtgtggaggacgtgcccattcccatctactttccccccgaatcccagcgggggttgtggggcggcgagggctggatcctgggccaaatatatgccaacaacgacaagctctccaagaggctgaagaaagtgtggaagccacagctgtttgagcgagagttctacagtgagatcctggacaagaagttcacagtgactgtgaccatgcggaccctggacctcatcgatgaggcttatgggctcgacttttacatcctcaagaccccgaaggaggacctgtgctccaagtttgggatggacctgaagcgagggatgctgctgcggcttgcccggcaggacccccagctgcaccccgaggaccccgagcggcgggcagccatctacgacaagtacaaggaatttgccatcccagaggaggaggcagagtgggtgggcctcacgctggaggaggccattgagaagcagagacttttggaggagaaggaccctgtacccctgttcaagatctatgtggcggagctgatccagcagctgcagcagcaggcactgtcagagccggcggtggtgcagaagagagccagtggccagtgaccacacagctcctccatgcctgacaacagggccagctttcctgccagggcctttgcctgaggacacagatcccggggagctgtgagggcccgggggcaggggtggtcctggttcggtgcggccatgacttcagccgggcagttgggggtcccaggagctggcgccaaggcctcgttgccgttggggttcttgccg

SEQ ID NO: 186035 - DNA, 515 bp, Homo sapiens
cagtcatcttgagacggatcaagtcctcggaagagctgagcgacctctggtgccccctggtggcccacagggaaactactcatgactcaccttctggagcagccagggaaaacctacctgactagccagccacctgccttgctaagcggtgcccacctcacaaacatgggtgctttgccagagaaggacccctggggtccatagctcatgaagtccaaacatatctatacattcccagcaagcacctctggcttcccacatcgggggccaccttgatccaaagcagggctggcgagggtctcaacttgcaggacctgctcagacatgaccatcatctgaggaaccctgggcaggcagaacctgcaggtgtcagaggctcaactcctccatctaaccagtcaggctcccagagtccccggaagagcctgcgcagctgaagcagactgctcctagttggagagtggtcactggggaaaaggacttgggccatccaccttccaatacctgctgcctgt

SEQ ID NO: 186036 - DNA, 480 bp, Homo sapiens
cagtcatcttgagacggatcaagtcctcggaagagctgagcgacctctggtgccccctggtggcccacagggaaactactcatgactcaccttctggagcagccagggaaaacctacctgactagccagccacctgccttgctaagcggtgcccacctcacaaacatgggtgctttgccagagaaggacccctggggtccatagctcatgaagtccaaacatatctatacattcccagcaagcacctctggcttcccacatcgggggccaccttgatccaaagcagggctggcgagggtctcaacttgcaggacctgctcagacatgaccatcatctgaggggctttggtaagaaactgatggctgggcgcggtggctcacacctgtaatcccagcactttgggaggccaaggagggcggatcacgaggtcaagagatcgagaccatcctggctaacatggtgaaaccccatctctacta

SEQ ID NO: 186037 - DNA, 338 bp, Homo sapiens
tgtaaatctaaaactgttctaaaaagtcaagtctatttaaaaaacactgatgcccaggccctgcccccatgcatttagatttaatttctgggatgtgacctgggtatctaagttttgaaaatctccctgagtgagttatttccatttccagaagaagaaatctaggttccaactggtggggctgcatctggaatctggatccttcatcacaccctgaagtcttaaacttgctttttccataactcatgtctgccacagggtgctaggatggattctattcaaaggagggatgaggctgggtgcggtacctcatgcctgtaataccagcactttgggag

SEQ ID NO: 186038 - DNA, 266 bp, Homo sapiens
atggggtgggtcaggattggcagcagaaggtggcagcggggcacagctttctgccccccagcagccccacagtcaggccaggagatgctgcagaataaggccaaggtagaattcaatctgcaagacagagacctgaggtctggtttcttacatgcaccggcttgtgaccttaggcaagtcactgaaccaccccttctctacctgcactgtgagccaacaacccttcacacggttgtttagagcatacatagtagagaagaggctct

SEQ ID NO: 186039 - DNA, 567 bp, Homo sapiens
ctggtctcaaactcctggcctcaggtgatccacccgcctcggcctcccaaggtgttgtgattacaagcatgagccatggtgccggcgggctgatttttttaatttttagtagagacaaagtctcactatattgcctaggttggtctcgaactgctgagctcaagcaatctgccggccatgttctctcaaagtgctgggattgcaggcttgagcccctgcacccagcctgtaagatattttaaaatccacacttggccaagcgtggtggctcacacatataatcccagcactttgggaggccaaggtgggcggatcacaaggtcaggagttcgagaccagcctggccaatatggtgaaatcccatctctactaaaaatacaaaaactagccaggcgtgttggcttacacttatagtcccagctactcaggtggctgaggcaggagaatcacttgaaccaggaggcggagtttgcagtgagctgagatcacagcactgcacaccagcctcggcaacagagtgagactccgtctgaaaaaaaaaaaatccacgctgttttatatttctaa

SEQ ID NO: 186040 - DNA, 710 bp, Homo sapiens
tagtgacttgacagggcggctgctattgcataaagaatgcctttgcaaccgttatctttttctaaagatgctgcctcttataacaacacagtatagaattttcttttgtttgcattggaatttgaatacatctactttttcttgtgaatgatggaagagtcgaatgaacctgtgggttctcgaaattaactctgggaagtgagagggtggaagggaaacagtgacgactcacaggagacacactggttgaacctgtgatcttgccagggccatttgtgtgaagtcacctgaatctcggtgtttttcctctggatcagctgcctggatggttttgtcaaactttcagatccttccatcctccacccccatcaatgtgtgactttgcataactgagaaagctactaaacacagaattaagtttcttttattgtttttctctactaagggaatttgattctctaggatgacttgcacttcatgtgggaaagacacagctggatgcccaactgatatccattcccccctccttttctgtaactgaacccattttgtttaattcaccactatgtccagttaagtgctagatttcccagaatcccttgcagctgggaggtggttcagtgacagtagtcctggctgatgagatgtaaatagctggatgccccgttccccaaagctcttaaaaggggaagcctctgtgagcttgcctg

SEQ ID NO: 186041 - DNA, 391 bp, Homo sapiens
gcacagtggccctgtgaggcaggcttgttgttatccccattcacagacaggcagatgtgtgactaaccctatcttacaggcaaggaaatggtggcaggatggagctaaataactcactgaaggtcacacagctagtccagaatctactctgaatggtgactgctgctagcatcagcgttgccacttctggcagttggagaatcagaaaatacgttatgaggaaaaggacaggcagctttggctttgaaagaggagcagcctctccccagtggagagaagggtgtcgcaataccaggaacaaacataggggggcaggcccacagagacccgggctgagccagggaggtactggagcagagggcatagggcagtgctggagacaaagctaaag

SEQ ID NO: 186042 - DNA, 310 bp, Homo sapiens
gatttgcctcccaactcaaatgtttatggggtacctggggtgccctgtggctagaatcccagaggaccatggtgagagtcatacagttccttcacccactccttccccaggagcctttcagggccaggaactagccctagcatttgagtaccccacggatggttcacagcttcctacctcttcagcttcagtgtctgcattgcatctccgtctactcctagcattttcgttatgaaaatctattcaaattatgttgtttactcaaaatttatatctttcaagaaatttgtccattttcatctaacttgtt

SEQ ID NO: 186043 - DNA, 971 bp, Homo sapiens
caggcgtggtgacacacacctgtagtcccagctactctagaggctgaggtgggaggatcacttgagcccaggagtctgaggcttcagtgagttatgattgtgccactgcgctccaggctgggtgtgcctggaattcaaaattcaaaaaaattgaatttttttcaattctgtaaaaaagagaaaaacccctgaaatcttatttcaatgttcgctcaatgtgtatttttttaatcccacttgcagggagtgaggaggccaacgggggcactccccagagcaggatttccagggaaacccgccttcctcccattcatctgcatcgcatgaaaagcctcataaggagcaaagcagagaggccccagggaggaaggcacacgggcatttctactctggggaagaaggcaaaggccggctctggtctcaggaagaagcagagacggctgccaaggagtgttagaagcacccgcgatgtgcaggctgccggcaaaaaagaggacgctccccaggacctggctctggcggtgtgcctgtcagtgttcatcacattccttgtcgccttcagcctgggggctttcacaaggccttatgttgacagactgtggcaaaaaaagtgccagagcaaaagccctggcctggacaacgcgtattcaaacgagggcttctacgatgacatggaagctgcggggcacacaccacacccagagacccatctgcgccaagtatttcctcatctaagcctctacgagaaccagacccctttgtgggtgacacagccacacccacacgccaccgtaattcttgatagtactctgggaaggagcagaaaggatcctggcagttcgcagagcccaggacagtgcggggacaacaccggggcaggaagtggaaatgatggtgcagtctattccattctccagagacatccacatgccggtaaccgtgaactaatgtcagcagcgcaggaccacatc

SEQ ID NO: 186044 - DNA, 263 bp, Homo sapiens
agagagaatagaagccagttaaacagtagaggtgggagtgaaaaaggattaaataagaacgataaagccaaagttgaaaagtgattaaagaaggatggtaatgaaagctggatagagggtggggcatgagcaatgttttatgtgcctaccatcctctatccagtaatctaggcatggaacactgaaaccagaccaaccagtcagatgctgcaggtagggaggtgggatgggaattgtcactatccaatcactgttgtaactgg

SEQ ID NO: 186045 - DNA, 452 bp, Homo sapiens
gctttggctccttcccacagcttggcacagccacacggccatcatttaataacagtactgaacagagtgagaaaatgatgcctggaaaagcccagggactcaacaacttacaccacgactgagaggccccagacttccaacactactgtagctatagttctccctatagcccacactcacaggaaagctataaatgagctttaaaataagaaagtattaccctagataggcagcaagggatcccacagaaccagcactcctttgtaatcttatgaaagactctcacaaagtcaattccctaactgggcaagtgtgaaatttgaagatgatggctgaaactacacgagtggactttagagctctgtagcagcttccactcagctacacacacaactgacacaagcttacaagaaatcaattaaagcaggaccaccttcagcttggtaatatta

SEQ ID NO: 186046 - DNA, 241 bp, Homo sapiens
ttagaagacccagatttgtgactgtcatgtgaggtgagagcagtgttgtgggactgagcccttaacctgcagggtctgcactaaccgtgggcagttagtgtcagaatttagttaaatagtaggacatccagtcaatgtatggggacaattgcagaattcgctggcgtggaaaaaaaccccacatatttagtgtcagaaatgaagtgttacagccaggtgtggtggcttatgcctggaatcc

SEQ ID NO: 186047 - DNA, 573 bp, Homo sapiens
aatgacaaagaggcaggctctatctttctggaaatctgacttatctgccccttgatctagggaccaaataactcttcagagctgggtaggtgtctttctatcaacagcgttgatttggaagttgcatggtattgtgattaaaaacataggtggggcttgggaggggagccccggtcagtcctaacaccacccttaggtacatcactaacatcaagcaacgcaactcccataggaccaaaggcaagtacagggctttccacacaaggggtacttactaggtgttttgctgaatcactaaatgtgtgaacgaatccaggtctttgtcatggagggacttaggatctaactggagaagaggacatgatagaaacaagacaggatatgatgcagctttgttatttcccatgatgaacacatggattagaaagcagatgctactatcattctcgctgatatattttcactcattatgttagattttaacatgttagatttgatgatatctggaaggcaatgtgaacacagaatcagaagaaagaatatgtggctctaacacatagcacaataagacca

SEQ ID NO: 186048 - DNA, 310 bp, Homo sapiens
ccatcaaagctcatttcttagcattctacttggaaaacaagaaggactgagctactgtaaatcaagtggtcagaggaaggtgacatttgaagagacctgaataaagaaagagagcaggttactcaaaggaaggaacaagtgggctctgaagtaagaatacagttgagatgtttgaaaatcatcaggaaggctggtgagactgggccaaaggagaagggaattgagcactgagaggtaagcaaaggccagactggcagggccctgcaggccatggtaaggagtttgcattttactctaattgtcatgagaa

SEQ ID NO: 186049 - DNA, 317 bp, Homo sapiens
tgtcgtgtgaggcctgaatgtagtgaggtgtgtgtgaagcaacctctttcctgactcattctcctctatttaaaaaaaaaaaaaaagtaggtcagaaagcaaggacgaaaactgcagaggctgaggagacggacgtttttggagaaagccatgtacatcaaaaaggttcaaagactgaggaaagcctcatgatccgggggtaatttactacccagaagccaaatgcattcaatgacttggcattcctctaaaaatcagagggtgtctgttttattttatttttttattttttattttttttgagacggagtctcgct

SEQ ID NO: 186050 - DNA, 724 bp, Homo sapiens
ccattttgttactagccaggtgaagagaacacaggagcatgtacgtgctttttctcagtaattggatatgttagacacggattatgttttcgctgggaccttgtagttaaaagaaagcaaaaagctgatctgaatgttcaatatttcccttttctcaagagcacatgaagttggtattgaaatgtgagttgcctgcctcttatttccatcgtttgaaatcagactgaaatcctgcatgtgggaccctcattctgtgacctctgtctgtgtatccaccaggcttccttgccagccctctttctgactcacaaatggcagtgggtgtgagtgcccaggaatacttagagtggtaaatacaggatttgggaaatttatctgcagaatgtcagccctcagtaggaaagtagtgctgtccaatggaaggcctggtcaaatgccttttggttggatgtttcaagctggtgtggcatagccggagattcccagtcctcaggagtgtggtagggtaggctctgtcctaccaggaatgcatttggattttagagatagttgagaagtagtttcttttggaataacatttaagacacgtttgggttctgggacatcctccttcctcatttttcccctgggagtcattgtggctggttgggcctatgggcctgcaggctgtgtttgatgtggtgagctccccttttccaaaggatgaacctacctgccttgagat

SEQ ID NO: 186051 - DNA, 556 bp, Homo sapiens
tgaaagtgagtgcttccttaaattttgcaccctagtcatgtctcttgcctcgtcttagtctcagtcctacagttcaccatccatcgtttcagtacctactcccattttctaggatcccactgacctcaggttcccagcattgaatgcagagatagggcaggcccctccttgtctgagctgctgctgtactctcgggtgcctaatgctaagccaactcttttgactcataaatagtctgctgtcacctaaaccaccaggtttttgtcacatgagcagcatacaaaccaggtcttctctatcctatccttctctgctgattttgaacctccagagtcctttaaaggggacactcaaaagcctaaggagtcacagccatagaagaactgggtcaaggagatgggggaagagacaacagggtcacagagatgggggagttagggagatagagatcagagagatgagatcagagataaaacctacagacaggattggagcgatgaagtcaaagggatggagacatcgaggaaataagagtagggtcagggaggaaggccaa

SEQ ID NO: 186052 - DNA, 209 bp, Homo sapiens
cagtcactcttccacatttctaagcgaaatgtcaacactcatactcaatatgacactactagaatgtgaagcccaaatttcattttaaatctctaattacctaccaaggaagctcatttccccaaacaattctgtgaactccaatgccagactatccaagtttctggggacttaacagtatctgtgcctttcacatgtaggagtcctct

SEQ ID NO: 186053 - DNA, 228 bp, Homo sapiens
agagaagaggatgtaagcagagaacgggggctaggattgagacctgggtcatctgatacggggaagctgggaaggaaaggaggaaccagcaaagaaaactgcaagtggggaatccagtagggctggagaaaaatcaagcagaacaagttatacctgaagaaaatgctccaaggaaagagtattcaagccagcagtgcagtgttaattttttttttttttttttttaag

SEQ ID NO: 186054 - DNA, 960 bp, Homo sapiens
tcctctttgctcctggcaacaagtatagtacatcctttcagagaagaaatcctcctcaaaggggtgaattcaccatgtgactttccgtctaacactcagatgagatcacaaagtgagagggaaaaaacacttttgactttcagtgggtggaagggaaagaagttatctaggacagcagtccccaacctttttggtaccagggaccagttttgtggaagacaatttttccacggaccgaggcggggaggaggatggtttggggatgattcaagcacattatgtttattgtgcacttaatttttattattgttacactgtaatatgtaatgaaataattacacaactcaccataatgtagaatcagtgggagtcctgagcttgttttcctacaactggacggccccatctggggtgatgggagacagtgacagatcatctaggcattagattctcataaggagctcgcaacctgtatccctcgcatgtgcagttcacaatagggcttacgcttctttgagaatctaataccgctgctgatctgatgggaggtggagctcaggcggtaatgtgagtgatggggagcagctgtaaatacagatgaagcttcgctcactgccactcacctcctgccgtgcaacccagttaataacaggccacggaccagtacaggcatatggcctggggtgtggggacccctgatctaggaggatatagtcaatgaccatattttttccaaacttaacatttaaattgttaggacatttgttctgaaaagaatgcctgtgccattttaagatataagaactgggggaagccttttataacaagtccaggttaagtagtatatacaaatctgaagatgtgtacagaagtgcttcagctgggtatgccatacatgtgcaattctggccaaatagtcccattcagtgaaccaattattttccaatcacaatactcact

SEQ ID NO: 186055 - DNA, 431 bp, Homo sapiens
ggtcttgctatgttgcccaggctggtctcgaaatcctaggctcaacggatcatcccacctcggcctcccaaaatgctgggatttacaggcatgagctactgcacctggcctctgctagatcttttgatgctcaagtcttccaagcatgaacttgcacaggctgccaagggagccatagctgctgcctttttagcttgtgttatgcaaaagattttattttatccttttaaaaattcccttgcaaatgacctttgtaacatcccctaaaatcacacgcatgtgcctttacccatcacctatatccagatttgcagccacactcagggccagaccagcaggtgtgctgttgaaagcagctggctaggagccagctctacagcatcccaaatcagcaatagtcccagaggatcggtggtccctttgttcccacc

SEQ ID NO: 186056 - DNA, 436 bp, Homo sapiens
cttcttccaggaaaagattaaaagcttcctcacagacaatttagctgcaggattaatacatggagagctggtttggggtgggctgcagcctcagaccccttctcagagtacctgcttttcacccctacccacagggtaaactagctcttgcccagacagcttcagaatctgctctgttgatctaagcaaataaaatgcagaagccaaggaaaaggatgtcattccacagcctccgggcttccttccttcatctgaaggtcaagtaataattcagccaaaatgtgaaactctttatgcaggacttacagtcaaaggcaggcaggctgggagggctaaggaaagcagttacaggccagcagctctcaaaggtgagacaggcccaggcctcacctattgtgaagagtctgattttaaaataaaaatgaatgccaaaagc

SEQ ID NO: 186057 - DNA, 496 bp, Homo sapiens
ttttataagcatgttgaattaaattttaaaaaaggaaatccaagaagtctacagtgtgcaacttttataacttcaaaaacaagcagtattaaataataaattgtttatgaatacatacatatctggtaagatattttaaaaagcaagtaaatgaaaaatacaaaatttagaatagtggttatgctatcctaaattgggtagaggaaattggaagaaacatataagtggcttaacagaattgatagtgttctatctcttcagatgagtgatagatttactttatgctttatactttacatatatattacatacattcttttatatatatatccagcattataaatgagttttaaagaaatttattgccaagtgtggtggctcacccctgtaatcctagcactttgggagaccgacgcgggaggatcacgaggtcaggagttccagaccagcctggccaacacagtgaaactctgtctctactaaaaatacaaaaatt

SEQ ID NO: 186058 - DNA, 690 bp, Homo sapiens
gtatgcttattttaacgtgaaaggtccagagagctctgaaacagtatttgcaaattatgtatctgctattgctaggaagaggttgggtacgtaaagtctaatgatttaatcccttcagccaagatacctgaggttaagactgacaaagtatcttgaacttgtttaagtcatgctccttcctgtagggagtttgtcttaatgtgttcgcaagattggtagatcattattttgttttggggtggagaagagatgcctttgtaattgctttcgggaatttgatgagctagacgctgggacggggctcccccaagtgagggccccgggagaggagcatcctcatttgtaaatatacggcatgattttcgttcctaaccctgacccagtaactgcatgtgaaacaacattgttctagcgagctaagtgttagtttgtgctcaaaaataaactttctagaatctgcacgtgaacaacttgttcagacataagtgaactgactacaaactgtaggatattcagtgcctgagcatgttaaggaataggccgtgcttccaacaattaatatacaaatcaaccatgtgcctgtcagtgtaatattttcttttattaaaaagggagttaaattggctgttatctccttcatagaaaacatttcttccacacttttgcctaaaaacttcattttccaaagga

SEQ ID NO: 186059 - DNA, 492 bp, Homo sapiens
tcgtagtccaacagttaaatacattcatttgatataaaatgcatatttctgtaattgcttaaatgagtagtttctagtgccaagtaaaataaagaatacttattttaaatcaataatgaaaaccatggtttgagttttttggcttagaaataaatatatatggccatgtttgatttgtaaactcatcaaattaatgtggttcattcacttttcagttaacattccagtttaggattctgtgtaccactgttggaaactgagactaccagatattaccaagttgggggtggaaggtaggagggatcaccgagatgaaagctccctccctccccactccctacctttctcaaaataaatctgtcttctcaaagagagctgtgaccttggaactctgttatgtacaattcaatcagatgaaagtgttcttgggttcggaggatggtttcagaaattattttctacttggacctgtgccttagtctacttggactg

SEQ ID NO: 186060 - DNA, 451 bp, Homo sapiens
attaactgatattcaaaagaatttgatgttttagtttcataactttgtcaggttacatcttcatacttattaaacatgattagttcttgtaaaggaaacttcgtatgtgttgagatttggaaataggtgaaatgctaaatttaaagaaatatgggccagtcgtggtagctcacacctgtaatcccagcactttgggaggccgaggcagtcggatcgcttgaggtgaggagttcaagatcagcttagccaatgtggtaaaaccccgtctctactaaaaacacaaaaattagccgggcatggtggcaactgcctgtaatctcagttactggggaggcggaggcaggagaatcacttgaacctgggaggcagaggttgcagtgagccgagattgctctactgtactccagcctgggcaacagagtgaggctgtgtctcaaaaaagaaaaaatta

SEQ ID NO: 186061 - DNA, 209 bp, Homo sapiens
actcagaaggcaagtggtgatggcgccactgcactcctacctcagcaacagagtaagactctgtcccaaaaaaaaggaaagaaaaaagaaaaagaaatatggaggttaaagccaaaatgtgtaggttggttctctttgcctcttttaccacccatgccattacgctaagtactcttcctgtggacaaaaaggcttcctgtgctgctccc

SEQ ID NO: 186062 - DNA, 235 bp, Homo sapiens
  misc_feature (5)..(5): n is a, c, g, or t
  misc_feature (33)..(33): n is a, c, g, or t
cacanggaaagaaacgtggacccgaaagcaggntgatattataccacaaagcttgactgtcacccctgctccaagatccctctaggaattgactctaagagttcttcagactctcctgcctccagtcccctgaggggttaacacatattcccatgagcacacctggctgcttccctctgccagtgattctcaacccccatgccacgctcaggtcacagccccgggtaagaattac

SEQ ID NO: 186063 - DNA, 328 bp, Homo sapiens
cttgatttcttcccttggcacgcagtgcctaaaatattatactatctgaccctttacacatttctagaccaatgatacttaatcctggtaatctatcagaattacctaatgtgcttattaaaaatacagattcccaggtctccaaacaaatccacccaatcaaaatcttagcaagttccgagagaagtgattctgatgtagccagccctcgcattacttcaaatctggatatatattttactcaaaactagatttcgtattaatttcatcttttaggatcaattacacaaaatctgtttttaaagtctaaaaatgccaagataagaaa

SEQ ID NO: 186064 - DNA, 289 bp, Homo sapiens
tctttctctggcaagctgcagccatttctcaaatgcctgttgattctcactcattcatatgtaagaacaaggcaataggaagcttagggatggttgatgaatgagtttctctgtaggtacaatgggctggaatctggacattttgctttgggtcccctactgccagcatgcagagtgctttcctcagggatgtccacatttacactcaccctagctgccccaactttctccatttattcaatttctttgtaagaagactccatgttgctcttgtttttttcttgcggtt

SEQ ID NO: 186065 - DNA, 144 bp, Homo sapiens
accctattttcttaatccatgaaatgggaataataatactcacccaatttaccttacacagtcgtgaggattcattgtaatgggctttgtaaaaatataaagtgctatataaacataagggtgttaatctcctgtctttggtga

SEQ ID NO: 186066 - DNA, 261 bp, Homo sapiens
ctggcaaacaagtttttaaaacccagttttattttttacatatatgagtaaaggcattttagcaaattctgtctctttatttatttatgagcatgctcattcgataaacctgttgagtgcttcctgctccagataacgtgccagggatacaactgtggccacagcagaaatgatctctttctttatgaaaattacagcggagaaagggagatttcccttatctccgccgcccttgtctctaatacattttaaaatgggagg

SEQ ID NO: 186067 - DNA, 156 bp, Homo sapiens
taactccccactggacaccctgccctgggtacccaggtgtcccctccccaactttctgttctgagatgctttcactgtcccattttatgtccaccccaactgcacagttttgaaggctaaagaaattccgtcttagttattatttcactgtattaa

SEQ ID NO: 186068 - DNA, 174 bp, Homo sapiens
tctagagtatacccaggtagactaaccccgtagggtaatatgcttatccccacttttgtaaatggtggggggaggcaaggcttagagatcatttcacttgccttaggctggtgcttctcagttactggggactcttgttaaaatggagattttgattcagttaggtctacctgg

SEQ ID NO: 186069 - DNA, 378 bp, Homo sapiens
gtcgcccaggctggagtgcagtggtgcgatcttggcactgcaacctctgcctcctgggttcaagcatttctcctgcctcagcctctggagtagctggattacaagcgcacaccaccacacctggctaatttttgtgtttttggtagagatggggtttcaccatgttggacaggttggtctcgaactcctgacctcaggtgatccactggccttggcctcccaaagtgctaggattacaggtgtgagccactgcacctggtcatgttgtcaaccttctgtcagatacccgagttcccaccaagcgttgattcacttctccgtgacagacaaattctctactttttgaggttgtcagtttgattattcaaatcttcagac

SEQ ID NO: 186070 - DNA, 491 bp, Homo sapiens
ttctctccttctgtagacatcgtgcctccatactgaaggaccagcacagggccacagaaagctccacacttacaacatcttatgcgtaacccacaaaagacttcctctctcccatcctccatttgtaatatcctggctgcggggcgagagcgggggagttttcattggcctgatttggaccaaatggcattttcttgttcaatcattccatctagaatggtggggtactatgatagctaagcccagggtatacgcccacatctgtagccagggaggtagagtattatgactgtcaaacccattaaaaccacatggagtgtggaagatcaaatctccttgctgtggtctgaatgtttgtgtcttcctaaaattcttacgttgaaacctaatccagggccgggtgcggtggctcacgcctatgatcccaacactttgggaggccgaggcaggcagatcacttgaggtcaggggttcaagaccagcctggccaa

SEQ ID NO: 186071 - DNA, 182 bp, Homo sapiens
ttctgaggaaggaactcagataaaacaattttaagtttcaatctttaagaccagaagtgtcaatttctctatttatccaaaaaaaattgtctactggactattggttcagtttcatgtccctctttgtgtctaataatattttctgtcttaaagtctgtcttgtctgatattaacatagcca

SEQ ID NO: 186072 - DNA, 384 bp, Homo sapiens
ctacaggtgcccgccaccacacctggctaatttttttttgtatttttagtagggacggagtattccctctcttgactgatgtttcagcagtatgtggacagattcttttttaaggtaaatgaccagggcttgtaatatgagtgtcacttaggcaacaggacatttcaatgaaatggtgatggaaataggttctttttgtagattgtgagctcttgggagcatggattttgctaaatatactgatttttaaatttttttgacatctagcatggtgcatttcacataggagtttttcaagaagtactcatttcacaggcatcttgaatgatagatgtttggtaagaactgcgcaagacagtgtactaatcactcattctcattcag

SEQ ID NO: 186073 - DNA, 107 bp, Homo sapiens
ttctaacccttcctcaactaatgccacgaagatgaataagctctcaatcagcctttgagtcatgtgccccctgtaccctctgcctccacttctggaccttcaattag

SEQ ID NO: 186074 - DNA, 125 bp, Homo sapiens
tcttccacccaactcaaaaaacacccccaaaccaaaaccaactctgctggactttctgggatggttgatgacctactgagatctgatttcccagagcaggaggtgggaagtgcttgatccagcaa

SEQ ID NO: 186075 - DNA, 245 bp, Homo sapiens
tgagagcactgaggacacggcagatggactcgaaagtcagagaatatggggcgtatctcagatgtgaccgcagcgagcgcgcagcctgagttttggtagaatcgtgagccctgaacagagtttactgcccacttgtgctggaggagaagctcccgaacaactagagagattgtggttcccaaagagcagcctccaggcctgatgcctcctccatgaccggtgtctgtccgtccctccctccctcc

SEQ ID NO: 186076 - DNA, 309 bp, Homo sapiens
tataagtcagtgtctaattgttctataatacagcagtgatttgattaggcttgtgatggatagaattcattttcacttagtcagaaaatctttctaaatagaggagaattagaaggcaaaaggcaatttgataggtgtgctagtgggaagtaacttcaaatctcagggagccatattaattatagagaaagcagtgccagagaagttgataggctgctagatgggagtgaacagagcaggttaaggatcaagagcattaataaactgatggagtattaataatttcataatctttattgtgttgggtga

SEQ ID NO: 186077 - DNA, 347 bp, Homo sapiens
ggactagagttgcacagctggtatcaggcagagtgcggattagaatccagacagtctagcttcagaccgaggccctgaatcactaggctacatccaatagtttatgcgaacatgtaacctaattgagacacttctacatataatgcaagatagcatatggttagtcaagtagtagaattctgagaagagaaaatctgactggactcattaggtaaacataagtggtggaaatggacatttaactgggccttgaaaggtgggtagtatttaaacagtgcagttacttaataagtgtccacaatatgcctggcattgtgctaaaatacaaggtaaattgtatgtggctg

SEQ ID NO: 186078 - DNA, 156 bp, Homo sapiens
atcgacatttgatggattaggacattagggtgcagattaactaagtagctcccacagagtcacatagggaatgggtgacacctccaagatctgaatcccagaaactctggctttggggatagatgctctgagttggcactgcaatgggtgtgcttt

SEQ ID NO: 186079 - DNA, 342 bp, Homo sapiens
acctcctccccacgaagcttccttgaccgaccagaagaaagcagatggcttctttagctgcaccctaatttcacataaaatttcatgaaaatgcctccactcttcatcccaattgtgcacttgcactcaatcttctacctggcatagtgcctagtacgtaaaagacactcagtaaatatttgctcttatttactgagtgttcactacgacctgtcactctttcatagcattcagcataattgcaaataattgttagcgtagttatttgcttaatgactgtcttctttactagactgttagcatctcaaggccagaattggattctgtctcattcacagctta

SEQ ID NO: 186080 - DNA, 634 bp, Homo sapiens
tttttagtagtgacggagttttgccatgttggccaggctggtctcaaacccctgacctccagtgatacacccaccttggcctcccataccataattctttctattcctccatctcaacaaactatctctttaaactgacatttaccctaagcctggaatacaataaccgctcatctttcagttcacacttcaaatgtcgtttcctcaatgaagccttcctttaattcccttctcctatccctgacccccaaatagattcagtgcccagatatacatttccatgctactccacacttccttgccacagcaatttctacagtatattgaagcttgttgttcaccccctgttggcatgtaagctctgtaacattaagaaaaaccatgtttgtcttgctcactattgaattcccaaggtctaaacatatgggcctgaccctcacaccctcatttgatttctaaaattgggcttacatatatcaaattaaggcagggctcatatgcattgcaacattcagttaaaatactctcttccatcgttataaattccttcatatgaatataaaatgttctgataaccaaaacaaacaagaaaaagtgaaaaaattgcaatttgtttctacactgccttcagttt

SEQ ID NO: 186081 - DNA, 269 bp, Homo sapiens
tttaataagccatttaaaactattaacctatgggccagaggagctagtgttttaagtcagttaaatgtttattttgtcatttgtccagggtcttaaaaactgatttaataactgaacttttaggaaacgattatctttatttctttgtcttcagataagtgtgtttttagagttcatatagcttttattctaaatgtcaaattttatttcaacatcaaacatttaaacaatttagacattatttttctaaatgaagcaaaaatttattt

SEQ ID NO: 186082 - DNA, 511 bp, Homo sapiens
gcagaaaggtatattgaagtcctaatctccagtacctcagacagtgaccatatgtgaaaacagtgttgttgcagatgtaattaattgagatgaggtcatagtagaggagggtgggaacctactccactatgactggtgttctcagaagaaggcagcgccacgcagggagcacacatgtgatgataaaggcagaaactggagtgatgcagctgcaagccagggaatgccagagatgacagcaacccactagcgctaggaagaggcaaagaagcatccccctacagggttcagagagagcatggcccttgtccatatcattatttcagacttctgccctccagaaccatgagacaatgaatttctgttgcatattaaatgtcaagtaatattgctgagtgcgagagtgattcctgttacggagctatgttggaaagcacgtggcaagtgcttagtgcggtgccagacacaaaaggtatttggcaaatgcttattcctttctcttcacttatct

SEQ ID NO: 186083 - DNA, 350 bp, Homo sapiens
gagaaagagcccatagcacatgagatggctgtatggaatgagggagagagaagagtctggaaagtccctggtttctagttggacaacctggtgatgatgctacttactatgacagggacacaaaagcggaaggtagagatgcgggcaggggatggggaactgcaattagataagattgctttaagcttcatgcagctgtgagatctccaagccacggtgcccagggccagtcagagctggcccctgacactcaggaacatgcagtcctgggcatcacccacttcagtagagctgtggagtctaggtcccctctgccaagctggcagaagctatgaccatatacaccaaat

SEQ ID NO: 186084 - DNA, 920 bp, Homo sapiens
caatgggtgcctgaaactgatgatagtaccgaatccaatataccaaaatgaagcattggtaaaaacatttcataaataaaatgggtgtcaaccacactttctgattacattgccagaagacgagcaaatgtttttgtgagcacatgggttttttgctctgtatactacacctggttttattatatgcccgagagtgttgctacatagcagaagagttagcttgtcctttcatgtttaatgccatggtacctcctttgtacttttataaatagtatgtacttccctcacctggacataattctcaatatctgaaaaattcaataatgttatcatagcaaattcagaaacaacttcagtatctactaataagggaatggttaaatcaaaccacaaataaggaggagactactgttgttacagaaatagtcttcaagaaacaatagcatttcctagaagttataaaatttttactggttccagactgatcctaatatcaggtatgattatttcctttggagtaagaaaaaaaattttttaaggctgaaatttttgcacaaaagtcttagattaaatatggtatatgatttgggacacaaggaaaagcctataatttaaaatcttggcttcttatcacaagtccaatgtataaaagttccacccttctccatagttcatgaaaactccaaaaagctattaacatcaattactcgagaatgaaattatataagccctcaatttagaataaaatgagattcatgtctaatattatttatccttattataaaaggaatgaaatatttggaactaactgtaagcaaagcataatttacaaaatccccaaattcctatatcaattcttatactcctatcatgtggagtatgcaactaaaataccaatttaatcctagcaaatgaagaaa

SEQ ID NO: 186085 - DNA, 525 bp, Homo sapiens
agtttgaagcagggagaacagttctgtgcttggggtacccaggaaggagagttgggtagctgaagtgaggaggccatcaaacagcctttacctgcttttgaaatttgccgaaagcagccctcatcatgcctggcaagaggcatccaggagagcattcagaattcacagtgctgcctcagcagaaaagttttataatttccttgagtcaagatcagaattataggcagcagcatttcttcctttgcaaaagacttctcaggtctgtatttaagtgcatctgttttaaaaattctgttctaaaggctgatgtctttcactgagagtgattcctcttggggccagctctatggagctgacctcctggctccttggccttaggaactgtagcacacccctgggaaatgctggagtgcagtcagcccaccgcccagtggtgcaggagctcggaagggggatcctaagccctaggcttccttgctctgtgccactgacatgctgggttatgctggacagatcactttctat

SEQ ID NO: 186086 - DNA, 358 bp, Homo sapiens
tatccccttatgtatacccatagtctagtacaaacctggctaatcaataactatctgtttagaaagtgaatgaacgaatgattgggagtgcctgcaagacctatatgttttaagtaatttagaatgaacataaagatcttgtatgtttctggaacattctactcaaaattggtgatatacttgttttctggaatcttattcaattaagcagtaattttccttttttaaaaaaaaaatcttacctcacagcatttgagggatataatacttcttcatcaataatataattgatgcaaaagaggaaaaggcattgagaccatctcaggtctttcttacaaatctctccccagttgaaaat

SEQ ID NO: 186087 - DNA, 644 bp, Homo sapiens
cacttgtaatttctggggttttttaatagtagccattctagtgggtgtgcagtggtatctcattatagttttgatttacattttcttatgagtagtgatgttgagtatcttttcatgctcttattagccatttgtatatcttctttggagaatatctcctcagctcttttgcccacttcattaaattgagaggtttgtttttgctgttgagttttagaacttctctatatattctggatattaatcccttatcagatataggatttgcaaatattttctctcattctgtggggtgcctttttactccgttgatagtgtctttgtacaaaaatttttaatgttcacgaagtccaagttgtctactttttgttttgttgcctgtgcctttggtctttgtgttagtccatttagcattgctataaaggaatacctgaggctggtaatttataaagaaaagaggtttaattggcttatggttctgcaggctgtacaagaaacatggtgccagcacctgcttctggcgagagcctcaggaagcttccaatcacggcagaaggtgaagcgggagtaggtgtctcatatgatgagacagggagcaagagaaaggaggttccagtctccttttaacaaccagatcttgcatg

SEQ ID NO: 186088 - DNA, 911 bp, Homo sapiens
ccaaaactgtaactggacgtccatcttgggtgacaagaggagaatgtcaggccacacggagctagagacttggtgggaacatttgtcggggagagggaggggacaatggagctcacttagactcacactgggcttgctgacttagaggtatccaggagcagctggatttaggggccagagttcaagaagagggcctgggctgggaaagggggcttgggaattatcccaccgagtggccccgggaccaggcagtggtggggacatgcgagggagaagtttccatggccagttaggacgaacaggccgcacggcgtggatgaagaggccaaagacggcgagatgggtggccttgaagggtatcacctgatgagggatggggggaccgaacaacgcagctcaagaccctgcccaggaaggcacaggaccccgctgaagagcagcagagactcaatcactgaggctcaagcacaaggcttttctcatttcagatacacaccactcagggcctttttctagattttggcaccacagaaaccaaacctcagaacaaccaacttagtcaggctaacgcattcctggctgtctgaacaacctgaggggaaacgcttcttgtatccaattctgagacattcaaaactatcatttcaagctggcttgaatctgattgggaaaaggaagactgaatttctgccgctgacgcttccagaccaacagaggttccctgtacctgggagttctggatattcacaggcaactcacacaggagccggaggtaatagaatttatttgtcatgaggtagaattgaaggggcctttctttctttttttctttagaaacagactcactctgtcccctgggctggagcgtagtcacaggatcatgctaactgcagcctcaaccacccgaccca

SEQ ID NO: 186089 - DNA, 253 bp, Homo sapiens
aaaaaaaaagtgcctcctcccggtgagacgggctgcccagaggctctgtgtgagaggagtgtctgctgtgctggcctcctcagccacagcctgggtttgccattccgctcattactgcctttagtaattgtatcatgtcattcccatcactcacaggaaaagaaacaatgaaaaaaataattgtattgtgaatgtttgctcgattgattgggtatgtgtgagtctctggcaataaaccatatttaagcattgc

SEQ ID NO: 186090 - DNA, 287 bp, Homo sapiens
atcatgcccagcccacattagtttactttgtactttacagtatatccatgttttaataaaaatagctaatgcttcaatagcactgaatgtatgtcaggttctagtctaaatactttacatagattctcaaacccataaggcttgaggaaactgagacccaaaaaggttaagtaacttgctaatgtcatacagccagtaggtgatggggctaggaagtctggctccagagaacgtgttcttaatgactgcgatttgatgttgaaaattctgccttacaggccgggcgc

SEQ ID NO: 186091 - DNA, 140 bp, Homo sapiens
ggttatacaagtttgagcactacttttctcaatcctctctaatctccatcccaaatgccaaaccccaaactaccaaattccaaagacaagataagtcaaaggaatatctccagattttcagtagatagtagtggtaaaag

SEQ ID NO: 186092 - DNA, 746 bp, Homo sapiens
agttttattattatatgttagcagctctggtaagaaactcagagaattaagtgagaatggtagattaaaatgaggctttaggataatgtgattgctccccatacatgtgtaattgacagttgtgtgaggtgagctcaatttaaaggaagactagcctaagctggtcagtaccaggaggattttgccccagtttgcttccgtccaagtgtgtgtccctcagcacagcatctcttgggcttcctcatttcctgtttatgataatagagtactcacccccatccttgagggatacattccaagacctccggtagttgtctgaaaccacagataatactgaaccccatttgtattacgtgcaaacttttttccttcataatttcatggatagatttgttcttactgtagatcttagcaaccttgttatttgatattgttttcttattaagaatttttaccttttcacgtaaaagaagccctttatggcttttctttggcatatccaaattgcagcatcagtactcttgagctttggggccatattaagccaaataaaagtggcttgtgttcacttttatccgtgatcacatccgcaacagttgatgtgatcagcaagacagctaccaagtgacttaacgggcaggtggcctagatggcacggagaagctggacaaagggatggtcatgggacagagcgggatgtcactcagtttcatcatgtttctcagaacggcgggcagtttaaagct

SEQ ID NO: 186093 - DNA, 703 bp, Homo sapiens
tcccaaagtgctgggatgatgggtgtgggccaccatgcccagccaagaatatttatttctaaaaaaatatgctctcccactattctggaaacctatggctctcttcatctttggtagatactacagtttatttagccaaaatcattctcctcttcctccttattaatagaaccccaattttttggaaggggaaaattgccccaaaagactacatttctcaacctttctttagtttcgctcttgttgcccaggctagagtgcaatggcgcgatctcggcttaccataacctccgcctcccgggttcaagcgattctcctgcctcagcctcccgagtagctgggattacagttgtgtaccacaatgcccagctaatttttgtgggtttttttgtagaaataagtcttgttttgttgcccgggctggtctcaaactcctagcttcaaatgatcctgggacgctgacttttattgaatcctttttctgcatctattgagatgatcatatggtttttgtttttaagtctgttgctgtgatgtatcatatttattgacttgcatatgttaaaccatcccagcatccctgggatgaaacccacttgatcatggtgtattgaatagggtgtattatttttctgatatgctgttggattcagtttactagtctttcattgaggatttttgcgtctgtgtcaccagaaatatc

SEQ ID NO: 186094 - DNA, 611 bp, Homo sapiens
ctacagctccattactataattaaccatcatgctacttctatttcagagttactgatgactttattgtacaattagtgctgttctgcttttcttcactctccttgaactccataacagtagatgttattaaactctttttctacccgaaatattattcttcctttctcacttatatactatacctccttgtttttctgacttaacctggtttcttttgctgccactcccttagatataggcattttccaagacttggtccttggtctgcccttctttcacagtgtgttcctttcagagctcatcttttttcctggcttcaactatcaccagcaacagtaccaccagagccagctctcccctccaatctttgtgtccctgtcagtggcaccacctttttataggcacaaaccaccatgtatggcaataagttcatatacttcctagttcttagaatcacttcagtagttttggagaggcaagatgcatgaaagaagatatagtctacatgtcttattaaccaaaagtaaaattaagaaatcaccaaggcacattattttaatcaatttttaaagcttgtttaataaatacataagagttcaagaccagcttg

SEQ ID NO: 186095 - DNA, 617 bp, Homo sapiens
tacctttatctggaacatcagaatggccaaaaaaagagccaatttcaatttactttttcgtttagtggagtaccctagtaactatgtttcactctgactaaagagaaataggaagtttaatcataatgatactcagaccttcataataatcattttgttcacacgtattcctggatcttttattaggggtcacatttccattttcagagaaagaaatcacagcacagaagcgaagatgatacagtggcccagactttgccaccttattacgtgctcaaaccattggatcccactttagatggagtcaaaattacagggaacacagtgcacgcttgataagtatgctccaagaaacttctcagaagtgctgggaaagaaatatctcacaggacctccaaaaggctttgtaagagaaaagatcaggaaagtcatactgaagaaagactctgttaatctgttttcttttgactggaaatgttggcatgttttcatttttacaaagtcctaatagtcacaacgccatatactcaagtcacattttggcctaattagttataggattagagctgtgtgaaataaaatagcaagcaagaatgtctattctagtgcctttttca

SEQ ID NO: 186096 - DNA, 557 bp, Homo sapiens
tgcactccctctccaaaagacagatcctagtgaagtgaagcacagctttcaagggggtggggagaagaaaagccaggactccttccgtgtggaagtgtgctaggggaaggggtcttctctctgacatgtctctctttttcagtcctctgctcaaaaacccttgagtgtcttcttggttcctttttatttcggtatgtacttttcaggccgagcctgatgataataccctaataaataaccctctctgctccatcgccaaccatccctccacctccaacatgtgctggcttgtttgtttgaactacttaaaagtctctaaaactgtcttggctgccctgccacttccctctactttctaatcatttatggcatgcctactctaggccaggactgtgccttcaaggagctcacagtctaggatagataggtaagagcaaatcattccagtacttaatgatacgtgttgtggtacaagtgggagagttagcagctcagcctggggttgcagtgtagagttctggactgcctgagagaaggaaacagtttaggcctgaggt

SEQ ID NO: 186097 - DNA, 840 bp, Homo sapiens
ccattctcggcccataccatcttgaggttacaaaatgaatggggactcagagcatggccaaaaacagattatagtggtaagcaggttttagtggcaagacaccttatgggagggggaaaagatgaggcctggctagcataagtggtcttgttaggtagatgaaatctcacaggtagcagccctcagaaagaattgatggtaaatacttcttttcgacctttaaaggtgtcagagcctcagttaattgttcctaaatctaaagagaagccccacataagtgaagattttatccactgatgcaaatctctcccaccaaagacagctttgcagggctacttctgtttgcaaggccctttgaacagctgtctcaaaatatgtcaaagaaggatattttaaggtgaaatatttttatttctttcactaacgtgtataaatacttcattccttttttattgccaaataatatgcacggacataggacattttatttataaagtcatcggtgctgggtaaggtgtcagagccccgcgtcgaatagtggttgactcgccgctcgcaatggctcacacctgtaatcccagcactttgggaggccaaggcaggtggatcacctgaggtcaggatttccaaagttccagaccagcctggccaacatggtgaaaacccgtctctactaaacatacaaaaattacccaggtgtggtggtgcgtggctgtaatcccagctactcgggaggcggagacaggagaatcgcttgaacccgggaggtggaggttgcagtgggccgagatcgtgccattgcactccagcctgggccacaagagtgaaactcagtctcaa

SEQ ID NO: 186098 - DNA, 199 bp, Homo sapiens
actgctgcctattatattatgccccaaactccacaggtcagtattccaaggctctccattaactggccttatctaatcatcatcataggggccctgtcttccccactccattccagaaacatcccactaattaattaccctgaattagctagcttcttgctactgcaaatagcctaaggtacctcctttgttcttaagc

SEQ ID NO: 186099 - DNA, 331 bp, Homo sapiens
tggaactcagtaagcaaggaggagaatggtgagaaatgaaactggggagaaaaggagtttggcatttactctgcatgagatgggaactgatcctggggttcctccccctcttagttatccagttcttggtactcaaacatccattcccctttaaggagataatggctgtctctaaagaaacttttctggaccatctgaagcagagaaatgagctggctcacatattgtaaatcacattctggctcttgtgtcaaaaaggacaaggctggaagcagggaggtcgacaaggaggcaatttacactaacccaggcaagttaagacggcaagcgg

SEQ ID NO: 186100 - DNA, 984 bp, Homo sapiens
  misc_feature (984)..(984): n is a, c, g, or t
tcctccggaagtgcggatcccagcggtggtcgtgtagctgagcaggcctggggcttggttctatgtccctgtggctatgtttccagtgtcctctgggtgtttccaagagcaacaagaaacgaataaatctctgatgaagagataccatttgacattttagagatggctgcatgcaaactcttaaaacatttgaatggagattcactcttgttgcccaggctggagtgcaatggcacaatttcggctctccacaatctctgcctcccagattcaagctattctcctgcctctgtctcccaaggagctgggattacaggctggtgtgcaatggtgcgacttctgctcactacacttccaccttccgggattcaagccattctcctgcctcagcctccggagtagctgggactacaggcatgtgccaccatgcccggctaattttgtatttttagtagaggcagggattcaccacattggtcaggctggtctcgaactcctggcctcaagtgatctgcccgcctctgcctcccaaagtgctgggaatacaggcatgagcaaccgcacccggcctggattaattgaaaattttcttctgtagattgtaatatattactattgttatctattttattgccccaattttctcaaatttggctatggaagtttattcaaagtggatctgtttccctttcacattttccccatttgtgagccatttcttacttcctaacatgacaaaatatttcaactaatctgtatgtcctggcccatctgatatcaatatgtcccaggacctggtcttatgggatgggtccctgtacggttgagtgttagccttgttaggcttacattgttgttttcccctttcttgtttttcatccggccttaaaagtgtggttgtcccaccaagaattgccctgggcaaaaaaaagggttgggacatacaagtggtgtctaaacaaactacgggaaggatattaatgn

SEQ ID NO: 186101 - DNA, 973 bp, Homo sapiens
  misc_feature (973)..(973): n is a, c, g, or t
tcctccggaagtgcggatcccagcggtggtcgtgtagctgagcaggcctggggcttggttctatgtccctgtggctatgtttccagtgtcctctgggtgtttccaagagcaacaagaaacgaataaatctctgatgaatggagattcactcttgttgcccaggctggagtgcaatggcacaatttcggctctccacaatctctgcctcccagattcaagctattctcctgcctctgtctcccaaggagctgggattacagatgaaagcaccattatcaagtaagaagagcacaagtcaagccactgctggtgtgcaatggtgcgacttctgctcactacacttccaccttccgggattcaagccattctcctgcctcagcctccggagtagctgggactacaggcatgtgccaccatgcccggctaattttgtatttttagtagaggcagggattcaccacattggtcaggctggtctcgaactcctggcctcaagtgatctgcccgcctctgcctcccaaagtgctgggaatacaggcatgagcaaccgcacccggcctggattaattgaaaattttcttctgtagattgtaatatattactattgttatctattttattgccccaattttctcaaatttggctatggaagtttattcaaagtggatctgtttccctttcacattttccccatttgtgagccatttcttacttcctaacatgacaaaatatttcaactaatctgtatgtcctggcccatctgatatcaatatgtcccaggacctggtcttatgggatgggtccctgtacggttgagtgttagccttgttaggcttacattgttgttttcccctttcttgtttttcatccggccttaaaagtgtggttgtcccaccaagaattgccctgggcaaaaaaaagggttgggacatacaagtggtgtctaaacaaactacgggaaggatattaatgn

SEQ ID NO: 186102 - DNA, 639 bp, Homo sapiens
ctagacgatccccctgatatgctggacatagattatgaaaaggaacgaatgtgtttctgggaatgagaggtagactagatgtcaaattacagaagttggatgacagattgctaaaccttatatatggagtaagggagaggtggaagttaaaactagctcttgggttttaaacctgagggacttggggatttattgcattagtcttaatgcacataggaaaataatgaggatgagctagtatatgtggacagatgatggtttatggttgactgactttgaattgccagtgaaacattcatttggtgctatgtagggggtaattggcaatgtgggagtgaaagttgagggagtggggtggctagagagttgaagaatatggatttgtacttaagttgcatgcgtagaggtggtagatgaagccatggaagtggatgaagttgtcatgggaaaatgtgcaggtaggtgtgtgtgtgcagtaagtagaggtggttagggagctgaacgtagtttattttaaaagaaccactttattacaatttcatatgctcattatttaaaaaaatctttgggtacagaggtgtatccaaaaaaaaatcttactacctagagaaactgtcataagaaccagaattatcaggg

SEQ ID NO: 186103 - DNA, 509 bp, Homo sapiens
taagcagcagccagctggtcagagatacccatggcatgaaaaaagagtgcccttgcactggagggcgaggggtgaatactgttattgcagcagctcggaccccaggcctgctcctacactcagagcctccaaggcagagctggcttcgtggaggtgtgatctgggcagtggcctagggtcccaggtttagaagggtccctgcagctgatttaatgctcttctgtcaggggtttcatcaataatttatgaatgagagagtcttcattttcattttgcagtggatcctgcaaattatgtagctagctatgcccaagacctgagggtttggggccactgagctaaataaacagaagtactcaagaagaaatctagtagagctgaatttctgatggatatcttcttaaagacagaaagcaaatcccaaatggaaagccaggccattgtttgtctccaggtcccctctctctgctacatctttggcttcttggtggtacccccacaggctggaa

SEQ ID NO: 186104 - DNA, 388 bp, Homo sapiens
aattctgctctcacacactctgcaaggccttagtcttctaacttagctcctctaacttttgctttttgtttgtttttcatttggaaatgtacatgaaaatagtaccaatcttacaaggttgttatggagattaattgaaaatgcaaggaaagtatatagtgtggtgcctggcatatggaaagcccttgataaatgctcgttgtttagcattattattgtaaaatggggataataataccttccttacaaaattgtcatgagagtaaaaggaggtattttgtatgaaaatctctagatcagtctcctgcacatagtaggcccacaatacttgtttttacaaattagccagtgattctgaaggctttttattgttttgaaagttgtgaca

SEQ ID NO: 186105 - DNA, 373 bp, Homo sapiens
gaggtaatatgagaggaatgttgcggtgatggcacagttctgtatgttgattgtcgtggaagctacacaaaactatacatgtgataaaattgcatagaaacacacacacacaagtatatgtataactggtaaaatctgaataacctctgtggattgtaccaatgtcaattttctgatactaatattgtaccatagttaggcaagatgttaacattggggaagggtgagtgaagggaatacaattctttgcaacttcctttaaatctataattatttccaaataaagcttttaaaattaaccataagaaaacaagcaacccaatattttgaatggacgagaatataaacagaaaatttaccacagaagttagat

SEQ ID NO: 186106 - DNA, 697 bp, Homo sapiens
tttagatgttaggtgatgtagtcgtgttggatgctctggatttcagccagctaggtaggacctcagacaaatcacataagtggttttctgcttcactgtctctatcacgatcaatgagaacagtcccacctacccctgtctccttggggccactgtgaagccactgccaagagtctaaaaatcacagttctttctctgatgtgtccagtaacatcttctacagagctttcacatctattaacaccaaattcttccccctcagtaaagttgaaagtaaagaacaaagattttaagttcagtgacaagctaagtgacaaaggggactcataagcccacttgaatagggcaatttccacttcacaagcaaagcacatactttcacatgtcggaattcaaaccactctcacagatcttcaagctatttcactagagtcttagggtgcaactctcttaacaagcaaccccattgctggcatctctgaggcagcaattcaaaccccaaattggcctgttttccctgacagactgctgggatacagattcctggccaacagcagaaaagctggcagctcactgcctcttccagagttggcttggccagggcaatgccagaacaattggtctcattgccttcaacatgggtacgactcgaatctacgcttcttgttttttataaaaaaaaaaacaaaggagcgcg

SEQ ID NO: 186107 - DNA, 232 bp, Homo sapiens
gggagctctgaatcatgaaagacatggagaagtgaggagaaggcagtcccttttatatgtctgtgtaaggaaggagatggagggtaggtggtcaagggcaaaggaaacactaggatgagaaaatggaaattacaggtgggcaagagtggcatccctaaaggatgtacttgatgagattatgtccagaagctgttgagatcatctgcagaaggcattgccaccgatgcttgag

SEQ ID NO: 186108 - DNA, 484 bp, Homo sapiens
aaaaaatattctaaaggatccttattgataaaaattggaatatagacagtaaattattgtattgatgttaaatttcactgaactgtggtgatgcgagaaaatatccttgttcttaggtaatacccactgaagtatttgggggcaaaggggcatgatggctgccactttcagttcagttaatataccaaaaaaaaactatgcttttattgtttttttgttttttgttttttgagacaaggccacgctctgtcgcccaggctggagtgcagtggcgcaatcatggctcactgcagcctcaatctcgctggctcaagcgaccctcccacctcagcctcttgagtagctgggactacagttacacatcaccacagctggctaattttgtttatttttttgcagagacgaggtctcactatgttgcccaggctggtctcaaacttctgggcttaagtgattatcctgccttggcttcccaaagtaccgg

SEQ ID NO: 186109 - DNA, 541 bp, Homo sapiens
agttggtaggcaaggaggaactgcagaagatttttaagaaataaagtgaaaatctgtgcacaggaaagactgataagggaaataaagaggcaagaaaccacttgggatcctaatcatgagctgaaaatgaattaatgagggactaaattagggttaaggcaatgaaaatataaagtaaacaaaagcagaaaatataaagtaaacaaaagcagaaaataagatatttcaaagaaaaatctgtaagactaagcaactaattagatataaaaaagaatgagtccaaggtaattcagggtcagaagaagaatgaatggtcaaactgctaacagaattttgaatatgggaagagcttatttaggaggagaagaaggtaatgtgcccagtttgtaattttcttttcaacaagtcagtaagtagggacctggaatttagggaaacgtaaaggctcaggttatggatttgaggttcatctgcctagaggcctgaagccttgggaatacagagctcagtgagggaatgcatagaactccttctcttacag

SEQ ID NO: 186110 - DNA, 990 bp, Homo sapiens
atctcaagaggcaaaccccactccgtagaccctgcctcgaatcctgcatcagtcgcccatacaaggccagctttgctttgggggtgttacagggcaacagccaagggtgggcttggaaggggttgaaagctgttggagagctcacagaagggcagcagagtgctgagaaggaggtgagctttagagtcaggtagacctgggttcaaagccagatgtcacctctttgggctgcatgggtttgggaaagttgcttaacctctcagtgcctcagtttcctcatctgtcaagggtgtgggccatgatgaggatcataaataaaagcagcaagtactgagcatggtagctggggcatcttaagtgcccagcagcagtgcttgtcatctgcctttccccaccttctccatgccttcaaagtcaggctgttgaatgaggaaatcgttcagatgtcgaactgccagctgtggagtgcgagaggccaaggaagggtcgggagggcctccagctgcagagggctggacagaggcagtgagccagtcaggatgatttatactagctgccacaacaaacaaacccccaaatctcaggggctcctcccagcaaaggttcatttctttctcacgcatcatctggttaggtcatcagctcttctgggtcctccctgggtgactcagggatcctggctgctcctgtggccccaccatctggagtgtgttgtcccatggtcagtgccacagaggaagagagggatgaaggaggcacagaagcttttaagtgcttgacccagaagcaacactcatcacttcctctcgcagtccatggccagtggggaggctgggaaaggcagaggagcatctggaatattaggtgagcacaccagtaaggctccctgcgtacattcccatccctcgagccccaggttaaaaacatcacgtggcaggctcatctctggtgctgattagacagccgtgagcgtggcttgtcttagggatt

SEQ ID NO: 186111 - DNA, 1551 bp, Homo sapiens
  misc_feature (1001)..(1001): n is a, c, g, or t
  misc_feature (1203)..(1203): n is a, c, g, or t
  misc_feature (1371)..(1371): n is a, c, g, or t
  misc_feature (1535)..(1535): n is a, c, g, or t
agagtccaaagctagaaagcaaaattcttttaaatctgaggtggtcccaggagttttttgaccaccagtgatacggaatgaaatgtgtgcaacactgtggatttacaggtaggaacacagaggaggtggtaatttgccccatttttcaatgttttgtcttaattccaagagcatggaccttgcaacagctgtttggacctgatagaggaacacaattcccaacacatgctgtcccccaccaaaatgacctacctgagcaattataggctttgagtaaggagcaaggactgtgaacttgatatacccgctgtccacagcactcttacctactcacagaaatgaccccactgaacaaactgatggctacacgtttaagatgcaaactgaaaacatcttttagaccatgtttaaacctccatagtttgttctttttgttcttaagaagtcattctaggctgggctcggtggctcacgcctataatcccagtactttgggaggccgaggctggcgaattacctgaggtcaggagttcaagaccagcctggccaacatagggaaaccctgtctctactaaaaatataaaaattagatgggtgtggtggtgcatgcgtgtaatcccagttacttgggaggctaaggcagaattgcttgaacttgcgaggcagaggttgtggtgagccgagatcataccactgcactccagcctgggcaacagagtgagactccatctcaaaaaaaccccccaaaggccaggcgcagtggctcatgcctgtaatcccagcactttgggaggctgaggtgggtggatcacgaggtcatgagatcgagactatcctggctaacacagtgaaaccctgtctctactaaaaatacaaaaaattagccggacgtggtggtgggtgcctgtggtcccagctactcgggaggctgagcttgcagtgagccaagactgcgccactgcactccagcctgggcaacagagcgagactctgtctcaaanaacaacaacaacaacaaaaccccaaaaaacagaagtgtttctatggctgggcccagtggctcacgcttgtaatcccagcactttgggaggccgaggtgggtggatcatctgaggtcaggagttcaagaccagcctggccaacatggtaaaacccagtctctactaaaaatataaaaattagccaggtgtggtggtgggtgcngggcatggtagctacaggtttaagatgcaaactgaaaacatctttcagaccatgtttaagcctccatagtttgttctgtttgttcttgcttaagaagtcattctagaggccgggcgcggtggatcacgaggtcaggagatcgagaccatcctgggtaacatggtgaanccccatctctactaaaaatacaaaagctaaattagccagacatggtggcgggcgcctgtagtcccagctactcggaaggctgaggtgggagaatggcgtgaacccgggaggcggagcttgcaatgagctgaaatcgcgccactgcactccagcctgtgtgacanagcgagactccatctc

SEQ ID NO: 186112 - DNA, 328 bp, Homo sapiens
tttcagttccacggaaaatagccctaatgaccatattagaatctccagacatcctcatttaaaaactgagtctgacctcaagtggccagttaacaatgacttctcaaagacttctgagcaaatgttggtttggacttaatatcaatgtgttattcccaaggaggaatctcccttagtcgagtcagcatctgccattgtagccaccgtcccacttcttaagtgaactggggtagtttttaacttcagtttccccttctatcaagtagggataatcatgataataattacgtttgaaaaagcctcatacaccgtaaagcacaaatccaag

SEQ ID NO: 186113 - DNA, 383 bp, Homo sapiens
gctgggattgtggctttgaaacgatccctaagagaggaggttgctttgtgtgccaagtcccgctgtgccacctgcccccacagttcatacaaccagtctggtttgcgggaaccacccatcttccagctggggggtctggaggcttggtaggcagagggtgcccatgagcctggccccagtgagagccccgggcccggagtctcaagcagagttgctttccgagcagaaacactgcatgtgccagctgtgttttgtggctgggacccctctcaggagggagagaggatagggactccggtgtggatgcccccttaccaatggctgtgattcgccacagccacgagcacagtgccactgagtcccgtgggtggctatgggcggcc

SEQ ID NO: 186114 - DNA, 237 bp, Homo sapiens
tctctctcccctgcccttcccgtgggcaggacgcagagctcctccagggttccttctaggccctcttctctctctacaacctttcctgggtgacctcatttgctcacctgattcttacaccacatgctggagctgcccataacctcagcagcagcacagagctcttccccgagtacccagcagcctctctgacacctccaccgggaggtccttcaaccgcagtcctttcaaagctga

SEQ ID NO: 186115 - DNA, 226 bp, Homo sapiens
ggctacaatggatgtcctcataaagccgcataataataaaaacaagactctttcagaatcattaataaggaaacacggccaggtgcaaaggctcacacctgtaatcccagcactctgggaggccaaggcaggaggagtacttgtggccacgagttcaagaccagcctgggcaacacagcaagaccctgtctctaccaaaacaattgagaaattaggcaggcatggt

SEQ ID NO: 186116 - DNA, 328 bp, Homo sapiens
aagatggataacactcaacagatatttcttctatgtcctgaatgggaagaagctgtgtaagtgcttactaccttttaagcaccaagaacaaagatctcatattcttcattatctgttaaggaatttaggtaaaaatggtatgtcaagactctctgatggctaacttgggtacagaacttagatgtcaaggcttcagttgcctcccaagtcagagaagcataggataggcttcctgttaagatcataaaagtcttacataaccagaactctgacctcctgagtagacagatatacccagattagcagttatcctgtagctgctgggaca

SEQ ID NO: 186117 - DNA, 364 bp, Homo sapiens
tcatgggatgccacactttcctttcaacctcacaaaaatcctgctttctgcaacagagattacagttcagtaacaagcaaaatgtaaaatgtgacaatgttctcattggtcattgataagcattcactaattagattatagccagtaagaaagagacaaggttgggggcgggggcaagcaaagaggggtatagagagagaaagagaaaaatgagaaataaaagaaaaagttatctttactaagttctctgttttaaagtaacaaggacaaggaccaaagtttaagaagaagaaaaacataaatttttattatactgaaaggaatacttacagttatttaaataaagatatagaaagttgaccaa

SEQ ID NO: 186118 - DNA, 532 bp, Homo sapiens
aaaataaataaaaagcaatggaaatttggaggaagaagtagtgaatcagcctctctcttccatgtgctgtattttattggaatatgagtaagtataagggtaatatgagaaatgggggggggggttctagtcaccaaaatggcatctgactctccaaatgcagcaatgctcactccagtgggttgcttcactgtgactcaagatctgtcaaatgaggacataagggaatttgaataaagccaagatacactcctaaaataaaccaaatcttccaatagacctaacagaagatgtaacaagaatcaagaagctaacctactcaacataaattgattctaaaatactttttaaaatgaattattgctaatgcaaaaattcaggaaagaagtctaggaatttgttttcctaatggcacattccatttatctgttggtagaggtcactaaaatacattactaggtgtctatgtatccctcccctgttctccttttataaccttattcttcaaaaataaaaggtaattaagtgaaag

SEQ ID NO: 186119 - DNA, 352 bp, Homo sapiens
ttgtgcctcagcctctcgagtagctgggactacaggcgtgcaccaccatgcctggctaatttttatatttttagtagagacagaggttcaccatgttggctaggatgttctcaaactcctggcctcaagcaatctgcctgtcttggcttcccaaagtgctgggattacaggtgtgagccatcgcacccagcctccatgttatatattgattatataaagataaatagttttggctccttagctctttgagctaatcttaggcacagccatatctcagagttattgtggatttggtttcagatcaccacgataaagagagccacacaaattttttgatttttcagtgcatata

SEQ ID NO: 186120 - DNA, 421 bp, Homo sapiens
catagggaaattattttaaaagcttctgttgcacagaagagtaactaattatacgggacaagtaaatggaccacatattttactcaggtggtttggctgcctgatcagaattcaggtcagatttacttgcttccaaagaacttataggtagtatctagcatcacagaaaaatgaagcattacctaaaaattcagatggtccaatgatccacaggtatctcttgggttgctgatcttaatctgtttgatcaatttttgcagtaccttgggagcttttcaaacactgaatgtcatctactttatttgattaagtaaagactcggagtgcagggataatggcttaaaagcctgttgtgctgccataatgctgagtccagtggctctcccacagctgatgtgagctgaatcatgaactcatgatt

SEQ ID NO: 186121 - DNA, 832 bp, Homo sapiens
gtgacagggaaaagcagggtgcaggacagcgatgcttcccaaagccacctgcagggttggtgctggaagttaccagatggcaccaggctggccgtgggctcacaatgacctctcttcctagctggaacttccagggtccctgttggaaaggaagtgtccagaggacacagcagctgagcaaggggcccacctctggttccctccatcttttactctgcatttctataccttcactctggagggctgggtgggaggacatggcttccttttagtcttctggtagaagcatggatgcaaacaccttccttgagtttccatgagcatagctgccacaggctgacctttccaaaagacattactaaatataaaaggagaacaaaagaaagctaaagatagggcgtgcaaagaataaaaacagcctggctcacaaagaacaagttactggtttgtttccaaagctttcggaccctgccctgttattccccttccaggagataaccacctccaaggccagcagacgtctgcaggccctttcgccaggctctctggcctcctagtgctggcttgtccactgtctaggttgtcttgtaggacccatgccaccaggaatcctctccagactacttgaccaccctgcagtcagatctctgttctgccctcttctctacccagggctcttggctgtggtggcggagggagggatgcctgtttccctaggtctcccaggtgattggcacctatgtgactggaccttttaggagtgcagccttgttccatgtaggccttgtaatatgacctacctcttgccatgctgctcaggccagtttagccc

SEQ ID NO: 186122 - DNA, 564 bp, Homo sapiens
ggaggctctcatagggctggggattcggagaaggattccctgagaaagtgaaatgtatttggagtttgatggatcaactggatgttccctaggcaaagggcagactgggaatggaggtggacagcaaacattccaagcagaagaaaaactgcatctgtaaagacctgtggcaggtccctttagaatgtgttctggccaaggaggttcatcatgttcagtgcccttgaggaaggcgggttctgaatttcccagataccagatagatgagatcccactgccaggggcccatgagcagaaggggtttgagagggatgggagactttccaaggcaaattctaacaaattacaaataatctggagaggagaaagagaggcacctaaataaatcagtttagagttttagaatgacttgtccaaagttggaagggggtcaggtaaccaaggaggaacagtgcagagcagctggaatacatcagaagggggtcaggaatgccaaaggacctgatgagctaaggcttctggaaaatgctaatcagccacaagggcctttaaaactgtctgcag

SEQ ID NO: 186123 - DNA, 509 bp, Homo sapiens
gagacatactggtctgtaatttccttaaaatgtatttgtctgattctggtatcccagtaatgctggcatcatgagccttgtaaaaaattccttccacttcaatatttttaaaagcatataaaattgatattattttttccttaacttgtataattcaccagtgaaactatccggacctagagttttctttttaagtagacttttactacaatttttatttctttagcatataaaaagctactcagggctaggcatgatagctcatgtctgtaaccctaccacttcaggccaaagcaagaggatcacttgagcccaggagttggagaccagtcagtacaacatggtgaaaccttatctctacaaacattaaaaataaaaaaattagctcgggggtggtggcacatgcttgtagtcccacctattcaggaggccgatgtgggagggtcacttgagcccaggaggtcaaggctgcactttagtcttggcgactgagtgagatcctgtctttt

SEQ ID NO: 186124 - DNA, 635 bp, Homo sapiens
cgtgagccaccgcacccagctgcagctcaccatttcactgatggtgatggccagtttactgatgcacagctttaatggttactatgttatattacattatgccaaattatgctgctttgggttacaacgtgtgatgttacatagtgtcatatacatgtttactgtctacctcattttaccagaatgtagccacctggaacagtgcttagcacaaaacacctgtggaatgtttagtgacagaaattgttaggaagtttattaaaaccaaaatcttccctgtagctttaaaccacacataatgtcatttccacaagccagcccctcaaatgtctgacacagaatccatgcccttctcatgcttcttctttgccaaaatgctaattagacccatcagaaccatgcagcaactgttcgaatatagatctgttgcgtttacatgtatttgttcattgtttattgcttctctcctctcatggtgcttacacctcctgagagcaggggccatgtctgttgtattctgctttgtttcccaagacctagagtagtctgagtgtctaaatgtgtgtttggttgaacgcatgcctgagtgtacaggtgcactaatagaaactgaactgattggctctattaagtct

SEQ ID NO: 186125 - DNA, 407 bp, Homo sapiens
tgcatggacagctgtgtggagggatagaagaatccagtttttaaaccagatggctgagctatttcattaagtcaccccagaagtcttcaactaacagtatcttaactggtgaactcctgtgactgatacaggaaaattttacttcgtaacaaagtatgataattcctttgtgcaggaaggaggttttgtggaaatgatgttgattcactgcacactgtacaggagggtgtctctttgacaccaccaaccttaaatagtaggaaagccatcacagtgggttgggtggttggattgctttattgcaactaataaagggtcagttgtgcagttgttaactatctttcacttccctcagaactgtatctcctagcccagtgccctataggtcaaaaatgccagtttgttgt

SEQ ID NO: 186126 - DNA, 681 bp, Homo sapiens
ctcataaaagggaggagaaagagtgcaaaaatgataaggaaagggcaaaaagcatattcaataattcagtaggtaaattcttactagaaaataagcatattactttgagaatacacagactagttcaaataatactttaatgtttatcatgcattcttattgaaattatctaagtcaagaagagaccattttagcgtattgattttaacatcagaatttgttaaaatttttttatgaatcagaaagctgaatgcagaagatattagtgtgtttaaactgttaaaaataaactacaaaatttacacagatcagaatttctccaggtaaaagtaaagctatcaaaatactgaaattaccctgaggtaactatatcactgtgtattgtaagtagattagaactacactctgacacattatcatctttggtaaatttattaaataagcacaaaactgattagccagaaatgagtgccatgcaatggctggaagcaactaataaaccgaacgcaccttagtgagcacagatttatagacagcccagcatgaagttgccaatgattgcttctagtagtctaataagaaaagtaagatttcattgagagtttctgtacctgtctctgtttgttaaacccagagtcacacagctttaaggaaggaataaaacacagtgaaggacaagag

SEQ ID NO: 186127 - DNA, 1316 bp, Homo sapiens
ctcctgcctcctgcaaggtggagggtggggcttggccaggagtgaccagactacagagtgaggggtgtgcttgtgggggtgaagggttggggtgagaactgagcccgagtcgaactcatcctcctctgccctgatgcactgtgcaacttgggggagtcactgtccctctctgggcctcgctttccccatcttcgataggacttggctctgcctggccactcctcctccaatgggggaattcctgggcttgcctctgtcttggctccagctcaggtgtcagtctcagccctgtcccagccaggaacaatgggccaggcagggccagtcaccccctgtccctgggggctccacccacggccctggactattttcagcccttgcagatggagtcagaagaggattttccactcccagtacaatgactgccctggaccattgtccagcagtgacgcgggggacctgcctgccccaaaatatctcctgcccctagtttccaagcctctttgccctgctcctcacctcctggccctgctccttacctccccaccctgatgtcatttcctggggctcttaactcctgaaggccattgtgaaacatcacgtgagactcctgggagacacaaccagttggaatgagttttccctcctggcagggaccccagggattgtttggctgcttagtgggactggtggcccagagagggctgtgccttacccagtcacacagcagtcagtgtgaagcttaggtgtaagcccagggctctttggctgctcccactgcctcagccaacttcattagctccagtctgtggctcctggactggagctacagtggtgagagctcaccactgagcttcctgggatgggcacctgggatagcagcccaagtggtgtgggtggagaggtgcagctcatgctctgaccttggagtgagcccagtgcaggggcctgaccttaaaccctttctccccactgagtcccatttttaccaaatgtggctgttaggaactgaatgtttgtgtcccccgccccacaaatccatatgtcaaaatcccaactgccaaggtgatggtattagaaggtggggcctttgggaagtaaccaggtcctaagggtgcagccctcatgaatgggtttagtgcccttacagaatggaccccagagagctcctcaccctctttccaccatgtgaggataatgagaagttggcagtctgcaacctggaagaggtccctcaccagatcccaaccatgctggcaccccgatcttagacttccagtcttcagaatggtgagaaataaatgtctcttgtttct

SEQ ID NO: 186128 - DNA, 641 bp, Homo sapiens
aaacagcagcagcagcaaatcaccatttgccatttcaactaaaatgattaattcaggctatgatcatcaatggataaaatcacttgataaaaaggactttacaaatgaaggaaccaggctgtcattacctgaacccagtgatcacatcagccttactaaacataggagagccagagccagacatcctgtttctccagatgggaggcaatacacagtttacagtaacacctaaagagccaaaaaacttgaacctaaatctagtcaaggcatttaaagctaacttccatttaacaaaataatgaaaacaacgaacagattaaataagaggtttcctgactctcggccagtgaataaatctttccactataccactactaacctctctgaccctcaggacaaatagaagctgcaaccttaagactgattttcctttttctgagacggagtcttgctctgtcgcccaggctggagtgcagtggcgcgatctcgcctcactgcaagctctgcctcctgggttcaagccattctcctgcctcagcctcccgagtagctgggactacatgcgcccaccactgtgcccagctaattttttgtatttttagtagagatgggtttcaccgtggtctcgatctcgtgacctc

SEQ ID NO: 186129 - DNA, 441 bp, Homo sapiens
tcacacaaccccctactcaggccactggtatctgctctggattattgctcagcatctatgttagtgtcaccggcagcgaatccgtatcttacgggtctgcagcaacctcaattcttgcctcctcagaagaaagaattcaactgaggggcataaggcagaaggagagaacaaggcaagttttagagcaggagtgaaagttgattaaaaagctttagagcaggaacacaaggaaggaaagtacacttggaagaggcccaagcaggtaacttgaaggacaagtgcagggtttgaccttttgacttgggcttgtatatgttggcatgcttccggggtcttgtgtcccttctcccgattcatcccttggggcgggctgtctgcacgcacagtggcctgccagcagttgggagtggagcgtgtgctatgtgtttcctggagctgtat

SEQ ID NO: 186130 - DNA, 250 bp, Homo sapiens
taaaactaaggcttagagaaaataagtaacttacaatctgacaactagtaagtagatatcagaacgtaaatacaagtgagtctgactccaaagtgtgtttaaaccactctgaaatacactcattccttctctctttctcttagagatgtcttgaaggtttgcttgaatagttatgctgtaatagtttatgctgtaatagtttatgctgtaatagtttatgctgtaatagtttatgctgtaatagtttatg

SEQ ID NO: 186131 - DNA, 367 bp, Homo sapiens
ctcctaccaccacacttatgctcctaatagcatctgcatctacacattctgccttcctgcccattaccatagatgaactatctatactcctatctacagccagtaccttctcttatgccacctagatccatcccctttgatctattctaggacgtgctctagcaatttcccttctgtttcctatatcagttcttttctctctctggattacttccatcagtattcaaacatggagttatttccccctttgtaaaatatcctctcctgacagttattgcaccatttctctattcctcctttgcagcaaaactctttgagaaaattgtttgacgctctgttgccaattcctctcctctcattctcttaa

SEQ ID NO: 186132 - DNA, 290 bp, Homo sapiens
gatttgttcttaactgagtgctagatgtccctcttagttcaaacattaacaaggcagacctgattaaataatgtctatctccaaaggtgtattttctgactgttggatatagaaggatctgagcatcattctcatcctaaataaagtatggagtattggtaccgtgactctgactttgcacagtgagtgatcccttagggaaatgagacatctgtgtggaagtgatatgccagtattcaaaaattgtagcatgcattacttattcaaaaaatgaccttgcaaccaggtag

SEQ ID NO: 186133 - DNA, 583 bp, Homo sapiens
ggagagacaggcaggcttatatacagaatgacaattttcttccacaagcactaacctttggggaaaccgttgtcaaggtaggaaaacctaaacttaattgacgaattgttggatgttcgatgtggacacatctgagagttaaaaactccaggaagacccagacagagaagggtccccacacttctgtgagtttgacacctagcttgaccaggttctcacagtgaatgttggagaaaaatctcctcatgcttccagaaagggaaggtgaaaaggaaccatcttgaagtacaccagagctttctgttcttcttaacaaggtctttcctcaagggcaaatatttcacctaagctactggtgttttgttttcttgttttgttttgttttgttttgttttttgttttcagagcctaacctgcctggaggaaggaaattacccacctctggccatcctgtccccaagtaagggtggtgatgggagggagggctgagaagctcttgtgaaggtcacagcccagaggctaaggctccctaaaggactcagacctaatcacagggctatagaacctttccccttcccacaca

SEQ ID NO: 186134 - DNA, 224 bp, Homo sapiens
cataagatatttggcagagctgtttcagactaaaaacactttaactctcccactggcccatatgaagaccaacctcctgccacatgcatgttttttgaaggtgatgtaagaccaactgcaggaaagggtgtcactaaagaagaaaaagaagggggggaagctcagagatgaataaaccttgaaatgaaaatctggctggcaaagaatgcgtctgtatgtaagca

SEQ ID NO: 186135 - DNA, 134 bp, Homo sapiens
tccccacccaccgtgtaccccactcaccccaaaggcacctgcatgtcccctaagaatctgtagcctgcatgtcccctaagaatgtttactcttcatttactcacacggaagcaccaggaagagcagcaaaaggc

SEQ ID NO: 186136 - DNA, 235 bp, Homo sapiens
cgtccggaatggttacggattcatccacaggaatgacgccaaggaagatgtctttgttcaccagacagctattaaaagaagcccaggaagtttctgcgcagcgttggagatgaggagactgtggaatttgatgtcgtggaaggagagaagggtgcagaagccgctaatgtaactgggcccggggaggtgcccgtgaagggcagctgttatgcccccaacctacgtaagtttcgcc

SEQ ID NO: 186137 - DNA, 848 bp, Homo sapiens
cacccgattctcctgcctcagcctccctagtagtgggattataggtgcctgccactgcactcagctaattttggtgtttttcgtagagatggggttcaccatcttggccaggctggtcttgaactcctgggctcaagcaatcttcccgcgtcggcctttcaaagtgctgggattataggagtgagccgttgtgcctggccaaaagtgtagtttaaataattggaattttttcaaagttattggaagagatattaaaaaagaaagaaaaatatttggaattttagtagctgtgcattgttctaacaaagttataatttgcctaattgtgtattgtttgatttatagggtattaccagtttttgactcatttacttagttagttgtgtaaacaatacagcagtaaactctttacttccaaagctgtttgcattgtgtgtgggctgagattacttccccaaactaaattcccagaagtgagactgtgaggtcaaagcatacatgattaaacatacatgatttatggttcttgataaaactctgataatttatgttcagataattatagtagaattacagatagaattatcaatagatttacagacttatagatagatttccaaatgtcactgaaatgatcaacatgggtgtggaattagcttatctgagatgtgggtaattcagagttgataacacatatattcctccataagaactactgtaaatgtactcttatcagcaacttttgaacattgagtcaagttattgaagaaaagagttttagaggttgtttggtgtagctgcagcctttgagtacgtctgggcttttccacagcgattaccactaatca

SEQ ID NO: 186138 - DNA, 367 bp, Homo sapiens
aagatagctgcatttctttttggggaataaaatacagataggatctaaataagtaaacatcaatgtgtcatttaactgaactaaataacttttttcttatacaaattaaatcacaaaagcattgcgatgtcatcattttgatattccataaaaatggaaaataggtcatcagtctgaaacaaacaaaagtgatttacagctaggaattactatttttaaaacaaaattccaaaaaatcttacttgatattcatatgattctacaaagattttttataccatttagaatttttttttttttttttgggaccggggtttccttttggcccccgggggggggggctaacaaaaagggtgaaaacgtaggg

SEQ ID NO: 186139 - DNA, 638 bp, Homo sapiens
ggaaaataaatctttttccagtatgttctgtcagtttcttgggtttagagacatctcttctatgatcctttttttctctactgactgcttgtaccactattactctagaattctatctttttaaattcactgcccttctgcgttgagttctttgtttcttggattccttgccttcctgtttcttggtttggttcttcttgatattggtggcatgtgagaaaggatgaatgagaattaaattttgtgagttctggtatatttttcaaccactatattgattctttggcagggcatggaattctacattaaaaatatttttcctcagaattttaaaattatgatctctgtcttatagtattgtttagaactccaaagccattttcattcctggtctttggtttataccctgtctttgcatattggagccttttagggtattttctttgttcccagtgtcctagaacctaataaaaatatatgtaaatgtaaatcatcttttttttatactacataccaagtggacccattaaatatggagactcatttctttcaggtctgggaagttgcccttaatgctactttttagaacaatctgtattttctgttttctttgaaaaatttcaaacatagagaaaaaa

SEQ ID NO: 186140 - DNA, 573 bp, Homo sapiens
ttaattgttgaagatttcccctgtaaagttatagtctaaaattgcaatgttagtctacgatgcttctatcattaaaactatactttctccccaagaatttttacacttctttaattgacccacagcattttcctgatgaagtaatactaaactaaaaccttgaatgcgtataccctctacatcgctcaggctttagataactgggggttagtaatcaatcaccttcatgttttttggcctaggctctgtacatttcagtagtttattcaaagggaatcattcttttcctgagtacaagaaatagtgaatctgactcctcactgaccaaacccctgaccaatgtggcagagtcccctgaacacttctggggtggccatgggtacataccacttaggaggagcatcaaggtccactctctgtacccttaagaagtagcttggcatggtggcgccattctgagcccaggccctccttgggactgagataagatatgacttcagcctgaggccatttctcacacttgaaaaagtaagacactcctatccccatcccattccagctacccagcctcca

SEQ ID NO: 186141 - DNA, 529 bp, Homo sapiens
aaaacagaccacattattacaagcatcaccatttaccttgctgatggtgaaatcacataaaaatgaacgggagacaaatctaaggtatgacttttagccctttaatattcattttgcagactgttcacaaccaagttttaatctcgaattgctttcctttgccacccagcaagcttctgagttgcttccttacgctgttctttggaatgtgccccgggaatgtaaactcattttaatattggcctaagtaaaataggattataaaggcaaatctgtggctcaagttcccataatgcatttcaaaagcaagttaaattattttgggattatcctgtttgggataacattattcctttctactagcatagttaatcaagaattgacaaatgtattttgtgaagtaaacatgaaattacacaattatttgtcactttttattaagttaccaaacattcacttaatgctggtgtaggtgttataggaaagcaatggcaatatgaatcaaattttagtagaggctctgtcattt

SEQ ID NO: 186142 - DNA, 444 bp, Homo sapiens
tgcctattctggacatattacataaatgaaatcatacaatatgtgatcctttgtgactggcttctttcactgggcacagtgttttcaaggttcatccatgctgtagcatgtaacagttactttaaaatctgcccttttccagccaggcatggtggctcacatctgcagcctcagcactttaggaggccaaggggggcagatcacttgaggtcaggagatcgagaccagtctggccaacatggtgaaaccctgtctctactaaaaatacaaaaattagccaggtgtggtggcgtgtgcctgtaattccagctactcaggtggctgagacaggagaatcgcttgaacctgggaggtggagagtgcagtcagccgagatcacgccactgcactccagcctgggcgacagagtgacagactctgtctcaaaaaaaaaacaaaacaaaa

SEQ ID NO: 186143 - DNA, 356 bp, Homo sapiens
tcccaaaatgctgggattacaggcatgagccactgtgcccggcctggaatgtttttttggcaactttacctccctgggtaatttactgacctgcagcccagtttaaatgtctctcctagctctgtctctgggcagcctctcccctgcctcaaaaggttctacctctgccaaaccataaattccctgaagactgagaacatctgactggcgcagtccccagggtctaggccagggcctgacatgtggcaggtgctcagtaaatgagctgaaactgatgatgtaatacaaaataatgcttagtagacaagatgggcaagtatctcagactaataatacccactgctgggagtgtccgc

SEQ ID NO: 186144 - DNA, 348 bp, Homo sapiens
tgaaaatagtaacagggaatactgcgatgatggatagctttgttaatgtcttatgaaattttcatgaacaatctgtcaatcataatattatgattgacagattgccccacaagtaacagctacataaaaacagttgtaaaattgtccttggttttacaatgataaatgaaaaacattaaaattctctaattgaacaaggtatgcaaggatttttatattgttttttgctaaaactatgacagcaaaataacatcctggagtataaagataagagctgaatgagcaggccactaggggacaaagggagtcttttcacagaaccaatgcttcttttgcccaccccatctc

SEQ ID NO: 186145 - DNA, 299 bp, Homo sapiens
ccttgccatgttttcaacacacatctaaagcctgaattgagagtataatttttctgtagatacatcaccttgaggaattttataaacttcagtttcctcatctgagaaatgaggtagttggattagatgaactggctcatcaagtgagtataaggagccttccaaatttaagaattattaacatttcccggaagactaaccaggcaatttttcttctttaggtttgactttctgagatgtcatggcttagtattctttaagcaaattctggaatgttcttgtccctttggaataattgt

SEQ ID NO: 186146 - DNA, 810 bp, Homo sapiens
gtctgaggctgatgacctgttcttccttcttttccttcccctttcaaggtgccatttctgcatgttgtttccagactccgcacaggaacgcaaggcacctctttagatatcggattggactgtaaatcccctgaaaacctacatcttcattatttttgtgtcctcttattttcatgtagtgaccgtatgtcctcattaaaaaactcaggccaggcatggtggctcacgcctgtaatctcagtgctttggaaggacaagtgggaggatcttttgaactcaggagtttgatatcagcctgggcaacataacaagaccccatctctacaaaaaattaaaaaggttagccagctgtggtggcacatacccatagtttcagctactcaggaggctgaggtgggaggatcacttgagcccaggaagtcacggttacagtgagctatgatcatgtcagtgcactccagcctgggtgacagagcgagaccccgtctctgaaaaaagaatcctagagtattttggcactgtgcattatatgcattatacttagctgctgaataaaggtgtgataactgagtaatagtggatgccaccgatattaaatgtgatgtactagaggtaatcctcagagtcagggactgtggcagccctgggagtgggatagtactgggctgtgctctctgagactgagctggggtagagtgatgatctctcacattgtctgttctcattcttctgctgctgaaaagctgctcttagtcttctgagcatttcttccctctacccacttggatctgctgactcaagcaggcacct

SEQ ID NO: 186147 - DNA, 403 bp, Homo sapiens
agtgagcatgctacccagcctgggaaactgctttttccatggatctttgcaatccacagatcagaagatcccactcatgagaccacaccaccagggccttgggtgccaactacagagccatgcagattctcaacagccactcagctggagtctgcctaaaaagttggggagggttgtcatcatcactgtggctgcctgctgcctaaaccctctgagttccctgggggagggggagcagtcatcactgtggttgctggctgcctaagacaactgagcttcccaagagaggggcagtcatcatcactgcagctgcctgctgcctgaggaaactgagctccccaagaagggacagcagccatcactgtggctgctagctgcctaagacactgaactcctggggagg

SEQ ID NO: 186148 - DNA, 358 bp, Homo sapiens
ccaagcagaggaaatggagaagaacagaaatgggctggccctgggtctgggctgacccctgatatcagggtgaagtcctgaccctgaactgagctctgatctcacactcaaccccagccctgggctgagccctagcactgattgtaccccaagtcgggctgagctcccacttctcactgaaccccaactccaaccaacccctgatcccaggctgaacttgatcttgaactgaacttcaacctggatctgtctggtggaaacacagacagggcaggggtggtgaggacgggggctctccagatctgtccccctccccatctccagcccccctcagcaggcagaatactggacctctatc

SEQ ID NO: 186149 - DNA, 330 bp, Homo sapiens
aatcgagctcggcaccatttgtcgagagaaattagaagactgaatataaagttaagaaattacgggataattttcaaagaaaaattagtttagatagtaccttgaaagttaggtggctaatttctctcggaccaatgcattggtccgagagaaattaggaactttccaggtttgatttgaaacccccaccacagaatttgtttttcctccctgagagattgatgggttactgttttgggattaaagcctttgggggctttctctggtggagaaatagttcagacaaaaggtagtggatccattagatggctaatttctctcggaccaatg

SEQ ID NO: 186150 - DNA, 611 bp, Homo sapiens
ggcattccattttatgtgaattacacctcaattcaaaagtttaaaaatgaataacaggattatatagttttaaaattaagaaaaatttctaaacaacttgttgattaaagagtaaattttgttggaaatacagaactgaaaatatgcatgaaaactggtatgtggctaaagtggtatttagaaggctttacgtgccgtatcagaaaagaagaaagggcagccaggtgttgtggcacgtacctgtaatcccagctacatgggaggctgaggcaggaggattgcttaagcccagggagtttgagtttgggaccagcttggacagcatagcaagatcctgtctctaaaaaaaaaaaaaaaaaaaacccagggacagtggctcatgcctataatcccagcactttgggaggctgaggtctgaggtggtaggattgcttgaggccaggaggagttcaagaccagcctgggcaacatagtaagaccctgtctctacacaaaataaaaaaattagccaaatgcagtggcacatgcctgtaaccccagccacttgggaggctgaggtgggagaattgcttgagcccaagaggtcgaagctgcagtgagctatgatcata

SEQ ID NO: 186151 - DNA, 266 bp, Homo sapiens
tgctgggattacaggcgtgagccaccacacccagccctctggggtctcttttctaagggcactaattccattcaagagggctctgtcctaatgacctaatcacccaccaaaggccctgtgtctgttgtaccaaaccctgttaacttccatagggaaggcagcaggtttaagaggccaaagaagagacctagagccagcaaacaagacacagggttttattaggggcttacatacacggaagagagtccagtggtggtgggctggac

SEQ ID NO: 186152 - DNA, 326 bp, Homo sapiens
gactgctggggacgatggcttccagctaacttaatagagaaactcaagcagtttccttctaaacacacatgtcctggttgacatgtccagtagagactatcacaggtctttggaacattcttttgagagaaacctatttaggtccttggtctgtctttcaatcaggttgtttgatttttgctattgagttgttggaattccttatgtattcagatatttgccccttctgccatgtaggttttgcaaatattttctctcattttctgggttatcttttcactcggttgattgtttcctttgctgtgcagatgctttagcgttaaatg

SEQ ID NO: 186153 - DNA, 562 bp, Homo sapiens
  misc_feature (75)..(75): n is a, c, g, or t
tgcgagagtacgtaacatgtcatagctgtaccagtgtcaaaacccctggccgactgccggtcctgaattggaaanacacctgaaaaatccacaatgattagtaaagaaaaatataagaattaacagaccctttaaatttgttttaaatatttgaagatttaaaaagtgtttaaagtttgtaattcctagtaggaaaacattatctgaatgaataccctaatggcaaaccactgtaaaatgcttcagctgcatttgggggagaggggtagggattatcttcaaagcaccccagctctcttgatgagaaggtcagaggtacgttggtttgtattattgcgacatccataaggtgatctaggttgcttttccttcagcagggctttatttatcagaagggcattatgcttgacctccaaatttggctgacaatttactgatgagattcataacctttgggttgctctggtattttgacatatttgctgggttctgagccacatcctggaaggccaccataacttctggatcctgcatggctgcaagagcctctggatcactaaga

SEQ ID NO: 186154 - DNA, 197 bp, Homo sapiens
ggaagaagttcatttacattttctaccatgtaaaaaactacttaggataatactgtttgaagctatttgatttatgaaggtattattagtctgataccaaaaccaggcaatgataatataggaaaactaagccagtgtctcttataaaatagatacagaagtggggcatagtggcacataacctatagtctcagtta

SEQ ID NO: 186155 - DNA, 572 bp, Homo sapiens
acatttgccacactgacctgttctaacagttatttgtgtatgtgggtcacaagctgggcctgtgctgtcagctctgggtttgagtcctggtttcatcactaactatgactgttgttattccacatctcaacttcaggttcttctgcgaagtggttagaagccatcagtggagcacctcctttttggtacagtacctagcatatcatggatgcttagtaaatagttcctcctaagaactcgtgcccctgacatgtgaacatacatgcatggaggtacacaagtgtgctgggctcaagcccctgttgggggccccacatcagatttatgtttcttttcttctctgcagctagtgcagcattttgcatgtacaggtagtagtgtttgttgaaggtggggacaggtggtgttgtggtctcctcctccagggcagcccccctctggctccagctcttggcctgtgagcagccagagtggcttctcttgtccatttgctgcctgggccctccaaggatcactggagacacctttccctggctcatcccagtgggctgggacctgcggaaatcatctga

SEQ ID NO: 186156 - DNA, 473 bp, Homo sapiens
ttgtaagtatatcgtcaagaagctgttactgttggttactggccactttttaaaaaactgtctgcagacaatttcattcctgaggtagacagatacttctcacactattttcttgaaatgcagacagtgtttgttcctataaaaaattttcttagttatttctaaagtacatttaactcagcaattaaagttgaaggtataacattgaaacattgaaatctagtactaaaaatataagtgaagattgataattaaaatacattacagcatgagaaaaattaagaaattagggattgagatttttctcttttctaatgaaaagataatgaagccaattactaaacagactagttttcagttttatgctaactaaaatgtaataaatactcacttttattggcaatgttattttaattacattaaacttgcttgcttttaaacagatgtttgtatgttataattcaagcagagtt

SEQ ID NO: 186157 - DNA, 172 bp, Homo sapiens
ccaagtagctcctcctccccctcaacacctggtatgattcatgactgatttgggtagctgtaatttttctaatgtcagttagaagggaaagaatttaaatttactacatgccaatcatattccaaagccatacttagtattaaaaccacagaaggagtcatttacatttaac

SEQ ID NO: 186158 - DNA, 289 bp, Homo sapiens
gtagtttatttgggagatagtcccaggaaacagaagtgagacagtgaggagaataagacaagaaagagagaaaagccaataaatcttactgtgttggttgctgctgagaataactggaactcaatgctacttgcaaacttcgaagtttatagaatgtgcctcagaataatcttgctaaagaactcgagactggtctgtttacataaacactactgtttagcatggtttgagtgttgtccccatggttattaaccctccgcacttctgagctgcaccttgcatctactga

SEQ ID NO: 186159 - DNA, 396 bp, Homo sapiens
cttatttcttattaattaggtgaccttgagcgagttaactttcctgactgtgcttcagtttcctatcaataaaataagaataaaaagaaaacctacctcataggtattatgaggattaattaagtacatatttataaaggacttgggataaacttggcacacagcaaatgtattaaagtatttgctaaataagtgacaatatcacattccacagcttataaatatgaaatctaattcagttttaacattttcagtaaatgaatgtgcaaaacactaacgaaaaatacatcttaactacttctcatcttaaataacaaagtcagactctcccctctcctccagtcagaaatcacccaaaagaaacaaagagagtaagaaacataactggaaatatga

SEQ ID NO: 186160 - DNA, 1263 bp, Homo sapiens
caatgtatgggagtgcctgcttcctcatcccttgccaacccaggtgttatcaaaaggacatcaaattgattttgtattccagtacaaactcttggctcatagtgtttagtttcatcattattctcaagctcatcaggttcatctgaccgatatttatgaagggcctactctgtaaaaagggaacaggttgctaaacaaagagaacaaaacacaccaatgaaatgagcaaaagcttctgaaattcagcagagaggaagactgatttcaacttgaaagaaatctccctggaggaggcaagctccgacctacctagatcctgaaggacatgtcaactttggacagagaaaggagtcccagaaaggaggtgagaacaagtagtgtgttggaacaggaaagcatagggtatggtccgtggcacagcagtgtgaggagaggaagagaatgctcaagtggcagctcgaagagtgactgccctggcaaggcctgagctagggaagaatcagtcagtgatctgagaattgggatttccactttaggcattagctaagtgatcatgagaaatactagcttacctgggcctcaggaggttagccctgaaaccaaaatttctgtagctgcagaactgtgtgttcaaagtaaatcttacagtcaagactaacgacaagcaagcacaactgcgctgggagagggaacaggaaggaactcagccccttattctagttgctccatcctgataacctgagggaggagggggcaagaaactcttaggattatgtgaagcacagtctaaatgcaaggaggcctaggtagctaaggttcccttcagctcgaaaaactactccaattcaatgtcagatggtacacctgtaccttcatttctattctgcttgcctatgattcatttattaacaggaattcactgagtacccactacatttcagacagtgttataggatctggggagacatgggctaaggttgcaaagactcttccctctcaggtttaatttctacttggaagggagagagaaaaatgaagaaataaacgtataatgtgtcagagcaacgagtgtaagaggaaaaagtgtaatgactgttccactcatcaaaactctacacatcctcatgtcaggagtctttccttcagccttttcagctttgcattcttacagatcatctgttctcttctctgaaatcctacagcactttggaccacgctgtaagcctctgccacttgttaactacttcattgtactgggcttct

SEQ ID NO: 186161 - DNA, 372 bp, Homo sapiens
gtccccccattcatatattaaatccctaacccccagtaccttagaagatgactatatttggagataagggttgaaagaggtgattaagttaaaatgaagccatcagtgtggcccctaatccaatctgactcgtgtccttataagaagaggaaatttgaacacacaaagagagaccagggatgtctgtgctcacagaggaaataccatgtgaagatacatgaagaagacagccatctataagccaaggagagaggtctcaggagaaaaccaacctgccaactccttgattttggacttctagcgtccagaactatgagaggataaatttctgttaagtcatcccatatttgatattgtgttaggcagccctag

SEQ ID NO: 186162 - DNA, 225 bp, Homo sapiens
caattatctatttaatttattatagtaagtgtggatacaaagataaaaggtgggccttattgtctagtagaaagaaaataaatggaatgttgtatcttcatatatatttttcaaaatcggtatgtatgaggaactgtgagcacaaagaggggaggacgacctagctctgttgggtgacagtggcagagactttgagaaaggaacaaggaagactacagagaagat

SEQ ID NO: 186163 - DNA, 311 bp, Homo sapiens
ctataattactacatagtattgataaatatttgttgagtgaaaaaattgatataaaaacaagaggggctaccatgtgtaagtcacattatgtgtgttactatgtgtaagtcatattatattttgtgtactactgtatatgcaagtcgcactgtgtttttccagtagtttgttttatacatattggtgattttcatatcttaaaagatggccctgaaggttctttgtcaaaagaatagaaaacaagtatcctcataaaagtgaaaaataatgacttccattcatgcatatgatctcattttatctttacaat

SEQ ID NO: 186164 - DNA, 637 bp, Homo sapiens
agtggtcattttgtctcacagtatattcattcttcctgagcaacttcacccatgaactgccattatcaactaccattatcacttatacatgacttcccaattgtcctcaaccccagacatttgagttccaaatccatatatccactagcctaacagactataacactttttcgtgtggttgtctcacaagcatctcaatctcagcatgcccaagtgagatagtagtatctttcactctcatccccaaaatgcttttactgttgcatttgctaccatggtttctggcaataccatctctccactcaaccaatcaagaaacctaagaatagtctagaatcccccttctgtctcattcccacacatatgtcttcttaattctacatatttaacatctcttttgtttgtctccttatgctgctatctaagttcaggatctcattatatcactggatcatcaaaaagggccagttctggccaggtgcggtggctcacacctgtaatcccagcacttcgggaggctgaggcaggcggatcacttgaggtcaggagttcgagaccagcctggccaacatggtgaaacctcgtctctactaaaaatataaaaattagccaggtgtggtggcacgcgcctgtaatc

SEQ ID NO: 186165 - DNA, 699 bp, Homo sapiens
caagagaaaaatctggaaattctttgtagacctggagacatgggtgctctcatgcagaggaaagtaaatctatcccagccctttgtcactgaccttgggaaatgttgcttgagctgttgagtcctggctcctgtgcaaaagcaaaactccctggggaaatactttatatcccttctacatactaggaactagagattactggagatttttaaaatgttagttttttgcagattgttccagtgaagtcaaatatggccatgttctctttttgatgaggctggacaatctcacttacagagattgtgacatccttgttattaagtatgtttcaagacagcagaaggttaagccatttaatgttattacaatggggaagtgacatccaagatgtaatgaggtacaagattgtggtggttgggtgaccctttgctttcagaaatgcggtgagtgctcaggattatggtgtggaaatccaactatgccacaggcctatgcacatgaattaattttatgcaggtgtcagggctttaaaaaaaatcaaataaatcatagcacttactggaaaccctgtgtgaatttaaacatatgatacatgacatgtttatttcctttcccaagtgagcatgttttaaggaccattcccacaggcatacgtaaacacagaccttagcagtgttttgaaattgaaatgaagttcca

SEQ ID NO: 186166 - DNA, 148 bp, Homo sapiens
agggaaatgtctttgatttaatgaaaaacctaaactaaaaaatgtatggaagagctgtttaaaaaggaggatggacaggacctggggattgttgggtaggagggtgaggaaggagaaagctggcatgatttgcagacttactgacttg

SEQ ID NO: 186167 - DNA, 471 bp, Homo sapiens
ccttaataccccatcttctttctcaattcaaatataaacaagaattaaataagctaaaagattaatttaaaataagaatagaatatgtgccttttcaaagcttggtgaatatgtatttgtatctttttaaaaaggaagagtcctggcactctttgaaatgctgagcaggactggagccgtacacactggcaaagggaagaagacagatcatacctggcacggcagacagagctttaagtaaaaattggttgatgatggttataggtttggtataaatttgaacataccagctggagtccatcttgaataaccgaatttcatctaggagttagacaagatgaaaagttactgaaatggaaaggtgaagattgttgactttggaaatcagattgcagaagtatgtagaatgaaatattttgttgaaaatgcatatataaaaatatgtgtatttgggatgggggaaaagactag

SEQ ID NO: 186168 - DNA, 326 bp, Homo sapiens
aaacactttaaagcactgagaaaaataactatcaaggtagaattctacactcagttaaatcatacttcaagaatgaaacaaaattaaaagacatttgaacatcaaagatctaagcattaccaatacacattcactgaaagaactattaaattatgtactttaagaagtagttaactgaatcccaaaagaaagagtaggatgaaagtaggaatggtgaggaatgaaagtgacaaagacttaggtaaatcaaaagaaacattgactgtgtgaaataataatgatggccaactttgaggagggctgtaaacaatcggtttccaatatat

SEQ ID NO: 186169 - DNA, 763 bp, Homo sapiens
tgctcatacaaagcctgtttggtggtctcttcacatggacatgtgtgacatttggtgctgtgacttgaattgggggaccgcacttgggagatcagtcccgtgtcctcctgctctttgctctgtgagaaagatccacctacgacctctggccctcagaccaatcagcccaaggaatatctcaccaattttaaatctggaccccactggaaattgaactgtccaactggcccaaggctctgactgacttcttcccagatcttctcagcttagcggctgaagactgacactgcgtgatcacctcggaagcctcctggaccatcacagatgcttctggtaactcttactgcggaggataagtccaaccccttcttaatcaatatggaggctacccactccacattaccttcaagggcttgtttctcttgcctccataactgttgtgggtattgacggccagtcttctaaacctcttaaaattccccaaatctggtgccaacttggacaatattcttttatgcactcctttttagttatccccacctgcccagtccccttattaggctgagatattttaacaaaattatctgttttcctgactattcctaggctacagccatacctcattgctgcccttttccccagttcaaagcctccttcacatcctccccttgtatctccccaccttaacccacaagtatgggacacctctactccctccttgatgacgaatcatgcaccccttaccatcccattaaaacctaat

SEQ ID NO: 186170 - DNA, 194 bp, Homo sapiens
ctttcagatgtattcatttagtttatttttaagttgacagagaaattgtatttcataatgtttttgtcttttctgaaatatttagttactgaattttcatcaacgtgtttaaaacaagaatttaagtatagcttattgatttatctaagcctttgatttggaaccaggttgaggattgccgatgaaataagtaa

SEQ ID NO: 186171 - DNA, 346 bp, Homo sapiens
  misc_feature (15)..(15): n is a, c, g, or t
ggtcgtctctagcangatcccccggagacacttacgcattagaattggtgaagtcagtagttaaacattcacatgttaatgagtgtgtggaaagacaataaaccataaaaaaaaaaaaacaaaaacattgttaacaaacttaaaaagcaagcgtttggtttaaaacctcaaaaaaaaaagattgagaaaaaaaattcatagctctagaacccattacgattacattacttttctcttttgtcttcctgattttggctctaaaatttttttcccttacgcattttcaagtgtttatttgattttgattttcacattcgtcctaattcttctttctttctttcttttt

SEQ ID NO: 186172 - DNA, 251 bp, Homo sapiens
gttttgaaaccagtctttctcctgacggcatcatggcagtagcattctagatatcacatctgtgcacgacaacatcaagaaggagtatctatttctgggtctcctgtttaggggcaaggaaacctttcctagacatccctcaccttatttcatgtctctttggccagaacagggccagatgttaaaactctacaccagtggagtacaggattagtttagattaagtaaaagatgtcgcccaagctaggata

SEQ ID NO: 186173 - DNA, 466 bp, Homo sapiens
tgggaactcctcaggactttgccaaataggtggcactgacctgatcagaagaaagaaggtgtttcagatattccatattgtaaataaatgtccctgactattggtttacctttagtggctaaaaaaaaaagcattgtctcctgaaaccccaatttgggataatttctgggaggcactaggagagtctcttctctgagaaattgatggctaatttggagactgaaggaatcaagtggctggttagttacatttcttcctgtgtaaaagctccatgacagtgctgctgttacatttgtttcaacaactaaaccatgtgccttgattccacaggcaatggagaactttctctctgtgccaagaactgtgggtaaagagaaaagcaagactgacaaacataagtggattttcagtgaaattagacttttaaaccccctggtctttccaagttcataaccctttaggaggc

SEQ ID NO: 186174 - DNA, 475 bp, Homo sapiens
  misc_feature (153)..(153): n is a, c, g, or t
ggggaccggacgacggcgaagcccgaaccgcggcggcgctgggagatagatatcgtgtcacgagaccagaaccagcggcagtgccaggaatcgtgggggacatgcagtggctggcgctgccaacaaaggagaagcacaggaaggctgagttcncggccaccggggagctttgcattgtcaggccgtccagcctcctccccagacgcctcccgggcgcgggaacagcccgggctgtgcagagctcagctgcgtggtggcccctgtggtcccggggtcttcgagttaagggctgagctgaccccatcgatgcacattgactggaagaaggaggatttggggaaatggatactttgctgtcaacttctcgtgtctcccagtttgctgccgagttgagtttgggtttctgagtgtgtcccttgggtgaggatgtctgtctctgtgataataaagcacatccaggacattttgtaatgaa

SEQ ID NO: 186175 - DNA, 207 bp, Homo sapiens
attcctcgtggggcaagtactaatgacaggtcaggagaatcaggaaggtgaggctggggagtcctctgagccttcaagaaattagcgaaagaacaactctatgggagttaatagatccctttctcggccgggcgcggtggctcacgaccttttttttttatttgtgaagtggattacactctttgggcccagggtaaaaatgtctcc

SEQ ID NO: 186176 - DNA, 138 bp, Homo sapiens
ctgggcctggagaggccgactggaggaagtccagggcctggagaggatgcaaagcagcaaacactaggcctggaaaggctgccctgaggcatgggcttggcctacagaggccactggcaggagctgggcccgcagagg

SEQ ID NO: 186177 - DNA, 309 bp, Homo sapiens
ggttggaagtagtataggttccttatgtgactacattgtgttcgcattttctttatccttattgatttttgtctggtttttctatcagttactgagagatgtatgataaaatctcccactatgattgtggatttttctatgaattttctataagtttttctgttcttttctactttaattgcattatggtcagaagacatattctgtatgatttaaattctttaaaatgtattgcaatttactctatgagccagtatatggtcagattttaagtatgctctgtgatttcagctgctgttggaagtagta

SEQ ID NO: 186178 - DNA, 183 bp, Homo sapiens
ctagtttaagggcagtgggggtgatcctggcactccccatcttccctgaaagtgacagagcagctcagagcagacaaagccatcaggcagaggagcgcaggtgctggcagtggagcgtccctctggtgtgccctggagtggttgaggtgtcgcaatgcagcctcaaaaagaaagagggtgtag

SEQ ID NO: 186179 - DNA, 578 bp, Homo sapiens
aggtaattctgatgcatgctaatgattgaaagcccttgccctagcaatataccaaagttaaaattacgtctgaactgaaactacagcttcaacgagtttagctactaccctgaaaaaaagttcagttgaaacataagtcctctagccttacccaactagaattaaaaacaaacaataaaaagcacaaagaaactcgaagttaagtgaaacgcctggaacgactgccaatgattttcaagtgttgacttcaaaaaaactcaatatgccttacggtgcttacatctgcttaagggcgcattgttaaaaggcactcgattggccgggcgcagtggctcacgcctgtaatcccagcattttgggaggccgaggcgggtggatcacgaggtcaggacatcgagaccatcctggctaacatggtgaaaccccatctctactaaaaatacaaaaaattagccaggcatggtggcaggcgcctgtagtcccattaagaaaatcagaagtggccaggcacggtggcttacgcctgtaatcccagcactttgggaggccgaggcgggcggatcacgaggtcaggagat

SEQ ID NO: 186180 - DNA, 632 bp, Homo sapiens
ttttcccaagccatcttagagagatctttcgtgacattttccttagtataattgaatctgagacacttaaatgaccagctgtgggaaatgaggcttctttgaatgccaagtggctgagaacaggtgagaataaagctagcttgacttaattgtctgtaaatatgtacttcttctaagtggtctagcacagtggctgtaaccttaatcagaacttcaatggaaagtcatacggaaatgtttcctccttgatttttctcactttgtagaatgggaatattcatctccaaagtaaagctgagttgctaaaatgagatttaacaagaatatctggaaacatcctggaactgggataagaatagatgaaagtccaatgtttttatgtagtttgtatttctgagtatgggatatgaagcccatattatagacctagctactaataccagcctccacctgggtcccaactccctcaacctgctttagattagatactggccaggtgatgaaatctccatttttaagatcgcatcctggatttcatcattgggtaatatcacatgtaaaggcagctgctgaaacatttgttaagcatagttttccatcttaagtatttatttttttcattaaaatttgtg

SEQ ID NO: 186181 - DNA, 738 bp, Homo sapiens
ttcgtcagacctgtgcttgttttctttctactcagccccatcttggctttgcccccccgggcaccactgcacccaggagacaaaccctgtattgttttcatagacctaataaatgacatcgctccccacctcctgccactaactcactagccctcccatccccccaggatcatctaaagtgtcccttgtgctaagcggctccctctgctatgaaagaacaggcgagagagaaacctgtctgtctgaaggggcctcccccctccacatgttatcaggtgaagattccacccggagagaggcagcatcataggtggccaatttaaacagtcccagcctcttcctctggctcaggtctagaattgaagggaacatactaaggtggcgattaacagtgctgatgataaaacagaaggatgttcagtaagtttttcaaaacacatctttcatcaagaaggtttctcctcaccccttgaaaaagtcaacgatgaaagggatagaaaagggggtagccatttatgcctagggttccattattggaacgctaagcatgtaggtgttatttatatcctactgctcaaggtcatcaccaaggcctgatttttgaaattcaaaaaaatggcagcctcaggcataaatgggttaagccaggaaagactgaatttttcccactggtcaagttgatgaggttcttcagatgtgctctgggaggggattgctggcgcacgaggaaggctgatc

SEQ ID NO: 186182 - DNA, 131 bp, Homo sapiens
ccaccctacctgccaacctctccacccgcctgggccagactatcccgctgccctttgcttactggaaccagcagcagtggcggctggggtccctgcccagtggggacagcactgaaacggggggctgccag

SEQ ID NO: 186183 - DNA, 422 bp, Homo sapiens
atgctcagcttccgctgggggtgttggcacggcccagcgccctccccactcccagggaccttcccacctcgagcctgtagcactttcacttccccaggtacccagcccctgcccccagcacctgggtgctccctggtccagaacaggctgcagactctgagaggcacaaaaacaagtggggaagggggagacagagaaaagaagacaggctgggcacagtggctcacgcccataatcccagcactttaggaggccaaggcaggaggatcacttgagcccagaaatttgagaccagcctaggcaacacagtgagactcccatctctacaaaaaatgaagaaaattagccaggcatggtggtgtgcacctgtagtcccagctacttgggaggctgaggtgcaaggattgctcgagcctgggaag

SEQ ID NO: 186184 - DNA, 444 bp, Homo sapiens
tgtcacaactgggatggtgctattgacatctagtgggtagaagccggggatactgctaaacattctacagtgcacaagagagtcccccacaacaaagaactgtgcaatccaaaatgtcagtggtatggaggttgaaaaactctagcctaggcaattgacccaacaaggaaggggccctataagtcttagcttaggcctcaagtctgaggcccagtagggggagactaaggagggacagactaggcagatgaatatccccaagtcctgcttcccagccccctctgaggcataccccctaattaggctggggagggaggcaggtgctgggtcagctgttgagtgggagggggacagctggggcctgtgtctgggtgaggaacattattgtcccaggagggggagaatcctggcctcattgccaagggaggctgtgaatggggtgag

SEQ ID NO: 186185 - DNA, 587 bp, Homo sapiens
cacaaaattcaaaatttatggggggcggaaagacagagaactagtaacctgggcaagaaaaaagagaggaaaaagctctttctcatcaaatttccttatgcattggctaattccttccctctgatttgtcaatttaccttccatttcaaaacaagcttccttagccattgtgtaacatctagatttggagcgactgtcgggaatgctttggtgaagagggctgctgcacttgacaaacaactccgtctctgaaagtctaaccaaaagacccaattcacagtgaacggtcacctgccactcactaggaacaggctggcttgacgaaatggaagaatcaacattgtcacacattgtgaaataatttcccatatagttcagttgcatttgcctggccagacaaccatgaaaggttgcattttgtttctagggtcatttctcagttcatttaataggtgggtagagtgaagtctagtggccttggccaggtgagttcatgggaagttaggaaaaaacagcctgtggattctgctcaagcttgaaaatcctaacacacctcacgagactattctgaatcctcaattttaaat

SEQ ID NO: 186186 - DNA, 728 bp, Homo sapiens
ctccggccttttgagcaattggtcctctgggacctaattactacccaagggccccacctccaaatcccatcacattgggattagggtctccgtgtatgaatttgcagggggatacaaatatttagtccactgcactctctatactgccaaggcagaggtgtcgcccagtggggaagggcacaggcctcggaaccaagatgtccagcatggaatcctggcccatccttcttccagctctgcgttcttgggcaataatataacatccctgggctgcagtttccttgtctataaaatgaggataagaactgtcacttctgggttgccatgaatattaagttagtgagtactcacaatgtcagaaccatgcctctgcacatagtaaactttctagaaagcactaagaaggtggcgacaaagttcttttgatggcaaataacagaaactaaacatagcagaaattaagaggggcattgttggaaggatgctgggtttttcctgggatggaagagatgtacagccaggcttgagttggaaagaatgaggccactcccgggacccagcaggaggaattcctggaccctccctagcaagggtccttataacttggagtccatctactccctgggggtctggcagagtgacatgaatttggatgaggaaaatgacagctttattttaacaaacctctgagtgaaatttacctttcactcgatgaattacaggcaaaa

SEQ ID NO: 186187 - DNA, 222 bp, Homo sapiens
ttagacaaataaaacatttctgattttagcacagaggtttatgcagcatattttaaaaagtgattagctatatttctatggctatggataaggtaatagattttatcaatgaatgaaactgacagcaagatgattagtgtacagaagagtttttaaaaacacacttttcctccacatcacgttttcttttttctttttcttttttctttttttttttttttt

SEQ ID NO: 186188 - DNA, 318 bp, Homo sapiens
tttcccgtctgcgaaaaagttaacgcatgcatagcgctgagcacggtgcctgtcacaaactacgctctgaagaaacgtgagtcgtgcccggtcgtgttaaaaccagcaacacaagagggattcgtgttcgttgtgactttcctgtccaacttcctgagtagctactggatttcttggtgctgcttttctgggggagggtctgctctgactggtgggcacagctcacagttaggctcaggcgcaccccagtgtggccacagacggggtactgtaagctgcccttgggttcaaggcctccagagctgttttgagctaaaa

SEQ ID NO: 186189 - DNA, 307 bp, Homo sapiens
ctttattccaatctgagtagagagcagagaccttgagccatcatggaatgcagaagctgaaagtacctggggagttcagtaaattttgactattttcctcagttgaggaaaatttacctactaactggcatgatgtaactacttaagcagaggagagttaccgcttagctatacataagaacatgcttttctggctggacgccgtggttcatgcctgtaatcccagtactttgggaggccaaggcgggcggatcatgaggtcaggagatcgagaccatcctgtctagcacggtgaaaccccgtctgt

SEQ ID NO: 186190 - DNA, 175 bp, Homo sapiens
aagctgtgtggtccttctcaccaaaacctggctgtggcaaagctgaacagaatgaacagaagttttgagtcattatgggaaggggaggggcaaaccatccctagggagtttggaacaaagtgctttaagcagcacccaagcactgggtagcagggtgggaggacataaggggtca

SEQ ID NO: 186191 - DNA, 1413 bp, Homo sapiens
ggttgagatatagaagaacaagagttgctctttttccttaaggtctctcctcccacccctgaccttagctcaccagcatgggagaatactatttgactccttgtactctgagacgtggatttcaagatatagcattccaacttcaacggcagcaagaaaagaagcaacagaaggagaagacatcatagcaaacagggatgcatgctgcatttcctaatactcaaacccggaaacgagacttcactcaaggtgaagggagggcaggtcaccacctggtagcactagccctaaattaaggaatgcagaatgtttgtgggattgcccatcataaaaattacaaaatgagtaaggaatgcaggcacagctggccaggtgggtttgtcacaaccatggcagccctttgccccacagccagtacacagaactggtctctccaattccgattgcatatcttctggcacctctgttcctctccctcagctgcccaggatttttctggttctgaccatgttacttcctcttttaaacctgttagcatttcacgactgcctacaggcaacggtctaaatggtcggaaggcccaagcttagcatccgagaccctgacctacctccagccacttcctcctcctctccacttcactggactccccatctccacccagacacctctgttctcccctctgtgtgcctttgcttatgctgtcccctgtgttcctagtgtgtctctggctatcttttaagcttccctccccaacctcattagttctgtggagcccctggaatagagctgacttctccttccctgctgctcccaggctgctcagaactttctggaaagggatgattatctgagttccagcctcaccccagcccccggactctgagtccctcatgtctgcctcccttctttctctctgaccacacagctggtacatagtcagtacagacgcagtcagtgagtggagcacggggcttctctccaggattcctgcccctttgtttatccctagtctcaggactccctactcctggtcttctgcctaaatctgtgcctcttggaagtgaagcctccgttcccagtggggccaggtcctgacccttgggaacttgcaggatccctcccttgggcctctccccgaagcttccagctcaatgctgaccagagcacaggctgcctgtgacagtccttggggtgacctcccttatcaggaaaaatgcagaaaacctattaataccttagccttgtgattgttaatggtcacaaaactcctttagggtcctttggactcagcacctttatggtctcactttgaattttgaacctcccacctccccccatcccccagagtaaggcaaatggtcttctgattgttcctgcagagggaaggctccacaggtaagcacacgatgg

SEQ ID NO: 186192 - DNA, 170 bp, Homo sapiens
gtacagagtgagaagagcagaagacagaggctaaaacacaagaacagctttcataaaggggcaaggaaagaaaagaaacccatataggaagcagaaaaaaagccaagatggaaaaaaaccaggagaggtggatcccacaaaaatggagaaaggaaaatatttcaagaagg

SEQ ID NO: 186193 - DNA, 264 bp, Homo sapiens
tactctttttttttttgtctgtagatatcataggctataccttgacctagtttttactgtgaaaattgagaagtttgaactgagtgaaataagtgttaaaatcaaattttgtttggagataatttagatattttaactcaaatatttaaaacacgtttattttaaacctgattaaaactgatttatggagtttttaaagagggagaataacaaaatctttttctgattcattgatcagtataaaaaagcactgctatagttgaa

SEQ ID NO: 186194 - DNA, 157 bp, Homo sapiens
gcacctggctgaggatttcttaagatatcaaaaatacttcccattaaagaaaagactgataaatttgactaaattaaaactaataagttgtgttcatcaattgataccataaagagagcaaaaaggcaaaccacagagtagaagaagatatctgcaa

SEQ ID NO: 186195 - DNA, 410 bp, Homo sapiens
ctgcctcagcctcctgagtagctgggactacaggtgcccaccaccatgcccgactaattttttgtatttttagtagagaaggggtttcaccatgttagccaggatgggctcaatctcctgacctcgtgatccactcgcctcggcctcccaaagtgctgggattacaggcgtgagccaccgcgcccagccttgtttttttaatttttaaagaaaagactcgagtaagtcaggctctcagggaccctgcctgagtccccagtggaaatggttcgtcttagggctgcatcatttgccccagccaacttcttaccaactggagggtctcaaggtgggcccccagaaggtcctgcagggctgggagcccagaggacaaatatggctaatggaatccagcctggactcttacatct

SEQ ID NO: 186196 - DNA, 524 bp, Homo sapiens
atcagaatatgcatctatctctgtgagcagagggatgactttgaatagaatgggaggcagatttgccctgagcagttcccagcttgaaggggcccaagatattttcctttcacaccatcctcagaggaaaccagaaggactattacagggttaaaatcagctgtttatgcttcctataattcttgaacatccacaagtatgagatggctgcagagtcaccagaggtacgtgagccctttagtctgataaacatgccaagagtaccataagaattcacaggtaggatgttttttcagttaatgataataaaaaataagagaacaggtttgcactttgaagaatgtggatttgcaaaggtaagggggaaaacatttagataaatgacaataagcactgaggcaaagaaatattggttatgtttgaggaaggctaagtattaaaaaaaaggtaggtgaagaggagtagtaagaatttcattctttaaaatgcaacagatgtttatgctgctttggttgtatttttag

SEQ ID NO: 186197 - DNA, 272 bp, Homo sapiens
aaactttaaaaatgtctgaatatacatgagggcaagagcctttctttacatcacatagcttcatgttgaatttgaacaccttagtatcatgtatctagtgtgaactcggtttattcaaataaaaggaattttttatttggttttgtgagacagcataatataatttacttggcttcaaggacataaatattccatcacagattaagaagaaaaatgagaagagatgctgaaatgtaagtcccacttcatcttgtttctggctaacctatttg

SEQ ID NO: 186198 - DNA, 139 bp, Homo sapiens
accgcacccagccaagagatcgctttttactgcaatacacaatttattggagagaggaactactcatgtggagatgattagcgtcacagggcattttaagtggatagtcacacttgagctcaccacactagcaacagga

SEQ ID NO: 186199 - DNA, 217 bp, Homo sapiens
agaccaaatgtgaaaaagcagtgagtcctgtggaacattgggatatgtgacatagggaggactggaggggacttggcctctgggggcctctgtttctccaatgagagacaatttgagctgttatctgaacagtcagtcaatactaatcaacttttttaaatgcacacatcttttaacccaacagttctacttttaggagcttattcaacagttacac

SEQ ID NO: 186200 - DNA, 265 bp, Homo sapiens
ggaggtccctcccagagggggttaagcgaaatgccaagagttggatgcatctgacctactgtgcctgtgcacagtccctctctaggacacataccgtgggctcagaaggccgtagcatgtggcaccagctgtctttacagtctgcagtggctgctggttggacagaggtcatgggagcccctctctgctgattggagagccctccctgccgattggagacccctccccactatcaaggactccgtcagtgctgaccatgctgcag

SEQ ID NO: 186201 - DNA, 375 bp, Homo sapiens
agaaaaagtaacagcataaagggaatgaggatatgtgctttaggattcagagaggggaatttcatagcattggtgtggccagtgggatttaaattgagttttgagggatgggtacatttcagattgagaattccaaagactgtgaggtagcaaaaggaagagggagttgatgaagaagggagaaatatttaataaatcatgtttttttcacaactaaaagttgtatactatattttttatagtgttcagcatgatttgatatatgtatacactgaatggttaaatcaagctatttaacatgcattacctcacatacttatttttgcgtggtgagaacacttaaaatctgtcttagcaattttcaaatatacagta

SEQ ID NO: 186202 - DNA, 292 bp, Homo sapiens
aaccgtgtgtctgagaatgaatgtgtttatatcacagtgctggaatagttatgttttaagacttggaaataatgttatgtcagagtgcaatgcatatttacaaagtcccatgcttaataatcagaatgcagggatgtgtatatgtacagccaatacaaatgggataaaatctacatcaacaataacaagtttttaaaaacctacaccaggccccaaataaccatgggctgctgttcatgccagttgtttggaccgagcttctttacctaggcatctcctagacactctcatc

SEQ ID NO: 186203 - DNA, 544 bp, Homo sapiens
tgttcaataaataaacttcgatggaggtgagtagggaaagtgcgcagacctatacatcatgcaggctatatagtcctctcacgtggttttaaaaacacatactctattggagaaagctgtgaacaaaatagtcaagttcaataacgtcttcacattcttcacatacaattggcctgttatcatgctttaactacccttgtttaatacttcaagatactaaaaaactcttcaagatgtttgtgacctgtcctttgaatttagctgaaaatcaaacagaaataaaccttttcagaagcagtttttactttcaaccattttggcattcaagcagcacatttcacctttacagtcatacacatcatgcatacatcatgttttgacaggcctgcaatttatagataaaagttgacatttagaagtaaatataaggagttcaagtgatttgtctgctttggcctccaaaagtgctgaggttacaggtatgagccatcatgcccagccaaaaatttcttcttatagtcaatgtggtgagcaaacatccagc

SEQ ID NO: 186204 - DNA, 287 bp, Homo sapiens
taatgatgaaataataggacatccatacgcaaagaaaagaaagaaaacaaaatgattctagacataaacctcatacccttaacaaaaagtaactcaaaatggatcacagacctaaatttaatatataagactaaaaaacatctagaagaaaacataagagaatatctacatctagatcaccctgaatgatctcacgctttcatcactgaccaaacctgtaattacatctcagtcctttctcctgaatctgaggcctatttctctatctacctaatatatttaatctt

SEQ ID NO: 186205 - DNA, 447 bp, Homo sapiens
taccctctcccatcttggggactctgagttgctctgaggcaggcaggtagcctgtaatatgctcttcaatcaaacacttttattccagggactctcctcaagtgagaacctccccctatcttgcgagggtcagtgatgtccaaggtttgcagcacaagaaaaatactcacagaccatgcctcaaggttttaagtcaaggtctctaaatttcttatgggcaagattctggttgttccaagatgcccaggcagaaataatgtttccaagagaaccaaagagctgcttccaaaacatacatactgccacagatggaaaagacccttccagttcatgcttacagacatgcagcaattaacagccactctctggagaaaatgttaggatacaaccagtaatatacattcactactaggcttttgagaaataagctatgaaaatgccaacctg

SEQ ID NO: 186206 - DNA, 583 bp, Homo sapiens
aggacagttagagaaggggaaagtgtgaccaggctgtctgatcctgttaatgtcgctaccagtgaccagccatcttggttgaggggttttccaggacttgggacttgcattgctaaagctaggaaattccctggccaatggggacaagttgatcccctgttcactacacacagtatccatgtgatgtcattgactgcactcagtaccaggacacaaagaggaatgcccactcgagttactctcagtccagcggggaagctagatgaatagatgatggtgtccttcacctatagcttgaggagtgctctgagagagggggacagtggtcgggtggaccagcgggggcacctgtctggacagcaggctccctgaactgaaacctgaagcccgggaagcagttctccaggtgaagggctttggaaatgggaggaagctcagtcaggaagcttggtcctggtcctgctctgctgtgatcccactcccaggccccaggcgtgttcttttcttgcagactttagattccctcacctataaaatcagggagttggaccagatacccagaactatcaagggggtaccgagc

SEQ ID NO: 186207 - DNA, 849 bp, Homo sapiens
aggacagttagagaaggggaaagtgtgaccaggctgtctgatcctgttaatgtcgctaccagtgaccagccatcttggttgaggggttttccaggacttgggacttgcattgctaaagctaggaaattccctggccaatggggacaagttgatcccctgttcactacacacagtatccatgtgatgtcattgactgcactcagtaccaggacacaaagaggaatgcccactcgagttactctcagtccagcggggaagctagatgaatagatgatggtgtccttcacctatagcttgaggagtgctctgagagagggggacagtggtcgggtggaccagcgggggcacctgtctggacagcaggctccctgaactgaaacctgaagcccgggaagcagttctccaggtgaagggctttggaaatgggaggaagctcagtcaggaagcttggtcctggtcctgctctgctgtgatcccactcccaggccccaggcgtgttcttttcttgcagactttagattccctcacctataaaatcagggagttggaccagatacccagaaataatattctctatctctgcaaatgtcacattttcaagtaaatagtgacatacctttaaaagtgatacatccttacactggggaagtatttgataatcagttctccattgcttcagaaacatcatttttatcttgctcatctattagtgagctcctgtccatgtctccacttaaaaaagggtggggctggagccaggcacagtggctcacacctgtaatcacagcgcttcgggcggctgaggttggcagatcttttgagtccaggagttcaataccagcctggccg

SEQ ID NO: 186208 - DNA, 383 bp, Homo sapiens
gagaagttggcacaaaggagttatgggacaaaaggtccaagataggcagaaaagaaaatgttgccagttgatggggaagaaaggaagtcagagggctcagacactgtgggggacagaacatctccatgtgcactctcatctcttgtagtcagcaacaggtttccacagggaaggccctacatcatctgctaccctgaaagatctggaggtaagaggctctgggcagaggtgcagtgacccttcgggtcaaccctccaacctcctcctccaggtgggactgggtgcccctctgccagctgagacagcccacacaccccagccctaatgattgttctctctacctctccccccactcctgctccacctcctcctctctgcatgca

SEQ ID NO: 186209 - DNA, 416 bp, Homo sapiens
ggaaggcagtggacaaggctggccatcaggccccagaagaggccctgagcagttagtgatattgcttgtgttgggtgccctgggtaggctgagggctgaggggtagtgtgcaagggggatggaggcagcttgcctgctcgattatttccttactggagcagcccatgcgaccagttgcactgccagggtcctatgcaagattcatcagaaatggagtcttagctggcagaatgtggccatgttcctgatgtggctgctgtggcctggcttcccccaaagtggtgtgggcgctgagggttccccatggctctgttgcctgggctttgtgctgcagccttaatgcagagggagtgtagtggcacatggagagcagaagccactcgtagcccagagcccctctcactaggagaggccag

SEQ ID NO: 186210 - DNA, 1072 bp, Homo sapiens
  misc_feature (9)..(9): n is a, c, g, or t
  misc_feature (11)..(11): n is a, c, g, or t
  misc_feature (17)..(17): n is a, c, g, or t
  misc_feature (1058)..(1058): n is a, c, g, or t
cacattatntnagatanaaataaacaggttgttgggggtagaaaagtttggatatcagatcagaaaagtttggatatctcagctcagagccacgatgagagtggggagggagcccgcgcttctcaagctcaaatgcctaggagtcctttggagatggcgttcagatgcagattcttgttccatagatctggctggagcccaaagttctgcagctggcgggctgattcagaaaacatgagttggtgcttttcctctttttgccgccgtactccattgagagtcttagtcatggagggaaacccgaaaaccaccggtgtccgggacagatactctgacgcattctcccggaacaccctggggactgcgagaaagcccctgctggctcactcgtttgctgggatcagttcccatcaggcatgcggctgtgcttcttggtatcgatttgcttcttggtcccatggcttctgcagcccacgtcgggagggcaaggtgtggtgcagcctgagagaagcatgctcctttgcaggaaggagagggaggcgcacaggcgggccttttggagcagaggaggcagaggagtccaagctgggtgcagttcctctgctgcagccctgagctgggcagacaggacacttcgctggcctttcctggcctcatacttgtcactcggtgacactgcgaccagtgtgagcaaacgttcagaaagcacatttaaacactgttacttaaaattgcaacttcacagggccagtattctttttaccatgttccaaatgaggaaaccggggtgctgaatgattaagtgacttatccaagaccacagggcttgcaaatggcaagtgggaggattgtttgagcccaggaatctgagaccagcctgagcaacatgatgagaccccatctctacaaaaaattaaaacattagctgggtgtggtggcgcatacctgtggttccagctacttgggaggctcaggcaggaggattgcttgagcccagtaggtcgaggctgcagtgagctgtgattgtgccactgcactccagcctgggccacagaacnagacttcatctcag

SEQ ID NO: 186211 - DNA, 368 bp, Homo sapiens
ctgttacggatttctagctttatgccattgggatgcaaaaattttctttctataattcaattctctaatatttgttaagatctgttttgtggcctaacatatgacatatactggagaatgttccacccacatttcagaagaacaggtacacttctgctgttggataggatgttctgggtatatctgttagatccagttgctccaaagtgtgattcaaatctaatgtttcttaatttattatctttctaaatgatctttccatggttgaaattggagtattgaggtctcctactattatagtattgcagtatatttttctcatgagattatttaataattgctttatgaatttaggtcttgtgaccttg

SEQ ID NO: 186212 - DNA, 663 bp, Homo sapiens
caacaaaggcaggaaagccagtgagtcccaaatgaatggtcatgacccttggggtggagatggagaaaacattgaggagtggggtaacaggaagaaacttcctagaggaggccagacttcaccagagatgttatttggatttgggaagagtgaaggagcctttcaattgaggagaagggcttgagcagaggcacagaagtagaaaatcttatggtatgtttgtgggcttgagcaggtgtgttttttgtgcagtctcagaaataaaaccctaaaggcaggctgggaccctgctgaagaggatcctgaattctaagccaagggatgggcaaagatggtcacagaaggctttgaaatagagaagtgacatggtaatagtgctgctttggggagatgaatatgtcagccatgtgcagagtagtgcagagtgagaagaggtgaggctggaagctggagaacacttaggaaacaagcacagtactcctgagagaaggtggtaagtgtctgtctagggaggtaaccatggaatggaaagaaagctataaaaagaattatgggtgattccaaatatatgacattttgaactaggcaaaactgtgtagacagtaaaaggatcggtggttactggggttaggaaggaggaaaggatgaataggcagaacacag

SEQ ID NO: 186213 - DNA, 305 bp, Homo sapiens
ccattgccaagtgtgtgacatatcatgtggtcttctccttcagaggccagatacagaatgcaccattacccagtagagagctcctggagaagtttctgttccaggtgcccaaagagcatagtgttcattccagtgtgcaactacttcaaactgacagggctcatggctctaggaagcagtcccaaatctttatcttcacatactatgggctacttccatgcctccgtaactgatatgtcctttcagtagcagccaagcttgttgtgcggccctaaacacacatgcatgagaggtcgggagcggtg

SEQ ID NO: 186214 - DNA, 162 bp, Homo sapiens
tggtggtggtgaaatgatgaatgcagttggtggtgatgacctattaatgatagtagcaaagacaatgttgttgatggagatgacaacattgatggaagtggtgatggaagagttcgttgttggtgttgatggtgatgacagtggcaattgaggtagtgatgg

SEQ ID NO: 186215 - DNA, 315 bp, Homo sapiens
ggaaaaaaaaacaacttatataaacgaagagctatattatgtacatggatttgaaaactcaatattcttaagacattaattctccccaaattgattcataagttcaatgcaatcccaaccaaactctcaatggatttttgaggatatcaaaaagttgattctataatcaatattaaaggaaaaggaactagaatagctaaaggtcaggaggtatgtgggtgtgagaaaaactaacactgctaaacgtcaatttcttcaaatataaaatgtggataacataacctatgatcttttaaggatgttgtaagaattaga

SEQ ID NO: 186216 - DNA, 318 bp, Homo sapiens
cacatcagcccggcctctgcccttccctgcttctgcccctctccaccggcctccatcaccactactgcccaggaccagtccacatcaaccatggggagacaggacatagctgggggcaactgctgaagagaaggaccagtgcatttggcctccactttctctctctccctttatcctccctttccttttcatggaaccagaggcacactcatgttgccccttacttcaccttccctgacctccactcacctccaattcacaaatcacgtcagacttcagctggctgtgttgtgcggaaggcagcggagacagagctag

SEQ ID NO: 186217 - DNA, 297 bp, Homo sapiens
ttagccgtacctaaagcaaggccgaccccaggatttgctctctgacccagtagttctgtgcctcctcccaggacagcagtgggctcagcatggtcttctttgtcatcagcttcaggcacaggcgttttcaggaaacaatcaccttgctccacactcagagttttggtcatggtgcacccccacatgctcccttgtccctgtgctcagtaaaccgctttttaaaaacgaaaatgaaaaacacagaaacagcacaggtagaaaataccatcatatgttttcactgaaggcaaaaaaaga

SEQ ID NO: 186218 - DNA, 276 bp, Homo sapiens
agtgtttgctgccacagggaaggtggtcctgtcctctgctcccagtgttataaaatgtgtcctgctacattaagtgcccatgtccactctgattccagggataaggatacaactaagctaattttcaaaaggggagtgtagttcataggatcgcacttgctaacacagtggagcttcactattggcagaacaacagttttcaaacagatcagctattgagaggaggtgattatactcacagcctcctaattttatcaaaggcctatcagccacagt

SEQ ID NO: 186219 - DNA, 287 bp, Homo sapiens
  misc_feature (12)..(12): n is a, c, g, or t
ggatccccacangaggcgatgatgtgaggaagctgaattttattctctgaccaagagaaagtcgccaaagaaatttaagcaagagagtatggtaacatttatgttttaggtgaaacgaaaaagggcaagaagtgaggtcaggtgatcaggtgataagagtaacggtagaaatgaaaagagaacatacttgaaatatattattgagataaagttaacaaaactgagtgggcagcctcaaaaaattaaaagtagaactaccatatgtcttagtccattcctgctgctat

SEQ ID NO: 186220 - DNA, 513 bp, Homo sapiens
actaaggtctggtgaactccaaagccgacatccttctactgggaagagcaacttctctgcctttacttctctccctgtgagagctaaacctgagatgatgccactctatgctgggtgcatagctgccctgtggttgtgggttctctgtgcaaggcaggtctcacccatccccagggcagaacctcgggggtccccgaaagcacctgagatctggcccgcaggtgtcagtgaaacaagtcctggtctgggtccaggagcctcctgaaactcagcctggcttctgatctgccattggccccttcgtgggctaccaggcaggggtttaaacgaggtgagggtgccagtctttgttggggtgcatggttggttttgctctcggggtttgtcttttcccctgcaccatttgtgaaggtctttcgcagccttgaatctttccagaggcggcaggtgtactcatctcttccacctggtggctccccacctccctctgcaaaccactccccacaagaggag

SEQ ID NO: 186221 - DNA, 387 bp, Homo sapiens
aagcaaggggcagaaggctacagagtatggggccactgacatactgctttaagactttcagaataaacgtctgaaggttatgatgccagtgtgtctgcaggaaacttggttaggtgtctgggggaagactgcctctgctctgagcgcacgcagagaagggatgaggacttcagtccaccagcagaatcagagcactgccatctctgcctgcctgaacagaccacacccaaaaattaaaatgcagggtgaattcacggctcaccagctttctgacctggaggttcagaggatccctggggaagcatccgcatgggcacaggtgggaggacctgctcaacgtgggcgctattctgcatcgttttttcttactctgtatgggggatctcg

SEQ ID NO: 186222 - DNA, 166 bp, Homo sapiens
gttgaccttcctctataggtttgctgtggggaggagtaaaacaatcctaaccacttgaataggatttattattcaatgataaaatcttaccataggaattctgtatggaggacataaagttaaggacacagctatagcttagtaagctaatcagcaaagcctttgt

SEQ ID NO: 186223 - DNA, 345 bp, Homo sapiens
ataatgacctacaatggatatatcgggatcgcattttcttttcttggtggggctgtctatgaagtactagtctaaatgcaattgattgcatatagactcaggattttacggacttttaaagtcatttagaccaattatccattagattcatggctcatctctctcctcactcccattttccacggagtcttataggtagttagtgggggagctggagttagaatccagttatcactactcctacttaattctaccctgacttctctaatcacagaaaacagtgcccttgccttctgagcacttgcttttttactggggaagcgagatacacctataccaattaaa

SEQ ID NO: 186224 - DNA, 799 bp, Homo sapiens
aataataataataaaccacatcacacccaccacaaaccagctgtcagtgtgaaaataaagccaaatagcttaacatttctaaagactagctggggccaggcatgatgggtcaggcctggaatcccagcacttagggaggccaaggcgagaggatcacttgaggtcaggagttcaagaccagcctggccaacatggtgaaaccctgtctctactaaaaatacaaaaataagccaggtgttgtggcgggctcccataatcctgtaatctacttgggaggctgaggtgggagaatcgcttgaacccaggaggcggaggttgcatgaactgagatcgtgcactccagcctaggcaacggagcaagactgtctaaaagacagtcttgtcttttagctggagaatcctgccaggaaaagaccctcagccgccaagtgctctgctcactcgaagctggaagatgcggctctagagacgcatcaggaccaagccacgactcccaacttggagaaatcaacggggaaagagacggagacaaagaagaaccatctcactgggagaggcgatgctgtttgacacatcgtccctgtacctcccaaagccactgtcctcccacacctgggcaacagtggcctcaaccccaggcccagccctcctgcaggaaggaagaggactgaatggagggcgtggcaggatgaaaggacgtggcctcctcaaacccattggtaaagggcctctggggccacctggctaagaggggctggcagaccaggaagtggcctcctcccgggagttgagccagagc

SEQ ID NO: 186225 - DNA, 383 bp, Homo sapiens
caatatgacacttcaggaatatctaattcttttacagtttatttgggctatattagcaaactttaaatacagatgctgtcttgatacaacaagcagatgcatctgagacagggcactgtaaagtaggatatttttgtagagggccagagggttgatctgcatcatccttagcaaatggaatttgaaaccatatggctgaatgaagaaagactgttggcaaaaaatcagtagcgcataaagcagcagtggaaaatgaccacaggatgggaagtatgagcagtgtgtttcagagggttgggtgactggactatgcatgggatggccttctcaaagcgggtggacaaccccaacggccagtccctccgtacctttccattttgcac

SEQ ID NO: 186226 - DNA, 486 bp, Homo sapiens
ctgacctcccgcctccctcctacaaggatgcccgtgatgaccttgggccacccagatgaccaggatggtccccacctggaggccccttgctcagtcccatctgcacaggccctactgccgtgggagaggcacatagcaggctccggggaccaggacgggggtgcctcccaggacctctttcccaggctgagcgtttcatagcaggctccggggaccaggatgggggtacctcccagggcctctttcccgggctgcatgtttctttcctagtccgactcctgtcttctaacactggttttggtgtcttttgttacacaactgctttaacttcttatgtaactgaagacgtccatcttgtcctttttgggattagaatttggggtagaaagtcttttcctccaccggaattatacaactattccatttttcttcttttaaactttttttgcaatttagcggatttatctgcacagaatttattgtgtc

SEQ ID NO: 186227 - DNA, 177 bp, Homo sapiens
aaacagctctgttggaataatgcagcgcctgagagatggggtataatatggttaaatgcttttacagttccccattaaagtaagtggatggaaattcataaaatattgatagcatttgaaatgtgttcattcatagctctgcccagaatctcaagtggtgaaccacgacgacgacga

SEQ ID NO: 186228 - DNA, 273 bp, Homo sapiens
ttacaaagggcttagttgagagtgcacgatttgtgagtcctcttcaacttggtgtttaaggagagcgggggtgagctcagtgaatgcggtttagcaggagagcatttgaatcccacagaggagccagcctatgccctagttctaaggcgcctctggtcctgtgtgaccgcgcccgggaggcaacagctctgagctcagtttcctcctcagcaaaatgtagccaatgacggcgttgtgaagcgtgaatgagatcaggtctatgaacgtcacttt

SEQ ID NO: 186229 - DNA, 550 bp, Homo sapiens
acattaaaaggattctctcccatgatcaaatgggatttatccctgagatacacaaaagactcaacatacacaaatcaataaatgtggtacatcacattaacaaaatgaagtataaaaaccatgtgatcatgtcactagatgcaggaaaagcatttgataaaattcaacattcttttattataaaaagccaccaaattatgtatagaaggaatgtgcctcatcacaataaaaaccatgtaagagaagcctacagctaataatatactcaatggtgaaaaagctgaaagctttttctcttaaaatctgaaacaaggtaaggatgcccattctcaccacttctattcagatagcactagaattcctttccagagcagacagccaagagaaagaaataaaaggcacacaaataggaaaggaagaagtaacattgtgaatgtttgctgacaacacaatgttatatgtagaaaactctacagactccaccaaagagctatttgaactaataaagttgcaggatacaaaatcaacacagagagcagtagcacttctg

SEQ ID NO: 186230 - DNA, 471 bp, Homo sapiens
tcctgcttatggagtaaacatatgctgtgtacacaataacataaactatatagtattgaatttaaatcacatttcttacaaatatatataaatttctgaggaatagaactaattccatgtgcagcatctatctgctgacaagtgtgagagtttcctgatgaaatgacctgctcgtcacttccatggatataggtctacaactttgttggcttgaaggctcctcatcctcacacgactggaggtaaatgtacgtaagtaattcaggaaattcttaaccaaatttactcatgtataatgttccagaaaatttgccacatcaaagaaatgttataaaatacataaatattgtctttatcagtggctcattgacaaaatagatcttcactctggattcctaagtcttatattaaaaaattaatgtgagatatctttgtaaattttctttacacaaaggttcatcacaaccataaa

SEQ ID NO: 186231 - DNA, 234 bp, Homo sapiens
tgactcagaggatcccgtcaatttctacacgatggtctgagaatatatttagggatttgtgagttaatcaacctttgggagtctggctgtttttaacaacatatggatgtctgggctgtagattggcagttctctgtgctgttgtctggggaggaagaggagaggatgttgtgtctgatgtacaggcttgtcctgcagaacagggcttcttgctggctgaacccagtgtatttg

SEQ ID NO: 186232 - DNA, 317 bp, Homo sapiens
taaattaagttctttagtgatctgtcttacatgggtaaggcacaaagaggagtgagttaaatatctgtgcagtcatcattttgtccttggtatttgagtggaaactagtggggaattcctacatatgtacttgtgcaggacatggttatgcacatcatacttgctatttcctggttctagatatcagcattaggtaaagtagtgccctgtaaggcagtaacttctgtatctggttgtgtacctccttctgtcaccaatcttgcatacccatgataaggagccgggttattaaatccaacttggtttcaaatcgtttt

SEQ ID NO: 186233 - DNA, 165 bp, Homo sapiens
cctaaagcccttggaacttagacatcctgtgatttcacagaatccacaccattttttcgtccctccaaagcttgagccaaaaccatcaatttaaaaaaaaaaaaaaaaaaaccctcttcctcacctccgtaggcttagcacatggcagtgttacacagaagtttt

SEQ ID NO: 186234 - DNA, 362 bp, Homo sapiens
ctcgattttaaggattagctaaattcatgtgaccattattatgtcttccatttgctaaaattgagtcccctaaatatagcctggtacagagaaggcacaccaagacagaactcgtaattgaggagagttttgagaatgcagttgtatagtttggtaattgggaacagaaaccttggaacaaacaggttaaatgccagctccattgcttactgtgtaactccgggccaattgctaactatccctaattctcaatttcctcatttttagaattggaatattaataatcctgtttatagggctttcaagatcaacattaaataggatagttgtgtaaaacctttaatgcaatgcctgcctccagt

SEQ ID NO: 186235 - DNA, 279 bp, Homo sapiens
ctcaccttcctcattctagtaatggaactaatccctaactggtgggataggggtacaaggattccatgaggtgatgtgcacccagtgcactgtaggtactcactccaagttatttctattccttttccaccttgaccagggctgagaccctcttccatcccatagctccctcctctgagtgttattagctgtgaacccaggtccctaaatggcctaaaggtcctaggtgtttgtgaacagtaaagaaatagtctttactttaccttgacctcatgctgt

SEQ ID NO: 186236 - DNA, 492 bp, Homo sapiens
agtgtgccaccaccccaactaatttttactttttatggagatggagtcataccatgttgcccaggctggcctcacactcctgggctcaatcagttctcccacctcggcctctcaaaatgccgaaattgcaggtgtttgccattgcacccagcgaatgcccaccttttatagagattccttttctggctttatccttacctttaagctgccaccaatcagcatctctgttcacagggtcagaggatggggtcatctgtccagaatgtgggtaatgcagtgccctgatgaagtaccatcattgtttccttcttgtagttgtgattagtatataacttggaacttctctagtgtggccttgaaaagcctttcatgtcttaaaagagggtttttttgtcagtctgttttactttcaacctgatcaaaattctttagaatttatcatcatccagtgacatctactcgctttgcaacagtgctgttgtttcattttat

SEQ ID NO: 186237 - DNA, 584 bp, Homo sapiens
ataccaaggagcacaattgctggatcatatggtaagagcttatttatttttttgagagactaccaagctgccttccaaagtggatgtaccattttgcattcccaccagcagtgaatgagagttcctgctgctccatattcttacaaacatgtagtattgtcaaatgttttggattttaaaaccaaaatccattttcatagatgtgtagtggtatcccgttttaatttgcaattacctaatgacttgatgttctgtgtcttttcagatgcttatttgccgtactgtttatcttctttggtgaggtgtctcttcaggtcttttgcccatttttaatctggttgttatttttcttgttgagtttaagaattctctgtcctttgtcagatctatcttttgcaaatattttctcctagtctgtggcttatcctctgattctcttggcattgtctttcacagagtagacattttatattttaatgaagtccagactatcaattatgttctcatggatcatgcctttgatgttatatctaaaaagttctcgccatacccaaagtcatctagattttctcctgttatcttct

SEQ ID NO: 186238 - DNA, 558 bp, Homo sapiens
tttttttttgagatagagtctcactctgtcacccaggctggagtacagtggtacaatctcaactcactacaatctccgcctcccaggctcaagcaattctcgtgtctcagcctcccaagttgctgggactatggacgtgcaccaccttgcccgactaatttttgtatttttgatagagtcagagtttcaccatgttggcaggctggtctcgaactcctggcctcaagtgatccacctgccttggcctcccaaagtgctgggattacaggtgtgagccaccacactcagccagcccccttactttccttggagaccatatactgtggcttgtgccaaagtggtacagcatggatttccagctcccctatctacttgctgcgggaccctagatatagctttctgtgcctatttcctcaattgcataggaatagcacctatcgcatagggtagctgtgaagatgacgtgagttaacataatatttagagcagtgcttggtacctaataagctctatataagtgtttgctattatattattattatcactgccaccaccgct

SEQ ID NO: 186239 - DNA, 618 bp, Homo sapiens
aagtggagtttagagggaaactgtacacaaaatacctaaatctgaaaattacaattcagtttaatagcatttagtgctcacctacaaatgcattcattacattttactaactaaagaggattcaaaaatgtgcatctttaggaagctcattattagggaggcaagatttatatatataacacaagacaaaaaattcaaacatgacagaccataataaataaatacatggttcagaaggtaaatgctacatgataaagttcaatttttggcatatttagacagttcgttagcagctgataactagctttataaaaccagagatttccacattgatttccggattactttgaaacaattgtaattaatcttgatctttgcagaaaataaactccttaggggctattaattgatgctcacatctcaaaagagggaagaactctaattttatcctataggaaagagtatgcccatgtggaggtatttttaccttgaagaattgtacacctttattatatgtctcagcatgtgataatggtaagaaagtttgtaggtctataaaaaacaaatgtatctgtccacaatatctttgtaagagagagggcaatgggaaggacagca

SEQ ID NO: 186240 - DNA, 683 bp, Homo sapiens
  misc_feature (614)..(614): n is a, c, g, or t
aactctatgaacactgagtctcatttctatatctgaaaacttagtacatgaatatcttccttggggaattaccatgatgtctgaaagaacatattctagtcaggagctagcatatggtaggtgctcagttcattcattcattcagcaaatattcattaagagcctcctctgtgccagacactgttccaggcactgagaatacagtagacaacaaaaccacaaaaatccctgccattaagtagcttatatgttttgggggagagagaaaataaacatgataaatatgtaaatagtgtgtaagggagtgattagtgctaagaagaaaactaaaccaggaaaggaaaacataaaatgttggcggaggctaggtgtggtggctcacacctataatcctagcactttgggaggctgcagctggaggattgcttgagcccaagaatttgaaaccagcctgggcaacataggcagaaccctgtatctacaacaaataattttttaaaaattcttgattggtgtatttgttttcctgagacttctataactaattgctacaagcatgctagcttaaattaacagatttattctgttggttcccaaagtcattggtggcaggnttggttccttctggaggatctgagggagagagaatcttcccgtgactcaggtggtgtgggggatctcta

SEQ ID NO: 186241 - DNA, 309 bp, Homo sapiens
ccgcagattgaaatgtgtttgagattgaagaagcatttcaagagggaaaatcaagggtgtggccaagtgaccatttgataaggagattgggatgaattaaatgaaaccagaggctactcatcaggataataaaagaatgatcccaaaggcacttggaagagcctctgtactgcccctccaatcacaggcccagagtgccaaggcctgggggaagaaaataggttgccaaaagagaatgagaggataaaaagggaaaccaggagaatggaaaatgattggtcaaccgtgctgagaactgctaaatggcca

SEQ ID NO: 186242 - DNA, 189 bp, Homo sapiens
catgtttttcttcccacgtttcctgatcctatttcaaagcatatgcaaagtctccctgcaaggaagtccaggatgtagccaaaagttccaaacccacatcctaccctgctgttcatctgtcctgagaacttggacaacctcctgaactctaagcctcagtttcctctgctgtaagatgggataacatga

SEQ ID NO: 186243 - DNA, 167 bp, Homo sapiens
tgatgtgggaggatttcttctttcattgttgggtgactaatacaacaatctttatttatatattagtcatgggattctgtgagtattttaggaaagaatagggacctttcattcaacacccaaagtctctgtttttaaactcttcagaaggccctgggaggaaaaca

SEQ ID NO: 186244 - DNA, 159 bp, Homo sapiens
ctgtctgtttctctctctctctctctctctctctctctctctgtctctgtctttctctgtctgtccctttctctgtctgtctgcctctctctttctctttctgtgtctctctgtctctctctctgtgcctatcttctgtcttactctctttctctgcct

SEQ ID NO: 186245 - DNA, 614 bp, Homo sapiens
cgcccatttaaagcatagagttcaacagcttttagtcaattcacagagttgtgcaacattaccatgattaattttaaaacgttttcaccacccccaaaagaaattccacacccattaacagtcattcctcattttcctccaaagcccccaggtatctagatacctactaatctgctttctgtctctatagatttgcctattctagactttcatagaaatggaatcctacaatatgtagtaggaagattttaaataatagattccatttcatcagtaggtataagactataaagattttctattcttcttgtatctattttgataagttgcatttttcaataattttgtcaatttcctctaagttgtcaatattattggcataaagttgtaaataatattttatgtttttaatttctgtataatgttttgtgatgtcctcttttacattcatgatattgatcattcatatttatcttcttttttcctggtctttttttttctttttttgagacagggtaccattctgtcacccaggctggagtgcagttgcgcaatctcagctcactgcaatctccaccgctcagggtcaaatgattctcccacctcaacctcct

SEQ ID NO: 186246 - DNA, 736 bp, Homo sapiens
  misc_feature (475)..(475): n is a, c, g, or t
tttaaatttagcaagacctgggttcaaatcttgactccaggacacactggtttgaacaagtttgacttcatgaataaacgaaggattgtgctgagaatagatgagatgacatacatcatagttctggtttggtgtctgacacataatagaccaccaggaaattataggtgttaatagacagaaaaatattttcatcttacatggcttatattaaaaaacaagatttcaagaagatggttggctcctgtcttaatgttcagaaaggcagaggctttgctctcgtttccctgagtcccatctgtgctatccaggagccactttggatactttagatatttggtgatcacaacacagaagtttttaaatttaccaattataacaattcagtccaacaagagtgaaactcagtcctcaataaataaataaataaataaagcaaattctcatgaagcaaatggtaataatcttaatttantggaagggccacaagaaagggggaaaagaacaactaaaaaaaaactttttctaccaacattaacttgtcctaacaatcaacttatttttgctttaatggttcctcctcttctcaaatggggctatgaaaagcttaattaaattaagataatgagctgatggcttctgcctaaatatctttaaattcaaagtacagtgtttttgtatttccttaaaattatagcttttagcaaagtattaactggataaccctgtggaagta

SEQ ID NO: 186247 - DNA, 246 bp, Homo sapiens
gagaggcattccttgctgtctggccaaaaatatatcaacatcgtttattgtgactgttgcatattttatgataggagtagacactgtagaccacaaagtgtcctatctgatacacagggatcctcagggcaccacctcgcactttctttttgttttttgaggtatactcccatgtatacctaaatccatgcatacttaagtcctgtagttggccctgcagaacctgtgtatacgaaaagttggttt

SEQ ID NO: 186248 - DNA, 427 bp, Homo sapiens
gctaggaaaagttaagttcacaactgctttgcaactaacatatggtggatctcagactcaatccccaagttattttctctacttatttgcatatagattccttagcctaaagtcacgatccagcagactgggctcagctttggcctcatcctatcattccccacccctgtgagctggtagtctgagttttattaatcaacaaagcgttttgcctttgtccatgcactcctgttgcctagaaagctctctgttctctccgtgtgaaaacctaagtctttcaaagctgaactcataaactgcttttgtcagcataatctctctaaacccaatttcccagatcatttgtttttttaaaatatgagaaacttcccagttcagtttctgatcacaaactctgttgctgatgtccttccttccttcagcactt

SEQ ID NO: 186249 - DNA, 508 bp, Homo sapiens
cgctaacaaagatgaaaaggcaacccttcaaaggatctacctgagaccaccctgggtggtgggaacacaaactattcccagccctgtgcaactgatgtccaagaagtgcttggccttctcctttttggtggttctcctcccagccttgaggtgcttcctcttggccacgtgcagaccaggatgcagccaacgcctcaagggggcccttctgcagatctctagagctctctctctaacctgctccctcctctcctatgttttcctccacaaattctagctgtcttgtcctccccaatttctcctgtatcatcactttagtgaagccagtgggttctgtttgacttctctcttcctgccctgaaacatggaaactgcctctcgagacaaactaaggctgtttgtgtcagaaaggttttattgtaatgcgtccacgtccattcacttacatacttaggatgaaagcaggcacagagcatagcagagtagttgtgacattaacagcatccgg

SEQ ID NO: 186250 - DNA, 443 bp, Homo sapiens
gttcacagagaccccctttcacttccatttgatttttttcctttcatccagctccatcttatacatgcatgaaacaagtcttattgataaggctttctcagtttatcacagccttttttacatttcctttcccccatagccattatcttggatccagatattggagaacctctatattgcccagacattttctttttcctttctcctccacaaattctttttataaaagctagttatctttaaaaatgcacatgtaactgtctctctctctcagcttccagtgatttgtaattacccttttgagaaagtcgagcgctctcagcatggcttagaatatcttcccagtttgaccgctgccttccccagcctcatctcccatgtctctctttctttgtgctccagttacattcctatgtcagtttctcagaaactccattctcttt

SEQ ID NO: 186251 - DNA, 441 bp, Homo sapiens
cattcattgcccacctcagctacctgtagcccccacctccttaccataggagatgacatcttcccagtttttccaggcgagcaacttcgagtagctgaccgccctctttacaaacaggatggaggctacgcatgtgttttctctgtggggcaaggccagattaagcaaagaaaacacagcagctccttccccctccccccaggaaaaaccctgtccggtcaatagcagaactaaagagctggtgcacactttcacttcccactcgagtgcctgaggacccggcttctcctaggcgtccagcaaagcccagacttaaaggtggcaggtgctgtcctctcaccctgcttcgggtgaggacgggtctccaactgagctccaatgaacaagacgaggctgggctggctccaggaggcaatttctggctgggaggtggggaagaaa

SEQ ID NO: 186252 - DNA, 173 bp, Homo sapiens
gacaggctgcgctggggtcagggtggaagcccgcggggccagcggcgttgagggaaggttctccggaagcagccgctgttctggcttggcgcaagtgcgtgtggacgacagcaggatttcctgcccagggacatctggataagaggcccaaggtccccaggagcccccaggtg

SEQ ID NO: 186253 - DNA, 280 bp, Homo sapiens
ccaaggagaagcagcctatggaccgctgaaggccagagacagacagcagggctcaccagacattctccagaaagtgccaggcggtaactgttttaggatttgcagttcatagtctctctgtcactactactcacctctatcattctagcacaaaagcagctacagacatgagtaaaccaatgagagtggctatgttccagtaacactttcaatcttattagatgccaaaattggaattttacatagttttcatgtatcacaaaatagtttcttctttggg

SEQ ID NO: 186254 - DNA, 406 bp, Homo sapiens
acctcccattgcctcaaaggctgaccttcagctgttatcccccaccatctctgaccctgcctcttccctcccaaagctcccatgaccccagtgcttacttctggatgaccctattgatttctattatatgtttatgtgttgtatcttgaggaaagggatgtgctttctactgtctttgaatcaccatccccgcaatgagagaaaatctctcattgcgctcggggttgagtcgcttgaggatctgggccaacacgttcactgtctgctcgctgctcagccctgtcttcttggtctggaactttttcagcaggtccttagtggtcatgggcttccgtgtcaggtagcggcgcacggcatcctcagtcacctgcacgtcgcctctgttgggtgttgtcttgcctgatgg

SEQ ID NO: 186255 - DNA, 457 bp, Homo sapiens
gctgctctgaggtacgaagctgaaggagaaaataaacatgaatgatttctagctgatgggtttttaacacatggaatccttgcttaggtggtacatgtcctgccattagacaaatgctttaatagagacagcaaggtatcagaactacaaaaattgagctaaacttgatctcacagaccaattagtgtgacaagataaaaatcagaaatgagtaaaggagtattgcagaaaaatcaatctggcaacagtatacaggatgcataggactgagaagcaacattgtaagagtataagtgggaaataatttaaaagttgactattttatagtcatggtcaagaagaggagctattttgaataaaaaaactaaagatatgaagtaacccaacatatgtctgaatgaaccaaccgtcagtcttttttttaaagatggagtctccttcaggacgggtagagtgc

SEQ ID NO: 186256 - DNA, 323 bp, Homo sapiens
aagttctcctccaccattgaactgcttttgctgctttgtcaaaaactaattggccatatatgtgggcatatttctgggttctctattctgctacattgatctatgtgtctatctttctaccagtaccacattgtcttgattgctgtaactatatagtcagccttaatatcagccagcgattcctcccactttaatctttgtcaaaaattgagcaaggcctttcactttccatattagttttggaataagcttgtctatgtctacagagaaacttgttttctttctttctcaaaacttgagattttgataggaattttgttaaa

SEQ ID NO: 186257 - DNA, 524 bp, Homo sapiens
taggaaaaggtaaggtttatggaataagtgggtcttaaagctgtggacaaatgtaaataaatagaatgggccagggagggcatttcaatgtgggaaccatgaaaacagaagaagacaggacagggttcagatcagtgggcagtaaaagtctacataagcgaggaactggaagaaaaatgtggacaaataaaatgggttcagattatatgtggccttgaatgccaatccctgtagcttggatttggtcctataaataagtagtcactcaagagggctctgggatgcagggagaccttgtgaaagtgaagtgcagggaagatgaggtaagcaggacctactcatgagattccggtggccaaaaggcaggaggtagggaaaccagtgtggaaactagtacagggttttcacacatcaaaccatggttatttaacattgtcttaaaaatttgtaatgcatgggagttctcagacttatttctaaatagcaagtggtggaagaagagagtaggtagaagagttccaggc

SEQ ID NO: 186258 - DNA, 145 bp, Homo sapiens
tctgtcccctcatcactgtgtacccttatcttttcccagagcataaatgaacataagagggagaattcctcacgtagctacagggaacctcacagaatccagtaggagttatggggctggatatgggagttgttagaagcagaga

SEQ ID NO: 186259 - DNA, 366 bp, Homo sapiens
gcctgagcatacgggcacatgcaagccgcttcctcctcctgcctccctgtaccaaatgtcccgcctgggaggcagaatgcagtttacagaccttgaaaccaagtgcaaagtgtctacaattagaggagaggaaagcattgaggaggaaataataaatcaagtattgaagatctcaacaacttagagaacaagataccagtcttaagtgaaaagaacacatttggcattaagtatctcaggaaacatgtccttcaggtccattgactcagaaacatctctattttcaaagaggcatttagtcagctccttccctcatctaactcaatttcctacttccctccatcatagaccatgcgttctttggtt

SEQ ID NO: 186260 - DNA, 307 bp, Homo sapiens
agatgctgtaagtaagaaactggctcgtcaaccaaaagagaagtcatctgacaataacaagttggcacttttcctttacccccagtttctaataggttatcttggcaatgtggctggggacagcttcttgcagcaccacttccagggggtatataaactgccactccaaatccattgcccacatcttcctcaggtcagagaaacaatttgggctgagtgtctacttcctctgcatagccatgctcaggtaagatgatcccagctcgaagtcaggggaaagtcctaattagtctataagctaatcagg

SEQ ID NO: 186261 - DNA, 374 bp, Homo sapiens
tgggcaataagagtgaaactccgtcaaaaaaaaagggtacctctaggacttggggtgcaagagcggctacgatcaggatggcttagtaaagggggattcctatcccctccttatcctccctgagcgaccacccctcccccacaccagcaaaagtccagaggtttatttcccagaattcaggcagctgactgcaaagacccctgccttcaactccaagttgactccaagaagactggcagccagaccctcccttgctccctgggtaacttctctgggaatcaggtcagttcctaaagatactgacatccaaggatcaaggatcactcccattcatgggtctcaagggcaatgaacccctcctctcttactgtcag

SEQ ID NO: 186262 - DNA, 375 bp, Homo sapiens
ccgtatttcctcacaaaagcagagtagggagtgacaaattataggatgagggcccaatggtaggtacacaaaatttaatttcaaaattgtataatttttccttagaacaactacgttatggaaataattttttcatgagacttctgtattttactggataaatttttattctatatcacaatggaatgaagttgaaaaggcttataatattgcatcatccacatttggtcagatattcaaaagaatcataaagagagacaattaatatgagagcttgatcttgctaaagttttcattaaagacctatacactgagtggaagcagaaagatagttcctttaaaaatattgggaatgaaatatttatgctttccagt

SEQ ID NO: 186263 - DNA, 128 bp, Homo sapiens
agtaagcctctcctgttggtgacataatgcttgatttctctccctcatggcatcactgtccacccgttgcacacatcagaatttcagaatcagccttaattcttagttttttctcactcttcctccat

SEQ ID NO: 186264 - DNA, 269 bp, Homo sapiens
tccatgatgctaaaaattattccttcactatgaaccattttcaaacacagcattcattaattgcttgttttttaagggttagttttttaagcataatttattatcgaatgactagagagggcattagtgttctacttcaccttttctaaatgttttaattaaaaatctaccaatatggccaggcttggtgcctcacacctgtaatcccagcagtttgggaggctgaggcgggtggatcacctgagttcaggagttcgagatcagcctgg

SEQ ID NO: 186265 - DNA, 618 bp, Homo sapiens
gccaagaggaaataaaaacattttaaatttaggtttaatatgtaaatactctgagatgtttaggtagtgattttttaagtttatactctagtgagtaaccatatttttgcttactgaaatatcttggattatttagttattttctgcattttgatgttttattacttactaaatagtataaacatggactacctttctaaggaatcattttactagattattagggttatccctaattaacatttgtatttagatcacttgggcacttgctactgctatcaaccaaatggcattggcaatctaacagttacttatgtaggatcaaactgcgatagtgcattgtgttaaaatgtcatgttagtataaatcatgcatatcatagaatattatgttgctatgaattaggaaaaatcatttaattatggaaaagaacacactgaattaccaggataggaaaacctatcttaaataaagacttaactttttttttatacttaaagctcctttttcttcttaaagcttctcttttatgtctctggaaaagctcccttgagtgatgaaattgctgtttgacctttttgtttttgtttcttctaagtccatatattctgtgtcgtg

SEQ ID NO: 186266 - DNA, 656 bp, Homo sapiens
ccctctagctaccaggttcctcagggagtggttgacactccataaaagctgcatttacagctttgacttcattaaactagcaggattgctttatttgccttctaaattttcaggacttttatttaaaatgtttcatcctaaacagaataaaatggaaataaaaggtgcagccttcatcgcatcttataattatttggaaaagcaatctaggatgtcctagagcaaagcttttgttcgcacttccaaaaatgtcccttctgggcagccccttcatgctggctgccgtcagggctaccagtagattgttctttttactccagttttaaacacacagttctcattctcaacctaatgatcagaagcatgtttttcccaggagcacaattaaccagtcacccctctttaccttgaagtttcctcatttctgtaattggaccaaggctgttctcctccaaagtccggcttagctaggaacaccttctcaagctcaggtgccacaaaaggcacagggaatgctgagataagcagaattggctcatgtcctcaaggagcctgcagtctataagcagatatttgtaatatagcatcagaaatgttaagtcacagcttttatagaagtacattggagaagtccctggaccagactgagaaggtaa

SEQ ID NO: 186267 - DNA, 381 bp, Homo sapiens
ggttttatggaatcctggagccccttgcccactctccctcgttttgtcccatctctgcagaatgtctgtagtttgggggcagatccaggactagcgtgacaacagagacgggcagacagacaaacacagccccaaacagggcagccaacagagtcattgcgaataacggtgaaaagagactgcagcccccagcaaataaatatgtgccctttccatttcagatctggagatgtggcctaagaggagaagacagagacttaaagagagcattttgttgagcagacttagatttaccatgcagttgaaactttttgtaagcctggtttgtggaaaaagcaggaaggaaaggaggccagccacttatctggtgtgtttaggaca

SEQ ID NO: 186268 - DNA, 275 bp, Homo sapiens
gggagagcaggggtggtagcaggataagtagaggtgaaattggggagggcatttatgaagaatggagactttttcctctggatacttctggctgacctagagggacttttgagaaaaaagagagattggttgggaatcctaccaggtaatctcatttctcctctttctcggtttcaagaacagctgaagtatccttagaaataaagggtcagcccctctgggcctgagcattccaatcaacctttattgagttctcctttaggataggccccaaa

SEQ ID NO: 186269 - DNA, 620 bp, Homo sapiens
  misc_feature (50)..(50): n is a, c, g, or t
taacgatacatgcaggacctctttcggcttggagaagcggaaattctgtngccagaattccatggctctttaaagctaatcttcactcttttacagctctcagaaggaactctcacgtctggcctttctctgttgtctgttctgctccctgatcttcggcttaagttggggcaatagttccaagaggtttagctgggaccattcagatctgtgtcttatagctgcttcttccaagattacaattcaaagtcccagatgcctccccctgcagaggagaggaaacatctgggctggagctgcacggagagagcccagctgtgtgggacatccctcagggtaggagcctgtgagctgagagctcttcattgcagatgtggttctaaccatcggggtctgggtctcacccatgaggcttcgacaggccccaggcatgtgtgtgcagggaatctgaacagtcagcctgcaggaaagaggctctggggagttatatgtggctggtgtggtggcaagtagagtttgtatggacaccgaaccaaaatagagaaatgcgaaggcagctagacagaaagtgggtggggggaagcattccaaggaacagacctctgcagcaaggagcttgg

SEQ ID NO: 186270 - DNA, 596 bp, Homo sapiens
  misc_feature (50)..(50): n is a, c, g, or t
taacgatacatgcaggacctctttcggcttggagaagcggaaattctgtngccagaattccatggctctttaaagctaatcttcactcttttacagctctcagaaggaactctcacgtctggcctttctctgttgtctgttctgctccctgatcttcggcttaagttggggcaatagttccaagaggtttagctgggaccattcagatctgtgtcttatagctgcttcttccaagattacaattcaaagtcccagatgcctccccctgcagaggagaggaaacatctgggctggagctgcacggagagagcccagctgtgtgggacatccctcagggtaggagcctgtgagctgagagctcttcattgcagatgtggttctaaccatcggggtctgggtctcacccatgaggcttcgacaggccccaggcatgtgtgtgcagggaatctgaacagtcagcctgcaggaaagaggctctggggagttatatgtggctggtgtggtggcaagtagagtagttggcaggcgttagtagttcgcaggagataaatggttcccgtttgaatccttatgctaggtttatacggtagcacagt

SEQ ID NO: 186271 - DNA, 823 bp, Homo sapiens
aatagcataaatattgagttaacctctggaagcaggctttgactttgatattgacctgaccacttaactctctggagactttgacaagtgacatcaatgtctgtctctgtgtttcctgatttatatccacagatagaaagccatctccagatcctagggccattttcaagattcagtgagataaggtgaagcatttgaatgttctccataaatgtcagctgcttttattattactagcattattttttgttttcattattattattaacatagacccgtctaagggcagaaagaaatctgaccaagaatggagtgaaagtcggctgtgaaggttaggactccctgaaaacaaaaaagaaaagtggtaacatcactctgtatccaagggcatggataaggatgattcagaatttttttataacattgatgttaatatacatagagaaatacacacacacacacacgtatatatgtccatggacatcaaaatgaggtataggttaggaagttaccctggaagttagaattgagataattactttgattagcaaaggtttatgttagaaatatgagtggttgaaggcagcgcctttcaccttgatgcctgttgtgtttagcactggatagaaaattgctatttttactgatgactactttaatgcttggttcattcatatgaaataatctttcttttctcctttaataataatgatctctcctgatttcaagttgaaaatgtattaatttaagataacttatgaagcaatgacatatggaagaggagatgggaaattgtttctcaatgggaaagtgtttataaatg

SEQ ID NO: 186272 - DNA, 382 bp, Homo sapiens
tgacagtggccttttcacagccttatggagagagatgctgagagggaagtggtacataaacaaaaagagcaaggaacgaagataatgatcaagttcgaggatgacatataaacctctagatccagctgtgcctgaagccaccacatcaacattgtagaatactgttttgtgaaccaatgtgttcctttttctttctccttccttcctttctttttcttctctccttccttccttcccccttccctctccctcttctccttccttccttccccctttccgttcccttccctctccttccttccttcctctctctttctttcttcctgtgttcccttttctcttttctccctccttccttccttcctttttttctctttttttt

SEQ ID NO: 186273 - DNA, 748 bp, Homo sapiens
tgacctcaagtgatccacccacctcggcctctcaaagtactgggattacaggcgtgagccaccacacccagctcttcctttcttttctccctttcttccttccatccctttctccttttctccctttcttccttccttctttctcttcccctcttccctccttccccttttcttccctccataccccaggaaaaataacttgattggcagtgtagaagaaggggtaggggaggatagaggtgacctctaggcagatggtgcagccaaccctaaggaggattaagaacctgaagagtttggtttgggatgtgccagccttggggaccagtaggacacacagggacagttgtccttgaggcagctgggtccccaggctgaagctcagaggagaagcctgggctgcaaagtaaggcctgggtactggccacatgttgggagcagtggaggtgactccgcctgggatcccaaagacagatgctgagtcagggtttgggtgcaagtcatttattgggaggggttcccaggcagcgcagtgaggaggtcgggaggcagggaagggcctttactgagtgggttgctgctatgggcaactgggactcagtcctgctggcaattctcagaggaatggtggggagcacacctcagaattgtcccagaagcgggaagaaggctggggtatttgtctaccacctcctacccttctttcattgaaggctgttcttagggtcctaactgcttggcacttctg

SEQ ID NO: 186274 - DNA, 367 bp, Homo sapiens
gtggacgaggcgtgaagaggaaggcactgttgatgtagtttgggcaatggatgatgaggcttggactcgggtctgctggtggggatgcacagaaatagatgggctcataatgtactttggagatagcattgacataacttgatgataaactgcaaaaacagaagacagggtaagggagaaggaaaggccaagtcttgagttttttatttgggcccctaggctagtggtagagccatggtctaaaatgaaaaaatctgggggagtaactgattcatgggcaaggaaatggaaggttctattcttaccttgtcatttgccaaaactggcattgtgactaaaaataaagaacacaaaactagaagctcta

SEQ ID NO: 186275 - DNA, 282 bp, Homo sapiens
cccaagctctaaaaagtacagccatatgtgtgataagtgcttagttaagatgaaaaaggcattaaatttgtgagtggaaatcaaacagaaatgtgttctgattgaaagcaattgggtcaatgctacccaagtttcaggcatccactgcgggtcttaaacacatctcctgcagataagggagggctattatataacgtttctttcttttttctttaattataaagcattctccttttttaatataaaaattggccacatatatcactttaggtataaagatat

SEQ ID NO: 186276 - DNA, 370 bp, Homo sapiens
ctttttccttctcaggagaggagttgggggcttctctctttgcatgtcttcctgtcaagtattacctattatgattctggtgaagagcggactgtcttgcatctaaaggtaatgaagaccatctacttcagaagtcttgttaagttctgcgctaaaacatttatctcccatttctgttatacctgtaaaggggagcaaagaatttgtgtcttcagagagaagtccactatcctagtcctttcagcccccttgaggtttggtgcaggcctgcctgggagttccacaaatgggagtgtgctctagggccccctgcctgaaccagtggccagcgactccctttggagagaatatcccggaagaagaaaatgat

SEQ ID NO: 186277 - DNA, 358 bp, Homo sapiens
acataccacatatctgattatattatactattttgtgttctataaaatagaagtgatggtccaaaacagactaatacactaaaaaataagctatgataaagttaatttcttcttcagtcctccaaaaacttcactgctcaagaaactgggtatatttctaatcttttaaacttgttaacatttaattgggattagtagtggaagctgatagtctataaaaataactgattaaactgtgctaagtggctttattatattgtgtttagtttgatactcattttctcttaaatatcttaaaaataactgcttcaattctttaatctccattactataacatacatatttcttttttttttt

SEQ ID NO: 186278 - DNA, 232 bp, Homo sapiens
tgggggaaatgggcaccccccattctacaggctggagatggggttgcttctattttcaaacagctcctcccatccccatgcctttttcccaaggtcataagccctgagcggaagaagaaagctgagaggagtctgacgggtgaacggcagctttcagtggtggcattcagccctttgttgtctctgacttttccagccacagcccacattcccaataacatggcccagctcc

SEQ ID NO: 186279 - DNA, 145 bp, Homo sapiens
agaaaaaagttactcataatccctcttctgtgaataactgctattattatttgtccttttagcttttttagcacatctaatatgcatataatgatatatttaatatatctttttatgttacaaacgtggtgtcatactatacata

SEQ ID NO: 186280 - DNA, 303 bp, Homo sapiens
cacagtgaatactgactacagaatattgataatttgaatagctaagtgttgaacacagaacagtgggattttgcacctaccctaaaatgaaacatctgtgacctgttattggtgaggttatcacaaaggctaagtacctccaacctaaaagtaataggaactaaagtttactttaatgggtgtgatgcagtggtagagttgtgactgatatttggttactatctggttcttccactgacttcaatttagttaatggtaactgagtgactcgagacattctttatgcctaagttgttaacacct

SEQ ID NO: 186281 - DNA, 201 bp, Homo sapiens
aagctttggtcagcagaggaaacaaattttatttccacatttgtcagtcgccttacaagtaatccttttttcccccagaagtaagagaagtctaactttttttcccatgtaacaaggtttgtttgccctctgccactaactctctagtacagtgtttctccacgtgtgatccctgaccaagcttagcatcatttgggagct

SEQ ID NO: 186282 - DNA, 423 bp, Homo sapiens
ccatctcttgaaaaaaaaaaattagccgggcgtggtggtgggcgcctgtagtctcagctgctcaagcggctgaggcaggagaatcgcttgaatccgggaggcggaggtcgcagtgagccaatatcacaccattgcactccagcctagatgacagagcgagactctccaaaaataaaataaaaataaaattttccatgatcccaaaggatagagtatgaaaagaagaaaactagtaactttccagtggggaaacctagcaagcctacctcagccaagagatcaaggtcagcatcatcagttatcactgtcaataatttatcagtcttgttggtatcctatactcctgataagattcacagaagatggctggacgaggtggcttacgcctgtaatcccagcactctgggaggcagaggcgggcag

SEQ ID NO: 186283 - DNA, 392 bp, Homo sapiens
gaagcacctatgttgcactgtcgccaggtaattcgttctgaggaaacttctgggaggtattttgtggcagtagactcagcattggtgtggtcattgactgactgagggggcagggtagaggggcaggagaccatgcacactgtggcactgagcctgcagcaaggagaaaggctgtgccactgacagagaggatcaggaagatcatacttcccagagcagccttccaccagaaataaaggtccaggccctggagttattatgcgcctctcgttgcctcccactgcatcatccctttttgccacatccccatcttggctcctatatcatggctcagctcccagccaaattgactcctgatgcattgcatttgtgcctccaaatcgtttcccttg

SEQ ID NO: 186284 - DNA, 485 bp, Homo sapiens
gcgtgaggcaccgcgcccggcctcctcctcccgttttcaaagtcaccagcgtagcatcctgattcaagatcacattgtcttcttttttttttgtagccaaatctccctctgcctctctcccctggtgacgacaatggctggggtcttgacttgccaaggtaactcgttggggagcagagagtgggatccgcagtgttctggtggctgttgggatctgggcgcgaggaaggagagtggctctcatgattctctgcattctcagtgcagcgtggcccgtactggtcacctgggtatagctttactgaatttcgcagatctggaaacggagaagggactggatctccaaacttggactgccttggactgaccctggcctggaaggtgtgggctcaggactccgagctcaagtcagtctgttcccccaacccctaacccactgcatccgggtgaggagttgggcccgagcgccacagcgcagatagggt

SEQ ID NO: 186285 - DNA, 733 bp, Homo sapiens
agtcacccatggggacggcgaacacccactgcctccagaagattcccagcactctgccagcaaagccatgtggaaaatgctggggcagaggactggggtgcgtgagggtggcgtagagcccaggggtgggttcgtgggaaggtgtgtccacttgtagatttggtggcattgccagatcacacgccccatgggcagtgtggagagacctcccctgccccgcgtgccctccacagctcctgctcctcggcctgaggtgtggatgctggtgtcgcaggtaaactggcgtttctttcacggtcatcgaagcaagagtgcttggtatgcctggaggccgactgcgtttctttttttgggaactcctggagtttcctgctgcccctttgttttaaggaaaaactctcacaccgtgtttctcctcctcccaccacaacagttgtccacacagaaggtgggtgtgaagggtcttccccatgcaccacgcaggggtcgctgctgccttctaattcagttccaacagtatggacccggggtagcgtccgatcgcacgggttgagggctccgtccccaaaactgccctctgacacataccggtaaactgtctgagcctctggaactgaccagttgacttcaagttggggttcccacaaccccgtttgctggcgtggctcacagtgctcagggaaacatgacgtcagcattctcccccggggagtgggggaccctctcaggagag

SEQ ID NO: 186286 - DNA, 695 bp, Homo sapiens
cactgtactccagcctgtgcaaaagagcgagactccgtctcaaaaaaaaaaaaaaaaaaaaaaagagagactcactttaaatccaaatgttgctggtgaaaggatagaaaaagatattccatgcaaatagtaatgaaaagggatcggggtggctattctactatcagacaaaaagagttacagaattgcaggaagaaatagacagttctacaataaaagttggaagctttaatatcccactatcaataatggatagaaaaataaagaaactttacatgataaaccaactagatttaacagacatttatagaacactctacccaataacaatagcatacattttctcaaatgtagatgggatgttttccaggatagactatatgttaagccacaaattagtgtcaatagattttaaaagatatacaaagtatgttcttattgcaaccacaacaggataaagttagaaatcagtaacagaaggaaaattggagaatccacaaatttgtgcaattaaccatatactcttagtcaaccaaagggtaaataaagaaattacaagagaaatttaaaaatacttaaagatgattgacaatgaaaacacacataccaaaatttatgggacagtgaaaacagtgctaaaggagaaatttatagctttaaatatatacattaaaaaataagaaaaatctcaaatc

SEQ ID NO: 186287 - DNA, 234 bp, Homo sapiens
agtcttaaatctttggggtttgaatgaaggttttacataaagaaatatttcaaaaaataaatttagaatgtcaaacccatgcaaacatgtcttacttgaacagcaagccaggacatgggaatgaaattggtgtgagacggttttgcgctccttagactcacagtacagaaacgggtaacatccagcaatgctggtgtgtcatcaatctcagcccagtcccactgccttaatttg

SEQ ID NO: 186288 - DNA, 1215 bp, Homo sapiens
  misc_feature (1017)..(1017): n is a, c, g, or t
tgagaggagatggcagcttttcttggtggaggtttctgttacaagaatctaagagtcttatgaagatagggctaaataaaaccaggatacgaaccacaggggagaaccgccaaaagaagggtagtaaatgaatggttctgtcaagtcacctctctgtcattcttcaaaggccaacttaaagccagcactgccacaaaagccatccaggactaaggttagcgaacggtgacccttgtttggtccacgatgcactaacagactcttccccttgttgcttcttactgctactggaatggaagctttgggagggcaggtgtgccatcttttccagcctgccaggcagtctggtgcatactcgtctttctcctccataccggctgtcactgccttccttctggccccagacctttcagttgtctcctctctgatcttccttcctccattttgtccccacccccaacacaacttggaatgattctttgcagataaaaatgtgatcttgttactctctgtctcacaccacagtaccacagtgtagcatgaaccacagcttcttgtcacctgcaaggccctttactgcctacctttctagtatcatctccacattatgttccaaccacataatgaacttttttctcaggaggacatggtctcgctctgtggccaaggctagagtaatctcagctactcggaaggctgaggcaggagaatcagttgaactcaggaggtgcaggttgcaatgagccgagattgtgccactgcactccagcctgggcaacacagcaagactctgtctcaaaaacaagcaagcaatcctgaagctcagtgtgcctgttggcgagattggagcgaggtagcaagggccagaccagaaagggctttggggggtcacgatgaggagtgcgcaagctatcttgttgccaccggggaattcatggcaaagagtgaagtttctctctgcctaatacacctccagggtctcgcgatcactgttgagagatccacgatgtgacccgntgaggactccctcatcgctggtcttaaggtttcgcatctcatcgctgtacccctgcctggacctccctcccactacgcggtccttgcaacacccccttccggccttcctctcccacacccccgccactgcacttttccttgcctctcactcccgacctctctgtccccaatcttcgcccgatggccccttcactcctt

SEQ ID NO: 186289 - DNA, 1481 bp, Homo sapiens
ctcctcctcctccctctaatgcctgtaactcacatccgaggctgggcgaggaatccggaggggagattttcctcatgctcacggttgttggaaactggaagagtgagaggaaggaggaaggggatttgtggcgctctctacctactacaagactgacaaggggagggggcacctaaatttgcatcttttcttcgtggtgattgagaactgcaggttcaaaccgatcccactgagcactggcgattgattataaaaaaaaatcgacactgggagaagggaggctctgtcttcggctgtcagactcaatctcggaggtggtattgggtgtctaagctgctggattgcttttcgcccaaatcaatgtggtttctttggaacattttcagcaaaggaacgcatatgctgcagtgtctttgtggcaagagtcttaagaaaaacaagaacccaactgatttcaggtttctacttctacatctccagccctgaatactcatggaatatcgctgtacctatgacagagtgaatgctgaaacttggaagccaactgacaagatgccagggatggcatggcaaggaagagagagccttcatggcaattttgaatacctgatctcttgctttcatcatcttgtctaggggaagaacacggagcctggtagttgggaggtgagaggcaggaatggataccagagatggacagacagtggggtggtgagaagggagctgcaatttgctaatccttgtagtactacctgtcaatcatcttgctttccttaatcatcgatcctggagagactttgaggaaagggctggtggagttgcgcagatgtgatcttcatttcagccttatgaatacataccaaggtctctttaaatctgtggttcctgcacaaagtgctgtgacttcaggctaatagagaggtccagatgtcacatgtgccaattagaaagaaatgaggaccatggctatggcccactgtgttcagaagacacgcccaagccacccattggcattcattgtgtctaatacttgacctgtcctgctgtttattatgtggggtggctccatattttaaaaactgtattcataaaaagatatttctcatcctgctgagtctcaggcccattgttgtaggtgaggtggtttcttttgtttgatatataacgttttgctgactttcgacttgggaattgcaaaggcttacccaaaaccctgaaggaaaagctaagaattcatacttattaagcacttggtaggtgtctgacactgtagtagatatatgcgagagcccagaacaagctgatgtccatgtacgtatctttaaaaaatataatgatctagtcttatctgtggaaactgcttcagatactgatcttactctttcctgttacatcagaaattctggaaggtaatatcctgaaagatttatcctcaagaataacaatacattaaaatcttctgctttgaaaatgctttgaaa

SEQ ID NO: 186290 - DNA, 541 bp, Homo sapiens
tgctctggggaaagccagctgccatcaggtggggacactagaggagccccagggagctcccatatggcaaggaactgagacctgctgccaacacccaggaccaatttgccatccatgagagtgggccgtctcgaaagtgggagaatgtggtcagtgtttcagccagtgcttgctgctgaggcaggagagaataattgtgtaaagagggggctcccgcagtgcaggacaggaagccaccatgtgagcaccacatccacgtgcaggtcgcaggcttcatcatgtcctgaataccatgccttagcattttatttagatgagatcatgtgactggatccctcatgatgagatgagtgcccccaaaagaagacaccagagagcttgcttctcattccacacgcatgctccaaagaaaggccatggcagagcacagagagaaggagagctcccaccagaacctggcaaagtgtgctgctggcatgcttgtctcataattctgccctccaggactgtgagaaaataagtttctgttgcttaaaccacc

SEQ ID NO: 186291 - DNA, 439 bp, Homo sapiens
acaggtgtggcaactccttcccagtggaggaagcgactgttccaagagccagttttggaattgtaggcacaaacacaggagaatgtggtcagtgtttcagccagtgcttgctgctgaggcaggagagaataattgtgtaaagagggggctcccgcagtgcaggacaggaagccaccatgtgagcaccacatccacgtgcaggtcgcaggcttcatcatgtcctgaataccatgccttagcattttatggaaactgaatagtggaagagctgccttttagctggtgttacgcagaaagaaatgcaaaagtgaaaactagcaagatgtatgggaattcagatttctgtggtattttgattacatcatcaaaatgtggccagaaatttatatactaaaaattatgataatatggaaagaaatattaaggtgcaacaatagtt

SEQ ID NO: 186292 - DNA, 432 bp, Homo sapiens
ctcctcctcctccctctaatgcctgtaactcacatccgaggctgggcgaggaatccggaggggagattttcctcatgctcacggttgttggaaactggaagagtgagaggaaggaggaaggggatttgtggcgctctctacctactacaagactgacaaggggagggggcacctaaatttgcatcttttcttcgtggtgattgagaactgcaggttcaaaccgatcccactgagcactggcgattgattataaaaaaaaatcgacactgggagaagggaggctctgtcttcggctgtcagactcaatctcggaggtggtattggtgtgtgagtgtgtgtggtggtgtttttttttctttttttttcttttttctttctttctttcctctttttttttttttccttctctcctaggggctacacaatggcagt

SEQ ID NO: 186293 - DNA, 1396 bp, Homo sapiens
attttttctccaaccctttggtaataatccggtggtgatcgaggggggataaatcattcaccctggccgaaaacaaacaatcactgagaagtctcaaagaaatataccacgtgaggggaaaaaactgggagaagatccggaatattatcgtttttcctatggtaaaaccggtgcccctcttcaggagaactgatttcaaattattattatgcaaccacaaggatctcttctttctcagggtgtctaagctgctggattgcttttcgcccaaatcaatgtggtttctttggaacattttcagcaaaggaacgcatatgctgcagtgtctttgtggcaagagtcttaagaaaaacaagaacccaactgatttcaggtttctacttctacatctccagccctgaatactcatggaatatcgctgtacctatgacagagtgaatgctgaaacttggaagccaactgacaagatgccagggatggcatggcaaggaagagagagccttcatggcaattttgaatacctgatctcttgctttcatcatcttgtctaggggaagaacacggagcctggtagttgggaggtgagaggcaggaatggataccagagatggacagacagtggggtggtgagaagggagctgcaatttgctaatccttgtagtactacctgtcaatcatcttgctttccttaatcatcgatcctggagagactttgaggaaagggctggtggagttgcgcagatgtgatcttcatttcagccttatgaatacataccaaggtctctttaaatctgtggttcctgcacaaagtgctgtgacttcaggctaatagagaggtccagatgtcacatgtgccaattagaaagaaatgaggaccatggctatggcccactgtgttcagaagacacgcccaagccacccattggcattcattgtgtctaatacttgacctgtcctgctgtttattatgtggggtggctccatattttaaaaactgtattcataaaaagatatttctcatcctgctgagtctcaggcccattgttgtaggtgaggtggtttcttttgtttgatatataacgttttgctgactttcgacttgggaattgcaaaggcttacccaaaaccctgaaggaaaagctaagaattcatacttattaagcacttggtaggtgtctgacactgtagtagatatatgcgagagcccagaacaagctgatgtccatgtacgtatctttaaaaaatataatgatctagtcttatctgtggaaactgcttcagatactgatcttactctttcctgttacatcagaaattctggaaggtaatatcctgaaagatttatcctcaagaataacaatacattaaaatcttctgctttgaaaatgctttgaaa

SEQ ID NO: 186294 - DNA, 1339 bp, Homo sapiens
tgctctggggaaagccagctgccatcaggtggggacactagaggagccccagggagctcccatatggcaaggaactgagacctgctgccaacacccaggaccaatttgccatccatgagagtgggccgtctcgaaagtgggagaatgtggtcagtgtttcagccagtgcttgctgctgaggcaggagagaataattgtgtaaagagggggctcccgcagtgcaggacaggaagccaccatgtgagcaccacatccacgtgcaggtcgcaggcttcatcatgtcctgaataccatgccttagcattttatatttcaggtttctacttctacatctccagccctgaatactcatggaatatcgctgtacctatgacagagtgaatgctgaaacttggaagccaactgacaagatgccagggatggcatggcaaggaagagagagccttcatggcaattttgaatacctgatctcttgctttcatcatcttgtctaggggaagaacacggagcctggtagttgggaggtgagaggcaggaatggataccagagatggacagacagtggggtggtgagaagggagctgcaatttgctaatccttgtagtactacctgtcaatcatcttgctttccttaatcatcgatcctggagagactttgaggaaagggctggtggagttgcgcagatgtgatcttcatttcagccttatgaatacataccaaggtctctttaaatctgtggttcctgcacaaagtgctgtgacttcaggctaatagagaggtccagatgtcacatgtgccaattagaaagaaatgaggaccatggctatggcccactgtgttcagaagacacgcccaagccacccattggcattcattgtgtctaatacttgacctgtcctgctgtttattatgtggggtggctccatattttaaaaactgtattcataaaaagatatttctcatcctgctgagtctcaggcccattgttgtaggtgaggtggtttcttttgtttgatatataacgttttgctgactttcgacttgggaattgcaaaggcttacccaaaaccctgaaggaaaagctaagaattcatacttattaagcacttggtaggtgtctgacactgtagtagatatatgcgagagcccagaacaagctgatgtccatgtacgtatctttaaaaaatataatgatctagtcttatctgtggaaactgcttcagatactgatcttactctttcctgttacatcagaaattctggaaggtaatatcctgaaagatttatcctcaagaataacaatacattaaaatcttctgctttgaaaatgctttgaaa

SEQ ID NO: 186295 - DNA, 300 bp, Homo sapiens
atgtggtcagtgtttcagccagtgcttgctgctgaggcaggagagaataattgtgtaaagagggggctcccgcagtgcaggacaggaagccaccatgtgagcaccacatccacgtgcaggtcgcaggcttcatcatgtcctgaataccatgccttagcattttatgtgagtaatcttagatcattcatcaaagaacaggttatgtttacaaatataatggttttaaggaatattataattcagcatcttgaccactggtactggtacgacatgttataatatactgtgcttttaagtatt

SEQ ID NO: 186296 - DNA, 877 bp, Homo sapiens
tgctctggggaaagccagctgccatcaggtggggacactagaggagccccagggagctcccatatggcaaggaactgagacctgctgccaacacccaggaccaatttgccatccatgagagtgggccgtctcgaaagtgggagaatgtggtcagtgtttcagccagtgcttgctgctgaggcaggagagaataattgtgtaaagagggggctcccgcagtgcaggacaggaagccaccatgtgagcaccacatccacgtgcaggtcgcaggcttcatcatgtcctgaataccatgccttagcattttatatttcaggtttctacttctacatctccagccctgaatactcatggaatatcgctgtacctatgacaggttgcatgatttttccccctctgtgcactcaatttgtgtattattgtatcatatgacattctgaatcaagtgctgctagtaccaagctgctatcatcagctgatgccaaaaatattcgttataactcttctcagcatgcaagtgagagcacttcaaatcacacagacagaatttccagccattgttcttttcttctttgcttattatacagcaacaagaatcaaaacaaaaggggatttattagaaaataatgcttcagtaaaatgttataaaacatgaggtttattgtttgtgaagatagagtgaaattcagtaccacattatagataccacctcagaggcctattttccccttcttttctcttttcccaaatgtttttcaagtggcatctttttttcagtctttgattacattaaggtgcaaactatttatccatctggaaataagcaatactggtcaacagagaaccaggaaatgaaaagtgcagccggccatatgcc

SEQ ID NO: 186297 - DNA, 259 bp, Homo sapiens
atcgcataatcggggatgcagaaatgaagatctacaaagaccacttttagtgaaacagtgagcagaggagcttcaggtctgcagaaaatgagcctggaaaccctcaaacaatcagggcacacgtcccttctctccatgcttgtctgctccattcttccaattgcagacaatttatcaggtaacttgctgtcaggatggtccaggtgtataagcttcaaatccaactgaggtttccggttccagggatggaatcagatgg

SEQ ID NO: 186298 - DNA, 424 bp, Homo sapiens
tgcaggataggagaaaagccccgggtcacgcaggaggtcacaggcagagctggactagaatccatgcctctccatgcctcatctggagcgccatgtgtgctgtgtgatcttcgtgtcatttccctcatgggaatggccccaaatgcttttcattgattaagatgagcagaacagaactacaaattttgccattcagacgtggtccaatattggccatttcatgtggttccacctaatcttggttcatttcatcctcaaaacaactccatgacgatcagtctctagacgaagagaccgggatacagggcagggcaattaacctgctcaagctcacccagcaaggaaacgaaggagctagggtgtgaatcccactccttgggtccagggccaatgctcctgacttagactttactacaacttatta

SEQ ID NO: 186299 - DNA, 232 bp, Homo sapiens
cacatgattgtaaatgattgacagaaagatcttcagcaaaatattccacccaagatacgtgggagatattgagatccaagcaataagccatatttgaaaggcattatagttttcaaaagctgtagcgcaatcattcttaaggccagttaccttctccccacatctctgggatcctgtttgaagggagttctaacaaggcctgtgttcgagcagcccagcatcccttactcct

SEQ ID NO: 186300 - DNA, 385 bp, Homo sapiens
ttacaattccccatacagagtaattctcccactataatttagccttcttatttatgatgttcatctgaaattcataccattgcttaatagaatacctcaaaatctctttctgataaattcagtggctccacatttgagcatgaaaagcagcagaaataatcaaagtatattttaaaactgaagacaactaaactgtcagtttaaaggaacacttgttatcaaacttctatcttacaaacatttaggctccacctaaaaatctagagcaaagaccaaaacattgttttgacagagtctaagaagaatgtgaggaacaaagaagcaagagaaaacatgaaaaactaaaattgatatctctctggctccctctgtttgggggatctcg

SEQ ID NO: 186301 - DNA, 337 bp, Homo sapiens
tggcagtgagtgtttacttgtttttaatagtgtataaatttaactctggtcacttgttttgtcagcttcatttcttatctcagctcaaccaaaagaacttaaatgacatcatcagtcattgttctgtgaccattaaaatgtctaggttaattccagaaaaactgtcaactaaagatacttttagaaaattcctcttccagattttcttgattcattcattcaacaaagacttcttaagtgcttaataagtgtcgtgcaacacacaaagtcttagggacaccatggtggccaagatgagctcagtttgtggatctcaaactgggaaaagacagacatg

SEQ ID NO: 186302 - DNA, 484 bp, Homo sapiens
cacacaattcacatgcccacgcccatgatccctagccccccattcagacacagtcctgtgttgcactctgacatattccggcacacaggcaccgtctctttcacactcctccttgtgcccacccatgtgtacatgtgtgtgcagatgcttatgctctgtacacgcatacatgtatgtacacacgtgtgttctcgtgtgcatactcttatgcaccctcagcacactcatgttcacatgttccattgtacagccctgtactacatcctgtgtgcatccgctttaatgtacactcatgttcacgtgttctattgcacagccctgtactatatcctgtgtacatcctctttaatgcactcttaatgttcacatgttctctgcatagccctttattacatcctgtttgcatccgccttaatgcacatttatgttcacatgtgctattgcaaggtcctgtactacatcctgtgagcaccctctttaatgc

SEQ ID NO: 186303 - DNA, 867 bp, Homo sapiens
aagagctcctgaaggaagcactaaacatggaaaggaacaaccagtaccagccactgcaaaaacaggccaaatggtgaaacaccatcgacactatgaagaaactgcattaacgaacgggcaaaattaccggttagcatcataatgacagaatcaaattcacatgtaacagactgggtgtagtggttcatgcctgtaattccagcacttcgggaggttgaggcaggtggatcatttgaggtcaggagtttgagaaataaacaaaaatatctgacaaaccctatagaacatgtgctgtatatctccaaataagtgcttttgtttttaaccacaaaaatcaatggcaatgttcttacctgacagcttcaccactgagcacatcaaaactaggagcactgcaatttaacttgtgctacctctcagatccaggtaatggaccttaatatgtgcccctcagctttctgtactgtttagcaactaggatatttgagaaaaattaaaaactacctataatatattcccctgaaatatctttatgcatggtgaggactcagttatacattttcctctgggaaagtagacaaatagttattccaaaggtggcctaaagacctcctttatgttactaataggttgacactggccagaaaatactattttgatctaagttaaggcattcacaaaacaatacagcaaaaaataaagaaagatacagatatgtatggatatagacattacaactgaaaagtatcagtggcagaactgaaaagttgaaatatttttttcttttttttgagacagggtcttgctctgtcaccattgcactccagtggggaacaagagcgaaactctctcaaaaacaaatgtaaa

SEQ ID NO: 186304 - DNA, 195 bp, Homo sapiens
acgtctaaattcatcattgacttaaaacaaaaaaacaaccccagaagtataatgctatgcccatagttctttgttcagagaacaagacagggagctggagcttgaggatgagtgctgaggggagggaggggtgccctcttgagtagcagccataaaaagcaagggatcctctatatttttgccttaagagtagtg

SEQ ID NO: 186305 - DNA, 311 bp, Homo sapiens
gatgcacaactccattacatgcacgcacacactcaaacacacatacatctttgaagaacatgtagataaatatatactatcaggaaagagtttactaattcactcaacaaaaatgtactggctatcaactaagggccaatctatctgtatctcatttctttatctctaaaataaggacaataatctcttttcagaaagctactgaaaggttggataataaatgtcaggtactgatatggtttggctctgtgtccccgtccaaatttcatcttggattgtaatccccatgtgtgcaggaagtgacctggtgg

SEQ ID NO: 186306 - DNA, 125 bp, Homo sapiens
ttgggagttgagtagaaaactcagggagcctttctggtattgacagcattgaaccctgggaacagtgatatttaaggattgggttttataataggaggattctagggaggaagctaagcctagaa

SEQ ID NO: 186307 - DNA, 315 bp, Homo sapiens
gcaattttgaggggtaggaccttgaaattggaagaaccttgtgcataacgcctgtctcttctcagtgcttccacatcaattgttttggagcacctggaatttttaatgactctatatgtaatgacttcagtttgaaggacttacctgtaaattaactattattatttgcagatttttttaataacaaataatttaagttctaaaaatacttatttggtgctccagttaacaaaaatagccagcatcattgattcaattaataaataactaccaattcagaagtctttacaaggtcgctgtgtgaagtaaccaatt

SEQ ID NO: 186308 - DNA, 593 bp, Homo sapiens
cctttcttcacgtgcaaagctattattgatgttctagtctgttctatctcattccttagagaatcattttagcaggattttaggagggggcctagcgttcacatactaacaaaaaaaaaattagtgttattctttcatcttaaaacccactaacagttccctgttacccaagggagcaagtgtggctctacagcacgatgcatgttcttttctcatctggccattactctgtccacagcttcatcacccatcagtcttccagggctcctgaccctatgaaacatttccccaccaactgcaattgtgcccagaggcacaagtacaacatgtcgtctcttccctttaggtcatggtgcaatttcctctgcctagaaaacctttccttcccaatttcatctggaaaactattgtagcccctttcaatgctttctgaagcaagaatatgaaatgaaaaagatgagatgtaaatcaatacaaaacgcctaccctgtctttgaaaccctgtgcagtgccactcctccagggcgctcctaaccccatccctcagtcatccttcccagccgtgctgtgttgtgcacgacagcatggccagc

SEQ ID NO: 186309 - DNA, 266 bp, Homo sapiens
taccacattgctgggcaacatcacgagcaggcacaagaggtaggcagagatgattaaaacccatcatccaaggaacaaagaatttagggcaatagttctcaatcaccacacatatcggaaatacctggggaatagagcctgggacttggcttagacctacactggaatcagtatctggctctgaaccacatggttttgttaccactccccatcacccccagccctgccaccatgccttgtatgtgtacacactgaatgtgtacatg

SEQ ID NO: 186310 - DNA, 343 bp, Homo sapiens
ggaaacattaggaatttctaaattcatctaactctaactaatctgttttttttccaataattacagcattcttttagtaaagtaacaaaaatatgtaagttcatcagcaaagctatttaacagaagtcagtactcagtatgttgtgaatgatgttgctttttgctattgtgtaaatgctttgaaaaaagtaagcatcgtgttgtccttttaaattgtcttacttgaagctgaattcaatttgtgtagatttatacacacaaattttatatagtatcttatgttccttatttaatgcagaagataaatattatctgtacaatgaggaactaaatggttcctagg

SEQ ID NO: 186311 - DNA, 378 bp, Homo sapiens
gtattttggttttttctgagacagagtttcgctcttgttgctaaggctggagcgcaatggcgcaatctcggctcactgcaacctccatctcctgggtttaagcgattctcctgtctcagcctcctgagtagctgggattacagacgcatgccaccacacccagctaatttttgtatttttagtagagacggggtttcatcatattggtcaggctggtctcaaactcctgacctcaggtgatccaccagtcttggtctcccaaagtgctgggattacaggtgtgagccactgggcccagcctggtcaatgttttttatatttacccacatacacatatttgccacattctttgcagtttattctccattgtgttccagg

SEQ ID NO: 186312 - DNA, 344 bp, Homo sapiens
ctagtgcctcacagtttttcctcacagttttccttacttacctgaccttctattggtagcttccatcacaaattattccttcctttctcatcccataacattacgttccctgccttgttatatgcagatcccacttcatttgtcactctataaatgacttcggataatcctatcttttttcatgttttccctgtggtcattttgtgtctctatgatccctctttagagctctagatccatatatgcagcagctcatcagatttatttacttaaatgtcccatggatacttcaccatatggaccaaactaaattcatccatcccaccatgcacaccaaaaactgg

SEQ ID NO: 186313 - DNA, 261 bp, Homo sapiens
atctgccttgtgttggtgctgctttgggaaaattaacaaaaaggggacatgttctatgctggggagaggtcagaagctgccagaaacaagaacaaagcttaggaacagacagaggctgccttggactctttcagagccactgtagaaggtgctgggcctagagtacccaggtggtaccctgaactcactcacatccactgcaatgcatcagcacacccggtgcttttaccatacttctcagggaaagagtgtctctgggag

SEQ ID NO: 186314 - DNA, 579 bp, Homo sapiens
gattgctgacaaaatagagaagtccagaaggggaaatggtttggacgggaagaggaggggtccagctgtcaacgttttgagcaacaggtcccaggaggactttcagctggggccgtcattcagctagaaatccagggctaggtttcaggagagggccagagatgtctagcatggtagtggggcacagtgacactgtgacgctggagggtcagggtcggagcggaggagcttcccagggagtgcagacagcggggaccaggaggtgcgggaagaagagtcaggaggagagtcagggtgcacttggagaagagagctgagctcctcagtggggtatttgagggagtgaggactcaaggctagagattagactgttgggaaatcatcagcggtcttgggatggcctgtttgtgccctgtggtgggaacacaatgtgaggagttgaggagagagtgggtggtgagaagtggggctgctggtgtagcctggtcttaaaggactaagggaaggactgtgtgtcagtggtgtgtgtgtgtgtatatatacacatatgtgaatatatgagtggcgtgtgtgtgtgtg

SEQ ID NO: 186315 - DNA, 524 bp, Homo sapiens
gacctggccctgccccgccaccagccttctccttccagccacacttgttagcccatttctcacataggccaagtcagttcattcccacctccgggccctgtgctggcctctgccatgcatcccctcctgcctcagagagtctccaggaccacgcaatctaaagccatgcccagccctctggagcaggggccgggaagctggggccgtgcctcccaacctccatttttccaagtgatatcaatgaagctttctttgaacacagccaggcccctctgttcactcggtgttaatgggcacttttgcccactgtggcagagctgaacagttgtgacagagactggccagaagcattcaccatccatccccgacagaaacagttcacccggtgttaacgggcacttttgcccactgtggcagagctgagcagttgtgacagagactggccagaagcattcaccatccatccctcacagaaacagttgccaaccctgccctgaacacagtccctgtgtagagggccctgc

SEQ ID NO: 186316 - DNA, 659 bp, Homo sapiens
taatttctgagagtctaaacattctttgtatgtttactttttattgcataggcagtaaatttttatatctttgctttacttttatcaagcaatatatgaacagcattttctaaattaatggaaataaaatatttaaaacaaaaagtcaagaacgttctagtgatgccttttcactattccagaggctcacctctcatctgcagcatagactcagctttttattttcatatttccatatatctgaataacatatactgttatcttttgattcctcaattttggaaaagaatattgactttctgtgatggtagataagtatctagatctttgatgtcattctttctacttttattttcccattatacttctacagttatattaaattttagtaaagtcaatattgaatgcctatactatcatgtttgctcaaatattactcatagctgaacactttagtgtgctgcaattatgtctctttaatactttttggtttagctaatacttgccttgttttataatttagtcaatatctttgcacccagtgaaaattgatggatgtattaattttttaggtcagccataacaatgttacctcaaactaggtggcttaaaataacagaaatgtattgtctcacagttctggaggccagaaattcaaa

SEQ ID NO: 186317 - DNA, 488 bp, Homo sapiens
tgctcattatgctcacagggcttttgaaaagagaacaaaataaagatttcaagtcttagcaatgtgctgcccagccaacatttttctgagttatactgtgtcttaaatttctaattatatcattctccccattccccaatagcttgtttcctgtgggacgagccccttttccacagatgtgggtctgacatttgcatcattccagttggcaagccacatgttggtagacagtgttctgggcatgatctggaggacaggatgagtgctttgttttctctttgttatgccatactcagcagctttggtcattatttgtagtgtccacattaagcttcttagggagaaaacaaatccttgttgaagaaacattttttaatagtgctattattttgaaccatgaaaatgcatttaaagcagtaatgtctcaaatgctactgtcagagcagactctttacaggaatgagttcatttcccccagatatggtaaa

SEQ ID NO: 186318 - DNA, 412 bp, Homo sapiens
ttacagcctattcaatttttattgcttagtctatttcatggttagctgagggttttaattattagttattaaagtttttaaggtttaaagaccaaatgattcataaaacatagggaatatttcctgccaccaccccatctaaaactagagacaccatttaaaggttaaagtactctctttccaaaacagatcagtatagtgtcttgtagagagagtaggtgattattcaatcttcactggtaatgattatttgaaacaacagccctggcatgtggaatataatcttctcgcgaggagaagcagggcagctgtggcacgacctccagcaccagacaggtcttgggttcaaggatctgctctgggcctaccagctttgagcaagtaacaggctctcgctccacctccacatgct

SEQ ID NO: 186319 - DNA, 237 bp, Homo sapiens
tatttgaaagcaatctaacaaccacatggatctgtgcaaaggaataaatgttgccaagacaaattacaaagaaaaacattctgaatgcgagttttctttgtcatattttggctcgaagtcttttcacatttttcagacaattctttggaaattctgagtagcaaatattttttctctatcacttttcatctttataactgcagctgcatgcctgcagttcagctctcctggacaact

SEQ ID NO: 186320 - DNA, 566 bp, Homo sapiens
accagccaaggagcccaccatgccaggccacatagccacttctgcctggaagagggcagaagaaattggggcagtgctcctactacgcccaccacagcccagatgaacctgtatagatagccccagctcctaagaggaggtggctcacctggtggacccccaagagcacctgcctgatgtcctcaaatgtggtgtgtctgtgagcagtagtgagctctacctctgcatccttccgtgaaccctttggtagggcacaaatgagcacctctctggaaggcatcatgctaggcgttagggatatggaaacgtatggcacattccctgcccccaagaagcttacaacatgggggaagagagtctgtatatataaatgcctagcactgggccttacacatagcaggttcacaaagaaataggaacagtaggtaacagatgccaaatgatactgcacaagacctacccatcccctgtgaataagggctgccccatcgtccttccctggacagctccctcgacctcatccagccctgcctctctgctccccctgctgcatcagggcagtctcc

SEQ ID NO: 186321 - DNA, 284 bp, Homo sapiens
gaaagacagagagagaaagaaagaaagagcaagcgagagagagagaaaagaaagaaagaaaagaaaaagtaaaagaaaaatggattcatggtacaggaaagagtggatactgaggctcagggaaggcttcatggggaaagaggtcatggaggtaatatggagctaatatgtatacaaaacacttacttagtctagaaccttgtagctcgataaatggctgtgtttagcatctggtggaacacattgtccttaattttactgtgtgatattgtgcagtttaaaat

SEQ ID NO: 186322 - DNA, 283 bp, Homo sapiens
cttgtgcaacttcctccattagcctaaatacttctgtcttagtcagctcagactgtgcaacttttataaacaacatcgattcattgcttacagttctggaggttgggaagtccaaggtcaaggcactggcagattcggtgtgtactgagtgccattcctcatggatggcacctcctagctctgtcctcacatagcagaagggacaaagaagctccctcggacctcttttgtgagggcactgatatggttggaggtccccttcaaactgcatgatgaaatgcaa

SEQ ID NO: 186323 - DNA, 144 bp, Homo sapiens
gagagcgtttgggaacttgggagtaattaggtgtgactggagcattgttgggacaggataggtattagaaataaagacaaattggtgagcaggggccactaattggtgaggtgggaggattgcttgagcctgggaagtgaaggt

SEQ ID NO: 186324 - DNA, 317 bp, Homo sapiens
caaagcagggtcaggagatgcaaacaaactgatgtgggggttccaagtgaggtggaattccagacaggggccgggaagacttcgtggaaagggagaatctgaggtgggttttctaggatgggtaaagttcattagaggaagagaagtgcaacagaggaagttcggtgagaggtagagggaaggcgttctgatcatgaaggaaacactagaaaaggtatggagatagaaaaagataaggcctgattttttaacctaccacttaaaaaaaatccttgaaaagagatttttaaaacgaatacttggtgctgacaaaggtg

SEQ ID NO: 186325 - DNA, 374 bp, Homo sapiens
ataaatacatctttcaaatgcagaaagttaacctaggattcctttggttacttgcctagatgtatttgagagcagaactgcattatacaaagcaaactagttaataacacactggtagaaaggcttgtcagaaagaactttgtactgggccagtatatgacagggtatagtgaagcacaaataactacaatccagaggcattacataatttcaagccaatgttaaagatggtatatctatattagaacatataaatattttggttcctgaattaaaaaaaaaagatcagaggagatcagagagtaaacagttctaatcaaactcagactgcagtgcttaatagtgttaagtaaaatagagattgctttggattc

SEQ ID NO: 186326 - DNA, 233 bp, Homo sapiens
agcaggtgcggctgtccgggagaggaagggtacccggcaaacagcgagatgaggaatgaaccttttaaaaggacgcgctaatcaagcatccagacaacctcagctaatccttgaacttggaagtgcaaccgttccccaggcagggcaggaaaagggcagaagcacggcgggtgcggggcactcttttgagtgctcatcagccaacttgcacatttcctgtgacgctttctagt

SEQ ID NO: 186327 - DNA, 149 bp, Homo sapiens
catggagccgagcagatttcccagatgaggctttcaaatcagggcttgtgctcaagcacaagggagacagtggaggtgaggcacagggtcctctgactggctctgcaggaagcagcagggggaagctggtaggtgtttttttattaggc

SEQ ID NO: 186328 - DNA, 346 bp, Homo sapiens
ccatggccctgacctatcacctgctacagacccttaactatttcagggtctttgggcagtaattacctgtgataaagggtggactaaatgaagacgttaattttttccctaaaagatcgtgttaaattagcgtgcagtgtcttctgcaccaccaacttagcttctcataaactgtttaaataaatgatctacacctactgctctctctatcactacccagtgttcataaactgctcattttcttccattcttttaaaggtggggcttaaatgttaccaacaaaaaacatcaacaccatggcctttgctcactctcacagaaacttttcacaaaattcgggaactgc

SEQ ID NO: 186329 - DNA, 378 bp, Homo sapiens
caaaaaagaaaagaaaagaatacacgggtgcttttggaggagcgttctatgccaatccagcccatgtttcaacatttttccagaatggaccagagggccttgagggaaacacgcaataaatagctcccagatcaagattttaacaaaggacataaggaaagaaaactgaaaaacagactaactggttaaagtacattttgatgtttagttaaaaggccactgacatatttaccaagtacacactgaaacaatcaaacttaagtttaggtaccaaaggttttcaataaataacaaagactagaaagcatgcagacattgatatgaactggatgcaactaatttaaaacagcaactattttgaaattgttttttaaaaaa

SEQ ID NO: 186330 - DNA, 269 bp, Homo sapiens
tcacactatctggatagtctgccatgtgtccaactttgaaaatcgtcttcctctacgtagcaatcttcatcttcacttcaaagcctaaatcagatattatctctttccagatgccttcgttgaactcccactccatacaaccttcccccaacaaggctgcattaggtacttctaacttaattcctcataacaccctatgctttaggtcagagtttatcaacctcatcacttttgacattttggggtcagataattcttgatgtgagggg

SEQ ID NO: 186331 - DNA, 482 bp, Homo sapiens
tctaaccatgtgaggtaagtcactaaggtatagcagcatgaactcacagagggactaaattaacatgggtccagatgtggagtctaattggcatgttgaatgatcttgtactatatcgcacgttagggggatcctctcaagagtcgatcctggagcacatagctcatgcatgggaaatggagcagttcaaatcagttggtatgccagaagcagagaaccctgatccttactggagttgactaggacaccttctctttattagttaaaggtatggctaaatttaaataactaatagaggtcagacacgacttacttagtttctgagagtagttgttaactgtccttttcccaagggaaataagctaagctgaattacttaaaccacactttttccgtttcttaaaatgatttccatttccctgccctaggaaaagtaggcggctgcagagaggttgtgacagaattataaagctatttgagtt

SEQ ID NO: 186332 - DNA, 290 bp, Homo sapiens
aggagttccagaccagcctggccaacatggtgaaacaccgtctctagtaaaaatagaaaaatgagctgggcgtggtggcgggcacctataatcccagctaactcaggaggctgaagcacaagaatcgcttgaacccaggaggcagaggttgcattgagccgagattgtgccactgcactccagcttgggtgatatagcgagactcagtctcaaaaacaaaacaaaacaatcttcatatgtacccatatcctttctcaatcctgatttttttttaatgttacctttttccc

SEQ ID NO: 186333 - DNA, 335 bp, Homo sapiens
aattatacttgtaattcaatttaatgattttcattgaatttcttatttttccatttctgattgatctagcactatcatccatgtttatgcatattatttaaaattgtgctctgtattttatataatttacacattaatctcattttatattgttccataaccccaaatgtgacagactttggatagtatgttttccttttgataaatgtgcccatactgcttgacttgtgcaaatgtaagccgagtttttcataaccagtttctaggatttaattaccatatttctaccttttaaattgtccactgattgcaagatacatcaatgagttaaatgc

SEQ ID NO: 186334 - DNA, 643 bp, Homo sapiens
ctgatctagaggattccaatatatcggcctatccatcagatcccagatcaaatccagtaccccaggatagccatgaagggctgttccagcatgatcctgtgtagcaggcccggcagcaacaacaggtctacattgctgcagaaaggtccaggggctctgagaagggagtgtgagccaagatgagatcctgatttaacgcgggtatggcttgggagcttagagaagattgaggcttggataaaggtgaacaatagaagaaaaaagaaaggcaatgagaaaagccaaggaaagcaagagtcatggtccaaatgtgaagtacacaaagcaattgatagaatgtaagaatagcaagtctgtttgaccttaatgctaggaacagtttcttttgaggctgagggcttctgatactgctcccagacagaaaaaggaaaatcagaatacagtttggttcagcactgagtaatacttatttggctatgtaaaagaatagatgactgaattgtggttaaaagtcaaaatgtaagtggtaataggtcctgtaagtgtaaaggtgtagctggtagatagcaagacatggagaaactaagaggaaagtttggaaggaagaatccaaatgctcatagctttgtctcactaactaggg

SEQ ID NO: 186335 - DNA, 523 bp, Homo sapiens
aaatggtaccatagacattacggatgacacaattgagcaacagctttcactgtttaacaagcagtgtctctggaacactgggttagtgctgtcggatgttgactgaaaagtcagtggtttgagcccatccagtcatattaatgtttctagctgatgtgaccttccatctgaagagtctcttccttggaccaaatatctcttaaagcttctcttcttcttgtctcttgtctattttctaaggtgcctctttgttgcttggggcaaaaaaagtccattttaaatccacacccaacaaacatctacccttacgtatcctggtttttagggttttgagtttgttgtttgttttctcagcttctcatatttggaatactggaaattcctaaagtggaaaatgacagaacgtgaatcacagctatggtgaagccacaggctctggatgaaaaacctaatctgccagggtttgaggttaaacacatgaatcttctctgccttccctgtacactttcaaatgggctaaatc

SEQ ID NO: 186336 - DNA, 330 bp, Homo sapiens
  misc_feature (156)..(156): n is a, c, g, or t
  misc_feature (322)..(322): n is a, c, g, or t
tccaggctgtaccctcctctcctccagggtgtaccctcctctcctccagggtgtaccctcctctcctgaatcacccctcctcaacctccaggcttccacctgaaccgcagagaggccctcccacccagcaggagccacatctccgctgctgttctnagctcctggcgccctgctttcttgggggcccgaccaccccctggaattatacgggttacacaggtatgcgtgtgatgacttgtttcctctgcacccagcacggcaccttcgtcaatgtttactgaatgtttaggttacaagaaagaggggattaacgatccacatngtaggcct

SEQ ID NO: 186337 - DNA, 256 bp, Homo sapiens
  misc_feature (211)..(211): n is a, c, g, or t
ccgagttccagaccagcctgggaaacgcaaagcgaccccacctccacaaaagtgggttttctttaagtttttgactagtccgcaattcacagaattgacattttggcagatgaagattgcaagtaaggaaactaacggtatctcagatttgttctttagcaatttgctaaacctctcctctgacttttttgcccagtggccaacgcccgantgtctgttttcaggagccccaggtcaagccttgtcccttcctcct

SEQ ID NO: 186338 - DNA, 235 bp, Homo sapiens
gtctaggtggaaaagatttagtcataaaatggtgcagatctgcccaaggccttgggagctcagccctcacagcactgtgccatggatatgggacaagaattcaaaaatgatgattttggagctgtagcattaactgactggcctgctgggttttggacacttatgtatcctatgagtcatccattgcctgtacaatcattgtaccttggaagtagtaaacttgctttataactca

SEQ ID NO: 186339 - DNA, 337 bp, Homo sapiens
ctgagggttctattattgctgacttttttttaatggagaaacaatcagaaaggttaattaactcacccacaatcctaagcaggtaagtcctgcagaaatacagaatccaatacagtctttacgacttcgaaatcttactcattaaagcgtacaaatgggccgggcacagtggctcacacctgtaatcccagcactttgggaggccgaggcaggcagaccacttcaggtcaggagttcaagaccagcctggccagcatggtgaaaccccgtctctaccaaaaataaaaaaaatcagccaggtatggtggcatgtgcctgtaatcccagctattcggga

SEQ ID NO: 186340 - DNA, 427 bp, Homo sapiens
aaggaatggtaatatatgaaggcggaaaacccaaatgtttcttctttgagagtcatgactaccttctggtgtggagaaataccaaagcatatacatacataatgctgctgatgaaaataaaataatgaaactcagattcatttaaggtcaagcaaacatataaatcagcaactggcataggaaacaatgcttttccacaaaggaagagtgatgttagtgaaaatggcagagaagggaccgcagaaaactgtctctactgttaacactgatcaaaatcagctttttaaaaactagaaataaaaccatacttgcagcaatccagagagcatttatgcaagaaaaccaggtgattattggtaagaatgttgagcctggcagcattttaacatgtcctactcctaaattccaaccccttcccctccaggcg

SEQ ID NO: 186341 - DNA, 287 bp, Homo sapiens
tgttgcgattacaggcatgagccaccgcctagtctgaccctgtgttctacatgcaaatgggaatcatcataacaatacctacctcctggagttgttagctaaagaaagtgcttagactgctgcttggcacacagtaattgctcaacaaattaaggtattgctttaagtacaagcgtgtttatgagctaaaaaaataaattaacatagaaactagtgaggaagtcagtcttagagctggatgaatagccagaaacttcataaagaagttcagaagataatagataatc

SEQ ID NO: 186342 - DNA, 543 bp, Homo sapiens
tggtttttacatttttgaatggcaggaaaaaacatctaaagaatactaattcgcaacatgaaaattacatgaaattcaaattttggtattcataaataaagttttattagaacacagccacacttatttaactatcatctatggctgtttctttgctacaggggcagaactgagtagttgagacagagattgtatggctgcaaagcctgaggttttattatctgtctctttataaataaaagtttgccagcccctggtattgattattctgcttcttcaattttacaagataatcctaaatagtaggcaaaaatggctagcctttttgacaaatttaattgtggtaaactgtgctaataatattttcttcatttgctttttgtcacattctttaatctgattctttaatggtcacttttttgtttgttttccttcaatgtgttgtttaacttaataaatgatacttcatcaatctgtgtagagttttgttaccacattgatcaaatgtaactgtaaatgaaatcatccttattgatgaaaacc

SEQ ID NO: 186343 - DNA, 206 bp, Homo sapiens
ggcctgcctttatccccctcctctacttgcagctaaaatctattcattcaggttcctgtgtttcatcactttttttaactttgtgcctctgtgttctctttacaaaaattttcagtgttaaccgtatataactttcgtaataagcaaaaaacaaaagtgctctttttcaataacaaaaatttcacccacacccacagaggcccaag

SEQ ID NO: 186344 - DNA, 372 bp, Homo sapiens
ccacgccaatcagcccctgcagagtctgtgctgagcccggcttgtcaggcacactagggctgggacagatagaaataagcggataggagctacagccccgccacactgctccttccagtggtcactaatcctagttaaaccggaacgggcctcccgtcgtccagtgtcaatgggaagcaaaggagcctcgggctgatggattcgggactggcattggcagaggggcttcatcagaaagccctgagagggaggagggcggggtggcaccgtggtcccgttggtggagacagggatcatgtcaactgatttgctgattgagcttcagatcctaggagaaccttccacagaatcacatcagtgcagcagctgggc

SEQ ID NO: 186345 - DNA, 903 bp, Homo sapiens
gaagagcgggatgatatattcaagtgctgaaaggaaaaaaacaaaacataacaaaaactgtcaaccaagaatacacagcaaagctcttctacagaaggaaaagagaaaaggacttttgcagagacacacacacacaaagtcaagagttcattactctcagaagtgtcttacaagaaatgctaaaggaagttctttgggctgaaagaaaaggatgttaattagtaacacagaaacataagaaagtttgaaactcactagtaaaagtaagtacaaaaagtttaagtcaaaagtaagtacaaaagtaagtcaaattttaaaactgtggtggtagtgtttaagtaacatttattacagtggttaaaacaaactattaaaaatagttaaagctgcaataattcattaagggttacacaatataaaaagcatcaaaaacataaagtgtgggtgggtaaaaatgttgaatttttgtgtgtgatcacggttaagttgtattcaagttaaaaaaacttgctgcaactataagatattttatgtcagcctcctggtaaccacaaagcaaaaacctgtactagatatacagaagatacaaagtaaggaatcaaaccatgccactatagaaaattgcctaatcacaaaggaagacggaaagagaaggaaggaacaaaggaaaacaaagctagaaagaatgaactaaatggctgtagtcaggaaacaaagccagaaaagaatgaactaaatgactgtagtcagtcttacctggcaacaattaccttaaatgtaaataaattaaactattcaatcagaagacatagtgtgacttaatggattataaaaaccagacccagctctgtgctacacacagggagctcgcttcacttataaggacacacatagactgaaagc

SEQ ID NO: 186346 - DNA, 621 bp, Homo sapiens
tgttggtacataattatatctgtttatggagtacatgagatattttgatatgggcatgtagtgcataataatcacataatggagaatgggatatccatcccctcaatcctttgtgttgcaaacaatctaattatacttatcgctacattttaaagtgtacctttttaaaatgtaagctaatttcttcacttatgacatgttgattgattgctatatattttctcaatctatctcagaataaaatatttcacttctcttgatggctcatttctcttatcatggtatattcacttattttttaatacaagtaaaagtatagaaacatttcattatttaaactcattttgcaatttgacaagattaaggtacagttgtaaaactcctcaactaccttcattatgtattaccaggtcccattttgtccctttttgtgtacatccatagaagattcttttttccaccactgtttttgtttttcttgaattctcttcaaacagactgtattagtccattcttgcattgctataaagaaataccagagactgggtaatttttagagaaaataagtttcattggctcacggttgtgcaggctgtacaggaatcatggtgctgacatctg

SEQ ID NO: 186347 - DNA, 524 bp, Homo sapiens
gtgggaggctgaggagggtggatcatgaggtcaggagatcgagaccatcctggctaacacagtgaaaccccatctctactaaaaatacaaaaaaaaaattagctaggcatggtggtgggcgcctgtagtcctagctactcgggaggctgaggcaggagaatgacgtcaacctgggagcggagcttgcagtgagctgagatcacgccactggactccagcctaggcaacacagaccgaccttgctttaaaaacaaaaaagaacaacaaaaacatgagctgaggccaggagtggtggctcacacctataatctcagcactttgggaggccaaggtagccagatcacttgagcctggaggttgaggttgcagtgacctaagatcgtgctactgcactccagcctggatgataaagtgagaccctgtttcacaaagaaaaagaaaaagagttaaaaaaatccaggcatgaacaggaagggatgagcatggaataaaaccaggatgctgcctccgtaccaccagttctt

SEQ ID NO: 186348 - DNA, 190 bp, Homo sapiens
gatgggagggaggatagaacctgtcccaagatgagactttattttcccaaggagatgtgtacatgaggcaggtcttttccctgtctgcatgtcccagatctgagatttatgcacaagagtaggatctcagaagccttctgcagttgggcagtctcagagcacagtgatgactggattccagggagtctct

SEQ ID NO: 186349 - DNA, 199 bp, Homo sapiens
aaggaggctaggactgaataagtgagcttgtatgagtaatacttggcattgacctcttccccactgtatccacgcagtccccatgtccagtagcaggcctctcagatcgtgagggtctggctgctcttttctgcctccactgcctcttcccctttccttcttagcacagcagccagcatctccattctcattctgctct

SEQ ID NO: 186350 - DNA, 316 bp, Homo sapiens
cagtcagctatgactgactcactgtagtctagcctgggcaaaagagcaagcccctgtctctaaaactgaaaaagctatttacagatataatcaagttcggatgagatcacactggatattaaagagggcactaaattcaatgacgactgatgtctacataaggagagggagatttggggacaaacagacacatacagaggagaaaggtcatgtgaagccaaagacttgagttatgctgccataagccaaggaatgcaggaagccaacaaaagctggaagaggcaaaggattctcccctagaggcttcacagggagt

SEQ ID NO: 186351 - DNA, 187 bp, Homo sapiens
taaaaattcctttctgattaggtaaatcagagtcactttctatcatttgcaaccaagaattctggtttcttttacagcattttcccataattttgtttttagtgagggctggtgaaaccatgctcttttgtgagctccctttaatatttgaactttatgatttcttacctaccactgtgaacaactg

SEQ ID NO: 186352 - DNA, 845 bp, Homo sapiens
cttctctgttcgaaacttgaaactccaccttcaggagcgaatccacgcggaggtcaccagtgtggaagtgctttaagctgtgacgagggagttcctgcagctcagggagccagtagtgagaaaccccacgaatgcacgaagtgtgggaaagccttgtgctgcagatcggacctcagggtacatcacggggtccacgcgggggagaagtcctctgcgtgcagtgaacgggggagtggtttcagggagaagctttgccctgacaaacagggaactcacacaaaggagaaacccgctagagacagcagaagtggtaaaacgatcttccggaagacacgcctgtgtgtcccgggcacagttcacgccggagcgaagccttacaagtgttgggagtgtgagaaaacctcccacaagtcgcgcctcatcgagcaccttcgctcccacacgggggagaagccctgcggctgcagggaatgcggaaaggcctttttccagaagtcacacctcatcctgcgtcagaggactcacacgggggagaagccctgcgactgcgcggagtgcgggaaagctgctcccaggactcctgcctcctgacccacaggcggactcgcggggaagaaaccgtacgagtgctccgactgcgggaagacctcccggaaggcgaacctcatccgccaccacgggatccacacgagggagaagctgcatgggtgaagagaccgtgggatcgtcacaaagtcacatcacgaggtcgccgaacctctaggagggacatcgccagggaaacagccctcaaccaaaactacgacgccaccctaggcagaggtcccatatcggggtgaaattcg

SEQ ID NO: 186353 - DNA, 868 bp, Homo sapiens
cttctctgttcgaaacttgaaactccaccttcaggagcgaatccacgcggaggtcaccagtgtggaagtgctttaagctgtgacgagggagttcctgcagctcagggagccagtagtgagaaaccccacgaatgcacgaagtgtgggaaagccttgtgctgcagatcggacctcagggtacatcacggggtccacgcgggggagaagtcctctgcgtgcagtgaacgggggagtggtttcagggagaagctttgccctgacaaacagggaactcacacaaaggagaaacccgctagagacagcagaagtggtaaaacgatcttccggaagacacgcctgtgtgtcccgggcacagttcacgccggagcgtgagccactttagccaggatatacttaattataaagacaactgtggatatgaagtttttttttcttttgagatgaagttttactcttgttgcccaggctatgggaagaaatgaaatcattacgactaacagatctaaaaagcgtgagaacatcccagagggacgcaggggtgtgttccaagtgtgctacagacagataatttttatttttgtgttgcactggtgaacagaacataattgtgaatctgtagacatacataccataatatatagaagatctatggatactttctatgctaaattatacccttctgtgtttgtgatatagaactggaataagatgaatatattattaaagcagagaggcccactgcagcagcacataccatttcttctgtttgtcatcacgtattacagagcccctgaacttggaagctaacaatttcatgacatctgataactcacagtcaactagtttataagttatatttttggctggg

SEQ ID NO: 186354 - DNA, 634 bp, Homo sapiens
gttagatgattgtaatcaactataggtaggctaacataagtgttctgagcatgtttaaggtaggctaggctaagtaagctatgatgttctttaggttaggtgtactaaatgcgttttcagcttgtgatagtttcaacttagatgggtttatcggaatgtaaccccatcataaactgaggaccatctgtatcaggtgaagtatgatctatttatctgctaggtaaagtgagcaatatctgctaggtgaagtaagcaatgttttagacctaaatgaacaaatgagctattacattggaataagatgggcatctacccaagagttttgaaagcatttatataacattatgaaactgttgtcaaatatatgcatcgtgtcattacaaagggtactgtgccagaggactggccagatgccagtgtgatgtcaacaaacctgggaaccctgagaaatgcatatggggactgggccctctatagtaggcaagctagaggaggctctcataaaggatacgttcttttttttttttgagacagagtcttgctctgtcgccaagactggagtgcagtggcgcgatctcacttcactgcaacctccaactcctgggatcaagcgattctcccacctcagcctcct

SEQ ID NO: 186355 - DNA, 386 bp, Homo sapiens
cctgggactgcggttccttgtcctgcccctgctggttctgggtgagctcttgattttggactactcacatttttccatcaatgttctgtgacctctgagaggtcacaggggaaaaataatacaggatgaagaaacccttccttagctcaggggaaaatatcctgagaatgggtatcaatttccctgcccaaatttttacaggagccaaactctgtacaaagcacatcgaagcctaaacacatggaggattccaggagacactaggtctgggcagttctctcctgtgtccccagcaaggcagggtaggcacgaggtggggagggagcagtggcaaggggccttgggaaggctaagctatggagaagaatgggaggtgcaggggagca

SEQ ID NO: 186356 - DNA, 657 bp, Homo sapiens
gtacctcaacattaggcttcctggaaaaaagtaatcgattttcagagattccgctggtattaccatctttaaatgaaaacagagttgcctgtgtcagctgtaactgctggcaagaatcctgatatggtttgtctgtactgacttctaaatgttaatatcagcacatgcagtgagaactacagcaggaacttagatgcaggtcggttaggatagggtggctggtaaaattgcagtccttccatggcattacaggttccagtaaagtaattcctcctatatctctagatctgtactctatatatagaaacagcagtgccaaaaggtgagattcttttctgttttatataatgttgttttgatacagcaagcttgttctctcagaattaagacgtgcactcaaaaagatactcttgaatgtttaagatctcttttcttccctttaagtctccccaaaccacggaagctttccagcttcggattcctcagaatctgtacagtagttaagtgtggtgggaagattctcctttccttttcaaagccaagttcttgcctttctagtctgatagaataaacacacaagcagattcagattttttctttcatttcatttcattttctcccacttctcacagagatagctgtaggcactaactttag

SEQ ID NO: 186357 - DNA, 144 bp, Homo sapiens
cttcacatctagcacatctattcagttcacagtttgggtgcgagtaattagtaattagcttattctaattccacttaatcttaacacctaatcatctttaattgcacaggattgaatagaatgacagagaagaaaaaatggtga

SEQ ID NO: 186358 - DNA, 427 bp, Homo sapiens
tgagtgttgttacaagcttcattatcattttcataactgtctaatattttagagttggcactttgattacttagtgcatgatccctttggcttacgcacttttatctcgttttataaattataacagaggcagcctgattcttaggccatccaatggagcaggaaattatcttcactacttcgaacactaggggactgctgagagcacaaatgagagtgttttaaattgacttagtggctgggtgaccttggacagtcagcttaactcatgtccttagtgcttcatcaataaaatgacagtgataatgaaaatgcctaaaaacagggaactttgagggcccttttcggttgtgagaggttccataattttatctttcctaccaggataatctcatgtaaaataatggaggtaaatcaaatggctgaa

SEQ ID NO: 186359 - DNA, 224 bp, Homo sapiens
gagattgcgccactgcactccagcctgggccacggagactctgtctcaaaaaaacaaacaaaaacgaacaaccaaaacccacctaattgtccttttattaaagacaaaacaaaaatggttcgagttaaaaatgttacattaaaaggtttttttttgttttttttttgtttgtttttgaaacagggtcttactgtgttgcgcaggctagagtgcagtggtataat

SEQ ID NO: 186360 - DNA, 126 bp, Homo sapiens
aagctttacaataaaattcattgcttctaaaataactagctatgggaatgtgggcaatttatttaaacttagatgtctgtggttccttaacaagcagaatagtaatgaattaattaagggtatgcc

SEQ ID NO: 186361 - DNA, 198 bp, Homo sapiens
tcaacatatagctcctgtacatattttgttagatttatacctaaatatttaaaaaattttggagctattataaatggcattaacttcttttgttcccaattgttaattgctaatatatagaaatggcatatagaaattgatttctgtggctgggagcggtagcttatgcctgtaatcccagtactttgggaggccgaa

SEQ ID NO: 186362 - DNA, 408 bp, Homo sapiens
cacgatgcggcacctgttctggggccacttccctggccaccggccctgacccaaggctctctacagtccccagagtttggatgagaacttgaagaggacttgctgcttcaggggcctgcagtaggcatctccccttttcccaaagctcagcttctgagactgggggatcccaggccatgggctcccaagcccctggaaaagtgagaggggttggaaatggggtgattctgggagtcaaagtccagcagatgagggtcccccaaagtaagtgctgcacggggcacacctcgctgggcgggtctcggccctggtgcagggcaacttgctagcattcctgcccatgccagtcctggggagacagcgcctgccccaactctcagacagcatttaatttccttctctgctcag

SEQ ID NO: 186363 - DNA, 676 bp, Homo sapiens
gaacctttcagaataattacataaccaagataggcaactaaccagagatgactactgcggggcaagcaattttacaatataacacttttcaagaaagcacaaggacctcttttcagcatctaaaattttcacagacttctttctgtatagaatagaatagaatagaatagaatagaatagaatagaatagaatagaatagaatagaatagaatagaatagaagagtagaatagaacaatagaatctgttgattgagaaaatacaggccaggcatggtagctcattcctgtaatcctatcaccttgggaagcagaagagggaggactgcttgaggtgaggcattcaagaccagcctgggaagcatagcgagatcccgtctctacaaaaaattgaaaaattagccaggtatggtggcacatgcctatagtcctagctactcgggaggctgaggcaggaggatcgcctgagcccaggaatccaagtatgcagtgagcagcgatcatgccactgcactccagcctgggcagcagagtgcaaccctgtctcaaacaaacaaaaagtacacaatgaaataagtatgaattcaatactgctttaaaatgcatttgtatattatccataataacaatggttcttaaaatttgggaagatagtctcacaagatgtacaaagcata

SEQ ID NO: 186364 - DNA, 768 bp, Homo sapiens
tgctgggattaatcttaacaaagtagtacattttccccacttgataggaattaatataattttaaactctagatggagaagataggctcctattctaaagaatataaacaaggactgttgagagggaaaaacaagtgctgtgtgaggaatgctatacaaaactgtctacctcaaaaatgaggaaaacaaaatgcattgcaaacagcttctcactatttttcttcatgttgcttcacatatctgttttttgttgccattgtctttcatcatcacccttccaggtgtcccttcctgaagttcagtcagcttcagccccagtcttgcagtatttctattcccaccttggcctattatgaacaatctttgggctactgtcttttgacagaggatacttttaatgaagcagcttagatttctatagagggtagcggaggaaaagataaggatgaggctgcttctggaataattgtcatgggaatgaaagggctgttgaaagattagaggccagtgtgcctgggtacaaggactggggtcataattatactttgtcttttactagtgccttttgtccaagtcactgaaagggcttaataaaattctggtctgaataatattattctttgctctttggaatttactggaggtggcagtgaggctctgaaaaaaatatgaatgttttatagtggcataaaaggaagtgagttagataccctgattccttgttaaggaaagatgagtctggtgaaagctggtgctgttaggtgaaac

SEQ ID NO: 186365 - DNA, 659 bp, Homo sapiens
ggtgaaaagaaaatcagaaaatagtagcagcatggaagtgaatgaaaagtccatttccagtgaaaaggagaagttccacagttttaaatactacagaggtcaagtagcaaatttcaccactggaaaagagacattatatatggcagcaaaaacacccttgttgtcttctttgactctcccaaagtaggtcatgtattcttcctttatttttacttgatgattatttgtctgtttcctccattagaatgtaacccccaagaggaccaagactgtttttttgttttgttttattgtggtgaaatatacgtaacataaaacttaccagttttaccatttttaagtttacagtttaatggcattaagtacatttacattgttgtataactatcaccaccattcatctctagaactttcttcctcttccaaaactgaaactctgtatccattaaataattactccccatttccctctggcaacgctgcttccactttctgtctatgaacttgactatgctaggaacctcaaataagtagaatcatatagtagttgtccttttgtgtcgtattttacttagcatagttatcaaggttcatccatattatagcatgtgtcagagttcctcccttttaaaggatgaatatttcagccttttatggat

SEQ ID NO: 186366 - DNA, 414 bp, Homo sapiens
tgagtgaaatataccacatgttgaatttgctggcatcagcaccttctgccgatttaacttatgggcagatgatagcaggcccaacacccaatactacttgcccatatccttgctttcatttcataaagcaagaataaaagagagtcagtatcaatatcaaaataaataccactagtaatattgatgatgttacttttaccaccaataataatagcagttatcaattaccgaatgcttacaatgggccaagcactgtgctaaacaccttacgtattatatctcatttattctcaaaacaatagccacactgattcttttaaaagagatgtcagatcttgctttcacctcctcaaaacccttcagtggctcccattttactgagtgccacaggcgaagtccctttcacagtctgca

SEQ ID NO: 186367 - DNA, 373 bp, Homo sapiens
tagctgggattacaagcacccaccaccacacctggctaatttttgtgtttttagtagagaaggggtttcaccatcttggccaggctggtcttgaactgctgatcttgtgatccacccgcctcggcctcccaaagtgctgggattacaggcgtgagccaccgcgcccggcctatgttgagtttctttaataaagaatttccatagtccctctgcatctgatttagtaactaaaagtccttatgataagtgagtttgcactcatagaatctgtgacaatatggggaaaagaaactgggggatttggataaaaaaacataagaaatctcttagagatttacttcatgtagatttccaccaacagagagcactgtca

SEQ ID NO: 186368 - DNA, 234 bp, Homo sapiens
attaccattcaataatattagggatattattaatattagggatcatatataatttaatattatcagaagtatcttcccattgagtaccaagactactttggggaatgaaattcgtcagactaaaaatgtgtaatttgagtaatgggagagattattaagtcaaactaacagtttctagtaagaggttggttatgctatggtttaccattgtccaacggaccaagtgtttgtttt

SEQ ID NO: 186369 - DNA, 194 bp, Homo sapiens
aggtgttctttgccgagagtgaataatcaatctcttctccgtgtcctctccttttagctgagcctttgcttcagagtagctccttgtatctccttttggttgagtaactcctttccaaatagctccatttggtaggagactttgttttttgctttcttgactctctgcttcaccttaattaaaattaccccagc

SEQ ID NO: 186370 - DNA, 485 bp, Homo sapiens
gcaccaccactccccacgtcagacctgcttagcagatttcccacgtgccgtaaaacaggtatcaatcactgataagtggaataacaaactgagacttgtaatgttcttaataggatagatcataggccaatttaaataggatgcaatttagttggaacaaatgcaaagcctgcacttggggttagaaaccatcactacaactattttggttgttttctaacctaggacttgttagcattttgtatataaaaggcatagcattttgttagccacaaggataggccatagtgggatatggcttccaaaacgtcaatgtcctagtgtgcgttaggacagacgaggggtctggaagggatgacaggagtaacagggttctgcatccaggtcctggccagctacagagaattccagtggatttggaccaggcagatcaggcttctgaaaagtgagttgtttgaagactgttgtaggaactgaggattctc

SEQ ID NO: 186371 - DNA, 761 bp, Homo sapiens
tcagataaagatggctcactctgtctagactgcttgtaccaaaaatagggctcatgtggaatacctgctttcctttgtggaggctggaattttgttatatgctacagagagggtgcctacgtggccaacttccaataaaaactgtggacactgagtccctaatacatttctctggtagacaatacttcatatatattttcacagctcatttctgggggactaattaaatgcatcctgtgtgaccccactggaagaggacatttggaatcttgtacctggttttctccagacttcgcctcattcaccatttccctgtgctcattttgccttgcatccttttgctgtgataaatctcagccatgagtgtgaccgtatgctgagtcttatgagtcttccttgcaaaccaccaaacctgggttggcgtttcagtgcctgacacagttgtattcctaagacatagttgggaccagacctcaagaaaatagccaacaaatactgggtgaatgaacgaaagaggccatatgcagtcagcccccctctctctgggttctacatatgtagatttaactaatgacagattaaaagcattcgaacaaacggagggtggtatctgtactgaaaatgtaccaactgcttttttttgtcattattccttaaacaatccaacataaccactatttatatcgtgtttatattgtattaggtattataagtaatctagagatgatttaaagtgtacaggagcatcacatacattatat

SEQ ID NO: 186372 - DNA, 335 bp, Homo sapiens
aaacctatgtttatgctcaatctcatccttggtatttttttttctatttctcctaagtacctcatcatgtttaacattaaaatttgtttcatttcttttgagttagatttaactttattattccaatagttaaccaagtgtccatttttatttatcagtcttgcctctagagacctgaaatgttaacttttcgcataaactcattcttttttttaaagtttctcttctttttaaacatttatatacagtgaaatgcacaaatctaacacatgcaggagctgatttgtgacaaatgcatacatctctctaacccatgctactgcctttttaaactt

SEQ ID NO: 186373 - DNA, 398 bp, Homo sapiens
cgagctcggttccctgaatgcagcctgctgagttgctcgggtttctctgctttctggatcacagaggcattatggagacttaaacaaatcaggtgttcatctagtttacaatgctactgtgtctgcgaggaaaactttgccaaacaaggtttttacaaacaaaagctagaatagacacaatttcaccttcaaataaaaggacaggctgacatgaagtttaaacttaaattgccaaaggaaggaagctcacaattaaggtagctgttcctagcacttagtagtctaaggccaacagcatacaagcataacaaaccaacagtccccatgtggacagacaacactgagatttctgatacaattagtttccttttcacgaaagagtcagattcataattaaa

SEQ ID NO: 186374 - DNA, 493 bp, Homo sapiens
gatgccaagatctgagagaggcagttcctgtcttaaagttgctcacagtttaatggtgatgcccctgtatgaacaaacaggtataaccacgcccgaggttaaagtagaggtagttgagttgagcacagccaaacctgcaaggaagggatggagctgtgtcacagaaagctttaaagaagtttaaagagtcagttctttaaagatgacgtatgagctaaatctcagttaagattttgactgatgagaaaagggttcagacagtggggaaaagatgggctaggcaaggaaatcgctctgtgaatgaacacacagaggcttcaaaagacccttttggggaagagcaagcaaggcatggcaggagagaagaaggggaaggaagaatgaaactggggagggggcactggcccacagtgggtggaagagctgcctctgcattagggaattggactttgtcctctgatggggcaccagggtggatgtgccccagaaggca

SEQ ID NO: 186375 - DNA, 424 bp, Homo sapiens
ataaatgtttaaatattttctgctttcaaatttattcatcatttttctccttttcacttctttcttcttctcttttttaaatttttatttatttatttgggagacaggtattgctctctcccccaggctggagtgtagtgacatgctcatagctcactgcagtatcccaggctcaagtgatcctcccacctcagcctcccacatgactgggaccacaggcacacaccaccacgcctggctaatttttgtatttgtagagatgagaccttgctatgttgcccagggtagtcttgaactcctgggctcaagcgatcctcctgcctcggcctcccaaactgctgggattgcaggcaggagcccctgcgcctgcccagctcacttttaattttttttggagagacagggtctcattgcattgcccagg

SEQ ID NO: 186376 - DNA, 190 bp, Homo sapiens
ttaagatttttaatgaaggagtggtgtgaatgggatgatcactctggctgctctgtggagaacagactgtttggcggggagaatggaagcaggaacacccgtcaggaagtgactgcatgcatgccagtgagagatcaccatggtttggtctgaggtgaagagaggcacacagatttgagagcaaatttgg

SEQ ID NO: 186377 - DNA, 358 bp, Homo sapiens
caccacactaccggaatcgaaatatactactaagctatagtacaaaaacagcaacataaaaacagacacatagaccaatggaacagaatagagaacccagaaataaaaccacacatttgcaaccaactcatttttgacaaaagcaccaagaacataccttgaagaaaggacagtcttcaatacaaggtgctgggaagactagatatccatatgcacaggaataaaactagagtcctatttctcaccatatagaaaagtcaaatcaaaatagattaaggatgtgaagttttggatgtctatatttgaaggaggtgaaagaagagcaggaaagggggccagtaaatgagaaaccgattag

SEQ ID NO: 186378 - DNA, 291 bp, Homo sapiens
ttttcagccagtttaggtagattcttagattattgatgtgagatctgtccttttttataataagaacatttaaccctatacattcctccctaagcatggctttttctgcatcctccaatttgtatgttgtcttttcatgtttgttcagttcaaaacacttagtaatttcccttgaaatgtttcattcaacccataaattattgagaatttgttattttccaaacatttagagaacattttcctgctatctttttgtaattaatttgaagttaaattccattttgcccagga

SEQ ID NO: 186379 - DNA, 188 bp, Homo sapiens
gcatactgtccagcatatgttaagtactctaaatgatgcgtggggatagtggtgtcctatcgtatgtagcacaaaagtgggtgccaagtcacagtgttgttcaagaccctgttcaagtcatttggacaaatttaatgatgctggtgaagctcccaatcaactcacagatgcctatttaacctctgctg

SEQ ID NO: 186380 - DNA, 266 bp, Homo sapiens
tgctcactgctcattcctctcatttttcccctgagtcttgctctccctccagggacatggctccatcctgctggtttgccatagttcctcatggtcatcctggaaattcatctggaaggcccgtgtgtttgaaggtccacaaggtgccgtacctacaagacagacacactgtgtattgctgtgcttacacggtcttcgtctctgtatctgcttgccaaagaccctcttgccattggaggtgaggaagacacgagcagggtgagggg

SEQ ID NO: 186381 - DNA, 406 bp, Homo sapiens
ccaacatggcagaggctgcagtccgtcttcccttcaaaaacttggaatgatttcaaatcataggcaccttcacttaaccctagcttccattcatcagcaaacacatcggatcgatgctacgctaacctatcgggttctctctccgcgcgttcaggttaaatgaatacctgacgaaagggcccacgtttcaaggcagtgacatttgatagctgagaggaaaagtggctttaatgaaaagcaacctttggaattcctgcttgtgagaaatccaattcagctttttgtgctgccagcaagaaatgatcagtagcaccagtgtttatgattttgtttgtctcaaatgtgcggcctaaaggaaccagagctacaaacctaaaagactagaaagtgggcaagtgctcacact

SEQ ID NO: 186382 - DNA, 960 bp, Homo sapiens
actggagtgcactggcctgatcatagctcactgcagcctcaaactcctgggttcaagccatcctcccacctcagccttctgagtcactggtgcagctttctcagagaccctgctacctttctgacagaccccaaggtgcagatggaaggggactaggtgtcctaggaaggcccaggcatccagacccccagctccatgttttcccctcacccaagggtcttggatgcatccttgcacaccttggtacattcaagtcatgatgagtgtaggggatgagggagaaccacaggagcaagggcttctcacaatctcaagccttgcctctgctgatgtgcccagcttcaatgcccaccagtatactgactgatactctgctcccaccagaccatatcgtttcacacatcctagcctttacaaatactggcctctgcctagaatgctcatttagtatttgggtgctgaagacacaaaatggtggggaaaacaagcaacatctctgccctgaagagcttaaacgctttctttctctgtttggcaaactcctatgcatccttcaaaacccagctcagttgtcacctcctcctgaaagcagcccaattgccctgctttggatcctgttaaagcaccctcccgcaaccctgtcttactgtgatgtcaggagctggccagtgtttttgcagggagggttggagaaggaagcataaccagttctaaactctcctctcctctgctgaatcatgcccattgcttcctgagtggcacagaaaggggaacagatgcactttctaaaccagggagctctccaaggaggcttcagactgatatgccctgattgcagaggtctggccccagaggtcctactctctcgctaacctcacccacctgtctctgtctcgtcccttccctcttctccctcttaaagcataaattaaagatgctgttgtaaggatgctcagggtc

SEQ ID NO: 186383 - DNA, 977 bp, Homo sapiens
cgtggtggcacacgcctgtagtcccagctacttggaaggctgaggcagcagaatctcttgaacccaaaaggcggagattccagtgagctgagactgcgccactgcactccagcctggatgacaaagactccgtctcaaaacaaaacaaaacaaaacaaaaacaaaaacaaaaactaaaactttaatcacatccagcttttgaggatgttccaggtttactacctactaaatacacagtgaatgaaaaatacaccatgattagcattaccataaaatgctaacatgattcaacaggaatggcttttctagaaaacgaatcccatttatcaaaatattatgctccctttgtatttccccaaaataagcaaatttaaggagtgcctctttccaaatttagggtgggaaacatgacattctttcactatttactcttttatggtttactttaaattgaagtaactcttattttattcaaataaatttctttaggaaaaaaatgcagatataaatgagttaactttttaggcaatgtaagaaagagaagttacaaaaagtgggctctgctattagactgcctaggttcactcccaaattacaaagatgtgaatctttggtccgtgttatttaaattcactgggacaagagtctcatagggttgttgtgaaaagcaaatgagtcaataaaggtaaactgcttatcagacccttgccaggcacatggaatgtgctaaaaaaaaaaaaaaaaaaagaactattattacactgattataaagcagtcttgttttacaattcctgctttacaactattattgatgtttcacaaactcccacaaattgaggtaatttctgtaacacccacactacccaatacaattatatttggaatataaaacatggtcaggcgatgtgtttttaaagggggatgtctcactgagagctgaactaaattagagtaaggtaccaaggtaccaaattac

SEQ ID NO: 186384 - DNA, 657 bp, Homo sapiens
agaggaaatcacttatggtagggtatcctgagtatggcgggagagcagggaaggaacccccagattccattccctctgtttgtctgctggtgacagcacataagcatgccctggacacccccatggacccaaatttagaaagtggataaattagggtgccattattcattttacaaaagaattcactgcaggagtcctttaaatggcaaagtcccctggtgccttttagcatctttatagatcaccagctactttgacagagaggctgggcaggcagagaattaaaattacagtgtaaggagccactgcccactgcagctcaatcccaaagaaaatcgcatctcagaaatgatggctatagctgacaggttctcatttactggctttttaggtagggtgatgtgtccggcaaggccactcgatggcaggagagggggagtgagtggcatcagcaacctggggatgtgagctgtgaagagtacattctttaccatgctgttcctggcacctctccctgggaatcaacatgcctactgagcccacgatctgatctaggaggatgtctctccccatttctaaactcccaggccacatgatcaagtccatgtcctaacatctgcctgaggttcctttcttgctccttcttgttccatccac

SEQ ID NO: 186385 - DNA, 564 bp, Homo sapiens
cctaccatccatccatccatccatccatccatccatccatccatccatccattcatctctccctctcccacaatccatctactcactgagaaacatccagcgaaggctctctgctggcctttcgtatacctatccaaacatcacttagagctggtctgaattacagtataaaaaccggtaatctgcatcaacattaccaatcagttgccaatgttaccaatcaatgttaccaacaggtctgaccatgtctgcaggattgtgcttattgggcagtaggaagaccctggagctgtggagtgtgaatgaggcctagagctaagtcatgttctcccaaacacatggtttcacctgcaggctcatagcatttgctggtcagcaggcctgacctcatcactacaggaagggaggtgaggcccagccctcatgccccctctcctttctctgccccccagggctccttcctcacactgacctcctgggcctggcctccctagcacagccccaccgtctctccctcctttctcctactgaccttggcttggccggtgctgtggctgtggcaag

SEQ ID NO: 186386 - DNA, 553 bp, Homo sapiens
catgtaatgaatatactatggcaaaggcctggggttagtggaagaacacaggctttgaatcccagcactgccatttaccacgtgtgaccccgagcctcagttactgcactcataaaaggaacgtatttacatgttccttgcaaaactgtcaagaataaatgaggtcattcaaactattgaaacaacagcatttacaacatgctaacaatgtcagtttccttaatccacaataaaaaatccttaaagtattttcagtaggtacattttatataaatgtccatgctattttacatacgatatcaatgagccattccaaagcctctcaaaggtcacagtctaatcaaaatggaacatttcacatatgagtcattttgtcatttttgtatgtatgtggcaagtccctgggttgtagtctcagactcttgaagtttaattaaagagctgtttttgaagatgaggactccaatacatgcatcttagaacttttaaatgccccataattcctacacttcatatgtcaccaacatccagtttgatcctttgcttgaatttc

SEQ ID NO: 186387 - DNA, 217 bp, Homo sapiens
ggtctgtgccctgtgtggggtgcctgccctgtgtgtggtgcatggggtctgtgccctgtgtgaggtgcctgccctgtgtggggtgtgtggggtctgtgccctgtgtggggtgcctgccctgtgtgggatgcgtggggtctgtgccctgtgtgaggtgcctgccctgtgtggggtgcgtggggtctgtgccctgtgtggggtgcctgccctgtgtggg

SEQ ID NO: 186388 - DNA, 292 bp, Homo sapiens
agtgaagggggaacagagtcagggtgcttgtgtggtcactcactgtgggtcagtgtttttgttggagtgttatgtggtgtctgctacttgggcttctcccatgctgtcagggccaaacctgtttgttttcacatgtcggggagatagacatgcaattaatgagctgccttatgcttaacgtggtggtgttttggagggctttcaatttcttattgggaatgtgagttttggtggtccatatagactggagcctttctgacattattccccatcaagccgtagtggcagttac

SEQ ID NO: 186389 - DNA, 247 bp, Homo sapiens
cccacaaggaagaaaaaagggaatgaagaaaatgggggaagaggtgagggaataaaaagaaataagatagaggtaaattttccaaagaggaaaagagattaaaaggtagcacaaaaaactagagtttaaagttctgggcaattcacagacaataatctcaatctctctctctctctctatttttccctatcaaaatttaattgcatgtatcaacattatagataaaaccattaaacaatcaagacca

SEQ ID NO: 186390 - DNA, 283 bp, Homo sapiens
ataacaccttcctgctcttgttcagttcttctgcctagtagacttcagcagtgtgagtttggttttataactactgtaaagtcatttttacatgaactgctcaccacttagtcctaattatcattggaacataaaatggacaaaacattaaaataggtgtcatgtaaatgttattgtaaattttatttatttataacactcttgaaggtttattagtttttgactgcttacaattttttttaattacagggaatatttatcagccgccccaagtgttgataag

SEQ ID NO: 186391 - DNA, 513 bp, Homo sapiens
taagtggaatgttttggctttatgtaagcaaaatggaaacacggtgattaatttacaatagttagctttaaaagttgtaggcaaaagtccagtactactgggaaaaaaacaccaaccagggaccagagaggactagggtcctaaatgcaacccagctattaactgtgtgaccttattaaccctactaagattgtgtgaccatggacaaaatgagaggaatacttgggccacacataggctggaacactattagaactactaaaaaacgacagacacctatgtgtattaacctaggagaagttgtaaaatatgtaaaacaaaaaacataatgcaaaattataggaactaatatataaaatgatactatttgagataataaatcgataagatatacagatgtgcatgtaagcccctgggagaaactggaagggtatacaccactgacaggttgtgtttgggtgcaggatggggaagagcagcagagtgggtctacattcctctactgtcagaaaa

SEQ ID NO: 186392 - DNA, 121 bp, Homo sapiens
tatgaaagaaaataattactgatgcagccttttcttttttaaccaaacaatgaatgaagtgtgaagatggaatcaagataagttcagaaatgcatgactttaatacatgctaatagtggag

SEQ ID NO: 186393 - DNA, 305 bp, Homo sapiens
aaccataggtatttctttttactggaaaaacaattagttgtttcggttttattttttcctttaattaacagtactagtgactttgtgaaagaatatgagttactatttaggtatgcttacttaactacaatacactacattgcagtatttctgaaacctaggacatacacattatatataacaactctatattgaaatatatattacattatattcattttaacttttgaatctgcctatgatcatgagttgattgaaatattatgtctttgcttatatcacccatcaccaacctgctgcagtta

SEQ ID NO: 186394 - DNA, 325 bp, Homo sapiens
attctttttctctgatattgggttttttatttctagcatttccattgactattttagtttccatctctaggggaaatgcatattgcctgcctttccttctagagcctctgctgtgttcatcatagttaccttagagtccttgatctatagttcagaaaacagggtcagccctgagtctgagtctcctaattcctttatcatctcttgactgtaatttgcttttccttgctttttttgtgctttataaattttaattgcatgctggacattgtgtgtagaagaacaatagcgaatgaggtaagttgcatagtctatagtttagtaa

SEQ ID NO: 186395 - DNA, 131 bp, Homo sapiens
cctcatttttgccctcttgctccccaggattaaatcacagcagtcgagattgaagcaacgttcaaatcagtttcaggaccttgttctcatactcctaaatcttgagctaacaaagccttcagtgcagtgtt

SEQ ID NO: 186396 - DNA, 124 bp, Homo sapiens
ttttgtgaacatcttcactgcaatatcattacataccccgagcctgagccagacagttgagcctttcccagattcctgaccctcagaaactcttattttaataaattcttatttttctacattg

SEQ ID NO: 186397 - DNA, 1147 bp, Homo sapiens
  misc_feature (817)..(817): n is a, c, g, or t
  misc_feature (833)..(833): n is a, c, g, or t
  misc_feature (926)..(926): n is a, c, g, or t
gaagattataatacctgtgagggagcatttggtgcccttcagaagatttgtgaagattctgctgagattttagacagtgatgttttagatcgtcctctcaacatcatgattcccaaatttttacagttcttcaagcatagtagtccaaaaataaggtctcacgctgttgcatgtgtcaatcagtttatcatcagtaggactcaagctctaatgttgcacattgattcttttattgagaatctctttgcattagctggtgatgaagaaccagaggtacggaaaaatgtgtgccgagcacttgtgatgttgctcgaagttcgaatggatcgcctgcttcctcacatgcataatatagttgagtacatgctacagaggactcaagatcaagatgaaaatgtggctttagaagcctgtgaatttggctaactttagctgaacagccaatatgcaaagatgtactcgtaaggcatcttcctaagttgattcctgtgttagtgaatggcatgaagtactcagacatagatattatcctacttaagggtgatgttgaagaagacgaaacgattcctgatagtgaacaggatatacggccacgttttcaccgatcgaggacggtggctcagcagcatgatgaagatggaattgaagaggaagatgatgatgatgatgaaattgatgatgatgatacaatttctgactggaatctaagaaaatgttctgctgctgccctggatgttcttgcaaatgtgtatcgtgatgaactgtgccacatattttgccctttgaaagaattactttttcatcatgaatgggtgtnaaagaatcaggcattnggtttaggagcaattgctgaaggttgctgcagggcatgattccatacttgcctgagcttattcctcaccttattcagtgcctctctgataaanaggctctgtgcgtccataacatgctggactcttaggcgcgtatgcacactgggtgggtccggcagcggccgacacgtcccgacggcataatgacgactggtaagcgctcgtgtagcacagaagtacacgacgcggcgcgggcttgtcacctacaggaagcggagaaccggcaaccaggcaatactagaaccggcctgcatcacatacgacatacacgctca

SEQ ID NO: 186398 - DNA, 347 bp, Homo sapiens
ctatctctatcctcctcccaaacaaatcagtgatctcaatgagtcttaaccctttgaacacccactctcattattgttgtctagggcaatgcttttcactctctgtggggaaagaccagttggctggagttttttttttcttcattccattgtgaactgatacttttgtaaaatacaatgaagagtcacaataacgtcaaattgctatagaagttttgaaacttttaccctcactttttccacgttgctcaccacagattgtgacagacagttcctagacaagcagcggtccagactacattttgaataacaatggcctagcttctttcaccttaaaacacataggt

SEQ ID NO: 186399 - DNA, 277 bp, Homo sapiens
ctgagcccaccagaccctgaaatccagaactccaaaaaaagccattattattagtaatttttcctagagctcaaatctacaccattaagcttgacaacaaagtccaaatgatagttttaaccagatttagatgaaccgtgcttcaccccaaaacacacaaccacgtttcaaggtactttgtaatttgcacatccatccctagggaaacgcctaggaatggaatacgtttctgagctctcattatgatcattatacacagcctctttccaaaccacat

SEQ ID NO: 186400 - DNA, 299 bp, Homo sapiens
cttccatgcccactagactctctaatgaagcgtggctgtctctctctggaaaaaactatggaattcttcccacccaatgctcctagcagccacaaccaaagggtcagaggtgacccttacaatgaacccaatttgccatccctcaattagatgtttaagattcctttccactttaatatcctgtggtgcaaatctaagcaagcctgcttgtttggccacatggaggtacatgttcctgcaaaatcaaccccaagaaatcctgttgctcacaggtaagcaggtaacccctgcttccatag

SEQ ID NO: 186401 - DNA, 183 bp, Homo sapiens
agagcgcctttcttctgaggggagaaggatttgtgaggagcagtggttgtgacgtccactcctgttgctttttccagttttggtgtccacataccttggggaagctgtagaattattttatgcctaatttttctctttatagaaaattattattgaattatctgcatagttcatagttttgtt

SEQ ID NO: 186402 - DNA, 414 bp, Homo sapiens
tcctgggagtacaggcatgagccactgcacccagccacaatgggactatttttcaggaagctctgctaagttgtgctatgatctttgttaatactaagttgttgttaatatagtacgtaaccctacagagattctgttacatgcaaatgagagcttgttaaagatcatgcaaatgttggcattcaacttgggtttttgtaatctaggatttactcttttatttccagattcttaactaaaaactatttctgtccctggggaagattttcattccttctgaaacgatttactggttgttatgcacacacagtgggtcgctgataaaaatggaagaatttattacatttagggggatgggatgtggaaagcagacagctgacagctttgcattcttgtttgtaccagactctagac

SEQ ID NO: 186403 - DNA, 417 bp, Homo sapiens
gactctaaggatccccgtaaggcggatgttcacatttggggactggtttgtccatgcccttgggtttgagctttgtctgagctccaagggaatgggaactggacgttggtaatctgtgatgtgctgtggcatcgagttaatcagactgttgcctacagcttgtctttataaagtaccaactccagcgcatgccccgggagcccaagtggctgctgtacttgactgtgatgtcaataacgatgactgtaagggctgtggcgtgggacggattcttctcagtgcactgcgtcacttccagaaagaaaaccactgtgcccagctgacgcctggctaattttttttttttttgagatggagtttcactcttgtccccggggctggagtgcaatggcgctatcttggctcactgcaacctct

SEQ ID NO: 186404 - DNA, 248 bp, Homo sapiens
ttcatttgcttaagaaccttcctcaaacaactacctccctctagagattttttcttgtctgtcgataaatatgactgaatccttcccattttaaaaacaaaaccaaaaatagccctcctataaacagtgatcaccatgatttctactttgtcacattcacctctctgtagtatctaatagagaaacatttgtttttcctaagaattgagtataccctagagaaactcctattccattactatgcgtcc

SEQ ID NO: 186405 - DNA, 269 bp, Homo sapiens
tgcatcctaaacccatacaaggatgtataaatatagaaaaatgtattgagttgtaattgtactttatgtaggttaatgtcagttttttttaagtgttttaaaaggcagtgtaaaagagctggaagttagtatgtacacagatggccatggcattcagctggggctggtacagggtctgtgggactggttaggggtggggcaggcggctcagttctgacttgggttggaagagtggaatctgggcaggcttcccctaaggaagtggctct

SEQ ID NO: 186406 - DNA, 152 bp, Homo sapiens
atgtgttcgtttaagagactgcttttaagactcgtgtttttatttagggattgataaatatatggtatgtcagaaggataaaacaagtaaattttaactgactaaaatggatttatttcattgtggaaaataatagagggtgctactatgca

SEQ ID NO: 186407 - DNA, 428 bp, Homo sapiens
tgcatttgctgctgaggctccttggagctacagtgatacaagcatttcatttgtacctgtgttcctgtgtgaaattctcttcctagtggctgtgtgtggaccccagtcctatcccagtcctggtccacacttgactctgactggttgctgtactgccctctccctgagtgtaagccccttgcggactaggcccagtttgttttgctcaccatcatatctgtagtactggcatattaccttgcacacagtaggcactatgttataaactttgtatttctttaaagaagcatttttttaatagtttgagtactctgaaatcgggatgtacctcataatcaatggtatcttacctgaaatgtgccatttgttgaatgaataaatactgcattttagaattatttcagagattcttcttcaattgcctatac

SEQ ID NO: 186408 - DNA, 491 bp, Homo sapiens
cttatacaagcttccacagaatattagagatagactagagtgccctttatttcctacacaggtttgtgtattggaagagtacctaaacatactgtcaccaaaacaggatcatttccctcatccctcctcaaggaccttattctgtcagttacctcgtcttttctgtatcttctattgcttcctctccactgtcctttcaaattattattaatagaatactcaggacttaaatattgtaataaggacattgccatcacctatttcatctagacataatgtcatgcttcttcccttcccttcattgcccacagtggcacacgactcactattttactccctcaagttccattctaaattcagctcttctaaaactgttccagctggggtcgcagacaaatccatgggacgatatgtagtcttcgtctgtcccaatttttgtgtagcatgaaaactcttgacaccacacactacaaactacatttcatgggagg

SEQ ID NO: 186409 - DNA, 321 bp, Homo sapiens
tgcattaagtatttaataactgtactaataattacaaacacttttaatgggccacttgggagccttaatgtggttaaaaaatgtatttcttctctgtcaagttaacttgtgtcaaattgagagaaattcttctaagcagctttgaaaggtttgagcttcataagcctaggagcaagtagcatattgtgaaagtagtttttatgtaagaagagacaacagaaatagggtgagtattaatgtagtgctttgtacatttcctttatagttttgtattttttaggtggagaagtgtcccaccaccctgttgcatccgctgtatgt

SEQ ID NO: 186410 - DNA, 160 bp, Homo sapiens
agaagatgatgtgtaatcatttttaaatttaaaagaaggcacagtgctacaaatgggtaattttgaatattggaactatggacatgtttttggaaaacccatctgttttcatgtttcttattttaactcgaatggggacttttattcagaggaggatttg

SEQ ID NO: 186411 - DNA, 262 bp, Homo sapiens
gtcttgtgacagagctttcggcacataacacagtgcctctcttctctgtctacaacaaaggccagccccgtggagagctaaaaagagtgaggaacaacaggcagacagatgatcctggagcacgttcagggaggagggcaggagccaggtctggctcagctccccaagtcagcggcacttcttgccttcagctgaaggcacggtcaaccgagaagccccggtgaacccacaagccacggtcgacccacaagccacggtgaaa

SEQ ID NO: 186412 - DNA, 600 bp, Homo sapiens
cctgttcctcgctgtcacacatattgaatgccagttcccgttcaatctatttcctaagtagctatttcctaaatctctttacttttcattctccccttgctgctggtccaagccatgagtaccggtctgaattattgcagcaatgtcccagctggtctcctttccttcagcactgtccttccccaatacactctctacagcacagccaaatactacaacctcaaagactttcccttttgttggaatgaagtccggaattcttaacatggatagcaaggcctgttattttcccttccttgtattattctcagcttcatctcccatcattctccagagcatgtgcaactgtcctctctgcaccctaaactccaccatatgcacattcagtaatgtggtaatgtcaagaactctccactttccaactttgcatatgctcttgcctctgcctgccctgtccatcatcttgctaatttctattcacactgtaggctttagtgcctcttccatgaaccattcatgaactccacatcacccagtcctaaaatcaaggatgactgcttgcataacatcctatattctgcctcatcctggaagtgatta

SEQ ID NO: 186413 - DNA, 198 bp, Homo sapiens
ccacctcagtctcccacgtagctgggactgcaggcgtgcatcaccatgtctggttaatttttgtatgttttgtagagaagcaattttgccatattgctcaggctatctcaaactcctggactcaagcgatctgcccaccttagcctcccaaaatgttgggattacaagcataaaccactgcgcctggccataaggtgg

SEQ ID NO: 186414 - DNA, 212 bp, Homo sapiens
ctcatcatcatccaatttattcctttagtttatattaccacaactctcctaaacgtcccaaagtctattattaagtctaacaacttagcttcgaacctcaacccaagcatctgacaacacactgaaatgtgcaagcaagagtccctatggccgggtgcagtggctcttgcctataatcacaacacttcgggaggctggggcaggaggatcac

SEQ ID NO: 186415 - DNA, 471 bp, Homo sapiens
ctttgagaaccactatgaaattgtttagtgaattaaattattatgcttttcgctattcacatatccacttccattgactgttaaggaatatgcttcaaggaggacagatgagatataggtaaagtttatttttaagatacttaggtaaaacaaaataaaccagcaactggcagatgtttggtgaccttgaaatctggcttttgttttgagacagtgtctttaaaatgaccagtgccacaaatgtaaacaggggagttggagggcattggagtattcaggaagaaagtgagaaatcagtaatttgtagaacatgactaactggaactattgtttggtctgctggggtttgagggagtagaggaatttgtgaagaaggaaagaaggttaggagatgcatagagcagagaaacaagggtctaagctttcctaggaatctcaggtcagacccttgttaaattttgtccgtatatt

SEQ ID NO: 186416 - DNA, 357 bp, Homo sapiens
aaagtcactaaagtatgaggatctattttccatttgggaaatatgctcttcttcggaaagactcaggttggaaggggagcattaaatttagaagagaaagatttggtacttacaaaatacaaaaacggtgtgattcatgttttctgaaatagctgctagtcagcttttcaatgtactgcatgcattcagtccactgcaccgtctcattttctacccattatcaatacaaaaattagagtatcttgacaacagatttttcacagtgggattcactttattctagggtcttttctagtaaaaataaaatagcaaaggaactccattatctagaagattttcaatacagcctattccagc

SEQ ID NO: 186417 - DNA, 687 bp, Homo sapiens
ttatctggaagtggaaaggggtcatcgtattgaagggtggggaacatgctatttacaataactgacaattatctgcaaatacagtagttaaataaaatggatatatccataaaatggaatattatgcagctgcaaaacaaaggtctcctctacaccctgatgtgaaaggatcaggaaggcttaaagttaactggaaaaacaaaacaaaatctaaggctcagtgtgctatctttttgtgttgggagggatatgaatatatatatatttacatgtccttgtacgtgcataaagaaattctggagacgtgtacatatacaaattaataaaaaatatatatttgtgacagagtatgagcacaaaagaggacaacagacagagtggcagcaatgctgtatatttcttagcttagctttagctggcatgtcttccccttaggaaggaaggagaatagcatacaaacaggtagcagtaaggatccagatgacagtatggatctcaaaaagtgggaagttgagcttgaaaggggcttccactagcaccataatttgagcgataaattatgctaataaaaaattacaaacaactgaataaaataagaacccatgggtccatactgatatgaatgaatgattgagtgagtgaatggagagaagtaccaaatcttacagtaaaatatcaactaatgta

SEQ ID NO: 186418 - DNA, 699 bp, Homo sapiens
gagtctagctggggagacataagattggaatctatatacagatagcccagtaaggcaagctaggtccagtggtgaaactgatagggtttcaccagctgaggtccccaagggtgagagaatgtcaaagaagacttcctggaggaggcaagttaaaggggattatgggttgggcaggtggacagcttcctgatccactaatcagaggaacactgaaaccacagggatccatcagaaatctgctgcctgttaactcaggtttccacctgcagcttctcacatagctggtggaaatgaaattggtgtcccttttgccaaaatagacaatgcccctaagtagaaagaaaagctactcctccccagcaccagcctacctctgtgggggtatttctgcaatgtgcattgcaagttgctgcatccactggccagtctggctctgagatcagccagctggcagcctctgcagtgggcatggctgggcagcctgaattctgaaaccaattaatgcactgcaaaggacggtttaccaagaaggtatctgcaagccttaaaaaatatctcctaaaaagttgtccacttgtagtcccagctactcgggaggctgagactggaggattgcttgaggctatgagtttgaggctgtggtgagctatgattgcatcaatgcataccagcctgggcaaccaagtgaaacaccgttgc

SEQ ID NO: 186419 - DNA, 194 bp, Homo sapiens
atctacagactaaaacccctcaataagcatggatacagaaatcctttaaaaatttagcaaatcatatccagcaccatataaagaggataacaccctatgaccaaatgggatacatttgagaaatactaggttcacatgattattaattatacataagaattatatagaattgtttaatacacaatagtaacagc

SEQ ID NO: 186420 - DNA, 722 bp, Homo sapiens
taaaatcttgatcatgttttgattggggttgtatagaatttatagatttattgggggattaaaatggagcaaaatattagctcttaggattgggatctggcacagggcaagcgtgcataactttttgcggagtcatgacccactgtctgtggaaggtgggaaggtgggcgtcccgcgctctctggacagcagaggccctctctggccctgggtcaggatgctcagtgtggggcagtggaaggtgctgtcattttctcccgaggcatgcagacaccagggattcctccagaggctctgtcggggcctccatgagatacaaagtgctggacgggaagggttggttccaacaccattcactcgctcacactcatcaaatgctcactgagcgcctgccccatgcaggtgctgggtgctgggtgctccaggggcaggcaagaaactcccgtgtctctgaaagaccttcctccagattcccaaaggcgggtgtggagcagggtggggtgaccctgaggaagagcccctcactgcagcctggaggggacagtctctggggtgggcttcacaggataggtcagttttccaggcaccaccaagaatggggctttgtagggagaggacgtggcatgtctggagacacagtggtgtggggtgggggctgggagggggtggcccgagtcggggaagggcagttggagatgaagcctgcttgaatcttgcttgag

SEQ ID NO: 186421 - DNA, 606 bp, Homo sapiens
ttgttcaatttccacctataagtgagaacatgtggtgtttggttttctgtccttgcgatagtttgctcacaatgatggttttcagcttcatccatgtccctacaaaggacatgaactcatccaaaaaggtgtatgatttttacagggaaagacatacttgataacctaaatgactgcctaacaaaaaatatacttttaatataaatatttacacctaaaatttatatcacaccttgttggctttgaaaagattttggaaaaagtaacagaatgatacataggttattaagcagaatttttaatgacaactttatcttataaaaatgacataaaaaatcaaccattaatttctcctgttgactgctacaagtcaatgagaatactgggtatttctcaccgagggtgagaaatttttttatgttatagataccgcaaattcactactactcaacacttttattgaaaacaaactggaatcaaaaactaagctttctatcagttacttaattcaatctactagtcattgaaacattggtcctggattatttcctcaaagtttgtgacaatatgggggaaagaacactcatatactacaggtggcaatgt

SEQ ID NO: 186422 - DNA, 159 bp, Homo sapiens
gagtgagtaccttcaatgagtgggaaagaataaacggcttcaaccattgcagacatgcccccaaaagaggaattactatgcctgctgagtttgggcacccccatcataagcattctctctgtttcaccagagttttagatctagtgtattccccatgcc

SEQ ID NO: 186423 - DNA, 535 bp, Homo sapiens
tagctgtctagaggatcccacgctgacctcttcccacagttacatgtctgcagtcgttcttaaccaaagctttcagaatacagaactactgatcctgaaagttgatcttaaaactcctgatcctagaagcccgaattggaggtggaagtagtattttctcaaattggggtaaagacagtgggagggaataggagtaaagtatgcataatttggtatgtaaagaaaaaagtacttttctttagaatgatgatatagatagcaagctaaacaagtgaatgtaccgagtgggaaaccagatgacagtagtgagcatccaggagtgtgagtttgtcatgggggagggagaagcacctaggaggcagatcagggtcacagctgcatgttttaagagtgaaaatagtggcctttcttaggcacataaaagtgccacgcactaggctggccactcagctttcacaacagaggggaggtatttgtatagtatgtgcttacagatgaggaagctaagactcagagaggttaagtagcttgccta

SEQ ID NO: 186424 - DNA, 269 bp, Homo sapiens
tgtgaaagctctaagctgcaagacaaagatttatacaagacagaaggaaaaggaagtcacagggtaatctgaaatacagcaaacatcactttccaaaaatatgctgtatatgcaaatgtgtgataaacgtcattagagtaagaaggaaacaaaggcacaacgaaatggctggtaaacatcacagctgccttctaaggagggtggattctaaccaaagaagcctcaggctccctctgcacagctgctggcagtgtgtagatggcagttgg

SEQ ID NO: 186425 - DNA, 709 bp, Homo sapiens
tcctctgggaaaagtttatgtaattttttcttacatattaaaattataaaggataaactctccctttgtttttgttgttcaaaactggtagtttttcttgaatttttatatttatgttttttgtcactatccacaccatattttttccaaagcctgagccactctgtggttcttgccccaatataacaatcatcccttcactcttagaattccttttcccttgtcattttgcctttctacagtttataaaaaatgaggactttggggagggaaaaaacccaacatttctgtgaactcgagactataggcagtgcctaaaccagtaggatcaggcaaataaaactagttggacagcagacatatcatgaactcttgcaacagcgtgttatctgtatgcatgtctaaagtgttatactgattcactattacaataaggatcatgcagttgaccagggtgaagcaggactgtctacaggattatgtgaattgtggtggtggagacagtatacaagattaatggattaaaacctagctgctttcctggaaaatggcctatgttctaaaagacaaaatctagtttttatttttttaatttatgaagctacaagtcaataatatgctagtgcttctggttcaaaatgaaagcaactggctatggtaatgtagagaagacagcaggaatagcaccagaatgttcgaggctttttaa

SEQ ID NO: 186426 - DNA, 336 bp, Homo sapiens
gcatcctgtggtacagaggatgtatttaccagtcttctcttgagatggatacttaggttgtttctgacctgtttttatcagaactacaagaccgtgtatatatcctggaatcaacatatctttgcacatgtgtgtgatcttatgtgcaggataaattcctaataatgacagctacaatgtctatttttaatttttctagataatgccaagttgcctctgaaaaagctgtacaaatgtatgtgatccacagtgtttgggagtgattgttttcctgttatcactatggcatttcatcaacaattttacttctgccaatctaataagcaaaagtattct

SEQ ID NO: 186427 - DNA, 310 bp, Homo sapiens
aataagtgtttctttaaaataaaaacaaaacaaaagcacaagtaagagaatgaataggtgtccaactccattcccaggatattttgaaaatcattagctaatacttgagcacttgtcaggagcacacgttgtttcccagatgctcattgccttctcaccactctgcataatcctaacacatgacacattagtttcagatgagccagatgccaaatgggagacattttacagtacagagaaatcagagtggtggagtaatacagaaacttttagccaaggcacattctctgggctctcaatcctttgcagc

SEQ ID NO: 186428 - DNA, 169 bp, Homo sapiens
taaggcagagcataaataaataactctaatggagggtggaggactcacagtagtagtaccatgaattacaacataaatgcctgaaaagagcctaggacagcatctgtgtgtaattaatagtcatgatgatcactcctaagtcactaagaaacagtttaaactttgcatg

SEQ ID NO: 186429 - DNA, 537 bp, Homo sapiens
tcatggaatacagacacagtcattactcagttacccttcaaagcctaagacctaaagacttgattggaccacaagaggaaaccagaaatgccaaagatgtatctttagccctttatctatgtaaatgttgtgctaatccaataaggaatgaataacaattctccttagtatatggtggtgagaataactgatacttttaactctttgacaatgatactattgtacagatgaatcacaagagatcagtttatttaggtattattctaataatggttagtggacagttttgccttcaagcatggaatcagtctaagaaaatcttaaaagctttttgaattcacatcaatgtcatcacaggagtagttttttttaggtggaattgatgtttactatgcccttaaagcaataatattgcactgtaagaggcttaacacatttttaacaacctctcttaccatcctagaagcactgctggatacatgttttcaagttgatgtggtttcagtgcagaaaggttctttaaggtagcatgaaaca

SEQ ID NO: 186430 - DNA, 231 bp, Homo sapiens
tgcgtgtgcactgattacaactactcctgtgttgtttacaaagaattcccaaggctatgagggaaagaagattagagaagctcttgtacatcctcttcttttgaaaagagtgatgcttgtcatgctgaatggggaaaaggtggaagcaattgccttggcaaccagagcaagacaaggctgccctctgtcaccactccgtattcaacatagtactggaaggtcctggcctaa

SEQ ID NO: 186431 - DNA, 118 bp, Homo sapiens
tgaatctgctggtacctctctcttctggggtcttcctttcctaagagtttcaaggtaacctccaatgtcatcagggaggtttgagaataactcagagctccctctcacccccaccctg

SEQ ID NO: 186432 - DNA, 354 bp, Homo sapiens
cttacttattagttctaggagtttttttgtggatgccttgggatcttctatgtacacaatcatgtaatctgcaaatatggggtcttattccttcttttccaatctatatgacttttacttccatttcttaccttattgcactggctagaaattacagcactatgttggataagcggtgagaactaatatccttggtttgttccccatcttagggacaaagcattcagtctcacccttaagtatgttagctgaaggcttatggtgtttaccctttatcaagttcaggaaaatccccctctatgtctatttttcctgagatttttaaaatcataaatgtgtgctaaattttgcatc

SEQ ID NO: 186433 - DNA, 616 bp, Homo sapiens
tggccgcatttttgccgtcttagaagtcaactggattttcatagctgtttctgccttcagtctatggagttaagatgtttcattggaagtataagaagacaatacagcctcacacaggtatttggttggaaaagggagaatagtttttaaaagcctttaaaaataattgttgatatgctcctttgatacactactaggtttcttttttcccccccctttttcgtaggacacatgctcaaagagatactaggtttcttagaggctagttgcaatgtggaatctgaaaccatatccaagaatttttttctactttgttacattaaaatccattggtctgtcagtgtcttgcatctggaatggatctcttacctgtgtaagatttttaacatcatacactgcttatttggaaaataatggttcagtgagttatgcagatcttccaatgttgacacattttcttatatagtatcaaacaataataattcattaatattacctctaaactcattaagcgtctttgatttttaggaagttgtcaggcttacagtggcagatgaaatctttctaaaattctgatttttctactgaaagcttaaattttaagcaacaatcttaa

SEQ ID NO: 186434 - DNA, 1050 bp, Homo sapiens
tatttatggtatttatcaactaactgctgtgtactatgctctattgaaaatgttagcaatatagtaatgaacaaaacagatgttatctctacccttatggtttttatattttaataaaagtggcagaaaagaaataggtaaaacaataaactgagctctttggagaagaggcccacgttcttttcagattctgatttctccgtgatataaatagttttttaggtgatcacttgtttttaatgtacctacctatctatacctttctctctctctctctctctctgtgtgtatgtgtgtgtgtgtataaaattacatatccagtatgaaacctaaaaataagattttggggcctgtgaatttttttaacctttcttaacctacatcctaattatttgatttgacattgtgatgaaacatactgttgttttgaattttggaaatagaccagtgattcttcagtagggtcgtaaggtcccgtcaatgcagcagtcaaattttttcttggtgggggggatgcatatgtgtatgtgtgtgcatgagtatcttgataatttagaaagattaattaaacattgatcatctatgtgaccacatttaaaatgagcaccaccacatccaaatgtctgagtttacattttgtgtcggtacttgctttggcagaactctgtgcctttccccaagtcttctgtgaccttctcacctggcctgcatcctggtccttatcaaccgtattttacagttaaggaaactcggctcaaactagcttcggggactcgctgtggccataggtgccctaggctgcagtctgagagtgaaactgaggtctcactcccttcatagtctgctctccgtctctgcctcatctggcttctcagggtggtggggcgtgggcactaatttgatttgatcacttagagacaacagcttacaaaatgctaccgagcagtgcctgtcctttctgagaacttgatataataacgttggcttgatctcctcagcctgtgtcttgagggaacaagtaaattaaacaagtaattagatccataatgt

SEQ ID NO: 186435 - DNA, 209 bp, Homo sapiens
acttctatatgtgatttgtattttttattataacctcatatttgttggaaatctatctatgagaatcctttgggacctaggtgaagatattctaaagagaatctgcatttttccttgcctaactcccataagcactaccaacccagatccactttaaaattatttcgttgcaattttcagaccacacacattacataaattaaaacccc

SEQ ID NO: 186436 - DNA, 176 bp, Homo sapiens
aggcatgagccaccgtgcctagccagattacttattttcagataacccatatagccttggtgtgacatagctacttcagtgtttcttgctagttctatttcattatattttaaagcagcttgaattttaatttttgtttacaaagtctattttgtggacttatctgtgtaaaaaga

SEQ ID NO: 186437 - DNA, 801 bp, Homo sapiens
  misc_feature (732)..(733): n is a, c, g, or t
  misc_feature (737)..(737): n is a, c, g, or t
  misc_feature (754)..(755): n is a, c, g, or t
aggggtccatacggcgtgttctggattcccgtcgtaacttaaagggaaattttcacaatgtccggagcccttgatgtcctgcaaatgaaggaggaggatgtccttaagttccttgcagcaggaacccacttaggtggcaccaatcttgacttccagatggaacagtacatctataaaaggaaaagtgatggcatctatatcataaatctcaagaggacctgggagaagcttctgctggcagctcgtgcaattgttgccattgaaaaccctgctgatgtcagtgttatatcctccaggaatactggccagagggctgtgctgaagtttgctgctgccactggagccactccaattgctggccgcttcactcctggaaccttcactaaccagatccaggcagccttccgggagccacggcttcttgtggttactgaccccagggctgaccaccagcctctcacggaggcatcttatgttaacctacctaccattgcgctgtgtaacacagattctcctctgcgctatgtggacattgccatcccatgcaacaacaagggagctcactcagtgggtttgatgtggtggatgctggctcgggaagttctgcgcatgcgtggcaccatttcccgtgaacacccatgggaggtcatgcctgatctgtacttctacagagatcctgaagagattgcacaagaagagcaggctgtgctgacacggcgtgacccagggggnntccnggtgaatggctggtccnntcctggttcctggacccaggctgggtgcgacgggtcgcgtgtccgg

SEQ ID NO: 186438 - DNA, 276 bp, Homo sapiens
tgtggggatggctgcagcgtgagttaccggacacaaatttcttcagagactacatgaagacaacaaaataggctactcattatggccttcccccactgcctttaaaaaaattctaaaattgtggtaaaagacataatataaatgttatcatcctaaccatctggagcatacagttcagttgccttagtgttgtacagcagaatcttcacacctttttcatcttgcagaatgaaaattctgtacccgtttcctcctcccccagctcttggcacccac

SEQ ID NO: 186439 - DNA, 480 bp, Homo sapiens
cctgataacaaactagcccacagtgctgagctctcctccatgccagcatgctgcagccttttataatctaactaaattctaaggtaaagccataaccacctcattcttccctggacatgtctaaaatagtaagatcatcctcatggagaaatagatcataggtattaactggtagtacataaaacaaaaacaacaaaaacattaggccattgcattttctgttaataagaagttgcagtgccccattaaattttctgtgtcaccaaagcctcccagttgtagttacacaaaggcaactttgtcttgagaaggctactgggaagatgggcctaatcttggcaagggcttggtgtaccaagaaccatgttattattttttaatcaaatgacaacacacaaaaagaaatattatttaagccatcttttcttttctttttctttttttttttttttttttttgttgttgttgcccaggctggag

SEQ ID NO: 186440 - DNA, 420 bp, Homo sapiens
cctgataacaaactagcccacagtgctgagctctcctccatgccagcatgctgcagccttttataatctaactaaattctaaggtaaagccataaccacctcattcttccctggacatgtctaaaatagtaagatcatcctcatggagaaatagatcataggtattaactggtagtacataaaacaaaaacaacaaaaacattaggccattgcattttctgttaataagaagttgcagtgccccattaaattttctgtgtcaccaaagcctcccagttgtagttacacaaaggcaactttgtcttgagaaggctactgggaagatgggcctaatcttggcaagggcttggtgacacagaaaattaatggggcactgcaacttcttataacagtaaatcggtagccgagctcgattctatc

SEQ ID NO: 186441 - DNA, 392 bp, Homo sapiens
gttacaattcctagctttatcacttagtagctatgaaattacaggcaagttgcttcccttcgctgagcctcacttgactcttttgtagtgagaattaggagcacctacttcttaggattgttgtaagaattaaataggataatccctataaagcacagtgcatggggcaagatgctcactaaacactagctactaaaattcaccactgaaagtttctgaagcccatctagtccatgttctaccctatacaatgatctcatcttattcattttcaggacgttatccctgggcctctgtgggatggctagggggcagttaaaggaagattttgcaaaaaagagtaataagttcctactctccacactgactcctctttcataacaactatcagc

SEQ ID NO: 186442 - DNA, 408 bp, Homo sapiens
ctagaggatccctcattctccccgactaataatttgagaagataaactaaaagtaaatgcattgaggggttactatttttttaggtgctgtagatatataatcatattaaattctcataggtattattattctcagtttacatatggggaaactgaggctcaggtaagttaatgaatttgcttaaaaaaatgccgcaacctatactggttccatcttgaatgcagccttttccaagccttctactttcttcaagacacaatacagtgcagaatagatcctggagaagactgggttggaattctccctcccgtacagtcctaattgtttgatttgtgtaaagcattcaatttttctgtctcttaagttttcttataaaggagataacatctctccaaggaactgctgag

SEQ ID NO: 186443 - DNA, 409 bp, Homo sapiens
gatcagcatagaggttatggaaataataatgcatcactgtggcaaggatcgtgttggaggtcataatcttcacaccaaacactgaggctgaaatatgctgcttatcaaaactgccacctgctataggagcagctgttgatccaggacccctgttggcctccagaccaccttgtttgagggcattcaagttgctcccactgggacttctcactgtgtatatgtgcaagcatatgggctcttcaggtcaaactgtggaaagctgtactggaagaaatttaaagtctctacaataataaaattctattttgaaataatatatgaatgtcagtagacttcagcaatgcctaaagtgtatgaaaacctaaattatgaactacacttcttagaaaataaaaaagtcttttgtttg

SEQ ID NO: 186444 - DNA, 369 bp, Homo sapiens
acgttgacacttcaggaggtcctgatgatatgtgcccaaggtggtcaggccacaacttggttttatacattttaggcagacataaggcatcagtcgatacatgtaagatgtacattgcttgggtctggaaaggcaggacaagtggaagcaggggcttccaagtcataggcagattcagagattttctgattggtagttagttgaaagagtttttatcactagaaaggaatgtctgggttaccataaggaattgtggagaccaaagtgttgtcatgctgatgaagccaccaggtaccagatttcagaatagactgtaaatgtttcttatcagacttgaagagtatgttttatgtttcttttttttttttt

SEQ ID NO: 186445 - DNA, 323 bp, Homo sapiens
ctttaacctctgagagctccgtctgggacagactgccctttagtatatgggacatgttccctatccattccactgtgctcccacatcttcctgttgttaccactggaaaggaatctacatggactacattaaattttatccctaggatataattatatcccattaaattatatccctaggatatagtttaatattacgcccttgtagctttcattgattttttatgaaataattcagacgtataataatcctccatgcaccttctaccctactaaagaaataaaacactacaatacaatcgaacctctaatcctccctaatcc

SEQ ID NO: 186446 - DNA, 349 bp, Homo sapiens
  misc_feature (313)..(313): n is a, c, g, or t
  misc_feature (332)..(332): n is a, c, g, or t
  misc_feature (342)..(342): n is a, c, g, or t
gaaatttatagcttgcccataccatgcctttaaccctctcctatccatagggtagatgggctgagggaagccaagtgagcagcaggcatgcttgggcaccagcagggtagaataatgtgtggaggagggagggggcaatgacacccctcccctccattctatgtgtccagtcttaggcccctgctgccctcctggctctcagtggagagaaaagaggaaataaatttggacccagccttgagatcctggaagagctcaattggatgttggtttggcatcctagcatctcctcacaaaattatgatcttccctngggcatttctaggccaccnaattgggttngcctgca

SEQ ID NO: 186447 - DNA, 304 bp, Homo sapiens
aggctggctgggtggaattgtcttcccacctgtgagtcacactttgtcagcactacccagtatagggggggaaaggtcatttttttacctgccttatcttggaatcttttcagcagtgcttccacaagagaattaagccctactaccctgaggcatccatggtacgtgtgacttaactttgtcttctacatctcaagctgggaaaattagccagtcagatcccgctgggtgttctgtggttaggctctcaaagaggctggagttctagggccgggcatagtggctcaagccagtaattccagca

SEQ ID NO: 186448 - DNA, 376 bp, Homo sapiens
atcagggattttatttccaaagattctgagacacctagctcttaccaatgttctgccttccccattctaggaagaaactccacttaatgtggagcatgaagtgactgaggagtcacagaattgtgtcattcttggccactgatgttggggaatatttaataatgctacacaagaagtttgctgggggaacacagagggagactaagcaggaaagattatttcctaccaaaaaagcttagaaacatttctcaatttaagcagcatgtcagctagtgtgcagttgttagcagagagacctgcttccctccaacagactgcaaacatatagtcacacagccatttctgggcactggaaataaaaaatacatatagtgga

SEQ ID NO: 186449 - DNA, 391 bp, Homo sapiens
aaaagcctagtgcctcacccagacttttgatgaaggatggatttgaagttacattctcttagcctaaaactgtctcttaaagctaaggaaagtattggagataaaagcgtgcaagcagactctacacagttgggcaagtaaccttttgtaaaattttaactttggccaaaatgcccagttgctttttctaaagaaggtgcttgtattagagacaaaaaataaattaataactatattaaatgatgtgccaaaataggtaccctcacatttaattgtacctttctctggtttatattaacaaacacaatggtttgtcagaatttttccttaaaacaaagttttgggtggggaaaagagttattctttaattcatacaagaccgcgctttgca

SEQ ID NO: 186450 - DNA, 578 bp, Homo sapiens
gttttcctcctttccatttcctcctgaaattctactccaggacccatttcaaatgccaccccaccatgaatatcttactttcaacaggatgtgcccatgccccctcaagcaggcagtgtcagccttggattacaggtatttatgggtatggcttattctcctattaagttcccaaaaaacacactgtcctttgcatcctgtacagcagggtttcctaaactgcaggtttcagcctatgaatgggaaattctaaaaaaaagaaaaaagagaaagaaagaggataggaaatatccaagtgtatcacacatagtaataagcgttatttcatgatgctcttgtttcacttacgtgtatgcatgttcaaggggtggtgggtggcagtgttaaacgtgtatttgttactgggggtcatggtctgaagcatttgaaagtcactgccctgatggtacctctcctctgtctaatattctgtgaatgcttattgaattgaacaggttgatgagtatgaaatgatccatgtattataacttcaaaggctccaacttaaaggaatataaagaataatgcctatctgaaca

SEQ ID NO: 186451 - DNA, 755 bp, Homo sapiens
gttgactctctactggtcatgagtatatcacagcagcagtttgtttgtttgttttttaccttttggattttattttcactaagttaatcataataataacaacaattataattactgagctcttaaatgtactgtctcccatagttttcacaacaaccttatgagaaaagtactgctgttatttttcccattttgaggaaatgaagaagccggccatgcaagtttaagtaacttgccctaagtcagtgtctcaagctcagcactactggacaactgggcccggtaattctttactggaggggtagaggggctgtcctgtgtaccacaggacagttagcaggagtcatgtctttacccacaagatgccaatagcagcccccatccagtggtgataactaaaatgtctccagaccttgccaaatgtgccctgggggcaaaatcaatggagaagcactgttctaagtgatgctggagatgagagtcaagaagccagggttctggctgaggtcttaccactgcaaaggcgccacggccccctcccaagagaaggcatcaagccccctttgcatgctccaagcaaaggagccggcaggagctcttgcctctgtcgcacacacagtctgtcagcactgcagacaggcctgaagcttgacaaatatcaaagtgagacaaagctgtaccaagtgccagcaatttcagacacagagtaatccttcagtacaagtaatgccctgtgtaactttcttcctatccta

SEQ ID NO: 186452 - DNA, 595 bp, Homo sapiens
tccatttcaaaaaaaaaaaaaaaaaagaaagaaaagaaaagaaaagaaaagtaagcaaaaatatagataattcatagaaatacacattaatgaaaaatatattttaaggaattcaaacacacaaggaacaaaatgatggtttaaatgcaattctgtgattctagttttcccttatcaaattagcaaagataagaagaatacttcaatctagtgtacctttgcaggaaagaaagccctttcatgtacacttgatgaatgtgtaaattgctaaactcttttttgaaaacaatttgtcaatatatatcaacagtcctaaaatatttatgcccttttctctagtaatttcatatcacaaagttgtcagagagatgcagaccaatatttatatcctgggatttcattgcagcattatttataataatgaacaattggaagcaactcaaatattcaacagagagcaattataaacaacattatgatacatcaagaaaatgtaagattatgtggctagtaaacattttgtggtatggtttggatgtggtcggtccctgctggaatgcatgttgaaatggtcgccaatccgcgggatcctcta

SEQ ID NO: 186453 - DNA, 649 bp, Homo sapiens
cccggctaatttttgtatttttagtagagatggggtttcaccatgttggccaggctggtcttgaacacctgacctcgtgatctgcccgccttggcctcccaaagtcctgggattacaggcttgagccaccatgctcagccgttttgttttgttttaaaacctggtctgcaggaataggtgagacttagcatgacctcagtttatgtttgaagaggccatttttctgccttgtaacatagtagttaagaactagattgcctgggctcaaatcaaggctcagctacataattgtgtcaccttgagcaagttttgtgctacagtttcctgtctgtaaaatgggtgtaaaaaagagtacccattttatagagttgtgctgattaaatgaatgaacatatataaaacatgtaggatagggcctgccacataaatattaactgtgatgatgcagcatcttttttaggttgtccttttgagggaatctgtgaagattttgtttgtttatatttatgcttgaaaaatcatatagcaaaacttaactactgttcttggaggaggaggaaagcaggtattgatctttatgttactggtgcttttaaattccttagctctacctggcctttgcctaacattttaattttgtgacccatca

SEQ ID NO: 186454 - DNA, 222 bp, Homo sapiens
aaccaaagctggttacagaaatcaaaacagtactaaggaaattactgagaacctcaaaataatagtacatatgtcacagagcagttacaaagtttacctgatgtaatccacagaatccattcacacatgtatagtatttggtatacaatgagacagatgttaactatcacccaccagggcgtaagctctgtgaaggaagggacttttttttttttttttttg

SEQ ID NO: 186455 - DNA, 375 bp, Homo sapiens
aaacatgctaacaatcagtctcagactttctctttgccttaattaggagaattaaaggagagctgaaatgggaatcatgtttttacgctgtgattcagtgctatttaaggctgtttccacgccctaaaatcatttcaacctcatgagtcttaaaggttccactttgggaagcactgacatcatctagtccttccatgttttacaaacgaggagatggaggctcagaagaggctgtcccaaggtttagaacctgtttacaggaattcacatggaattgagtactcacatgtattgagtacaggggaattctatggacccacagcagggaagtagggccgggtcttaagatgatattcttttgatcttcactttctc

SEQ ID NO: 186456 - DNA, 191 bp, Homo sapiens
aagattttttgttgctcaggatatagagaactctcttagaaatgagagacattaaccctactagtgttgtaaggtacaactaaaattgctggcctttctgaaaatttaccttccctaatcaatgactaattaatgagcttgcctcctgctgaaaaagaatggtcacaaaacaggagtactcaaatatgcca

SEQ ID NO: 186457 - DNA, 376 bp, Homo sapiens
cagatgccttctccttaatatgaaaggtgatttcatcaacagttctgtgcctttcactagcagtcttgcaaccttgtaagtgaacagcagaggtgtccccagttaggaactgtcaaggtaaatagagtacagtgtttcagtggttaactccttccctcaaatggttatgctatcccaaccccaacacattttaaaacaccttggagctctccaaagtttatactttgctctttctctgttttattctaatcctttaacatgaagaaatcattaagttacctatcctaattcctaacaaataaatgggcaacactgtagcaatatactcttcctagtctttgaaacctagacaaaaggaaagaatacagatctgcgc

SEQ ID NO: 186458 - DNA, 367 bp, Homo sapiens
tttttgaatttcctttacacttttgttgaaaattaatgaccatgtatatgtgtatctatttctgaactctgtttttctctattctgtgctttggatatttctgtttttttgttctgtgtttctgtctttaagccaataccacattacgttttttaccaaagctttaaaataagtcttgaaatcaagtattatgaattctctaactttgttgttcttttcaaaattgtttcatatttccatgtaacttttagaattggtttgtcattctgccccataaaaagctggaactttgattgaaatttccctgaatcataggttaatttgtggaagattgctatccttaacatacttagtctaaatgcaatca

SEQ ID NO: 186459 - DNA, 2349 bp, Homo sapiens
  misc_feature (1)..(2): n is a, c, g, or t
  misc_feature (5)..(9): n is a, c, g, or t
nncannnnngtcaaaatgatggactgaagaaaacatttacaattaacatcttaaaggagtatttttctccatatacatatataaaaaatcatgttctgggtgtggtcgctcattcctataatcctaacactttgggaggcctagacaggaggattgattgaggctaggagtttgagactagcctgggcaacataatgagaccccatctataaaaaaattagaaaattagccaggtgtggtggtgcatgcctgtcatcccagctactccagaggctgagatgggagggtggcttgagcccagcagttggaggctgcagtgagctatgattgtgccacttccctccagcctgggcaatagagcaagatgctgtctctaagaataaaataaaagtaaatcccagcactttgggaggccaaagtgggtggatcgcttaagcccaggagttcgagatcagcctggacaatacggtgagaccctgtctgtaccaaaaatacaaaaagttagctgggcatggtggcctgtagtcccagctatcccagaggtcgaggctgcagtgagctgtgatcgcaccactgtattccagcctggatgacaaagcaagaccctgtctcaaaaaaaaaaagttcacaaataaaagaagacaaataggtcttaaacatatgacaagatgttgagctcactgaaaagcaaatgtgaattaaaatttcaccaagagactgtttcccacttagcagtttggcaaagataaaaatctggcacctcacggctgggtgcggtggctcacgcctgtaatcccagcactttgggaggccgaggcaggcagatcacgaggtcaggaggtcaagatcagcctgaccaacatgatgaaaccccgttgctactaaaaatacaaaaaaaaaattagccgggcgtggtgacgcacatctgtaatcccagctactcaggaggctgaggcaggagaatcgcttgaaccagggaggcggaggttgctgcaaagcatggtgaggcccaggtgaagatctggaggcactcctatgatgtcccaccacctccaatggagcccaaccatcctttctatagcaacatcagtaaggatcgcaggtatgcagacctcacagaagatctgctaccctcctgtgagagtctgaaggacactattgccagagctctgaccttctggaatgaagaaatagttccccagatcaaggaggggaaacgtgtactgattgcagcccatggcaacagcctccggggcattgccaagcatctggagggtctctctgaagaggctatcatggagctgaacctgccgactggtattcccattgtctatgaatgggacaagaacttgaagcctatcaagcccatgcagtttctgggggatgaagagatggtacgcaaagccatggaagctgtggctgcccagggcaaggccaagaagtgaaggccagcagggaggatactgttcccaggagcaccctccctgcctgtcttgtccctctgcccctcccacctgcacatgtcacactgaccccatctgtagacatcttgagttgtagctgcagatggggaccagtgactcccattttcattttagccattttgtctcctgcacccactcccttcatacaatctagtcagaatagcacttctagagcacaggttctcagtccaagctgtggaaaagctccccttatccaacagagtttaaaagtagtgacttgggtttttgcgagttgctttgtttactaaggacttgtggggaggaaccatgctaagccatgaccaatgaggagaagcaacagagcctgtctgtccccaggagccagtcctctgctcgtctgcagtcaggccactgcctgagggctctagtcattccagtggaagatgaatgtaacctgcatggtgatgtgacaactgtttcctccctgacgccagaggagctggctctagaaggttgggatcaatcctgaatttagttatgtgttacatttaatttaagaagtatagtatatataaataatacaaaacaataacccttctggggtttctcgtggcggttgaaatagtcccacatgtagtcatcagaaaataagccattcctcataccaatataggatcagctccttgacctctgaggggcaggagtgcttcctggtgtgggtattacaatcccttcctgccttgtttcgtgacagtgaaatgcctcttggtcctgtccaagtatgtctttcactgatttctgaatcatgttctacttgcttggccctgccacatgggtccagtgttcatctgagcataactgtactaaatctttttccagatcagtataataaaggagtgatgtg

SEQ ID NO: 186460 - DNA, 331 bp, Homo sapiens
atgagtaatttttaatactaaaaaataagaagtatcttgaggattcaacaagatggtggttaagaaccggtcaaataattttactcacataatagaaaattatgcagctataaaactatagaccagtgttgtctaacagaaatagaatatgactgacatttgtaactttaaattttctagtaagcacattagaaaaagtaaaaagtaacgagtgaaattaatttcgttaatatattttatttagctcaacttatttgaaatatttcaacatgtaatcaatataaaaattagtaatgagatattttactttttaaaaatgtgtttcttgttc

SEQ ID NO: 186461 - DNA, 438 bp, Homo sapiens
ttaatttcagcttttgtattggaaatgcatttggatgactttcttccctactgctgggattgaacatttgatcttctttgcccttggtcggtgtcgaccagaagaacgtgggtgtctgcgaggtagcaagagatcaaggacaagttcccatcaggagcctgacaatcccagctccaggtgtcaacaaacattgtgttttaaatatttttaggagacaagaggacctgaaaaggagtcctttctggccgggggttatctaggtcttgggagaggtgtcaggagggatagctggggccgctggcgtcaaaggacccaacaggacaaaggagggccactggtggcaagctcctgaaaggcctgtttgttttttgttttgttttcagtgctgatttccactatctctgttgggtctataaaaataataacttttacagcttt

SEQ ID NO: 186462 - DNA, 416 bp, Homo sapiens
cttgagtgagtccactattagcactattaattttgttttcttgtgtggccatagactgcattcataaaaaccaacttgctgagcaaaagtaattgattatcacaaatctattactcttattggcaaagcaattaaaaaatctatgactcttgaagaaatagaatagggtccagttcacaaaaatacaggtgtacctcattttattgcatttcgttttattactttttgcaaatattgcaagtatatcaatgctgtttttccaacagcatgtactcacctcatgtctgtttttcacatttggttaattcttacactatttcagacttttgcatgattttatctgtgtggtgatttgtgattagtgatcttttgctgttactattattattgttttggttgccacaaactgtacccgt

SEQ ID NO: 186463 - DNA, 365 bp, Homo sapiens
tcttgtttcctgcacttctgcattttcctttttttccacccctgttttagtttggctgttatttaaaagtcggtttgtttttttaatttattttttgactgcttttgcggagcaggctatcctataagcagtatgctgagagtagcgtattcagaagtttttaaaatggaagtgcaggaaacaagaccggtcttgtttcctgcacttctccccacctaaaacactattctccaagttatatcacaggtttctacctcactggttgcaccctctcagtatctttctcctaaatgagatttctaaaatctagtgtgccacagggctctattcttggccctcttctctttccatttatcctctctttc

SEQ ID NO: 186464 - DNA, 285 bp, Homo sapiens
gttacagtactcattgagctttttctggagaattattaggattcctttcaatgtttctgcctttgtgctgtattttccataaatttctagtgatcctcagttgtctctttcttttaagcaagactgtgttgagtaaaacaggaattttgtatgattttcttttgcacttgtgtcttttttcttctggtaggtctttccctgactagctgacagcaggctctaattaagatatgacaagtttatataggctggcatcaggcaagcatgtataactgttgtcaaagt

SEQ ID NO: 186465 - DNA, 761 bp, Homo sapiens
tccagcctgttgacttggcctgggccagctgtcctctcacgctcatgattgctgcctctgctcctgccatcacatacacaagcagtgcctgttcagtggaacaaaaggaaatcaaaaagaggaatcacattgtcctgtgtctctacaatgtttttttttttttaaatcatgaaaaccgttcccagaaaccccacaacagactttctgtttcatctcattggccagaacagtatcacaggagactactgggattggcatagactagctaggatgcacccttagagcccgtggaggacggcagacatctgagcagagctgggcctcagcgggcaggggatgacagggactggcaggcatccttttggtcactcagaggacttccttcaatccacccagggctggttggcatcataaactcaggatggcagcacttggatggctgtggttgctttgtctccagtgagtgccccaggaaaccatctcttctggtcgccacacggctatttggtgagctgcttgctggggtgagctgctgctgaatgggtgtggttgaaactggaagggtgaggtcccaaagccactgtctgcccctgggtgactgcaacaggtagcccccccaccaacttccaggcaaatccgtgggaaatggaacaaggtatcaaggggaacaggggagtcaggccaccagggccccactgaggaaggcacctgttgcaccatattttgacgtcttgaatgtgtatccactggcccagggagtg

SEQ ID NO: 186466 - DNA, 587 bp, Homo sapiens
ctgtgatggggcaaggattcctaaaagcatcaggatagccaaagggctatcaatagtgactcttacaagaatttgtcatttcaggatatgtccaagaaatataaaaatcatctctaaggctagtgtgttcaaaaattgttgtcatatacttagaaaaattgatgcatgaagtgggtgggttttatttagggatggaaattaaggagatgattatgttgggcttgggtatataagaaatggattctctggaataagggcttaaccaaaatataaaagttgtctgatgaaattacccagtagggctgggcgcagtggctcatgcctgtaatcccaacacttcgggaggccgaggtgggcggatcacttgaggtcaggagttcaaaaccagcctggccaacatgttgaaaacccacctctactaaaaatacaaaaacaaaattagcaggacgtgatggcacgtgcctatgatcccagctacttgggaggctgagccatgagaatcgcttgaaccctggaggcagaggtggtggtgagccaagattacaccactgcactttagcctgggtgacagagcaagactccatctc

SEQ ID NO: 186467 - DNA, 213 bp, Homo sapiens
gtgtcaccacggccagcacagagcagagagaggagacaggcctgagggcctgaggggtgacaaggaaggggaggctgctgggacccattctgggccatgatatataaaatcatttcttttcttttctttttttaattttatttttaggagagacaaggtctggatatattgcccaggctggtctcgaactcctgggctctagcaatcctccca

SEQ ID NO: 186468 - DNA, 267 bp, Homo sapiens
aatcagccatttttccaaggagccctcgtccattttttttggagaatagtatttacaagccaaaatctgggcaataaatgtacctgttgctcttgtggtgttgctgctcctagacccttgcagtcaaacagagctgggcaatgcgtcttatgtatgtaagcacatatttattatgtgtgtatttctgtattcatctgtatattaaaaattgtcagttcacacacatctcaaattccgaataacatcataagtttcattttcattttc

SEQ ID NO: 186469 - DNA, 331 bp, Homo sapiens
gtctcccttgacaaatgaatggggcttgggacctcacctggggatgccagaggctgagtgaggtcaggctgagtgctaagtccattctggtccaattctcagccccaccactacccaacctgaacccagcaaggacagaattttccacagaattcaggacctgaatagaaaatacagtactagaaatactcatggaggtgtgacaagaatacccacaagtaaaaacgatggctccagatagaaatgtgatcatagcagcaaagtggggcgggatgtctggggccttctggctaaagacaattctgccaagtgggtgaactgagttttgagg

SEQ ID NO: 186470 - DNA, 207 bp, Homo sapiens
gtggaccccagggcgtgcagaatggcctctgggttcagccctgttgtccaagaaaccaggcaggctccagaggatgggaggaggctcgggcctggccttcaggtggcctcacgtgtgagccccatggtgaaaggcagcacccagacaaggtgtcactcccctggcggcctggtccctgcaggggggatcgctgcttctcccatgcct

SEQ ID NO: 186471 - DNA, 724 bp, Homo sapiens
tgacctttccaccacaaagcatgactagaaaaagccccctgcatgatgatgccaagaggcaaattccagaaatgggagtagacagtttccgatgaaccctagaatgcttacagactcgcaggattagaagaaacctttatagacacgtacacttatccttgcttgctcggccatcttctcactggttcaagtaaacagaacatgatgcctaccaaagatatcctgacatgcttctgaagagagaggctccttccccctgctcaagaggatgaacctaaaatttgttgcaatgaaggcacagtcactgtaaatatacctcaggaaggaaaccgcagaaaccctaagtcaaccacagttccagtacagaggaagccctcccttggacagaggtcataaggctaaacaagcaatgttccattggacacctctgttaccttaataggcatctcatcacctccctgcccaaacgccactgctattcatactgaataagacattagctagacctggaggcaggtctaatgataatatttcttcacttgagcccccggtttggtcactggcagaaggtatccttgaggggcttctgtttatgtcagcagatgttagcctgagaagtagcagcttttgtttccatgacttcttccaaatgaagtcagaagcctccagggttctcagatacatcagagagttctaggggcattgcttcctttgtggccagaac

SEQ ID NO: 186472 - DNA, 145 bp, Homo sapiens
tccccttcccaccaggccctaagagagtaaaatgcccccaaacatactccatgagacaggaatcaacagagatggaaaggctcagttaccacgagagaaaagaccttgggggtagaaaacatttcactgtgctactaggatctgg

SEQ ID NO: 186473 - DNA, 539 bp, Homo sapiens
atctttaatctagtataaagtgacttctacaccaacaatccactgaacatgcatttgccaaaaatatatccaccattactaattttaccatatttcagaacttctgaaaactcagtatgtcccacactctacatatctcctcctccccatacctgaaactagcttgtgactcttctaaattctctattctttaaaaaatagcaccaccacacctacctctgttctcaagctaggttactttaactgttttatttccaaactatcatctctgatttgtccttcctagaaccacagacctagaattttctgcatcgtatctagaaaagatgagatattttctctgccacccaatgccatcatctcccaccaacccagaagtggacatgggggcctgttaaaaactaaactataaaataaaagtaagaacattaaaagtctattataaacgactgagtgggataagctgaactattgccccacaaaagacttccacaccctgatccctgaaatctgacaatgttacctcatatggcaaaaaa

SEQ ID NO: 186474 - DNA, 248 bp, Homo sapiens
ctcttcatcacaatctggagttgctccatagccactaaaatttgctaaactgaaaacaacgttgcattttcaaatgctcaaagtcacaagcctcaaaatcatttgtaagtcactgttgccccaaaatgtacagactaaaaatataccttcttccacttaaatttaaacaacacacacttaatgacagccccacacccagactatttcaaggcaatttaaaagatgaattttgtaaatcattgggaggg

SEQ ID NO: 186475 - DNA, 1110 bp, Homo sapiens
aaaaaaggctgtggctatgtgcagctcactcactgcatgaactgtgcctgaggcatgcccaaggacaaggctattaagaagtttctcatacaaagccgggcgtggtggctcacatctgtaatcccagcaattttagaggccaaggtgagaggaatgcatgaacccaggagtttgagaacagcctggacaacatgggaatctttaaccagtttcagtgtagtagtgaaaaagtgcttccatctgacactctccgcagtgctctggcaaagactttccaggatgaacaacgtttccagctgggaattatggatgatgctgcagagtgctttgaaaacctcctgatgagaattcacttccacattgctgatgaaaccaaagaggatatatgtactgcccaacactgcatttcccatcagaaatttgcaatgacattgtttgagcagtgtgtatgtactagctgtggtgccacttctgatccgctgcctttcatccagatggtacattatatctccaccacttccctttgcaatcaggctatttgtatgctggaaagacgagagaaaccttcaccaagcatgtttggtgagctgctgcagaatgccagcaccatgggggatctgcggaactgtccaagcaactgtggagagaggatcaggattcgccgtgtgttgatgaatgctccacagattatcacgattgggctggtatgggactcagaccactcagattagcagaagatgttatccacagcctgggaacctgccttaagctgggtgatctgtttttcagagtgacggatgaccgggccaagcaatctgaactgtacttagttggaatgatctgttactatggcaaacattattctacattcttttttcaaacaaagattcgcaaatggatgtattttgatgatgctcatgtcaaggagattgggcccaaatggaaggatgtggtgaccaaatgcatcaaggggcattatcagcccctgctgctgctttatgcagatccccagggtaccccagtttccacccaggacctgcctccccaagctgagttccagtcatacagcaggacatgctacgacagtgaagattcaggtgagcagccagg

SEQ ID NO: 186476 - DNA, 442 bp, Homo sapiens
aaactgtcagcaatgtgtcgtcaatgctccacagattatcacgatgtgtatgtctcagattagcagaagatgttatccacagcctgggaacctgccttaagctgggtgatctgtttttcagagtgacggatgaccgggccaagcaatctgaactgtacttagttggaatgatctgttactatggcaaacattattctacattcttttttcaaacaaagattcgcaaatggatgtattttgatgatgctcatgtcaaggagattgggcccaaatggaaggatgtggtgaccaaatgcatcaaggggcattatcagcccctgctgctgctttatgcagatccccagggtaccccagtttccacccaggacctgcctccccaagctgagttccagtcatacagcaggacatgctacgacagtgaagattcaggtgagcagccagg

SEQ ID NO: 186477 - DNA, 739 bp, Homo sapiens
ttactgtgtttatgggacactgagcctggtcaggggctttggtatagggggcagaggaagaaagtcaaatgtgtgagttaggaatgtacattaatgtttgatttagcagtaactaaatacaaaccatcatcccccttctattccccatcttgaagcaatcaggctatttgtatgctggaaagacgagagaaaccttcaccaagcatgtttggtgagctgctgcagaatgccagcaccatgggggatctgcggaactgtccaagcaactgtggagagaggatcaggattcgccgtgtgttgatgaatgctccacagattatcacgattgggctggtatgggactcagaccactcagattagcagaagatgttatccacagcctgggaacctgccttaagctgggtgatctgtttttcagagtgacggatgaccgggccaagcaatctgaactgtacttagttggaatgatctgttactatggcaaacattattctacattcttttttcaaacaaagattcgcaaatggatgtattttgatgatgctcatgtcaaggagattgggcccaaatggaaggatgtggtgaccaaatgcatcaaggggcattatcagcccctgctgctgctttatgcagatccccagggtaccccagtttccacccaggacctgcctccccaagctgagttccagtcatacagcaggacatgctacgacagtgaagattcaggtgagcagccagg

SEQ ID NO: 186478 - DNA, 235 bp, Homo sapiens
aggagctccagagcaggaccctgtgttaacgctgtctcgctctcaggcttctgagtcccctctaacccaactttattatgtattaataataataaagctgctcaggaggctcctggagtacagctggatgcccctgccctaggaagcctgcgttctgggctgagggcgcagggccaggtggccacggggatgtggcagtcatatgggcgcggctctagcctctcagccacagaca

SEQ ID NO: 186479 - DNA, 362 bp, Homo sapiens
tttcgagattcagatgtagtagagggcttgccaaggtgcaaatggatgaggactgtgggtcaaggcagatgatctaacagctgcctccccttccttcactgtggtttatgaccaaacattttcagtgtcacctgattgagatctaggctgggtgtagtggctcacacctataattccaatactttgggaggctgagttgggaggatcacttgaggccagaagttcaagaccagcctgggcaacataatgagacccacgtctccaaaaaaattaaaaaaaaaaagaataaaagatctattaatgaaggtatgaagatacagtgcagatctgtgggacaagtctcaaatctagcagtggtcagc

SEQ ID NO: 186480 - DNA, 299 bp, Homo sapiens
cctgcttgagttgtgcaatgtcgggtaaatagctgagcggtggaataaagtcactgatttactaagttgaaaaaactgatgggttaacccatagctgaaaaagtaagaattatttttgagatggggtgttgttgatggctgatgtgatacttcagttcttatcttcttttttcctttttttttgagacagagtctcatgaccagactggagtgcagtgatgcaatcttggctggctcactgcagcctgcgcctcccaggctcaagggattctcctgcctcagcctcccaagtagctggg

SEQ ID NO: 186481 - DNA, 281 bp, Homo sapiens
gacctgggtgacagagtgagaacctgtctttaaaaaaaagagagagagagagaaagagagaaaggagggagggggggagagagagagagaaagagagaaagaaaaaggaaaggaaaagaaaagaaagaaggaaggaaggaagaaaagaaaagaaagaaatctaagttaaagcaaggagactccagaatgagattactgagaatagaagatccaggataattcacttccatgaaaaatatggataataaagtagaataaggacagacaggaggagccacttg

SEQ ID NO: 186482 - DNA, 450 bp, Homo sapiens
ggtcgacggggattacagcgtgagccacttaacatttattgtttgagacaaagtctcactatttcgctcaggctagagtgcggtggcgtgctccaactgcaacctccacctctcaggttcaagcgattctcatgcccagcctcccgagtagctgagattacaggtgtgcaccaccatgcctggccaattttttgtatttttagtagagacagggtttcaccatgttggtcatgctgatcttgaactcctgagtcaaatgatccgcctgccttagcctcccaaaagtgctgggattacaggcatgaaccaacataccctgccagttccataattttagtacatttataaagttttgccaccatcctcaaaattgttcttaggacagaagaaactctgtacccattaccagccatccgtatttccctccagctcttctcacccaatccccaa

SEQ ID NO: 186483 - DNA, 520 bp, Homo sapiens
gcggggggtctggagtggccagccaatcaggcgggcagtgccacctcggggaatgacgctcgggccaatgggaagggcactccattccgtcaacgctgtgggtcggggttctgagaaaagagagctgagtgggagtcgggccaggctgatgtgtgcccaagggaggggaaaagagagagcgaagttcctgcgaagaactgcgggaatgtgcggccggaattcactctccaccgccccccttatcccgactaggctgctgagggagcgcctgggccctgctcgcggataccctgccactcctaatagcacggcgcccagggaccctccgccacccatcactccatccgtgggattccagtgccttaagaaagacgcgctgttcaagaaggcacgttcattctgttctatatttccctcctccgtttcattattcgccttttcacatttgccgaaaccataatgatggaatggaatgtgtagcctttccgttttctttttaaaaaatgctaaagcttagcaa

SEQ ID NO: 186484 - DNA, 717 bp, Homo sapiens
tgccctggttttgagggtctttatccctctcacgcaaatggtagatttgactgtgatttctttagaatacatcacccaagactgaaccaaatgtttgtggtatcatcagagcaaagcaggactatagcttcctccttttgggacctatcgctttgcactcctgcgataaagttcttggcacccatactgttgactcatattgggcttgcagtcaaccaaaacctccgcgtctttttaataagtgctccgccagagcacttctaccccttcttgtgcttctcagccaacttcgcttcaggtcagctaaggatagaccttgggcccctcaccttctaaatttctcaggatatatggaaaagaggaataggggttggaagctggcataacacaatctttaaaccaagtgcatttgaaaaaaggccagggtggcggggcgtggtagctcacacctgtaatcccatcactttgggaagccaaggcaggtggatcatttgaggtcaggagttcaagaccagcctgaccaacatggcgaaaccccatctctactaaaaatacaaaaattagctgggcatggtggcacgcacctgtagtcccagctactcgggaggctgaggcaggagaatcgcttgaacccggaaggcggaggttgcagtgagccaagatcacgccactgaactccagcctgggcgacagagggagactccatctccaaaaaaa

SEQ ID NO: 186485 - DNA, 350 bp, Homo sapiens
attatcctacagcagaaggtagagtatatatgagtacaaatttggaatatgttttttaaaggagacaaatagtagatgctcaataagtgttgtttaatgaataccatttctaaaattaatgaatgagttagttgacttccatgagttatgctattaggaagtaaagatacaagcatgaaaatatgctgattccaggatgacagagtgtatggaaatagattatactacactagattacctcataatgagacatgtgtgtacttggtttcagtaaaattcatactggttcaaaataaactcttgatatagaaatttttcagtaattcactaaaatcaggtaaactgactat

SEQ ID NO: 186486 - DNA, 1669 bp, Homo sapiens
agaccagcctggccaacatggtgataccctgtctctcctaaaaatacaaaaattagccgggtgtggtggtgcacgcctgtaaacccagctacttgggagactgaggcaggagaatcacttgaacccaggaggcggaagttgcagtgagccgagatcacatcactgcattccagcctgggtggcagagtgagactctgtctcaaaaaaacaaaaacaacaacaacaaacaaaaaaccagttaagtgaaatgaggaaatttctttggtgaaagagaaggctagataagatgacagttgtctcaaagtcatcatacggaaaacagaatagaagcacagaacaaggactattgtatataagagaagcaggtgttaatgtaagttgctgtggaatgactgttttcaagaagagagaaggagccaatatatctactttcattaagaagctgaaattaaatttggatttccttctttccaaagctgagacacgatggccaaaaagcgattgctgtgattggagctggaattagcggactgggggccatcaagtgctgcctggatgaagatctggagcccacctgctttgaaagaaatgatgatattggacatctctggaaatttcaaaaaaatacttcagagaaaatgcctagtatctacaaatctgtgaccatcaatacttccaaggagatgatgtgcttcagtgacttccctgtccctgatcattttcccaactacatgcacaactccaaactcatggactacttcgggatgtatgccacacactttggcctcctgaattacattcgttttaagactgaagtgcaaagtgtgaggaagcacccagatttttctatcaatggacaatgggatgttgttgtggagactgaagagaaacaagagactttggtctttgatggggtcttagtttgcagtggacaccacacagatccctacttaccacttcagtccttcccaggcattgagaaatttgaaggctgttatttccatagtcgggaatacaaaagtcccgaggacttttcagggaaaagaatcatagtgatcggcattggaaattctggagtggatattgcggtggagctcagtcgtgtagcaaaacagatttgaccagtaggaactgagattcaacgtccccaagactgcaaaagtacctacaatcaaacaaattaatatatttcctaattggatcagcatgcagacaagtttacaaatatattacagaaagatttgaagagggattctggttacgttcagttaagcaggacactaatcctgaacaatctgatgtattaaagtttctaatgtttgtatctttggtttgatgcatacaatagagtggaagtctgtagtagttaatatgatgataattcgcttctaaatttaaatccttatttatatatgaagcatagctatgtcaatgtccagggaagcatttttaaatagtaaatcagaaacatgtaaactagtgaatacaattttctatttttcattcagaaatttgttgtcatagatgcagcctttatctggaaatcagtgggcagctctggtcaagcacagcatggcgaccactgtgtagtattttaccacctaatccttagtagccaacactgttaaatctgcataatgggtagcatatgaataaaataatatcttgt

SEQ ID NO: 186487 - DNA, 485 bp, Homo sapiens
tgtctcgagggtgaaccacggcctcccttacagtagtcactcactgtattcttgagaatgaccgaaaagtgctcaattatatgccctgaaaaatgctgtgctcagatccaaaatcctgttgcctgatgaaggcaaggaactgtagctgccccagtgatgatgagtttatttggattttatgctgtagggtagagggcagattcaggagtcacactgcctaggtttgaatccttgactcccaggcatgtgtgtgtgctgtgtgtatatgtgtgatcttggtcattacttagccttttaaaacttcagtttcttcaactataaaatagggtgatttttagttttcacatatgagtgagaacatgcggtgcttaacttgctgttaaaaaagttcatcttggccgggcgaggtggctcacgcctgtaatcccagcactttgggaggccgaggcgggtggatgacgaggtcaggagatcaagaccatcct

SEQ ID NO: 186488 - DNA, 385 bp, Homo sapiens
acaaccccacgggcaaaactaactttgcctttctgagtaaccgaaaaagacaatgcagtcagactggagtgggtggaacactgatgataagaaatgatgtcaaaaggcaggcaatggccagactgtgtagaacactggaagaaccagctaaagaggcaattgcaattcaggttcgacctgctagaagataatggaaacttaaaaaaaaggaaaagcgacggatttgaaggaaaaaataatgtgcctgccaggcggtttttttgaagtagattatgagattatgggaaatggaggagaaatgacagctcctgggtttttgtctgagtgaaatatatgagtgagaggagaaggaccatatagtgagatgaggaagaatgaaaaaaag

SEQ ID NO: 186489 - DNA, 669 bp, Homo sapiens
ccatttcagataccatcttgtctcctctttacatggtaaagagaacttgggaggaagggactgaggaatcaaagcttctgagatttgaggatctggagctcctatagattttgagaacaccctgtgacctctggtctaaatcagaaaaccgtaatatcccagagctgatcaaacatgcctacaccactgatcatctaggataacatcacccaccatgtttggagaattgcagatttgggacaaagaagaaatgactgtttcactagaaggacagccataactctggtaggagatgaacatcttcaggacaagagataagcactccctcaaacctgtcacttttagtacctgggatatctgaatcaactctatataatcaacaagagaattaggcaaataacatctggttgcactgatggacaaaggacataaagatgttattttcaaatgtcttctcctgaagaaaaatgaaaattgtgtagccagtcaccattttaggccactcattcttgtccagtcatctgtaggattatggtttgagggactttttaaaacaaaagtaaaagcaatacatatgatttgataagttccatgattaaactgaactaataaaaatagtaaccactcaatgaatatgccatatgctataccaagtatgttagctggagt

SEQ ID NO: 186490 - DNA, 101 bp, Homo sapiens
tcttttgttgcattccatttgctagtggatgcagccatccatctctctactgtccactcatatctgataattcattttcgttatgccatggtaactgtact

SEQ ID NO: 186491 - DNA, 513 bp, Homo sapiens
tagtattatggcctttgtacaaaggaataaatactcttcgcagggaagagttagctacatatagattaatgtagactgacatctaagattcatctttaagtgaagaaaaatattccatgccatcattttttatagtaagcattcagatttttttaactgacaaaatcagttatatgtgcccatataacaataaagatctctgaaatgataaacaaataatagtaacattgtctctagggaaaagagttagcagaaagtgacaaaaggcaaacagttttgaccaggtaccctttcatactattaaaatgcacaatcatagacaaataacctttaaagaaaaataatttttttttttttttttggaaatggagtgtcgctctgtcgcccaggttggagtgcaggggcgcaatctcagctcactgcaagctccgcctcccgggttcccgccattctcctgcctcagcctcccgagtagctgggactacaggcgcctccaccacgcccggctaattt

SEQ ID NO: 186492 - DNA, 391 bp, Homo sapiens
ggtataaagtcaagacggtactgctcctccctgtagtaagtccttttatcagggaaagcggatgaatagagtgatttttagggttaaaatggcagggtgaggttgttccacagaccttccactctgaatcaagaaaaaaaattaccaaaaaaatcctgtcctaaactataccgtccataaattgcaaccaaacaaagaaggaacaactttaagttacatctcaaaatggtggccaaagaaaagattctgaaagactggatgattggtatgggggtaacacaaaggcctgccctcattcccagaaatagtaatgagggaaaattagttaacatatactggaaattctcaatttggagaagtagactgtggggttaaataggcagtcccaaga

SEQ ID NO: 186493 - DNA, 375 bp, Homo sapiens
agcgccaatgtgaaactcaataggttcaacgtttcctgatttggagtttagggcttgtgcatgtcatacaattcatagtgtaattttcaaaccttcaaataaaatgctgataaaatggactccccaggtgagtctaatatgttaaggttgaaaaccactaatctcaatagtgaaaatttaagacagtcatagagagacataaagagtatatataaaaggaaagcaaagcactgaaagactacagcttagaaaacgtgtgtgtgtgtgcatctctttcaataagaatgtatgaattgaaagcctatcaataggtattctcccataacctcactggtgcgcttatttcttttcacatttggcataaaactatagcca

SEQ ID NO: 186494 - DNA, 545 bp, Homo sapiens
ctctttgcaataaatcttgctagtgctcactctttgggtccacactgcttttatgagttgtaacactcaccgcaaaggtctgcagcttcactcctgaagccagcgggaccaggagcccaccgggaggaacgaacaactccagacgcgccgccttaagagctgtaacactcagggcgaaggtctgcaccttcactcctgagccagcgagaccacgaacccaccagaaggaagaaactccgaatgcatgcgaacatcagaaggaacaaactccagacgcgccgccttaagagctgtaacactcaccgcgagggtccgtggcttcatgcttgaagtcagtgagaccaagaacccaccaattccggacgcaatgtgacattcaagtcaagaagtaagttaggtgttgtactattaaggttactggtagttaaaaatccttaaatgaatgagatttttctctatgaaagacagaagaggcctggcgcagtggctcaaacgcctgtaatcccagcactttggtaggctgaggtgggcagatcacctgaggc

SEQ ID NO: 186495 - DNA, 472 bp, Homo sapiens
tgctcaaaaacttaaataaaaacacaggccgggcaccgtagctcacacctgtaatcccagcacttggggaggccgagatgggcagatcacctgaggtgaggagtttgagattctgctcccgcaagtctcctcagaaaggagaaagaacaaagaagacgagcagagcctaaaggacctgtgagatgtcagctcaccaaccaaccatggaagtttgaaatgggcagaaagaatgtctgaaaaaataatggccaaaaccttttcgagtttaatgaaagacaaaaattttacaaatccaagaagctcaacaaactccaagtaggataaactcacaggacccaaaatgaaacacattttaatcagtgttgaaagccaaaagacaaaaaaagagagaatcttgacagcagcaagagataagcgactggataactgttaacagctgacttctcatcagaaatcacgaaggccaaggccg

SEQ ID NO: 186496 - DNA, 422 bp, Homo sapiens
atttgtttatccgttcttccattgatgggcgtctgggctgcttccagtttggggattttatgaataaagccactaaggacattggcatacatgtggacatatgttttcatttctctcgggtaaatagctcagactggaatttctgggtcataaagtaggtatgtattcaactttattagacactacagagtgggtgtattttcatctccattttacaacacaggccacagaaagcttcagggacttgtccaaggtcaaggggaggaagagaaataggatttttctccaggaataatgctaggtgcttatcctgttcatctcctttaatcctcaaagcaaccccgtaaggtgggaattctgattcccattctgtagatggggaaactaagggtcatgaacatccagcaaggtcaggttcaatc

SEQ ID NO: 186497 - DNA, 370 bp, Homo sapiens
cctcagtggccctcaggcctccccctcgccccttgtgtctgactcaagctccccagcatcctgttggatctgacgctctctcccactgagagcccggtgtaggctgccaatccctgttggtaataaacccctaaacctgactctatgccaggcagacacctgtgtgatggggctccaggctctgggtccatgtgacttctgtcccgggaggcagcctatggcaccgcgcacaaaagcctccaggcaggagcccactacttgggcttaaatctgccacttaactgtgtgcccttggtcaaatcacctgactgttttttgttgcttgctattgtttttaaattttattaaaatacacacaacataaaatgta

SEQ ID NO: 186498 - DNA, 384 bp, Homo sapiens
caagtgaaagccctcagttctagtaaggagacacacagaagagtgtttatttgtcatgctagttttttatgacttggacctaattgccatggggattaatgtgaccagtttcacattggtacatcaagtggcatcctgtgcaatctgctgatgatttaaggaatacagttaaagtaagcacatagaaaacaatgcttctccaaatgaaacacagtgagattttacataattttatttgctttcttgtttgtcacctggacaaagaacagctctgttttgtgattatacaccctgggaggtttccttggagtgagttctgaatttgtaaatcctaaggacttaatgtatgcttctattaatttgaattgaaacagaggttcccat

SEQ ID NO: 186499 - DNA, 423 bp, Homo sapiens
ccacctcaccctcctgagtagctggctgggattgcaggtgcaagtacacaatccaccacaaaatagttatgcataaactgtttttctaataacttgtgttagccactttatgtaagctgcataccatttcttaccatcttctggatttaagctctgcttggctttgtgttaatgtggaaagtcaattttttctttaattttatagaggcagggtcttgctctgttacccacgctctagtgcagtagtgctgtgatagctcgttaaaatcacagactcctgggctcaagccatcctcccacagcagcccaagtagctaagactataggcacacagtgccacacccagctaatttttattgttgtagttgtagagacagggtcttgctatgttgcccaagctggtcttgagctcctggtttcaag

SEQ ID NO: 186500 - DNA, 502 bp, Homo sapiens
agaaacattcaattgaaggaaaatcgtagcacataaatgcaatcctgctctatgcagagattctcaagcccatgcttatggaatcaagcgaggcttgactgcctttgactatgaattgcctaatttagtaaactttatgtttttagtgtaataaaaaggagctgaagaaacacatatattgtaatgatttggtcgttgttcttggttagcccccgacaacatcctttcaatgaatctaaatcaagtgagtaaagggaagtctgggtgtctcttaatcatagctaaaactcaccatcactttatagaccctgaatcattttataattatattcttcatgaaatttcatgatgacttttggttgcgtatcattcacaataaattttcatttagactaagtgtaagttattaggctctgcatatcactgtcaagtaggaagacattagatttgatatttaatgggttactgtgtgattccaatattaaacattaaacattttctt

SEQ ID NO: 186501 - DNA, 423 bp, Homo sapiens
tgctgtgttggccaggctggtctcgaactcctgacctcgagtgatcagtccaccttggcctcccaaagtgctggggttacaggcatgagctactgtgcccggctggcaatcacttctactcggcacctcagtggatttcaggccctcagtgctgggggcgccctgagcagacagcagctgagtcaggagcgtggccttgtaagatctccatgtctgaggtgcgagaggttgaggttgaggactagaattagacactgtagaaggctttactggaacgtggccctgaactggacagacattttatggatgggcagagagagaaggtattgtgaccccattttacagaagtggaaagtgaagcccagaggaaggcgtggaggatcagcagcagagctggaaccggttgactaaagctgtggtctt

SEQ ID NO: 186502 - DNA, 581 bp, Homo sapiens
caaatatattgtaaagtttagtttaaattatttttacagtgttttcatccttcttcatggcctccttcccacaaatatcaggaaaatgggaactgatgaggagagtaacattaaataaaaagggaagtacaagtaattttattgttgtgctcagcacagacggacccaattacagtcctacaagtacctgggttgcttccctcctgacctggagaacagtcccctggtacactgtcattgtggaaacagagaaaacacatctgttaaaaatgagctttagtggaaaaaattcagctggcattctcttttcctctctgtcgtccttttttaatagcactcttatgtaaggtcgttactatatatagtagagaacagggagctgtgatttgacctgtacagaggcagtcagatatgggccatttcctaccttggtgggcccaaaggcagctgaacctgctggacagcaggagcggcggcacctggaacccttgctctttgagacctcagcacagctgcacggctgttctcttcttgcatcttcagcttcccacctacaaaatcggcacagggcctacttctga

SEQ ID NO: 186503 - DNA, 194 bp, Homo sapiens
tgtggctatgcaggtgtcggttcagggaaagcaggtggttggattcaaggtgggagtttaccgatgggcgtcaggaaaaggcatgggatgagcgaatttaaatattgacaagaatgtcagtgccagcatgacaaaagaggagagtgaagcaagggagtgggctggcaaattgggagcagataggaggcagtgat

SEQ ID NO: 186504 - DNA, 678 bp, Homo sapiens
tctccacaaccccttatgttaacccagacactcctttctattgattccaggtctttagaaaataacttaactcctccaagcaattgccaaacagaaaaccttggcatcttcctatgacctgtaagcacccactttcccctgctttaagttgtcctacccttctgcaccaaaccaatgtatacctcacatgtattgattgatgtcttctgtctctctaaaacatagaaaagaaagctgtaacccaaccaccttggtcaggacgtcttgagactgtgccttgcgccatggtcagtcgtattttgtgcagaataaacatttttcaatattttacaggaaaaaaaaaaaaaaaaaaaaaaaaaaaagaaaaaaaaaaaaaaaaaaaaaaaaaagaaagaaaaaaaaaaaaaaaaaaaaagaaggaaagaaaaagaagaaaagggcgaagagaaagggaagagagaaacaagaaacacacgcaaggacaatgacagagacaatccacgacgcaaagccagctaccaaccacggaacgggacgacgcgaaaacaccaacgaatcgaaccacccaacggcacacacagcaaccaaaagccacccacaccaaacaaagacatgaaaaacaaaaaagcagagagagaggagcccacacaccagagacgagaagaagagacgcaaaca

SEQ ID NO: 186505 - DNA, 768 bp, Homo sapiens
gtgatgctcccacgtcagcctcctgggtagctggggcttaaaaagcacatgccaccatgcctggcctttttagttcttttttaattttctgtggagacaaggtctcactatgttgcccaggtgggtctcaaactcctgggttcaggcgattctcctacctcagccccccaagtagctgggattacaggtgcatgccaccatgcctggctgatttttgtgtttttagtagagacggagtttcaccatgttggccagcctggtctcgaactcctgacctaaagtgatccacccaccttggcttcccaaaatgattatagacgtgagccactgcacccagctggccctagagttttgatagagatggagggtttactgggaattagggcgcttccagggaaatgactggagttgaggtaaactggaaccagatcattaagggcgatgaatcctgggccaggctgtgcagacatttctcatatgcagtgggcagctactgcagactttgagctggggagaaggggctgtgtgagtagagcgttaacttgggagaagtcctttgcagctgtctgtgcaggctagattcatacaggcacaggaaatgagagaggtcagttgaacaagagttaatgaaggcctgagttagaattgtggcagtcagataacaaaggaataaatgtgatagaaattacaagagaccagctgggctctgtggctcaagcctgtaacctcaacactttgggaagctgaggtgggatcgcttgaggccag

SEQ ID NO: 186506 - DNA, 521 bp, Homo sapiens
ttccttcttggccctgccgaaaacaaggtgggcagttcctgccacctggagctcgtttccccacctgtcaaatgggcgttaagaattccattgtggtttgatacatggaggttctcactgtgttgcccaggctggagtgcagtagcatgatgatagctcactacagcctcaagcaatcctcctgccacacctcccgagtagctggaactacaggtgtgtgccaccatgcctggctaatttttttattttattttattttattttttgtagagatggagtctcactatgttgcccaggctggcctcaaactcctggcctcaagtgatcctcctgcctcggtctctcaaattgttgggatgacaggtatgagccactgcacatggcccaagagtttttgtttgttagttttgttttttgagatggattttcactcatctcccaggttgcagtgagctgagatcacgtcatcgcactccagcctgggcaacaagagggaaactccttccccgcctcccccacca

SEQ ID NO: 186507 - DNA, 378 bp, Homo sapiens
agccactgcacatggcccaagagtttttgtttgttagttttgttttttgagatggattttcactcatctcccaggctggagtgcagtggtatgacctcggctcactgcaacccccacctcctgggttcaggcgattctcctacctcagccccccaagtagctgggattacaggtgcatgccaccatgcctggctgatttttgtgtttttagtagagacggagtttcaccatgttggccagcctggtctcgaactcctgacctaaagtgatccacccaccttggcttcccaaaatgattatagacgtgagccactgcacccagctggccctagagttttgatagagatggagggtttactgggaattagggcgcttcca

SEQ ID NO: 186508 - DNA, 699 bp, Homo sapiens
agcacggaccttcttgctgtgtcctcacatggcaaaaaatgaaatggagagatagagcaagagagggctgaacccatccttttatagcaacaccaatcccacccatgaagatgaagcctcgtgcagcctaatcacctcttaaaggtcttgcctcttaataccattacaatggaaattaaatttcaaaatgacttttggaggggtcacatattaacaccatagcataagcataaacatttcacattaatagagaaagaatgagctggtagatggtcagccatttttgcacaactctatgaggtaaaaggaaaatcattattgacttctactttatggttaaactatggggaggatctccccttctttcttggggcttagataaccataaagtctacattcaattgtctactcttcctcagaaagttgctattataaatccatgctctgccttgtggtactgggtagaaggaagaaaaggcttttacagagcttatagtattcctctgaagtctgtagtaacaattaaaagaaaaagtatacactgggcatgtagatcaagcaaaagatctagtaaaaattataagttgttaggaagtcactaaaaatattttagtttatgcctttgatttaggacttttttggggtgagttctttggaatgaaattaaacacgttccaattcgaattcttactggataga

SEQ ID NO: 186509 - DNA, 340 bp, Homo sapiens
catattgttattataggcagagtttagatttaaatcttgaccttctgatttgaagtccactattgtttccactataacctagctgcttcctaaaatattttctaaatttgtgttttattttgaaatatcatacacaaaagtaatgagaatacaataagcccccatatacacataacctgattttatggttatgaagattttgctttacttatttcatctcttttccctactttttgctgaactattttaaagcaaatcctagtcaccctgccatttacccctgcatactttagtatgcatctctacaaaacacatatgtttccttacacaattataatgc

SEQ ID NO: 186510 - DNA, 247 bp, Homo sapiens
tcgccttcacccaaagtcattccatctgttttacacctaagtacactatctacattcttgtctgtagttacactggggggagataaaaatattttccatttcagtaactcagtatttgtgagtaatttgcttagtaataatcccaaaattaaattgtcttcgtataaggactactaatagtttgtgtgggatttgccaaataaactaccttcgggaaacttcttttttttttttttttttttttttg

SEQ ID NO: 186511 - DNA, 413 bp, Homo sapiens
tagctgggattacaggcatgcaccaccacgcctggctgattttgtatttttaatagagatggggtttctccatgttggttaggctggtctcgaactcccaacctcaggtgatccacctgcctcggcctcccaaagtgctgggattataggcgtgagccaccttacctggccatgctgctgcttttcatctgtttttttcttcatcctcactgtcaacacttttggccattatttctgatttggatagtagctggttggtctctcactatagtccaagatccaaattgctgctagtgtcattttcctataaaatcaatcatgtcatatctctttttggaaagctatacgtttgctatggcttatactatcagatccaatctcatctctttctcttctctccttgcatgattcat

SEQ ID NO: 186512 - DNA, 476 bp, Homo sapiens
tctgtgggtataaagaacctctcgggagagcctgaatgatcaggagatctgaactggggagccatcggcccagcaggaggtgcctctgcttggccaaccagagcctgctgcaagaaaccttttttttttttttttttttggttctgacaggcttgttggggaaattgaaaatctcctgtttgaaagccagataatttaaaatcctttctgattcagaatctcagcaagtagtgaagggctaggttattgattgtgggaaatggggcagcctcaaagggctctgggctatctcagtaccccatctccctcacccctcacgcttcctcaggtttctctctcatgctagcttggaatggatggtgtatttcctacccagttgcctttgtttataagcatccaccaccgctgcagtagggtcaggaaactggcaatttcctcagtgatccttgcccttgaaccctatctcctccagccta

SEQ ID NO: 186513 - DNA, 284 bp, Homo sapiens
  misc_feature (3)..(3): n is a, c, g, or t
ggnccgctctagagtatccccggctcatttgatccttctgcctcagcctccctagtagctgggactacatatccatacccagctaatttttttagtagagatgggggttcaccatgttagccaggatgatctccatctcctgacctcgtgatcttcctgcctcatcctcccaaagtgctgggattacaggtgtgaagtatggcacccagcctaaagtgttttttggacacatgtagggcagtcctgttccaactgttcatgtccaaacatagagaatgaaaagc

SEQ ID NO: 186514 - DNA, 310 bp, Homo sapiens
actgacggtgagctttgcaacaatttttatgccattaacatgtcactttattaagttccttagcaataagaaaaacttttcccaggcacgtagttttcctcccccacaggtaaatgctaactatttctagaactctcaactatttgggaagcttgccatcaactcccatgataccacccaacccacaccatgttttcggggagacaaaggtgccctacttccccagactataaactattaaaatggtgagaacatgccgagatccctgcactgcgctccagcctggcgacagagactccgtctcaaaaca

SEQ ID NO: 186515 - DNA, 290 bp, Homo sapiens
gtggaagctactcaaagtacgtcgccatcttttgttttgtggaaagtcaggaaaagctttctcgtagatgtggtgctaagaatggggcccttgggccgaatcttaagaaaggaacaggtctctagcaggctcagagggaaggacggggtcttttcaggcttgggtaaaaaactggagcatctgtgtccacttgcctctgctgggtaatgaattggctttctatagctgtttcatcttcttcccaaagggaatggtaaattttattaactcagcatccaaatgcgtatcta

SEQ ID NO: 186516 - DNA, 242 bp, Homo sapiens
ttaaaaccacctttgagaaagactaaggttttatccataactagaaaaaaactggaaaaaaacccaaatgttcatcaaaaggttaatgaatatcaaaatgtggctgatctataccacaggaataatattcagcagcaaaaatacattattgatacatggaatacattattgatatgcaaaaatatggatggatctcagaataattattttgaggctgggtgcggtagcttactcctataatc

SEQ ID NO: 186517 - DNA, 141 bp, Homo sapiens
accaggtagacatctggcctcagatagacaccaaggtcccagatgtacagcaggccccaaccgaaccccagactcatgtggacatcaggccacaggtagacaccaagccttaggtagataaataacttcaggtagacatca

SEQ ID NO: 186518 - DNA, 283 bp, Homo sapiens
cctcccaaagtgctgggattataggcgtgagacaccgcacccagcctattacccccatttaaagatgaggaaattgaggcacagagaggttaagtaatttgcctaactgcatacagctagtagatggaagagcagggactaaatcctgaatgtgagggccctagacctgggaggcttaatcatcacatctacttcatggtggcaggacagttgatggtgcaggggctgagggagcaggagtgggtgctggggtgaaccagtgttcctgaagaagggatcccga

SEQ ID NO: 186519 - DNA, 459 bp, Homo sapiens
accttggtccctggtggtgctgctgcttcgtgaagtatgcagtttgccagatgctaaagcgcgtgcctcactgtaagaacggtcacattaggtgtggatggattctcagtgctgagacgctcactcatcacaccttaacttcgctgttggccctggaagctttttggggggtggtccctgttctgtgcagctcccctgaggagtgcagagcattctcctggaatgttctgaaacatttgagggtgaccctgtggacatagcctggccattccaggactggcaggtgaacacaggatctggtcggggatgcgcatggtagagtcggcgggaactctggttggactccctctgggaagctttgcaaaggatatgccattggaaggagccaggccgggggtgaggcccgttcatggtgtgtgattgaggagagggcttgggggcagcatcaaaacaggactc

SEQ ID NO: 186520 - DNA, 437 bp, Homo sapiens
caccgctcctgtgtctgttgcccacctccttctccatctgtgcctcagttcctcctcctgtaaaacatgggaaagggaagcctgcacgagcataataaaccctgaggactcacactgtgctggccatgcttcttcccatagctaatgcagcgcttcctatccttgatacaggacgggatcgtggaagttaacagctcattccctgctataaattacgaagtcctgttctggcttccatttctcttgtttagacagaacttaaacctcataaagtgagtggaattagctctttaggtgaacagacacaattgtgtttttagatctgtaaattcgagaaacaaacctggtgggacctgcctcctgagggccctgtgtctgtgtagaggtggggtgggtgggacctacttccccagggtcctgtgtctgtgtagaggtgg

SEQ ID NO: 186521 - DNA, 1103 bp, Homo sapiens
gaccatcacctcagaaagcagccccgctgggaggtccacggagcagttcgccgagctgtgcacaggccctttattttccatctgtcaagaaaggaagctgcctgttgcttatttcctcctcccactcttctcccttcccgccagcagactcttccactttcaaaatattctgatgggggatcacaggagttttcctcaaacaagatcacttggggtcaactactgagcaactcccagcctcagccccacccattccctcaccctccagcttgagcaatagctccagttagtaaagcagttggatcaacaggacaacaaccaaaagtgaccttctacgtcctaaagcccttgcctgacaccacctctttttttttttaaattattcaggggccttttggggacccccagttgagctgtattctgcagaaagaacttccaaacgaaaggaataaggcattgttttaccaagagccttttctccctcaagaaacacaatgtaaactaggaaacttgcactttcttttacctttgggtagatgagcagaagggaagagttactacccagggtgaggtcattcctccatggtggtagaatatctggttctttcagtttccccatggtgctggcctcacaataggtgttcatgaggtgcaggctaattgggtgagtggatgcagtgctctgatggatttattcagtgtacaagattgcaaagccatgtgccagcaaaggcttaaccaccccaccctacccttcagaccagccccatagctttccatgtccctgtctgcccagcctcaggccaaagcaaaggcagggatctgagctgtacccactgtgaatgcccatctcctgacccctgtgctagtgtcttgtccctgcatgcctcggctgtcttctctctggactatgattcatggcagatattaaaaaggaaacagcatccttcaattctttctaccatttctcttatctttaaagggttcttattaagcagtatcttcaaacttatttatgtgatgtcatgctaggaagcagcgttgtcaatgtgccactttccatgagcactgaattcagtaaaaataaaagccaaataaatgat

SEQ ID NO: 186522 - DNA, 559 bp, Homo sapiens
taaactttatgattagttagcttcttttaaaaatattacttaggggccagggatagttgtcagcttcctgaattaagaggtttcagaaaaaggatggaaatcttgtcttaccaggagcatcctaattatgcttataggtacatatacaatacatagatgagtcccgagacccttttggggatcgattggtccattttaggaattgacccagacatccttttctcatattatttaaagattgttttaagataatgagcaattttctgcgtttcattgtcattaccattcactccaaagaaacagccttgcaatttggccaacgtaaaaaaagtttggtgatatcttttcatgagagagtcagccattcttatcccgcagaacagacaaattgacagggtaacagtaataaacgagttcccccttgagagagggaaggtcaaactaaagcagaataaatcaattgttatgatttcctaaagtagacactttttcagcgattactaatttaccttagattcactaaggaaaaaagagaatcttgtaatataaacgctcagat

SEQ ID NO: 186523 - DNA, 288 bp, Homo sapiens
tttaaattcagaacattactcacacaattctttccaaaataaatctgataacaggttaaaaggagtaaactgctgtatactctgtaaagaaaaatacattaacttccaactacacacctcttttcacaaaccaaagatcattctattattagaaaaagatacttccccctcactggttatgagaatctgactagtgtccattgttgttttatctctctgcatgcaaccttaaaaaagttaaacatggcaaaatttaaacattcaaaatctgcacagtttgattgcatg

SEQ ID NO: 186524 - DNA, 252 bp, Homo sapiens
tggcccccatctacctccctgacatcagcttttcgctccatcccctgctccagccatgctagcctccttggtgctctttaaacatatcaagcatgttcctacctcagggcctcaacacccgctattacctttgcctggactgctcctctccagacatggtgaaaccccgtctctactaaaaatacaaaaattagctcggtgtggtagcacacacctgtcatcccagttactggggaggcaaaggcaggagaa

SEQ ID NO: 186525 - DNA, 368 bp, Homo sapiens
gctgtagatattcaagttctactagcttctaactccttccatgtaaagcagcagcgaagctgccctgccaaggcccacagttagatttgtgcatctctgagcatcttttcttgagctctctttgttaccacctgctggtcacagagctgaggagggctgcacccccttccaccatggctgcagatgccctctgggagaacactcggggcagactcctgaggaccccatggtgttgagcacctgtccttgctgtggccaggctgcgctccgtaccaaggtaggcaaaacgccctgtcacccactgggcatcatacctgggaacctgggcacacccaaaaactgctgcatcatgctctgcccaaagccct

SEQ ID NO: 186526 - DNA, 349 bp, Homo sapiens
catgtcccaaaacccaaacttcgcttatctcctaataactcaatttttgaagccctctcactagccccttgggaagacagacaccttggcatccaacagcttcctcgctggtctgcagttccctctgccatggctgcatccagcccttccttctgtatcgaacctacacaaaactgccaatacatctgttcacctgttttcgctctgttgcttactccatccagaatgccttaaaccccttctcgaacaaatggaactctacaggagttcaagggtggagacaaatacctgcctcctgcttcacaaggtctcagctttgtgttcacagaaagcgttgtgtgtgcccctg

SEQ ID NO: 186527 - DNA, 678 bp, Homo sapiens
attttgtttatatttttgtagagacagggtcttactgttatccaggctgtcttgaactcctgggctcaagcaatactcctgcttcgaccttccacggtgctgggattacaggtgtgagccactgtgcctggcaaaagtgttcattttgaaaattatttctacatataccaagaagtatacaaataataacagattaagcatttaaactaaagggtaatcactacttacgtcaaaacatctaaggaagaaacagcaccagtcccacacaaattcttccagagagcagaaaaaagcaaaatacagtatcatccaactcatcccttgaaacacaaccccaacagtaaaacttggctcagataccacaagacaaaaaccatgggcagtctactgcaaaagaatcccaaacaaaatactaacaggccaaattcagttattcccagaagaacaacacttcacagtcaagtggggcctactccaggaatgcaaatttggcccaacacttgaaaatcaattcaccacatcagcaggaccaaaagaaactggatgataatctcaacagatctttctttaaaaaagatcataaaaaattttaaaaagaccaatagatgaattctcatctgctcaacagttatcaagactttgccacatttattcatgctccgtttttctttgtgatat

SEQ ID NO: 186528 - DNA, 432 bp, Homo sapiens
tccttagctattcattcatatttataagtgaaggatagattagtgtatgtaattagcattagtttttctgaaacttatgtaagtctgtttttccactgtcctactctgaatgggaggtctgatacgatctgtttgtgagttatagatagatggttattggcaagtgttactttagggtatgtaggcatggaaaagtagagattcccctcctcccaggtatcaaaagtatgagaaatttactcttgggatggaaaactttaatgtattttccttcactgcagagctacttctcctgtttccttttctttatatctgcggtagaattttgcagttaactcaggttcctctgtttctctctgaggcccctatacccacagcaagagctttcctcaagtaggcagtttactttcttcagaaaattagctgatttta

SEQ ID NO: 186529 - DNA, 275 bp, Homo sapiens
tggatactggggggtgactgtacttaaaacaatagtgtgtggtggaaagtgctaaacttcctaaaagttgtccaaatggtgagctgtgtgggtttagaagaggggagagaaggcttctagctagggaaggaggggtggagagggtagcaattgcaaaaatctttgtaaaaacagtgacatttgtgacacagaagagcagttgggtgtgtagctcttggggggcggaaatagttttggaggggagacagggtggctgaaaacagagaagagagagg

SEQ ID NO: 186530 - DNA, 250 bp, Homo sapiens
tactaataaaaacttgaatagcacagacaagcagctcagcatggaaatcaattactttcaagagataataatgcaaaaaaaaccattaggataaaaatgcagctatttaggggtaagaacatggaaatggaagtaacttctgagcattatccttgactaaaaaaaatttgtacacacgaaccaatacaactttagtttataataatatcattctgcaatttaccaactgtatatcaagaaacctggtggt

SEQ ID NO: 186531 - DNA, 450 bp, Homo sapiens
tagtttgggcctgcgaaggggaagggaggagtgagcctcgcagccctacactgacagggctaggagggctcctggtgctctccatctcttcctgagccccagctacattagcagaaacagagtctctccaaaaaatgagcaagaccaccctcagcatcggactccatgattggcactgataacagtagcttgagaacactttgctcttttggctatctttctgcaccgccgcaatagtgcgcatgaatgtcctggctgatgtgctcaagagcatcaacaatgccagaaagagaggcaaacggcaggtccttattaggctgtgctccaaagtcatcgtctggtttctaattgtgatgctgaagtatggtaaattggcgattttgaaataattgatgatcacagctaggaaaattgctgtgaacctcacaggcaggctaaacaagtgtagag

SEQ ID NO: 186532 - DNA, 312 bp, Homo sapiens
tccagtccttatgaactctctgtgggatttggctctggtggccacctctccaatggaagttgacccgtgcctcacttcagttgctagactttagtcagcgaatctcacactgcctttgctgggagtggaaggatctcgcctcacccactgctcagctgcctctcccccagtaccctgccttcagatcttgccaaaccactgcaagttcccaggacataccatgcttgctccctcccaggcagctttatcaaaggtatttcttctttacgatgctcaactcttcaaggaggtggtggagcagagaggacctgg

SEQ ID NO: 186533 - DNA, 327 bp, Homo sapiens
tggcagccctcagtaaacctgctggttctgccacctgtcctattccactcctgcaggaagctggagaaacaaaccctcttggctgtctgctgtccagggagtcgccactcccttcattatagccttgctcagagtgcagcggcaggcctggggatggcctcgggaggtaggtggcccctgagcccttctcctgggaaagggcagcagcagggagacgcctcctgggtgtgcacagagaaaagcacagtttccctaactccccgctccctaactcctcgctctttaactctcacctccctaactcccccctccctaactcccttctcc

SEQ ID NO: 186534 - DNA, 382 bp, Homo sapiens
acaaagcttcccatttagaaaaggttcaggcagcctcctgctgggatctgcccaacccctctaggaggtggcatggatgcccacctcttcttccaagggtgcactttgcctttaggtttggggaaaagtactgggcgagcctttgggactgttgtgtctcatgagtgggctgaccttggtggaggcttgcgtttcccatgtggggcctgactttttatgtgtccagccagagtgatgagctcgttcactttccctgcagtgcttccttgttgaacctgaaagagaggacgtgggagcttttgtaggagagagaggacacatgctttattcttgaactgtgaggtgtatgtcaccagagagaattggagacagcggtgactgt

SEQ ID NO: 186535 - DNA, 229 bp, Homo sapiens
tgcaccctgccttctccggactccaacagggctagcccctgctgcccagtcttgccgggtacagaggatcccagtaccaggaagagcagcctaatacccggctgctcagattagacttactgttctgaccaaaggcactgataacagtgggcaagaaaactgccttccaggaagggcgaggtattcagagaaaacgatcctttgtttcccggaagaaggtaaaaatgat

SEQ ID NO: 186536 - DNA, 358 bp, Homo sapiens
tcaaactggtccctgtaaatttactagctcggtggcctcaggctgaggcttcaggtgccaccactgtaaaatggggtcagcaatgaactgttttacaagactactatggggcaaaagcaggtaaaatgacagggttttctacatatagtcaacaaacttctgaagtcccttctaatcaaattatttcaaaggttgctaatgagagaaggtgaaattatgtctgtgtgtgtctcggagctcccagaggacagagaagggcattggatgtcgctggcaaaggaggctgacttgtcccctctggctagagggcagaggtgttgcctaggagctcctatctttcccttcctgcttcttccaa

SEQ ID NO: 186537 - DNA, 498 bp, Homo sapiens
atgctcccaggtgtctttgccatcagggcacaattctgctcccaccccatgcagatcctggcaggttgtcatacaaaccaaggactggcctgctacttacacttttataaatattcaatcaaaagacaaataatgtttttcacttctgagcaaggctttgccatgacaaatgactacccctcaatttgtttggggaacactgaaaaaccaagagttaagaagagaaatggagcaaaccagagaaatgttttggaaagaactttgagagaacaggtatctccagggtaagtcaatcctgggggcagaacacatttcttcactaaaggaacataggagagtaagaattattttcaaatcccaaatcctggattttctcattgctcccagcctattttgcataattgtatacatttgcatgttgtttacatttgcatattgttttctatggactcaaatccctgacaactgtaattatgaaaaatacagactgggtatgtt

SEQ ID NO: 186538 - DNA, 291 bp, Homo sapiens
aagtcagacacttcaagtattctattatcttcatattcctgaagatgtgttcccatctggactggttgcctactggttttatgtatacctgttatcctgggacttccctttaccagcaccttagagatattcattacctctttgtattggattacctgttttttagatttcatgtcttctttcttggtttagtctttcatcttggcagaacaggttctccaagtagctgcctgtgaaagggtttatgtaagttaaactttgagatcctaataggctgaaaatgtcttactc

SEQ ID NO: 186539 - DNA, 357 bp, Homo sapiens
ttcaatcatgtacgttgcttaaatttaagggcttcacacacttgtaccaacagtgataattaactttacataaattcttcgcattattgctgctcacaatgatgccataaataccagggaatttcaagattaaaataatcaagcatcttcagtagaatctttcaacaatactttggaccgcaagaaattaaatgcaacaaatttttgattcctcaaaagaacactactcagatctattttaatcagctttgaacgtgtcagagaatcaatctagtctgttaagtgataaatagctataagcatattacctcttcaacagttgtcgagttgccattccatttatgggaatctagtttt

SEQ ID NO: 186540 - DNA, 190 bp, Homo sapiens
tttccttactttattactgaggaaaccttattaaatgagaaataaattttaagatattgaacagggcatttggtctctaacgttgaggcttcctttactaaatttgtgaactgtgtacacccagggtgtgttgcaggcgggcaggtcaggcagaagacattgtgatccccaagggattattaagtttttt

SEQ ID NO: 186541 - DNA, 451 bp, Homo sapiens
agtggagagagaacgaaaatgtaaggagcagcaagacagatacaagaaggacactaggaaggagatttttcaagcagtgattgtccacaggctggctcagatgccacaccacagaggtacaaacttgaagtggtctgggccttctccgtgtgaaaatggcaaatccattcactgtttgctggatgaatggacttatcattgagctatttgctggatttaccatctagctaaaagatagctaaaagattccagcttagactatgtcatcaagaaaggaggcctgatagggtatgaaacggggaaaacaagaaaaacaaacaaaaatggatgctctcagctcttgaaaggatgatttatacccgtgtttgagcaaagcagattctgccttcagagaagcagcagcaaagatagctcatttctcaagcagcaccccatctcatccatcacccac

SEQ ID NO: 186542 - DNA, 140 bp, Homo sapiens
ggccatctcagcctgggattatagacgtgagcctctgcgcccaggcagcctcatctctgctgctccattttacctttccctcgatcattctccctttcatccaaaatcaggctcgcaaatgagattctccaaaagaaagg

SEQ ID NO: 186543 - DNA, 495 bp, Homo sapiens
agactatggacaaagataaaaacagataaaaataaaaggaaatacaaatgaaaaactaaaacaaaataacatcagcaacttaagacactgaaagcaagaaaacaaaagccatctttcaatcaacgtaatattaataatgtagcaatgttaattcaaaaaatgaacacctttacccaaacactcttcaaagactgcttttccctcctaagatttttcatgaaaactttagttagcaaataatctcacgataaaaagccgaagagtgaagagcacagctcctggtctcataccaatggctactatccctagtgctccggcttttctaagacacttatacaagaagatagcacgatccctcaaagaatgctgagcaggccgtaagtgcgatttgtctaacttcccatgagcagtcaacgggtacaaccaaacatagacccatacacatccacatcccctaaaaaagtagtctggattttcagtcagaaaacagtcggc

SEQ ID NO: 186544 - DNA, 166 bp, Homo sapiens
ctgggtatattcttgatccttgtttactggcagaagctctctgttgcctcaggcaatgggctgatccatggaatgcacagtggcttgagctccctgctcagtcccaggaggtaagatgagtggggctggaccagagcaggcctgtctacaggtccctcaatggcag

SEQ ID NO: 186545 - DNA, 525 bp, Homo sapiens
caacatgctcagaactttaaaaaaaaaaagatgtgttaatggcattcagagatgcagttatttgccctaagaataggtagagctctgaaaaatgtcttgtggtttgaattttactgaaaaattggaaggatagcatcactactgtgaacttttctatttggtattattttgacttcaaaagctctgaattttgagattaagtatacaaattcttaaaggataaaaatttaaaggagatctccatgtatcatcaagagcttatacatcacttagatatggccaagattataatattttggaaggtgtattctcaaacatgagtgtttgtggagggatatggggaaatattggatattttcccataatcagcaaactttttctgtaaaaggtcaggtagtaaatatttccatctctttagatcatacatagggtctctcacattcaactctgtgattgtagtgctaaaatagccatagacaatatgtaaattgtagataaggctgttccagtaaaactttatttaaa

SEQ ID NO: 186546 - DNA, 385 bp, Homo sapiens
acatcaccacggtgtaaacatccttatggctcaatctggcccatatccttatttcctcaagaccaattcccagaaatgtcacctacttctactttatattctctggatatatcttacatacctttacaagatgccttaattctttatttaagagaggtacaggggaaataactgaacatttaaaaaaatgtttccatacattacaactgttttggaaaaaatatcttttgacagtatacataagggtaggtttttaaattctctctcttccctctacttaatgcctcacagtccttatgaaaaaaaaagtgtatatttctcaactggcaagttatgaatcctgctttaaaagagagaatttctttccactacttaaaaagggctg

SEQ ID NO: 186547 - DNA, 313 bp, Homo sapiens
cttcctgggttcaagtgattctcgtgtctcagccttctgagtagctggggactacaggcgcacaccaccataaccagctatttttttttttgtatttttagtagagatggagtttcactatgttggctaggctagtctcgaactcctgacctcgtgatctacccgcctcggcctcccaaagtgctgggattacaggtgtgagccaccgcgtccagccaaaatatatatgtttttaaattctaggaaataacgttgatttggatatagaaaaattaaataccagggaatgctggcttataaattttagtccagc

SEQ ID NO: 186548 - DNA, 105 bp, Homo sapiens
ttgggataaaacaagagacagacagacagacagtgttggggaaacaggtgttggctgggcccagcttctgtcccatgttttgtgaaattgttttccaaccctttg

SEQ ID NO: 186549 - DNA, 347 bp, Homo sapiens
ccctcctcgaggtaacataatcagggccatttctccaatcctaacctggcaagagatctgaaatcaacagatgccttaaataatatctcaaacttactattaggcagataagtggcttaaggtaaacattaaataaaatgttaaagctgcccttcactacatgagtactgctccctttaagagagctgttttgagccacctcactaaaaacacagacttagcaaaagtttggatgtggttcatttactttaaagataaattactcgtttcagataatccatctaaatagtaaatcccccttactttactcaaaacaaccaggaatctaaaaattaagtttactctga

SEQ ID NO: 186550 - DNA, 303 bp, Homo sapiens
aatctggtattatgaaggataagatgtttgtaagtttagtttaagtcgttagttcaaatgaataaaatatatgccaaaaatctccgttttctaattatagacaaggaaatttgatttgatgtgtcatatatttaaaacaaatacctaaacaattgcctaaataaaagagtgtcttaactatgcattttagaacactaggtttctaaatcttacccattcacagcaaagtgagatcttttctggacccacatgactttttagccttctcagacctgagaaatgttattaaagtttaatattatg

SEQ ID NO: 186551 - DNA, 359 bp, Homo sapiens
  misc_feature (44)..(44): n is a, c, g, or t
gagctcggtacccccaggttgtgcaggtccatgtgtgctgtccntcacgcaacctgtacccaagccatacacacactcacagaatctcagaatatcagaatcaggtcactccttttacagatgaagacactgagtcctggagatgcagtcatgacatcagctattggcacgagcaagcctagggaccgccaaccctgcagtcagtgctctttccacttgccggctgtctctgcaatgtgcttctgacaatcagcccattctttctctgcctggtccatgacttaaaacaagtcagccaagtgcaaagggaaatggaaagtctgcctggaaccagcagagcaaaactattaatacaaagt

SEQ ID NO: 186552 - DNA, 408 bp, Homo sapiens
ggtcaaggctgcagtgaactgagatcatgccactgcactgcagcctgggtgacagagtgagatcctgtaaggaactgaaatcatgtactggatttccccttaacacacttatcaaagttctctgggtaagcttttaggatggagggcttctttaaaacacagcagtatcaatgctttcttcttttgattcttgattcccacagcactcacagtttatattatctgtctcattgctcgttccttctcctcttctcctctaccaaacttcctgaaagagttatgtccactcgtgttcttcacatgctcacctcccattcactccttactcttggtcctctaagtgtgatctgtggaccagcagcatgggtatctcatgggaacttgttagaaatgctgaatcatgggccc

SEQ ID NO: 186553 - DNA, 253 bp, Homo sapiens
tcaagagaggaaagggaaacttgtcagagcagcaacagtagctaagataaagctatataccttcgatttcagctattgaagagtaatggatacaggtcccaggtgaagtcagaacacttttcacccagactacaaaactcatttttgaaaaagattaatatggggcagtagaaccagcactggagttcgaacatttaaatttgtaacgataactctgccattaacaaactaaaagacttcaaacaaatcattc

SEQ ID NO: 186554 - DNA, 525 bp, Homo sapiens
ctctggagcttatccatctctctattacaacaagtactccttcaagcaaatgttgaataaatgaatgaatggacaaacaaataaatctgttctgtcaatccttaacagccagctgaaggcttaaatcagagaacttaaattgcccctgaaataattactgcaatctgtactactcttcagacaattccctatttctgtcaacctacccctaactcaatatttaactgatttctaactttgtgtctcaactatgtgatgctttccaaaactagaattaccttggcagccaggtttatagacttcaaagaaacctgatgctgctatggatggaaatagggggcaatagggggcaagctggtttgtgtggtgagtgccaaggttaagtaaatagacatagtggagccaaacattcacctgcatttcaatatgatcagatttacacacacacacacactcttaaagttagcaatttatgctatgagaatgagaatattttagacttgaggaaactcaaatttaataaaa

SEQ ID NO: 186555 - DNA, 747 bp, Homo sapiens
taactgaaagggaggtcttccttacccctccatagtccctgaagacattactaaccaacctctcccatactctttgctgagccaagacaccatgcggacttctcaaggtggccttccactaccaatcagagtgggtgcagatgatggagtggtcaaatcagaatctggaagcatctgttctgcttctggctgcatctcttaagagctgtgtgaatggaagcttctatttctttatttgaaatgggataatgcatacgaaagcatatgaaacattttttgaaattagatattataaataggccatgtaatatggtcttaaactattatttcagtcttctattgagatagagccagtggtgtgcccatttaacaaccaggtctcaggaaaaaatagctctgattgtagcctttgctgacttccttggtgcaaataccacatggcagattttaaactacgaatgagacatcgttgaatacagacttggaattcacagcaatacgctgttatacagtgttttcattgtacggatacagtagatgttgatcttctcaagaacatagataatagtagaaggtagtaaaataattcagaagtgatgatgtttgagtattgccttttgttttagatctacttttaatatttagtatttaacaatggctatttttagcaactggcctgaaaatttctgacaatttaacaattggctttcactagtgggcgtgagtcagctctagcacacttctggt

SEQ ID NO: 186556 - DNA, 353 bp, Homo sapiens
attgcccaggctggagtgcagtggcacaatcatgtaatcatggctcactatagccttgccctcttgggcttaagccatcctcccaccttagcttccaaatcctgggactgcaagcccatgccaccatacccacctgattttttaattttacagagacagggtctcactgtgttgctctggctggtcttgaactcctggcctcaagtgatcctcccaccttggcctcccaaagtgctaggattacaggcatgaaccaccatgcctggccttgaatgaatcttttattcatgcatgattttgtaatttcatacagcagtcatttggaaaaattggttctcttatggagattttat

SEQ ID NO: 186557 - DNA, 434 bp, Homo sapiens
gcttgatcaaagagaatcaaagtcacatcccacttctgaggcatccttaatcaggctatgacacagaacagatgggtaaacctttagagtccttcatttgcatttatttgcacttcattgtataacatgttcttattccaaatccctcctttctttccttcaaatctgttttgagcacttgctaaataccaggcactgtgctatctcattgcatcctcccaacagcctgttttatggctatcagtaataagaactagtggacttttttttttcttctgcatttatacgatgccaggcacagtgctaaatattttatgggcaacattatctcttgtaatcatcactattaatttaatgtgatccagtagaggtccacaatcccttatctgaaaccctggggccagatgtgttggaattcagaattttttggacat

SEQ ID NO: 186558 - DNA, 150 bp, Homo sapiens
caggaagattgcttgagtctagaagtttgagaccaacccaggcaacatagcaagaccccatctctaccaaaacaaacaaacaccacacagtgtttcctcaaaaaattaaaaattgatacataaactctacttcttgatatatacccagaa

SEQ ID NO: 186559 - DNA, 386 bp, Homo sapiens
agaagggaaagaaaggaaagaaagaaagaaacagtacaccagaagtatttccttccggtagctaaccactccttttcacccaaaggtaaccgctagcctgacttctaacagcatagagcagtatccttgtgtttgtgcattatatacatgtgattttttgtgtctggtttctttaactcactatgatggtcatgaggttcatccatattttgagtatagtcactgtttgctcatgagaatgctgcagtgcagtccattttgtgaatataccacaatttatgtattcaaccaattgttgataggcattggagtagtctacattttggaactattaaaaatattgctgctatgaacattgtaataaacgtcttctgatgaacatgata

SEQ ID NO: 186560 - DNA, 314 bp, Homo sapiens
tgctgtgattacaggcgtgagccaccgcgcccggccttgtttcccttcatcttaaaaggcagaacggcctctctttggggtgaccggaggcaaagagctgttgggagtgttttgtggggtctcttcttccttccttgtggctacatgaagcctgagtctcagcctctggtttcttggtttctttccactgccctgggcaaaccagcttcgactgaacgtcagccagtccagagagtaattaaaagagttaagtctcaaaagtaaatctccgggaagagccctcagtggtttcagacccccaggcacttgtcctc

SEQ ID NO: 186561 - DNA, 483 bp, Homo sapiens
tgaatggacgctgggccccggcaaatgaggcgctgtgggtccccaagaagtggggtaccaggctctactcccaccccggcctctgaaacgcttctctctcggccgctagcctagaggctgccagggttgggcactgttctcactcacacgctcacctctctcgggcagtcctcgagatatgtgaatggtggaatgaatgctctcactggggctgtgtcaggatgcgtttttaaattttctcaaattaaatgccaacccctcattccccaccccaagtagttggttcgtttgtttttagagtaactaccaaagcaacagcaatgttaaccgtccttgattagctggttatttggtgtagggtttttctcatcctcctttattcttcctgttaaaaaggagggcttgaacaaatccttcctaactctgtctctgccatatgaaaagggtggggggagaagagaaggaaggtggggagaaaggaca

SEQ ID NO: 186562 - DNA, 682 bp, Homo sapiens
  misc_feature (21)..(21): n is a, c, g, or t
  misc_feature (33)..(33): n is a, c, g, or t
  misc_feature (74)..(74): n is a, c, g, or t
  misc_feature (127)..(127): n is a, c, g, or t
ccaggtagacctaacagaganaggaaggaacgnaaactgctgaaatgcattacagaggccaatgcacctgccantgctcaggcaatgagactgatcctgaccagaaactcgggcaagcagaaacaancaagaagcagcaaataaaacatggcaaaataaatgcaggatgcagttagaatgaagaccgaccagaacatcgttaggtatacctgggataggtctaccctgggttaggttacctaggtagacctaacccagtcatttttaggatcatgaatgataatagcttctttttcatagtcatacatatgtggtttagaataaagtgagaggtcatcagtgcttctacaattattgtacgttctacattatgatacaattttttgctatccatctatttctctccttataatgagagcccctcagagatgtgaccccagtctctttgtttctccatgacctagcacaagtaggcactcagttatacttattgaattgaactaagcgacttttccatagctcataagtcttggaagaggccagcattttcctttatctcattttcttttctttttttttgcctattaattaattagtttatttttttatttttttattatactttaagttctagggtacatgtgcacaacgtgcaggtttgttacatatgtatacatgtgcc

SEQ ID NO: 186563 - DNA, 431 bp, Homo sapiens
tgtcatcttcctagtaagagctgaagactgggggctgcagacagtcccccactcacttggcttatttcctgggaccatgggtgctgtgggtggaactgaaaagtgagtgagtaatttggagatccctatggggcaccaggcagaaggctctttaataatttcagggtgaagccttcttgagaatggattttaaattagaagtgagattagggtggtggattggggtcttccctgggggttagaatcgaaggagaaatccctgcttagggagcacctgctttgtgcctgggaggggcaggagtaacagagctgcctaggaactaggcccctgaaaggactgtgagaccaagttcctaggggacagacactgagcaccggcctgaacatcgtatttaatatttctgaatgaatgaatatattaaacgcagtgg

SEQ ID NO: 186564 - DNA, 243 bp, Homo sapiens
gccactgttgcaattggttggtttttctgcataacagctgggtgtcttagaaatgagggggtttctatagtaaccaattacagccatgattggtgaaaaatcacagaaatatcctgtgtgtgaagttatgccagcgaggcaggcacgggcttaggtgctatggttttaatttcctggggcaatatttctctaagtactgatggcaggcaggtttgcttgtcatggcttttgattcagcctgcc

SEQ ID NO: 186565 - DNA, 452 bp, Homo sapiens
catggatgccttctgaggccacctctgtaaattgtgaaagtactttatgtaaactgtggcacacttcataacctcagtaagtgatgaaaaatggcattcctccaagatgcagagtctgagggctcaaaagtacctggttagtcttgagtacttgcttctcaatggccagactggcatgcagtctgtccaagtctttttaactttgcctggcacttattttcagagcccagggcttgtagttagtatttgtctgattaacgatgaggttggttaagagttagaatggggagggtgggaagtaagtgatttaacttgaggcttgaacctggaagttcatctagaaatagacataaacattgcccagggaaagtatcaccaatgtggatttttgtttctttcaaggctactgagctgtcatgactttgtcattcccttttctggcccttttagaa

SEQ ID NO: 186566 - DNA, 302 bp, Homo sapiens
attgcctcattgaatcctcagaacaaccctgtgagagaggtacaattattatctccattttgcatttgggataactgaggcatacagaggttaaataattttctgagtcacataattaacaaatggagtctctgcaaccattcaaacgtcttctcctcattcctttagagccctaggttggagggtaagttgagtgtcttcctttctgttcatcaccacttctaagccattgtcctccctgggtccttagtgcagtcatctcctgacctcgctttcctctgacccattgcttgaagatgtca

SEQ ID NO: 186567 - DNA, 479 bp, Homo sapiens
atcttacaggaagcactagctgcctaccactagtggggtggagagaaatcagcattactggaggcgtgcccacacttacctctcattgcttgtcttcagtggttctgttccttaaccagagtagggatagataattataccaccctggttcccttgctctggatcaaattttgtttttacccaaagctttgtaaaaataatagcttgtaagtaacactacttgctttatgtctatataagtgaaaaacatttttttgttgttgttagagacagggtctcgctgtgttgtccaggctgaagtgtagtggcacagtctcagctcactgcagccttgtcctcccaggctcaagtgatcctcccagctactcaggaggctgaggccagaggatcccacaagactgggaggttgatgctgcagtgagctatgattgcgtcactgcactccagcctgggtgacagagcaaggtcctgtctcaaga

SEQ ID NO: 186568 - DNA, 250 bp, Homo sapiens
cacagtggattctgggatgtacagaagttaattagaaagaaatgcacctgcggcgggcccgcttcggccatctctccggcccagtttccctcggcgtgcgactgtgtgctcagcccagcaccatgggcaagtgggacaaatgggtagcctatatgaacccaacagcaatggcgagatcaaggggtccaatccagtcttcagggccaaaaatacaggattatctgaatcgatcaaggcctacctgggaaga

SEQ ID NO: 186569 - DNA, 303 bp, Homo sapiens
cattagaattagctagtcaattttcaaaaaaagaaatcttctaagagtctgatagaaaatgcattgattctatagatcagtttgggtagaactgatatttttatcacactgaaccttttaattcttgaacatggaataccccacatttatttaggtcttaatttctctcaataatgttctaaagttctctgtgtattcggaatagtcttgtatatttttcattaaatatattactaggtatatgatgatttttgatgctatggtaaacaatgttggttttgaaatttcattttataatcgctt

SEQ ID NO: 186570 - DNA, 606 bp, Homo sapiens
ccccctgtattgtctggctacttcactgccataatgtcctccaggttcatctatgtgtcaccaatggcaagcatattagttgagtgtaccatcttaagatacgcaatgacttggccaggcgcggtggctcatgcctgtaatcccagcattttgggaggccgaggcgggcagatcacgaggtcaggagatcaagaccatcctggctaacataatgaaaccccatgttgcccaggaggatcacttgagtccagcagtttgagatcagcctgggcaacatggtgagaccctgtctctacaaaaaaatttaaaaattacctgggtatggtggcacacacctgtagtcccagctactcaggctgaggcagggaaggattgcttcagcccaggaggctgaggctgtagtgagctgtgaccattccaccgcactctcgcctgggtgacagagcaagaccctatctcaaaaaaagaaaaagggaaaagaaaataaaaaataaaaaacatggccactgttctgaaaacagtgagtagtccagagtggcaagatcagagatggtgttgagaggagtggcaagaactaccaggaaggtatgtagatatacccagaaa

SEQ ID NO: 186571 - DNA, 344 bp, Homo sapiens
caggtgatccatctgcctcggcctcccacagtgctgggattacaggcgtgagccaccgcactggccagagcctcctttttgttcccacagtgatgacttgagtctcatcccccacatctcttgctccacttcccccacttaggatgaccttcggacacctccaaatccattgtgtaaagtcagccccatctcctcccttcagaactgccctccctcctgggtccccatgtaatctttccccagacctcttccctgacaccctccagccaccaagtgagtcccctcttccctatgcccactttcctgcccttggctagactatcacttgccaaggatacacatca

SEQ ID NO: 186572 - DNA, 410 bp, Homo sapiens
gaacttctagcggcagaaagggggtgatcctttcttctccatcataagggtcatggcccacatccctgtaacaaaagacaggttaacgagagaaaagcattatacatttacttgatcctggttttacggcatgcgggagctacggaatgaagacccgaagattcaggggaggtcgtctgtgtgccttggttccatgacttgggggcagccaagtagaagtggaattggacaaatagggcatgagcgggccgggcgtggtggctcatgcctgtaatcctagcactttgggaggccaaggtgggtggatcacctgaggtcaggagttcaagaccagtctggtcaacatggtgaaaccccatctctactaaaaatacaaaaattagccaggcatggtggcgggctcctgtaat

SEQ ID NO: 186573 - DNA, 500 bp, Homo sapiens
  misc_feature (346)..(346): n is a, c, g, or t
cacactttctgtttcccactctctcccctgtgcacactactactgtttcactcctgcttgaaattcactcctacattcatcccatccacagccatagtaatccaagcacctgatagcaaaagtcaaacacactggagtctatctagatggggatttcagtgtgcctggccacagtgactgggggagcctctttctcctcgcattggcactgctggtctaaaattccacttgtcctccggggttcgtgagagtgccctttcctgttaggtctacctgggttaggtctacctggggtctacctgggttaggtctacctggccaggtagacctaacccaggtagggtgnggggcatccatatagtcactccaggtttatggagggttcttctactattaggacttttcgcttcgaagcgaaggcttctcaaatcatgaaaattattaatattactgctgttagagaaatgaatgagcctacagatgatgttaggtctacctgg

SEQ ID NO: 186574 - DNA, 115 bp, Homo sapiens
tgggcaaactcgtcatcctcaaatctggctaccagcaagacaattgccaacactctgaccccaagacattggaacaatggagaatatccacaagcacaaaaaatacttttggtca

SEQ ID NO: 186575 - DNA, 361 bp, Homo sapiens
  misc_feature (300)..(300): n is a, c, g, or t
cttcactcagagtgaggtcctgcaggaagaaatcggcaaggccagcagcgggcgtgggagatacgggcatagaggatgcaaacgctgtcaggggttcagcctctcaggggcccctgactgaaccttgggcagaagacagtcccccagaccagcctcccccagcttctgcccgctcctcagtgggggaaggagagctccagtatgcatccctcagcttccagatgtctgttattcttttttattttttgtgtatcttgtttttttttttatttgtttattttttaggaataaacagtcttnattgggctcagaccagagtccgtagggtcctgagacctctgtgtattgtcaaagaaacgcg

SEQ ID NO: 186576 - DNA, 457 bp, Homo sapiens
cggtccagtgtgctgtctctcagcctctaggggaatgttcattccctcttcctagcttccggtggttgctggcactccctggtgttccttagcttgtagacatatcactgcaacctctgtctccatcatcacatggcattttccttgtatatctgagtccaaagtgtttcaatcttcttcctttcttgaccatccaaccaaattcttagcaactgcacataaatcaatggaagtacatacttctgtcctcttgttccagacaaagtagatgtattactttcctagggctgctgtaacaaatgaccacaaaccaagtgccttaaagcaacagaaatgtattgtctcatagttctggaggccagaagtctgaaagcaaaatgtcatcaggccatgctgtctctcaagcctctaggggagaattgttcattccctcttcctagcttccggtggttgctgg

SEQ ID NO: 186577 - DNA, 417 bp, Homo sapiens
ggctccggcattagggaaattggaaaccaggcatggaagcagcgtccctaccttcctcggccaggttcataaacctggggctcaatccgcctctccatgtaggacactgtatgtttgcaggctgaggaattggccaccactgttctaaagacaagcaggcatgacaagatgggcgttaggcctgttgccgccaggttttgccggctgccgtccttcccaaggctttcccttctccatccatcctcccccggtccctcgacacagcactagagtgagaacaccctggatgtgacttggggactcctcctcggtgtgcttgcgtggagagtggagaggtgcgtcgtttgtgccccgctttgccatgaccggggtggtcctggcacgccgggtatctagacagcttttcatcagtcgctc

SEQ ID NO: 186578 - DNA, 788 bp, Homo sapiens
atttcactctgcagtacaaatttttagaacatattttggggtaaccttttgagtttgcttctcttagtttcattagtatctcaagagataatatacattgccagtgtagcataatttcattatcctaagaaggaaaataatatacttcctaaacaatcagaattgaagtcatagtcataattttttttttctttaatggataaggcttcgaggaaaattatgaaatgtattgtgctttagtagtgttagctgactgcattctctctgtggtttaggcttgatcatgaatgatgttgggatcctctgagggagagaagtgacagtaaaagaagggtagtaattgagctctttgggattggaactgctcacagtcccaaaagataaagcacaagtggcatggtcttttctatctagggcttaagctacaattactttgctttcctttagagcaaggtttagtgttttgttatgtatctttttggatttttttttcttttggctattgtggttttgctttctttttgtttctaatattataggttttagttatatagttaccttctgttaagacaagaggtctttagacagtgttggagaagaaaaggcaaaaccttcatttactgaaaatgaattacataaatgtccgatcaggttacctattaaattatgaatgttagtgtttaatagtttagtatatgcaacatatatttgaaaattataactgctattaaactagtgttttggaacttttttgttgcaaattatttgcttcggaactactgaatttg

SEQ ID NO: 186579 - DNA, 198 bp, Homo sapiens
ggcatttgtacatttcagagcacagggaaatatggcttgagagaaaggtgggtttgatcacagctttgcagtcttaaaatacttgctaatcacaactgatttggtgattttgtagatagttggaagctactgaagatttctgagaaagagaatgctatagtttgatattctttaagaatacatatctggcatcagggt

SEQ ID NO: 186580 - DNA, 265 bp, Homo sapiens
agtgtctccaagacctttcaaacactgtaatatcctgactttcaagataattgaaattgcagcagcgcagtcttccctttaaggaactggtgtttttgaaattaattagaggctggaaggaacttgagccatcttctaggctttcagaagttactataaatggattgtgatctggtggaatggatagctgccttgggagtcacaagataggtttgagtcctgtgtctgctcctaaaaaatggtgaaatcacttaatttttctgaa

SEQ ID NO: 186581 - DNA, 325 bp, Homo sapiens
ttaaatttcctttttttgttgggatatgttcttgctctgttgcccagtgcagtggtatgatcatagctcactgcaacctcaacctcctcagcttaagcgtcctcctgcctcaggctcccaaagtgctaggtttacaggcatgagcactgcacacagccataggagtttttcaatctgaaagaaagaacattaatgtgcaaaaagttttttcaaagaaggtacaaaacccaccagtaaaattaagtaaacagacaaacccaggatactctactactataaatgtgtgtaattcacttataactctagcatgaagcccaaaagacat

SEQ ID NO: 186582 - DNA, 303 bp, Homo sapiens
ttagtgtattttatatgtggcccaagacaattctactttttccaatgtggcccagtgaagccaaaagattggacacccctgccgtaaatggaattaaaatgttgggcataagatatcctcaaaagactgtcataatatattttgtggaaatagttcacttcatttctatgattagatggattaccaataatttatagtttattatgagtaatgctgcagtgaacattccccatatgtcctttggtgtacatgtttgtatttctgttgattatatacctagaattggaattgtttgggcatggg

SEQ ID NO: 186583 - DNA, 433 bp, Homo sapiens
aacaaccacatttgtgcacatggtttttaagtcttctaaaagcttgagtgagggggatgggaatagggcaaggtaaaaaacacctcaaagcttactgtttttactgatattcggctgtttttcttgaataaatgctccttggaatgttgcaagtctttgttaattcctagagtactgaaaaagttgatttggacaatttttaccactgtttttgttgctattgtggaggaagaaatttttgatggtccgttctctgctgttctaggagtgttgtctataaaattcttttaagagcacttttaaaatttgggatgggacaagggaaaattgttctaccaaaaatacatctgcactcaaatgtttattgcagcactattcacaatagcaaagtcatggaactaaccctaggtgcttatcagtggtggattggata

SEQ ID NO: 186584 - DNA, 470 bp, Homo sapiens
ctgtcaccaaaaatcacctgggacccacttcactgactgtctttccaaatgacatttgtcaaagaggaggagattcctagttggttagtttaaaaataaataaataaaggctgaggcatttgtccatacatagttcttcctagcttaatgaatgcaaaaatagggctaacctccttcttctaccaacattttcccctctgggtttacttgatcattgtgtgatttattttccttaagaatgcatagtgttacctgcatatgaaaagatgcttaatatatatcactaatcattagagaaataataatcaaaaccttgatgatatgtcacttcatggccattaggatggcgactattgaaaaacagaaaattacaagtgtcaacaaggatgtggagaaattggaaactttgtctactgttgagattgtaaaatagtgcagctgctatggaaatcaacaggcgattcctcaaa

SEQ ID NO: 186585 - DNA, 182 bp, Homo sapiens
gccgggctgtgacatgacttgacttgggttttaatggaatcactgtggctgctctgaggaggaaaacctccaagggatccagggcacaagcaaggggaccatttagcaagctcttgcagtacttcagcacaagacagtggcagtctggtccaagacagtggcaggcgaagtggtgggaagtg

SEQ ID NO: 186586 - DNA, 171 bp, Homo sapiens
gctattaagagcttactcatatatagtggtgtctctcaagataagaaaatatactttatgtatttattaaggtatgatattgaacaaggtaaagaatagggacaataaattctgtttgtgttgtattgaatattttaatatcctaacagaaagcagatttacaatatcttt

SEQ ID NO: 186587 - DNA, 1069 bp, Homo sapiens
gtgtggtggtgtatcccagctacttgggaggctggggtgggaggattgcttgagcccgggaggttgagtctgtactgagctgagattgtgccactgtcctccagctcaggtgacagagtgagacgcctccagggcaaggaagttgtggggtcctgatgggaatctggatttcctgaatgtcacttagggtgatcagtccatgtgatggtctttgggtgtgtggcggggcctttccagccatctgctgtgagtggcagagctgaagtgcattaaaagcctagtgctgtgtgatcagtctgggtgtgctcagccatgccacatggcgaggatggcactgcaccgtctggggtgctgtttccaggaaagccttcccttaaagctggccactggagtacctgactcaggctgataaggtatttatagttcaaaaaaagttgctgaatggcagtaatcccctggtgaggaacattccccatggctgtgctctccaaagtttgccaagattgggtgaagacgttcactgtgaccttgattgtagtggcaaaacctgaaaccaagctgtactcatttgtcaggggacttacaaagtagagtcagcacatattcatatactgtcatcctgggcaccaatagggattagggagctatagttggattgatctgccatgctgttcaggatggactgggaagttgaaaaaggaagttgcagaattggtgggtatggtaaagactcatttggtcaaatgaaggctgggtgtaattgtaataaagatagacacatttggcttggtgcagtggctcacacctgtaatcccagcaccttgggaggccgaggtgggtggatcacgaggtcaggagttcaagacaagcctggccaacataatgaaaccccatctctactaaaaaaaaatacaaaaaagttagcctggcatggtggtgcatgcctgtagtcccagctactcgggaggctgaggcaggagaatcacttgaaccccagaggtggaggttgcagtgagccaagatcacgccactgcactccagcttgggcaacagagtgagactttgtctc

SEQ ID NO: 186588 - DNA, 510 bp, Homo sapiens
gctagaggatcccctccataatgtgtgcccagagtcagcacatattcatatactgtcatcctgggcaccaatagggattagggagctatagttggattgatctgccatgctgttcaggatggactgggaagttgaaaaaggaagttgcagaattggtgggtatggtaaagactcatttggtcaaatgaaggctgggtgtaattgtaataaagatagacacatttggcttggtgcagtggctcacacctgtaatcccagcaccttgggaggccgaggtgggtggatcacgaggtcaggagttcaagacaagcctggccaacataatgaaaccccatctctactaaaaaaaaatacaaaaaagttagcctggcatggtggtgcatgcctgtagtcccagctactcgggaggctgaggcaggagaatcacttgaaccccagaggtggaggttgcagtgagccaagatcacgccactgcactccagcttgggcaacagagtgagactttgtctc

SEQ ID NO: 186589 - DNA, 337 bp, Homo sapiens
cttgattagacttatttatttgttgaaaagtctgtgtggctggtgtgtggaaaataaagaatggattgaaaaggaactcaagtggagcatcaagactcagttaaggagttaatctaggttggaaataattgtagcttaggcctggatgctggcaatagggaaggggatggattcatgaaagaatgggatacttgagaagaaatatttctgtgctggagaagtagattggggagttcatggcataaacattataatggatgctatgggcatagataacataaacatgtagagaaagtaaaggtgacctagggcagaagccttaggaacaccaaagttt

SEQ ID NO: 186590 - DNA, 195 bp, Homo sapiens
agactctatcctcacttcctaccctgacctcaaagctgcttgctagtaacacaggtccctagcagggtcatgcctcatttgtggaagataaatagttctactctagcatcaacaacaacccctcacacaatgtctagcaaagagtcaatgctcaacaaatatctgttgaatgaatgaacaaatggatagatggat

SEQ ID NO: 186591 - DNA, 187 bp, Homo sapiens
aagcaggaagagaaaaatgactcatgacagacaaaggaatcccaataagatgaacagctgagttttcatcagaaacaatggaggccagtaggcaggctggcgacatattcaaagttctagggtaggccaggcatggtggctcacacctgtaatctcagcattttgggaggctgaggcggatggacca

SEQ ID NO: 186592 - DNA, 509 bp, Homo sapiens
ctgctctcactggattagttccacggatacatggtcctctgcattagctgggttctctatcttgggtgacatcaaacctagagatgaactctagcccctcactgatacctcacaactcagtctcagaagacatttttgcatggaacagactttaatgaatggtgggtgagggggtgcctgctattgaatgaataagtatggggggaattagtcacaggacttcatactgagcattagagtccggagtctttgttcttggaagtcttcagctcccgcccggtccctgaggatcttcccccgactgcttgatcttgcatcattgccctccctccccgagggagcaacacagagcggccctagtccactctcatgatgcctccattaatcccccggtcagggaccttccagccctgcccacagcagtcgatgccttcagtgcatctcagtcttccacccccaaaagcggtggggggtctctgtgcgggatcacccctctcctaatacccctg

SEQ ID NO: 186593 - DNA, 915 bp, Homo sapiens
aaacatttacaattaacatcttaaaggagtatttttctccatatacatatataaaaaatcatgttctgggtgtggtcgctcattcctataatcctaacactttgggaggcctagacaggaggattgattgaggctaggagtttgagactagcctgggcaacataatgagaccccatctataaaaaaattagaaaattagccaggtgtggtggtgcatgcctgtcatcccagctactccagaggctgagatgggagggtggcttgagcccagcagttggaggctgcagtgagctatgattgtgccacttccctccagcctgggcaatagagcaagatgctgtctctaagaataaaataaaagtaaatcccagcactttgggaggccaaagtgggtggatcgcttaagcccaggagttcgagatcagcctggacaatacggtgagaccctgtctgtaccaaaaatacaaaaagttagctgggcatggtggcctgtagtcccagctatcccagaggtcgaggctgcagtgagctgtgatcgcaccactgtattccagcctggatgacaaagcaagaccctgtctcaaaaaaaaaaagttcacaaataaaagaagacaaataggtcttaaacatatgacaagatgttgagctcactgaaaagcaaatgtgaattaaaatttcaccaagagactgtttcccacttagcagtttggcaaagataaaaatctggcacctcacggctgggtgcggtggctcacgcctgtaatcccagcactttgggaggccgaggcaggcagatcacgaggtcaggaggtcaagatcagcctgaccaacatgatgaaaccccgttgctactaaaaatacaaaaaaaaaattagccgggcgtggtgacgcacatctgtaatcccagctactcag

SEQ ID NO: 186594 - DNA, 496 bp, Homo sapiens
gtgtgccatgctcctgagaagtttctgggttgtggctttaatgttctcctgcagtgagaacgctgacacttggccaaagggtcctcacctctcccctagtacacttctgagatgccaggaaggttctgaacatcagattgattcctgggactcccctccagggtggccttactggagtcaggagcccctgccccactaggatggctctgcagtggcctgaggacagtgagcactgactggtcactggtgcaaagttgcccactgtgatggttttgaccgttgatgggaaccaagtgaaagccctgcagctatttctaggcatttcagagggtgcttccctgcatgtactctgctgcagaccatcctccctgggccaggagcccgctacacagtaggagattctttttcttctcttttgagcacttttattctctttttcttaatctctgctcctcctttgaactgagaaatgtgcaaatcttttttgttagttttg

SEQ ID NO: 186595 - DNA, 274 bp, Homo sapiens
atggcaggcagagaccaagaggaggaaggagagggaggaaagaagagattcataggtaaaggcagagccagggaagaaatggtcatgatgaagggaaatcatccatcatgactggagaagtcattatttcaccagcaagactggttcactggcctgattagtaccggggagtgggactgaagtaacccaaatgttacgcatttttttcaatgccatggtattttgaaaaactgtttaatgtcgccctatagttggaggtagattgttgcataca

SEQ ID NO: 186596 - DNA, 366 bp, Homo sapiens
cctccactcccatctcattctatctgtatctcgctctacttaacctgagctatactgaatttgcattcggtttggacaagtcttagttcctcttttggcagatcatcttcacatttccatcaacatgcagcacaggtggaaaaaaaggggccaataactggatctgcctggggaatctggaagcccaagaggagctgcattttgggaaggagccaggctaggggcttaaactctgtacttgggggtagggttgcaacactggctcgaaggggaagaaagggattatcctcaacctttcacacatccagactctgggagatgcgcaggcttagctccctggcagggctaccagtgaaggcagggaga

SEQ ID NO: 186597 - DNA, 399 bp, Homo sapiens
ctgggatacctgctattaccaagccaaccgaaggcctgactttccctctgccttcctacataaaaagaagagagtaaaggtttaatgtcttctaggtagaagttagatgaccacccaggccacacttcaccaagtttgctttttcatctgccgtcaaacactactatccacactcagctttgctcatttattccttcccttctccctcctgccctcctccagactgccacagagatagttcaaggtgacaatggctcctctgcagcagcacatagcagtcttgccagacacaacagcagatcaagtaactactgaagatgatggctacacttggacaggtgacattacattatcatcaacaaacatttatcaccctcttgagtactgtgactacaaaga

SEQ ID NO: 186598 - DNA, 425 bp, Homo sapiens
ctgtttgtgatggccccttccagatcatggagcagagttacgaagcatcctccgaatgggacgagtaagaacgttctgaagtcccaaccaattctcgcacatatctggtggcgtttctccacccccacacctcacactcacccagcgggtggtctcagtctcccctcttgactcatgcttatcaaagtattcggtcctttacattcaacaagcaacagcagctcaagattagcgagcctcactatgtgcaaaaggctttaatgtaccacagtaccccacttcagagttattctgagttaaacgagattccgcttgcagagcacctggcacgtagaaagcattctcagcagaagtctgttactgttaatgtttgtgctacttaattcgaaagaaacaagtaacctactcaaaaccctactgcacat

SEQ ID NO: 186599 - DNA, 581 bp, Homo sapiens
ccgaggcttcttaaggaccagatcaaactcttactgggcttttctcacctcgctccaactctaccttattttccactatgtcagtctagattcttattccagccttcctatctcaaacacaacaagcacaagtttcgtctcccttgaaatgtcctccttctcttaacctacacgtcctgttctccttacaaggttcaagtcacaactctgcacacacctgactgatgtcagcgcttgccagtttcatccttcctgaacgactctagcagttacagtgtgcaacccgactcaagtataccatcaaatactactaagaatcactactacaaatcactaccaagaatgatagttgtgtgatcttggatagatcatttaacctatatgggccaccatttcctcatctgtaaaagagtaagtctaacttaagaaattttaaaagatcttgccgggcgcggtggctcacgcctgtaatcccagcactttgggaggccgagacgggcggatcaccaggtcaggagatcgagaccatcctggctaacatggtgaaaccccgtctctactaaaaatacaaaaaattagcc

SEQ ID NO: 186600 - DNA, 174 bp, Homo sapiens
gagtgttggggctgcctggcttgaaacctgccctcctgtcttccttgggggccagctcaggtctgaggctcttggctttagtctctgatttgcatgtcatcatcagggacgttgttgcgtcccatcagggccaatggtggtccttgtgctgcaggccagagtgtcctgtgtgtg

SEQ ID NO: 186601 - DNA, 492 bp, Homo sapiens
tttctttttgagacagcgttccactcttatcgtccaggctgtagtgcaatggtgcgatctctgctcactgcaacctccatctcctgggttcaagtaattctcctgactcagcctcctgagtaggtgggattacagatgcctgccaccacgcccagctaattttttttttatttttagtagagacagggtttcaacatgtcggccaggctgatcttgaactcctgatgtcagttgatccacctgcctcgacctctgagcctgtttctacgtctgaataattttcaggagaggctgggcttcgggagccctagtctagtggtctgtgatcttctgagaaggtttttttcttggcccctcctttcctgattcctcatctttcttctctgttttgatcacacttttgctcccctgggaagagcccagggcttcaggctggaggttctgttctgaggagataaggtcagctgaatgacacttaaggcttgacatttt

SEQ ID NO: 186602 - DNA, 456 bp, Homo sapiens
gatcttagtgcaactcaagatgggaaccctaataatgacagagtccttgcaggttggagcaaagtaaattgaaagaaaaactaaaacatatgctgattgtttaaaaatagatacagagactaaaaataagagtccaagctggaaggtgtttccatgtaaaataacctctcttgaggtttcctttaacctgatcatagaggctgggggacagaaggaagtgagctcactcatgcagccttaactccagtgcccaagtccacagcgagggcccagcacttcacggtttccaagcactcccacctgggccagctcacgccatctcatggccaacctcagaggtgggcaatgatgaatccccattctccagatgaagaaaacaggggctgaagggagttaaacctggagatcttaaatctttgaattaccaagttcaaaaaaatccctttccccacccct

SEQ ID NO: 186603 - DNA, 167 bp, Homo sapiens
aaagggagagaatggagacacagggattttggtgatggctagtgtaaatcaagggaatttctgagaggtctgtctggctaccacactccaaaattctcctaggtccctgttttcctctgaatgactttgtaaagagactagagcccatataatgccccatcctgctt

SEQ ID NO: 186604 - DNA, 293 bp, Homo sapiens
ggtttgactcctgactttactactgaccattatatcatcccaggctagtttcttttttttttccttaatttttttaactaatacataataattgtacatgtttatggggtatgtgtaatatttggattacatgcataggatgtgtgatgatcaaatcagagtatttaggatatccatcacctcaaacttttctcatttcttggtgctgggaacatctcaaatcttatcttctagctactttaaaatataccataaaaaataaaatacacaataaactgttaagcatagtacca

SEQ ID NO: 186605 - DNA, 513 bp, Homo sapiens
ggctagtctcgaactcccaacctcaagtgatctgcttgcctcggtctcccaaagtgctgggattacaggcatgtgccaccacgcctggcccttaattctatttttatcctcagtagaatctgtccattgttagccagttagaaatgccacacttatcttgttggctagttgaatgttgttgttttgcaatattagtttatgcataactttaatatttaatgattatttctacttaagattattaaaatcctatttgttttaaacagtgactttttaaaaaaatacagccggccctccgtgtctgtggattacacattcttagattcaaccaactgcagatcgaaaatgtttgaaaaaaaaaaagcgtaataaaaaagaatacaaatataaaaccaatacagtgtaacaactatttgcacatttacatttgtgtattaggtattataagtaatgtagagactgcttaaaatatgtgggagaatgcatgtaaactagatgcaaataccacaccat

SEQ ID NO: 186606 - DNA, 376 bp, Homo sapiens
ccttctcgtgtttagatacacaaatattattctgttacaactgcccacagtacagtaacatgctgtacaggtttgtagtctgggagcaataagctataccatatagcctaggtgtgtagtaggctatactatttaggtttgtgtaagtacattcaatgatgtttgcacaatgaaatagcctaacgacacatttcttagaacatatttccatcattaagcaatgcatgactacctagaaggaagtctgaacaactcaacaaatgcagagctagtaaaattaagaacagaacatttaaatagagccacgcaaaacatacgtatgtaaaacttgcccttgtattgcacttcagggattttacaatttcagattttacca

SEQ ID NO: 186607 - DNA, 241 bp, Homo sapiens
tgtcttcttccgtaagttaagggctggtgatatccaaatacaataattatactgattatgcagtcataaatgttgtgtcttctcccatctgtccttgctcttaatagctctatctgtattagtctacagtgatccaggccacaaacacaccatgctcattctaatttatgggcatttctttgcttccgttattttccttgttgcaatatcctccccttcttctccaaacttcaagacccct

SEQ ID NO: 186608 - DNA, 138 bp, Homo sapiens
gctgcagcccactgccacctacaggccagaggagacagagttcccttctacaatgctatggctttcttgaaggaagagggaaacatatgaactcagtagttacctgtcatctgggagtgtcttgaaaaaactgaactg

SEQ ID NO: 186609 - DNA, 229 bp, Homo sapiens
accaggttttagaagaattagaatgataaaagccttttaaaataaatattgattctcaccagcagctttccttatcaatgaactctcaggagtttcaaaatatcagtgacatatttttgaaatgtttaatggattgaatactcaaaagccaaatctgtctactttccaaagtatcaccttcttcgaacaacagaagagtcagaatagcagagtgctgaagaatttaata

SEQ ID NO: 186610 - DNA, 213 bp, Homo sapiens
taaatgattaaaacaaaaggattctttcattttgttttgtttttgctttatgttcaagtgtaaacatgcaaaggattattttagaatccatatgtagagtgctcaaagggaaaatcttatttcagggagacaaaatagaaaggaatagcaaaatgtaggagtaaggtgtgaaggggctaaatcagatcagttgtaataagaatggaaagaaaa

SEQ ID NO: 186611 - DNA, 588 bp, Homo sapiens
cttacacctcagtagtactcaacttggtagggtcagcagccatgtgtttagctggaaggtgcactttataaacaggtgaactgttttgttctatgtgactgtgatctttgctactgtagtggctaccatctaggttacaaataaagcagagttgttgaggaagcctggggagattcttcccaaaattccatctgtgtgaagctgacatcttagatacagagaaggctctaaccaggtagaagtaggtgtgtttgttctcctttaatctcctcacagtctcagcttccttgattctttttcatattttttatttgccttttctaagtaatgaatttggtctcagacaaggtgcacagacctcactgaaataatgagccaacatgagcatgaggatcgtagtacacaggccttgttatgtactccaggtcaggtttcataacttcagtaggatcagcctgaaggcaaagtgaattcttattaagacctagtcctcttttaatttagtaaatgtttcttatcctagacttcccagtactactgaggtgtaagcgcttacacctcagtagtacaaaatcaatacaaagtact

SEQ ID NO: 186612 - DNA, 518 bp, Homo sapiens
tcctgtgttgggagatatcaaaacaacagaattcttgccagtgggaacatttttcttttttagacaaggtctcattctgtcaccccagctggagtgcagtggcacagtcttaattcactacagccttgaactcctgggctcaagaaatctttctgcttcagcctcctaaatagctggtactataggtgcgtgccaccacacccagctcatgggaataatttttacactccttcagaaggagtcatttgtgattggagtccacatagaaacaggtttccctctgtacataatcgtaggtaccaaaatattactgtgtaaagtgttgtttatataggtcaatttttgtggaagatctaatttctattttcagagaacagagcacattaaaaaatctatttagtattgtgtactatataatctatgtgaattatagctccttaactaaatatattactgagttttttttttaatactgtaagttctagggtacatgtgcacaatgtgcaggtttgttacat

SEQ ID NO: 186613 - DNA, 490 bp, Homo sapiens
gaaggcagccttttttctcctgacttctccaaccccaccaactccaaagaatatccacccatgagaatctaagacacaccactcggaggtacacagcacttgggatgcaaacatgtcacccccattccacagtgcagcacctaaactcccttactggaatcaccctccagtttccccttgctcttgccccaaacaccacggcccctgctctgctccttctccagatccagtgcttccaaagccccagtcctctgcctgcactaaccctcctccttcaagtccaaaacatcatctgtcctgtcttctgactcttcagacttgtggccttagcagttgttcaccacaacccacaacaagcagaaaggaagtcagaacccacctataggcatctgtgtactatggaagaagctggggaagaagagatggagcctgcctataggtatctgtgcactaggggaggagctcgggaggaggagatgaagcctgccta

SEQ ID NO: 186614 - DNA, 274 bp, Homo sapiens
acactattttgaatgtctcatacaatatttatgggtcttttttcccttgactcacctttatttaattatcacttttgtctaaagccagatgctgcttcctccagaaagactgccagaacttccccgctctccaaagtcacactgggtgccctagttttgcagtcttaagaattatactttgttttcttataatactattctggtgtttcatcatttgttttccagattctgcttgggatttgattccgttgtcatggcctaccctggcattttt

SEQ ID NO: 186615 - DNA, 220 bp, Homo sapiens
ttcacaaattagcatttttagtttttattctccactgtgaggcaggctttggccataatcattttttctattctagacccaccctgtaagcagccgacccaggcccactccacaggcagcctggtatttcccagacattttgcccatgttcacttgggtgctgggctcctagccctgcacgatttcagtgaggttctccacttcccaccatctgtgaagg
